United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 84

SEQ ID NO: 3845635 - RNA, 20 nt, Human
ucaagagccuuaaaacauca

SEQ ID NO: 3845636 - RNA, 22 nt, Human
ucaagaggaaugaaaaaagcuu

SEQ ID NO: 3845637 - RNA, 12 nt, Human
ucaagaggcuga

SEQ ID NO: 3845638 - RNA, 18 nt, Human
ucaagaggcugagacagg

SEQ ID NO: 3845639 - RNA, 20 nt, Human
ucaagagggcacugguggcc

SEQ ID NO: 3845640 - RNA, 17 nt, Human
ucaagagggucugagga

SEQ ID NO: 3845641 - RNA, 19 nt, Human
ucaagaggugggagggccc

SEQ ID NO: 3845642 - RNA, 21 nt, Human
ucaagagguucucgacuggag

SEQ ID NO: 3845643 - RNA, 20 nt, Human
ucaagagugaauucccucac

SEQ ID NO: 3845644 - RNA, 18 nt, Human
ucaagagugguaucuugc

SEQ ID NO: 3845645 - RNA, 21 nt, Human
ucaagauacugcuacuguaau

SEQ ID NO: 3845646 - RNA, 16 nt, Human
ucaagaucaaugaaau

SEQ ID NO: 3845647 - RNA, 22 nt, Human
ucaagaugaugaugaucuuuaa

SEQ ID NO: 3845648 - RNA, 19 nt, Human
ucaagaugggggcagggcu

SEQ ID NO: 3845649 - RNA, 20 nt, Human
ucaagaugggggcagggcug

SEQ ID NO: 3845650 - RNA, 21 nt, Human
ucaagaugggggcagggcugu

SEQ ID NO: 3845651 - RNA, 17 nt, Human
ucaagaugucagacugg

SEQ ID NO: 3845652 - RNA, 18 nt, Human
ucaagaugucagacuggc

SEQ ID NO: 3845653 - RNA, 14 nt, Human
ucaagauucagcua

SEQ ID NO: 3845654 - RNA, 19 nt, Human
ucaagauucccaggaguuc

SEQ ID NO: 3845655 - RNA, 16 nt, Human
ucaagauuuugaaugc

SEQ ID NO: 3845656 - RNA, 14 nt, Human
ucaagcaauccucc

SEQ ID NO: 3845657 - RNA, 23 nt, Human
ucaagcagcgaccgcccccuccu

SEQ ID NO: 3845658 - RNA, 14 nt, Human
ucaagcaugaagau

SEQ ID NO: 3845659 - RNA, 16 nt, Human
ucaagcaugaagauaa

SEQ ID NO: 3845660 - RNA, 17 nt, Human
ucaagccaauccccucc

SEQ ID NO: 3845661 - RNA, 18 nt, Human
ucaagccaauccccuccu

SEQ ID NO: 3845662 - RNA, 20 nt, Human
ucaagccaauccccuccuug

SEQ ID NO: 3845663 - RNA, 12 nt, Human
ucaagccaccaa

SEQ ID NO: 3845664 - RNA, 14 nt, Human
ucaagcccaggagg

SEQ ID NO: 3845665 - RNA, 19 nt, Human
ucaagcccaggaggacugc

SEQ ID NO: 3845666 - RNA, 17 nt, Human
ucaagccgcaucccaga

SEQ ID NO: 3845667 - RNA, 14 nt, Human
ucaagccucugguc

SEQ ID NO: 3845668 - RNA, 13 nt, Human
ucaagcuaauaaa

SEQ ID NO: 3845669 - RNA, 20 nt, Human
ucaagcuaauaaaauaucau

SEQ ID NO: 3845670 - RNA, 23 nt, Human
ucaagcuaauaaaauaucauuca

SEQ ID NO: 3845671 - RNA, 18 nt, Human
ucaagcuagaaggccaca

SEQ ID NO: 3845672 - RNA, 19 nt, Human
ucaagcuagaaggccacau

SEQ ID NO: 3845673 - RNA, 18 nt, Human
ucaagcuccaucuuauuu

SEQ ID NO: 3845674 - RNA, 12 nt, Human
ucaagcucugag

SEQ ID NO: 3845675 - RNA, 21 nt, Human
ucaagcucugagggaaagggc

SEQ ID NO: 3845676 - RNA, 20 nt, Human
ucaagcugaguauuaaaaug

SEQ ID NO: 3845677 - RNA, 14 nt, Human
ucaagcugcuugga

SEQ ID NO: 3845678 - RNA, 21 nt, Human
ucaaggaaagggggucccagu

SEQ ID NO: 3845679 - RNA, 18 nt, Human
ucaaggaauaaugggcuu

SEQ ID NO: 3845680 - RNA, 18 nt, Human
ucaaggacaaagucucca

SEQ ID NO: 3845681 - RNA, 19 nt, Human
ucaaggacaaagucuccag

SEQ ID NO: 3845682 - RNA, 20 nt, Human
ucaaggacaaagucuccagc

SEQ ID NO: 3845683 - RNA, 22 nt, Human
ucaaggacaaagucuccagccc

SEQ ID NO: 3845684 - RNA, 23 nt, Human
ucaaggacaaagucuccagccca

SEQ ID NO: 3845685 - RNA, 22 nt, Human
ucaaggaccaacaagggcagug

SEQ ID NO: 3845686 - RNA, 22 nt, Human
ucaaggacucugguuucucauu

SEQ ID NO: 3845687 - RNA, 20 nt, Human
ucaaggacuuucugaagccu

SEQ ID NO: 3845688 - RNA, 13 nt, Human
ucaaggauccuga

SEQ ID NO: 3845689 - RNA, 17 nt, Human
ucaaggauccugagcca

SEQ ID NO: 3845690 - RNA, 19 nt, Human
ucaaggauccugagccaga

SEQ ID NO: 3845691 - RNA, 23 nt, Human
ucaaggauccugagccagauuuc

SEQ ID NO: 3845692 - RNA, 17 nt, Human
ucaaggcacucuagauu

SEQ ID NO: 3845693 - RNA, 22 nt, Human
ucaaggccagcaagguggagug

SEQ ID NO: 3845694 - RNA, 17 nt, Human
ucaaggccucccacagu

SEQ ID NO: 3845695 - RNA, 18 nt, Human
ucaaggccugucccuggc

SEQ ID NO: 3845696 - RNA, 18 nt, Human
ucaaggcugcuuagaauc

SEQ ID NO: 3845697 - RNA, 14 nt, Human
ucaaggcuuagacc

SEQ ID NO: 3845698 - RNA, 17 nt, Human
ucaaggcuuauauucaa

SEQ ID NO: 3845699 - RNA, 14 nt, Human
ucaaggcuuccacu

SEQ ID NO: 3845700 - RNA, 20 nt, Human
ucaagggaauguaacugcug

SEQ ID NO: 3845701 - RNA, 21 nt, Human
ucaagggaauguaacugcuga

SEQ ID NO: 3845702 - RNA, 17 nt, Human
ucaagggcuuacuauuu

SEQ ID NO: 3845703 - RNA, 19 nt, Human
ucaagggcuuuccugugcc

SEQ ID NO: 3845704 - RNA, 16 nt, Human
ucaagggugcgucugg

SEQ ID NO: 3845705 - RNA, 16 nt, Human
ucaagguaaaauucua

SEQ ID NO: 3845706 - RNA, 17 nt, Human
ucaagguaaaauucuaa

SEQ ID NO: 3845707 - RNA, 15 nt, Human
ucaaggucguuuuuu

SEQ ID NO: 3845708 - RNA, 18 nt, Human
ucaagguuuuagguucua

SEQ ID NO: 3845709 - RNA, 20 nt, Human
ucaagguuuuagguucuaaa

SEQ ID NO: 3845710 - RNA, 22 nt, Human
ucaagguuuuagguucuaaagu

SEQ ID NO: 3845711 - RNA, 23 nt, Human
ucaagguuuuagguucuaaaguu

SEQ ID NO: 3845712 - RNA, 16 nt, Human
ucaaguaagaagacau

SEQ ID NO: 3845713 - RNA, 18 nt, Human
ucaaguaagaagacauga

SEQ ID NO: 3845714 - RNA, 12 nt, Human
ucaaguauuacu

SEQ ID NO: 3845715 - RNA, 15 nt, Human
ucaaguauuauaaac

SEQ ID NO: 3845716 - RNA, 16 nt, Human
ucaaguauuauaaaca

SEQ ID NO: 3845717 - RNA, 21 nt, Human
gcguguggcucacguguguga

SEQ ID NO: 3845718 - RNA, 15 nt, Human
gcguguguagaguua

SEQ ID NO: 3845719 - RNA, 22 nt, Human
gcguguguagaguuaagaagcu

SEQ ID NO: 3845720 - RNA, 16 nt, Human
gcguguguggguggau

SEQ ID NO: 3845721 - RNA, 23 nt, Human
gcguguguggguggauauaaaua

SEQ ID NO: 3845722 - RNA, 23 nt, Human
gcguguucauaucuacucuuuac

SEQ ID NO: 3845723 - RNA, 18 nt, Human
gcguuagaaugaggagga

SEQ ID NO: 3845724 - RNA, 18 nt, Human
gcguuauaguaacuccca

SEQ ID NO: 3845725 - RNA, 19 nt, Human
gcguuauaguaacucccau

SEQ ID NO: 3845726 - RNA, 22 nt, Human
gcguuauuggucggcagccuuc

SEQ ID NO: 3845727 - RNA, 22 nt, Human
gcguucauggaacgcguugaaa

SEQ ID NO: 3845728 - RNA, 17 nt, Human
gcguuccaugaugcugg

SEQ ID NO: 3845729 - RNA, 13 nt, Human
gcguuccuuucuu

SEQ ID NO: 3845730 - RNA, 15 nt, Human
gcguuccuuucuuuu

SEQ ID NO: 3845731 - RNA, 22 nt, Human
gcguucuuguaauuuuacacgc

SEQ ID NO: 3845732 - RNA, 23 nt, Human
gcguugaaauuguaauuauaucu

SEQ ID NO: 3845733 - RNA, 24 nt, Human
gcguugaaauuguaauuauaucug

SEQ ID NO: 3845734 - RNA, 14 nt, Human
gcguugcuuucacu

SEQ ID NO: 3845735 - RNA, 14 nt, Human
gcguuggaauuaaa

SEQ ID NO: 3845736 - RNA, 15 nt, Human
gcguuggucucugca

SEQ ID NO: 3845737 - RNA, 14 nt, Human
gcguuguaaaauau

SEQ ID NO: 3845738 - RNA, 15 nt, Human
gcguuguaaaauaua

SEQ ID NO: 3845739 - RNA, 16 nt, Human
gcguuuagaccaagga

SEQ ID NO: 3845740 - RNA, 18 nt, Human
gcguuucuaugacacaug

SEQ ID NO: 3845741 - RNA, 22 nt, Human
gcguuugaccuuuuauguagua

SEQ ID NO: 3845742 - RNA, 13 nt, Human
gcuaaaaagcaac

SEQ ID NO: 3845743 - RNA, 18 nt, Human
gcuaaaaaugagcuugau

SEQ ID NO: 3845744 - RNA, 14 nt, Human
gcuaaaaaugggac

SEQ ID NO: 3845745 - RNA, 17 nt, Human
gcuaaaauaaagaaaua

SEQ ID NO: 3845746 - RNA, 12 nt, Human
gcuaaaauguuu

SEQ ID NO: 3845747 - RNA, 19 nt, Human
ucaguacccucucagcucc

SEQ ID NO: 3845748 - RNA, 13 nt, Human
ucaguaccuggag

SEQ ID NO: 3845749 - RNA, 14 nt, Human
ucaguaccuggagg

SEQ ID NO: 3845750 - RNA, 16 nt, Human
ucaguacuucagcaag

SEQ ID NO: 3845751 - RNA, 19 nt, Human
ucaguacuucagcaagaga

SEQ ID NO: 3845752 - RNA, 23 nt, Human
ucaguacuugugaaacacagcug

SEQ ID NO: 3845753 - RNA, 24 nt, Human
ucaguacuugugaaacacagcugu

SEQ ID NO: 3845754 - RNA, 19 nt, Human
ucaguaguuugcauuucag

SEQ ID NO: 3845755 - RNA, 20 nt, Human
ucaguaguuugcauuucaga

SEQ ID NO: 3845756 - RNA, 21 nt, Human
ucaguaguuugcauuucagaa

SEQ ID NO: 3845757 - RNA, 15 nt, Human
ucaguauaaacaaag

SEQ ID NO: 3845758 - RNA, 17 nt, Human
ucaguauaaacaaaguu

SEQ ID NO: 3845759 - RNA, 13 nt, Human
ucaguaucaggcc

SEQ ID NO: 3845760 - RNA, 16 nt, Human
ucaguauguauucuuu

SEQ ID NO: 3845761 - RNA, 18 nt, Human
ucaguauguuuuacacug

SEQ ID NO: 3845762 - RNA, 21 nt, Human
ucaguauuaauacuaaaauau

SEQ ID NO: 3845763 - RNA, 14 nt, Human
ucaguauugaagca

SEQ ID NO: 3845764 - RNA, 18 nt, Human
ucaguauugaagcauuuu

SEQ ID NO: 3845765 - RNA, 24 nt, Human
ucaguauuguuuugguuugcuacu

SEQ ID NO: 3845766 - RNA, 20 nt, Human
ucaguauuuaacuaauuaua

SEQ ID NO: 3845767 - RNA, 16 nt, Human
ucaguauuuucccugc

SEQ ID NO: 3845768 - RNA, 18 nt, Human
ucaguauuuucccugcua

SEQ ID NO: 3845769 - RNA, 22 nt, Human
ucaguauuuuggagaaauuauu

SEQ ID NO: 3845770 - RNA, 14 nt, Human
ucagucaaaacuuu

SEQ ID NO: 3845771 - RNA, 23 nt, Human
ucagucagaaaacuuuaaaaaau

SEQ ID NO: 3845772 - RNA, 15 nt, Human
ucagucaugcauaaa

SEQ ID NO: 3845773 - RNA, 13 nt, Human
ucagucauuaaau

SEQ ID NO: 3845774 - RNA, 12 nt, Human
ucaguccaggau

SEQ ID NO: 3845775 - RNA, 14 nt, Human
ucaguccauuuaua

SEQ ID NO: 3845776 - RNA, 23 nt, Human
ucaguccauuuauauaugaaaac

SEQ ID NO: 3845777 - RNA, 13 nt, Human
ucagucccuaugu

SEQ ID NO: 3845778 - RNA, 16 nt, Human
ucagucccuauguauu

SEQ ID NO: 3845779 - RNA, 16 nt, Human
ucaguccugcuccaga

SEQ ID NO: 3845780 - RNA, 18 nt, Human
ucaguccuguaguuuuau

SEQ ID NO: 3845781 - RNA, 15 nt, Human
ucagucuauccacag

SEQ ID NO: 3845782 - RNA, 18 nt, Human
ucagucuauccacagaga

SEQ ID NO: 3845783 - RNA, 18 nt, Human
ucagucucagaaugucau

SEQ ID NO: 3845784 - RNA, 19 nt, Human
ucagucucccuucucccau

SEQ ID NO: 3845785 - RNA, 23 nt, Human
ucagucucccuuucccuucuugg

SEQ ID NO: 3845786 - RNA, 21 nt, Human
ucagucucuauaccaauaaag

SEQ ID NO: 3845787 - RNA, 19 nt, Human
ucagucugcuuagaaauaa

SEQ ID NO: 3845788 - RNA, 13 nt, Human
ucagucugguggg

SEQ ID NO: 3845789 - RNA, 19 nt, Human
ucagucuggugggaggacg

SEQ ID NO: 3845790 - RNA, 20 nt, Human
ucagucuucucucacuuuga

SEQ ID NO: 3845791 - RNA, 22 nt, Human
ucagucuuuaaucugagaggcc

SEQ ID NO: 3845792 - RNA, 17 nt, Human
ucagugaaguugcugcu

SEQ ID NO: 3845793 - RNA, 11 nt, Human
ucagugacaga

SEQ ID NO: 3845794 - RNA, 16 nt, Human
ucagugagccaagauc

SEQ ID NO: 3845795 - RNA, 17 nt, Human
ucagugaggcccaggga

SEQ ID NO: 3845796 - RNA, 15 nt, Human
ucagugaugugccua

SEQ ID NO: 3845797 - RNA, 17 nt, Human
ucagugcaaccucugcu

SEQ ID NO: 3845798 - RNA, 23 nt, Human
ucagugcagcccguguggccccu

SEQ ID NO: 3845799 - RNA, 21 nt, Human
ucagugccaacuguggcuggu

SEQ ID NO: 3845800 - RNA, 14 nt, Human
ucagugccgccgcc

SEQ ID NO: 3845801 - RNA, 23 nt, Human
ucagugccgccgccucgcccacc

SEQ ID NO: 3845802 - RNA, 9 nt, Human
ucagugccu

SEQ ID NO: 3845803 - RNA, 16 nt, Human
ucagugccuuauggaa

SEQ ID NO: 3845804 - RNA, 19 nt, Human
ucagugcugccugucccca

SEQ ID NO: 3845805 - RNA, 19 nt, Human
ucagugcuguggccugggc

SEQ ID NO: 3845806 - RNA, 16 nt, Human
ucaguggaagaagcag

SEQ ID NO: 3845807 - RNA, 12 nt, Human
ucaguggcagcu

SEQ ID NO: 3845808 - RNA, 20 nt, Human
ucaguggcuucaucugucaa

SEQ ID NO: 3845809 - RNA, 15 nt, Human
ucagugggaacguga

SEQ ID NO: 3845810 - RNA, 17 nt, Human
ucaguggguuaacauca

SEQ ID NO: 3845811 - RNA, 20 nt, Human
ucaguggguuaacaucaguu

SEQ ID NO: 3845812 - RNA, 23 nt, Human
ucagugguuggcaauuguuucaa

SEQ ID NO: 3845813 - RNA, 18 nt, Human
ucaguguaccauuugccu

SEQ ID NO: 3845814 - RNA, 17 nt, Human
ucaguguacccccgccc

SEQ ID NO: 3845815 - RNA, 21 nt, Human
ucaguguacccccgcccaggc

SEQ ID NO: 3845816 - RNA, 15 nt, Human
ucaguguagccccaa

SEQ ID NO: 3845817 - RNA, 14 nt, Human
ucaguguaguuaau

SEQ ID NO: 3845818 - RNA, 15 nt, Human
ucaguguauuucagu

SEQ ID NO: 3845819 - RNA, 14 nt, Human
ucagugucucacac

SEQ ID NO: 3845820 - RNA, 22 nt, Human
ucagugugccccccauccuggc

SEQ ID NO: 3845821 - RNA, 15 nt, Human
ucaguguuaaaaaau

SEQ ID NO: 3845822 - RNA, 17 nt, Human
ucaguguuaccugugug

SEQ ID NO: 3845823 - RNA, 18 nt, Human
ucaguguuaccugugugc

SEQ ID NO: 3845824 - RNA, 14 nt, Human
ucaguguuauuagu

SEQ ID NO: 3845825 - RNA, 18 nt, Human
ucaguguuguugcucuag

SEQ ID NO: 3845826 - RNA, 18 nt, Human
ucaguguuuaugugcuau

SEQ ID NO: 3845827 - RNA, 20 nt, Human
ucaguguuuuggacuccauc

SEQ ID NO: 3845828 - RNA, 23 nt, Human
ucaguguuuuggacuccaucucu

SEQ ID NO: 3845829 - RNA, 14 nt, Human
ucaguguuuuuccu

SEQ ID NO: 3845830 - RNA, 20 nt, Human
ucaguuaacuauugcauuua

SEQ ID NO: 3845831 - RNA, 16 nt, Human
ucaguuaagaaaaaaa

SEQ ID NO: 3845832 - RNA, 13 nt, Human
ucaguuaagaaau

SEQ ID NO: 3845833 - RNA, 16 nt, Human
ucaguuaagccuuugg

SEQ ID NO: 3845834 - RNA, 14 nt, Human
ucaguuacagaaag

SEQ ID NO: 3845835 - RNA, 15 nt, Human
ucaguuacucagccc

SEQ ID NO: 3845836 - RNA, 19 nt, Human
ucaguuacucagcccuggg

SEQ ID NO: 3845837 - RNA, 22 nt, Human
ucaguuagagcugacacaaacc

SEQ ID NO: 3845838 - RNA, 13 nt, Human
ucaguuauucauu

SEQ ID NO: 3845839 - RNA, 17 nt, Human
ucaguuauugguggaau

SEQ ID NO: 3845840 - RNA, 21 nt, Human
ucaguucaaagucaugauguu

SEQ ID NO: 3845841 - RNA, 22 nt, Human
ucaguucaaagucaugauguuu

SEQ ID NO: 3845842 - RNA, 19 nt, Human
ucaguucauugugguccuu

SEQ ID NO: 3845843 - RNA, 17 nt, Human
ucaguucccagaaucaa

SEQ ID NO: 3845844 - RNA, 20 nt, Human
ucaguucccuuggccucaga

SEQ ID NO: 3845845 - RNA, 22 nt, Human
ucaguucccuuggccucagaau

SEQ ID NO: 3845846 - RNA, 19 nt, Human
ucaguuccgucagaaagug

SEQ ID NO: 3845847 - RNA, 17 nt, Human
ucaguuccucuuugcau

SEQ ID NO: 3845848 - RNA, 21 nt, Human
ucaguuccucuuugcauggaa

SEQ ID NO: 3845849 - RNA, 20 nt, Human
ucaguuccugcagcagagcc

SEQ ID NO: 3845850 - RNA, 16 nt, Human
ucaguuccuuugugug

SEQ ID NO: 3845851 - RNA, 20 nt, Human
ucaguuccuuuguguguacu

SEQ ID NO: 3845852 - RNA, 22 nt, Human
ucaguuccuuuguguguacuca

SEQ ID NO: 3845853 - RNA, 13 nt, Human
ucaguucuaggaa

SEQ ID NO: 3845854 - RNA, 15 nt, Human
ucaguucuaggaaaa

SEQ ID NO: 3845855 - RNA, 18 nt, Human
ucaguugauuuucuggau

SEQ ID NO: 3845856 - RNA, 16 nt, Human
ucaguugcaauaauac

SEQ ID NO: 3845857 - RNA, 17 nt, Human
ucaguugcuaaacacug

SEQ ID NO: 3845858 - RNA, 14 nt, Human
ucaguuggcugacu

SEQ ID NO: 3845859 - RNA, 18 nt, Human
ucaguuguagaauguauu

SEQ ID NO: 3845860 - RNA, 21 nt, Human
ucaguuguagaauguauugua

SEQ ID NO: 3845861 - RNA, 13 nt, Human
ucaguugucucug

SEQ ID NO: 3845862 - RNA, 13 nt, Human
ucaguuguguuuu

SEQ ID NO: 3845863 - RNA, 14 nt, Human
ucaguuguguuuuu

SEQ ID NO: 3845864 - RNA, 17 nt, Human
ucaguuguuaguguguc

SEQ ID NO: 3845865 - RNA, 12 nt, Human
ucaguuguuuuc

SEQ ID NO: 3845866 - RNA, 19 nt, Human
ucaguuuaauccuucuagu

SEQ ID NO: 3845867 - RNA, 14 nt, Human
ucaguuuauguuuu

SEQ ID NO: 3845868 - RNA, 16 nt, Human
ucaguuuauguuuugg

SEQ ID NO: 3845869 - RNA, 20 nt, Human
ucaguuuccaauuauuugac

SEQ ID NO: 3845870 - RNA, 20 nt, Human
ucaguuuccuggucuguaga

SEQ ID NO: 3845871 - RNA, 18 nt, Human
ucaguuuguccuguagag

SEQ ID NO: 3845872 - RNA, 19 nt, Human
ucaguuuguuggaaaguaa

SEQ ID NO: 3845873 - RNA, 14 nt, Human
ucaguuuuaucuuu

SEQ ID NO: 3845874 - RNA, 18 nt, Human
ucaguuuuuuguuuuaca

SEQ ID NO: 3845875 - RNA, 22 nt, Human
ucaguuuuuuuuuauacacugu

SEQ ID NO: 3845876 - RNA, 16 nt, Human
ucauaaaccuuaagua

SEQ ID NO: 3845877 - RNA, 13 nt, Human
ucauaaacugugu

SEQ ID NO: 3845878 - RNA, 14 nt, Human
ucauaaacugugug

SEQ ID NO: 3845879 - RNA, 11 nt, Human
ucauaaaugaa

SEQ ID NO: 3845880 - RNA, 22 nt, Human
ucauaaauuauuugauuauuua

SEQ ID NO: 3845881 - RNA, 18 nt, Human
gcuaccuguguggacagg

SEQ ID NO: 3845882 - RNA, 23 nt, Human
gcuaccuugccccaacccuucuu

SEQ ID NO: 3845883 - RNA, 21 nt, Human
gcuaccuugugacccagcacu

SEQ ID NO: 3845884 - RNA, 17 nt, Human
gcuaccuuucaaagcuu

SEQ ID NO: 3845885 - RNA, 20 nt, Human
gcuaccuuuguauucucucc

SEQ ID NO: 3845886 - RNA, 21 nt, Human
gcuacuaaguucacauuagaa

SEQ ID NO: 3845887 - RNA, 18 nt, Human
gcuacuaaugauguuuuc

SEQ ID NO: 3845888 - RNA, 17 nt, Human
gcuacucacucaaguuc

SEQ ID NO: 3845889 - RNA, 22 nt, Human
gcuacucacucaaguucaagga

SEQ ID NO: 3845890 - RNA, 14 nt, Human
gcuacucagaagcc

SEQ ID NO: 3845891 - RNA, 23 nt, Human
ucauugccuuaacuggagcccca

SEQ ID NO: 3845892 - RNA, 23 nt, Human
ucauugcugaaaaugguauuuuc

SEQ ID NO: 3845893 - RNA, 15 nt, Human
ucauugcugagccuc

SEQ ID NO: 3845894 - RNA, 21 nt, Human
ucauugcugucugcagccuug

SEQ ID NO: 3845895 - RNA, 12 nt, Human
ucauugcuucuu

SEQ ID NO: 3845896 - RNA, 11 nt, Human
ucauugcuuua

SEQ ID NO: 3845897 - RNA, 23 nt, Human
ucauugcuuugaagcaguugugu

SEQ ID NO: 3845898 - RNA, 21 nt, Human
ucauuggauucugagagcugu

SEQ ID NO: 3845899 - RNA, 14 nt, Human
ucauuggcuuuauc

SEQ ID NO: 3845900 - RNA, 17 nt, Human
ucauuggucuaauuuau

SEQ ID NO: 3845901 - RNA, 13 nt, Human
ucauuguaauguu

SEQ ID NO: 3845902 - RNA, 19 nt, Human
ucauuguaauguugugaau

SEQ ID NO: 3845903 - RNA, 14 nt, Human
ucauuguacaguuu

SEQ ID NO: 3845904 - RNA, 17 nt, Human
ucauuguacaguuuguu

SEQ ID NO: 3845905 - RNA, 21 nt, Human
ucauuguacuaccuguguaua

SEQ ID NO: 3845906 - RNA, 14 nt, Human
ucauuguagaaaag

SEQ ID NO: 3845907 - RNA, 14 nt, Human
ucauuguauaaaaa

SEQ ID NO: 3845908 - RNA, 16 nt, Human
ucauuguauaaaaaua

SEQ ID NO: 3845909 - RNA, 22 nt, Human
ucauuguauauauguguguuua

SEQ ID NO: 3845910 - RNA, 15 nt, Human
ucauuguaugaugug

SEQ ID NO: 3845911 - RNA, 14 nt, Human
ucauuguauguggu

SEQ ID NO: 3845912 - RNA, 15 nt, Human
ucauuguauguuauu

SEQ ID NO: 3845913 - RNA, 15 nt, Human
ucauugugaaauuau

SEQ ID NO: 3845914 - RNA, 23 nt, Human
ucauuguuuauuaacaaauuaug

SEQ ID NO: 3845915 - RNA, 13 nt, Human
ucauuguuuugaa

SEQ ID NO: 3845916 - RNA, 14 nt, Human
ucauuuaaaaugau

SEQ ID NO: 3845917 - RNA, 17 nt, Human
ucauuuaaaaugauuag

SEQ ID NO: 3845918 - RNA, 16 nt, Human
ucauuuaagggaaaaa

SEQ ID NO: 3845919 - RNA, 11 nt, Human
ucauuuaauaa

SEQ ID NO: 3845920 - RNA, 21 nt, Human
ucauuuacaagacaacauugu

SEQ ID NO: 3845921 - RNA, 15 nt, Human
ucauuuacuaaacau

SEQ ID NO: 3845922 - RNA, 13 nt, Human
ucauuuacugugg

SEQ ID NO: 3845923 - RNA, 17 nt, Human
ucauuuagcauguuguu

SEQ ID NO: 3845924 - RNA, 16 nt, Human
ucauuuagccuguccu

SEQ ID NO: 3845925 - RNA, 17 nt, Human
ucauuuagugaguuauu

SEQ ID NO: 3845926 - RNA, 21 nt, Human
ucauuuauaaaaccaucaaaa

SEQ ID NO: 3845927 - RNA, 19 nt, Human
ucauuuauaucgcuggcca

SEQ ID NO: 3845928 - RNA, 15 nt, Human
ucauuuaugaaaaga

SEQ ID NO: 3845929 - RNA, 18 nt, Human
ucauuuauuguuuaugua

SEQ ID NO: 3845930 - RNA, 13 nt, Human
ucauuuauuuuuu

SEQ ID NO: 3845931 - RNA, 19 nt, Human
ucauuucaaauacaucuuu

SEQ ID NO: 3845932 - RNA, 15 nt, Human
ucauuucaccccucc

SEQ ID NO: 3845933 - RNA, 23 nt, Human
gcucagguacagagaaggaaugu

SEQ ID NO: 3845934 - RNA, 16 nt, Human
gcucagguacuuguaa

SEQ ID NO: 3845935 - RNA, 17 nt, Human
gcucaggugcuggggcc

SEQ ID NO: 3845936 - RNA, 23 nt, Human
gcucagguggggucacucuggca

SEQ ID NO: 3845937 - RNA, 22 nt, Human
gcucaguaaacgggaacaugcc

SEQ ID NO: 3845938 - RNA, 23 nt, Human
gcucagucccaucagagagcgag

SEQ ID NO: 3845939 - RNA, 19 nt, Human
gcucagugaaguugcugcu

SEQ ID NO: 3845940 - RNA, 19 nt, Human
gcucagugcaaccucugcu

SEQ ID NO: 3845941 - RNA, 20 nt, Human
gcucagugcaaccucugcuu

SEQ ID NO: 3845942 - RNA, 19 nt, Human
gcucaguugcuaaacacug

SEQ ID NO: 3845943 - RNA, 19 nt, Human
gcucauauggggcugggag

SEQ ID NO: 3845944 - RNA, 16 nt, Human
gcucauauuccugcag

SEQ ID NO: 3845945 - RNA, 22 nt, Human
gcucauauuccugcagccugga

SEQ ID NO: 3845946 - RNA, 14 nt, Human
gcucauauuuugua

SEQ ID NO: 3845947 - RNA, 18 nt, Human
gcucauauuuuguauaua

SEQ ID NO: 3845948 - RNA, 22 nt, Human
gcucaucucugucccacuuggc

SEQ ID NO: 3845949 - RNA, 18 nt, Human
gcucaugcauagucccag

SEQ ID NO: 3845950 - RNA, 20 nt, Human
gcucaugggccccucugacu

SEQ ID NO: 3845951 - RNA, 21 nt, Human
gcucaugggccccucugacuc

SEQ ID NO: 3845952 - RNA, 15 nt, Human
gcucauguagcaauc

SEQ ID NO: 3845953 - RNA, 16 nt, Human
gcucauuaugccacuu

SEQ ID NO: 3845954 - RNA, 22 nt, Human
gcucauucauuuuauauugaaa

SEQ ID NO: 3845955 - RNA, 15 nt, Human
gcucauuuuuucuua

SEQ ID NO: 3845956 - RNA, 21 nt, Human
gcuccaaaccuucacacacag

SEQ ID NO: 3845957 - RNA, 17 nt, Human
gcuccaaagucauaauu

SEQ ID NO: 3845958 - RNA, 18 nt, Human
gcuccaaccugcaaagau

SEQ ID NO: 3845959 - RNA, 13 nt, Human
gcuccaacuccaa

SEQ ID NO: 3845960 - RNA, 14 nt, Human
gcuccaagaauuuc

SEQ ID NO: 3845961 - RNA, 16 nt, Human
gcuccaagaccuguug

SEQ ID NO: 3845962 - RNA, 18 nt, Human
gcuccaagaccuguuggu

SEQ ID NO: 3845963 - RNA, 18 nt, Human
gcuccaagauucuagaug

SEQ ID NO: 3845964 - RNA, 19 nt, Human
gcuccaagcucccaggcau

SEQ ID NO: 3845965 - RNA, 20 nt, Human
gcuccaaggggaaucagaac

SEQ ID NO: 3845966 - RNA, 16 nt, Human
gcuccacacccucucc

SEQ ID NO: 3845967 - RNA, 19 nt, Human
gcuccacacccucucccag

SEQ ID NO: 3845968 - RNA, 21 nt, Human
gcuccacacccucucccagga

SEQ ID NO: 3845969 - RNA, 16 nt, Human
gcuccacagccauccc

SEQ ID NO: 3845970 - RNA, 12 nt, Human
gcuccacagugu

SEQ ID NO: 3845971 - RNA, 23 nt, Human
gcuccaccagcaucaccugccug

SEQ ID NO: 3845972 - RNA, 20 nt, Human
gcuccaccccacucacagag

SEQ ID NO: 3845973 - RNA, 16 nt, Human
gcuccacccuuggccu

SEQ ID NO: 3845974 - RNA, 22 nt, Human
gcuccacccuuggccugucuca

SEQ ID NO: 3845975 - RNA, 13 nt, Human
gcuccacucugcu

SEQ ID NO: 3845976 - RNA, 19 nt, Human
gcuccacucugcuucucug

SEQ ID NO: 3845977 - RNA, 20 nt, Human
gcuccagaaaugucuaaaug

SEQ ID NO: 3845978 - RNA, 21 nt, Human
gcuccagacacauguccaaga

SEQ ID NO: 3845979 - RNA, 20 nt, Human
gcuccagaccugauccugga

SEQ ID NO: 3845980 - RNA, 23 nt, Human
gcuccagaccugauccuggaggc

SEQ ID NO: 3845981 - RNA, 23 nt, Human
gcuccagccaaccccuguggagc

SEQ ID NO: 3845982 - RNA, 17 nt, Human
gcuccagccugacauca

SEQ ID NO: 3845983 - RNA, 15 nt, Human
gcuccagccuggcuc

SEQ ID NO: 3845984 - RNA, 14 nt, Human
gcuccagcucacca

SEQ ID NO: 3845985 - RNA, 20 nt, Human
gcuccagcucaccagcccca

SEQ ID NO: 3845986 - RNA, 20 nt, Human
gcuccagcugcucugucuuc

SEQ ID NO: 3845987 - RNA, 23 nt, Human
gcuccagcuggccgggagccuga

SEQ ID NO: 3845988 - RNA, 20 nt, Human
gcuccagcuguucagcuggu

SEQ ID NO: 3845989 - RNA, 21 nt, Human
gcuccagcuguucagcugguu

SEQ ID NO: 3845990 - RNA, 21 nt, Human
gcuccagcuuucugccaucua

SEQ ID NO: 3845991 - RNA, 12 nt, Human
gcuccaggagca

SEQ ID NO: 3845992 - RNA, 14 nt, Human
gcuccaggagcagc

SEQ ID NO: 3845993 - RNA, 17 nt, Human
gcuccaggagcagccac

SEQ ID NO: 3845994 - RNA, 22 nt, Human
gcuccaggcagcacccagguuu

SEQ ID NO: 3845995 - RNA, 13 nt, Human
gcuccaggcaggc

SEQ ID NO: 3845996 - RNA, 21 nt, Human
gcuccaggcaggcuaaggcgu

SEQ ID NO: 3845997 - RNA, 17 nt, Human
gcuccaggccagggggc

SEQ ID NO: 3845998 - RNA, 16 nt, Human
gcuccaggccugcagc

SEQ ID NO: 3845999 - RNA, 22 nt, Human
gcuccaggccugcagcaggagu

SEQ ID NO: 3846000 - RNA, 15 nt, Human
gcuccagggccagau

SEQ ID NO: 3846001 - RNA, 21 nt, Human
gcuccagguaccuugaccuuu

SEQ ID NO: 3846002 - RNA, 21 nt, Human
gcuccagucaacaaacuauuu

SEQ ID NO: 3846003 - RNA, 18 nt, Human
gcuccaguccugcucucu

SEQ ID NO: 3846004 - RNA, 23 nt, Human
gcuccaguccugcucucuaccca

SEQ ID NO: 3846005 - RNA, 20 nt, Human
gcuccagucugcugcccucc

SEQ ID NO: 3846006 - RNA, 21 nt, Human
gcuccaguggaagaagaaaac

SEQ ID NO: 3846007 - RNA, 16 nt, Human
gcuccaguguccugag

SEQ ID NO: 3846008 - RNA, 20 nt, Human
gcuccaguguccugagcuca

SEQ ID NO: 3846009 - RNA, 17 nt, Human
gcuccauacacacgcug

SEQ ID NO: 3846010 - RNA, 19 nt, Human
gcuccauaguuuggcauuu

SEQ ID NO: 3846011 - RNA, 14 nt, Human
gcuccaucaaugag

SEQ ID NO: 3846012 - RNA, 14 nt, Human
gcuccaucuccacu

SEQ ID NO: 3846013 - RNA, 19 nt, Human
gcuccaugcuccucacugc

SEQ ID NO: 3846014 - RNA, 23 nt, Human
gcuccaugcuccucacugcccgc

SEQ ID NO: 3846015 - RNA, 15 nt, Human
gcuccauggcugcca

SEQ ID NO: 3846016 - RNA, 16 nt, Human
gcuccauuuaaacaga

SEQ ID NO: 3846017 - RNA, 17 nt, Human
gcuccauuuacaaacua

SEQ ID NO: 3846018 - RNA, 20 nt, Human
gcuccauuuuuagugaaaua

SEQ ID NO: 3846019 - RNA, 11 nt, Human
gcucccaaggg

SEQ ID NO: 3846020 - RNA, 19 nt, Human
gcucccaaggggccugagc

SEQ ID NO: 3846021 - RNA, 20 nt, Human
gcucccaaggggccugagca

SEQ ID NO: 3846022 - RNA, 23 nt, Human
gcucccacaagccucugcccagg

SEQ ID NO: 3846023 - RNA, 15 nt, Human
gcucccacaagccug

SEQ ID NO: 3846024 - RNA, 17 nt, Human
gcucccacaagccugag

SEQ ID NO: 3846025 - RNA, 15 nt, Human
gcucccacaggcagc

SEQ ID NO: 3846026 - RNA, 15 nt, Human
gcucccacaggcccu

SEQ ID NO: 3846027 - RNA, 17 nt, Human
gcucccacaggcccuuc

SEQ ID NO: 3846028 - RNA, 18 nt, Human
gcucccaccccacccccu

SEQ ID NO: 3846029 - RNA, 18 nt, Human
gcucccaccuggcucugu

SEQ ID NO: 3846030 - RNA, 17 nt, Human
gcucccacuucugccag

SEQ ID NO: 3846031 - RNA, 12 nt, Human
gcucccagcagc

SEQ ID NO: 3846032 - RNA, 23 nt, Human
gcucccagcagcccuaaggaucu

SEQ ID NO: 3846033 - RNA, 14 nt, Human
gcucccagccaggc

SEQ ID NO: 3846034 - RNA, 16 nt, Human
uccaaagcuucccacg

SEQ ID NO: 3846035 - RNA, 19 nt, Human
uccaaagcuuuccuggaga

SEQ ID NO: 3846036 - RNA, 22 nt, Human
uccaaaggccauggagagcugg

SEQ ID NO: 3846037 - RNA, 14 nt, Human
uccaaaggcccccu

SEQ ID NO: 3846038 - RNA, 16 nt, Human
uccaaagguuucaacu

SEQ ID NO: 3846039 - RNA, 14 nt, Human
uccaaaguacacug

SEQ ID NO: 3846040 - RNA, 16 nt, Human
uccaaaguacacuguu

SEQ ID NO: 3846041 - RNA, 23 nt, Human
uccaaagucucuggaauuugaaa

SEQ ID NO: 3846042 - RNA, 13 nt, Human
uccaaauaaaaac

SEQ ID NO: 3846043 - RNA, 18 nt, Human
uccaaauaaaaacuaaau

SEQ ID NO: 3846044 - RNA, 17 nt, Human
uccaaauaagaaaccua

SEQ ID NO: 3846045 - RNA, 14 nt, Human
uccaaauaauaaag

SEQ ID NO: 3846046 - RNA, 19 nt, Human
uccaaaugaaugaccuugu

SEQ ID NO: 3846047 - RNA, 14 nt, Human
uccaaaugcagcuu

SEQ ID NO: 3846048 - RNA, 19 nt, Human
uccaaaugcagcuuuaaaa

SEQ ID NO: 3846049 - RNA, 19 nt, Human
uccaaauguccuccagaag

SEQ ID NO: 3846050 - RNA, 19 nt, Human
uccaaauucaguuucauaa

SEQ ID NO: 3846051 - RNA, 23 nt, Human
uccaaauuguuuaaauucacaau

SEQ ID NO: 3846052 - RNA, 16 nt, Human
uccaacaccacagaca

SEQ ID NO: 3846053 - RNA, 20 nt, Human
uccaacacugauuuccccuu

SEQ ID NO: 3846054 - RNA, 14 nt, Human
uccaacaggagcug

SEQ ID NO: 3846055 - RNA, 17 nt, Human
uccaacaggagcuggga

SEQ ID NO: 3846056 - RNA, 13 nt, Human
uccaacagugagu

SEQ ID NO: 3846057 - RNA, 18 nt, Human
uccaacaguuuaaugaag

SEQ ID NO: 3846058 - RNA, 20 nt, Human
uccaacaucacagcccagcc

SEQ ID NO: 3846059 - RNA, 15 nt, Human
uccaacccaugauga

SEQ ID NO: 3846060 - RNA, 17 nt, Human
uccaacccauuagccau

SEQ ID NO: 3846061 - RNA, 20 nt, Human
uccaaccccccagcacugag

SEQ ID NO: 3846062 - RNA, 24 nt, Human
uccaaccccucgcccagucccagc

SEQ ID NO: 3846063 - RNA, 16 nt, Human
uccaacccgaggcccg

SEQ ID NO: 3846064 - RNA, 14 nt, Human
uccaacccuagcaa

SEQ ID NO: 3846065 - RNA, 23 nt, Human
uccaacccucaucaccaacgucu

SEQ ID NO: 3846066 - RNA, 16 nt, Human
uccaaccuaaccugug

SEQ ID NO: 3846067 - RNA, 17 nt, Human
uccaaccuaaccugugu

SEQ ID NO: 3846068 - RNA, 17 nt, Human
uccaaccuggacaacaa

SEQ ID NO: 3846069 - RNA, 22 nt, Human
uccaacgaggcuaaguuaaugc

SEQ ID NO: 3846070 - RNA, 14 nt, Human
uccaacguggccca

SEQ ID NO: 3846071 - RNA, 16 nt, Human
uccaacguggcccaga

SEQ ID NO: 3846072 - RNA, 17 nt, Human
uccaacguggggcagca

SEQ ID NO: 3846073 - RNA, 21 nt, Human
uccaacguuuggaagauccug

SEQ ID NO: 3846074 - RNA, 20 nt, Human
uccaacuacuaauagaauaa

SEQ ID NO: 3846075 - RNA, 21 nt, Human
uccaacuaucucauuuccaag

SEQ ID NO: 3846076 - RNA, 14 nt, Human
uccaacuccagcaa

SEQ ID NO: 3846077 - RNA, 24 nt, Human
uccaacucuucccccucucccagu

SEQ ID NO: 3846078 - RNA, 16 nt, Human
uccaacugcugcccca

SEQ ID NO: 3846079 - RNA, 19 nt, Human
uccaacuguguucauuaga

SEQ ID NO: 3846080 - RNA, 15 nt, Human
uccaacuucauuuga

SEQ ID NO: 3846081 - RNA, 23 nt, Human
uccaacuuggcugcaggaaucuu

SEQ ID NO: 3846082 - RNA, 16 nt, Human
uccaagaaagaugaau

SEQ ID NO: 3846083 - RNA, 14 nt, Human
uccaagaagcccag

SEQ ID NO: 3846084 - RNA, 16 nt, Human
uccaagaauccacauu

SEQ ID NO: 3846085 - RNA, 20 nt, Human
uccaagaauccacauuucua

SEQ ID NO: 3846086 - RNA, 12 nt, Human
uccaagaaugcu

SEQ ID NO: 3846087 - RNA, 16 nt, Human
uccaagacauugucaa

SEQ ID NO: 3846088 - RNA, 20 nt, Human
uccaagacucuagaguccaa

SEQ ID NO: 3846089 - RNA, 18 nt, Human
uccaagagucuaaagaug

SEQ ID NO: 3846090 - RNA, 18 nt, Human
uccaagauauuuuaaaau

SEQ ID NO: 3846091 - RNA, 10 nt, Human
gcucccucag

SEQ ID NO: 3846092 - RNA, 12 nt, Human
gcucccucagac

SEQ ID NO: 3846093 - RNA, 19 nt, Human
gcucccucccaggacucug

SEQ ID NO: 3846094 - RNA, 20 nt, Human
gcucccuccccugcccuggu

SEQ ID NO: 3846095 - RNA, 19 nt, Human
gcucccuccgcccccaggu

SEQ ID NO: 3846096 - RNA, 20 nt, Human
gcucccuccgggucuuccua

SEQ ID NO: 3846097 - RNA, 18 nt, Human
gcucccuccuccaggccu

SEQ ID NO: 3846098 - RNA, 12 nt, Human
gcucccugaagc

SEQ ID NO: 3846099 - RNA, 17 nt, Human
gcucccugaagccagcc

SEQ ID NO: 3846100 - RNA, 20 nt, Human
gcucccugaagccagccuuc

SEQ ID NO: 3846101 - RNA, 12 nt, Human
gcucccugacug

SEQ ID NO: 3846102 - RNA, 13 nt, Human
gcucccugacugg

SEQ ID NO: 3846103 - RNA, 22 nt, Human
gcucccuguguccaccuguggg

SEQ ID NO: 3846104 - RNA, 12 nt, Human
gcucccuucagc

SEQ ID NO: 3846105 - RNA, 13 nt, Human
gcucccuucagcc

SEQ ID NO: 3846106 - RNA, 23 nt, Human
gcucccuucagcccccagccccu

SEQ ID NO: 3846107 - RNA, 21 nt, Human
gcucccuucaucuccagggag

SEQ ID NO: 3846108 - RNA, 16 nt, Human
gcucccuucccaccuc

SEQ ID NO: 3846109 - RNA, 18 nt, Human
gcucccuucccaccucuc

SEQ ID NO: 3846110 - RNA, 21 nt, Human
gcucccuucuacagccucaga

SEQ ID NO: 3846111 - RNA, 16 nt, Human
gcucccuucucuguag

SEQ ID NO: 3846112 - RNA, 14 nt, Human
gcucccuucuuccc

SEQ ID NO: 3846113 - RNA, 13 nt, Human
gcuccgcaggacu

SEQ ID NO: 3846114 - RNA, 13 nt, Human
gcuccgccucugc

SEQ ID NO: 3846115 - RNA, 22 nt, Human
gcuccgcugcuccuuggcuuac

SEQ ID NO: 3846116 - RNA, 14 nt, Human
gcuccgcugugugg

SEQ ID NO: 3846117 - RNA, 24 nt, Human
gcuccgcuuucuacccagcgagcc

SEQ ID NO: 3846118 - RNA, 23 nt, Human
gcuccggaggacucaccacugcc

SEQ ID NO: 3846119 - RNA, 21 nt, Human
gcuccgggacguggcaccucc

SEQ ID NO: 3846120 - RNA, 23 nt, Human
gcuccguccaggagccugugccu

SEQ ID NO: 3846121 - RNA, 15 nt, Human
gcuccgugccuccac

SEQ ID NO: 3846122 - RNA, 16 nt, Human
gcuccguggaggaggu

SEQ ID NO: 3846123 - RNA, 22 nt, Human
gcuccgugugggagaccggccu

SEQ ID NO: 3846124 - RNA, 23 nt, Human
gcuccgugugggagaccggccug

SEQ ID NO: 3846125 - RNA, 15 nt, Human
gcuccuaagcuucaa

SEQ ID NO: 3846126 - RNA, 13 nt, Human
gcuccuagaggga

SEQ ID NO: 3846127 - RNA, 14 nt, Human
gcuccuagagggag

SEQ ID NO: 3846128 - RNA, 19 nt, Human
gcuccuagagggaggggcc

SEQ ID NO: 3846129 - RNA, 21 nt, Human
gcuccuaggacccgucuccag

SEQ ID NO: 3846130 - RNA, 21 nt, Human
gcuccucaaccccuccccucc

SEQ ID NO: 3846131 - RNA, 15 nt, Human
gcuccucacuguggu

SEQ ID NO: 3846132 - RNA, 18 nt, Human
gcuccucagggacucagg

SEQ ID NO: 3846133 - RNA, 18 nt, Human
gcuccucauccagggcuc

SEQ ID NO: 3846134 - RNA, 19 nt, Human
gcuccucaugguggguuca

SEQ ID NO: 3846135 - RNA, 21 nt, Human
gcuccuccaggguggcagcaa

SEQ ID NO: 3846136 - RNA, 13 nt, Human
gcuccucccagcu

SEQ ID NO: 3846137 - RNA, 15 nt, Human
gcuccuccccuggag

SEQ ID NO: 3846138 - RNA, 22 nt, Human
gcuccucccucucaacacccag

SEQ ID NO: 3846139 - RNA, 19 nt, Human
gcuccucccuggcugcccu

SEQ ID NO: 3846140 - RNA, 21 nt, Human
gcuccucccuggcugcccugg

SEQ ID NO: 3846141 - RNA, 22 nt, Human
gcuccucccuggcugcccuggc

SEQ ID NO: 3846142 - RNA, 14 nt, Human
gcuccuccgugcuu

SEQ ID NO: 3846143 - RNA, 14 nt, Human
gcuccuccucccug

SEQ ID NO: 3846144 - RNA, 17 nt, Human
gcuccucgagggcaggg

SEQ ID NO: 3846145 - RNA, 20 nt, Human
gcuccucgagggcagggacu

SEQ ID NO: 3846146 - RNA, 13 nt, Human
gcuccucuccagg

SEQ ID NO: 3846147 - RNA, 22 nt, Human
gcuccucuccaggcacccuucu

SEQ ID NO: 3846148 - RNA, 19 nt, Human
gcuccucuccccagcaagu

SEQ ID NO: 3846149 - RNA, 16 nt, Human
gcuccucuccccagcc

SEQ ID NO: 3846150 - RNA, 23 nt, Human
gcuccucuccccagcccagagac

SEQ ID NO: 3846151 - RNA, 16 nt, Human
gcuccucuccuggagg

SEQ ID NO: 3846152 - RNA, 17 nt, Human
gcuccucuccuggagga

SEQ ID NO: 3846153 - RNA, 12 nt, Human
gcuccucugcuu

SEQ ID NO: 3846154 - RNA, 14 nt, Human
gcuccucugggcag

SEQ ID NO: 3846155 - RNA, 19 nt, Human
gcuccucugggcaggaccu

SEQ ID NO: 3846156 - RNA, 21 nt, Human
gcuccucugucucgagcgccc

SEQ ID NO: 3846157 - RNA, 22 nt, Human
gcuccucugucucgagcgcccu

SEQ ID NO: 3846158 - RNA, 20 nt, Human
gcuccucuguggugucugcc

SEQ ID NO: 3846159 - RNA, 14 nt, Human
gcuccucuucccca

SEQ ID NO: 3846160 - RNA, 15 nt, Human
gcuccucuuccccag

SEQ ID NO: 3846161 - RNA, 16 nt, Human
gcuccugacacugcug

SEQ ID NO: 3846162 - RNA, 15 nt, Human
gcuccugaccaguug

SEQ ID NO: 3846163 - RNA, 19 nt, Human
gcuccugaccaguugcagu

SEQ ID NO: 3846164 - RNA, 24 nt, Human
gcuccugaccaguugcagucacuc

SEQ ID NO: 3846165 - RNA, 18 nt, Human
gcuccugaggggcaucug

SEQ ID NO: 3846166 - RNA, 21 nt, Human
gcuccugaggggcaucugccc

SEQ ID NO: 3846167 - RNA, 20 nt, Human
gcuccugcacuuacuugcuu

SEQ ID NO: 3846168 - RNA, 12 nt, Human
gcuccugcccac

SEQ ID NO: 3846169 - RNA, 11 nt, Human
gcuccugcccc

SEQ ID NO: 3846170 - RNA, 18 nt, Human
gcuccugccgcagagcug

SEQ ID NO: 3846171 - RNA, 18 nt, Human
gcuccugccuucuguccu

SEQ ID NO: 3846172 - RNA, 23 nt, Human
gcuccugcuaacggugcucaggg

SEQ ID NO: 3846173 - RNA, 14 nt, Human
gcuccugcuccaca

SEQ ID NO: 3846174 - RNA, 12 nt, Human
gcuccugcugca

SEQ ID NO: 3846175 - RNA, 14 nt, Human
gcuccugcugcacc

SEQ ID NO: 3846176 - RNA, 18 nt, Human
gcuccuggaaaggcucag

SEQ ID NO: 3846177 - RNA, 11 nt, Human
gcuccuggacc

SEQ ID NO: 3846178 - RNA, 15 nt, Human
gcugagucugaaggc

SEQ ID NO: 3846179 - RNA, 19 nt, Human
gcugagucugaaggcuggg

SEQ ID NO: 3846180 - RNA, 15 nt, Human
gcugagugcaggccc

SEQ ID NO: 3846181 - RNA, 16 nt, Human
gcugagugcaggccca

SEQ ID NO: 3846182 - RNA, 20 nt, Human
gcugagugcaggcccacccu

SEQ ID NO: 3846183 - RNA, 13 nt, Human
gcugaguuggugu

SEQ ID NO: 3846184 - RNA, 18 nt, Human
gcugaguuguugagucug

SEQ ID NO: 3846185 - RNA, 13 nt, Human
gcugauaaaagau

SEQ ID NO: 3846186 - RNA, 15 nt, Human
gcugauaauuuuaaa

SEQ ID NO: 3846187 - RNA, 18 nt, Human
gcugauacauaacuaaau

SEQ ID NO: 3846188 - RNA, 17 nt, Human
gcugauauauguguuuu

SEQ ID NO: 3846189 - RNA, 18 nt, Human
gcugauauauguguuuuu

SEQ ID NO: 3846190 - RNA, 20 nt, Human
gcugauauauguguuuuuca

SEQ ID NO: 3846191 - RNA, 16 nt, Human
gcugaucgccuucccc

SEQ ID NO: 3846192 - RNA, 19 nt, Human
gcugaucgccuuccccacc

SEQ ID NO: 3846193 - RNA, 22 nt, Human
gcugaucucagggaagcccagc

SEQ ID NO: 3846194 - RNA, 22 nt, Human
gcugaucugcggaucucagcuu

SEQ ID NO: 3846195 - RNA, 21 nt, Human
gcugaugaacuuauucuguag

SEQ ID NO: 3846196 - RNA, 21 nt, Human
gcugaugaaucacuguuuuua

SEQ ID NO: 3846197 - RNA, 21 nt, Human
gcugaugacccccccagcuuc

SEQ ID NO: 3846198 - RNA, 13 nt, Human
gcugaugacucaa

SEQ ID NO: 3846199 - RNA, 22 nt, Human
gcugaugacucaagauucccag

SEQ ID NO: 3846200 - RNA, 15 nt, Human
gcugaugcucauggu

SEQ ID NO: 3846201 - RNA, 14 nt, Human
gcugaugcugggcu

SEQ ID NO: 3846202 - RNA, 20 nt, Human
gcugaugcugggcugggugc

SEQ ID NO: 3846203 - RNA, 16 nt, Human
gcugauggagaaggaa

SEQ ID NO: 3846204 - RNA, 17 nt, Human
gcugauggagaaggaag

SEQ ID NO: 3846205 - RNA, 18 nt, Human
gcugauggugcaaugacc

SEQ ID NO: 3846206 - RNA, 22 nt, Human
gcugaugguguggccuguggcu

SEQ ID NO: 3846207 - RNA, 23 nt, Human
gcugaugucaauuucuguguugc

SEQ ID NO: 3846208 - RNA, 19 nt, Human
gcugaugucccuagaaaac

SEQ ID NO: 3846209 - RNA, 20 nt, Human
gcugauguccucaccacaug

SEQ ID NO: 3846210 - RNA, 14 nt, Human
gcugauguucagug

SEQ ID NO: 3846211 - RNA, 18 nt, Human
gcugauguucaguguaau

SEQ ID NO: 3846212 - RNA, 15 nt, Human
gcugauuaaaugaca

SEQ ID NO: 3846213 - RNA, 14 nt, Human
gcugauuacuguca

SEQ ID NO: 3846214 - RNA, 21 nt, Human
gcugauuacugucaauaaaca

SEQ ID NO: 3846215 - RNA, 22 nt, Human
gcugauuacugucaauaaacag

SEQ ID NO: 3846216 - RNA, 13 nt, Human
gcugauucucagg

SEQ ID NO: 3846217 - RNA, 20 nt, Human
gcugauucucagggucucug

SEQ ID NO: 3846218 - RNA, 23 nt, Human
gcugauuucuagguaggaaaugu

SEQ ID NO: 3846219 - RNA, 20 nt, Human
gcugauuuuaacaauaacua

SEQ ID NO: 3846220 - RNA, 18 nt, Human
gcugauuuuauucuugau

SEQ ID NO: 3846221 - RNA, 22 nt, Human
gcugcaaaggguaucaggugcu

SEQ ID NO: 3846222 - RNA, 23 nt, Human
gcugcaaaggguaucaggugcug

SEQ ID NO: 3846223 - RNA, 12 nt, Human
gcugcaaagugu

SEQ ID NO: 3846224 - RNA, 20 nt, Human
gcugcaaggacauucuugua

SEQ ID NO: 3846225 - RNA, 16 nt, Human
gcugcaaggccuuucu

SEQ ID NO: 3846226 - RNA, 23 nt, Human
gcugcaagguggcuccagcacca

SEQ ID NO: 3846227 - RNA, 19 nt, Human
gcugcacagggcagcuggg

SEQ ID NO: 3846228 - RNA, 23 nt, Human
gcugcacagggcagcugggccca

SEQ ID NO: 3846229 - RNA, 15 nt, Human
gcugcaccagguaga

SEQ ID NO: 3846230 - RNA, 13 nt, Human
gcugcacccucag

SEQ ID NO: 3846231 - RNA, 19 nt, Human
gcugcacccucaggcaggu

SEQ ID NO: 3846232 - RNA, 14 nt, Human
gcugcaccggcugg

SEQ ID NO: 3846233 - RNA, 19 nt, Human
gcugcaccugccagccugg

SEQ ID NO: 3846234 - RNA, 20 nt, Human
gcugcaccugccagccuggc

SEQ ID NO: 3846235 - RNA, 22 nt, Human
gcugcaccugccagccuggcuu

SEQ ID NO: 3846236 - RNA, 18 nt, Human
gcugcacucugugcccau

SEQ ID NO: 3846237 - RNA, 23 nt, Human
gcugcacucugugcccaugggca

SEQ ID NO: 3846238 - RNA, 18 nt, Human
gcugcagagauuucucau

SEQ ID NO: 3846239 - RNA, 13 nt, Human
gcugcagagcagu

SEQ ID NO: 3846240 - RNA, 20 nt, Human
gcugcagagcagugggccug

SEQ ID NO: 3846241 - RNA, 13 nt, Human
gcugcagagccac

SEQ ID NO: 3846242 - RNA, 15 nt, Human
gcugcagaggccaga

SEQ ID NO: 3846243 - RNA, 21 nt, Human
gcugcagaggggcaggcccug

SEQ ID NO: 3846244 - RNA, 22 nt, Human
gcugcagaggggcaggcccugc

SEQ ID NO: 3846245 - RNA, 23 nt, Human
gcugcagauaacagaaaggcuuu

SEQ ID NO: 3846246 - RNA, 22 nt, Human
gcugcagauacuacugaccaga

SEQ ID NO: 3846247 - RNA, 16 nt, Human
gcugcagcaccgaggg

SEQ ID NO: 3846248 - RNA, 16 nt, Human
gcugcagcagaggcac

SEQ ID NO: 3846249 - RNA, 18 nt, Human
gcugcagcagaggcacug

SEQ ID NO: 3846250 - RNA, 12 nt, Human
gcugcagcagcg

SEQ ID NO: 3846251 - RNA, 12 nt, Human
gcugcagcaugu

SEQ ID NO: 3846252 - RNA, 15 nt, Human
gcugcagccaggcca

SEQ ID NO: 3846253 - RNA, 15 nt, Human
gcugcagcucaccca

SEQ ID NO: 3846254 - RNA, 15 nt, Human
gcugcagcucccugg

SEQ ID NO: 3846255 - RNA, 16 nt, Human
gcugcagcucccuggc

SEQ ID NO: 3846256 - RNA, 19 nt, Human
gcugcagcucccuggcuuc

SEQ ID NO: 3846257 - RNA, 18 nt, Human
gcugcagcuggacagagg

SEQ ID NO: 3846258 - RNA, 12 nt, Human
gcugcagcuucc

SEQ ID NO: 3846259 - RNA, 12 nt, Human
gcugcagcuugg

SEQ ID NO: 3846260 - RNA, 16 nt, Human
gcugcaggaaucaaaa

SEQ ID NO: 3846261 - RNA, 21 nt, Human
gcugcaggaaucaaaaauuga

SEQ ID NO: 3846262 - RNA, 17 nt, Human
gcugcaggaaucuuuaa

SEQ ID NO: 3846263 - RNA, 16 nt, Human
gcugcaggggcucugg

SEQ ID NO: 3846264 - RNA, 23 nt, Human
gcugcaguccguguggauccaau

SEQ ID NO: 3846265 - RNA, 22 nt, Human
gcugcaguucuacucaggcugg

SEQ ID NO: 3846266 - RNA, 13 nt, Human
gcugcaguugcca

SEQ ID NO: 3846267 - RNA, 14 nt, Human
gcugcaguugccag

SEQ ID NO: 3846268 - RNA, 21 nt, Human
gcugcaguugccagucacccc

SEQ ID NO: 3846269 - RNA, 18 nt, Human
gcugcauagaaggaggag

SEQ ID NO: 3846270 - RNA, 16 nt, Human
gcugcauccgugagca

SEQ ID NO: 3846271 - RNA, 21 nt, Human
gcugcauccgugagcagugug

SEQ ID NO: 3846272 - RNA, 18 nt, Human
gcugcauccuccaagaau

SEQ ID NO: 3846273 - RNA, 22 nt, Human
gcugcauccuccaagaaucuau

SEQ ID NO: 3846274 - RNA, 19 nt, Human
gcugcaucuuauagcacuu

SEQ ID NO: 3846275 - RNA, 23 nt, Human
gcugcaucuuauagcacuuugaa

SEQ ID NO: 3846276 - RNA, 21 nt, Human
gcugcaugcccucucaggccg

SEQ ID NO: 3846277 - RNA, 15 nt, Human
gcugcauuagaaaaa

SEQ ID NO: 3846278 - RNA, 19 nt, Human
gcugcauugaaaagagcug

SEQ ID NO: 3846279 - RNA, 20 nt, Human
gcugcauugaaaagagcuga

SEQ ID NO: 3846280 - RNA, 17 nt, Human
gcugcauuuaaaagaua

SEQ ID NO: 3846281 - RNA, 15 nt, Human
gcugccaaauuuugg

SEQ ID NO: 3846282 - RNA, 18 nt, Human
gcugccaaggccagagug

SEQ ID NO: 3846283 - RNA, 23 nt, Human
gcugccaaggccagaguggccug

SEQ ID NO: 3846284 - RNA, 15 nt, Human
gcugccaauauccua

SEQ ID NO: 3846285 - RNA, 16 nt, Human
gcugccaaugggagcu

SEQ ID NO: 3846286 - RNA, 21 nt, Human
gcugccacaaccagccaggca

SEQ ID NO: 3846287 - RNA, 15 nt, Human
gcugccacacuucag

SEQ ID NO: 3846288 - RNA, 18 nt, Human
gcugccacacuucaggcu

SEQ ID NO: 3846289 - RNA, 23 nt, Human
gcugccacacuucaggcucuucu

SEQ ID NO: 3846290 - RNA, 13 nt, Human
gcugccaccugcc

SEQ ID NO: 3846291 - RNA, 12 nt, Human
gcugccagagaa

SEQ ID NO: 3846292 - RNA, 20 nt, Human
gcugccagccuugagcccug

SEQ ID NO: 3846293 - RNA, 17 nt, Human
gcugccaggugagaaac

SEQ ID NO: 3846294 - RNA, 22 nt, Human
gcugccaguggggccugaggcu

SEQ ID NO: 3846295 - RNA, 12 nt, Human
gcugccauccag

SEQ ID NO: 3846296 - RNA, 13 nt, Human
gcugccauccagg

SEQ ID NO: 3846297 - RNA, 23 nt, Human
gcugccauccagguucagcuugu

SEQ ID NO: 3846298 - RNA, 14 nt, Human
uccauugacaugua

SEQ ID NO: 3846299 - RNA, 19 nt, Human
uccauugacauguacagag

SEQ ID NO: 3846300 - RNA, 16 nt, Human
uccauugguccaagau

SEQ ID NO: 3846301 - RNA, 15 nt, Human
uccauuuaaacagau

SEQ ID NO: 3846302 - RNA, 18 nt, Human
uccauuuaauaauuauau

SEQ ID NO: 3846303 - RNA, 14 nt, Human
uccauuuaguucuu

SEQ ID NO: 3846304 - RNA, 20 nt, Human
uccauuuaguucuuuguuau

SEQ ID NO: 3846305 - RNA, 21 nt, Human
uccauuuauauaugaaaacua

SEQ ID NO: 3846306 - RNA, 21 nt, Human
uccauuucaucuauuucugag

SEQ ID NO: 3846307 - RNA, 19 nt, Human
uccauuuccauugcuuauu

SEQ ID NO: 3846308 - RNA, 18 nt, Human
uccauuuccccuccuucc

SEQ ID NO: 3846309 - RNA, 20 nt, Human
uccauuucgccccucauuua

SEQ ID NO: 3846310 - RNA, 14 nt, Human
uccauuugaaagaa

SEQ ID NO: 3846311 - RNA, 12 nt, Human
uccauuugcaag

SEQ ID NO: 3846312 - RNA, 15 nt, Human
uccauuugcaaggga

SEQ ID NO: 3846313 - RNA, 14 nt, Human
uccauuugcucuuc

SEQ ID NO: 3846314 - RNA, 15 nt, Human
uccauuugcucuuca

SEQ ID NO: 3846315 - RNA, 13 nt, Human
uccauuuguaaaa

SEQ ID NO: 3846316 - RNA, 13 nt, Human
uccauuuuauaaa

SEQ ID NO: 3846317 - RNA, 19 nt, Human
uccauuuuccuacaggcag

SEQ ID NO: 3846318 - RNA, 23 nt, Human
uccauuuuccuacaggcagucuc

SEQ ID NO: 3846319 - RNA, 22 nt, Human
uccauuuucuuauugcgcugcu

SEQ ID NO: 3846320 - RNA, 22 nt, Human
uccauuuuggcgcuauuacaaa

SEQ ID NO: 3846321 - RNA, 22 nt, Human
ucaguccuccccucacagccuc

SEQ ID NO: 3846322 - RNA, 22 nt, Human
ucaguccuguaguuuuauuuua

SEQ ID NO: 3846323 - RNA, 17 nt, Human
ucagucucccuuucccu

SEQ ID NO: 3846324 - RNA, 13 nt, Human
ucagucucugagc

SEQ ID NO: 3846325 - RNA, 17 nt, Human
ucagucucugagcagug

SEQ ID NO: 3846326 - RNA, 23 nt, Human
ucagucugauuaaagguggugcc

SEQ ID NO: 3846327 - RNA, 19 nt, Human
ucagucugauucccaagcu

SEQ ID NO: 3846328 - RNA, 21 nt, Human
ucagucugauucccaagcucu

SEQ ID NO: 3846329 - RNA, 16 nt, Human
ucagucugcuuagaaa

SEQ ID NO: 3846330 - RNA, 16 nt, Human
ucagucuggugggagg

SEQ ID NO: 3846331 - RNA, 13 nt, Human
ucagucuugccuu

SEQ ID NO: 3846332 - RNA, 12 nt, Human
ucagucuuuucc

SEQ ID NO: 3846333 - RNA, 20 nt, Human
ucagucuuuuucuguuguaa

SEQ ID NO: 3846334 - RNA, 14 nt, Human
ucagugaaguugcu

SEQ ID NO: 3846335 - RNA, 18 nt, Human
ucagugaaguugcugcuu

SEQ ID NO: 3846336 - RNA, 14 nt, Human
ucagugaggcccag

SEQ ID NO: 3846337 - RNA, 16 nt, Human
ucagugaugugccuaa

SEQ ID NO: 3846338 - RNA, 14 nt, Human
ucagugcauuugug

SEQ ID NO: 3846339 - RNA, 20 nt, Human
ucagugccaacuguggcugg

SEQ ID NO: 3846340 - RNA, 16 nt, Human
ucagugcccaacuguu

SEQ ID NO: 3846341 - RNA, 20 nt, Human
ucagugcccuccaggauaga

SEQ ID NO: 3846342 - RNA, 10 nt, Human
ucagugccuu

SEQ ID NO: 3846343 - RNA, 15 nt, Human
ucagugccuuaugga

SEQ ID NO: 3846344 - RNA, 23 nt, Human
ucagugccuuauggaacacucug

SEQ ID NO: 3846345 - RNA, 12 nt, Human
ucagugcucccu

SEQ ID NO: 3846346 - RNA, 14 nt, Human
ucagugcugugcug

SEQ ID NO: 3846347 - RNA, 16 nt, Human
ucagugcugugcugug

SEQ ID NO: 3846348 - RNA, 22 nt, Human
ucagugcugugcugugcuaugg

SEQ ID NO: 3846349 - RNA, 15 nt, Human
ucagugcuguggccu

SEQ ID NO: 3846350 - RNA, 19 nt, Human
ucaguggacuuuccacccc

SEQ ID NO: 3846351 - RNA, 23 nt, Human
ucaguggacuuuccacccccucc

SEQ ID NO: 3846352 - RNA, 11 nt, Human
ucaguggcagc

SEQ ID NO: 3846353 - RNA, 15 nt, Human
ucaguggcagcugcu

SEQ ID NO: 3846354 - RNA, 14 nt, Human
ucaguggcagggcu

SEQ ID NO: 3846355 - RNA, 22 nt, Human
ucagugggaacgugacugcccc

SEQ ID NO: 3846356 - RNA, 14 nt, Human
ucagugggagaaaa

SEQ ID NO: 3846357 - RNA, 16 nt, Human
ucaguggggaggggcu

SEQ ID NO: 3846358 - RNA, 17 nt, Human
ucaguggggcucucuga

SEQ ID NO: 3846359 - RNA, 21 nt, Human
ucagugguccacaucccggga

SEQ ID NO: 3846360 - RNA, 14 nt, Human
ucaguguaaagugu

SEQ ID NO: 3846361 - RNA, 11 nt, Human
ucaguguacau

SEQ ID NO: 3846362 - RNA, 19 nt, Human
ucaguguaccauuugccuc

SEQ ID NO: 3846363 - RNA, 19 nt, Human
ucaguguagccccaagaag

SEQ ID NO: 3846364 - RNA, 17 nt, Human
ucaguguauuucaguuc

SEQ ID NO: 3846365 - RNA, 16 nt, Human
ucaguguauuuguauu

SEQ ID NO: 3846366 - RNA, 15 nt, Human
ucagugucaaauaaa

SEQ ID NO: 3846367 - RNA, 21 nt, Human
ucagugucaaauaaacacugu

SEQ ID NO: 3846368 - RNA, 17 nt, Human
ucagugucccgggcccg

SEQ ID NO: 3846369 - RNA, 19 nt, Human
ucaguguccucuugcucaa

SEQ ID NO: 3846370 - RNA, 15 nt, Human
ucagugucucacacu

SEQ ID NO: 3846371 - RNA, 19 nt, Human
ucagugugccccccauccu

SEQ ID NO: 3846372 - RNA, 19 nt, Human
ucagugugucuaaauuuga

SEQ ID NO: 3846373 - RNA, 16 nt, Human
ucaguguuaaaaaauu

SEQ ID NO: 3846374 - RNA, 15 nt, Human
ucaguguuaccugug

SEQ ID NO: 3846375 - RNA, 19 nt, Human
ucaguguuaccugugugcu

SEQ ID NO: 3846376 - RNA, 15 nt, Human
ucaguguuucugggg

SEQ ID NO: 3846377 - RNA, 22 nt, Human
ucaguguuugggucaccccucc

SEQ ID NO: 3846378 - RNA, 16 nt, Human
ucaguguuuuggacuc

SEQ ID NO: 3846379 - RNA, 14 nt, Human
ucaguuaagaaaaa

SEQ ID NO: 3846380 - RNA, 19 nt, Human
ucaguuaagaaaaaaauaa

SEQ ID NO: 3846381 - RNA, 13 nt, Human
ucaguuacagaaa

SEQ ID NO: 3846382 - RNA, 18 nt, Human
ucaguuacccacucgguc

SEQ ID NO: 3846383 - RNA, 14 nt, Human
ucaguuacuaagaa

SEQ ID NO: 3846384 - RNA, 16 nt, Human
ucaguuacucagcccu

SEQ ID NO: 3846385 - RNA, 17 nt, Human
ucaguuacucagcccug

SEQ ID NO: 3846386 - RNA, 18 nt, Human
ucaguuacucagcccugg

SEQ ID NO: 3846387 - RNA, 15 nt, Human
ucaguuacucuucag

SEQ ID NO: 3846388 - RNA, 23 nt, Human
ucaguuauugucccuggcuuccu

SEQ ID NO: 3846389 - RNA, 20 nt, Human
ucaguucaaagucaugaugu

SEQ ID NO: 3846390 - RNA, 20 nt, Human
ucaguucagaaucacuucug

SEQ ID NO: 3846391 - RNA, 14 nt, Human
ucaguucccagaau

SEQ ID NO: 3846392 - RNA, 18 nt, Human
ucaguucccagaaucaaa

SEQ ID NO: 3846393 - RNA, 15 nt, Human
ucaguucccuuggcc

SEQ ID NO: 3846394 - RNA, 16 nt, Human
ucaguucccuuggccu

SEQ ID NO: 3846395 - RNA, 19 nt, Human
ucaguucccuuggccucag

SEQ ID NO: 3846396 - RNA, 19 nt, Human
ucaguuccucuuugcaugg

SEQ ID NO: 3846397 - RNA, 19 nt, Human
ucaguucuacggaucauca

SEQ ID NO: 3846398 - RNA, 23 nt, Human
ucaguugagcuucauauaccagc

SEQ ID NO: 3846399 - RNA, 22 nt, Human
ucaguugcuaaacacugcgcuu

SEQ ID NO: 3846400 - RNA, 17 nt, Human
ucaguugguugugucuu

SEQ ID NO: 3846401 - RNA, 13 nt, Human
ucaguuguacagu

SEQ ID NO: 3846402 - RNA, 13 nt, Human
ucaguugugcagc

SEQ ID NO: 3846403 - RNA, 12 nt, Human
ucaguuguguuu

SEQ ID NO: 3846404 - RNA, 18 nt, Human
ucaguuguguuuuuuaag

SEQ ID NO: 3846405 - RNA, 19 nt, Human
ucaguuguuagugugucuu

SEQ ID NO: 3846406 - RNA, 15 nt, Human
ucaguuguucuuuuu

SEQ ID NO: 3846407 - RNA, 19 nt, Human
ucaguuuaaaagcacgaca

SEQ ID NO: 3846408 - RNA, 16 nt, Human
ucaguuuaauccuucu

SEQ ID NO: 3846409 - RNA, 23 nt, Human
ucaguuuauccaagguguaacuc

SEQ ID NO: 3846410 - RNA, 14 nt, Human
ucaguuuaucuguu

SEQ ID NO: 3846411 - RNA, 21 nt, Human
ucaguuuauguuguacaaugu

SEQ ID NO: 3846412 - RNA, 15 nt, Human
ucaguuuauguuuug

SEQ ID NO: 3846413 - RNA, 12 nt, Human
ucaguuucuaca

SEQ ID NO: 3846414 - RNA, 16 nt, Human
ucaguuugaucacacu

SEQ ID NO: 3846415 - RNA, 16 nt, Human
ucaguuugcagaguag

SEQ ID NO: 3846416 - RNA, 12 nt, Human
ucaguuugguug

SEQ ID NO: 3846417 - RNA, 15 nt, Human
ucaguuuguauauac

SEQ ID NO: 3846418 - RNA, 15 nt, Human
ucaguuugugugucu

SEQ ID NO: 3846419 - RNA, 14 nt, Human
ucaguuuguuggaa

SEQ ID NO: 3846420 - RNA, 16 nt, Human
ucaguuuguuggaaag

SEQ ID NO: 3846421 - RNA, 19 nt, Human
ucaguuuuaucauuuucaa

SEQ ID NO: 3846422 - RNA, 16 nt, Human
ucaguuuucaggagug

SEQ ID NO: 3846423 - RNA, 13 nt, Human
ucaguuuucauuu

SEQ ID NO: 3846424 - RNA, 13 nt, Human
ucauaaaagagac

SEQ ID NO: 3846425 - RNA, 12 nt, Human
ucauaaaauaaa

SEQ ID NO: 3846426 - RNA, 16 nt, Human
ucauaaaauaaaguau

SEQ ID NO: 3846427 - RNA, 21 nt, Human
ucauaaaauaaaguauauaua

SEQ ID NO: 3846428 - RNA, 21 nt, Human
ucauaaacaacuuaauguucu

SEQ ID NO: 3846429 - RNA, 19 nt, Human
ucauaaacagaugaauaaa

SEQ ID NO: 3846430 - RNA, 15 nt, Human
ucauaaacugugugc

SEQ ID NO: 3846431 - RNA, 24 nt, Human
ucauaaagcaggcagaacucaucu

SEQ ID NO: 3846432 - RNA, 22 nt, Human
ucauaaagugagaaaacuguga

SEQ ID NO: 3846433 - RNA, 20 nt, Human
ucauaaaguuagaaucuauu

SEQ ID NO: 3846434 - RNA, 18 nt, Human
ucauaaauaaaguuuguu

SEQ ID NO: 3846435 - RNA, 14 nt, Human
ucauaaaugaauuu

SEQ ID NO: 3846436 - RNA, 19 nt, Human
ucauaacauccagagcuuu

SEQ ID NO: 3846437 - RNA, 14 nt, Human
ucauaaccuagccu

SEQ ID NO: 3846438 - RNA, 16 nt, Human
ucauaacggaucagaa

SEQ ID NO: 3846439 - RNA, 19 nt, Human
ucauaacggaucagaaaua

SEQ ID NO: 3846440 - RNA, 20 nt, Human
ucauaacuuauugcugauuu

SEQ ID NO: 3846441 - RNA, 22 nt, Human
ucauaagagccacaggucuuua

SEQ ID NO: 3846442 - RNA, 21 nt, Human
ucauaagccaauuuuucugca

SEQ ID NO: 3846443 - RNA, 15 nt, Human
ucauaaggcuucaaa

SEQ ID NO: 3846444 - RNA, 20 nt, Human
ucauaaguauuaugucucuu

SEQ ID NO: 3846445 - RNA, 16 nt, Human
ucauaaguauuuggaa

SEQ ID NO: 3846446 - RNA, 16 nt, Human
ucauaauaaguugcau

SEQ ID NO: 3846447 - RNA, 14 nt, Human
ucauaaucuuugcu

SEQ ID NO: 3846448 - RNA, 13 nt, Human
ucauaauggccug

SEQ ID NO: 3846449 - RNA, 12 nt, Human
ucauaauuacca

SEQ ID NO: 3846450 - RNA, 18 nt, Human
ucauaauuccuacagcac

SEQ ID NO: 3846451 - RNA, 12 nt, Human
ucauaauucuaa

SEQ ID NO: 3846452 - RNA, 23 nt, Human
ucauaauugcauugacuuucccc

SEQ ID NO: 3846453 - RNA, 14 nt, Human
ucauacacuuccuu

SEQ ID NO: 3846454 - RNA, 16 nt, Human
ucauacagaagguggg

SEQ ID NO: 3846455 - RNA, 15 nt, Human
ucauacagagaaguc

SEQ ID NO: 3846456 - RNA, 22 nt, Human
ucauaccaggccgccccagccu

SEQ ID NO: 3846457 - RNA, 20 nt, Human
ucauacccacccccacccaa

SEQ ID NO: 3846458 - RNA, 21 nt, Human
ucauaccuaaguacuguaaua

SEQ ID NO: 3846459 - RNA, 14 nt, Human
ucauaccucagaau

SEQ ID NO: 3846460 - RNA, 18 nt, Human
ucauaccucagaauguaa

SEQ ID NO: 3846461 - RNA, 14 nt, Human
ucauacguccacca

SEQ ID NO: 3846462 - RNA, 20 nt, Human
ucauacuaucuacucuccuc

SEQ ID NO: 3846463 - RNA, 15 nt, Human
ucauacucaccucac

SEQ ID NO: 3846464 - RNA, 23 nt, Human
ucauacucuagauuuuguuuugc

SEQ ID NO: 3846465 - RNA, 16 nt, Human
gcugcccaaucuccau

SEQ ID NO: 3846466 - RNA, 22 nt, Human
gcugcccacuguuucucuugag

SEQ ID NO: 3846467 - RNA, 16 nt, Human
gcugugcugcccugaa

SEQ ID NO: 3846468 - RNA, 19 nt, Human
gcugugcugcccugcccac

SEQ ID NO: 3846469 - RNA, 22 nt, Human
gcuguggaccauggaguggcag

SEQ ID NO: 3846470 - RNA, 14 nt, Human
gcuguggccaggag

SEQ ID NO: 3846471 - RNA, 18 nt, Human
gcuguggccaggaggugc

SEQ ID NO: 3846472 - RNA, 14 nt, Human
gcuguggccagggu

SEQ ID NO: 3846473 - RNA, 19 nt, Human
gcuguggccagggugagag

SEQ ID NO: 3846474 - RNA, 21 nt, Human
gcuguggccagggugagagcu

SEQ ID NO: 3846475 - RNA, 22 nt, Human
gcuguggccagggugagagcug

SEQ ID NO: 3846476 - RNA, 20 nt, Human
gcuguggccuaaccugccga

SEQ ID NO: 3846477 - RNA, 15 nt, Human
gcuguggccugggca

SEQ ID NO: 3846478 - RNA, 15 nt, Human
gcuguggcuggugag

SEQ ID NO: 3846479 - RNA, 15 nt, Human
gcugugggaaauggu

SEQ ID NO: 3846480 - RNA, 17 nt, Human
gcugugggcagguggga

SEQ ID NO: 3846481 - RNA, 19 nt, Human
gcugugggccucaaggacu

SEQ ID NO: 3846482 - RNA, 21 nt, Human
gcugugggcgugagaccugcc

SEQ ID NO: 3846483 - RNA, 22 nt, Human
gcugugggcgugagaccugccc

SEQ ID NO: 3846484 - RNA, 18 nt, Human
gcugugggcucccuuccu

SEQ ID NO: 3846485 - RNA, 21 nt, Human
gcuguggggcugguagcucag

SEQ ID NO: 3846486 - RNA, 16 nt, Human
gcuguggucucuuugu

SEQ ID NO: 3846487 - RNA, 22 nt, Human
gcugugguuuucuuuugccaug

SEQ ID NO: 3846488 - RNA, 23 nt, Human
gcuguguaagauuuguuuuuaaa

SEQ ID NO: 3846489 - RNA, 17 nt, Human
gcuguguccaacuccag

SEQ ID NO: 3846490 - RNA, 18 nt, Human
gcuguguccaacuccagu

SEQ ID NO: 3846491 - RNA, 18 nt, Human
gcugugugaauaccugcu

SEQ ID NO: 3846492 - RNA, 13 nt, Human
gcugugugaccuu

SEQ ID NO: 3846493 - RNA, 16 nt, Human
gcugugugucccaggc

SEQ ID NO: 3846494 - RNA, 18 nt, Human
gcugugugucccaggcag

SEQ ID NO: 3846495 - RNA, 22 nt, Human
gcuguguguuaguucccaacau

SEQ ID NO: 3846496 - RNA, 14 nt, Human
gcuguguuccccaa

SEQ ID NO: 3846497 - RNA, 23 nt, Human
gcuguguucuugccacugcacuc

SEQ ID NO: 3846498 - RNA, 17 nt, Human
gcuguguuugagcucug

SEQ ID NO: 3846499 - RNA, 18 nt, Human
gcuguguuugcagccugc

SEQ ID NO: 3846500 - RNA, 16 nt, Human
gcuguguuugcucccc

SEQ ID NO: 3846501 - RNA, 23 nt, Human
gcuguguuuggcuuucagggagg

SEQ ID NO: 3846502 - RNA, 14 nt, Human
gcuguuaaacuguu

SEQ ID NO: 3846503 - RNA, 13 nt, Human
gcuguuaaauaca

SEQ ID NO: 3846504 - RNA, 16 nt, Human
gcuguuaaauacagga

SEQ ID NO: 3846505 - RNA, 19 nt, Human
gcuguuacaguuuucuuca

SEQ ID NO: 3846506 - RNA, 15 nt, Human
gcuguuaccauucac

SEQ ID NO: 3846507 - RNA, 17 nt, Human
gcuguuaccgccugucu

SEQ ID NO: 3846508 - RNA, 21 nt, Human
gcuguuaccgccugucucuuu

SEQ ID NO: 3846509 - RNA, 13 nt, Human
gcuguuagagucc

SEQ ID NO: 3846510 - RNA, 14 nt, Human
gcuguucagcuggu

SEQ ID NO: 3846511 - RNA, 12 nt, Human
gcuguucaugaa

SEQ ID NO: 3846512 - RNA, 22 nt, Human
gcuguucccauguagcccccug

SEQ ID NO: 3846513 - RNA, 14 nt, Human
gcuguucuagcacu

SEQ ID NO: 3846514 - RNA, 15 nt, Human
gcuguucugcacuga

SEQ ID NO: 3846515 - RNA, 21 nt, Human
gcuguucugugguuccucugc

SEQ ID NO: 3846516 - RNA, 13 nt, Human
gcuguugaaagca

SEQ ID NO: 3846517 - RNA, 14 nt, Human
gcuguugaaagcaa

SEQ ID NO: 3846518 - RNA, 17 nt, Human
gcuguugacauauuuaa

SEQ ID NO: 3846519 - RNA, 23 nt, Human
gcuguugacauauuuaauguuuu

SEQ ID NO: 3846520 - RNA, 22 nt, Human
gcuguugacucuaguacuguga

SEQ ID NO: 3846521 - RNA, 15 nt, Human
gcuguugagcuguuu

SEQ ID NO: 3846522 - RNA, 16 nt, Human
gcuguugauugcuaaa

SEQ ID NO: 3846523 - RNA, 13 nt, Human
gcuguugcaguga

SEQ ID NO: 3846524 - RNA, 13 nt, Human
gcuguugcugaau

SEQ ID NO: 3846525 - RNA, 14 nt, Human
gcuguugcugaaua

SEQ ID NO: 3846526 - RNA, 21 nt, Human
gcuguugcugauuuuauucuu

SEQ ID NO: 3846527 - RNA, 23 nt, Human
gcuguuggcacucacagaccugg

SEQ ID NO: 3846528 - RNA, 22 nt, Human
gcuguuggcagugagugagccu

SEQ ID NO: 3846529 - RNA, 20 nt, Human
uccacaguugccaccaccuc

SEQ ID NO: 3846530 - RNA, 13 nt, Human
uccacauccucca

SEQ ID NO: 3846531 - RNA, 19 nt, Human
uccacauccuccacguucu

SEQ ID NO: 3846532 - RNA, 15 nt, Human
uccacaucugccuua

SEQ ID NO: 3846533 - RNA, 14 nt, Human
uccacaugcucuga

SEQ ID NO: 3846534 - RNA, 14 nt, Human
uccacauuguuuua

SEQ ID NO: 3846535 - RNA, 14 nt, Human
uccacauuucuaaa

SEQ ID NO: 3846536 - RNA, 14 nt, Human
uccaccaccacugg

SEQ ID NO: 3846537 - RNA, 18 nt, Human
uccaccaccacuggccac

SEQ ID NO: 3846538 - RNA, 19 nt, Human
uccaccaccacuggccacc

SEQ ID NO: 3846539 - RNA, 13 nt, Human
uccaccacccaaa

SEQ ID NO: 3846540 - RNA, 13 nt, Human
uccaccaccgccc

SEQ ID NO: 3846541 - RNA, 22 nt, Human
uccaccaccgcccgucugugug

SEQ ID NO: 3846542 - RNA, 22 nt, Human
uccaccagcccauggcccugug

SEQ ID NO: 3846543 - RNA, 14 nt, Human
uccaccagccugca

SEQ ID NO: 3846544 - RNA, 15 nt, Human
uccaccagccugcac

SEQ ID NO: 3846545 - RNA, 16 nt, Human
uccaccagccugcacu

SEQ ID NO: 3846546 - RNA, 14 nt, Human
uccaccagucauuu

SEQ ID NO: 3846547 - RNA, 21 nt, Human
uccaccaugggguccuaccaa

SEQ ID NO: 3846548 - RNA, 23 nt, Human
uccaccaugggguccuaccaaua

SEQ ID NO: 3846549 - RNA, 19 nt, Human
uccacccaacccuaucucc

SEQ ID NO: 3846550 - RNA, 12 nt, Human
uccacccaccuc

SEQ ID NO: 3846551 - RNA, 17 nt, Human
uccacccaccuuggccu

SEQ ID NO: 3846552 - RNA, 13 nt, Human
uccacccagccca

SEQ ID NO: 3846553 - RNA, 12 nt, Human
uccacccaggag

SEQ ID NO: 3846554 - RNA, 12 nt, Human
uccacccagggg

SEQ ID NO: 3846555 - RNA, 20 nt, Human
uccacccauaauccuuucug

SEQ ID NO: 3846556 - RNA, 22 nt, Human
uccaccccaauccucccagaaa

SEQ ID NO: 3846557 - RNA, 13 nt, Human
uccaccccaggac

SEQ ID NO: 3846558 - RNA, 19 nt, Human
uccaccccaggacgccacu

SEQ ID NO: 3846559 - RNA, 23 nt, Human
uccaccccccagaaccuguccuu

SEQ ID NO: 3846560 - RNA, 18 nt, Human
uccacccccgccucccuc

SEQ ID NO: 3846561 - RNA, 15 nt, Human
uccacccccucccug

SEQ ID NO: 3846562 - RNA, 20 nt, Human
uccacccccucccuggccug

SEQ ID NO: 3846563 - RNA, 21 nt, Human
uccacccccucccuggccugu

SEQ ID NO: 3846564 - RNA, 14 nt, Human
uccacccuccaccu

SEQ ID NO: 3846565 - RNA, 14 nt, Human
uccacccucugagc

SEQ ID NO: 3846566 - RNA, 16 nt, Human
uccacccucugagcuu

SEQ ID NO: 3846567 - RNA, 14 nt, Human
uccacccugcucuc

SEQ ID NO: 3846568 - RNA, 21 nt, Human
uccacccugcucuccgaccag

SEQ ID NO: 3846569 - RNA, 12 nt, Human
uccacccuggaa

SEQ ID NO: 3846570 - RNA, 22 nt, Human
uccacccuggccgaguccaagc

SEQ ID NO: 3846571 - RNA, 16 nt, Human
uccacccuguccccca

SEQ ID NO: 3846572 - RNA, 17 nt, Human
uccacccugucccccag

SEQ ID NO: 3846573 - RNA, 22 nt, Human
uccacccugucccccagcucug

SEQ ID NO: 3846574 - RNA, 13 nt, Human
uccacccuuggcc

SEQ ID NO: 3846575 - RNA, 15 nt, Human
uccacccuuggccug

SEQ ID NO: 3846576 - RNA, 16 nt, Human
uccacccuuggccugu

SEQ ID NO: 3846577 - RNA, 15 nt, Human
uccaccgcagaagga

SEQ ID NO: 3846578 - RNA, 18 nt, Human
uccaccgcagaaggaagg

SEQ ID NO: 3846579 - RNA, 23 nt, Human
uccaccgucuuucuuuuauacug

SEQ ID NO: 3846580 - RNA, 17 nt, Human
uccaccuaguggcuguc

SEQ ID NO: 3846581 - RNA, 16 nt, Human
uccaccucaccccacu

SEQ ID NO: 3846582 - RNA, 11 nt, Human
uccaccucagc

SEQ ID NO: 3846583 - RNA, 14 nt, Human
uccaccucagccuu

SEQ ID NO: 3846584 - RNA, 17 nt, Human
uccaccucagccuugga

SEQ ID NO: 3846585 - RNA, 13 nt, Human
uccaccuccaucu

SEQ ID NO: 3846586 - RNA, 12 nt, Human
uccaccucccug

SEQ ID NO: 3846587 - RNA, 16 nt, Human
uccaccucccugcaau

SEQ ID NO: 3846588 - RNA, 18 nt, Human
uccaccucgacguuuaca

SEQ ID NO: 3846589 - RNA, 18 nt, Human
uccaccucuucacccccc

SEQ ID NO: 3846590 - RNA, 17 nt, Human
uccaccugagcugccau

SEQ ID NO: 3846591 - RNA, 12 nt, Human
uccaccugccag

SEQ ID NO: 3846592 - RNA, 16 nt, Human
uccaccugcucccagg

SEQ ID NO: 3846593 - RNA, 14 nt, Human
uccaccugcucugc

SEQ ID NO: 3846594 - RNA, 15 nt, Human
uccaccugcucugcu

SEQ ID NO: 3846595 - RNA, 21 nt, Human
uccaccugguacucccucuca

SEQ ID NO: 3846596 - RNA, 14 nt, Human
uccaccuuaaauua

SEQ ID NO: 3846597 - RNA, 16 nt, Human
uccaccuucccaugcc

SEQ ID NO: 3846598 - RNA, 17 nt, Human
uccacgacugucuccau

SEQ ID NO: 3846599 - RNA, 17 nt, Human
uccacgauccugccacc

SEQ ID NO: 3846600 - RNA, 19 nt, Human
uccacgcacaugcgacccc

SEQ ID NO: 3846601 - RNA, 15 nt, Human
uccacgcugucucca

SEQ ID NO: 3846602 - RNA, 13 nt, Human
uccacggacucaa

SEQ ID NO: 3846603 - RNA, 21 nt, Human
uccacggagccacuccucuga

SEQ ID NO: 3846604 - RNA, 17 nt, Human
uccacguacugcagccu

SEQ ID NO: 3846605 - RNA, 19 nt, Human
uccacguucugcucaucau

SEQ ID NO: 3846606 - RNA, 11 nt, Human
uccacuaaccc

SEQ ID NO: 3846607 - RNA, 15 nt, Human
uccacuagugcaaau

SEQ ID NO: 3846608 - RNA, 18 nt, Human
uccacuagugcaaaucau

SEQ ID NO: 3846609 - RNA, 22 nt, Human
uccacucagcuguccugcagca

SEQ ID NO: 3846610 - RNA, 17 nt, Human
uccacucaggucuguuu

SEQ ID NO: 3846611 - RNA, 12 nt, Human
uccacucccacu

SEQ ID NO: 3846612 - RNA, 13 nt, Human
uccacuccuuccu

SEQ ID NO: 3846613 - RNA, 18 nt, Human
uccgaaaccaaagaagaa

SEQ ID NO: 3846614 - RNA, 17 nt, Human
uccgaaaugcugucuuu

SEQ ID NO: 3846615 - RNA, 19 nt, Human
uccgaacacccucgaagcg

SEQ ID NO: 3846616 - RNA, 20 nt, Human
uccgacaaccgaugcuccag

SEQ ID NO: 3846617 - RNA, 20 nt, Human
uccgacagcccccucugccg

SEQ ID NO: 3846618 - RNA, 17 nt, Human
uccgaccagacaccuug

SEQ ID NO: 3846619 - RNA, 18 nt, Human
uccgacccucugggaacc

SEQ ID NO: 3846620 - RNA, 21 nt, Human
uccgacuugugcacaggcaga

SEQ ID NO: 3846621 - RNA, 12 nt, Human
uccgagaacuaa

SEQ ID NO: 3846622 - RNA, 24 nt, Human
uccgagccggggaguuucuuuccu

SEQ ID NO: 3846623 - RNA, 13 nt, Human
uccgaggcagggu

SEQ ID NO: 3846624 - RNA, 15 nt, Human
uccgaggggcgggac

SEQ ID NO: 3846625 - RNA, 12 nt, Human
uccgagugguga

SEQ ID NO: 3846626 - RNA, 15 nt, Human
uccgauccuuccucc

SEQ ID NO: 3846627 - RNA, 15 nt, Human
uccgaugaauucuua

SEQ ID NO: 3846628 - RNA, 15 nt, Human
uccgccacuggggcu

SEQ ID NO: 3846629 - RNA, 14 nt, Human
uccgccagccuccu

SEQ ID NO: 3846630 - RNA, 16 nt, Human
uccgccagccuccucu

SEQ ID NO: 3846631 - RNA, 18 nt, Human
uccgccagccuccucugg

SEQ ID NO: 3846632 - RNA, 20 nt, Human
uccgccagccuccucuggac

SEQ ID NO: 3846633 - RNA, 21 nt, Human
uccgcccacaggaagccugca

SEQ ID NO: 3846634 - RNA, 16 nt, Human
uccgcccccagccuau

SEQ ID NO: 3846635 - RNA, 16 nt, Human
uccgcccccagguagg

SEQ ID NO: 3846636 - RNA, 14 nt, Human
uccgccccugagcc

SEQ ID NO: 3846637 - RNA, 21 nt, Human
uccgccccugagcccacugug

SEQ ID NO: 3846638 - RNA, 16 nt, Human
uccgccccugccugcc

SEQ ID NO: 3846639 - RNA, 22 nt, Human
uccgcccucaaaaugacagcca

SEQ ID NO: 3846640 - RNA, 13 nt, Human
uccgcccugccac

SEQ ID NO: 3846641 - RNA, 14 nt, Human
uccgcccugcuccu

SEQ ID NO: 3846642 - RNA, 19 nt, Human
uccgcccuuagucccccaa

SEQ ID NO: 3846643 - RNA, 14 nt, Human
uccgccucuugggu

SEQ ID NO: 3846644 - RNA, 19 nt, Human
uccgccuuaccaggagaag

SEQ ID NO: 3846645 - RNA, 11 nt, Human
uccgccuucac

SEQ ID NO: 3846646 - RNA, 13 nt, Human
uccgccuuuugua

SEQ ID NO: 3846647 - RNA, 18 nt, Human
uccgccuuuuguauacau

SEQ ID NO: 3846648 - RNA, 18 nt, Human
uccgcgugugccugugug

SEQ ID NO: 3846649 - RNA, 20 nt, Human
uccgcuccccugcuccuguc

SEQ ID NO: 3846650 - RNA, 13 nt, Human
uccgcucucuucc

SEQ ID NO: 3846651 - RNA, 16 nt, Human
uccgcugccagccuug

SEQ ID NO: 3846652 - RNA, 12 nt, Human
uccgcugcuccu

SEQ ID NO: 3846653 - RNA, 12 nt, Human
uccgcuucccug

SEQ ID NO: 3846654 - RNA, 13 nt, Human
uccgcuucccugg

SEQ ID NO: 3846655 - RNA, 18 nt, Human
uccgcuuucuacccagcg

SEQ ID NO: 3846656 - RNA, 20 nt, Human
uccgcuuucuacccagcgag

SEQ ID NO: 3846657 - RNA, 17 nt, Human
uccggaaugccacccac

SEQ ID NO: 3846658 - RNA, 16 nt, Human
uccggacuggugcccu

SEQ ID NO: 3846659 - RNA, 21 nt, Human
uccggaggagaagaaggaaau

SEQ ID NO: 3846660 - RNA, 16 nt, Human
uccggauuuaauuuga

SEQ ID NO: 3846661 - RNA, 22 nt, Human
uccggccaggugccuccugaca

SEQ ID NO: 3846662 - RNA, 14 nt, Human
uccggcccuccaga

SEQ ID NO: 3846663 - RNA, 21 nt, Human
uccggcccuccuacccugcgc

SEQ ID NO: 3846664 - RNA, 14 nt, Human
uccggccuccccuc

SEQ ID NO: 3846665 - RNA, 18 nt, Human
uccggccucugccuuugc

SEQ ID NO: 3846666 - RNA, 15 nt, Human
uccggcuaagcaggc

SEQ ID NO: 3846667 - RNA, 16 nt, Human
uccggcuaagcaggcg

SEQ ID NO: 3846668 - RNA, 16 nt, Human
uccggcuccugugcuu

SEQ ID NO: 3846669 - RNA, 22 nt, Human
uccggcuccugugcuuucccug

SEQ ID NO: 3846670 - RNA, 21 nt, Human
uccgggcaaaugccagggccc

SEQ ID NO: 3846671 - RNA, 15 nt, Human
uccggggccagcucc

SEQ ID NO: 3846672 - RNA, 22 nt, Human
uccggguuugagauggacacac

SEQ ID NO: 3846673 - RNA, 19 nt, Human
uccgguagggaggcagccu

SEQ ID NO: 3846674 - RNA, 18 nt, Human
uccgguggaaggccuucu

SEQ ID NO: 3846675 - RNA, 12 nt, Human
uccggugugccu

SEQ ID NO: 3846676 - RNA, 17 nt, Human
uccggugugccugcagc

SEQ ID NO: 3846677 - RNA, 18 nt, Human
uccggugugccugcagcc

SEQ ID NO: 3846678 - RNA, 19 nt, Human
uccggugugccugcagccc

SEQ ID NO: 3846679 - RNA, 22 nt, Human
uccguaacccaacucuccugga

SEQ ID NO: 3846680 - RNA, 20 nt, Human
uccguaauaacacccuuccu

SEQ ID NO: 3846681 - RNA, 20 nt, Human
uccguagccagcugcucccc

SEQ ID NO: 3846682 - RNA, 21 nt, Human
uccguagccagcugcucccca

SEQ ID NO: 3846683 - RNA, 22 nt, Human
uccguagguagauguguaaccu

SEQ ID NO: 3846684 - RNA, 14 nt, Human
uccguauuucagac

SEQ ID NO: 3846685 - RNA, 15 nt, Human
uccguauuucagacu

SEQ ID NO: 3846686 - RNA, 17 nt, Human
uccgucacuaccuggcu

SEQ ID NO: 3846687 - RNA, 17 nt, Human
uccgucagaaaguguaa

SEQ ID NO: 3846688 - RNA, 22 nt, Human
uccgucuaagucaugagcugag

SEQ ID NO: 3846689 - RNA, 23 nt, Human
uccgucuaguuaacauuucaagg

SEQ ID NO: 3846690 - RNA, 20 nt, Human
uccgucucccccguguuccc

SEQ ID NO: 3846691 - RNA, 18 nt, Human
uccgugaaaacggagcug

SEQ ID NO: 3846692 - RNA, 18 nt, Human
uccgugcugacagcugcu

SEQ ID NO: 3846693 - RNA, 22 nt, Human
uccguggaggagguugggaggg

SEQ ID NO: 3846694 - RNA, 17 nt, Human
uccgugggacggugccc

SEQ ID NO: 3846695 - RNA, 20 nt, Human
uccagaggguugugauuuug

SEQ ID NO: 3846696 - RNA, 15 nt, Human
uccagagucccugcc

SEQ ID NO: 3846697 - RNA, 21 nt, Human
uccagagucccugccuggacc

SEQ ID NO: 3846698 - RNA, 17 nt, Human
uccagaucacugccaca

SEQ ID NO: 3846699 - RNA, 16 nt, Human
uccagauccuggaaau

SEQ ID NO: 3846700 - RNA, 17 nt, Human
uccagaucuuucagaaa

SEQ ID NO: 3846701 - RNA, 16 nt, Human
uccagaugcagggcag

SEQ ID NO: 3846702 - RNA, 19 nt, Human
uccagaugcagggcaguca

SEQ ID NO: 3846703 - RNA, 17 nt, Human
uccagauuagagccugu

SEQ ID NO: 3846704 - RNA, 19 nt, Human
uccagauuaucuauuugug

SEQ ID NO: 3846705 - RNA, 16 nt, Human
uccagauuuacacugg

SEQ ID NO: 3846706 - RNA, 19 nt, Human
uccagauuuuucggaggcc

SEQ ID NO: 3846707 - RNA, 17 nt, Human
uccagcaacacagccug

SEQ ID NO: 3846708 - RNA, 21 nt, Human
uccagcaacacagccugggcc

SEQ ID NO: 3846709 - RNA, 22 nt, Human
uccagcaacacagccugggccc

SEQ ID NO: 3846710 - RNA, 19 nt, Human
uccagcaacuucuucucca

SEQ ID NO: 3846711 - RNA, 19 nt, Human
uccagcaauucuccugccu

SEQ ID NO: 3846712 - RNA, 22 nt, Human
uccagcaauucuccugccucag

SEQ ID NO: 3846713 - RNA, 14 nt, Human
uccagcacaaacac

SEQ ID NO: 3846714 - RNA, 15 nt, Human
uccagcacaaacaca

SEQ ID NO: 3846715 - RNA, 15 nt, Human
uccagcaccuugugc

SEQ ID NO: 3846716 - RNA, 18 nt, Human
uccagcaccuugugccug

SEQ ID NO: 3846717 - RNA, 23 nt, Human
uccagcagaagacaaaaagacaa

SEQ ID NO: 3846718 - RNA, 14 nt, Human
uccagcagauuauu

SEQ ID NO: 3846719 - RNA, 12 nt, Human
uccagcaggagg

SEQ ID NO: 3846720 - RNA, 17 nt, Human
uccagcaggagggacag

SEQ ID NO: 3846721 - RNA, 13 nt, Human
uccagcaggccca

SEQ ID NO: 3846722 - RNA, 20 nt, Human
uccagcagucacuucggcca

SEQ ID NO: 3846723 - RNA, 17 nt, Human
uccagcauucccaggua

SEQ ID NO: 3846724 - RNA, 20 nt, Human
uccagcauuuagcuggccac

SEQ ID NO: 3846725 - RNA, 14 nt, Human
uccagccaaccccu

SEQ ID NO: 3846726 - RNA, 10 nt, Human
uccagccagc

SEQ ID NO: 3846727 - RNA, 23 nt, Human
uccagccagcaaugauguccaga

SEQ ID NO: 3846728 - RNA, 12 nt, Human
uccagccagcgc

SEQ ID NO: 3846729 - RNA, 19 nt, Human
uccagccagcgccucccuc

SEQ ID NO: 3846730 - RNA, 14 nt, Human
uccagccagggcug

SEQ ID NO: 3846731 - RNA, 15 nt, Human
uccagccagggcugc

SEQ ID NO: 3846732 - RNA, 17 nt, Human
uccagccagggcugcua

SEQ ID NO: 3846733 - RNA, 21 nt, Human
uccagccaucaagagacugag

SEQ ID NO: 3846734 - RNA, 15 nt, Human
uccagccaucucaug

SEQ ID NO: 3846735 - RNA, 15 nt, Human
uccagcccacauugg

SEQ ID NO: 3846736 - RNA, 15 nt, Human
uccagccccucuggu

SEQ ID NO: 3846737 - RNA, 13 nt, Human
uccagccccugga

SEQ ID NO: 3846738 - RNA, 19 nt, Human
uccagccccuggaugcagc

SEQ ID NO: 3846739 - RNA, 22 nt, Human
uccagccccuggaugcagccuc

SEQ ID NO: 3846740 - RNA, 13 nt, Human
uccagccccuguc

SEQ ID NO: 3846741 - RNA, 14 nt, Human
uccagccccugucc

SEQ ID NO: 3846742 - RNA, 21 nt, Human
uccagccccuucucagaaucu

SEQ ID NO: 3846743 - RNA, 15 nt, Human
uccagcccgggagcc

SEQ ID NO: 3846744 - RNA, 20 nt, Human
uccagcccgggagccuagga

SEQ ID NO: 3846745 - RNA, 21 nt, Human
uccagcccgggagccuaggac

SEQ ID NO: 3846746 - RNA, 20 nt, Human
uccagcccugaguuccuagc

SEQ ID NO: 3846747 - RNA, 22 nt, Human
uccagcccugaguuccuagcca

SEQ ID NO: 3846748 - RNA, 17 nt, Human
uccagcccuggcugaag

SEQ ID NO: 3846749 - RNA, 20 nt, Human
uccagcccuggcugaaggac

SEQ ID NO: 3846750 - RNA, 21 nt, Human
uccagcccuggcugaaggacu

SEQ ID NO: 3846751 - RNA, 14 nt, Human
uccagccucagcuc

SEQ ID NO: 3846752 - RNA, 16 nt, Human
uccagccucuguuccc

SEQ ID NO: 3846753 - RNA, 13 nt, Human
uccagccugacau

SEQ ID NO: 3846754 - RNA, 21 nt, Human
uccagccugacaucaaaaaag

SEQ ID NO: 3846755 - RNA, 21 nt, Human
uccagccugagcgacagugag

SEQ ID NO: 3846756 - RNA, 11 nt, Human
uccagccugcc

SEQ ID NO: 3846757 - RNA, 20 nt, Human
uccagccugcccaagcccag

SEQ ID NO: 3846758 - RNA, 15 nt, Human
ucccaauuaggaagu

SEQ ID NO: 3846759 - RNA, 20 nt, Human
ucccaauucauccucacuca

SEQ ID NO: 3846760 - RNA, 16 nt, Human
ucccaauugagaaaaa

SEQ ID NO: 3846761 - RNA, 23 nt, Human
ucccaauuucagacucccauucc

SEQ ID NO: 3846762 - RNA, 21 nt, Human
ucccacaagccugagggaaag

SEQ ID NO: 3846763 - RNA, 17 nt, Human
ucccacacccaaagcug

SEQ ID NO: 3846764 - RNA, 13 nt, Human
ucccacacccugg

SEQ ID NO: 3846765 - RNA, 15 nt, Human
ucccacaccuccaca

SEQ ID NO: 3846766 - RNA, 17 nt, Human
ucccacaccuccacagu

SEQ ID NO: 3846767 - RNA, 22 nt, Human
ucccacacugcuaggugggcca

SEQ ID NO: 3846768 - RNA, 16 nt, Human
ucccacagccacgugu

SEQ ID NO: 3846769 - RNA, 23 nt, Human
ucccacagugacucgggcuccug

SEQ ID NO: 3846770 - RNA, 22 nt, Human
ucccacauccaacuccagcaac

SEQ ID NO: 3846771 - RNA, 20 nt, Human
ucccacaucccugggccugc

SEQ ID NO: 3846772 - RNA, 22 nt, Human
ucccacauuaaagaagaccuga

SEQ ID NO: 3846773 - RNA, 15 nt, Human
ucccaccacagcagg

SEQ ID NO: 3846774 - RNA, 15 nt, Human
ucccaccacccugag

SEQ ID NO: 3846775 - RNA, 19 nt, Human
ucccacccaauucaaaaca

SEQ ID NO: 3846776 - RNA, 18 nt, Human
ucccacccacaugugaca

SEQ ID NO: 3846777 - RNA, 12 nt, Human
ucccacccaccg

SEQ ID NO: 3846778 - RNA, 16 nt, Human
ucccaccccacccccu

SEQ ID NO: 3846779 - RNA, 22 nt, Human
ucccaccccacccccuucagug

SEQ ID NO: 3846780 - RNA, 22 nt, Human
ucccacccccuucucugcucca

SEQ ID NO: 3846781 - RNA, 13 nt, Human
ucccaccccuccc

SEQ ID NO: 3846782 - RNA, 21 nt, Human
ucccacccucuuccuacuggu

SEQ ID NO: 3846783 - RNA, 13 nt, Human
ucccacccuguuc

SEQ ID NO: 3846784 - RNA, 16 nt, Human
ucccaccuagcagcac

SEQ ID NO: 3846785 - RNA, 13 nt, Human
ucccaccucagcc

SEQ ID NO: 3846786 - RNA, 14 nt, Human
ucccaccucagccu

SEQ ID NO: 3846787 - RNA, 15 nt, Human
ucccaccucagccuc

SEQ ID NO: 3846788 - RNA, 16 nt, Human
ucccaccucagccucc

SEQ ID NO: 3846789 - RNA, 18 nt, Human
ucccaccucagccucccg

SEQ ID NO: 3846790 - RNA, 13 nt, Human
ucccaccuccagc

SEQ ID NO: 3846791 - RNA, 22 nt, Human
ucccaccuccagcccgggagcc

SEQ ID NO: 3846792 - RNA, 15 nt, Human
ucccaccuccauccc

SEQ ID NO: 3846793 - RNA, 23 nt, Human
ucccaccucccccucccccuucu

SEQ ID NO: 3846794 - RNA, 14 nt, Human
ucccaccucccugc

SEQ ID NO: 3846795 - RNA, 20 nt, Human
ucccaccucccugcccaggc

SEQ ID NO: 3846796 - RNA, 20 nt, Human
ucccaccuccugacacccuu

SEQ ID NO: 3846797 - RNA, 11 nt, Human
ucccaccucug

SEQ ID NO: 3846798 - RNA, 13 nt, Human
ucccaccucugug

SEQ ID NO: 3846799 - RNA, 20 nt, Human
ucccaccucugugaccucag

SEQ ID NO: 3846800 - RNA, 15 nt, Human
ucccaccuggcucug

SEQ ID NO: 3846801 - RNA, 19 nt, Human
ucccaccuggcucuguggc

SEQ ID NO: 3846802 - RNA, 16 nt, Human
ucccaccuuggcugca

SEQ ID NO: 3846803 - RNA, 15 nt, Human
ucccacgaauuugcu

SEQ ID NO: 3846804 - RNA, 18 nt, Human
ucccacgaauuugcuggg

SEQ ID NO: 3846805 - RNA, 15 nt, Human
ucccacggccuuucu

SEQ ID NO: 3846806 - RNA, 14 nt, Human
ucccacgugggaga

SEQ ID NO: 3846807 - RNA, 18 nt, Human
ucccacgugucuuccacu

SEQ ID NO: 3846808 - RNA, 14 nt, Human
ucccacucagucca

SEQ ID NO: 3846809 - RNA, 12 nt, Human
ucccacuccaag

SEQ ID NO: 3846810 - RNA, 13 nt, Human
ucccacuccaagc

SEQ ID NO: 3846811 - RNA, 19 nt, Human
ucccacuccaagccagcaa

SEQ ID NO: 3846812 - RNA, 17 nt, Human
ucccacuccaagcccag

SEQ ID NO: 3846813 - RNA, 22 nt, Human
ucccacucuagggcaguggagu

SEQ ID NO: 3846814 - RNA, 15 nt, Human
ucccacucuucucau

SEQ ID NO: 3846815 - RNA, 21 nt, Human
ucccacugcacccccuccugc

SEQ ID NO: 3846816 - RNA, 15 nt, Human
ucccacuucugccag

SEQ ID NO: 3846817 - RNA, 23 nt, Human
ucccacuuggcaucagcuggcgu

SEQ ID NO: 3846818 - RNA, 13 nt, Human
ucccacuuggcca

SEQ ID NO: 3846819 - RNA, 23 nt, Human
ucccacuuggccaagcagggagg

SEQ ID NO: 3846820 - RNA, 12 nt, Human
ucccacuuguca

SEQ ID NO: 3846821 - RNA, 23 nt, Human
ucccacuuugcuguuccuuacuu

SEQ ID NO: 3846822 - RNA, 16 nt, Human
ucccacuuuugccaga

SEQ ID NO: 3846823 - RNA, 19 nt, Human
ucccagaacacacuccauc

SEQ ID NO: 3846824 - RNA, 18 nt, Human
ucccagaaggaccuccug

SEQ ID NO: 3846825 - RNA, 19 nt, Human
ucccagaaucaaagcaaug

SEQ ID NO: 3846826 - RNA, 22 nt, Human
ucccagaaucaaagcaaugcau

SEQ ID NO: 3846827 - RNA, 23 nt, Human
ucccagaaucaaagcaaugcauu

SEQ ID NO: 3846828 - RNA, 18 nt, Human
ucccagacacccacccuc

SEQ ID NO: 3846829 - RNA, 22 nt, Human
ucccagaccugccucuuccccc

SEQ ID NO: 3846830 - RNA, 15 nt, Human
ucccagagagcccga

SEQ ID NO: 3846831 - RNA, 12 nt, Human
ucccagagcagg

SEQ ID NO: 3846832 - RNA, 21 nt, Human
ucccagagcaggaggccccug

SEQ ID NO: 3846833 - RNA, 21 nt, Human
ucccagagcugguggacccag

SEQ ID NO: 3846834 - RNA, 17 nt, Human
ucccagaggcugcccca

SEQ ID NO: 3846835 - RNA, 19 nt, Human
ucccagaggggccugccac

SEQ ID NO: 3846836 - RNA, 22 nt, Human
ucccagaggggccugccaccug

SEQ ID NO: 3846837 - RNA, 13 nt, Human
ucccagaggucca

SEQ ID NO: 3846838 - RNA, 16 nt, Human
ucccagagguccagcc

SEQ ID NO: 3846839 - RNA, 19 nt, Human
ucccagagguccagcccau

SEQ ID NO: 3846840 - RNA, 23 nt, Human
ucccagagguccagcccaucucg

SEQ ID NO: 3846841 - RNA, 15 nt, Human
ucccagagugcuggg

SEQ ID NO: 3846842 - RNA, 12 nt, Human
ucccagaguuug

SEQ ID NO: 3846843 - RNA, 16 nt, Human
ucccagauacuugggg

SEQ ID NO: 3846844 - RNA, 21 nt, Human
ucccagauuggcucacacuga

SEQ ID NO: 3846845 - RNA, 12 nt, Human
ucccagcaauuu

SEQ ID NO: 3846846 - RNA, 22 nt, Human
ucccagcacuaugcuuuccuuc

SEQ ID NO: 3846847 - RNA, 13 nt, Human
ucccagcacuuug

SEQ ID NO: 3846848 - RNA, 21 nt, Human
ucccagcacuuugggaggccu

SEQ ID NO: 3846849 - RNA, 15 nt, Human
ucccagcagccagcc

SEQ ID NO: 3846850 - RNA, 16 nt, Human
ucccagcagccagcca

SEQ ID NO: 3846851 - RNA, 13 nt, Human
ucccagcagcccu

SEQ ID NO: 3846852 - RNA, 17 nt, Human
ucccagcaucgcacucu

SEQ ID NO: 3846853 - RNA, 12 nt, Human
ucccagccaccc

SEQ ID NO: 3846854 - RNA, 16 nt, Human
ucccagccacucggga

SEQ ID NO: 3846855 - RNA, 20 nt, Human
ucccagccacucgggaggcu

SEQ ID NO: 3846856 - RNA, 13 nt, Human
ucccagccaggcc

SEQ ID NO: 3846857 - RNA, 15 nt, Human
ucccagcccaaagcu

SEQ ID NO: 3846858 - RNA, 18 nt, Human
ucccagcccaauccaggu

SEQ ID NO: 3846859 - RNA, 12 nt, Human
ucccagccccaa

SEQ ID NO: 3846860 - RNA, 14 nt, Human
ucccagcccccuga

SEQ ID NO: 3846861 - RNA, 21 nt, Human
ucccagccggccaauggaaac

SEQ ID NO: 3846862 - RNA, 15 nt, Human
ucccagccucagcgc

SEQ ID NO: 3846863 - RNA, 13 nt, Human
ucccagccuuggc

SEQ ID NO: 3846864 - RNA, 19 nt, Human
ucccagcggcuggugcagg

SEQ ID NO: 3846865 - RNA, 20 nt, Human
ucccagcggcuggugcaggg

SEQ ID NO: 3846866 - RNA, 21 nt, Human
ucccagcggcuggugcagggc

SEQ ID NO: 3846867 - RNA, 16 nt, Human
ucccagcuaccucaac

SEQ ID NO: 3846868 - RNA, 13 nt, Human
ucccagcuacuca

SEQ ID NO: 3846869 - RNA, 21 nt, Human
ucccagcuacucagaagccug

SEQ ID NO: 3846870 - RNA, 15 nt, Human
ucccagcuacucagg

SEQ ID NO: 3846871 - RNA, 16 nt, Human
ucccagcuacucggga

SEQ ID NO: 3846872 - RNA, 23 nt, Human
ucccagcuacucgggaggcugag

SEQ ID NO: 3846873 - RNA, 17 nt, Human
ucccagcuacuugggag

SEQ ID NO: 3846874 - RNA, 18 nt, Human
ucccagcuacuugggagg

SEQ ID NO: 3846875 - RNA, 16 nt, Human
ucccagcuaggaagag

SEQ ID NO: 3846876 - RNA, 10 nt, Human
ucccagcucc

SEQ ID NO: 3846877 - RNA, 14 nt, Human
ucccagcuccaccc

SEQ ID NO: 3846878 - RNA, 20 nt, Human
ucccagcucuagacaacccu

SEQ ID NO: 3846879 - RNA, 21 nt, Human
ucccagcucuagacaacccug

SEQ ID NO: 3846880 - RNA, 14 nt, Human
ucccagcucucccu

SEQ ID NO: 3846881 - RNA, 16 nt, Human
ucccagcucucccucu

SEQ ID NO: 3846882 - RNA, 22 nt, Human
ucccagcucucccucuggcccu

SEQ ID NO: 3846883 - RNA, 17 nt, Human
ucccagcugaaauacug

SEQ ID NO: 3846884 - RNA, 16 nt, Human
ucccagcugacagucc

SEQ ID NO: 3846885 - RNA, 17 nt, Human
ucccagcugacaguccu

SEQ ID NO: 3846886 - RNA, 18 nt, Human
ucccagcugccauguuuc

SEQ ID NO: 3846887 - RNA, 19 nt, Human
ucccagcugccccucccug

SEQ ID NO: 3846888 - RNA, 14 nt, Human
ucccagcugucugu

SEQ ID NO: 3846889 - RNA, 22 nt, Human
ucccagcugucugugucagccu

SEQ ID NO: 3846890 - RNA, 21 nt, Human
ucccagcugugcucuggacag

SEQ ID NO: 3846891 - RNA, 23 nt, Human
ucccagcugugcucuggacaggc

SEQ ID NO: 3846892 - RNA, 18 nt, Human
ucccagcuuguaggagcu

SEQ ID NO: 3846893 - RNA, 15 nt, Human
ucccaggaagcccag

SEQ ID NO: 3846894 - RNA, 19 nt, Human
ucccaggacaccacaccca

SEQ ID NO: 3846895 - RNA, 21 nt, Human
ucccaggacaccacacccagc

SEQ ID NO: 3846896 - RNA, 22 nt, Human
ucccaggacaccacacccagcc

SEQ ID NO: 3846897 - RNA, 19 nt, Human
ucccaggaccacaggcuca

SEQ ID NO: 3846898 - RNA, 23 nt, Human
ucccaggaccacaggcucaggca

SEQ ID NO: 3846899 - RNA, 22 nt, Human
uccugaugacccaggcugccug

SEQ ID NO: 3846900 - RNA, 19 nt, Human
uccugaugcuucuucagag

SEQ ID NO: 3846901 - RNA, 20 nt, Human
uccugauggucagcucccuu

SEQ ID NO: 3846902 - RNA, 19 nt, Human
ggaagggguuccucaaauu

SEQ ID NO: 3846903 - RNA, 15 nt, Human
ggaaggguaaacaau

SEQ ID NO: 3846904 - RNA, 15 nt, Human
ggaaggguuucucua

SEQ ID NO: 3846905 - RNA, 18 nt, Human
ggaaggguuuguggcugg

SEQ ID NO: 3846906 - RNA, 16 nt, Human
ggaagguggggacagg

SEQ ID NO: 3846907 - RNA, 13 nt, Human
ggaaguaguuauc

SEQ ID NO: 3846908 - RNA, 16 nt, Human
ggaaguaguuaucaug

SEQ ID NO: 3846909 - RNA, 13 nt, Human
ggaaguccucugg

SEQ ID NO: 3846910 - RNA, 19 nt, Human
ggaaguccuuaucuagcug

SEQ ID NO: 3846911 - RNA, 18 nt, Human
ggaagugacaaggcccca

SEQ ID NO: 3846912 - RNA, 20 nt, Human
ggaagugacgguuuaauggg

SEQ ID NO: 3846913 - RNA, 21 nt, Human
ggaaguguaacagcugagguc

SEQ ID NO: 3846914 - RNA, 20 nt, Human
uccugggcgcccuggaagcc

SEQ ID NO: 3846915 - RNA, 20 nt, Human
uccugggcuuuuguuuugcu

SEQ ID NO: 3846916 - RNA, 18 nt, Human
uccuggggaaccugaccc

SEQ ID NO: 3846917 - RNA, 12 nt, Human
uccuggggccag

SEQ ID NO: 3846918 - RNA, 22 nt, Human
uccuggggcccaaaugcuggcu

SEQ ID NO: 3846919 - RNA, 13 nt, Human
uccuggggccucg

SEQ ID NO: 3846920 - RNA, 22 nt, Human
uccuggggccucggagccucau

SEQ ID NO: 3846921 - RNA, 18 nt, Human
uccuggggcucugugcag

SEQ ID NO: 3846922 - RNA, 11 nt, Human
uccugggggcc

SEQ ID NO: 3846923 - RNA, 23 nt, Human
uccugggggccuggguugggggc

SEQ ID NO: 3846924 - RNA, 23 nt, Human
uccuggggguucuuucuuccucu

SEQ ID NO: 3846925 - RNA, 23 nt, Human
uccugggguauaaaacuuuccuc

SEQ ID NO: 3846926 - RNA, 22 nt, Human
uccuggggugcccuccacugcc

SEQ ID NO: 3846927 - RNA, 14 nt, Human
uccuggguaaugag

SEQ ID NO: 3846928 - RNA, 13 nt, Human
uccuggguggcua

SEQ ID NO: 3846929 - RNA, 24 nt, Human
uccuggguggcuacucugugccag

SEQ ID NO: 3846930 - RNA, 21 nt, Human
uccuggguuuuguauucucug

SEQ ID NO: 3846931 - RNA, 15 nt, Human
uccugguacccagcc

SEQ ID NO: 3846932 - RNA, 16 nt, Human
uccugguacccagcca

SEQ ID NO: 3846933 - RNA, 13 nt, Human
uccugguagaaua

SEQ ID NO: 3846934 - RNA, 17 nt, Human
uccuggucaccuaggaa

SEQ ID NO: 3846935 - RNA, 23 nt, Human
uccugguccccucagcucugccu

SEQ ID NO: 3846936 - RNA, 17 nt, Human
uccuggucuugagaugu

SEQ ID NO: 3846937 - RNA, 20 nt, Human
uccuggugccaauuucaagu

SEQ ID NO: 3846938 - RNA, 12 nt, Human
uccuggugcccu

SEQ ID NO: 3846939 - RNA, 18 nt, Human
uccuggugcucucugcca

SEQ ID NO: 3846940 - RNA, 19 nt, Human
uccuggugcucucugccac

SEQ ID NO: 3846941 - RNA, 19 nt, Human
uccugguggggcagcuccu

SEQ ID NO: 3846942 - RNA, 21 nt, Human
uccugguggggcagcuccucu

SEQ ID NO: 3846943 - RNA, 16 nt, Human
uccugguggguccagg

SEQ ID NO: 3846944 - RNA, 16 nt, Human
uccuggugguauuuuc

SEQ ID NO: 3846945 - RNA, 22 nt, Human
uccugguuucauaacuuccugu

SEQ ID NO: 3846946 - RNA, 23 nt, Human
uccugguuucauaacuuccugua

SEQ ID NO: 3846947 - RNA, 22 nt, Human
uccuguaaaaaaaaaaaaguua

SEQ ID NO: 3846948 - RNA, 10 nt, Human
uccuguaaac

SEQ ID NO: 3846949 - RNA, 20 nt, Human
uccuguaaaugguguacaua

SEQ ID NO: 3846950 - RNA, 18 nt, Human
uccuguaacuguuacagu

SEQ ID NO: 3846951 - RNA, 23 nt, Human
uccuguaagccaaagaaaugaac

SEQ ID NO: 3846952 - RNA, 15 nt, Human
uccuguaauuccuac

SEQ ID NO: 3846953 - RNA, 16 nt, Human
uccuguacacugaaua

SEQ ID NO: 3846954 - RNA, 14 nt, Human
uccuguagcaucuu

SEQ ID NO: 3846955 - RNA, 17 nt, Human
uccuguagcaucuucug

SEQ ID NO: 3846956 - RNA, 13 nt, Human
uccuguagcccua

SEQ ID NO: 3846957 - RNA, 22 nt, Human
uccuguaggaagguacuguaug

SEQ ID NO: 3846958 - RNA, 22 nt, Human
uccuguaguugcguggacucug

SEQ ID NO: 3846959 - RNA, 23 nt, Human
uccuguaguugcguggacucugc

SEQ ID NO: 3846960 - RNA, 22 nt, Human
uccuguauaagcacugaaaaac

SEQ ID NO: 3846961 - RNA, 15 nt, Human
uccuguaugucuguc

SEQ ID NO: 3846962 - RNA, 15 nt, Human
uccuguauucacccg

SEQ ID NO: 3846963 - RNA, 22 nt, Human
uccuguauuuguucccaagagc

SEQ ID NO: 3846964 - RNA, 12 nt, Human
uccugucagugc

SEQ ID NO: 3846965 - RNA, 14 nt, Human
uccuguccagagag

SEQ ID NO: 3846966 - RNA, 13 nt, Human
uccuguccagcuc

SEQ ID NO: 3846967 - RNA, 14 nt, Human
uccuguccagcucc

SEQ ID NO: 3846968 - RNA, 17 nt, Human
uccuguccccaucuguc

SEQ ID NO: 3846969 - RNA, 19 nt, Human
uccugucccucauccauag

SEQ ID NO: 3846970 - RNA, 16 nt, Human
uccuguccucagcuuc

SEQ ID NO: 3846971 - RNA, 15 nt, Human
uccuguccucuuuca

SEQ ID NO: 3846972 - RNA, 17 nt, Human
uccuguccucuuucagc

SEQ ID NO: 3846973 - RNA, 19 nt, Human
uccuguccucuuucagcuc

SEQ ID NO: 3846974 - RNA, 22 nt, Human
uccugucggagcccugucuccu

SEQ ID NO: 3846975 - RNA, 18 nt, Human
uccugucuccccucugcu

SEQ ID NO: 3846976 - RNA, 15 nt, Human
uccugucucuggccu

SEQ ID NO: 3846977 - RNA, 22 nt, Human
uccugucugccagccagcagcc

SEQ ID NO: 3846978 - RNA, 13 nt, Human
uccugucuguuca

SEQ ID NO: 3846979 - RNA, 21 nt, Human
uccugucuuauccuccaccgu

SEQ ID NO: 3846980 - RNA, 15 nt, Human
uccugucuuccugca

SEQ ID NO: 3846981 - RNA, 14 nt, Human
uccugucuucugcu

SEQ ID NO: 3846982 - RNA, 15 nt, Human
uccugucuucugcuu

SEQ ID NO: 3846983 - RNA, 21 nt, Human
uccugucuuuaaagccugccu

SEQ ID NO: 3846984 - RNA, 17 nt, Human
uccugucuuuaaggaaa

SEQ ID NO: 3846985 - RNA, 19 nt, Human
uccugucuuuaaggaaaaa

SEQ ID NO: 3846986 - RNA, 15 nt, Human
uccugucuuucugag

SEQ ID NO: 3846987 - RNA, 22 nt, Human
uccugucuuucugagcacacuu

SEQ ID NO: 3846988 - RNA, 18 nt, Human
uccugugacauguaacag

SEQ ID NO: 3846989 - RNA, 17 nt, Human
uccugugagauguguau

SEQ ID NO: 3846990 - RNA, 13 nt, Human
uccugugcacagc

SEQ ID NO: 3846991 - RNA, 15 nt, Human
uccugugcaugggug

SEQ ID NO: 3846992 - RNA, 18 nt, Human
uccugugcaugggugaag

SEQ ID NO: 3846993 - RNA, 19 nt, Human
uccugugccuccaucagcu

SEQ ID NO: 3846994 - RNA, 18 nt, Human
uccugugcucagcccuga

SEQ ID NO: 3846995 - RNA, 22 nt, Human
uccuguggaacccagcaguucu

SEQ ID NO: 3846996 - RNA, 21 nt, Human
uccuguggaaggcagagaaau

SEQ ID NO: 3846997 - RNA, 22 nt, Human
uccuguggaaggcagagaaauc

SEQ ID NO: 3846998 - RNA, 18 nt, Human
uccuguggagaugacuug

SEQ ID NO: 3846999 - RNA, 19 nt, Human
uccuguggcauaaauugca

SEQ ID NO: 3847000 - RNA, 20 nt, Human
uccuguggcauaaauugcau

SEQ ID NO: 3847001 - RNA, 12 nt, Human
uccuguggcccc

SEQ ID NO: 3847002 - RNA, 14 nt, Human
uccuguggcucccu

SEQ ID NO: 3847003 - RNA, 13 nt, Human
uccugugggagcc

SEQ ID NO: 3847004 - RNA, 16 nt, Human
uccugugggagccucg

SEQ ID NO: 3847005 - RNA, 18 nt, Human
uccugugggagccucgca

SEQ ID NO: 3847006 - RNA, 22 nt, Human
uccuguguaaucauuucuuggg

SEQ ID NO: 3847007 - RNA, 13 nt, Human
uccuguguacagg

SEQ ID NO: 3847008 - RNA, 17 nt, Human
uccuguguacuguguca

SEQ ID NO: 3847009 - RNA, 13 nt, Human
uccuguguagcau

SEQ ID NO: 3847010 - RNA, 14 nt, Human
uccugugucaguuu

SEQ ID NO: 3847011 - RNA, 24 nt, Human
uccugugucuugcaauggcagccu

SEQ ID NO: 3847012 - RNA, 18 nt, Human
uccugugugugcgccuac

SEQ ID NO: 3847013 - RNA, 20 nt, Human
uccuguguguuaagcucugc

SEQ ID NO: 3847014 - RNA, 21 nt, Human
uccuguguguuaagcucugcu

SEQ ID NO: 3847015 - RNA, 21 nt, Human
uccuguugaaugacaaaguau

SEQ ID NO: 3847016 - RNA, 13 nt, Human
uccuguugcaccc

SEQ ID NO: 3847017 - RNA, 16 nt, Human
uccuguugcacccagc

SEQ ID NO: 3847018 - RNA, 21 nt, Human
uccuguugcacccagcccugg

SEQ ID NO: 3847019 - RNA, 13 nt, Human
uccuguugggaga

SEQ ID NO: 3847020 - RNA, 14 nt, Human
uccuguugggagag

SEQ ID NO: 3847021 - RNA, 18 nt, Human
uccuguuuauucccaucu

SEQ ID NO: 3847022 - RNA, 21 nt, Human
uccuguuucccuucccuucca

SEQ ID NO: 3847023 - RNA, 22 nt, Human
uccuguuucugaaaagaaauaa

SEQ ID NO: 3847024 - RNA, 17 nt, Human
uccuguuugucuacaua

SEQ ID NO: 3847025 - RNA, 20 nt, Human
uccuguuuuauaaugaaccc

SEQ ID NO: 3847026 - RNA, 21 nt, Human
uccuguuuugcacagccaaau

SEQ ID NO: 3847027 - RNA, 16 nt, Human
uccuguuuuuauuauu

SEQ ID NO: 3847028 - RNA, 20 nt, Human
uccuguuuuuauuauuaaca

SEQ ID NO: 3847029 - RNA, 17 nt, Human
uccuguuuuucugggug

SEQ ID NO: 3847030 - RNA, 18 nt, Human
uccuuaaaaaucacacug

SEQ ID NO: 3847031 - RNA, 23 nt, Human
uccuuaaacuguguggacuguga

SEQ ID NO: 3847032 - RNA, 23 nt, Human
uccuuaaagaguguggcaaaaua

SEQ ID NO: 3847033 - RNA, 17 nt, Human
uccuuaaaucuuaaugu

SEQ ID NO: 3847034 - RNA, 16 nt, Human
uccuuaagaacacaaa

SEQ ID NO: 3847035 - RNA, 16 nt, Human
uccuuaagagacaauu

SEQ ID NO: 3847036 - RNA, 20 nt, Human
uccuuaagcugcagagauuu

SEQ ID NO: 3847037 - RNA, 16 nt, Human
uccuuaaggcucuuuu

SEQ ID NO: 3847038 - RNA, 17 nt, Human
uccuuaauccagcugau

SEQ ID NO: 3847039 - RNA, 16 nt, Human
uccuuacaaaugauug

SEQ ID NO: 3847040 - RNA, 18 nt, Human
uccuuacaaaugauugcu

SEQ ID NO: 3847041 - RNA, 22 nt, Human
uccuuacaaguuagaaaacaua

SEQ ID NO: 3847042 - RNA, 14 nt, Human
uccuuaccagcaga

SEQ ID NO: 3847043 - RNA, 17 nt, Human
uccuuaccagcagagca

SEQ ID NO: 3847044 - RNA, 14 nt, Human
uccuuacccaucug

SEQ ID NO: 3847045 - RNA, 21 nt, Human
uccuuaccuuuaccccauccc

SEQ ID NO: 3847046 - RNA, 18 nt, Human
ucccuuucuccccugccc

SEQ ID NO: 3847047 - RNA, 19 nt, Human
ucccuuucugcuuguguua

SEQ ID NO: 3847048 - RNA, 16 nt, Human
ucccuuucuucucccc

SEQ ID NO: 3847049 - RNA, 16 nt, Human
ucccuuucuuggccag

SEQ ID NO: 3847050 - RNA, 15 nt, Human
ucccuuugaaaugaa

SEQ ID NO: 3847051 - RNA, 13 nt, Human
ucccuuugcucca

SEQ ID NO: 3847052 - RNA, 15 nt, Human
ucccuuugcuccacc

SEQ ID NO: 3847053 - RNA, 17 nt, Human
ucccuuugucuuucaaa

SEQ ID NO: 3847054 - RNA, 17 nt, Human
ucccuuuuacauacugc

SEQ ID NO: 3847055 - RNA, 20 nt, Human
ucccuuuucaccuuuucagg

SEQ ID NO: 3847056 - RNA, 12 nt, Human
ucccuuuuccuu

SEQ ID NO: 3847057 - RNA, 20 nt, Human
ucccuuuucuguucuaguuu

SEQ ID NO: 3847058 - RNA, 23 nt, Human
ucccuuuugcggaugggaggggu

SEQ ID NO: 3847059 - RNA, 15 nt, Human
ucccuuuuugaagug

SEQ ID NO: 3847060 - RNA, 17 nt, Human
ucccuuuuuuggcugcu

SEQ ID NO: 3847061 - RNA, 19 nt, Human
ucccuuuuuuggcugcuga

SEQ ID NO: 3847062 - RNA, 23 nt, Human
ucccuuuuuuggcugcugaaggc

SEQ ID NO: 3847063 - RNA, 16 nt, Human
ucccuuuuuuuaagua

SEQ ID NO: 3847064 - RNA, 19 nt, Human
uccgaaaccaaagaagaaa

SEQ ID NO: 3847065 - RNA, 18 nt, Human
uccgaaccuccucuguga

SEQ ID NO: 3847066 - RNA, 22 nt, Human
uccgaaccuccucugugaagca

SEQ ID NO: 3847067 - RNA, 21 nt, Human
uccgaaguaugagggaaaaug

SEQ ID NO: 3847068 - RNA, 21 nt, Human
uccgacaaccgaugcuccagc

SEQ ID NO: 3847069 - RNA, 19 nt, Human
uccgaccuggccugucugu

SEQ ID NO: 3847070 - RNA, 16 nt, Human
uccgacucacaccacu

SEQ ID NO: 3847071 - RNA, 23 nt, Human
uccgacucuuucugagugccuuc

SEQ ID NO: 3847072 - RNA, 15 nt, Human
uccgacugcuuugga

SEQ ID NO: 3847073 - RNA, 21 nt, Human
uccgacuugaauuuucccacu

SEQ ID NO: 3847074 - RNA, 13 nt, Human
uccgagagggaga

SEQ ID NO: 3847075 - RNA, 16 nt, Human
uccgagaggugggcca

SEQ ID NO: 3847076 - RNA, 12 nt, Human
uccgaggcaggg

SEQ ID NO: 3847077 - RNA, 14 nt, Human
uccgaggcaggguc

SEQ ID NO: 3847078 - RNA, 20 nt, Human
uccgaggggcgggacccagg

SEQ ID NO: 3847079 - RNA, 20 nt, Human
uccgauggaugaaucuccca

SEQ ID NO: 3847080 - RNA, 16 nt, Human
uccgcacuuuccacuu

SEQ ID NO: 3847081 - RNA, 22 nt, Human
uccgcacuuuccacuucuuccu

SEQ ID NO: 3847082 - RNA, 23 nt, Human
uccgcacuuuccacuucuuccuu

SEQ ID NO: 3847083 - RNA, 23 nt, Human
uccgcagcccccacccccaaggu

SEQ ID NO: 3847084 - RNA, 12 nt, Human
uccgcaggacuu

SEQ ID NO: 3847085 - RNA, 21 nt, Human
uccgccacuggggcucagagc

SEQ ID NO: 3847086 - RNA, 11 nt, Human
uccgccagccu

SEQ ID NO: 3847087 - RNA, 13 nt, Human
uccgccagccucc

SEQ ID NO: 3847088 - RNA, 17 nt, Human
uccgccagccuccucug

SEQ ID NO: 3847089 - RNA, 13 nt, Human
uccgccagggccc

SEQ ID NO: 3847090 - RNA, 12 nt, Human
uccgcccccagc

SEQ ID NO: 3847091 - RNA, 13 nt, Human
uccgcccccagcc

SEQ ID NO: 3847092 - RNA, 20 nt, Human
uccgccccugagcccacugu

SEQ ID NO: 3847093 - RNA, 14 nt, Human
uccgccccugccug

SEQ ID NO: 3847094 - RNA, 15 nt, Human
uccgccccuucccuu

SEQ ID NO: 3847095 - RNA, 14 nt, Human
uccgcccugccacu

SEQ ID NO: 3847096 - RNA, 15 nt, Human
uccgcccugcuccuc

SEQ ID NO: 3847097 - RNA, 19 nt, Human
uccgcccugcuccucccug

SEQ ID NO: 3847098 - RNA, 22 nt, Human
uccgcccugcuccucccuggcu

SEQ ID NO: 3847099 - RNA, 21 nt, Human
uccgcccuuagucccccaacu

SEQ ID NO: 3847100 - RNA, 13 nt, Human
uccgccuccagga

SEQ ID NO: 3847101 - RNA, 17 nt, Human
uccgccucugcuggcac

SEQ ID NO: 3847102 - RNA, 13 nt, Human
uccgccucugucc

SEQ ID NO: 3847103 - RNA, 17 nt, Human
uccgccuucacauuccc

SEQ ID NO: 3847104 - RNA, 14 nt, Human
uccgccuuuuguau

SEQ ID NO: 3847105 - RNA, 12 nt, Human
uccgcgaaaaua

SEQ ID NO: 3847106 - RNA, 19 nt, Human
uccgcgaaaauaguuuguu

SEQ ID NO: 3847107 - RNA, 14 nt, Human
uccgcgugugccug

SEQ ID NO: 3847108 - RNA, 19 nt, Human
uccgcgugugccugugugc

SEQ ID NO: 3847109 - RNA, 15 nt, Human
uccgcuauccaccaa

SEQ ID NO: 3847110 - RNA, 16 nt, Human
uccgcugcuccuuggc

SEQ ID NO: 3847111 - RNA, 20 nt, Human
uccgcuuggagcuauuuucc

SEQ ID NO: 3847112 - RNA, 21 nt, Human
uccgcuuucuacccagcgagc

SEQ ID NO: 3847113 - RNA, 19 nt, Human
uccggaaacuaguguacau

SEQ ID NO: 3847114 - RNA, 12 nt, Human
uccggaaagaag

SEQ ID NO: 3847115 - RNA, 18 nt, Human
uccggaauccuguccuca

SEQ ID NO: 3847116 - RNA, 22 nt, Human
uccggaauccuguccucagcuu

SEQ ID NO: 3847117 - RNA, 18 nt, Human
ucgucuuucccaugggga

SEQ ID NO: 3847118 - RNA, 14 nt, Human
ucgugaaacccugu

SEQ ID NO: 3847119 - RNA, 18 nt, Human
ucgugaaacccugucucu

SEQ ID NO: 3847120 - RNA, 22 nt, Human
ucgugaaagugcauuuuuguaa

SEQ ID NO: 3847121 - RNA, 19 nt, Human
ucgugaaguauacuguauu

SEQ ID NO: 3847122 - RNA, 13 nt, Human
ucgugacaacacu

SEQ ID NO: 3847123 - RNA, 18 nt, Human
ucgugacaauguuuacaa

SEQ ID NO: 3847124 - RNA, 21 nt, Human
ucgugaccaacuagacauucu

SEQ ID NO: 3847125 - RNA, 20 nt, Human
ucgugacgcugaauaaaugu

SEQ ID NO: 3847126 - RNA, 15 nt, Human
ucgugagcucuugug

SEQ ID NO: 3847127 - RNA, 15 nt, Human
ucgugauaaacuuug

SEQ ID NO: 3847128 - RNA, 16 nt, Human
ucgugauugauaagaa

SEQ ID NO: 3847129 - RNA, 19 nt, Human
ucgugccagucgcgcugcc

SEQ ID NO: 3847130 - RNA, 23 nt, Human
ucgugccagucgcgcugccugug

SEQ ID NO: 3847131 - RNA, 20 nt, Human
ucgugcccccccuucccccu

SEQ ID NO: 3847132 - RNA, 20 nt, Human
ucgugccuccuuccaccucc

SEQ ID NO: 3847133 - RNA, 22 nt, Human
ucgugcuacugcacuccagccu

SEQ ID NO: 3847134 - RNA, 20 nt, Human
ucguggacugagugggaagc

SEQ ID NO: 3847135 - RNA, 24 nt, Human
ucguggagagcuaggagcaaagcc

SEQ ID NO: 3847136 - RNA, 22 nt, Human
ucguggcagauaaucagccucu

SEQ ID NO: 3847137 - RNA, 12 nt, Human
ucguggccagcc

SEQ ID NO: 3847138 - RNA, 18 nt, Human
ucguggccagcccggcug

SEQ ID NO: 3847139 - RNA, 18 nt, Human
ucguggggugugcuggga

SEQ ID NO: 3847140 - RNA, 19 nt, Human
ucgugggucuguuuuccuu

SEQ ID NO: 3847141 - RNA, 14 nt, Human
ucguguauccuggg

SEQ ID NO: 3847142 - RNA, 18 nt, Human
ucguguauccuggggcuc

SEQ ID NO: 3847143 - RNA, 22 nt, Human
ucguguauccuggggcucccuu

SEQ ID NO: 3847144 - RNA, 22 nt, Human
ucgugucauacucgagucugag

SEQ ID NO: 3847145 - RNA, 14 nt, Human
ucgugucucugguc

SEQ ID NO: 3847146 - RNA, 14 nt, Human
ucgugucuggcaca

SEQ ID NO: 3847147 - RNA, 17 nt, Human
ucguuaaaaaguuguuu

SEQ ID NO: 3847148 - RNA, 17 nt, Human
ucguuaacauugaccaa

SEQ ID NO: 3847149 - RNA, 17 nt, Human
ucguuagggaagagaaa

SEQ ID NO: 3847150 - RNA, 13 nt, Human
ucguucucccugg

SEQ ID NO: 3847151 - RNA, 13 nt, Human
ucguucucugccu

SEQ ID NO: 3847152 - RNA, 12 nt, Human
ucguuucaaaaa

SEQ ID NO: 3847153 - RNA, 17 nt, Human
ucguuugaaucacagua

SEQ ID NO: 3847154 - RNA, 13 nt, Human
ucguuuguuuguu

SEQ ID NO: 3847155 - RNA, 20 nt, Human
ucguuuuccaaacugacuca

SEQ ID NO: 3847156 - RNA, 21 nt, Human
ucguuuucuuaaagugccagu

SEQ ID NO: 3847157 - RNA, 20 nt, Human
ucguuuuuguauuuucauga

SEQ ID NO: 3847158 - RNA, 13 nt, Human
ucuaaaaacuucu

SEQ ID NO: 3847159 - RNA, 15 nt, Human
ucuaaaaagucagau

SEQ ID NO: 3847160 - RNA, 22 nt, Human
ucuaaaaauaaaccaaaggaca

SEQ ID NO: 3847161 - RNA, 18 nt, Human
ucuaaaaauaacuguaau

SEQ ID NO: 3847162 - RNA, 15 nt, Human
ucuaaaacuaaauag

SEQ ID NO: 3847163 - RNA, 21 nt, Human
ucuaaaacuaaauagcaugua

SEQ ID NO: 3847164 - RNA, 19 nt, Human
ucuaaaacuguacuuugau

SEQ ID NO: 3847165 - RNA, 16 nt, Human
ucuaaaagcagaaaau

SEQ ID NO: 3847166 - RNA, 13 nt, Human
ucuaaaaguguca

SEQ ID NO: 3847167 - RNA, 21 nt, Human
ucuaaaagugucaccuuuucu

SEQ ID NO: 3847168 - RNA, 23 nt, Human
ucuaaaaucuuauaguucuaggc

SEQ ID NO: 3847169 - RNA, 13 nt, Human
ucuaaaaugaguu

SEQ ID NO: 3847170 - RNA, 18 nt, Human
ucuaaaaugugauguucu

SEQ ID NO: 3847171 - RNA, 21 nt, Human
ucuaaaaugugauguucuaag

SEQ ID NO: 3847172 - RNA, 18 nt, Human
ucuaaacaagaaucaguc

SEQ ID NO: 3847173 - RNA, 16 nt, Human
ucuaaacccaauccaa

SEQ ID NO: 3847174 - RNA, 20 nt, Human
ucuaaacguaagcacuguuu

SEQ ID NO: 3847175 - RNA, 18 nt, Human
ucuaaacuaggcuccuuc

SEQ ID NO: 3847176 - RNA, 16 nt, Human
ucuaaacugcccccuc

SEQ ID NO: 3847177 - RNA, 22 nt, Human
ucuaaacugcccccucugcccu

SEQ ID NO: 3847178 - RNA, 23 nt, Human
ucuaaacugcccccucugcccug

SEQ ID NO: 3847179 - RNA, 13 nt, Human
ucuaaacuggaga

SEQ ID NO: 3847180 - RNA, 14 nt, Human
ucuaaacuggagac

SEQ ID NO: 3847181 - RNA, 15 nt, Human
ucuaaacuggagacu

SEQ ID NO: 3847182 - RNA, 19 nt, Human
ucuaaacuuuaauauguau

SEQ ID NO: 3847183 - RNA, 13 nt, Human
ucuaaagagcauc

SEQ ID NO: 3847184 - RNA, 18 nt, Human
ucuaaagauaauauuacu

SEQ ID NO: 3847185 - RNA, 24 nt, Human
ucuaaagauagagucauugcugua

SEQ ID NO: 3847186 - RNA, 13 nt, Human
ucuaaagauucua

SEQ ID NO: 3847187 - RNA, 15 nt, Human
ucuaaagauucuaua

SEQ ID NO: 3847188 - RNA, 16 nt, Human
ucuaaagauucuauag

SEQ ID NO: 3847189 - RNA, 23 nt, Human
ucuaaagauucuauaguucuaga

SEQ ID NO: 3847190 - RNA, 22 nt, Human
ucuacaaucucuuuuuguuugc

SEQ ID NO: 3847191 - RNA, 15 nt, Human
ucuacaaugugaacu

SEQ ID NO: 3847192 - RNA, 17 nt, Human
ucuacaaugugaacuuu

SEQ ID NO: 3847193 - RNA, 20 nt, Human
ucuacaaugugaacuuuauu

SEQ ID NO: 3847194 - RNA, 18 nt, Human
ucuacacagugggaacuc

SEQ ID NO: 3847195 - RNA, 16 nt, Human
ucuacaccuugcuuuu

SEQ ID NO: 3847196 - RNA, 17 nt, Human
ucuacacuccagugaga

SEQ ID NO: 3847197 - RNA, 12 nt, Human
ucuacacucucc

SEQ ID NO: 3847198 - RNA, 14 nt, Human
ucuacacucuccug

SEQ ID NO: 3847199 - RNA, 16 nt, Human
ucuacacucuccuggg

SEQ ID NO: 3847200 - RNA, 19 nt, Human
ucuacacucuuguaauaaa

SEQ ID NO: 3847201 - RNA, 16 nt, Human
ucuacacugcaaucau

SEQ ID NO: 3847202 - RNA, 19 nt, Human
ucuacacugcaaucauaug

SEQ ID NO: 3847203 - RNA, 20 nt, Human
ucuacacugcaaucauaugu

SEQ ID NO: 3847204 - RNA, 15 nt, Human
ucuacacugugcuga

SEQ ID NO: 3847205 - RNA, 21 nt, Human
ucuacacugugcugagucuga

SEQ ID NO: 3847206 - RNA, 12 nt, Human
ucuacagaaaaa

SEQ ID NO: 3847207 - RNA, 18 nt, Human
ucuacagacuucuccaga

SEQ ID NO: 3847208 - RNA, 16 nt, Human
ucuacagagcuucccu

SEQ ID NO: 3847209 - RNA, 17 nt, Human
ucuacagagcuucccug

SEQ ID NO: 3847210 - RNA, 18 nt, Human
ucuacagagcuucccuga

SEQ ID NO: 3847211 - RNA, 21 nt, Human
ucuacagaggccaugggccuc

SEQ ID NO: 3847212 - RNA, 14 nt, Human
ucuacagcaaauuu

SEQ ID NO: 3847213 - RNA, 18 nt, Human
ucuacagcaaauuuauaa

SEQ ID NO: 3847214 - RNA, 19 nt, Human
ucuacagcaaauuuauaau

SEQ ID NO: 3847215 - RNA, 13 nt, Human
ucuacagugguuu

SEQ ID NO: 3847216 - RNA, 22 nt, Human
ucuacagugguuuuauacugaa

SEQ ID NO: 3847217 - RNA, 12 nt, Human
ucuacaucacuc

SEQ ID NO: 3847218 - RNA, 17 nt, Human
ucuacaucuucugccuu

SEQ ID NO: 3847219 - RNA, 20 nt, Human
ucuaccaagcuauccuggcu

SEQ ID NO: 3847220 - RNA, 17 nt, Human
ucuaccagacuguguau

SEQ ID NO: 3847221 - RNA, 14 nt, Human
ucuacccaaacccu

SEQ ID NO: 3847222 - RNA, 20 nt, Human
ucuacccaagggcagaaagu

SEQ ID NO: 3847223 - RNA, 17 nt, Human
ucuacccagcccaucuu

SEQ ID NO: 3847224 - RNA, 21 nt, Human
ucuacccagcccaucuugccu

SEQ ID NO: 3847225 - RNA, 14 nt, Human
ucuacccaggugcu

SEQ ID NO: 3847226 - RNA, 19 nt, Human
ucuacccaucuuaaaaaca

SEQ ID NO: 3847227 - RNA, 21 nt, Human
ucuacccaucuuaaaaacaac

SEQ ID NO: 3847228 - RNA, 16 nt, Human
ucuaccccagacuaga

SEQ ID NO: 3847229 - RNA, 22 nt, Human
ucuaccccucccggcccugccu

SEQ ID NO: 3847230 - RNA, 23 nt, Human
ucuaccccucccggcccugccug

SEQ ID NO: 3847231 - RNA, 16 nt, Human
ucuacccucccacccc

SEQ ID NO: 3847232 - RNA, 12 nt, Human
ucuacccuggga

SEQ ID NO: 3847233 - RNA, 16 nt, Human
ucuaccuagauuuaau

SEQ ID NO: 3847234 - RNA, 17 nt, Human
ucuaccuagauuuaaua

SEQ ID NO: 3847235 - RNA, 15 nt, Human
ucuaccucaggcagc

SEQ ID NO: 3847236 - RNA, 19 nt, Human
ucuaccucaggcagcucaa

SEQ ID NO: 3847237 - RNA, 12 nt, Human
ucuaccugaggg

SEQ ID NO: 3847238 - RNA, 14 nt, Human
ucuaccugccacuc

SEQ ID NO: 3847239 - RNA, 18 nt, Human
ucuaccuggagggaagag

SEQ ID NO: 3847240 - RNA, 21 nt, Human
ucuaccuggucucuccuuguu

SEQ ID NO: 3847241 - RNA, 15 nt, Human
ucuaccuucucccca

SEQ ID NO: 3847242 - RNA, 18 nt, Human
ucuaccuucuccccagcu

SEQ ID NO: 3847243 - RNA, 14 nt, Human
ucuaccuucuguag

SEQ ID NO: 3847244 - RNA, 16 nt, Human
ucuaccuucuguaguu

SEQ ID NO: 3847245 - RNA, 14 nt, Human
ucuaccuuuucucu

SEQ ID NO: 3847246 - RNA, 15 nt, Human
ucuacgcucuccuuu

SEQ ID NO: 3847247 - RNA, 16 nt, Human
ucuacgcucuccuuuc

SEQ ID NO: 3847248 - RNA, 17 nt, Human
ucuacgcucuccuuucu

SEQ ID NO: 3847249 - RNA, 14 nt, Human
ucuacguuucuuua

SEQ ID NO: 3847250 - RNA, 14 nt, Human
ucuacuaaaaagaa

SEQ ID NO: 3847251 - RNA, 19 nt, Human
ucuacuaaaaauacaaaaa

SEQ ID NO: 3847252 - RNA, 16 nt, Human
ucuacuaaaaaugcaa

SEQ ID NO: 3847253 - RNA, 17 nt, Human
ucuacuagauugugauc

SEQ ID NO: 3847254 - RNA, 21 nt, Human
ucuacucacuuuucccacucc

SEQ ID NO: 3847255 - RNA, 20 nt, Human
ucuacucgaguuacagacaa

SEQ ID NO: 3847256 - RNA, 18 nt, Human
ucuacucuuaagccaucu

SEQ ID NO: 3847257 - RNA, 24 nt, Human
ucuacugcauuuagggaguauucu

SEQ ID NO: 3847258 - RNA, 21 nt, Human
ucuacuguauggaauacaaug

SEQ ID NO: 3847259 - RNA, 23 nt, Human
ucuacugucaaaugaugugcaaa

SEQ ID NO: 3847260 - RNA, 23 nt, Human
ucuacuguguaauauaaaagauc

SEQ ID NO: 3847261 - RNA, 20 nt, Human
ucuacuuacacaucuuccac

SEQ ID NO: 3847262 - RNA, 22 nt, Human
ucuacuuccaaacuaauuuuua

SEQ ID NO: 3847263 - RNA, 15 nt, Human
ucuacuuccaagacu

SEQ ID NO: 3847264 - RNA, 14 nt, Human
ucuacuuccccaug

SEQ ID NO: 3847265 - RNA, 22 nt, Human
ucuacuugccagaaccaaauua

SEQ ID NO: 3847266 - RNA, 14 nt, Human
ucuacuugcucugg

SEQ ID NO: 3847267 - RNA, 22 nt, Human
ucuacuugcugucccuuggaac

SEQ ID NO: 3847268 - RNA, 14 nt, Human
ucuacuuuuaaaga

SEQ ID NO: 3847269 - RNA, 12 nt, Human
ucuagaaaacca

SEQ ID NO: 3847270 - RNA, 13 nt, Human
ucuagaacacagg

SEQ ID NO: 3847271 - RNA, 19 nt, Human
ucuagaacaucccugccag

SEQ ID NO: 3847272 - RNA, 21 nt, Human
ucuagaacaucccugccagcu

SEQ ID NO: 3847273 - RNA, 17 nt, Human
ucuagaagaaaugaaau

SEQ ID NO: 3847274 - RNA, 18 nt, Human
ucuagaagaaaugaaauu

SEQ ID NO: 3847275 - RNA, 19 nt, Human
ucuagaagagucuauuguc

SEQ ID NO: 3847276 - RNA, 20 nt, Human
ucuagaagccaagggaaagg

SEQ ID NO: 3847277 - RNA, 23 nt, Human
ucuagaagccaagggaaaggggu

SEQ ID NO: 3847278 - RNA, 16 nt, Human
ucuagaaguuguuugu

SEQ ID NO: 3847279 - RNA, 23 nt, Human
ucuagaaucugcaauucaaaagu

SEQ ID NO: 3847280 - RNA, 17 nt, Human
ucuagaauuauaaguca

SEQ ID NO: 3847281 - RNA, 14 nt, Human
uccuaguuccacca

SEQ ID NO: 3847282 - RNA, 17 nt, Human
uccuaguucuagaaaaa

SEQ ID NO: 3847283 - RNA, 16 nt, Human
uccuaguucuguagaa

SEQ ID NO: 3847284 - RNA, 16 nt, Human
uccuaguucuucaucc

SEQ ID NO: 3847285 - RNA, 21 nt, Human
uccuaguuggugagaaaccug

SEQ ID NO: 3847286 - RNA, 13 nt, Human
uccuauaacuuga

SEQ ID NO: 3847287 - RNA, 18 nt, Human
uccuauaacuugaugcau

SEQ ID NO: 3847288 - RNA, 17 nt, Human
uccuauaaggaagauuu

SEQ ID NO: 3847289 - RNA, 20 nt, Human
uccuauaauauaauaaauau

SEQ ID NO: 3847290 - RNA, 16 nt, Human
uccuauaaucugucaa

SEQ ID NO: 3847291 - RNA, 17 nt, Human
uccuauaaucugucaaa

SEQ ID NO: 3847292 - RNA, 23 nt, Human
uccuauaaucugucaaaacacug

SEQ ID NO: 3847293 - RNA, 14 nt, Human
uccuauauauuucu

SEQ ID NO: 3847294 - RNA, 15 nt, Human
uccuauauauuucua

SEQ ID NO: 3847295 - RNA, 19 nt, Human
uccuaucaccuauuuccau

SEQ ID NO: 3847296 - RNA, 17 nt, Human
uccuaucaccuccccuc

SEQ ID NO: 3847297 - RNA, 19 nt, Human
uccuaucaccuccccuccu

SEQ ID NO: 3847298 - RNA, 15 nt, Human
uccuauccacugggc

SEQ ID NO: 3847299 - RNA, 17 nt, Human
uccuauccacugggcac

SEQ ID NO: 3847300 - RNA, 21 nt, Human
uccuauccacugggcacaacu

SEQ ID NO: 3847301 - RNA, 14 nt, Human
uccuaucccauccc

SEQ ID NO: 3847302 - RNA, 13 nt, Human
uccuauccuccua

SEQ ID NO: 3847303 - RNA, 23 nt, Human
uccuaucuccagcggcccuguca

SEQ ID NO: 3847304 - RNA, 13 nt, Human
uccuaucugggcu

SEQ ID NO: 3847305 - RNA, 15 nt, Human
uccuaugaaugcuuu

SEQ ID NO: 3847306 - RNA, 18 nt, Human
uccuaugaaugcuuugca

SEQ ID NO: 3847307 - RNA, 22 nt, Human
uccuaugauguauacugccacu

SEQ ID NO: 3847308 - RNA, 20 nt, Human
uccuaugcuauugacaauaa

SEQ ID NO: 3847309 - RNA, 14 nt, Human
uccuaugcuuugaa

SEQ ID NO: 3847310 - RNA, 22 nt, Human
uccuauggcuggccacugcaca

SEQ ID NO: 3847311 - RNA, 12 nt, Human
uccuauguguga

SEQ ID NO: 3847312 - RNA, 12 nt, Human
uccuauuagugu

SEQ ID NO: 3847313 - RNA, 14 nt, Human
uccuauuaguguua

SEQ ID NO: 3847314 - RNA, 17 nt, Human
uccuauuaguguuauau

SEQ ID NO: 3847315 - RNA, 12 nt, Human
uccuauuauauu

SEQ ID NO: 3847316 - RNA, 14 nt, Human
uccuauucaguucc

SEQ ID NO: 3847317 - RNA, 22 nt, Human
uccuauucaguucccagaauca

SEQ ID NO: 3847318 - RNA, 23 nt, Human
uccuauucaguucccagaaucaa

SEQ ID NO: 3847319 - RNA, 15 nt, Human
uccuauucucaccag

SEQ ID NO: 3847320 - RNA, 21 nt, Human
uccuauucuuucgaaagaaga

SEQ ID NO: 3847321 - RNA, 17 nt, Human
uccuauugucauuaaag

SEQ ID NO: 3847322 - RNA, 15 nt, Human
uccuauugugauuug

SEQ ID NO: 3847323 - RNA, 20 nt, Human
uccuauugugauuugacugu

SEQ ID NO: 3847324 - RNA, 14 nt, Human
uccuauuuagaugg

SEQ ID NO: 3847325 - RNA, 14 nt, Human
uccuauuucagaag

SEQ ID NO: 3847326 - RNA, 16 nt, Human
uccuauuucagaaguu

SEQ ID NO: 3847327 - RNA, 21 nt, Human
uccuauuucaguacuucagca

SEQ ID NO: 3847328 - RNA, 15 nt, Human
uccuauuucuuauag

SEQ ID NO: 3847329 - RNA, 17 nt, Human
uccuauuuguuuucaug

SEQ ID NO: 3847330 - RNA, 13 nt, Human
uccuauuuuugua

SEQ ID NO: 3847331 - RNA, 14 nt, Human
uccuauuuuuguaa

SEQ ID NO: 3847332 - RNA, 17 nt, Human
uccuauuuuuguaaacu

SEQ ID NO: 3847333 - RNA, 15 nt, Human
uccucaaagaaagug

SEQ ID NO: 3847334 - RNA, 19 nt, Human
uccucaaccccuccccucc

SEQ ID NO: 3847335 - RNA, 14 nt, Human
ucuccuccccuucc

SEQ ID NO: 3847336 - RNA, 16 nt, Human
ucuccuccccuugaau

SEQ ID NO: 3847337 - RNA, 14 nt, Human
ucuccuccugccca

SEQ ID NO: 3847338 - RNA, 16 nt, Human
ucuccucucagccccu

SEQ ID NO: 3847339 - RNA, 19 nt, Human
uccuggacauuuuuucagu

SEQ ID NO: 3847340 - RNA, 14 nt, Human
uccuggacugaggg

SEQ ID NO: 3847341 - RNA, 20 nt, Human
uccuggacugagggggccug

SEQ ID NO: 3847342 - RNA, 14 nt, Human
uccuggagagucuc

SEQ ID NO: 3847343 - RNA, 18 nt, Human
uccuggagagucucacuc

SEQ ID NO: 3847344 - RNA, 19 nt, Human
uccuggagcagaccacccc

SEQ ID NO: 3847345 - RNA, 15 nt, Human
uccuggagcccagag

SEQ ID NO: 3847346 - RNA, 21 nt, Human
uccuggagcccgaggcaccag

SEQ ID NO: 3847347 - RNA, 18 nt, Human
uccuggaggcccaguuca

SEQ ID NO: 3847348 - RNA, 23 nt, Human
uccuggaggcucaaauuuugagu

SEQ ID NO: 3847349 - RNA, 11 nt, Human
uccuggagggg

SEQ ID NO: 3847350 - RNA, 19 nt, Human
uccuggaggggcuggggac

SEQ ID NO: 3847351 - RNA, 22 nt, Human
uccuggagguuccccagcccca

SEQ ID NO: 3847352 - RNA, 22 nt, Human
uccuggaugauacuaauaaacu

SEQ ID NO: 3847353 - RNA, 23 nt, Human
uccuggcaauaguguguucugau

SEQ ID NO: 3847354 - RNA, 19 nt, Human
uccuggcacccggccccug

SEQ ID NO: 3847355 - RNA, 16 nt, Human
uccuggcacugcuucc

SEQ ID NO: 3847356 - RNA, 17 nt, Human
uccuggcacugcuucca

SEQ ID NO: 3847357 - RNA, 21 nt, Human
uccuggcacuggaccccagca

SEQ ID NO: 3847358 - RNA, 22 nt, Human
uccuggcaugggaaugaauguc

SEQ ID NO: 3847359 - RNA, 17 nt, Human
uccuggcccacugcauc

SEQ ID NO: 3847360 - RNA, 13 nt, Human
uccuggcccagcc

SEQ ID NO: 3847361 - RNA, 13 nt, Human
uccuggcccaggg

SEQ ID NO: 3847362 - RNA, 16 nt, Human
uccuggcccagggcau

SEQ ID NO: 3847363 - RNA, 19 nt, Human
uccuggcccagggcaucug

SEQ ID NO: 3847364 - RNA, 22 nt, Human
uccuggcccagggcaucuggga

SEQ ID NO: 3847365 - RNA, 16 nt, Human
uccuggcccucugugu

SEQ ID NO: 3847366 - RNA, 19 nt, Human
uccuggccggugugggggc

SEQ ID NO: 3847367 - RNA, 18 nt, Human
uccuggccuauccgcugc

SEQ ID NO: 3847368 - RNA, 23 nt, Human
uccuggccuauccgcugccagcc

SEQ ID NO: 3847369 - RNA, 22 nt, Human
uccuggccucagacugcaccca

SEQ ID NO: 3847370 - RNA, 13 nt, Human
uccuggccugaga

SEQ ID NO: 3847371 - RNA, 13 nt, Human
uccuggcuccuga

SEQ ID NO: 3847372 - RNA, 14 nt, Human
uccuggcuucccau

SEQ ID NO: 3847373 - RNA, 16 nt, Human
uccuggcuuugcccaa

SEQ ID NO: 3847374 - RNA, 17 nt, Human
uccuggcuuugcccaac

SEQ ID NO: 3847375 - RNA, 23 nt, Human
uccuggcuuugcccaaccucagc

SEQ ID NO: 3847376 - RNA, 14 nt, Human
uccugggaaauauu

SEQ ID NO: 3847377 - RNA, 16 nt, Human
uccugggaaauauucc

SEQ ID NO: 3847378 - RNA, 17 nt, Human
uccugggagaaccucag

SEQ ID NO: 3847379 - RNA, 14 nt, Human
uccugggagugagc

SEQ ID NO: 3847380 - RNA, 17 nt, Human
uccugggagugagcugg

SEQ ID NO: 3847381 - RNA, 22 nt, Human
uccugggcagcugccuccccuc

SEQ ID NO: 3847382 - RNA, 18 nt, Human
uccugggccccucccuac

SEQ ID NO: 3847383 - RNA, 23 nt, Human
uccugggccccucccuaccucaa

SEQ ID NO: 3847384 - RNA, 12 nt, Human
uccugggccugc

SEQ ID NO: 3847385 - RNA, 13 nt, Human
uccugggccugca

SEQ ID NO: 3847386 - RNA, 14 nt, Human
uccugggcgcccug

SEQ ID NO: 3847387 - RNA, 16 nt, Human
uccugggcgcccugga

SEQ ID NO: 3847388 - RNA, 12 nt, Human
uccugggcucag

SEQ ID NO: 3847389 - RNA, 12 nt, Human
uccugggcuggu

SEQ ID NO: 3847390 - RNA, 19 nt, Human
uccuggggcauccaugggg

SEQ ID NO: 3847391 - RNA, 13 nt, Human
uccuggggccagg

SEQ ID NO: 3847392 - RNA, 21 nt, Human
uccuggggccucggagccuca

SEQ ID NO: 3847393 - RNA, 15 nt, Human
uccuggggccucuug

SEQ ID NO: 3847394 - RNA, 14 nt, Human
uccuggggcucccu

SEQ ID NO: 3847395 - RNA, 15 nt, Human
uccuggggcucugug

SEQ ID NO: 3847396 - RNA, 16 nt, Human
uccuggggcucugugc

SEQ ID NO: 3847397 - RNA, 19 nt, Human
uccuggggcucugugcagg

SEQ ID NO: 3847398 - RNA, 18 nt, Human
uccugggggccugaccuc

SEQ ID NO: 3847399 - RNA, 19 nt, Human
uccugggggccugaccucc

SEQ ID NO: 3847400 - RNA, 17 nt, Human
uccuggggugcccucca

SEQ ID NO: 3847401 - RNA, 15 nt, Human
uccuggguggcuacu

SEQ ID NO: 3847402 - RNA, 21 nt, Human
uccuggguggucugcaggcag

SEQ ID NO: 3847403 - RNA, 18 nt, Human
uccuggguucaagugauu

SEQ ID NO: 3847404 - RNA, 17 nt, Human
uccugguacccagccau

SEQ ID NO: 3847405 - RNA, 22 nt, Human
uccugguauggguuucucccag

SEQ ID NO: 3847406 - RNA, 16 nt, Human
uccuggucaccuagga

SEQ ID NO: 3847407 - RNA, 15 nt, Human
uccuggugccaccuc

SEQ ID NO: 3847408 - RNA, 13 nt, Human
uccuggugcccug

SEQ ID NO: 3847409 - RNA, 14 nt, Human
uccuggugcucucu

SEQ ID NO: 3847410 - RNA, 13 nt, Human
uccugguggggca

SEQ ID NO: 3847411 - RNA, 19 nt, Human
uccugguggguccaggggc

SEQ ID NO: 3847412 - RNA, 21 nt, Human
uccuggugguauuuagccacu

SEQ ID NO: 3847413 - RNA, 17 nt, Human
uccuggugucaccccag

SEQ ID NO: 3847414 - RNA, 20 nt, Human
uccuggugucaccccagagc

SEQ ID NO: 3847415 - RNA, 24 nt, Human
uccuggugucaccccagagccaca

SEQ ID NO: 3847416 - RNA, 11 nt, Human
uccugguuccu

SEQ ID NO: 3847417 - RNA, 19 nt, Human
uccuguaaagguuacaagc

SEQ ID NO: 3847418 - RNA, 20 nt, Human
uccuguaacacaagccacag

SEQ ID NO: 3847419 - RNA, 21 nt, Human
uccuguaacacaagccacaga

SEQ ID NO: 3847420 - RNA, 13 nt, Human
uccuguaacuguu

SEQ ID NO: 3847421 - RNA, 21 nt, Human
uccuguaagccaaagaaauga

SEQ ID NO: 3847422 - RNA, 14 nt, Human
uccuguacauugug

SEQ ID NO: 3847423 - RNA, 22 nt, Human
uccuguaccucuugagccuuga

SEQ ID NO: 3847424 - RNA, 23 nt, Human
uccuguagaccuagggaggaccu

SEQ ID NO: 3847425 - RNA, 19 nt, Human
uccuguagcaucuucugga

SEQ ID NO: 3847426 - RNA, 11 nt, Human
uccuguagccc

SEQ ID NO: 3847427 - RNA, 20 nt, Human
uccuguaggaagguacugua

SEQ ID NO: 3847428 - RNA, 21 nt, Human
uccuguaguugcguggacucu

SEQ ID NO: 3847429 - RNA, 17 nt, Human
uccuguaguuuuauuuu

SEQ ID NO: 3847430 - RNA, 21 nt, Human
uccuguaguuuuauuuuaugu

SEQ ID NO: 3847431 - RNA, 19 nt, Human
uccuguauaccuccuccag

SEQ ID NO: 3847432 - RNA, 13 nt, Human
uccuguauguugu

SEQ ID NO: 3847433 - RNA, 20 nt, Human
uccuguauucagacagauga

SEQ ID NO: 3847434 - RNA, 17 nt, Human
uccuguauuuguuccca

SEQ ID NO: 3847435 - RNA, 19 nt, Human
uccuguauuuguucccaag

SEQ ID NO: 3847436 - RNA, 21 nt, Human
uccuguauuuguucccaagag

SEQ ID NO: 3847437 - RNA, 19 nt, Human
uccugucaagcaaucaaga

SEQ ID NO: 3847438 - RNA, 13 nt, Human
uccugucagugcc

SEQ ID NO: 3847439 - RNA, 17 nt, Human
uccugucaucugagaau

SEQ ID NO: 3847440 - RNA, 19 nt, Human
uccugucaucugagaauga

SEQ ID NO: 3847441 - RNA, 22 nt, Human
uccuguccacacccagcucagc

SEQ ID NO: 3847442 - RNA, 16 nt, Human
uccugucccaccaugc

SEQ ID NO: 3847443 - RNA, 16 nt, Human
uccuguccccaucugu

SEQ ID NO: 3847444 - RNA, 16 nt, Human
uccuguccccugcuac

SEQ ID NO: 3847445 - RNA, 17 nt, Human
uccuguccccugcuaca

SEQ ID NO: 3847446 - RNA, 22 nt, Human
uccugucccugcgccuuuccuu

SEQ ID NO: 3847447 - RNA, 17 nt, Human
uccugucccuugaccuu

SEQ ID NO: 3847448 - RNA, 19 nt, Human
uccuguccgcccucuuccc

SEQ ID NO: 3847449 - RNA, 22 nt, Human
uccuguccgcccucuuccccuc

SEQ ID NO: 3847450 - RNA, 11 nt, Human
uccuguccucc

SEQ ID NO: 3847451 - RNA, 13 nt, Human
uccuguccucccu

SEQ ID NO: 3847452 - RNA, 15 nt, Human
uccuguccucccuca

SEQ ID NO: 3847453 - RNA, 20 nt, Human
uccuguccucuuucagcucc

SEQ ID NO: 3847454 - RNA, 24 nt, Human
uccuguccugcucauuaugccacu

SEQ ID NO: 3847455 - RNA, 19 nt, Human
uccuguccuuuaccaaaga

SEQ ID NO: 3847456 - RNA, 22 nt, Human
uccuguccuuuaccaaagauga

SEQ ID NO: 3847457 - RNA, 15 nt, Human
uccugucuaacugcu

SEQ ID NO: 3847458 - RNA, 12 nt, Human
uccugucucccc

SEQ ID NO: 3847459 - RNA, 14 nt, Human
uccugucuccccuc

SEQ ID NO: 3847460 - RNA, 19 nt, Human
uccugucuccccucugcug

SEQ ID NO: 3847461 - RNA, 15 nt, Human
uccugucucccuccu

SEQ ID NO: 3847462 - RNA, 23 nt, Human
uccugucucccuccucugcccgg

SEQ ID NO: 3847463 - RNA, 12 nt, Human
uccugucugcca

SEQ ID NO: 3847464 - RNA, 13 nt, Human
uccugucugccag

SEQ ID NO: 3847465 - RNA, 16 nt, Human
uccugucugccagcca

SEQ ID NO: 3847466 - RNA, 17 nt, Human
uccugucugccagccag

SEQ ID NO: 3847467 - RNA, 14 nt, Human
uccugucuucccag

SEQ ID NO: 3847468 - RNA, 15 nt, Human
uccugucuucccagg

SEQ ID NO: 3847469 - RNA, 16 nt, Human
uccugucuucccaggg

SEQ ID NO: 3847470 - RNA, 16 nt, Human
uccugucuucugcuuu

SEQ ID NO: 3847471 - RNA, 16 nt, Human
uccugucuuuucaggu

SEQ ID NO: 3847472 - RNA, 14 nt, Human
uccugugacaugua

SEQ ID NO: 3847473 - RNA, 11 nt, Human
uccugugagga

SEQ ID NO: 3847474 - RNA, 18 nt, Human
uccugugaggagccccau

SEQ ID NO: 3847475 - RNA, 22 nt, Human
uccugugaggagccccaucugu

SEQ ID NO: 3847476 - RNA, 16 nt, Human
uccugugcauggguga

SEQ ID NO: 3847477 - RNA, 16 nt, Human
uccugugcucagcccu

SEQ ID NO: 3847478 - RNA, 14 nt, Human
uccugugcuggggg

SEQ ID NO: 3847479 - RNA, 19 nt, Human
uccuguggcaggcagcgcc

SEQ ID NO: 3847480 - RNA, 13 nt, Human
ucucucucuacaa

SEQ ID NO: 3847481 - RNA, 14 nt, Human
ucucucucucuccc

SEQ ID NO: 3847482 - RNA, 15 nt, Human
ucucucugccuguga

SEQ ID NO: 3847483 - RNA, 19 nt, Human
ucucucuggcccucuaccc

SEQ ID NO: 3847484 - RNA, 21 nt, Human
ucucucuggcccucuaccccu

SEQ ID NO: 3847485 - RNA, 16 nt, Human
ucucucuuaaaguugg

SEQ ID NO: 3847486 - RNA, 13 nt, Human
ucucucuuacccu

SEQ ID NO: 3847487 - RNA, 14 nt, Human
ucucucuucccuca

SEQ ID NO: 3847488 - RNA, 12 nt, Human
ucucucuucucu

SEQ ID NO: 3847489 - RNA, 14 nt, Human
ucucucuucugcuc

SEQ ID NO: 3847490 - RNA, 17 nt, Human
ucucucuucugcuccac

SEQ ID NO: 3847491 - RNA, 16 nt, Human
ucucucuuuauacagc

SEQ ID NO: 3847492 - RNA, 17 nt, Human
ucucucuuuauacagcu

SEQ ID NO: 3847493 - RNA, 16 nt, Human
ucucugaacacaggca

SEQ ID NO: 3847494 - RNA, 21 nt, Human
ucucugaagcauguuucaugu

SEQ ID NO: 3847495 - RNA, 20 nt, Human
ucucugaaggaggccaccuc

SEQ ID NO: 3847496 - RNA, 11 nt, Human
ucucugaaggg

SEQ ID NO: 3847497 - RNA, 13 nt, Human
ucucugaagggag

SEQ ID NO: 3847498 - RNA, 14 nt, Human
ucucugaagggagg

SEQ ID NO: 3847499 - RNA, 16 nt, Human
ucucugaagugaaacu

SEQ ID NO: 3847500 - RNA, 21 nt, Human
ucucugaccuacucgagggac

SEQ ID NO: 3847501 - RNA, 14 nt, Human
uccugugugugcgc

SEQ ID NO: 3847502 - RNA, 12 nt, Human
uccuguguguua

SEQ ID NO: 3847503 - RNA, 18 nt, Human
uccuguguguuaagcucu

SEQ ID NO: 3847504 - RNA, 12 nt, Human
uccuguguuucu

SEQ ID NO: 3847505 - RNA, 21 nt, Human
uccuguuaauguauuuguuca

SEQ ID NO: 3847506 - RNA, 18 nt, Human
uccuguuacuuaccuaaa

SEQ ID NO: 3847507 - RNA, 14 nt, Human
uccuguucagcauu

SEQ ID NO: 3847508 - RNA, 19 nt, Human
uccuguucccaugagauga

SEQ ID NO: 3847509 - RNA, 17 nt, Human
uccuguugaaaagccau

SEQ ID NO: 3847510 - RNA, 18 nt, Human
uccuguugaaaagccaug

SEQ ID NO: 3847511 - RNA, 19 nt, Human
uccuguugcacccagcccu

SEQ ID NO: 3847512 - RNA, 16 nt, Human
uccuguuucaaguuca

SEQ ID NO: 3847513 - RNA, 22 nt, Human
uccuguuucccuucccuuccac

SEQ ID NO: 3847514 - RNA, 20 nt, Human
uccuguuucucagucucaca

SEQ ID NO: 3847515 - RNA, 17 nt, Human
uccuguuucugaaaaga

SEQ ID NO: 3847516 - RNA, 18 nt, Human
uccuguuucugaaaagaa

SEQ ID NO: 3847517 - RNA, 22 nt, Human
uccuguuugggccccucuccca

SEQ ID NO: 3847518 - RNA, 15 nt, Human
uccuguuuuuauuau

SEQ ID NO: 3847519 - RNA, 21 nt, Human
uccuguuuuuauuauuaacaa

SEQ ID NO: 3847520 - RNA, 16 nt, Human
uccuguuuuucugggu

SEQ ID NO: 3847521 - RNA, 14 nt, Human
uccuguuuuuguua

SEQ ID NO: 3847522 - RNA, 12 nt, Human
uccuuaaaaauc

SEQ ID NO: 3847523 - RNA, 15 nt, Human
uccuuaaacagggca

SEQ ID NO: 3847524 - RNA, 18 nt, Human
uccuuaaagaguguggca

SEQ ID NO: 3847525 - RNA, 22 nt, Human
uccuuaaaggcaccaucuaaua

SEQ ID NO: 3847526 - RNA, 15 nt, Human
uccuuaaaucuuaau

SEQ ID NO: 3847527 - RNA, 21 nt, Human
uccuuaaaucuuaauguuccu

SEQ ID NO: 3847528 - RNA, 17 nt, Human
uccuuaagcugcagaga

SEQ ID NO: 3847529 - RNA, 17 nt, Human
uccuuaagucagaacag

SEQ ID NO: 3847530 - RNA, 14 nt, Human
uccuuaaugauccg

SEQ ID NO: 3847531 - RNA, 18 nt, Human
uccuuaauucacucccac

SEQ ID NO: 3847532 - RNA, 19 nt, Human
uccuuaauucacucccaca

SEQ ID NO: 3847533 - RNA, 20 nt, Human
uccuuacaaaugauugcuuu

SEQ ID NO: 3847534 - RNA, 21 nt, Human
uccuuacaaguuagaaaacau

SEQ ID NO: 3847535 - RNA, 18 nt, Human
uccuuacccaucugcacc

SEQ ID NO: 3847536 - RNA, 15 nt, Human
uccuuaccuuuuuau

SEQ ID NO: 3847537 - RNA, 16 nt, Human
uccuuacuccuguggg

SEQ ID NO: 3847538 - RNA, 20 nt, Human
uccuuacuccugugggagcc

SEQ ID NO: 3847539 - RNA, 18 nt, Human
uccuuacuuuuuauauau

SEQ ID NO: 3847540 - RNA, 16 nt, Human
uccuuagaaaagccau

SEQ ID NO: 3847541 - RNA, 15 nt, Human
uccuuagaacauuuu

SEQ ID NO: 3847542 - RNA, 15 nt, Human
uccuuagcaacagcc

SEQ ID NO: 3847543 - RNA, 21 nt, Human
uccuuagccuggaccucugac

SEQ ID NO: 3847544 - RNA, 17 nt, Human
uccuuaucaaaggacac

SEQ ID NO: 3847545 - RNA, 21 nt, Human
uccuuaucacugacacaaaaa

SEQ ID NO: 3847546 - RNA, 15 nt, Human
uccuuaucagagcua

SEQ ID NO: 3847547 - RNA, 14 nt, Human
uccuuaucuagcug

SEQ ID NO: 3847548 - RNA, 19 nt, Human
uccuucaaaauccuuccaa

SEQ ID NO: 3847549 - RNA, 19 nt, Human
uccuucaagaacucugggc

SEQ ID NO: 3847550 - RNA, 20 nt, Human
uccuucaagaucauguaccc

SEQ ID NO: 3847551 - RNA, 23 nt, Human
uccuucaaguuagcucaggaggc

SEQ ID NO: 3847552 - RNA, 23 nt, Human
uccuucaauuccauauauccuuu

SEQ ID NO: 3847553 - RNA, 20 nt, Human
uccuucacauccuguguuuc

SEQ ID NO: 3847554 - RNA, 17 nt, Human
uccuucaccucacugaa

SEQ ID NO: 3847555 - RNA, 13 nt, Human
uccuucacugcuc

SEQ ID NO: 3847556 - RNA, 13 nt, Human
uccuucacuguuu

SEQ ID NO: 3847557 - RNA, 19 nt, Human
uccuucagagagcagugcu

SEQ ID NO: 3847558 - RNA, 20 nt, Human
uccuucagagagcagugcuu

SEQ ID NO: 3847559 - RNA, 21 nt, Human
uccuucagagagcagugcuuu

SEQ ID NO: 3847560 - RNA, 17 nt, Human
uccuucagauauuuuua

SEQ ID NO: 3847561 - RNA, 15 nt, Human
uccuucagcacuuua

SEQ ID NO: 3847562 - RNA, 13 nt, Human
uccuucagcccuc

SEQ ID NO: 3847563 - RNA, 14 nt, Human
uccuucagcccuca

SEQ ID NO: 3847564 - RNA, 19 nt, Human
uccuucagcccucaccccu

SEQ ID NO: 3847565 - RNA, 13 nt, Human
uccuucagccuga

SEQ ID NO: 3847566 - RNA, 12 nt, Human
uccuucagugca

SEQ ID NO: 3847567 - RNA, 16 nt, Human
uccuucagugccuuau

SEQ ID NO: 3847568 - RNA, 17 nt, Human
uccuucagugccuuaug

SEQ ID NO: 3847569 - RNA, 22 nt, Human
uccuucagugccuuauggaaca

SEQ ID NO: 3847570 - RNA, 23 nt, Human
uccuucauaugaaaggugccaug

SEQ ID NO: 3847571 - RNA, 20 nt, Human
uccuuccaacaggagcuggg

SEQ ID NO: 3847572 - RNA, 14 nt, Human
uccuuccaacugcu

SEQ ID NO: 3847573 - RNA, 20 nt, Human
uccuuccaaugucuggagac

SEQ ID NO: 3847574 - RNA, 15 nt, Human
uccuuccagcccaga

SEQ ID NO: 3847575 - RNA, 16 nt, Human
uccuuccaggccccca

SEQ ID NO: 3847576 - RNA, 24 nt, Human
uccuuccagugucauuucucaucc

SEQ ID NO: 3847577 - RNA, 17 nt, Human
uccuuccaucccuaccc

SEQ ID NO: 3847578 - RNA, 13 nt, Human
uccuuccaugaaa

SEQ ID NO: 3847579 - RNA, 23 nt, Human
uccuucccaaaggacuccaccca

SEQ ID NO: 3847580 - RNA, 22 nt, Human
uccuucccaaguaagaggcugg

SEQ ID NO: 3847581 - RNA, 12 nt, Human
uccuucccagag

SEQ ID NO: 3847582 - RNA, 23 nt, Human
uccuucccagaggggccugccac

SEQ ID NO: 3847583 - RNA, 20 nt, Human
uccuuccuaauuucccuucu

SEQ ID NO: 3847584 - RNA, 22 nt, Human
uccuuccuaguucaucccuucu

SEQ ID NO: 3847585 - RNA, 14 nt, Human
uccuuccugaaacu

SEQ ID NO: 3847586 - RNA, 12 nt, Human
uccuuccugucu

SEQ ID NO: 3847587 - RNA, 17 nt, Human
uccuuccugucuuccug

SEQ ID NO: 3847588 - RNA, 16 nt, Human
uccuuccuguucugaa

SEQ ID NO: 3847589 - RNA, 15 nt, Human
uccuuccuucccacc

SEQ ID NO: 3847590 - RNA, 15 nt, Human
uccuuccuucccugg

SEQ ID NO: 3847591 - RNA, 16 nt, Human
uccuuccuucccuggc

SEQ ID NO: 3847592 - RNA, 16 nt, Human
uccuuccuugaccagc

SEQ ID NO: 3847593 - RNA, 17 nt, Human
uccuucguaucccgagu

SEQ ID NO: 3847594 - RNA, 23 nt, Human
uccuucguaucccgagucuggga

SEQ ID NO: 3847595 - RNA, 21 nt, Human
uccuucgugaacauccccucc

SEQ ID NO: 3847596 - RNA, 14 nt, Human
uccuucuacuuaca

SEQ ID NO: 3847597 - RNA, 14 nt, Human
uccuucuccacccc

SEQ ID NO: 3847598 - RNA, 14 nt, Human
uccuucucccaucu

SEQ ID NO: 3847599 - RNA, 20 nt, Human
uccuucucugaacacaggca

SEQ ID NO: 3847600 - RNA, 22 nt, Human
uccuucucugaacacaggcagc

SEQ ID NO: 3847601 - RNA, 13 nt, Human
uccuucugggcau

SEQ ID NO: 3847602 - RNA, 12 nt, Human
uccuucuuuaaa

SEQ ID NO: 3847603 - RNA, 16 nt, Human
uccuucuuugauaaug

SEQ ID NO: 3847604 - RNA, 22 nt, Human
uccuugaaaacacuguucucug

SEQ ID NO: 3847605 - RNA, 23 nt, Human
uccuugaaaacacuguucucugc

SEQ ID NO: 3847606 - RNA, 21 nt, Human
uccuugaagaacugcaggccc

SEQ ID NO: 3847607 - RNA, 13 nt, Human
uccuugaccagca

SEQ ID NO: 3847608 - RNA, 19 nt, Human
uccuugaccuuccucuggg

SEQ ID NO: 3847609 - RNA, 17 nt, Human
uccuugagacacggagc

SEQ ID NO: 3847610 - RNA, 19 nt, Human
uccuugaggggagccagga

SEQ ID NO: 3847611 - RNA, 16 nt, Human
uccuugaguguaugag

SEQ ID NO: 3847612 - RNA, 17 nt, Human
uccuugauaauauauug

SEQ ID NO: 3847613 - RNA, 22 nt, Human
uccuugauaauguugugguuug

SEQ ID NO: 3847614 - RNA, 13 nt, Human
uccuugauauuug

SEQ ID NO: 3847615 - RNA, 17 nt, Human
uccuugauauuuguauu

SEQ ID NO: 3847616 - RNA, 19 nt, Human
uccuugauauuuguauuua

SEQ ID NO: 3847617 - RNA, 13 nt, Human
uccuugaucauuu

SEQ ID NO: 3847618 - RNA, 22 nt, Human
uccuugaucuguauauacaaua

SEQ ID NO: 3847619 - RNA, 22 nt, Human
uccuugauuucaaaguuuuguu

SEQ ID NO: 3847620 - RNA, 20 nt, Human
uccuugcaccccucacucug

SEQ ID NO: 3847621 - RNA, 24 nt, Human
uccuugcaccccucacucuggccu

SEQ ID NO: 3847622 - RNA, 14 nt, Human
uccuugcaccugca

SEQ ID NO: 3847623 - RNA, 23 nt, Human
uccuugcaucaaggggucacuua

SEQ ID NO: 3847624 - RNA, 17 nt, Human
uccuugccuccugugua

SEQ ID NO: 3847625 - RNA, 15 nt, Human
ucugcacccuccacc

SEQ ID NO: 3847626 - RNA, 23 nt, Human
ucugcacccuggggccuggaccu

SEQ ID NO: 3847627 - RNA, 16 nt, Human
ucugcacccuucuuuu

SEQ ID NO: 3847628 - RNA, 18 nt, Human
ucugcaccguacugugga

SEQ ID NO: 3847629 - RNA, 14 nt, Human
ucugcaccuuaucu

SEQ ID NO: 3847630 - RNA, 20 nt, Human
ucugcacuacuccucugcag

SEQ ID NO: 3847631 - RNA, 21 nt, Human
ucugcacuacuccucugcagu

SEQ ID NO: 3847632 - RNA, 23 nt, Human
ucugcacuacuccucugcagugc

SEQ ID NO: 3847633 - RNA, 21 nt, Human
ucugcacucccaccugacaca

SEQ ID NO: 3847634 - RNA, 22 nt, Human
ucugcacuccccugcugggugu

SEQ ID NO: 3847635 - RNA, 21 nt, Human
ucugcacucuaacccuaggca

SEQ ID NO: 3847636 - RNA, 15 nt, Human
ucugcacuuaaauau

SEQ ID NO: 3847637 - RNA, 23 nt, Human
ucugcacuugcgguuccggcaug

SEQ ID NO: 3847638 - RNA, 10 nt, Human
ucugcagaag

SEQ ID NO: 3847639 - RNA, 19 nt, Human
ucugcagacacgccuuccc

SEQ ID NO: 3847640 - RNA, 16 nt, Human
ucugcagacuucccag

SEQ ID NO: 3847641 - RNA, 19 nt, Human
ucugcagacuucccagcua

SEQ ID NO: 3847642 - RNA, 18 nt, Human
ucugcagauaaacaguag

SEQ ID NO: 3847643 - RNA, 20 nt, Human
ucugcagcaugaccugugac

SEQ ID NO: 3847644 - RNA, 15 nt, Human
ucugcagccagccca

SEQ ID NO: 3847645 - RNA, 16 nt, Human
ucugcagccagcccag

SEQ ID NO: 3847646 - RNA, 20 nt, Human
ucugcagcugaccucuguug

SEQ ID NO: 3847647 - RNA, 15 nt, Human
ucugcagcuguuuua

SEQ ID NO: 3847648 - RNA, 22 nt, Human
ucugcaggauugauuaugcaga

SEQ ID NO: 3847649 - RNA, 14 nt, Human
ucugcaggcaccuu

SEQ ID NO: 3847650 - RNA, 14 nt, Human
ucugcaggcagaca

SEQ ID NO: 3847651 - RNA, 15 nt, Human
ucugcaggcagacac

SEQ ID NO: 3847652 - RNA, 15 nt, Human
ucugcaggucccuaa

SEQ ID NO: 3847653 - RNA, 16 nt, Human
ucugcaggucccuaau

SEQ ID NO: 3847654 - RNA, 21 nt, Human
ucugcaggucccuaauaaagc

SEQ ID NO: 3847655 - RNA, 23 nt, Human
ucugcaggucccuaauaaagcug

SEQ ID NO: 3847656 - RNA, 22 nt, Human
ucugcagguugaagccaugucu

SEQ ID NO: 3847657 - RNA, 18 nt, Human
ucugcaguagucucugug

SEQ ID NO: 3847658 - RNA, 20 nt, Human
ucugcaguagucucugugcu

SEQ ID NO: 3847659 - RNA, 20 nt, Human
ucugcagucucuauaccaau

SEQ ID NO: 3847660 - RNA, 21 nt, Human
ucugcagucucuauaccaaua

SEQ ID NO: 3847661 - RNA, 16 nt, Human
ucugcagugugccccc

SEQ ID NO: 3847662 - RNA, 14 nt, Human
ucugcaucagcugc

SEQ ID NO: 3847663 - RNA, 21 nt, Human
ucugcaucagcugcugaaaca

SEQ ID NO: 3847664 - RNA, 18 nt, Human
ucugcaucaucuguagau

SEQ ID NO: 3847665 - RNA, 21 nt, Human
ucugcaucaucuguagauacu

SEQ ID NO: 3847666 - RNA, 23 nt, Human
ucugcauccagagauucauuuuc

SEQ ID NO: 3847667 - RNA, 22 nt, Human
ucugcaucccagcaccugccuc

SEQ ID NO: 3847668 - RNA, 13 nt, Human
ucugcaucuccac

SEQ ID NO: 3847669 - RNA, 17 nt, Human
ucugcaugcggcccagc

SEQ ID NO: 3847670 - RNA, 22 nt, Human
ucugcaugcggcccagcccggc

SEQ ID NO: 3847671 - RNA, 15 nt, Human
ucugcauuuagcaca

SEQ ID NO: 3847672 - RNA, 15 nt, Human
ucugcauuucggugg

SEQ ID NO: 3847673 - RNA, 18 nt, Human
ucugcauuucgguggcua

SEQ ID NO: 3847674 - RNA, 16 nt, Human
ucugcauuuucugggu

SEQ ID NO: 3847675 - RNA, 16 nt, Human
ucugcauuuugcuauu

SEQ ID NO: 3847676 - RNA, 20 nt, Human
ucugcauuuuucugcagaag

SEQ ID NO: 3847677 - RNA, 19 nt, Human
ucugccaaaggaugugaua

SEQ ID NO: 3847678 - RNA, 17 nt, Human
ucugccaaccuaaaacu

SEQ ID NO: 3847679 - RNA, 19 nt, Human
ucugccaauuuuugccuuc

SEQ ID NO: 3847680 - RNA, 15 nt, Human
ucugccacacucuga

SEQ ID NO: 3847681 - RNA, 16 nt, Human
ucugccaccaaaggcc

SEQ ID NO: 3847682 - RNA, 19 nt, Human
ucugccaccaaaggccagg

SEQ ID NO: 3847683 - RNA, 17 nt, Human
ucugccaccauccugcu

SEQ ID NO: 3847684 - RNA, 14 nt, Human
ucugccacccuacc

SEQ ID NO: 3847685 - RNA, 17 nt, Human
ucugccacccuaccugu

SEQ ID NO: 3847686 - RNA, 18 nt, Human
ucugccacccuaccuguu

SEQ ID NO: 3847687 - RNA, 14 nt, Human
ucugccaccucccc

SEQ ID NO: 3847688 - RNA, 15 nt, Human
ucugccacuucccag

SEQ ID NO: 3847689 - RNA, 16 nt, Human
ucugccacuucccagg

SEQ ID NO: 3847690 - RNA, 21 nt, Human
ucugccagaagauccccucag

SEQ ID NO: 3847691 - RNA, 22 nt, Human
ucugccagaagauccccucagg

SEQ ID NO: 3847692 - RNA, 17 nt, Human
ucugccagcaaagagga

SEQ ID NO: 3847693 - RNA, 16 nt, Human
ucugccagccagcagc

SEQ ID NO: 3847694 - RNA, 14 nt, Human
ucugccaggccccc

SEQ ID NO: 3847695 - RNA, 20 nt, Human
ucugccaggcccccaccaca

SEQ ID NO: 3847696 - RNA, 11 nt, Human
ucugccagggc

SEQ ID NO: 3847697 - RNA, 16 nt, Human
ucugccagggcagugc

SEQ ID NO: 3847698 - RNA, 22 nt, Human
ucugccagggccccucucccca

SEQ ID NO: 3847699 - RNA, 14 nt, Human
ucugccauuucaug

SEQ ID NO: 3847700 - RNA, 19 nt, Human
ucugcccaaaaauaugguu

SEQ ID NO: 3847701 - RNA, 21 nt, Human
ucuacccuggcacuauaaugu

SEQ ID NO: 3847702 - RNA, 19 nt, Human
ucuaccuagauuuaauaua

SEQ ID NO: 3847703 - RNA, 15 nt, Human
ucuaccucuuggcug

SEQ ID NO: 3847704 - RNA, 16 nt, Human
ucuaccugccacucac

SEQ ID NO: 3847705 - RNA, 21 nt, Human
ucuaccugccacucacacagc

SEQ ID NO: 3847706 - RNA, 18 nt, Human
ucuaccugcccucaaggg

SEQ ID NO: 3847707 - RNA, 21 nt, Human
ucuaccuuccagucaggauga

SEQ ID NO: 3847708 - RNA, 14 nt, Human
ucuaccuuccugca

SEQ ID NO: 3847709 - RNA, 23 nt, Human
ucuaccuucuccccagcucccag

SEQ ID NO: 3847710 - RNA, 15 nt, Human
ucuacuaaaaauaca

SEQ ID NO: 3847711 - RNA, 20 nt, Human
ucuacuaaaaauacaaaaau

SEQ ID NO: 3847712 - RNA, 15 nt, Human
ucuacuaauuccaca

SEQ ID NO: 3847713 - RNA, 21 nt, Human
ucuacucagaaauuuuuauuu

SEQ ID NO: 3847714 - RNA, 18 nt, Human
ucuacucauauauaucua

SEQ ID NO: 3847715 - RNA, 21 nt, Human
ucuacucccaaguaugggguu

SEQ ID NO: 3847716 - RNA, 18 nt, Human
ucuacucuagggaaaaac

SEQ ID NO: 3847717 - RNA, 18 nt, Human
ucuacucucccauggcuu

SEQ ID NO: 3847718 - RNA, 20 nt, Human
ucuacucuccucaucucuaa

SEQ ID NO: 3847719 - RNA, 18 nt, Human
ucuacugaggugcuaugu

SEQ ID NO: 3847720 - RNA, 16 nt, Human
ucuacugggagccuac

SEQ ID NO: 3847721 - RNA, 19 nt, Human
ucuacugggagccuaccca

SEQ ID NO: 3847722 - RNA, 23 nt, Human
ucuacuggucuuguggaauuggg

SEQ ID NO: 3847723 - RNA, 21 nt, Human
ucuacuuaauccaauggguuu

SEQ ID NO: 3847724 - RNA, 20 nt, Human
ucuacuucauguaauccaaa

SEQ ID NO: 3847725 - RNA, 18 nt, Human
ucuacuucuggagucuau

SEQ ID NO: 3847726 - RNA, 21 nt, Human
ucuacuugcucuggaccugcc

SEQ ID NO: 3847727 - RNA, 22 nt, Human
ucuacuugcucuggaccugccc

SEQ ID NO: 3847728 - RNA, 14 nt, Human
ucuacuuuaauaaa

SEQ ID NO: 3847729 - RNA, 15 nt, Human
ucuacuuuaauaaau

SEQ ID NO: 3847730 - RNA, 14 nt, Human
ucuacuuuauuaau

SEQ ID NO: 3847731 - RNA, 12 nt, Human
ucuacuuugaag

SEQ ID NO: 3847732 - RNA, 20 nt, Human
ucuacuuugaagucauacca

SEQ ID NO: 3847733 - RNA, 15 nt, Human
ucuacuuuuacucau

SEQ ID NO: 3847734 - RNA, 22 nt, Human
ucuagaaaaacaggcacuuggc

SEQ ID NO: 3847735 - RNA, 11 nt, Human
ucuagaaagaa

SEQ ID NO: 3847736 - RNA, 16 nt, Human
ucuagaacacaggcaa

SEQ ID NO: 3847737 - RNA, 17 nt, Human
ucuagaacacaggcaaa

SEQ ID NO: 3847738 - RNA, 20 nt, Human
ucuagaacaucccugccagc

SEQ ID NO: 3847739 - RNA, 15 nt, Human
ucuagaagaaaugaa

SEQ ID NO: 3847740 - RNA, 23 nt, Human
ucuagaagaaaugaaauuuuacc

SEQ ID NO: 3847741 - RNA, 21 nt, Human
ucuagaagacugucagcuucc

SEQ ID NO: 3847742 - RNA, 18 nt, Human
ucuagaagagucuauugu

SEQ ID NO: 3847743 - RNA, 20 nt, Human
ucuagaaguuguuugucauc

SEQ ID NO: 3847744 - RNA, 20 nt, Human
ucuagaauguguuuucugaa

SEQ ID NO: 3847745 - RNA, 23 nt, Human
ucuagaauuauaagucacaaaga

SEQ ID NO: 3847746 - RNA, 16 nt, Human
ucuagaauuuuaagcc

SEQ ID NO: 3847747 - RNA, 17 nt, Human
ucuagaauuuuaagccu

SEQ ID NO: 3847748 - RNA, 19 nt, Human
ucuagaauuuuaagccuuu

SEQ ID NO: 3847749 - RNA, 21 nt, Human
ucuagacaagauauuguacau

SEQ ID NO: 3847750 - RNA, 20 nt, Human
ucuagacauggagguucuaa

SEQ ID NO: 3847751 - RNA, 13 nt, Human
ucuagacuuucug

SEQ ID NO: 3847752 - RNA, 13 nt, Human
ucuagagaagagg

SEQ ID NO: 3847753 - RNA, 16 nt, Human
ucuagagaagaggcug

SEQ ID NO: 3847754 - RNA, 23 nt, Human
ucuagagagggaauucucuuggc

SEQ ID NO: 3847755 - RNA, 23 nt, Human
ucuagagagggaggcaagcccug

SEQ ID NO: 3847756 - RNA, 15 nt, Human
ucuagagcagggauu

SEQ ID NO: 3847757 - RNA, 18 nt, Human
ucuagagccuucagccuu

SEQ ID NO: 3847758 - RNA, 21 nt, Human
ucuagagcuuaaugcuacaug

SEQ ID NO: 3847759 - RNA, 17 nt, Human
ucuagagcuuagcauau

SEQ ID NO: 3847760 - RNA, 17 nt, Human
ucuagagcuugaugcca

SEQ ID NO: 3847761 - RNA, 20 nt, Human
ucuagaguccaagguuuaaa

SEQ ID NO: 3847762 - RNA, 18 nt, Human
ucuagaguucagaguccu

SEQ ID NO: 3847763 - RNA, 15 nt, Human
ucuagauacaauaaa

SEQ ID NO: 3847764 - RNA, 22 nt, Human
ucuagauaccuaaaacauaaga

SEQ ID NO: 3847765 - RNA, 15 nt, Human
ucuagauaucgacuu

SEQ ID NO: 3847766 - RNA, 18 nt, Human
ucuagaucagaugcucca

SEQ ID NO: 3847767 - RNA, 19 nt, Human
ucuagaucuuugugccaaa

SEQ ID NO: 3847768 - RNA, 19 nt, Human
ucuaucuuguuccaaggcc

SEQ ID NO: 3847769 - RNA, 13 nt, Human
ucuaugaaauauu

SEQ ID NO: 3847770 - RNA, 23 nt, Human
ucuaugaacucuguuuucuuucu

SEQ ID NO: 3847771 - RNA, 14 nt, Human
ucuaugacacaugc

SEQ ID NO: 3847772 - RNA, 18 nt, Human
ucuaugagucuagauguu

SEQ ID NO: 3847773 - RNA, 22 nt, Human
ucuaugauuccagguggcauca

SEQ ID NO: 3847774 - RNA, 16 nt, Human
ucuaugccaaagauca

SEQ ID NO: 3847775 - RNA, 17 nt, Human
ucuaugccaaagaucac

SEQ ID NO: 3847776 - RNA, 18 nt, Human
ucuaugccccaaauauag

SEQ ID NO: 3847777 - RNA, 15 nt, Human
ucuaugcucauaacu

SEQ ID NO: 3847778 - RNA, 16 nt, Human
ucuaugcugaguuugu

SEQ ID NO: 3847779 - RNA, 17 nt, Human
ucuaugcuuuccaaacc

SEQ ID NO: 3847780 - RNA, 15 nt, Human
ucuauggguguuauc

SEQ ID NO: 3847781 - RNA, 15 nt, Human
ucuauggguuuaguu

SEQ ID NO: 3847782 - RNA, 21 nt, Human
ucuauggguuuaguuacuuua

SEQ ID NO: 3847783 - RNA, 17 nt, Human
ucuaugguaaagauauu

SEQ ID NO: 3847784 - RNA, 16 nt, Human
ucuaugguuaugaaag

SEQ ID NO: 3847785 - RNA, 18 nt, Human
ucuaugguuaugaaagaa

SEQ ID NO: 3847786 - RNA, 22 nt, Human
ucuauguacuaguacuguguac

SEQ ID NO: 3847787 - RNA, 16 nt, Human
ucuauguauauacauu

SEQ ID NO: 3847788 - RNA, 22 nt, Human
ucuauguaucaaauguaacuua

SEQ ID NO: 3847789 - RNA, 11 nt, Human
ucuauuaaaag

SEQ ID NO: 3847790 - RNA, 15 nt, Human
ucuauuaaaagacuc

SEQ ID NO: 3847791 - RNA, 16 nt, Human
ucuauuaaaagacuca

SEQ ID NO: 3847792 - RNA, 18 nt, Human
ucuauuaaaagacucauc

SEQ ID NO: 3847793 - RNA, 19 nt, Human
ucuauuaaaagacucaucc

SEQ ID NO: 3847794 - RNA, 22 nt, Human
ucuauuaaaagacucauccguc

SEQ ID NO: 3847795 - RNA, 16 nt, Human
ucuauuaagauuucca

SEQ ID NO: 3847796 - RNA, 18 nt, Human
ucuauuaagauuuccaag

SEQ ID NO: 3847797 - RNA, 12 nt, Human
ucuauuaauaua

SEQ ID NO: 3847798 - RNA, 21 nt, Human
ucuauuaauauauguauuauu

SEQ ID NO: 3847799 - RNA, 17 nt, Human
ucuauuacauuuucagu

SEQ ID NO: 3847800 - RNA, 14 nt, Human
ucuauuagacuuua

SEQ ID NO: 3847801 - RNA, 18 nt, Human
ucuauuagacuuuagaaa

SEQ ID NO: 3847802 - RNA, 22 nt, Human
ucuauuauacuguauuaagagu

SEQ ID NO: 3847803 - RNA, 15 nt, Human
ucuauuauggaaaac

SEQ ID NO: 3847804 - RNA, 14 nt, Human
ucuauuccaauaaa

SEQ ID NO: 3847805 - RNA, 14 nt, Human
ucuauuccagcuca

SEQ ID NO: 3847806 - RNA, 15 nt, Human
ucuauuccagcucau

SEQ ID NO: 3847807 - RNA, 16 nt, Human
ucuauuccuucuggcc

SEQ ID NO: 3847808 - RNA, 17 nt, Human
ucuauuccuucuggccu

SEQ ID NO: 3847809 - RNA, 18 nt, Human
ucuauuccuucuggccuu

SEQ ID NO: 3847810 - RNA, 19 nt, Human
ucuauucgccacacaguau

SEQ ID NO: 3847811 - RNA, 19 nt, Human
ucuauucugagaaaacaag

SEQ ID NO: 3847812 - RNA, 21 nt, Human
ucuauugauaauuuagacauu

SEQ ID NO: 3847813 - RNA, 21 nt, Human
ucuauugccucugagagcauc

SEQ ID NO: 3847814 - RNA, 16 nt, Human
ucuauugccuucuuug

SEQ ID NO: 3847815 - RNA, 18 nt, Human
ucuauugccuucuuugaa

SEQ ID NO: 3847816 - RNA, 19 nt, Human
ucuauugccuucuuugaag

SEQ ID NO: 3847817 - RNA, 20 nt, Human
ucuauugccuucuuugaaga

SEQ ID NO: 3847818 - RNA, 16 nt, Human
ucuauugggauuuucu

SEQ ID NO: 3847819 - RNA, 14 nt, Human
ucuauuguagcauu

SEQ ID NO: 3847820 - RNA, 19 nt, Human
ucuauuguagcauuucuug

SEQ ID NO: 3847821 - RNA, 18 nt, Human
ucuauugugggacuuauu

SEQ ID NO: 3847822 - RNA, 16 nt, Human
ucuauuguuacucugg

SEQ ID NO: 3847823 - RNA, 14 nt, Human
ucuauuuauaauac

SEQ ID NO: 3847824 - RNA, 18 nt, Human
ucuauuuauauguacaug

SEQ ID NO: 3847825 - RNA, 14 nt, Human
ucuauuuaugccuu

SEQ ID NO: 3847826 - RNA, 13 nt, Human
ucuauuuauuuau

SEQ ID NO: 3847827 - RNA, 11 nt, Human
ucuauuucuag

SEQ ID NO: 3847828 - RNA, 15 nt, Human
ucuauuucuccucca

SEQ ID NO: 3847829 - RNA, 20 nt, Human
ucuauuucuccuccauggga

SEQ ID NO: 3847830 - RNA, 12 nt, Human
ucuauuucugag

SEQ ID NO: 3847831 - RNA, 13 nt, Human
ucuauuucugaga

SEQ ID NO: 3847832 - RNA, 20 nt, Human
ucuauuucugagaagguccu

SEQ ID NO: 3847833 - RNA, 13 nt, Human
ucuauuucugcug

SEQ ID NO: 3847834 - RNA, 18 nt, Human
ucuauuugacuugugguu

SEQ ID NO: 3847835 - RNA, 12 nt, Human
ucuauuuggaau

SEQ ID NO: 3847836 - RNA, 13 nt, Human
ucuauuuggaauu

SEQ ID NO: 3847837 - RNA, 20 nt, Human
ucuauuuuaauaaaaauaau

SEQ ID NO: 3847838 - RNA, 16 nt, Human
ucuauuuucauuuucu

SEQ ID NO: 3847839 - RNA, 14 nt, Human
ucuauuuucuaugu

SEQ ID NO: 3847840 - RNA, 18 nt, Human
ucuauuuucuauguacua

SEQ ID NO: 3847841 - RNA, 15 nt, Human
ucuauuuugaugcag

SEQ ID NO: 3847842 - RNA, 17 nt, Human
ucuauuuuguaaacuca

SEQ ID NO: 3847843 - RNA, 24 nt, Human
ucuauuuuguaacuuucucuauga

SEQ ID NO: 3847844 - RNA, 22 nt, Human
ucucaaaaaaaaaaaaaugcac

SEQ ID NO: 3847845 - RNA, 14 nt, Human
ucucaaaaauaaau

SEQ ID NO: 3847846 - RNA, 17 nt, Human
ucucaaaacugcacugu

SEQ ID NO: 3847847 - RNA, 14 nt, Human
ucucaaaagaacuu

SEQ ID NO: 3847848 - RNA, 20 nt, Human
ucucaaacaaggggcuguua

SEQ ID NO: 3847849 - RNA, 23 nt, Human
ucucaaacacaguuacacuugug

SEQ ID NO: 3847850 - RNA, 17 nt, Human
ucucaaacuaaaagaca

SEQ ID NO: 3847851 - RNA, 19 nt, Human
ucucaaacuaaaagacauu

SEQ ID NO: 3847852 - RNA, 17 nt, Human
ucucaaacuaacaggcu

SEQ ID NO: 3847853 - RNA, 13 nt, Human
ucucaaacucuug

SEQ ID NO: 3847854 - RNA, 22 nt, Human
ucucaaagaaauuuccacucag

SEQ ID NO: 3847855 - RNA, 16 nt, Human
ucucaaaggagcgagc

SEQ ID NO: 3847856 - RNA, 16 nt, Human
ucucaaaguuuugaaa

SEQ ID NO: 3847857 - RNA, 13 nt, Human
ucucaaauuucua

SEQ ID NO: 3847858 - RNA, 18 nt, Human
ucucaaauuucuaaaucu

SEQ ID NO: 3847859 - RNA, 21 nt, Human
ucucaaauuuggauugcuaau

SEQ ID NO: 3847860 - RNA, 14 nt, Human
ucucaacacccagu

SEQ ID NO: 3847861 - RNA, 23 nt, Human
ucucaacaggccucagggcuccu

SEQ ID NO: 3847862 - RNA, 14 nt, Human
ucucaacaugucuc

SEQ ID NO: 3847863 - RNA, 18 nt, Human
ucucaacaugucuccuac

SEQ ID NO: 3847864 - RNA, 14 nt, Human
ucugcuucagccuc

SEQ ID NO: 3847865 - RNA, 13 nt, Human
ucugcuucagugg

SEQ ID NO: 3847866 - RNA, 13 nt, Human
ucugcuucucuca

SEQ ID NO: 3847867 - RNA, 14 nt, Human
ucugcuucucucac

SEQ ID NO: 3847868 - RNA, 16 nt, Human
ucugcuucucucaccu

SEQ ID NO: 3847869 - RNA, 19 nt, Human
ucugcuucucugacuucug

SEQ ID NO: 3847870 - RNA, 15 nt, Human
ucugcuucugcaccu

SEQ ID NO: 3847871 - RNA, 19 nt, Human
ucugcuugacaacaucuga

SEQ ID NO: 3847872 - RNA, 12 nt, Human
ucugcuugaguc

SEQ ID NO: 3847873 - RNA, 14 nt, Human
ucugcuugagucag

SEQ ID NO: 3847874 - RNA, 20 nt, Human
ucugcuugccaucccucccu

SEQ ID NO: 3847875 - RNA, 20 nt, Human
ucugcuugccgaaacuggaa

SEQ ID NO: 3847876 - RNA, 14 nt, Human
ucugcuuguguuaa

SEQ ID NO: 3847877 - RNA, 20 nt, Human
ucugcuuuaaaaaugucuua

SEQ ID NO: 3847878 - RNA, 22 nt, Human
ucugcuuuaaagggccugccug

SEQ ID NO: 3847879 - RNA, 16 nt, Human
ucugcuuuagacuuga

SEQ ID NO: 3847880 - RNA, 18 nt, Human
ucugcuuuagacuugaaa

SEQ ID NO: 3847881 - RNA, 15 nt, Human
ucugcuuuauguugc

SEQ ID NO: 3847882 - RNA, 13 nt, Human
ucugcuuuccaca

SEQ ID NO: 3847883 - RNA, 12 nt, Human
ucugcuuuccuc

SEQ ID NO: 3847884 - RNA, 17 nt, Human
ucugcuuucuccuuuaa

SEQ ID NO: 3847885 - RNA, 22 nt, Human
ucugcuuucuuugauucuccuu

SEQ ID NO: 3847886 - RNA, 18 nt, Human
ucugcuuugacugagcag

SEQ ID NO: 3847887 - RNA, 23 nt, Human
ucugcuuuuuaaagaaugcucuu

SEQ ID NO: 3847888 - RNA, 19 nt, Human
ucuggaaaagaacuguuua

SEQ ID NO: 3847889 - RNA, 14 nt, Human
ucuggaaagcaaag

SEQ ID NO: 3847890 - RNA, 14 nt, Human
ucuggaaaggagga

SEQ ID NO: 3847891 - RNA, 16 nt, Human
ucuggaacccagacuc

SEQ ID NO: 3847892 - RNA, 17 nt, Human
ucuggaacccagacuca

SEQ ID NO: 3847893 - RNA, 18 nt, Human
ucuggaacccagacucag

SEQ ID NO: 3847894 - RNA, 16 nt, Human
ucuggaaccucagccu

SEQ ID NO: 3847895 - RNA, 21 nt, Human
ucuggaaccucagccuggcca

SEQ ID NO: 3847896 - RNA, 20 nt, Human
ucuggaagagaggaaugccu

SEQ ID NO: 3847897 - RNA, 22 nt, Human
ucuggaagugacuuuggcugca

SEQ ID NO: 3847898 - RNA, 14 nt, Human
ucuggaauacauga

SEQ ID NO: 3847899 - RNA, 19 nt, Human
ucuggaaucuggagaccag

SEQ ID NO: 3847900 - RNA, 14 nt, Human
ucuggaaugagccu

SEQ ID NO: 3847901 - RNA, 16 nt, Human
ucuggaaugcaguggu

SEQ ID NO: 3847902 - RNA, 14 nt, Human
ucuggaauuugaaa

SEQ ID NO: 3847903 - RNA, 18 nt, Human
ucuggacagccccacccu

SEQ ID NO: 3847904 - RNA, 19 nt, Human
ucuggacaggauguguuug

SEQ ID NO: 3847905 - RNA, 20 nt, Human
ucuggaccccaucugugaau

SEQ ID NO: 3847906 - RNA, 14 nt, Human
ucuggaccucuggg

SEQ ID NO: 3847907 - RNA, 15 nt, Human
ucuggaccucugggu

SEQ ID NO: 3847908 - RNA, 12 nt, Human
ucuggaccugcc

SEQ ID NO: 3847909 - RNA, 13 nt, Human
ucuggaccugccc

SEQ ID NO: 3847910 - RNA, 22 nt, Human
ucuggacggcaggcucacugcc

SEQ ID NO: 3847911 - RNA, 14 nt, Human
ucuggacuaaaacu

SEQ ID NO: 3847912 - RNA, 18 nt, Human
ucuggacuccucugucca

SEQ ID NO: 3847913 - RNA, 14 nt, Human
ucuggacucuaaag

SEQ ID NO: 3847914 - RNA, 13 nt, Human
ucuuccuguaauc

SEQ ID NO: 3847915 - RNA, 13 nt, Human
ucuuccugugauc

SEQ ID NO: 3847916 - RNA, 16 nt, Human
ucuuccuguguccuga

SEQ ID NO: 3847917 - RNA, 21 nt, Human
ucuuccuguuuuguacauaga

SEQ ID NO: 3847918 - RNA, 15 nt, Human
ucuuccuuaaacucc

SEQ ID NO: 3847919 - RNA, 14 nt, Human
ucuuccuucccugc

SEQ ID NO: 3847920 - RNA, 17 nt, Human
ucuuccuucccugcugu

SEQ ID NO: 3847921 - RNA, 18 nt, Human
ucuuccuuucucuuucuc

SEQ ID NO: 3847922 - RNA, 14 nt, Human
ucuuccuuuuauca

SEQ ID NO: 3847923 - RNA, 18 nt, Human
ucuuccuuuucacugcug

SEQ ID NO: 3847924 - RNA, 18 nt, Human
ucuucgaagccuugccua

SEQ ID NO: 3847925 - RNA, 19 nt, Human
ucucugcccauuccccagc

SEQ ID NO: 3847926 - RNA, 15 nt, Human
ucucugcccuccaag

SEQ ID NO: 3847927 - RNA, 21 nt, Human
ucucugccugugagccagucu

SEQ ID NO: 3847928 - RNA, 14 nt, Human
ucucugccuugccu

SEQ ID NO: 3847929 - RNA, 17 nt, Human
ucucugccuugccuuua

SEQ ID NO: 3847930 - RNA, 21 nt, Human
ucucugccuuugacauuuaau

SEQ ID NO: 3847931 - RNA, 12 nt, Human
ucucugcuccac

SEQ ID NO: 3847932 - RNA, 15 nt, Human
ucucugcuccaccac

SEQ ID NO: 3847933 - RNA, 21 nt, Human
ucucugcucugcgugucaccu

SEQ ID NO: 3847934 - RNA, 13 nt, Human
ucucugcugaagg

SEQ ID NO: 3847935 - RNA, 12 nt, Human
ucucugcugccg

SEQ ID NO: 3847936 - RNA, 13 nt, Human
ucucugcuggacg

SEQ ID NO: 3847937 - RNA, 12 nt, Human
ucucugcuggcc

SEQ ID NO: 3847938 - RNA, 16 nt, Human
ucucuggaaaggagga

SEQ ID NO: 3847939 - RNA, 22 nt, Human
ucucuggaaaggggggagcugg

SEQ ID NO: 3847940 - RNA, 20 nt, Human
ucucuggaagccccugggcc

SEQ ID NO: 3847941 - RNA, 19 nt, Human
ucucuggaauuugaaacac

SEQ ID NO: 3847942 - RNA, 20 nt, Human
ucucuggagccaaguccaga

SEQ ID NO: 3847943 - RNA, 22 nt, Human
ucucuggagccaaguccagauu

SEQ ID NO: 3847944 - RNA, 22 nt, Human
ucucuggagugagcucuguuuc

SEQ ID NO: 3847945 - RNA, 14 nt, Human
ucucuggaugccug

SEQ ID NO: 3847946 - RNA, 15 nt, Human
ucucuggaugccuga

SEQ ID NO: 3847947 - RNA, 15 nt, Human
ucucuggccccaagg

SEQ ID NO: 3847948 - RNA, 11 nt, Human
ucucuggccuc

SEQ ID NO: 3847949 - RNA, 13 nt, Human
ucucuggccuucg

SEQ ID NO: 3847950 - RNA, 21 nt, Human
ucucuggccuucggccuccau

SEQ ID NO: 3847951 - RNA, 17 nt, Human
ucucuggccuuuuccua

SEQ ID NO: 3847952 - RNA, 17 nt, Human
ucucuggcuaaggacag

SEQ ID NO: 3847953 - RNA, 12 nt, Human
ucucuggcuggg

SEQ ID NO: 3847954 - RNA, 14 nt, Human
ucucugggagaaaa

SEQ ID NO: 3847955 - RNA, 18 nt, Human
ucucugggagaaaaucau

SEQ ID NO: 3847956 - RNA, 22 nt, Human
ucucugggagaaaaucaucaag

SEQ ID NO: 3847957 - RNA, 17 nt, Human
ucucugggccucagagg

SEQ ID NO: 3847958 - RNA, 20 nt, Human
ucucuggggcaggcugcuuc

SEQ ID NO: 3847959 - RNA, 21 nt, Human
ucucugggggcugaggagcag

SEQ ID NO: 3847960 - RNA, 17 nt, Human
ucucugguaauauugac

SEQ ID NO: 3847961 - RNA, 14 nt, Human
ucucuguacauauu

SEQ ID NO: 3847962 - RNA, 18 nt, Human
ucucuguagggaacucug

SEQ ID NO: 3847963 - RNA, 15 nt, Human
ucucuguauaaacau

SEQ ID NO: 3847964 - RNA, 20 nt, Human
ucucugucccauucccuggg

SEQ ID NO: 3847965 - RNA, 21 nt, Human
ucucugucccauucccuggga

SEQ ID NO: 3847966 - RNA, 17 nt, Human
ucucugucccuugcugu

SEQ ID NO: 3847967 - RNA, 18 nt, Human
ucucugucccuugcugua

SEQ ID NO: 3847968 - RNA, 17 nt, Human
ucucugucuaccaucuc

SEQ ID NO: 3847969 - RNA, 14 nt, Human
ucucugucucaucc

SEQ ID NO: 3847970 - RNA, 23 nt, Human
ucucugucucauccaucaucaug

SEQ ID NO: 3847971 - RNA, 16 nt, Human
ucucugucucaugugu

SEQ ID NO: 3847972 - RNA, 23 nt, Human
ucucugugaacgauuuagaaaga

SEQ ID NO: 3847973 - RNA, 18 nt, Human
ucucugugacccacuucu

SEQ ID NO: 3847974 - RNA, 15 nt, Human
ucucugugagaaggu

SEQ ID NO: 3847975 - RNA, 14 nt, Human
ucucugugagacuc

SEQ ID NO: 3847976 - RNA, 21 nt, Human
ucucugugcuuugacucaccu

SEQ ID NO: 3847977 - RNA, 18 nt, Human
ucucuguggcuccaggcc

SEQ ID NO: 3847978 - RNA, 21 nt, Human
ucucugugucuaagauucuag

SEQ ID NO: 3847979 - RNA, 22 nt, Human
ucucugugucuaagauucuaga

SEQ ID NO: 3847980 - RNA, 18 nt, Human
ucucugugugcacaaaua

SEQ ID NO: 3847981 - RNA, 13 nt, Human
ucucuguucauuu

SEQ ID NO: 3847982 - RNA, 18 nt, Human
ucucuguucauuuccuca

SEQ ID NO: 3847983 - RNA, 14 nt, Human
ucucuguuccaugu

SEQ ID NO: 3847984 - RNA, 21 nt, Human
ucucuguuccauugaaucugu

SEQ ID NO: 3847985 - RNA, 22 nt, Human
ucucuguucuacccguuccaaa

SEQ ID NO: 3847986 - RNA, 18 nt, Human
ucucuguugucguaaaga

SEQ ID NO: 3847987 - RNA, 13 nt, Human
ucucuuaaaguug

SEQ ID NO: 3847988 - RNA, 18 nt, Human
ucucuuaauuuaaucuuu

SEQ ID NO: 3847989 - RNA, 21 nt, Human
ucucuuacccuucugugccca

SEQ ID NO: 3847990 - RNA, 23 nt, Human
ucucuuacccuucugugcccagc

SEQ ID NO: 3847991 - RNA, 13 nt, Human
ucucuuacugcaa

SEQ ID NO: 3847992 - RNA, 15 nt, Human
ucucuuacugcaaau

SEQ ID NO: 3847993 - RNA, 12 nt, Human
ucucuuagaaaa

SEQ ID NO: 3847994 - RNA, 16 nt, Human
ucucuuagaaaaggug

SEQ ID NO: 3847995 - RNA, 16 nt, Human
ucucuuagcuccccuc

SEQ ID NO: 3847996 - RNA, 17 nt, Human
ucucuuagcuccccucc

SEQ ID NO: 3847997 - RNA, 15 nt, Human
ucucuuauagaauau

SEQ ID NO: 3847998 - RNA, 17 nt, Human
ucucuuauagaauauuu

SEQ ID NO: 3847999 - RNA, 18 nt, Human
ucucuuauagaauauuua

SEQ ID NO: 3848000 - RNA, 20 nt, Human
ucucuuauagaauauuuauu

SEQ ID NO: 3848001 - RNA, 23 nt, Human
ucucuuauucaguaaaaaacaac

SEQ ID NO: 3848002 - RNA, 15 nt, Human
ucucuuauugccuca

SEQ ID NO: 3848003 - RNA, 13 nt, Human
ucucuucagucuc

SEQ ID NO: 3848004 - RNA, 18 nt, Human
ucucuuccaggcagccgc

SEQ ID NO: 3848005 - RNA, 17 nt, Human
ucucuuccauaugaccu

SEQ ID NO: 3848006 - RNA, 21 nt, Human
ucucuuccauaugaccucaug

SEQ ID NO: 3848007 - RNA, 15 nt, Human
ucucuuccccucuca

SEQ ID NO: 3848008 - RNA, 17 nt, Human
ucucuucccugcgccug

SEQ ID NO: 3848009 - RNA, 12 nt, Human
ucucuucccuuu

SEQ ID NO: 3848010 - RNA, 19 nt, Human
ucucuucccuuuccccagc

SEQ ID NO: 3848011 - RNA, 11 nt, Human
ucucuuccuac

SEQ ID NO: 3848012 - RNA, 16 nt, Human
ucucuuccuaucccau

SEQ ID NO: 3848013 - RNA, 20 nt, Human
ucucuuccuaucccauccca

SEQ ID NO: 3848014 - RNA, 19 nt, Human
ucucuuccuccgaggccag

SEQ ID NO: 3848015 - RNA, 11 nt, Human
ucucuuccugc

SEQ ID NO: 3848016 - RNA, 11 nt, Human
ucucuuccugu

SEQ ID NO: 3848017 - RNA, 12 nt, Human
ucucuuccugua

SEQ ID NO: 3848018 - RNA, 12 nt, Human
ucucuuccuuga

SEQ ID NO: 3848019 - RNA, 20 nt, Human
ucucuuccuuuuaucaguag

SEQ ID NO: 3848020 - RNA, 19 nt, Human
ucucuucucagaguggugg

SEQ ID NO: 3848021 - RNA, 16 nt, Human
ucucuucuccacugga

SEQ ID NO: 3848022 - RNA, 13 nt, Human
ucucuucucccag

SEQ ID NO: 3848023 - RNA, 13 nt, Human
ucucuucuccuua

SEQ ID NO: 3848024 - RNA, 15 nt, Human
ucucuucucuccagc

SEQ ID NO: 3848025 - RNA, 16 nt, Human
ucucuucucuccagcu

SEQ ID NO: 3848026 - RNA, 14 nt, Human
ucucuucucugcca

SEQ ID NO: 3848027 - RNA, 21 nt, Human
ucucuucuggguuccuuccuc

SEQ ID NO: 3848028 - RNA, 13 nt, Human
ucucuucuguguu

SEQ ID NO: 3848029 - RNA, 12 nt, Human
ucucuucuucau

SEQ ID NO: 3848030 - RNA, 12 nt, Human
ucucuucuuuaa

SEQ ID NO: 3848031 - RNA, 15 nt, Human
ucucuugagccuggg

SEQ ID NO: 3848032 - RNA, 15 nt, Human
ucucuugagcuggcc

SEQ ID NO: 3848033 - RNA, 17 nt, Human
ucucuugagcuggccuc

SEQ ID NO: 3848034 - RNA, 13 nt, Human
ucucuugccucaa

SEQ ID NO: 3848035 - RNA, 13 nt, Human
ucucuugcuuucu

SEQ ID NO: 3848036 - RNA, 23 nt, Human
ucucuugggaacugaacucacuu

SEQ ID NO: 3848037 - RNA, 18 nt, Human
ucucuuuaaaaggaaaga

SEQ ID NO: 3848038 - RNA, 19 nt, Human
ucucuuuaaaaggaaagaa

SEQ ID NO: 3848039 - RNA, 14 nt, Human
ucucuuuaaaaugc

SEQ ID NO: 3848040 - RNA, 22 nt, Human
ucucuuuaagggcaugccuugu

SEQ ID NO: 3848041 - RNA, 21 nt, Human
ucucuuuaaugucacaggcag

SEQ ID NO: 3848042 - RNA, 19 nt, Human
ucucuuuaugucuguggau

SEQ ID NO: 3848043 - RNA, 17 nt, Human
ucucuuucuuccuuuac

SEQ ID NO: 3848044 - RNA, 19 nt, Human
ucucuuucuucucugcugc

SEQ ID NO: 3848045 - RNA, 12 nt, Human
ucucuuucuuua

SEQ ID NO: 3848046 - RNA, 13 nt, Human
ucucuuucuuuac

SEQ ID NO: 3848047 - RNA, 18 nt, Human
ucucuuucuuuacaagau

SEQ ID NO: 3848048 - RNA, 12 nt, Human
ucucuuugaaac

SEQ ID NO: 3848049 - RNA, 14 nt, Human
ucucuuugaaacau

SEQ ID NO: 3848050 - RNA, 20 nt, Human
ucucuuugaauuuucugugu

SEQ ID NO: 3848051 - RNA, 14 nt, Human
ucucuuuguucuca

SEQ ID NO: 3848052 - RNA, 17 nt, Human
ucucuuuguucucagcu

SEQ ID NO: 3848053 - RNA, 19 nt, Human
ucucuuuguucucagcucc

SEQ ID NO: 3848054 - RNA, 21 nt, Human
ucucuuuguucucagcucccc

SEQ ID NO: 3848055 - RNA, 20 nt, Human
ucucuuuuauauuuguagga

SEQ ID NO: 3848056 - RNA, 15 nt, Human
ucucuuuucaaaaca

SEQ ID NO: 3848057 - RNA, 11 nt, Human
ucucuuuucua

SEQ ID NO: 3848058 - RNA, 17 nt, Human
ucucuuuucuguacuuc

SEQ ID NO: 3848059 - RNA, 13 nt, Human
ucucuuuucuuua

SEQ ID NO: 3848060 - RNA, 16 nt, Human
ucuuuaaauguuuuau

SEQ ID NO: 3848061 - RNA, 17 nt, Human
ucuuuaaccaaacaaua

SEQ ID NO: 3848062 - RNA, 21 nt, Human
ucuuuaaccagucugaaguuu

SEQ ID NO: 3848063 - RNA, 16 nt, Human
ucuuuaaccuuguaua

SEQ ID NO: 3848064 - RNA, 16 nt, Human
ucuuuaacucaggacu

SEQ ID NO: 3848065 - RNA, 23 nt, Human
ucuuuaacucaggacuccagccc

SEQ ID NO: 3848066 - RNA, 21 nt, Human
ucuuuaacugccguaauuuaa

SEQ ID NO: 3848067 - RNA, 23 nt, Human
ucuuuaaucacuuaacauuccua

SEQ ID NO: 3848068 - RNA, 11 nt, Human
ucuuuaaugcu

SEQ ID NO: 3848069 - RNA, 16 nt, Human
ucuuuaaugcuuuuau

SEQ ID NO: 3848070 - RNA, 15 nt, Human
ucuuuaaugucacag

SEQ ID NO: 3848071 - RNA, 19 nt, Human
ucuuuaaugucacaggcag

SEQ ID NO: 3848072 - RNA, 20 nt, Human
ucuuuaaugucacaggcagg

SEQ ID NO: 3848073 - RNA, 13 nt, Human
ucuuuaauuuugg

SEQ ID NO: 3848074 - RNA, 15 nt, Human
ucuuuaauuuuggaa

SEQ ID NO: 3848075 - RNA, 22 nt, Human
ucuuuacaaaacaaacucauuc

SEQ ID NO: 3848076 - RNA, 16 nt, Human
ucuuuagaaaaggcau

SEQ ID NO: 3848077 - RNA, 22 nt, Human
ucuuuagagaacugaaaagaga

SEQ ID NO: 3848078 - RNA, 17 nt, Human
ucuuuagaguuagacug

SEQ ID NO: 3848079 - RNA, 19 nt, Human
ucuuuagaguuagacuguu

SEQ ID NO: 3848080 - RNA, 23 nt, Human
ucuuuagauagcccuguccuggu

SEQ ID NO: 3848081 - RNA, 16 nt, Human
ucuuuaggagauuuau

SEQ ID NO: 3848082 - RNA, 22 nt, Human
ucuuuaguuuuugguugggaau

SEQ ID NO: 3848083 - RNA, 15 nt, Human
ucuuuaguuuuugug

SEQ ID NO: 3848084 - RNA, 14 nt, Human
ucuuuauaagaaag

SEQ ID NO: 3848085 - RNA, 17 nt, Human
ucuuuauaagaaagccu

SEQ ID NO: 3848086 - RNA, 14 nt, Human
ucuuuauacaacag

SEQ ID NO: 3848087 - RNA, 20 nt, Human
ucuuuauacaacagugcuaa

SEQ ID NO: 3848088 - RNA, 14 nt, Human
ucuuuauacagcug

SEQ ID NO: 3848089 - RNA, 16 nt, Human
ucuuuauacagcugua

SEQ ID NO: 3848090 - RNA, 17 nt, Human
ucuuuauagugcacaaa

SEQ ID NO: 3848091 - RNA, 16 nt, Human
ucuuuauauacaauaa

SEQ ID NO: 3848092 - RNA, 17 nt, Human
ucugaaacagcugccuu

SEQ ID NO: 3848093 - RNA, 23 nt, Human
ucugaaacccuggaccagugguc

SEQ ID NO: 3848094 - RNA, 22 nt, Human
ucugaaacugggcuccugcuuu

SEQ ID NO: 3848095 - RNA, 23 nt, Human
ucugaaagcacaggagacacugu

SEQ ID NO: 3848096 - RNA, 14 nt, Human
ucugaaagccacgu

SEQ ID NO: 3848097 - RNA, 13 nt, Human
ucugaaagggacg

SEQ ID NO: 3848098 - RNA, 17 nt, Human
ucugaaaguuguacaug

SEQ ID NO: 3848099 - RNA, 20 nt, Human
ucugaaauaggaaacaagug

SEQ ID NO: 3848100 - RNA, 16 nt, Human
ucugaaauaucccggg

SEQ ID NO: 3848101 - RNA, 13 nt, Human
ucugaaaugaaga

SEQ ID NO: 3848102 - RNA, 21 nt, Human
ucugaaaugucaguucugaua

SEQ ID NO: 3848103 - RNA, 21 nt, Human
ucugaaaugugauaaguucuu

SEQ ID NO: 3848104 - RNA, 15 nt, Human
ucugaaauguuacaa

SEQ ID NO: 3848105 - RNA, 18 nt, Human
ucugaaauguuacaaaaa

SEQ ID NO: 3848106 - RNA, 20 nt, Human
ucugaaauguuacaaaaaua

SEQ ID NO: 3848107 - RNA, 16 nt, Human
ucugaacacaggcagc

SEQ ID NO: 3848108 - RNA, 13 nt, Human
ucugaacacauug

SEQ ID NO: 3848109 - RNA, 16 nt, Human
ucugaacagcuggugu

SEQ ID NO: 3848110 - RNA, 17 nt, Human
ucugaacagcuggugua

SEQ ID NO: 3848111 - RNA, 16 nt, Human
ucugaacucaaacuga

SEQ ID NO: 3848112 - RNA, 21 nt, Human
ucugaacucaaacugaggaau

SEQ ID NO: 3848113 - RNA, 21 nt, Human
ucugaacucgcuucucuguga

SEQ ID NO: 3848114 - RNA, 14 nt, Human
ucugaacuggagcc

SEQ ID NO: 3848115 - RNA, 18 nt, Human
ucugaacuugcauuguga

SEQ ID NO: 3848116 - RNA, 19 nt, Human
ucugaacuugcauugugau

SEQ ID NO: 3848117 - RNA, 12 nt, Human
ucugaacuugcc

SEQ ID NO: 3848118 - RNA, 12 nt, Human
ucugaacuuugg

SEQ ID NO: 3848119 - RNA, 15 nt, Human
ucugaacuuuggaga

SEQ ID NO: 3848120 - RNA, 14 nt, Human
ucugaacuuuggga

SEQ ID NO: 3848121 - RNA, 12 nt, Human
ucugaagaagau

SEQ ID NO: 3848122 - RNA, 14 nt, Human
ucugaagauuguuu

SEQ ID NO: 3848123 - RNA, 18 nt, Human
ucugaagauuguuuaucu

SEQ ID NO: 3848124 - RNA, 19 nt, Human
ucugaagauuguuuaucua

SEQ ID NO: 3848125 - RNA, 12 nt, Human
ucugaagcaugu

SEQ ID NO: 3848126 - RNA, 14 nt, Human
ucugaagcuugacu

SEQ ID NO: 3848127 - RNA, 17 nt, Human
ucugaagcuugacuccc

SEQ ID NO: 3848128 - RNA, 12 nt, Human
ucugaaggagau

SEQ ID NO: 3848129 - RNA, 20 nt, Human
ucugaaggagccccauuccu

SEQ ID NO: 3848130 - RNA, 19 nt, Human
ucugaaggaggccaccucc

SEQ ID NO: 3848131 - RNA, 14 nt, Human
ucugaagggaggug

SEQ ID NO: 3848132 - RNA, 19 nt, Human
ucugaaggggcaaauucuu

SEQ ID NO: 3848133 - RNA, 17 nt, Human
ucugaagucacaucaca

SEQ ID NO: 3848134 - RNA, 15 nt, Human
ucugaagucagaucu

SEQ ID NO: 3848135 - RNA, 19 nt, Human
ucugaagucagaucugccu

SEQ ID NO: 3848136 - RNA, 16 nt, Human
ucugaagugaaacugc

SEQ ID NO: 3848137 - RNA, 14 nt, Human
ucugaaguuauauu

SEQ ID NO: 3848138 - RNA, 14 nt, Human
ucugaauaaagcaa

SEQ ID NO: 3848139 - RNA, 16 nt, Human
ucugaauagaaauggg

SEQ ID NO: 3848140 - RNA, 13 nt, Human
ucugaaugcugcc

SEQ ID NO: 3848141 - RNA, 20 nt, Human
ucugaaugcugccacaacca

SEQ ID NO: 3848142 - RNA, 13 nt, Human
ucugaaugcugcu

SEQ ID NO: 3848143 - RNA, 14 nt, Human
ucugaauguaauuu

SEQ ID NO: 3848144 - RNA, 20 nt, Human
ucugaauguaauuuguguaa

SEQ ID NO: 3848145 - RNA, 13 nt, Human
ucugaauguucug

SEQ ID NO: 3848146 - RNA, 19 nt, Human
ucugaauguucugacauua

SEQ ID NO: 3848147 - RNA, 22 nt, Human
ucugaauguucugacauuaaca

SEQ ID NO: 3848148 - RNA, 23 nt, Human
ucugaauguucugacauuaacag

SEQ ID NO: 3848149 - RNA, 18 nt, Human
ucugaauuaguccuugcu

SEQ ID NO: 3848150 - RNA, 15 nt, Human
ucugaauuauuuucu

SEQ ID NO: 3848151 - RNA, 20 nt, Human
ucugaauuuacuuccuugca

SEQ ID NO: 3848152 - RNA, 15 nt, Human
ucugaauuugcaaag

SEQ ID NO: 3848153 - RNA, 17 nt, Human
ucugaauuugcaaagua

SEQ ID NO: 3848154 - RNA, 19 nt, Human
ucugaauuugcaaaguacu

SEQ ID NO: 3848155 - RNA, 21 nt, Human
ucugaauuugcaaaguacugu

SEQ ID NO: 3848156 - RNA, 18 nt, Human
ucugaauuugcccuggga

SEQ ID NO: 3848157 - RNA, 19 nt, Human
ucugaauuuuuaaacaagu

SEQ ID NO: 3848158 - RNA, 15 nt, Human
ucugacaacagacuu

SEQ ID NO: 3848159 - RNA, 13 nt, Human
ucugacacaaaaa

SEQ ID NO: 3848160 - RNA, 13 nt, Human
ucugacacacagc

SEQ ID NO: 3848161 - RNA, 19 nt, Human
ucugacacacagcucuguc

SEQ ID NO: 3848162 - RNA, 21 nt, Human
ucugacaccuauuuuagacaa

SEQ ID NO: 3848163 - RNA, 17 nt, Human
ucugacagcagcaucuc

SEQ ID NO: 3848164 - RNA, 13 nt, Human
ucugacagccuca

SEQ ID NO: 3848165 - RNA, 12 nt, Human
ucugacaggcaa

SEQ ID NO: 3848166 - RNA, 21 nt, Human
ucugacaggcaaugcuggcug

SEQ ID NO: 3848167 - RNA, 20 nt, Human
ucugacaguuuuucuguuuu

SEQ ID NO: 3848168 - RNA, 23 nt, Human
ucugacauaauccaguaaaauaa

SEQ ID NO: 3848169 - RNA, 15 nt, Human
ucugacaucucugca

SEQ ID NO: 3848170 - RNA, 18 nt, Human
ucugacaugauuccuucc

SEQ ID NO: 3848171 - RNA, 23 nt, Human
ucugacauuaacaguuuuccaug

SEQ ID NO: 3848172 - RNA, 22 nt, Human
ucugacauuaugugguuuuaga

SEQ ID NO: 3848173 - RNA, 23 nt, Human
ucugacauuaugugguuuuagau

SEQ ID NO: 3848174 - RNA, 22 nt, Human
ucugacauucucaggaagcccc

SEQ ID NO: 3848175 - RNA, 17 nt, Human
ucugacauucugauucg

SEQ ID NO: 3848176 - RNA, 18 nt, Human
ucugaccacacuuccugu

SEQ ID NO: 3848177 - RNA, 22 nt, Human
ucugaccacacuuccuguccag

SEQ ID NO: 3848178 - RNA, 19 nt, Human
ucugaccacuugaggccug

SEQ ID NO: 3848179 - RNA, 13 nt, Human
ucugaccagcagc

SEQ ID NO: 3848180 - RNA, 16 nt, Human
ucugaccagcagcgcc

SEQ ID NO: 3848181 - RNA, 14 nt, Human
ucugaccauuucag

SEQ ID NO: 3848182 - RNA, 18 nt, Human
ucugaccauuucaggggu

SEQ ID NO: 3848183 - RNA, 14 nt, Human
ucugacccagugcc

SEQ ID NO: 3848184 - RNA, 19 nt, Human
ucugacccugcuucaaaua

SEQ ID NO: 3848185 - RNA, 23 nt, Human
ucugacccuuacagccucugacu

SEQ ID NO: 3848186 - RNA, 21 nt, Human
ucugaccgaaacagcgcuggg

SEQ ID NO: 3848187 - RNA, 14 nt, Human
ucugaccuccauga

SEQ ID NO: 3848188 - RNA, 16 nt, Human
ucugaccucuuggcca

SEQ ID NO: 3848189 - RNA, 23 nt, Human
ucugaccuggcaucuaauucuga

SEQ ID NO: 3848190 - RNA, 21 nt, Human
ucugaccuucagcucacgcuu

SEQ ID NO: 3848191 - RNA, 14 nt, Human
ucugacggcccugc

SEQ ID NO: 3848192 - RNA, 15 nt, Human
ucugacggcccugca

SEQ ID NO: 3848193 - RNA, 13 nt, Human
ucugacuaauuag

SEQ ID NO: 3848194 - RNA, 15 nt, Human
ucugacuaauuaggc

SEQ ID NO: 3848195 - RNA, 23 nt, Human
ucugacuacugggcaaagagugu

SEQ ID NO: 3848196 - RNA, 12 nt, Human
ucugacuauaac

SEQ ID NO: 3848197 - RNA, 12 nt, Human
ucugacucccaa

SEQ ID NO: 3848198 - RNA, 15 nt, Human
ucugacucucaaauc

SEQ ID NO: 3848199 - RNA, 16 nt, Human
ucugacugaugcuuuc

SEQ ID NO: 3848200 - RNA, 14 nt, Human
ucugacugcacgug

SEQ ID NO: 3848201 - RNA, 20 nt, Human
ucugacuuaagcugccucaa

SEQ ID NO: 3848202 - RNA, 14 nt, Human
ucugacuuuacacu

SEQ ID NO: 3848203 - RNA, 19 nt, Human
ucugacuuuagccuaccua

SEQ ID NO: 3848204 - RNA, 23 nt, Human
ucugacuuucuuuuuugauauag

SEQ ID NO: 3848205 - RNA, 17 nt, Human
ugaacauuucauggugu

SEQ ID NO: 3848206 - RNA, 14 nt, Human
ugaacauuugugau

SEQ ID NO: 3848207 - RNA, 13 nt, Human
ugaaccaaugcaa

SEQ ID NO: 3848208 - RNA, 20 nt, Human
ugaaccacaucuugcucugc

SEQ ID NO: 3848209 - RNA, 20 nt, Human
ugaaccaccacacccagccc

SEQ ID NO: 3848210 - RNA, 12 nt, Human
ugaaccaccgcg

SEQ ID NO: 3848211 - RNA, 16 nt, Human
ugaaccacgcgggggc

SEQ ID NO: 3848212 - RNA, 13 nt, Human
ugaaccacuugua

SEQ ID NO: 3848213 - RNA, 20 nt, Human
ugaaccacuuguagauuuga

SEQ ID NO: 3848214 - RNA, 23 nt, Human
ugaaccacuuguagauuugauuu

SEQ ID NO: 3848215 - RNA, 18 nt, Human
ugaaccagaaccagucuu

SEQ ID NO: 3848216 - RNA, 15 nt, Human
ugaaccauaaaaugu

SEQ ID NO: 3848217 - RNA, 16 nt, Human
ugaaccauaaaauguc

SEQ ID NO: 3848218 - RNA, 18 nt, Human
ugaaccauaaaaugucca

SEQ ID NO: 3848219 - RNA, 19 nt, Human
ugaaccauaguuacuguaa

SEQ ID NO: 3848220 - RNA, 22 nt, Human
ugaaccauccacuuacauauau

SEQ ID NO: 3848221 - RNA, 22 nt, Human
ugaaccauggugaagugcuugg

SEQ ID NO: 3848222 - RNA, 17 nt, Human
ugaaccauuaaccagau

SEQ ID NO: 3848223 - RNA, 12 nt, Human
ugaacccaggac

SEQ ID NO: 3848224 - RNA, 19 nt, Human
ugaacccauuuugagugac

SEQ ID NO: 3848225 - RNA, 22 nt, Human
ugaacccgggacgcagggguug

SEQ ID NO: 3848226 - RNA, 17 nt, Human
ugaacccgggaggcaga

SEQ ID NO: 3848227 - RNA, 13 nt, Human
ugaacccuccagg

SEQ ID NO: 3848228 - RNA, 14 nt, Human
ugaacccuggggcc

SEQ ID NO: 3848229 - RNA, 15 nt, Human
ugaacccuugcuugc

SEQ ID NO: 3848230 - RNA, 22 nt, Human
ugaaccgaggggcucaggaaaa

SEQ ID NO: 3848231 - RNA, 22 nt, Human
ugaaccgaugagaaauaaaguu

SEQ ID NO: 3848232 - RNA, 21 nt, Human
ugaaccuaggagugccccauu

SEQ ID NO: 3848233 - RNA, 12 nt, Human
ugaaccugaaua

SEQ ID NO: 3848234 - RNA, 18 nt, Human
ugaaccugaugaaaauaa

SEQ ID NO: 3848235 - RNA, 23 nt, Human
ugaaccugaugaaaauaaagaau

SEQ ID NO: 3848236 - RNA, 21 nt, Human
ugaaccuuugugcccuaucac

SEQ ID NO: 3848237 - RNA, 20 nt, Human
ugaacgauauguagcagaaa

SEQ ID NO: 3848238 - RNA, 20 nt, Human
ugaacgauccuucaaagucu

SEQ ID NO: 3848239 - RNA, 13 nt, Human
ugaacggccuugc

SEQ ID NO: 3848240 - RNA, 19 nt, Human
ugaacguuugguucaaaug

SEQ ID NO: 3848241 - RNA, 21 nt, Human
ugaacguuugguucaaaugug

SEQ ID NO: 3848242 - RNA, 19 nt, Human
ugaacuaaacuuucacacc

SEQ ID NO: 3848243 - RNA, 17 nt, Human
ugaacuaggcugagcaa

SEQ ID NO: 3848244 - RNA, 18 nt, Human
ugaacuaggcugagcaau

SEQ ID NO: 3848245 - RNA, 16 nt, Human
ugaacucaaacugagg

SEQ ID NO: 3848246 - RNA, 17 nt, Human
ugaacucaaacugagga

SEQ ID NO: 3848247 - RNA, 20 nt, Human
ugaacucacuuuccuccuga

SEQ ID NO: 3848248 - RNA, 18 nt, Human
ugaacucagaucugucug

SEQ ID NO: 3848249 - RNA, 15 nt, Human
ugaacucagccaagc

SEQ ID NO: 3848250 - RNA, 17 nt, Human
ugaacucagccaagcac

SEQ ID NO: 3848251 - RNA, 21 nt, Human
ugaacucagccaagcacagug

SEQ ID NO: 3848252 - RNA, 23 nt, Human
ugaacucagccaagcacaguggu

SEQ ID NO: 3848253 - RNA, 14 nt, Human
ugaacuccugccau

SEQ ID NO: 3848254 - RNA, 12 nt, Human
ugaacuccuggc

SEQ ID NO: 3848255 - RNA, 16 nt, Human
ugaacuccuggccuca

SEQ ID NO: 3848256 - RNA, 14 nt, Human
ugaacuccugggcu

SEQ ID NO: 3848257 - RNA, 18 nt, Human
ugaacucugaacuuugga

SEQ ID NO: 3848258 - RNA, 16 nt, Human
ugaacucugggcucaa

SEQ ID NO: 3848259 - RNA, 21 nt, Human
ugaacucuucucauuacuugu

SEQ ID NO: 3848260 - RNA, 19 nt, Human
ugaacucuucugcaaaaau

SEQ ID NO: 3848261 - RNA, 12 nt, Human
ugaacugaaagu

SEQ ID NO: 3848262 - RNA, 13 nt, Human
ugaacugaacacc

SEQ ID NO: 3848263 - RNA, 22 nt, Human
ugaacugaacaccauugaaggc

SEQ ID NO: 3848264 - RNA, 17 nt, Human
ugaacugaacucugaca

SEQ ID NO: 3848265 - RNA, 13 nt, Human
ugaacugacaggc

SEQ ID NO: 3848266 - RNA, 12 nt, Human
ugaacugagcuu

SEQ ID NO: 3848267 - RNA, 16 nt, Human
ugaacugagcuuggaa

SEQ ID NO: 3848268 - RNA, 18 nt, Human
ugaacugauaguuacugu

SEQ ID NO: 3848269 - RNA, 20 nt, Human
ugaacugaucauguuuauga

SEQ ID NO: 3848270 - RNA, 17 nt, Human
ugaacugauucacaucu

SEQ ID NO: 3848271 - RNA, 18 nt, Human
ugaacugcauguauaaau

SEQ ID NO: 3848272 - RNA, 17 nt, Human
ugaacuggacccuguug

SEQ ID NO: 3848273 - RNA, 23 nt, Human
ugaacuggacccuguugcuaagc

SEQ ID NO: 3848274 - RNA, 15 nt, Human
ugaacuuaaaaugaa

SEQ ID NO: 3848275 - RNA, 17 nt, Human
ugaacuuaacaugcugu

SEQ ID NO: 3848276 - RNA, 21 nt, Human
ugaacuuaacaugcuguguaa

SEQ ID NO: 3848277 - RNA, 18 nt, Human
ugaacuuaauaacugugu

SEQ ID NO: 3848278 - RNA, 22 nt, Human
ugaacuuaauaacuguguacug

SEQ ID NO: 3848279 - RNA, 21 nt, Human
ugaacuuauuuacacauaguu

SEQ ID NO: 3848280 - RNA, 18 nt, Human
ugaacuucgcaucaaaag

SEQ ID NO: 3848281 - RNA, 19 nt, Human
ugaacuucgcaucaaaaga

SEQ ID NO: 3848282 - RNA, 21 nt, Human
ugaacuugaaauauccugcuu

SEQ ID NO: 3848283 - RNA, 16 nt, Human
ugaacuugaggacaca

SEQ ID NO: 3848284 - RNA, 19 nt, Human
ugaacuugaggacacaugu

SEQ ID NO: 3848285 - RNA, 21 nt, Human
ugaacuugaggacacaugucc

SEQ ID NO: 3848286 - RNA, 14 nt, Human
ugaacuuguagcug

SEQ ID NO: 3848287 - RNA, 21 nt, Human
ugaacuuguagcuguaaaacg

SEQ ID NO: 3848288 - RNA, 13 nt, Human
ugaacuuuccugg

SEQ ID NO: 3848289 - RNA, 17 nt, Human
ugaacuuugaccucugc

SEQ ID NO: 3848290 - RNA, 19 nt, Human
ugaacuuugaccucugcag

SEQ ID NO: 3848291 - RNA, 11 nt, Human
ugaacuuugcu

SEQ ID NO: 3848292 - RNA, 18 nt, Human
ugaacuuugggaagccuu

SEQ ID NO: 3848293 - RNA, 13 nt, Human
ugaacuuuuguac

SEQ ID NO: 3848294 - RNA, 15 nt, Human
ugaacuuuuguacug

SEQ ID NO: 3848295 - RNA, 17 nt, Human
ugaagaaaacuccuuua

SEQ ID NO: 3848296 - RNA, 24 nt, Human
ugaagaaaauacuuaaauguuaug

SEQ ID NO: 3848297 - RNA, 21 nt, Human
ugaagaaaccuucagauuugu

SEQ ID NO: 3848298 - RNA, 20 nt, Human
ugaagaaaggguguuuuucu

SEQ ID NO: 3848299 - RNA, 20 nt, Human
ugaagaaauacugcacuuac

SEQ ID NO: 3848300 - RNA, 13 nt, Human
ugaagaacaguaa

SEQ ID NO: 3848301 - RNA, 15 nt, Human
ugaagaacaguaacu

SEQ ID NO: 3848302 - RNA, 19 nt, Human
ugaagaacugaggaggaaa

SEQ ID NO: 3848303 - RNA, 14 nt, Human
ugaagaacugcagg

SEQ ID NO: 3848304 - RNA, 17 nt, Human
ugaagaacugcaggccc

SEQ ID NO: 3848305 - RNA, 16 nt, Human
gggacagcuccuucug

SEQ ID NO: 3848306 - RNA, 11 nt, Human
gggacagcugu

SEQ ID NO: 3848307 - RNA, 13 nt, Human
gggacaggccuca

SEQ ID NO: 3848308 - RNA, 13 nt, Human
gggacagggcugg

SEQ ID NO: 3848309 - RNA, 18 nt, Human
gggacaggggcaggagga

SEQ ID NO: 3848310 - RNA, 21 nt, Human
gggacagggugucuccugaag

SEQ ID NO: 3848311 - RNA, 20 nt, Human
gggacaguuuaucaugaagc

SEQ ID NO: 3848312 - RNA, 22 nt, Human
gggacauccugucaucugagaa

SEQ ID NO: 3848313 - RNA, 19 nt, Human
gggacaugcuuagcagucc

SEQ ID NO: 3848314 - RNA, 19 nt, Human
gggacauuugcucauggaa

SEQ ID NO: 3848315 - RNA, 20 nt, Human
gggacauuugcucauggaau

SEQ ID NO: 3848316 - RNA, 18 nt, Human
gggaccaacccuggggaa

SEQ ID NO: 3848317 - RNA, 17 nt, Human
gggaccaaggaccccuc

SEQ ID NO: 3848318 - RNA, 19 nt, Human
gggaccacagcaaggcacc

SEQ ID NO: 3848319 - RNA, 14 nt, Human
gggaccagccaaga

SEQ ID NO: 3848320 - RNA, 12 nt, Human
gggaccaggagu

SEQ ID NO: 3848321 - RNA, 23 nt, Human
gggaccaggaguggguggggagu

SEQ ID NO: 3848322 - RNA, 17 nt, Human
gggaccaugugucacuu

SEQ ID NO: 3848323 - RNA, 21 nt, Human
gggacccaauguaggagcugc

SEQ ID NO: 3848324 - RNA, 19 nt, Human
gggacccaggcuccgcccu

SEQ ID NO: 3848325 - RNA, 12 nt, Human
gggacccagugc

SEQ ID NO: 3848326 - RNA, 16 nt, Human
gggacccagugcagaa

SEQ ID NO: 3848327 - RNA, 15 nt, Human
gggaccccaggccca

SEQ ID NO: 3848328 - RNA, 20 nt, Human
gggaccccgagccuggcucc

SEQ ID NO: 3848329 - RNA, 12 nt, Human
gggacccugcuu

SEQ ID NO: 3848330 - RNA, 16 nt, Human
gggacccuuuccuucc

SEQ ID NO: 3848331 - RNA, 21 nt, Human
gggaccgcuacaccacucugg

SEQ ID NO: 3848332 - RNA, 19 nt, Human
gggaccuauaacugcccag

SEQ ID NO: 3848333 - RNA, 12 nt, Human
gggaccucaggc

SEQ ID NO: 3848334 - RNA, 17 nt, Human
gggaccugccaggcagg

SEQ ID NO: 3848335 - RNA, 18 nt, Human
gggaccugguacccuccu

SEQ ID NO: 3848336 - RNA, 17 nt, Human
gggacgaagaagagcca

SEQ ID NO: 3848337 - RNA, 20 nt, Human
gggacgaagaagagccacag

SEQ ID NO: 3848338 - RNA, 22 nt, Human
gggacgccugggggugccagga

SEQ ID NO: 3848339 - RNA, 20 nt, Human
gggacggucaguuugguguc

SEQ ID NO: 3848340 - RNA, 17 nt, Human
gggacggugcccaagcc

SEQ ID NO: 3848341 - RNA, 23 nt, Human
gggacguccugccaccuggggca

SEQ ID NO: 3848342 - RNA, 17 nt, Human
gggacuacaggcaccca

SEQ ID NO: 3848343 - RNA, 19 nt, Human
gggacuacaggcgugagcc

SEQ ID NO: 3848344 - RNA, 20 nt, Human
gggacuacaggcgugagcca

SEQ ID NO: 3848345 - RNA, 17 nt, Human
gggacucaaugcacuga

SEQ ID NO: 3848346 - RNA, 19 nt, Human
gggacucaucuuucccucc

SEQ ID NO: 3848347 - RNA, 17 nt, Human
gggacuccggcugugcu

SEQ ID NO: 3848348 - RNA, 20 nt, Human
gggacucugaagccucuggg

SEQ ID NO: 3848349 - RNA, 13 nt, Human
ucuguccucagcc

SEQ ID NO: 3848350 - RNA, 14 nt, Human
ucuguccucagccu

SEQ ID NO: 3848351 - RNA, 21 nt, Human
ucuguccucagccuugccaga

SEQ ID NO: 3848352 - RNA, 21 nt, Human
ucuguccugggagugagcugg

SEQ ID NO: 3848353 - RNA, 13 nt, Human
ucuguccugugac

SEQ ID NO: 3848354 - RNA, 22 nt, Human
ucuguccugugagguuucccaa

SEQ ID NO: 3848355 - RNA, 18 nt, Human
ucuguccuugaaggacua

SEQ ID NO: 3848356 - RNA, 21 nt, Human
ucuguccuuuuggcacugaga

SEQ ID NO: 3848357 - RNA, 19 nt, Human
ucugucgcccaggcuggag

SEQ ID NO: 3848358 - RNA, 16 nt, Human
ucugucgccuuagcau

SEQ ID NO: 3848359 - RNA, 23 nt, Human
ucugucgccuuagcauguuugcu

SEQ ID NO: 3848360 - RNA, 14 nt, Human
ucugucuaaaaaac

SEQ ID NO: 3848361 - RNA, 16 nt, Human
ucugucuaccaucucc

SEQ ID NO: 3848362 - RNA, 15 nt, Human
ucugucuacuugcuc

SEQ ID NO: 3848363 - RNA, 18 nt, Human
ucugucuacuugcucagg

SEQ ID NO: 3848364 - RNA, 15 nt, Human
ucugucuccagcuuc

SEQ ID NO: 3848365 - RNA, 22 nt, Human
ucugucucccuauaaugcugga

SEQ ID NO: 3848366 - RNA, 14 nt, Human
ucugucucugccuc

SEQ ID NO: 3848367 - RNA, 13 nt, Human
ucugucugcccuu

SEQ ID NO: 3848368 - RNA, 22 nt, Human
ucugucugcccuucaccccagu

SEQ ID NO: 3848369 - RNA, 12 nt, Human
ucugucugcugg

SEQ ID NO: 3848370 - RNA, 19 nt, Human
ucugucuggaagaugggga

SEQ ID NO: 3848371 - RNA, 13 nt, Human
ucugucuggucca

SEQ ID NO: 3848372 - RNA, 16 nt, Human
ucugucugguggcccc

SEQ ID NO: 3848373 - RNA, 18 nt, Human
ucugucugucugucccaa

SEQ ID NO: 3848374 - RNA, 17 nt, Human
ucugucuucaagggcuu

SEQ ID NO: 3848375 - RNA, 15 nt, Human
ucugucuucaccuga

SEQ ID NO: 3848376 - RNA, 15 nt, Human
ucugucuucuguaua

SEQ ID NO: 3848377 - RNA, 12 nt, Human
ucugucuuguaa

SEQ ID NO: 3848378 - RNA, 13 nt, Human
ucugucuuguaau

SEQ ID NO: 3848379 - RNA, 17 nt, Human
ucugucuuuccacucug

SEQ ID NO: 3848380 - RNA, 12 nt, Human
ucugucuuuuaa

SEQ ID NO: 3848381 - RNA, 16 nt, Human
ucugucuuuuaaacuc

SEQ ID NO: 3848382 - RNA, 15 nt, Human
ucugugaaaggaaag

SEQ ID NO: 3848383 - RNA, 19 nt, Human
ucugugaacaagcuucagu

SEQ ID NO: 3848384 - RNA, 17 nt, Human
ucugugaacagagagac

SEQ ID NO: 3848385 - RNA, 17 nt, Human
ucugugaacuugaaauu

SEQ ID NO: 3848386 - RNA, 11 nt, Human
ucugugaauaa

SEQ ID NO: 3848387 - RNA, 13 nt, Human
ucugugaauaagc

SEQ ID NO: 3848388 - RNA, 13 nt, Human
ucugugacccacu

SEQ ID NO: 3848389 - RNA, 13 nt, Human
ucugugaccucag

SEQ ID NO: 3848390 - RNA, 23 nt, Human
ucugugaccucaggcacuagccu

SEQ ID NO: 3848391 - RNA, 19 nt, Human
ucugugacuuaguggacag

SEQ ID NO: 3848392 - RNA, 23 nt, Human
ucugugagaagguuuauuguuaa

SEQ ID NO: 3848393 - RNA, 17 nt, Human
ucugugagacucgagaa

SEQ ID NO: 3848394 - RNA, 21 nt, Human
ucugugagacucgagaacuuu

SEQ ID NO: 3848395 - RNA, 14 nt, Human
ucugugagaugcua

SEQ ID NO: 3848396 - RNA, 17 nt, Human
ucugugagaugcuagaa

SEQ ID NO: 3848397 - RNA, 22 nt, Human
ucugugagaugcuagaacuccc

SEQ ID NO: 3848398 - RNA, 17 nt, Human
ucugugagauucauuca

SEQ ID NO: 3848399 - RNA, 19 nt, Human
ucugugagauucauucaug

SEQ ID NO: 3848400 - RNA, 17 nt, Human
ucugugaggaaagcaca

SEQ ID NO: 3848401 - RNA, 21 nt, Human
ucugugagggugcugacuggc

SEQ ID NO: 3848402 - RNA, 14 nt, Human
ucugugaugagcug

SEQ ID NO: 3848403 - RNA, 17 nt, Human
ucugugaugagcugauc

SEQ ID NO: 3848404 - RNA, 16 nt, Human
ucugugaugauccuca

SEQ ID NO: 3848405 - RNA, 14 nt, Human
ucugugcaccuggg

SEQ ID NO: 3848406 - RNA, 21 nt, Human
ucugugcacgcaguggccuuc

SEQ ID NO: 3848407 - RNA, 18 nt, Human
ucugugccagagccuggg

SEQ ID NO: 3848408 - RNA, 14 nt, Human
ucugugcccagcuc

SEQ ID NO: 3848409 - RNA, 16 nt, Human
ucugugcccagcucag

SEQ ID NO: 3848410 - RNA, 19 nt, Human
ucugugcccaugggcacug

SEQ ID NO: 3848411 - RNA, 21 nt, Human
ucugugcccaugggcacugcu

SEQ ID NO: 3848412 - RNA, 22 nt, Human
ucugugcccaugggcacugcug

SEQ ID NO: 3848413 - RNA, 14 nt, Human
ucugugccccaugc

SEQ ID NO: 3848414 - RNA, 15 nt, Human
ucugugcccuccuga

SEQ ID NO: 3848415 - RNA, 20 nt, Human
ucugugccucccuccccagu

SEQ ID NO: 3848416 - RNA, 20 nt, Human
ucugugccuuuuuuauaucu

SEQ ID NO: 3848417 - RNA, 22 nt, Human
ucugugcgugaaacacaccagg

SEQ ID NO: 3848418 - RNA, 21 nt, Human
ucugugcuagggaaacuuccc

SEQ ID NO: 3848419 - RNA, 21 nt, Human
ucugugcuggagauguuuuag

SEQ ID NO: 3848420 - RNA, 20 nt, Human
ucugugcuuugacucaccug

SEQ ID NO: 3848421 - RNA, 15 nt, Human
ucuguggccuuguuc

SEQ ID NO: 3848422 - RNA, 19 nt, Human
ucugugggcgggcccagca

SEQ ID NO: 3848423 - RNA, 20 nt, Human
ucugugggcgggcccagcac

SEQ ID NO: 3848424 - RNA, 20 nt, Human
ucugugggcuacaugcuggg

SEQ ID NO: 3848425 - RNA, 15 nt, Human
ucugugggcugcacu

SEQ ID NO: 3848426 - RNA, 12 nt, Human
ucuguggggccc

SEQ ID NO: 3848427 - RNA, 19 nt, Human
ucugugggugacccagguc

SEQ ID NO: 3848428 - RNA, 21 nt, Human
ucugugggugacccagguccu

SEQ ID NO: 3848429 - RNA, 22 nt, Human
ucuguggguuucuaaagcugcc

SEQ ID NO: 3848430 - RNA, 17 nt, Human
ucuguggugucugccug

SEQ ID NO: 3848431 - RNA, 16 nt, Human
ucugugguuccucugc

SEQ ID NO: 3848432 - RNA, 12 nt, Human
ucugugguuggc

SEQ ID NO: 3848433 - RNA, 22 nt, Human
ucugugguuuuccccucccugg

SEQ ID NO: 3848434 - RNA, 19 nt, Human
ucuguguaaccauuuuaua

SEQ ID NO: 3848435 - RNA, 20 nt, Human
ucuguguauuuaauuguaaa

SEQ ID NO: 3848436 - RNA, 22 nt, Human
ucuguguauuuaauuguaaacu

SEQ ID NO: 3848437 - RNA, 17 nt, Human
ucuguguccuucccugc

SEQ ID NO: 3848438 - RNA, 16 nt, Human
ucugugucuaagauuc

SEQ ID NO: 3848439 - RNA, 22 nt, Human
ucugugucuaagauucuagauc

SEQ ID NO: 3848440 - RNA, 16 nt, Human
ucugugucugaguggc

SEQ ID NO: 3848441 - RNA, 13 nt, Human
ucugugucugugu

SEQ ID NO: 3848442 - RNA, 12 nt, Human
ucugugucuugu

SEQ ID NO: 3848443 - RNA, 11 nt, Human
ucugugucuuu

SEQ ID NO: 3848444 - RNA, 22 nt, Human
ucugugugaaugugggcacugg

SEQ ID NO: 3848445 - RNA, 19 nt, Human
ucugugugcaccuuaccaa

SEQ ID NO: 3848446 - RNA, 14 nt, Human
ucugugugcugugg

SEQ ID NO: 3848447 - RNA, 20 nt, Human
ucugugugggacuguacaca

SEQ ID NO: 3848448 - RNA, 21 nt, Human
ucugugugggacuguacacac

SEQ ID NO: 3848449 - RNA, 19 nt, Human
ucugugugucaguuuucau

SEQ ID NO: 3848450 - RNA, 15 nt, Human
ucuguguguguguau

SEQ ID NO: 3848451 - RNA, 21 nt, Human
ucuguguguguguaugugggg

SEQ ID NO: 3848452 - RNA, 20 nt, Human
ucugugugugugugugugcg

SEQ ID NO: 3848453 - RNA, 16 nt, Human
ucuguguguuccuggc

SEQ ID NO: 3848454 - RNA, 19 nt, Human
ucuguguguuuaugugugu

SEQ ID NO: 3848455 - RNA, 19 nt, Human
ucuguguuuaauuucuuca

SEQ ID NO: 3848456 - RNA, 13 nt, Human
ucuguguuuuaau

SEQ ID NO: 3848457 - RNA, 15 nt, Human
ucuguguuuuugaaa

SEQ ID NO: 3848458 - RNA, 20 nt, Human
ucuguuaaaaucuauucugu

SEQ ID NO: 3848459 - RNA, 13 nt, Human
ucuguuaacugaa

SEQ ID NO: 3848460 - RNA, 20 nt, Human
ugaagaacugcaggcccugg

SEQ ID NO: 3848461 - RNA, 11 nt, Human
ugaagaagaga

SEQ ID NO: 3848462 - RNA, 22 nt, Human
ugaagaagcaccaaucaugaau

SEQ ID NO: 3848463 - RNA, 21 nt, Human
ugaagaagguggaccuuuuaa

SEQ ID NO: 3848464 - RNA, 23 nt, Human
ugaagaagguggaccuuuuaaag

SEQ ID NO: 3848465 - RNA, 15 nt, Human
ugaagaauacaguua

SEQ ID NO: 3848466 - RNA, 20 nt, Human
ugaagaauacaguuaggcac

SEQ ID NO: 3848467 - RNA, 16 nt, Human
ugaagaauacuucuca

SEQ ID NO: 3848468 - RNA, 16 nt, Human
ugaagaauccuuuugu

SEQ ID NO: 3848469 - RNA, 21 nt, Human
ugaagaaucuguuucccagca

SEQ ID NO: 3848470 - RNA, 21 nt, Human
ugaagaauuauuuuuuuucuu

SEQ ID NO: 3848471 - RNA, 16 nt, Human
ugaagaauuuaaagaa

SEQ ID NO: 3848472 - RNA, 16 nt, Human
ugaagacaaaaauacu

SEQ ID NO: 3848473 - RNA, 21 nt, Human
ugaagacaaaaauacucuaau

SEQ ID NO: 3848474 - RNA, 22 nt, Human
ugaagacaaaaauacucuaauu

SEQ ID NO: 3848475 - RNA, 21 nt, Human
ugaagacaaugacuuacugua

SEQ ID NO: 3848476 - RNA, 21 nt, Human
ugaagacaauuugauacauaa

SEQ ID NO: 3848477 - RNA, 14 nt, Human
ugaagacagaggga

SEQ ID NO: 3848478 - RNA, 22 nt, Human
ugaagaccuaaccagggccaga

SEQ ID NO: 3848479 - RNA, 19 nt, Human
ugaagaccuuuuucugcac

SEQ ID NO: 3848480 - RNA, 17 nt, Human
ugaagacuaugaaaaug

SEQ ID NO: 3848481 - RNA, 14 nt, Human
ugaagacuccagaa

SEQ ID NO: 3848482 - RNA, 14 nt, Human
ugaagacugaggac

SEQ ID NO: 3848483 - RNA, 13 nt, Human
ugaagacuugccc

SEQ ID NO: 3848484 - RNA, 22 nt, Human
ugaagacuuuucuuucagccaa

SEQ ID NO: 3848485 - RNA, 24 nt, Human
ugaagagaaccgagcaaagaucaa

SEQ ID NO: 3848486 - RNA, 19 nt, Human
ugaagagacagagacaagu

SEQ ID NO: 3848487 - RNA, 23 nt, Human
ugaagagaccaagacucugaaau

SEQ ID NO: 3848488 - RNA, 15 nt, Human
ugaagagauuuuuca

SEQ ID NO: 3848489 - RNA, 16 nt, Human
ugaagagauuuuucau

SEQ ID NO: 3848490 - RNA, 14 nt, Human
ugaagagcuugcuu

SEQ ID NO: 3848491 - RNA, 19 nt, Human
ugaagaggaaaaugaauaa

SEQ ID NO: 3848492 - RNA, 20 nt, Human
ugaagaggaaaaugaauaau

SEQ ID NO: 3848493 - RNA, 19 nt, Human
ugaccccaaagagccugga

SEQ ID NO: 3848494 - RNA, 20 nt, Human
ugaccccagggcacaggagc

SEQ ID NO: 3848495 - RNA, 22 nt, Human
ugacccccaaccaaguggcucc

SEQ ID NO: 3848496 - RNA, 21 nt, Human
ugaccccgacgccacagccca

SEQ ID NO: 3848497 - RNA, 22 nt, Human
ugaccccgacgccacagcccag

SEQ ID NO: 3848498 - RNA, 17 nt, Human
ugaccccucauagcccu

SEQ ID NO: 3848499 - RNA, 21 nt, Human
ugaccccuccucacuggccau

SEQ ID NO: 3848500 - RNA, 20 nt, Human
ugaccccuccuggggccagg

SEQ ID NO: 3848501 - RNA, 13 nt, Human
ugaccccugccca

SEQ ID NO: 3848502 - RNA, 22 nt, Human
ugacccggcacccccugcagcu

SEQ ID NO: 3848503 - RNA, 16 nt, Human
ugacccuacucccuug

SEQ ID NO: 3848504 - RNA, 19 nt, Human
ugacccucaauucauauuu

SEQ ID NO: 3848505 - RNA, 13 nt, Human
ugacccuccuguu

SEQ ID NO: 3848506 - RNA, 21 nt, Human
ugacccuccuguugcacccag

SEQ ID NO: 3848507 - RNA, 23 nt, Human
ugacccucugaaugguccagggu

SEQ ID NO: 3848508 - RNA, 21 nt, Human
ugacccucugcugaagacuug

SEQ ID NO: 3848509 - RNA, 15 nt, Human
ugacccugaagugag

SEQ ID NO: 3848510 - RNA, 14 nt, Human
ugacccugagcuga

SEQ ID NO: 3848511 - RNA, 15 nt, Human
ugacccugaugaaaa

SEQ ID NO: 3848512 - RNA, 14 nt, Human
ugacccugcacccu

SEQ ID NO: 3848513 - RNA, 16 nt, Human
ugacccugcagagaug

SEQ ID NO: 3848514 - RNA, 18 nt, Human
ugacccuguauauagccc

SEQ ID NO: 3848515 - RNA, 15 nt, Human
gggcugcuccuccag

SEQ ID NO: 3848516 - RNA, 16 nt, Human
gggcugcuccuccagg

SEQ ID NO: 3848517 - RNA, 21 nt, Human
gggcugcugcugggcucagug

SEQ ID NO: 3848518 - RNA, 12 nt, Human
gggcugcuuccu

SEQ ID NO: 3848519 - RNA, 18 nt, Human
gggcugcuuccuccugga

SEQ ID NO: 3848520 - RNA, 20 nt, Human
gggcugcuuccuccuggaaa

SEQ ID NO: 3848521 - RNA, 18 nt, Human
gggcuggaaucuggagag

SEQ ID NO: 3848522 - RNA, 17 nt, Human
gggcuggacuggcuguc

SEQ ID NO: 3848523 - RNA, 16 nt, Human
gggcuggaggcccagg

SEQ ID NO: 3848524 - RNA, 12 nt, Human
gggcuggcccag

SEQ ID NO: 3848525 - RNA, 14 nt, Human
gggcuggcccagcc

SEQ ID NO: 3848526 - RNA, 13 nt, Human
gggcuggccuagg

SEQ ID NO: 3848527 - RNA, 19 nt, Human
gggcuggccucuggcucuc

SEQ ID NO: 3848528 - RNA, 15 nt, Human
gggcuggccuuccug

SEQ ID NO: 3848529 - RNA, 19 nt, Human
gggcuggcggcuacucagc

SEQ ID NO: 3848530 - RNA, 15 nt, Human
gggcuggcucccucu

SEQ ID NO: 3848531 - RNA, 13 nt, Human
gggcugggaaguc

SEQ ID NO: 3848532 - RNA, 18 nt, Human
gggcugggagcucugcag

SEQ ID NO: 3848533 - RNA, 21 nt, Human
gggcugggcaaggaaaaagaa

SEQ ID NO: 3848534 - RNA, 20 nt, Human
gggcugggcacugcucucac

SEQ ID NO: 3848535 - RNA, 22 nt, Human
gggcugggcacugcucucaccu

SEQ ID NO: 3848536 - RNA, 19 nt, Human
gggcugggggaugggccug

SEQ ID NO: 3848537 - RNA, 22 nt, Human
gggcugggugcgaccccaucug

SEQ ID NO: 3848538 - RNA, 23 nt, Human
gggcuggguuggcgcacccuccc

SEQ ID NO: 3848539 - RNA, 14 nt, Human
gggcugguucugua

SEQ ID NO: 3848540 - RNA, 18 nt, Human
gggcuguaaaaugcauga

SEQ ID NO: 3848541 - RNA, 18 nt, Human
gggcuguaacugccaggc

SEQ ID NO: 3848542 - RNA, 19 nt, Human
gggcuguccaguucccaga

SEQ ID NO: 3848543 - RNA, 22 nt, Human
gggcuguccugccacccagccc

SEQ ID NO: 3848544 - RNA, 22 nt, Human
gggcugugcacccagaagaaga

SEQ ID NO: 3848545 - RNA, 15 nt, Human
gggcuguuuagggga

SEQ ID NO: 3848546 - RNA, 13 nt, Human
gggcuuagagcag

SEQ ID NO: 3848547 - RNA, 19 nt, Human
gggcuucagccuaguggcu

SEQ ID NO: 3848548 - RNA, 15 nt, Human
gggcuucagggcagg

SEQ ID NO: 3848549 - RNA, 17 nt, Human
gggcuucagguccaggc

SEQ ID NO: 3848550 - RNA, 14 nt, Human
gggcuucaguggca

SEQ ID NO: 3848551 - RNA, 15 nt, Human
gggcuucaguggcag

SEQ ID NO: 3848552 - RNA, 19 nt, Human
gggcuucauacacaugaga

SEQ ID NO: 3848553 - RNA, 13 nt, Human
gggcuucccaagg

SEQ ID NO: 3848554 - RNA, 21 nt, Human
gggcuucccaguggcugcugc

SEQ ID NO: 3848555 - RNA, 18 nt, Human
gggcuuccugaggggaga

SEQ ID NO: 3848556 - RNA, 15 nt, Human
gggcuuccuggagca

SEQ ID NO: 3848557 - RNA, 16 nt, Human
gggcuuccuggagcag

SEQ ID NO: 3848558 - RNA, 15 nt, Human
gggcuuccuggugcu

SEQ ID NO: 3848559 - RNA, 13 nt, Human
gggcuucuccuga

SEQ ID NO: 3848560 - RNA, 14 nt, Human
gggcuucugcaccc

SEQ ID NO: 3848561 - RNA, 15 nt, Human
gggcuucugcacccu

SEQ ID NO: 3848562 - RNA, 18 nt, Human
gggcuucugcacccucca

SEQ ID NO: 3848563 - RNA, 19 nt, Human
gggcuucugcacccuccac

SEQ ID NO: 3848564 - RNA, 19 nt, Human
gggcuugcaaguauguuuu

SEQ ID NO: 3848565 - RNA, 14 nt, Human
gggcuugccuucug

SEQ ID NO: 3848566 - RNA, 17 nt, Human
gggcuuggccugcugug

SEQ ID NO: 3848567 - RNA, 16 nt, Human
gggcuuguggggccug

SEQ ID NO: 3848568 - RNA, 23 nt, Human
gggcuuguugcuguugauguuuu

SEQ ID NO: 3848569 - RNA, 17 nt, Human
gggcuuuccugugccag

SEQ ID NO: 3848570 - RNA, 15 nt, Human
ggggaaaagagauga

SEQ ID NO: 3848571 - RNA, 16 nt, Human
ggggaaaaucagccug

SEQ ID NO: 3848572 - RNA, 21 nt, Human
ggggaaaaucagccugcucca

SEQ ID NO: 3848573 - RNA, 22 nt, Human
ggggaaagacacugccugggcu

SEQ ID NO: 3848574 - RNA, 13 nt, Human
ggggaaagcacag

SEQ ID NO: 3848575 - RNA, 23 nt, Human
ggggaacauuucuguaaauacca

SEQ ID NO: 3848576 - RNA, 17 nt, Human
ggggaagaagcagagag

SEQ ID NO: 3848577 - RNA, 18 nt, Human
ggggaagaagcagagaga

SEQ ID NO: 3848578 - RNA, 15 nt, Human
ggggaagaauaauuu

SEQ ID NO: 3848579 - RNA, 12 nt, Human
ggggaagacagu

SEQ ID NO: 3848580 - RNA, 20 nt, Human
ggggaagagagccugcagga

SEQ ID NO: 3848581 - RNA, 15 nt, Human
ggggaagcugcagcu

SEQ ID NO: 3848582 - RNA, 22 nt, Human
ggggaagggccagucugggcug

SEQ ID NO: 3848583 - RNA, 19 nt, Human
ggggaaugagcccagagaa

SEQ ID NO: 3848584 - RNA, 15 nt, Human
ggggaauucaucucu

SEQ ID NO: 3848585 - RNA, 19 nt, Human
ggggaauugaggacacuga

SEQ ID NO: 3848586 - RNA, 13 nt, Human
ggggacagauuca

SEQ ID NO: 3848587 - RNA, 12 nt, Human
ggggacagcucc

SEQ ID NO: 3848588 - RNA, 14 nt, Human
ggggacagcuccuu

SEQ ID NO: 3848589 - RNA, 14 nt, Human
ggggacagcugugu

SEQ ID NO: 3848590 - RNA, 19 nt, Human
ggggacaggccucaccucu

SEQ ID NO: 3848591 - RNA, 13 nt, Human
ggggacagggaug

SEQ ID NO: 3848592 - RNA, 22 nt, Human
ggggacagggcuggcccagccc

SEQ ID NO: 3848593 - RNA, 14 nt, Human
ggggaccagagcug

SEQ ID NO: 3848594 - RNA, 15 nt, Human
ggggaccagagcugc

SEQ ID NO: 3848595 - RNA, 16 nt, Human
ggggaccagagcugcc

SEQ ID NO: 3848596 - RNA, 21 nt, Human
ggggacccagugcagaaugua

SEQ ID NO: 3848597 - RNA, 13 nt, Human
ggggacccccgcc

SEQ ID NO: 3848598 - RNA, 18 nt, Human
ggggacccccgcccccug

SEQ ID NO: 3848599 - RNA, 15 nt, Human
ggggaccucaggccu

SEQ ID NO: 3848600 - RNA, 21 nt, Human
ggggacgcugguagagaugga

SEQ ID NO: 3848601 - RNA, 13 nt, Human
ggggacucagccc

SEQ ID NO: 3848602 - RNA, 14 nt, Human
ggggacucagcccu

SEQ ID NO: 3848603 - RNA, 18 nt, Human
ggggacuccggcugugcu

SEQ ID NO: 3848604 - RNA, 22 nt, Human
ggggacuccggcugugcuggga

SEQ ID NO: 3848605 - RNA, 20 nt, Human
ggggacucugagcgggaggc

SEQ ID NO: 3848606 - RNA, 15 nt, Human
ggggacugccaccuc

SEQ ID NO: 3848607 - RNA, 11 nt, Human
ggggagaaagu

SEQ ID NO: 3848608 - RNA, 14 nt, Human
ggggagagccugcu

SEQ ID NO: 3848609 - RNA, 16 nt, Human
ggggagagccugcugg

SEQ ID NO: 3848610 - RNA, 19 nt, Human
ggggagaucggggccagag

SEQ ID NO: 3848611 - RNA, 11 nt, Human
ggggagcaggg

SEQ ID NO: 3848612 - RNA, 18 nt, Human
ggggagccaaaaucucaa

SEQ ID NO: 3848613 - RNA, 22 nt, Human
ggggagcuuggcugagggucug

SEQ ID NO: 3848614 - RNA, 14 nt, Human
ggggaggcagccgg

SEQ ID NO: 3848615 - RNA, 14 nt, Human
ggggagggaaggga

SEQ ID NO: 3848616 - RNA, 17 nt, Human
ggggagggaagggagcc

SEQ ID NO: 3848617 - RNA, 15 nt, Human
ggggagggauucugg

SEQ ID NO: 3848618 - RNA, 19 nt, Human
ggggagguuuucuccccca

SEQ ID NO: 3848619 - RNA, 16 nt, Human
ggggagucugaagcag

SEQ ID NO: 3848620 - RNA, 13 nt, Human
ggggaguggccac

SEQ ID NO: 3848621 - RNA, 20 nt, Human
ggggagugggacagagucug

SEQ ID NO: 3848622 - RNA, 13 nt, Human
ggggaucacagag

SEQ ID NO: 3848623 - RNA, 15 nt, Human
ggggaucauaaaguu

SEQ ID NO: 3848624 - RNA, 23 nt, Human
ggggauccccgccuggccaggag

SEQ ID NO: 3848625 - RNA, 21 nt, Human
ggggaucccucccccccaugc

SEQ ID NO: 3848626 - RNA, 21 nt, Human
ggggaugacuagaggcaggga

SEQ ID NO: 3848627 - RNA, 13 nt, Human
ggggaugcuucau

SEQ ID NO: 3848628 - RNA, 14 nt, Human
ggggauuucuccca

SEQ ID NO: 3848629 - RNA, 15 nt, Human
ggggcaacuguauga

SEQ ID NO: 3848630 - RNA, 19 nt, Human
ggggcacaguccaggaaca

SEQ ID NO: 3848631 - RNA, 17 nt, Human
ggggcacugcaggggcc

SEQ ID NO: 3848632 - RNA, 17 nt, Human
ggggcagaacagccgcu

SEQ ID NO: 3848633 - RNA, 16 nt, Human
ggggcagagggcagag

SEQ ID NO: 3848634 - RNA, 20 nt, Human
ggggcagaucuuggacucau

SEQ ID NO: 3848635 - RNA, 18 nt, Human
ggggcagcagcagcccug

SEQ ID NO: 3848636 - RNA, 19 nt, Human
ggggcagccugccuugccc

SEQ ID NO: 3848637 - RNA, 17 nt, Human
ggggcaggaguagcuga

SEQ ID NO: 3848638 - RNA, 22 nt, Human
ggggucacucaauucugcagua

SEQ ID NO: 3848639 - RNA, 13 nt, Human
ggggucaggcagc

SEQ ID NO: 3848640 - RNA, 22 nt, Human
ggggucaggccgggcagagcac

SEQ ID NO: 3848641 - RNA, 19 nt, Human
ggggucaugcccuccucuc

SEQ ID NO: 3848642 - RNA, 18 nt, Human
gggguccacccagcaaag

SEQ ID NO: 3848643 - RNA, 17 nt, Human
gggguccagggagcagg

SEQ ID NO: 3848644 - RNA, 18 nt, Human
ggggucccagcagcugcc

SEQ ID NO: 3848645 - RNA, 23 nt, Human
gggguccuccuccagggacagca

SEQ ID NO: 3848646 - RNA, 18 nt, Human
gggguccugccggagagg

SEQ ID NO: 3848647 - RNA, 19 nt, Human
gggguccuggagcagacca

SEQ ID NO: 3848648 - RNA, 18 nt, Human
ggggucguggagagcuag

SEQ ID NO: 3848649 - RNA, 19 nt, Human
ggggucguggagagcuagg

SEQ ID NO: 3848650 - RNA, 17 nt, Human
ggggucucacccaugca

SEQ ID NO: 3848651 - RNA, 19 nt, Human
ggggucucccucuccugcc

SEQ ID NO: 3848652 - RNA, 22 nt, Human
ggggucucccucuccugccuac

SEQ ID NO: 3848653 - RNA, 14 nt, Human
ggggucucccuggc

SEQ ID NO: 3848654 - RNA, 17 nt, Human
ggggucucucacagaca

SEQ ID NO: 3848655 - RNA, 23 nt, Human
ggggucucucacagacaggaccc

SEQ ID NO: 3848656 - RNA, 19 nt, Human
ggggucucuuuuguaaauu

SEQ ID NO: 3848657 - RNA, 20 nt, Human
ggggucuggaguugaucugg

SEQ ID NO: 3848658 - RNA, 21 nt, Human
ggggucuggaguugaucugga

SEQ ID NO: 3848659 - RNA, 23 nt, Human
ggggugacccggcacccccugca

SEQ ID NO: 3848660 - RNA, 15 nt, Human
ggggugaggagcugg

SEQ ID NO: 3848661 - RNA, 17 nt, Human
ggggugaugagggcagc

SEQ ID NO: 3848662 - RNA, 13 nt, Human
ggggugcacagga

SEQ ID NO: 3848663 - RNA, 14 nt, Human
ggggugcacaggag

SEQ ID NO: 3848664 - RNA, 15 nt, Human
ggggugcacaggagg

SEQ ID NO: 3848665 - RNA, 16 nt, Human
ggggugcagaggcugu

SEQ ID NO: 3848666 - RNA, 15 nt, Human
ggggugcagcaguga

SEQ ID NO: 3848667 - RNA, 13 nt, Human
ggggugcagggau

SEQ ID NO: 3848668 - RNA, 19 nt, Human
ggggugcggcggucccagc

SEQ ID NO: 3848669 - RNA, 11 nt, Human
ggggugcugcc

SEQ ID NO: 3848670 - RNA, 15 nt, Human
gggguggccugugug

SEQ ID NO: 3848671 - RNA, 14 nt, Human
ggggugggccaggc

SEQ ID NO: 3848672 - RNA, 17 nt, Human
ggggugggccaggcuga

SEQ ID NO: 3848673 - RNA, 15 nt, Human
ggggugggccucugg

SEQ ID NO: 3848674 - RNA, 13 nt, Human
ggggugggcuggu

SEQ ID NO: 3848675 - RNA, 17 nt, Human
gggguggggaccucagg

SEQ ID NO: 3848676 - RNA, 16 nt, Human
gggguggggucaugcc

SEQ ID NO: 3848677 - RNA, 14 nt, Human
gggguggugucaga

SEQ ID NO: 3848678 - RNA, 13 nt, Human
ggggugucuuuuu

SEQ ID NO: 3848679 - RNA, 20 nt, Human
gggguucauaggucacuggc

SEQ ID NO: 3848680 - RNA, 22 nt, Human
gggguucccuugagggcugcag

SEQ ID NO: 3848681 - RNA, 17 nt, Human
gggguugugaggccugg

SEQ ID NO: 3848682 - RNA, 23 nt, Human
gggguuuucgaagcucagcccac

SEQ ID NO: 3848683 - RNA, 21 nt, Human
ggguaaaauacuuuuacucug

SEQ ID NO: 3848684 - RNA, 16 nt, Human
ucuuuaaaagagagag

SEQ ID NO: 3848685 - RNA, 23 nt, Human
ucuuuaaaagagagagagagaaa

SEQ ID NO: 3848686 - RNA, 19 nt, Human
ucuuuaaaagaugcuuuua

SEQ ID NO: 3848687 - RNA, 20 nt, Human
ucuuuaaaauguaaagccau

SEQ ID NO: 3848688 - RNA, 20 nt, Human
ucuuuaaaauuacaacuaag

SEQ ID NO: 3848689 - RNA, 21 nt, Human
ucuuuaaaggcccagccccua

SEQ ID NO: 3848690 - RNA, 21 nt, Human
ucuuuaaagggauggcaagau

SEQ ID NO: 3848691 - RNA, 14 nt, Human
ucuuuaaaguucuu

SEQ ID NO: 3848692 - RNA, 23 nt, Human
ucuuuaaaucauuuuaggaaagg

SEQ ID NO: 3848693 - RNA, 16 nt, Human
ucuuuaaaugcugcuu

SEQ ID NO: 3848694 - RNA, 19 nt, Human
ucuuuaaauguuuuauaag

SEQ ID NO: 3848695 - RNA, 16 nt, Human
ucuuuaacaucuucuu

SEQ ID NO: 3848696 - RNA, 20 nt, Human
ucuuuaacucaggacuccag

SEQ ID NO: 3848697 - RNA, 21 nt, Human
ucuuuaacucaggacuccagc

SEQ ID NO: 3848698 - RNA, 15 nt, Human
ucuuuaacucauaaa

SEQ ID NO: 3848699 - RNA, 11 nt, Human
ucuuuaacugc

SEQ ID NO: 3848700 - RNA, 22 nt, Human
ucuuuaacugccguaauuuaac

SEQ ID NO: 3848701 - RNA, 12 nt, Human
ucuuuaacuugu

SEQ ID NO: 3848702 - RNA, 20 nt, Human
ucuuuaagggcaugccuugu

SEQ ID NO: 3848703 - RNA, 18 nt, Human
ucuuuaaucacuuaacau

SEQ ID NO: 3848704 - RNA, 23 nt, Human
ucuuuaaucauuuugccucuuuu

SEQ ID NO: 3848705 - RNA, 18 nt, Human
ucuuuaaugauuccuaua

SEQ ID NO: 3848706 - RNA, 17 nt, Human
ucuuuaaugcaauauac

SEQ ID NO: 3848707 - RNA, 14 nt, Human
ucuuuaauuaaaac

SEQ ID NO: 3848708 - RNA, 13 nt, Human
ucuuuaauucugu

SEQ ID NO: 3848709 - RNA, 22 nt, Human
ucuuuaauuucugucagaaugc

SEQ ID NO: 3848710 - RNA, 14 nt, Human
ucuuuaauuuuaca

SEQ ID NO: 3848711 - RNA, 14 nt, Human
ucuuuaauuuugga

SEQ ID NO: 3848712 - RNA, 17 nt, Human
ucuuuaauuuuggaauu

SEQ ID NO: 3848713 - RNA, 18 nt, Human
ucuuuaccuuuauugaua

SEQ ID NO: 3848714 - RNA, 16 nt, Human
ucuuuacucccaagac

SEQ ID NO: 3848715 - RNA, 15 nt, Human
ucuuuacuucaugga

SEQ ID NO: 3848716 - RNA, 12 nt, Human
ucuuuacuuuua

SEQ ID NO: 3848717 - RNA, 14 nt, Human
ucuuuagagaacug

SEQ ID NO: 3848718 - RNA, 13 nt, Human
ucuuuagagcauu

SEQ ID NO: 3848719 - RNA, 14 nt, Human
ucuuuagagcauug

SEQ ID NO: 3848720 - RNA, 19 nt, Human
ucuuuagagcauugccauu

SEQ ID NO: 3848721 - RNA, 12 nt, Human
ucuuuagaguua

SEQ ID NO: 3848722 - RNA, 14 nt, Human
ucuuuagaguuaga

SEQ ID NO: 3848723 - RNA, 15 nt, Human
ucuuuaggagauuua

SEQ ID NO: 3848724 - RNA, 16 nt, Human
ucuuuaggucuuugua

SEQ ID NO: 3848725 - RNA, 21 nt, Human
ucuuuaggucuuuguaagaac

SEQ ID NO: 3848726 - RNA, 23 nt, Human
ucuuuaguuuuugguugggaaug

SEQ ID NO: 3848727 - RNA, 17 nt, Human
ucuuuauacaacagugc

SEQ ID NO: 3848728 - RNA, 21 nt, Human
ucuuuauagugcacaaaauga

SEQ ID NO: 3848729 - RNA, 17 nt, Human
ucuuuauauacaauaau

SEQ ID NO: 3848730 - RNA, 11 nt, Human
ucuuuauauga

SEQ ID NO: 3848731 - RNA, 12 nt, Human
ucuuuauaugaa

SEQ ID NO: 3848732 - RNA, 16 nt, Human
ucuuuauaugaacaua

SEQ ID NO: 3848733 - RNA, 15 nt, Human
ucuuuauaugaagaa

SEQ ID NO: 3848734 - RNA, 16 nt, Human
ucuuuaugauuuuuaa

SEQ ID NO: 3848735 - RNA, 13 nt, Human
ucuuuauuccuag

SEQ ID NO: 3848736 - RNA, 14 nt, Human
ucuuuauuccuagu

SEQ ID NO: 3848737 - RNA, 13 nt, Human
ucuuuauugucug

SEQ ID NO: 3848738 - RNA, 23 nt, Human
ucuuuauuuuaaccuuugauaga

SEQ ID NO: 3848739 - RNA, 18 nt, Human
ucuuucaaaccagcuuca

SEQ ID NO: 3848740 - RNA, 19 nt, Human
ucuuucaaauugagagaau

SEQ ID NO: 3848741 - RNA, 20 nt, Human
ucuuucaacaguuucaaaau

SEQ ID NO: 3848742 - RNA, 20 nt, Human
ucuuucaagcagucgugccu

SEQ ID NO: 3848743 - RNA, 21 nt, Human
ucuuucaagcagucgugccug

SEQ ID NO: 3848744 - RNA, 16 nt, Human
ucuuucaagugaaucu

SEQ ID NO: 3848745 - RNA, 19 nt, Human
ucuuucaagugaaucuaaa

SEQ ID NO: 3848746 - RNA, 16 nt, Human
ucuuucaauacagaua

SEQ ID NO: 3848747 - RNA, 20 nt, Human
ucuuucacacuuccaccagc

SEQ ID NO: 3848748 - RNA, 19 nt, Human
ucuuucacagcuccuccca

SEQ ID NO: 3848749 - RNA, 20 nt, Human
ucuuucacagcuccucccac

SEQ ID NO: 3848750 - RNA, 10 nt, Human
ucuuucacau

SEQ ID NO: 3848751 - RNA, 22 nt, Human
ucuuucacauuguuugcugcua

SEQ ID NO: 3848752 - RNA, 23 nt, Human
ucuuucacauuguuugcugcuau

SEQ ID NO: 3848753 - RNA, 20 nt, Human
ucuuucacccacagaaagag

SEQ ID NO: 3848754 - RNA, 18 nt, Human
ucuuucacucacaucuuu

SEQ ID NO: 3848755 - RNA, 20 nt, Human
ucuuucagaaaacagaaaaa

SEQ ID NO: 3848756 - RNA, 14 nt, Human
ucuuucagaaagcu

SEQ ID NO: 3848757 - RNA, 19 nt, Human
ucuuucagccaagaauucu

SEQ ID NO: 3848758 - RNA, 23 nt, Human
ucuuucaucaaucauuguacagu

SEQ ID NO: 3848759 - RNA, 21 nt, Human
ucuuucauccacuagugcaaa

SEQ ID NO: 3848760 - RNA, 10 nt, Human
ucuuucaugg

SEQ ID NO: 3848761 - RNA, 17 nt, Human
ucuuuccaaauaaaaug

SEQ ID NO: 3848762 - RNA, 19 nt, Human
ucuuuccacagaagcucca

SEQ ID NO: 3848763 - RNA, 19 nt, Human
ucuuuccacggagccacuc

SEQ ID NO: 3848764 - RNA, 23 nt, Human
ucuuuccacggagccacuccucu

SEQ ID NO: 3848765 - RNA, 14 nt, Human
ucuuuccacucugg

SEQ ID NO: 3848766 - RNA, 16 nt, Human
ucuuuccacucuggau

SEQ ID NO: 3848767 - RNA, 17 nt, Human
ucuuuccacucuggauu

SEQ ID NO: 3848768 - RNA, 10 nt, Human
ucuuuccaga

SEQ ID NO: 3848769 - RNA, 15 nt, Human
ucuuuccauuucucu

SEQ ID NO: 3848770 - RNA, 24 nt, Human
ucuuuccauuucucucuccagucu

SEQ ID NO: 3848771 - RNA, 16 nt, Human
ucuuuccauuugcauu

SEQ ID NO: 3848772 - RNA, 22 nt, Human
ucuuucccacccuguucccagu

SEQ ID NO: 3848773 - RNA, 13 nt, Human
ucuuucccucccu

SEQ ID NO: 3848774 - RNA, 13 nt, Human
ucuuucccuccuu

SEQ ID NO: 3848775 - RNA, 16 nt, Human
ucuuucccuccuuggu

SEQ ID NO: 3848776 - RNA, 20 nt, Human
ucuuucccugcuuaaugaaa

SEQ ID NO: 3848777 - RNA, 15 nt, Human
ucuuucccuuccagu

SEQ ID NO: 3848778 - RNA, 16 nt, Human
ucuuucccuuccaguu

SEQ ID NO: 3848779 - RNA, 17 nt, Human
ucuuucccuuccuccau

SEQ ID NO: 3848780 - RNA, 22 nt, Human
ucuuuccucuuccccuugcccu

SEQ ID NO: 3848781 - RNA, 16 nt, Human
ucuuuccugccuucuu

SEQ ID NO: 3848782 - RNA, 18 nt, Human
ucuuuccuguuguuguua

SEQ ID NO: 3848783 - RNA, 16 nt, Human
ugaggggcuaccagga

SEQ ID NO: 3848784 - RNA, 14 nt, Human
ugaggggcuccugg

SEQ ID NO: 3848785 - RNA, 22 nt, Human
ugaggggcuggccuuccugccc

SEQ ID NO: 3848786 - RNA, 22 nt, Human
ugaggggggccgugcccagggg

SEQ ID NO: 3848787 - RNA, 15 nt, Human
ugagggguuccuccc

SEQ ID NO: 3848788 - RNA, 18 nt, Human
ugagggguuccuccccuc

SEQ ID NO: 3848789 - RNA, 22 nt, Human
ugagggguuccuccccuccagc

SEQ ID NO: 3848790 - RNA, 22 nt, Human
ugaggguaauaaacuuagaaua

SEQ ID NO: 3848791 - RNA, 18 nt, Human
ugaggguaucaaauaaaa

SEQ ID NO: 3848792 - RNA, 15 nt, Human
ugaggguccugcagc

SEQ ID NO: 3848793 - RNA, 22 nt, Human
ugagggugacuauggagcugag

SEQ ID NO: 3848794 - RNA, 21 nt, Human
ugagggugcuuguucccucuc

SEQ ID NO: 3848795 - RNA, 14 nt, Human
ugaggguguuucuu

SEQ ID NO: 3848796 - RNA, 16 nt, Human
ugaggguuugagagag

SEQ ID NO: 3848797 - RNA, 15 nt, Human
ugagguaaguuuuuu

SEQ ID NO: 3848798 - RNA, 16 nt, Human
ugagguauuuuuuccu

SEQ ID NO: 3848799 - RNA, 18 nt, Human
ugaggucagggagugcug

SEQ ID NO: 3848800 - RNA, 18 nt, Human
ugaggucauagcagugcu

SEQ ID NO: 3848801 - RNA, 20 nt, Human
ugagguccagcccuggcuga

SEQ ID NO: 3848802 - RNA, 19 nt, Human
ugaggucccaggcagagaa

SEQ ID NO: 3848803 - RNA, 13 nt, Human
ugagguccugagc

SEQ ID NO: 3848804 - RNA, 14 nt, Human
ugagguccugagca

SEQ ID NO: 3848805 - RNA, 15 nt, Human
ugagguccugagcac

SEQ ID NO: 3848806 - RNA, 17 nt, Human
ugagguccugagcacug

SEQ ID NO: 3848807 - RNA, 21 nt, Human
ugagguccugagcacugccag

SEQ ID NO: 3848808 - RNA, 22 nt, Human
ugagguccugagcacugccagg

SEQ ID NO: 3848809 - RNA, 23 nt, Human
ugagguccugagcacugccagga

SEQ ID NO: 3848810 - RNA, 14 nt, Human
ugaggucucagccc

SEQ ID NO: 3848811 - RNA, 16 nt, Human
ugaggucucagccccu

SEQ ID NO: 3848812 - RNA, 17 nt, Human
ugaggucucagccccuu

SEQ ID NO: 3848813 - RNA, 18 nt, Human
ugaggucucgcugaugcu

SEQ ID NO: 3848814 - RNA, 23 nt, Human
ugaggucugcucggccgucuuca

SEQ ID NO: 3848815 - RNA, 14 nt, Human
ugaggucuguuccu

SEQ ID NO: 3848816 - RNA, 17 nt, Human
ugaggucuguuuaaagu

SEQ ID NO: 3848817 - RNA, 16 nt, Human
ugaggugaaagggagc

SEQ ID NO: 3848818 - RNA, 20 nt, Human
ugaggugcagagugcccaga

SEQ ID NO: 3848819 - RNA, 15 nt, Human
ugaggugcccaggag

SEQ ID NO: 3848820 - RNA, 16 nt, Human
ugaggugcccaggaga

SEQ ID NO: 3848821 - RNA, 14 nt, Human
ugaggugccugucc

SEQ ID NO: 3848822 - RNA, 15 nt, Human
ugaggugccuguccc

SEQ ID NO: 3848823 - RNA, 16 nt, Human
ugaggugcuauguucu

SEQ ID NO: 3848824 - RNA, 19 nt, Human
ugagguggaagagggcugc

SEQ ID NO: 3848825 - RNA, 17 nt, Human
ugagguggaagcccucc

SEQ ID NO: 3848826 - RNA, 20 nt, Human
ugagguggaagcccuccuuc

SEQ ID NO: 3848827 - RNA, 22 nt, Human
ugagguggaagcccuccuucca

SEQ ID NO: 3848828 - RNA, 14 nt, Human
ugagguggcacuuu

SEQ ID NO: 3848829 - RNA, 16 nt, Human
ugagguggcacuuuuu

SEQ ID NO: 3848830 - RNA, 20 nt, Human
ugagguggcacuuuuucauu

SEQ ID NO: 3848831 - RNA, 21 nt, Human
ugagguggccuccuugcuugu

SEQ ID NO: 3848832 - RNA, 14 nt, Human
ugaggugggagaug

SEQ ID NO: 3848833 - RNA, 13 nt, Human
ugaggugggaggu

SEQ ID NO: 3848834 - RNA, 22 nt, Human
ugaggugggagguggaagaagg

SEQ ID NO: 3848835 - RNA, 20 nt, Human
ugaggugggcagaucacgag

SEQ ID NO: 3848836 - RNA, 13 nt, Human
ugaggugggccca

SEQ ID NO: 3848837 - RNA, 14 nt, Human
ugaggugggcccag

SEQ ID NO: 3848838 - RNA, 21 nt, Human
ugagguggguuuucuucccau

SEQ ID NO: 3848839 - RNA, 13 nt, Human
ugagguggucuga

SEQ ID NO: 3848840 - RNA, 14 nt, Human
ugagguggucugaa

SEQ ID NO: 3848841 - RNA, 21 nt, Human
ugagguggucugaauguucug

SEQ ID NO: 3848842 - RNA, 18 nt, Human
ugaggugucuuaagccuu

SEQ ID NO: 3848843 - RNA, 14 nt, Human
ugaggugugggggc

SEQ ID NO: 3848844 - RNA, 14 nt, Human
ugagguuacuggaa

SEQ ID NO: 3848845 - RNA, 15 nt, Human
ugagguugcuuuguu

SEQ ID NO: 3848846 - RNA, 19 nt, Human
ugagguuucaaaccucccu

SEQ ID NO: 3848847 - RNA, 13 nt, Human
ugagguuucccaa

SEQ ID NO: 3848848 - RNA, 22 nt, Human
ugaguaaaauaaauauugucuu

SEQ ID NO: 3848849 - RNA, 20 nt, Human
ugaguaaauauugaggcuuu

SEQ ID NO: 3848850 - RNA, 23 nt, Human
ugaguaaauauugaggcuuugug

SEQ ID NO: 3848851 - RNA, 10 nt, Human
ugaguaacau

SEQ ID NO: 3848852 - RNA, 15 nt, Human
ugaguaacauuugcu

SEQ ID NO: 3848853 - RNA, 17 nt, Human
ugaguaacauuugcugu

SEQ ID NO: 3848854 - RNA, 15 nt, Human
ugaguaaugguguag

SEQ ID NO: 3848855 - RNA, 17 nt, Human
ugaguaaugguguagaa

SEQ ID NO: 3848856 - RNA, 19 nt, Human
ugaguaaugguguagaaca

SEQ ID NO: 3848857 - RNA, 21 nt, Human
ugaguacaaaugccuuaaaau

SEQ ID NO: 3848858 - RNA, 21 nt, Human
ugaguaccccugcuuugggcu

SEQ ID NO: 3848859 - RNA, 17 nt, Human
ugaguacguugugcauu

SEQ ID NO: 3848860 - RNA, 19 nt, Human
ugaguacguugugcauuug

SEQ ID NO: 3848861 - RNA, 14 nt, Human
ugaguacuacaguc

SEQ ID NO: 3848862 - RNA, 23 nt, Human
ugaguacuacaguccucccaucu

SEQ ID NO: 3848863 - RNA, 20 nt, Human
ugaguacuccacacugcaca

SEQ ID NO: 3848864 - RNA, 14 nt, Human
ugaguagaggcuua

SEQ ID NO: 3848865 - RNA, 14 nt, Human
ugaguagauauuac

SEQ ID NO: 3848866 - RNA, 20 nt, Human
ugaguagauauuacuuuauc

SEQ ID NO: 3848867 - RNA, 14 nt, Human
ugaguagcucugcc

SEQ ID NO: 3848868 - RNA, 22 nt, Human
ugaguagcucugccuuugcucu

SEQ ID NO: 3848869 - RNA, 19 nt, Human
ugaguauaaaaacuugaaa

SEQ ID NO: 3848870 - RNA, 14 nt, Human
ugaguauauuauaa

SEQ ID NO: 3848871 - RNA, 16 nt, Human
ugaguauauuauaaua

SEQ ID NO: 3848872 - RNA, 13 nt, Human
ugaguaucagaau

SEQ ID NO: 3848873 - RNA, 22 nt, Human
ugaguaucagaauugaaacacu

SEQ ID NO: 3848874 - RNA, 12 nt, Human
ugaguauuguuu

SEQ ID NO: 3848875 - RNA, 19 nt, Human
ugaguauuguuuaaaaugu

SEQ ID NO: 3848876 - RNA, 17 nt, Human
ugagucaccaagcccag

SEQ ID NO: 3848877 - RNA, 20 nt, Human
ugagucacccuaccugugcc

SEQ ID NO: 3848878 - RNA, 16 nt, Human
ugagucagggcccaga

SEQ ID NO: 3848879 - RNA, 18 nt, Human
ugagucauaucuuaauau

SEQ ID NO: 3848880 - RNA, 21 nt, Human
ugagucaucuguuagggccuu

SEQ ID NO: 3848881 - RNA, 13 nt, Human
ugagucauuuaaa

SEQ ID NO: 3848882 - RNA, 19 nt, Human
ugaguccagaaguuugaga

SEQ ID NO: 3848883 - RNA, 13 nt, Human
ugagucccagugg

SEQ ID NO: 3848884 - RNA, 15 nt, Human
ugagucccaguggga

SEQ ID NO: 3848885 - RNA, 18 nt, Human
ugagucccccagagaugu

SEQ ID NO: 3848886 - RNA, 20 nt, Human
ugaguccccuguuuguuucu

SEQ ID NO: 3848887 - RNA, 14 nt, Human
ugaguccuccagaa

SEQ ID NO: 3848888 - RNA, 21 nt, Human
ugaguccuggaugauacuaau

SEQ ID NO: 3848889 - RNA, 14 nt, Human
ugaguccuggccca

SEQ ID NO: 3848890 - RNA, 14 nt, Human
ugaguccuuaaaca

SEQ ID NO: 3848891 - RNA, 15 nt, Human
ugaguccuugaaaau

SEQ ID NO: 3848892 - RNA, 16 nt, Human
ugaguccuugaaaaua

SEQ ID NO: 3848893 - RNA, 14 nt, Human
ugagucgaggacag

SEQ ID NO: 3848894 - RNA, 15 nt, Human
ugagucucccaaggc

SEQ ID NO: 3848895 - RNA, 16 nt, Human
ugagucucccaaggcu

SEQ ID NO: 3848896 - RNA, 14 nt, Human
ugagucucuucaga

SEQ ID NO: 3848897 - RNA, 17 nt, Human
ugagucugaaggcuggg

SEQ ID NO: 3848898 - RNA, 16 nt, Human
ugagucuguucuggua

SEQ ID NO: 3848899 - RNA, 15 nt, Human
ugagucuuggcggca

SEQ ID NO: 3848900 - RNA, 20 nt, Human
ugagucuuugguucuaagga

SEQ ID NO: 3848901 - RNA, 12 nt, Human
ugagucuuuuuu

SEQ ID NO: 3848902 - RNA, 17 nt, Human
ugagugaaccuguauaa

SEQ ID NO: 3848903 - RNA, 23 nt, Human
ugagugagaggcgacaggaguau

SEQ ID NO: 3848904 - RNA, 14 nt, Human
ugagugauagagcu

SEQ ID NO: 3848905 - RNA, 20 nt, Human
ugagugauccuccaacuuca

SEQ ID NO: 3848906 - RNA, 20 nt, Human
ugagugauuauuuguuauuu

SEQ ID NO: 3848907 - RNA, 13 nt, Human
ugagugcagaccc

SEQ ID NO: 3848908 - RNA, 21 nt, Human
ugagugcagaccccuuggcca

SEQ ID NO: 3848909 - RNA, 19 nt, Human
ugagugcagccguuugaga

SEQ ID NO: 3848910 - RNA, 15 nt, Human
ugagugcaggcccac

SEQ ID NO: 3848911 - RNA, 18 nt, Human
ugagugcaggcccacccu

SEQ ID NO: 3848912 - RNA, 12 nt, Human
ugagugccuggc

SEQ ID NO: 3848913 - RNA, 13 nt, Human
ugagugccuuaca

SEQ ID NO: 3848914 - RNA, 20 nt, Human
ugagugccuuacacaauggu

SEQ ID NO: 3848915 - RNA, 21 nt, Human
ugagugccuucuguggggacu

SEQ ID NO: 3848916 - RNA, 15 nt, Human
ugagugccuuuugca

SEQ ID NO: 3848917 - RNA, 17 nt, Human
ugagugccuuuugcaga

SEQ ID NO: 3848918 - RNA, 22 nt, Human
ugagugccuuuugcagaagagg

SEQ ID NO: 3848919 - RNA, 12 nt, Human
ugagugcucuga

SEQ ID NO: 3848920 - RNA, 15 nt, Human
ugaguggcauggcca

SEQ ID NO: 3848921 - RNA, 15 nt, Human
ugaguggccagggaa

SEQ ID NO: 3848922 - RNA, 13 nt, Human
ugagugggaagcc

SEQ ID NO: 3848923 - RNA, 12 nt, Human
ugagugggagaa

SEQ ID NO: 3848924 - RNA, 17 nt, Human
ugagugggagaaggcag

SEQ ID NO: 3848925 - RNA, 22 nt, Human
ugaguggggagacaccucagag

SEQ ID NO: 3848926 - RNA, 23 nt, Human
ugagugggggaucacagccucug

SEQ ID NO: 3848927 - RNA, 19 nt, Human
ugaguguaacaagaaagga

SEQ ID NO: 3848928 - RNA, 11 nt, Human
ugauaugaaaa

SEQ ID NO: 3848929 - RNA, 19 nt, Human
ugauaugcauauuuguuua

SEQ ID NO: 3848930 - RNA, 16 nt, Human
ugauauggagcaagag

SEQ ID NO: 3848931 - RNA, 16 nt, Human
ugauauggcagaagac

SEQ ID NO: 3848932 - RNA, 19 nt, Human
ugauauggcagaagacacc

SEQ ID NO: 3848933 - RNA, 15 nt, Human
ugauauguaaacaua

SEQ ID NO: 3848934 - RNA, 15 nt, Human
ugauaugugaacagu

SEQ ID NO: 3848935 - RNA, 16 nt, Human
ugauauguuuuauuuc

SEQ ID NO: 3848936 - RNA, 17 nt, Human
ugauauuacauuuauuu

SEQ ID NO: 3848937 - RNA, 12 nt, Human
ugauauucagaa

SEQ ID NO: 3848938 - RNA, 16 nt, Human
ugauauuccauaguau

SEQ ID NO: 3848939 - RNA, 18 nt, Human
ugauauuccaugaaugua

SEQ ID NO: 3848940 - RNA, 19 nt, Human
ugauauuccaugaauguau

SEQ ID NO: 3848941 - RNA, 22 nt, Human
ugauauuccaugaauguaucag

SEQ ID NO: 3848942 - RNA, 17 nt, Human
ugauauucuaagacuua

SEQ ID NO: 3848943 - RNA, 17 nt, Human
ugauauugcauaugcau

SEQ ID NO: 3848944 - RNA, 21 nt, Human
ugauauugugaacauuuguga

SEQ ID NO: 3848945 - RNA, 19 nt, Human
ugauauuguuauauacaua

SEQ ID NO: 3848946 - RNA, 14 nt, Human
ugauauuucagaaa

SEQ ID NO: 3848947 - RNA, 15 nt, Human
ugauauuucagaaau

SEQ ID NO: 3848948 - RNA, 16 nt, Human
ugauauuucagaaaua

SEQ ID NO: 3848949 - RNA, 15 nt, Human
ugauauuucucuagu

SEQ ID NO: 3848950 - RNA, 16 nt, Human
ugauauuucucuagua

SEQ ID NO: 3848951 - RNA, 19 nt, Human
ugauauuucucuaguaguu

SEQ ID NO: 3848952 - RNA, 16 nt, Human
ugauauuugugcauuu

SEQ ID NO: 3848953 - RNA, 19 nt, Human
ugauauuugugcauuuucu

SEQ ID NO: 3848954 - RNA, 19 nt, Human
ugauauuuuaccucuuauu

SEQ ID NO: 3848955 - RNA, 14 nt, Human
ugauauuuucucua

SEQ ID NO: 3848956 - RNA, 19 nt, Human
ugauauuuuuuaucauaaa

SEQ ID NO: 3848957 - RNA, 18 nt, Human
ugaucaaaaauaaugcau

SEQ ID NO: 3848958 - RNA, 13 nt, Human
ugaucaaauguuu

SEQ ID NO: 3848959 - RNA, 18 nt, Human
ugaucaaauguuuaauca

SEQ ID NO: 3848960 - RNA, 19 nt, Human
ugaucaaauguuuaaucau

SEQ ID NO: 3848961 - RNA, 20 nt, Human
ugaucaagggaauguaacug

SEQ ID NO: 3848962 - RNA, 21 nt, Human
ugaucaauauuuuuauaucau

SEQ ID NO: 3848963 - RNA, 18 nt, Human
ugaucaauuauaguuucu

SEQ ID NO: 3848964 - RNA, 16 nt, Human
ugaucaauuuugacuu

SEQ ID NO: 3848965 - RNA, 14 nt, Human
ugaucacagcagcu

SEQ ID NO: 3848966 - RNA, 19 nt, Human
ugaucaccgacugaaaaua

SEQ ID NO: 3848967 - RNA, 14 nt, Human
ugaucacggcucac

SEQ ID NO: 3848968 - RNA, 16 nt, Human
ugaucacugaaauaaa

SEQ ID NO: 3848969 - RNA, 21 nt, Human
ugaucagagccgugguccuuu

SEQ ID NO: 3848970 - RNA, 17 nt, Human
ugaucagaucugacaug

SEQ ID NO: 3848971 - RNA, 18 nt, Human
ugaucagcuguuugucau

SEQ ID NO: 3848972 - RNA, 17 nt, Human
ugaucagcuuauugucu

SEQ ID NO: 3848973 - RNA, 24 nt, Human
ugaucagcuuauugucuagugaaa

SEQ ID NO: 3848974 - RNA, 21 nt, Human
ugaucaguaguuugcauuuca

SEQ ID NO: 3848975 - RNA, 23 nt, Human
ugaucaguaguuugcauuucaga

SEQ ID NO: 3848976 - RNA, 19 nt, Human
ugaucaguggacagucugc

SEQ ID NO: 3848977 - RNA, 11 nt, Human
ugaucaguguu

SEQ ID NO: 3848978 - RNA, 18 nt, Human
ugaucaguguuguugcuc

SEQ ID NO: 3848979 - RNA, 15 nt, Human
ugaucauaagucuaa

SEQ ID NO: 3848980 - RNA, 17 nt, Human
ugaucauaagugaauuu

SEQ ID NO: 3848981 - RNA, 20 nt, Human
ugaucauagguauuucaaaa

SEQ ID NO: 3848982 - RNA, 13 nt, Human
ugaucauccacug

SEQ ID NO: 3848983 - RNA, 20 nt, Human
ugaucaucgccagaggugcu

SEQ ID NO: 3848984 - RNA, 14 nt, Human
ugaucaugcauugu

SEQ ID NO: 3848985 - RNA, 14 nt, Human
ugaucauucuggag

SEQ ID NO: 3848986 - RNA, 18 nt, Human
ugaucauuuuccccccac

SEQ ID NO: 3848987 - RNA, 20 nt, Human
ugaucauuuuccccccacuc

SEQ ID NO: 3848988 - RNA, 13 nt, Human
ugauccaacuaau

SEQ ID NO: 3848989 - RNA, 16 nt, Human
ugauccacccaacccu

SEQ ID NO: 3848990 - RNA, 16 nt, Human
ugauccacccaccuca

SEQ ID NO: 3848991 - RNA, 18 nt, Human
ugauccacccaccucagc

SEQ ID NO: 3848992 - RNA, 23 nt, Human
ugauccacuuugggggaggagaa

SEQ ID NO: 3848993 - RNA, 13 nt, Human
ugauccagaaaga

SEQ ID NO: 3848994 - RNA, 15 nt, Human
ugauccagagcacag

SEQ ID NO: 3848995 - RNA, 18 nt, Human
ugauccagccucuccccu

SEQ ID NO: 3848996 - RNA, 19 nt, Human
ugauccagccucuccccug

SEQ ID NO: 3848997 - RNA, 13 nt, Human
ugauccauccagc

SEQ ID NO: 3848998 - RNA, 16 nt, Human
ugauccauccagcuug

SEQ ID NO: 3848999 - RNA, 19 nt, Human
ugaucccaagugccagucu

SEQ ID NO: 3849000 - RNA, 13 nt, Human
ugaucccagcacu

SEQ ID NO: 3849001 - RNA, 13 nt, Human
ugauccccacgcc

SEQ ID NO: 3849002 - RNA, 20 nt, Human
ugaucccguuuuccccauga

SEQ ID NO: 3849003 - RNA, 22 nt, Human
ugaucccguuuuccccaugaca

SEQ ID NO: 3849004 - RNA, 20 nt, Human
ugaucccuuccaccugcucu

SEQ ID NO: 3849005 - RNA, 17 nt, Human
ugaucccuugagauaug

SEQ ID NO: 3849006 - RNA, 20 nt, Human
ugauccuaacugaagagaca

SEQ ID NO: 3849007 - RNA, 12 nt, Human
ugauccucccac

SEQ ID NO: 3849008 - RNA, 17 nt, Human
ugauccuggaggcccag

SEQ ID NO: 3849009 - RNA, 18 nt, Human
ugauccuggaggcccagu

SEQ ID NO: 3849010 - RNA, 20 nt, Human
ugauccuguauucagacaga

SEQ ID NO: 3849011 - RNA, 15 nt, Human
ugaucgccuuuccca

SEQ ID NO: 3849012 - RNA, 15 nt, Human
ugaucgugacgcuga

SEQ ID NO: 3849013 - RNA, 23 nt, Human
ugaucgugacgcugaauaaaugu

SEQ ID NO: 3849014 - RNA, 15 nt, Human
ugaucgugcuaaauu

SEQ ID NO: 3849015 - RNA, 17 nt, Human
ugaucguucuuucuagc

SEQ ID NO: 3849016 - RNA, 13 nt, Human
ugaucuaggaaga

SEQ ID NO: 3849017 - RNA, 13 nt, Human
ugaucuagguuua

SEQ ID NO: 3849018 - RNA, 15 nt, Human
ugaucuagguuuaac

SEQ ID NO: 3849019 - RNA, 19 nt, Human
ugaucuagguuuaacucag

SEQ ID NO: 3849020 - RNA, 22 nt, Human
ugaucuagguuuaacucagauc

SEQ ID NO: 3849021 - RNA, 12 nt, Human
ugaucucaggga

SEQ ID NO: 3849022 - RNA, 19 nt, Human
ugaucucagggaagcccag

SEQ ID NO: 3849023 - RNA, 21 nt, Human
ugaucucagggaagcccagcu

SEQ ID NO: 3849024 - RNA, 14 nt, Human
ugaucucauuguuc

SEQ ID NO: 3849025 - RNA, 12 nt, Human
ugaucucuuccu

SEQ ID NO: 3849026 - RNA, 17 nt, Human
ugaucugacauccccac

SEQ ID NO: 3849027 - RNA, 20 nt, Human
ugaucugauaggguuuguga

SEQ ID NO: 3849028 - RNA, 15 nt, Human
ugaucugcucagccc

SEQ ID NO: 3849029 - RNA, 21 nt, Human
ugaucugcucagcccuggagg

SEQ ID NO: 3849030 - RNA, 14 nt, Human
ugaucuggaaccca

SEQ ID NO: 3849031 - RNA, 11 nt, Human
ugaucugggaa

SEQ ID NO: 3849032 - RNA, 13 nt, Human
ugaucuguauaua

SEQ ID NO: 3849033 - RNA, 14 nt, Human
ugaucugucugugg

SEQ ID NO: 3849034 - RNA, 20 nt, Human
ugaucugugcuuuccagcuc

SEQ ID NO: 3849035 - RNA, 15 nt, Human
ugaucugugggcaca

SEQ ID NO: 3849036 - RNA, 15 nt, Human
ugaucuguuauaggu

SEQ ID NO: 3849037 - RNA, 15 nt, Human
ugaucuguuuuucac

SEQ ID NO: 3849038 - RNA, 15 nt, Human
ugaucuuauuuuucu

SEQ ID NO: 3849039 - RNA, 21 nt, Human
ugaucuucaacaaauugcccu

SEQ ID NO: 3849040 - RNA, 18 nt, Human
ugaucuuccucugcuaaa

SEQ ID NO: 3849041 - RNA, 21 nt, Human
ugaucuuccucugcuaaauug

SEQ ID NO: 3849042 - RNA, 19 nt, Human
ugaucuucugggagcagga

SEQ ID NO: 3849043 - RNA, 20 nt, Human
ugaucuucugggagcaggaa

SEQ ID NO: 3849044 - RNA, 20 nt, Human
ugaucuucuuuauaauucua

SEQ ID NO: 3849045 - RNA, 20 nt, Human
ugaucuugcucuaucucaca

SEQ ID NO: 3849046 - RNA, 14 nt, Human
ugaucuugugacau

SEQ ID NO: 3849047 - RNA, 19 nt, Human
ugaucuuugcagacaggca

SEQ ID NO: 3849048 - RNA, 20 nt, Human
ugaucuuugcagacaggcaa

SEQ ID NO: 3849049 - RNA, 17 nt, Human
ugaucuuuuaaaguguu

SEQ ID NO: 3849050 - RNA, 18 nt, Human
ugaucuuuuaaaguguua

SEQ ID NO: 3849051 - RNA, 14 nt, Human
ugaugaaaagcuuu

SEQ ID NO: 3849052 - RNA, 22 nt, Human
ugaugaaaagcuuuguuuguuc

SEQ ID NO: 3849053 - RNA, 11 nt, Human
ugaugaaagcu

SEQ ID NO: 3849054 - RNA, 19 nt, Human
ugaugaaauaacacagcag

SEQ ID NO: 3849055 - RNA, 22 nt, Human
ugaugaaaugaggucagagccu

SEQ ID NO: 3849056 - RNA, 17 nt, Human
ugaugaacuuauucugu

SEQ ID NO: 3849057 - RNA, 14 nt, Human
ugaugaagagagag

SEQ ID NO: 3849058 - RNA, 16 nt, Human
ugaugaagcaaggaag

SEQ ID NO: 3849059 - RNA, 14 nt, Human
ugaugaaucacugu

SEQ ID NO: 3849060 - RNA, 12 nt, Human
ugaugaaucuug

SEQ ID NO: 3849061 - RNA, 22 nt, Human
ugaugacccaggcugccugagc

SEQ ID NO: 3849062 - RNA, 16 nt, Human
ugaugacccuuuucau

SEQ ID NO: 3849063 - RNA, 19 nt, Human
ugaugacguacaaguaguu

SEQ ID NO: 3849064 - RNA, 14 nt, Human
ugaugacucaagau

SEQ ID NO: 3849065 - RNA, 23 nt, Human
ugaugacucaagauucccaggag

SEQ ID NO: 3849066 - RNA, 15 nt, Human
ugaugacuggaauuu

SEQ ID NO: 3849067 - RNA, 23 nt, Human
ugaugacuggaauuuuuauuaug

SEQ ID NO: 3849068 - RNA, 15 nt, Human
ugaugacuggcauuu

SEQ ID NO: 3849069 - RNA, 17 nt, Human
ugaugacuggcauuuua

SEQ ID NO: 3849070 - RNA, 21 nt, Human
ugaugacuuaguacaaaguuu

SEQ ID NO: 3849071 - RNA, 15 nt, Human
ugaugagaauuucua

SEQ ID NO: 3849072 - RNA, 13 nt, Human
ugaugagaggaaa

SEQ ID NO: 3849073 - RNA, 18 nt, Human
ugaccaagaacugcaugg

SEQ ID NO: 3849074 - RNA, 16 nt, Human
ugaccaagagagaaag

SEQ ID NO: 3849075 - RNA, 18 nt, Human
ugaccaagagagaaagaa

SEQ ID NO: 3849076 - RNA, 17 nt, Human
ugaccaagcaggaagcu

SEQ ID NO: 3849077 - RNA, 18 nt, Human
ugaccaaguauaaacuuu

SEQ ID NO: 3849078 - RNA, 13 nt, Human
ugaccaaguuaua

SEQ ID NO: 3849079 - RNA, 23 nt, Human
ugaccaauauuauacuaagaaaa

SEQ ID NO: 3849080 - RNA, 19 nt, Human
ugaccaauauuguacaguu

SEQ ID NO: 3849081 - RNA, 18 nt, Human
ugaccaaugauggucacc

SEQ ID NO: 3849082 - RNA, 16 nt, Human
ugaccaauugugcugc

SEQ ID NO: 3849083 - RNA, 17 nt, Human
ugaccacaccugccucu

SEQ ID NO: 3849084 - RNA, 17 nt, Human
ugaccacacuccagcug

SEQ ID NO: 3849085 - RNA, 20 nt, Human
ugaccacacuuccuguccag

SEQ ID NO: 3849086 - RNA, 14 nt, Human
ugaccacagcacag

SEQ ID NO: 3849087 - RNA, 17 nt, Human
ugaccacagcacagcca

SEQ ID NO: 3849088 - RNA, 13 nt, Human
ugaccacaggcag

SEQ ID NO: 3849089 - RNA, 16 nt, Human
ugaccacccuccccuc

SEQ ID NO: 3849090 - RNA, 17 nt, Human
ugaccacugcagaagac

SEQ ID NO: 3849091 - RNA, 23 nt, Human
ugaccacuuuuuagaaagauaau

SEQ ID NO: 3849092 - RNA, 15 nt, Human
ugaccagaagggaaa

SEQ ID NO: 3849093 - RNA, 19 nt, Human
ugaccagcaccaucucucc

SEQ ID NO: 3849094 - RNA, 21 nt, Human
ugaccagccuccaugcugccu

SEQ ID NO: 3849095 - RNA, 22 nt, Human
ugaccagccuccaugcugccuc

SEQ ID NO: 3849096 - RNA, 13 nt, Human
ugaccagcucccc

SEQ ID NO: 3849097 - RNA, 16 nt, Human
ugaccagcucccccuc

SEQ ID NO: 3849098 - RNA, 19 nt, Human
ugaccagcucccccucccu

SEQ ID NO: 3849099 - RNA, 16 nt, Human
ugaccaggaucccaag

SEQ ID NO: 3849100 - RNA, 22 nt, Human
ugaccaggcaccuccccucccg

SEQ ID NO: 3849101 - RNA, 12 nt, Human
ugaccaggccug

SEQ ID NO: 3849102 - RNA, 13 nt, Human
ugaccaggccugg

SEQ ID NO: 3849103 - RNA, 15 nt, Human
ugaccaggccugggc

SEQ ID NO: 3849104 - RNA, 16 nt, Human
ugaccaggcugccucc

SEQ ID NO: 3849105 - RNA, 16 nt, Human
ugaccagucugacccu

SEQ ID NO: 3849106 - RNA, 20 nt, Human
ugaccaguugcacuuggccu

SEQ ID NO: 3849107 - RNA, 20 nt, Human
ugaccaguuuaaccugaugc

SEQ ID NO: 3849108 - RNA, 13 nt, Human
ugaccauaaaauu

SEQ ID NO: 3849109 - RNA, 23 nt, Human
ugaccauccacucuacccuccca

SEQ ID NO: 3849110 - RNA, 15 nt, Human
ugaccaugcauuuua

SEQ ID NO: 3849111 - RNA, 16 nt, Human
ugaccaugcucaucug

SEQ ID NO: 3849112 - RNA, 18 nt, Human
guaaaucccauuauucaa

SEQ ID NO: 3849113 - RNA, 20 nt, Human
guaaaucccauuauucaaag

SEQ ID NO: 3849114 - RNA, 16 nt, Human
guaaauccugccauuu

SEQ ID NO: 3849115 - RNA, 17 nt, Human
guaaauccugccauuua

SEQ ID NO: 3849116 - RNA, 16 nt, Human
guaaauccuuuuucuu

SEQ ID NO: 3849117 - RNA, 18 nt, Human
guaaaucucuucuguguu

SEQ ID NO: 3849118 - RNA, 14 nt, Human
guaaaucuuuuaca

SEQ ID NO: 3849119 - RNA, 23 nt, Human
guaaaugaaguaacuugucuuaa

SEQ ID NO: 3849120 - RNA, 12 nt, Human
guaaaugaugug

SEQ ID NO: 3849121 - RNA, 17 nt, Human
guaaaugcaaaguucug

SEQ ID NO: 3849122 - RNA, 24 nt, Human
guaaaugcaucuguccucaugugu

SEQ ID NO: 3849123 - RNA, 15 nt, Human
guaaaugcuguguug

SEQ ID NO: 3849124 - RNA, 18 nt, Human
guaaaugggggugcauuu

SEQ ID NO: 3849125 - RNA, 19 nt, Human
guaaaugggggugcauuug

SEQ ID NO: 3849126 - RNA, 19 nt, Human
guaaaugucucacugagca

SEQ ID NO: 3849127 - RNA, 21 nt, Human
guaaaugucuguggccuuguu

SEQ ID NO: 3849128 - RNA, 22 nt, Human
guaaaugucuguggccuuguuc

SEQ ID NO: 3849129 - RNA, 13 nt, Human
guaaaugucuuug

SEQ ID NO: 3849130 - RNA, 18 nt, Human
guaaaugucuuuguaagu

SEQ ID NO: 3849131 - RNA, 19 nt, Human
guaaauguguuggacaaau

SEQ ID NO: 3849132 - RNA, 19 nt, Human
guaaauguuaguuucuugg

SEQ ID NO: 3849133 - RNA, 22 nt, Human
guaaauguuaucuuauacugua

SEQ ID NO: 3849134 - RNA, 13 nt, Human
guaaauguuauuu

SEQ ID NO: 3849135 - RNA, 19 nt, Human
guaaauuaaacauaaaaca

SEQ ID NO: 3849136 - RNA, 22 nt, Human
guaaauuaacuuuuauaaacuu

SEQ ID NO: 3849137 - RNA, 14 nt, Human
guaaauuaggaggc

SEQ ID NO: 3849138 - RNA, 14 nt, Human
guaaauuauauuug

SEQ ID NO: 3849139 - RNA, 15 nt, Human
guaaauuauauuugu

SEQ ID NO: 3849140 - RNA, 20 nt, Human
guaaauuauucaguuaagaa

SEQ ID NO: 3849141 - RNA, 12 nt, Human
guaaauuauuuu

SEQ ID NO: 3849142 - RNA, 15 nt, Human
guaaauuauuuuaaa

SEQ ID NO: 3849143 - RNA, 18 nt, Human
guaaauuauuuuaaauua

SEQ ID NO: 3849144 - RNA, 22 nt, Human
guaaauuuaguguuuuuuuauu

SEQ ID NO: 3849145 - RNA, 16 nt, Human
guaaauuuaugugaug

SEQ ID NO: 3849146 - RNA, 18 nt, Human
guaaauuuccccaacagu

SEQ ID NO: 3849147 - RNA, 21 nt, Human
guaaauuuccccaacagugug

SEQ ID NO: 3849148 - RNA, 13 nt, Human
guaaauuuggcuu

SEQ ID NO: 3849149 - RNA, 20 nt, Human
guaaauuuguacuauuuaac

SEQ ID NO: 3849150 - RNA, 22 nt, Human
guaaauuuguacuauuuaacug

SEQ ID NO: 3849151 - RNA, 13 nt, Human
guaacaagccaga

SEQ ID NO: 3849152 - RNA, 23 nt, Human
guaacaagccagauuuuuuaaaa

SEQ ID NO: 3849153 - RNA, 19 nt, Human
guaacacaagccacagaag

SEQ ID NO: 3849154 - RNA, 17 nt, Human
guaacacuaauauauuu

SEQ ID NO: 3849155 - RNA, 20 nt, Human
guaacacuaauauauuuaaa

SEQ ID NO: 3849156 - RNA, 11 nt, Human
guaacagaaag

SEQ ID NO: 3849157 - RNA, 23 nt, Human
guaacagaaagggcaacaauaaa

SEQ ID NO: 3849158 - RNA, 18 nt, Human
guaacagaacagcuucag

SEQ ID NO: 3849159 - RNA, 22 nt, Human
guaacagaacagcuucagguua

SEQ ID NO: 3849160 - RNA, 12 nt, Human
guaacagacauu

SEQ ID NO: 3849161 - RNA, 15 nt, Human
guaacagacauuguu

SEQ ID NO: 3849162 - RNA, 23 nt, Human
guaacagcuccuugggaggaagc

SEQ ID NO: 3849163 - RNA, 12 nt, Human
guaacaggcaga

SEQ ID NO: 3849164 - RNA, 22 nt, Human
guaacagguauuuuguuucuuu

SEQ ID NO: 3849165 - RNA, 16 nt, Human
guaacaggucuccucu

SEQ ID NO: 3849166 - RNA, 20 nt, Human
guaacaggucuccucuuaaa

SEQ ID NO: 3849167 - RNA, 21 nt, Human
guaacaggucuccucuuaaaa

SEQ ID NO: 3849168 - RNA, 17 nt, Human
guaacauagcugugauu

SEQ ID NO: 3849169 - RNA, 15 nt, Human
guaacaucagggacc

SEQ ID NO: 3849170 - RNA, 11 nt, Human
guaacauccuu

SEQ ID NO: 3849171 - RNA, 12 nt, Human
guaacauguuua

SEQ ID NO: 3849172 - RNA, 13 nt, Human
guaacauucaugu

SEQ ID NO: 3849173 - RNA, 17 nt, Human
guaacauucuauuucaa

SEQ ID NO: 3849174 - RNA, 18 nt, Human
guaacauuggguccuggg

SEQ ID NO: 3849175 - RNA, 15 nt, Human
guaacauuuuucaau

SEQ ID NO: 3849176 - RNA, 17 nt, Human
guaacccaacucuccug

SEQ ID NO: 3849177 - RNA, 18 nt, Human
guaacccaacucuccugg

SEQ ID NO: 3849178 - RNA, 23 nt, Human
guaacccagauuuugcuguauau

SEQ ID NO: 3849179 - RNA, 14 nt, Human
guaacccugguggu

SEQ ID NO: 3849180 - RNA, 18 nt, Human
guaaccucuucagaggcc

SEQ ID NO: 3849181 - RNA, 17 nt, Human
guaacguugcuguggga

SEQ ID NO: 3849182 - RNA, 13 nt, Human
guaacuaaaauaa

SEQ ID NO: 3849183 - RNA, 17 nt, Human
guaacuaacuaaaacaa

SEQ ID NO: 3849184 - RNA, 19 nt, Human
guaacuaacugcauacacu

SEQ ID NO: 3849185 - RNA, 17 nt, Human
guaacuaggcucagaga

SEQ ID NO: 3849186 - RNA, 19 nt, Human
guaacucuaauucccauuu

SEQ ID NO: 3849187 - RNA, 15 nt, Human
guaacuguccugucc

SEQ ID NO: 3849188 - RNA, 16 nt, Human
guaacuguuuuuuaag

SEQ ID NO: 3849189 - RNA, 16 nt, Human
guaacuuauguagaua

SEQ ID NO: 3849190 - RNA, 22 nt, Human
guaacuuauguagauauuuggc

SEQ ID NO: 3849191 - RNA, 22 nt, Human
guaacuugauccauuucuaauu

SEQ ID NO: 3849192 - RNA, 23 nt, Human
guaacuugauccauuucuaauua

SEQ ID NO: 3849193 - RNA, 20 nt, Human
guaacuugcuuaaauuucuu

SEQ ID NO: 3849194 - RNA, 21 nt, Human
guaacuugcuuaaauuucuua

SEQ ID NO: 3849195 - RNA, 16 nt, Human
guaacuugguuauaca

SEQ ID NO: 3849196 - RNA, 14 nt, Human
guaacuugucuuaa

SEQ ID NO: 3849197 - RNA, 14 nt, Human
guaacuuuaugugu

SEQ ID NO: 3849198 - RNA, 15 nt, Human
guaacuuuuguaaga

SEQ ID NO: 3849199 - RNA, 20 nt, Human
guaagaaaccuacugcccag

SEQ ID NO: 3849200 - RNA, 13 nt, Human
guaagaaauacug

SEQ ID NO: 3849201 - RNA, 17 nt, Human
guaagaaauacuguaca

SEQ ID NO: 3849202 - RNA, 23 nt, Human
guaagaacaacuaccugagcuaa

SEQ ID NO: 3849203 - RNA, 15 nt, Human
guaagaaccuugccu

SEQ ID NO: 3849204 - RNA, 16 nt, Human
guaagaaccuugccug

SEQ ID NO: 3849205 - RNA, 16 nt, Human
guaagaagacaaacug

SEQ ID NO: 3849206 - RNA, 11 nt, Human
guaagaaggca

SEQ ID NO: 3849207 - RNA, 16 nt, Human
guaagacaauccaugu

SEQ ID NO: 3849208 - RNA, 13 nt, Human
guaagagaauguu

SEQ ID NO: 3849209 - RNA, 15 nt, Human
guaagagaauguuau

SEQ ID NO: 3849210 - RNA, 21 nt, Human
guaagagcaccuuccucacuu

SEQ ID NO: 3849211 - RNA, 14 nt, Human
guaagaguguagaa

SEQ ID NO: 3849212 - RNA, 15 nt, Human
guaagaguguagaag

SEQ ID NO: 3849213 - RNA, 18 nt, Human
guaagaguguagaagcau

SEQ ID NO: 3849214 - RNA, 22 nt, Human
guaagaguguagaagcauuccu

SEQ ID NO: 3849215 - RNA, 13 nt, Human
guaagauauuugc

SEQ ID NO: 3849216 - RNA, 19 nt, Human
guaagaucguucucugccu

SEQ ID NO: 3849217 - RNA, 16 nt, Human
guaagaugcuggguug

SEQ ID NO: 3849218 - RNA, 13 nt, Human
ugcacuguccugc

SEQ ID NO: 3849219 - RNA, 23 nt, Human
ugcacuguccugcuccacagugu

SEQ ID NO: 3849220 - RNA, 18 nt, Human
ugcacugugaaggacccu

SEQ ID NO: 3849221 - RNA, 14 nt, Human
ugcacuguuccccc

SEQ ID NO: 3849222 - RNA, 12 nt, Human
ugcacuguuuaa

SEQ ID NO: 3849223 - RNA, 21 nt, Human
ugcacuuaaggcacucuguua

SEQ ID NO: 3849224 - RNA, 20 nt, Human
ugcacuuaaguuagccucca

SEQ ID NO: 3849225 - RNA, 21 nt, Human
ugcacuuauaagguguuuucu

SEQ ID NO: 3849226 - RNA, 16 nt, Human
ugcacuuggcugcaua

SEQ ID NO: 3849227 - RNA, 20 nt, Human
ugcacuugugauuauuuauu

SEQ ID NO: 3849228 - RNA, 21 nt, Human
ugcacuugugauuauuuauua

SEQ ID NO: 3849229 - RNA, 19 nt, Human
ugcacuuucuaauguuucu

SEQ ID NO: 3849230 - RNA, 22 nt, Human
ugcacuuucucaugauuuacag

SEQ ID NO: 3849231 - RNA, 15 nt, Human
ugcacuuuguucugg

SEQ ID NO: 3849232 - RNA, 18 nt, Human
ugcacuuuguucuggcuc

SEQ ID NO: 3849233 - RNA, 14 nt, Human
ugcacuuuuucuua

SEQ ID NO: 3849234 - RNA, 20 nt, Human
ugcacuuuuucuuaaucauu

SEQ ID NO: 3849235 - RNA, 12 nt, Human
ugcagaaaacau

SEQ ID NO: 3849236 - RNA, 14 nt, Human
ugcagaaaacauug

SEQ ID NO: 3849237 - RNA, 18 nt, Human
ugcagaaaauucugugcc

SEQ ID NO: 3849238 - RNA, 14 nt, Human
ugcagaaacagauu

SEQ ID NO: 3849239 - RNA, 17 nt, Human
ugcagaaacagauuugg

SEQ ID NO: 3849240 - RNA, 13 nt, Human
ugcagaaagcauc

SEQ ID NO: 3849241 - RNA, 16 nt, Human
ugcagaaauagacaaa

SEQ ID NO: 3849242 - RNA, 20 nt, Human
ugcagaaauagacaaaaagu

SEQ ID NO: 3849243 - RNA, 21 nt, Human
ugcagaaauagacaaaaagua

SEQ ID NO: 3849244 - RNA, 15 nt, Human
ugcagaacaaaugaa

SEQ ID NO: 3849245 - RNA, 21 nt, Human
ugcagaaccggagagccagcu

SEQ ID NO: 3849246 - RNA, 14 nt, Human
ugcagaacuaaacu

SEQ ID NO: 3849247 - RNA, 14 nt, Human
ugcagaacucccaa

SEQ ID NO: 3849248 - RNA, 12 nt, Human
ugcagaacugcc

SEQ ID NO: 3849249 - RNA, 21 nt, Human
ugcagaacugccauuauuuuc

SEQ ID NO: 3849250 - RNA, 23 nt, Human
ugcagaacugccauuauuuucug

SEQ ID NO: 3849251 - RNA, 16 nt, Human
ugcagaagaaggcauc

SEQ ID NO: 3849252 - RNA, 15 nt, Human
ugcagaagagggugu

SEQ ID NO: 3849253 - RNA, 20 nt, Human
ugcagaagaggguguguuug

SEQ ID NO: 3849254 - RNA, 16 nt, Human
ugcagaaggaaaaaug

SEQ ID NO: 3849255 - RNA, 19 nt, Human
ugcagaaggaaaaaugugu

SEQ ID NO: 3849256 - RNA, 21 nt, Human
ugcagaauggcauuugcaaua

SEQ ID NO: 3849257 - RNA, 22 nt, Human
ugcagaauggcauuugcaauaa

SEQ ID NO: 3849258 - RNA, 14 nt, Human
ugcagaauuguuua

SEQ ID NO: 3849259 - RNA, 21 nt, Human
ugcagacagaagucuccucaa

SEQ ID NO: 3849260 - RNA, 12 nt, Human
ugcagacaggca

SEQ ID NO: 3849261 - RNA, 21 nt, Human
ugcagacaggcaagcaccucc

SEQ ID NO: 3849262 - RNA, 21 nt, Human
ugcagacagggggccagaaca

SEQ ID NO: 3849263 - RNA, 17 nt, Human
ugcagaccccuuggcca

SEQ ID NO: 3849264 - RNA, 14 nt, Human
ugcagaccuguccu

SEQ ID NO: 3849265 - RNA, 14 nt, Human
ugcagacgcccaga

SEQ ID NO: 3849266 - RNA, 14 nt, Human
ugcagacuagaauu

SEQ ID NO: 3849267 - RNA, 15 nt, Human
ugcagacucaguuug

SEQ ID NO: 3849268 - RNA, 19 nt, Human
ugaccauucuccaccugcc

SEQ ID NO: 3849269 - RNA, 14 nt, Human
ugacccacaugcca

SEQ ID NO: 3849270 - RNA, 11 nt, Human
ugacccacccc

SEQ ID NO: 3849271 - RNA, 13 nt, Human
ugacccaccccug

SEQ ID NO: 3849272 - RNA, 18 nt, Human
ugacccaccccugugcuc

SEQ ID NO: 3849273 - RNA, 18 nt, Human
ugacccacuucucaucac

SEQ ID NO: 3849274 - RNA, 22 nt, Human
ugacccacuucucaucacacac

SEQ ID NO: 3849275 - RNA, 13 nt, Human
ugacccaggccgc

SEQ ID NO: 3849276 - RNA, 19 nt, Human
ugacccaggccgcagcucu

SEQ ID NO: 3849277 - RNA, 19 nt, Human
ugacccaggcugccugagc

SEQ ID NO: 3849278 - RNA, 14 nt, Human
ugacccaggcuggg

SEQ ID NO: 3849279 - RNA, 17 nt, Human
ugacccaggcugggcaa

SEQ ID NO: 3849280 - RNA, 19 nt, Human
ugacccaggcugggcaagg

SEQ ID NO: 3849281 - RNA, 15 nt, Human
ugacccagucccugg

SEQ ID NO: 3849282 - RNA, 16 nt, Human
ugacccagucccuggg

SEQ ID NO: 3849283 - RNA, 13 nt, Human
ugacccagugaga

SEQ ID NO: 3849284 - RNA, 19 nt, Human
ugacccaugcugcccugug

SEQ ID NO: 3849285 - RNA, 21 nt, Human
ugacccaugcugcccugugag

SEQ ID NO: 3849286 - RNA, 20 nt, Human
ugaccccaggagggaggcag

SEQ ID NO: 3849287 - RNA, 22 nt, Human
ugaccccaggagggaggcaggg

SEQ ID NO: 3849288 - RNA, 18 nt, Human
ugaccccagggcacagga

SEQ ID NO: 3849289 - RNA, 21 nt, Human
ugaccccagggcacaggagcu

SEQ ID NO: 3849290 - RNA, 14 nt, Human
ugacccccagcucc

SEQ ID NO: 3849291 - RNA, 14 nt, Human
ugaccccccucagg

SEQ ID NO: 3849292 - RNA, 23 nt, Human
ugaccccgguggcggccccagca

SEQ ID NO: 3849293 - RNA, 11 nt, Human
ugaccccuccu

SEQ ID NO: 3849294 - RNA, 12 nt, Human
ugaccccuccug

SEQ ID NO: 3849295 - RNA, 15 nt, Human
ugaccccuccugggg

SEQ ID NO: 3849296 - RNA, 16 nt, Human
ugaccccuccuggggc

SEQ ID NO: 3849297 - RNA, 17 nt, Human
ugaccccuccuggggcc

SEQ ID NO: 3849298 - RNA, 13 nt, Human
ugaccccugcuca

SEQ ID NO: 3849299 - RNA, 22 nt, Human
ugaccccuuuucagcuucugcu

SEQ ID NO: 3849300 - RNA, 17 nt, Human
ugacccuacucccuugc

SEQ ID NO: 3849301 - RNA, 21 nt, Human
ugacccucaucuuucuuccaa

SEQ ID NO: 3849302 - RNA, 13 nt, Human
ugacccuccaaau

SEQ ID NO: 3849303 - RNA, 14 nt, Human
ugacccuccccaaa

SEQ ID NO: 3849304 - RNA, 16 nt, Human
ugacccuccuguugca

SEQ ID NO: 3849305 - RNA, 17 nt, Human
ugacccugagcugacca

SEQ ID NO: 3849306 - RNA, 12 nt, Human
ugacccugcaga

SEQ ID NO: 3849307 - RNA, 12 nt, Human
ugacccugccuc

SEQ ID NO: 3849308 - RNA, 22 nt, Human
ugacccugccucucccaggcag

SEQ ID NO: 3849309 - RNA, 20 nt, Human
ugacccugcgaaggggcccu

SEQ ID NO: 3849310 - RNA, 13 nt, Human
ugacccuggcucc

SEQ ID NO: 3849311 - RNA, 17 nt, Human
ugacccuggggcuggcu

SEQ ID NO: 3849312 - RNA, 18 nt, Human
ugacccuggggcuggcuu

SEQ ID NO: 3849313 - RNA, 21 nt, Human
ugacccuuccagacauacgaa

SEQ ID NO: 3849314 - RNA, 21 nt, Human
ugacccuucccaaucagcacu

SEQ ID NO: 3849315 - RNA, 23 nt, Human
ugacccuucccaaucagcacuga

SEQ ID NO: 3849316 - RNA, 20 nt, Human
ugaccgacagcuuuccagua

SEQ ID NO: 3849317 - RNA, 19 nt, Human
ugaccgcgacuaauuucaa

SEQ ID NO: 3849318 - RNA, 21 nt, Human
ugaccguguuggucuguacug

SEQ ID NO: 3849319 - RNA, 21 nt, Human
ugaccuaagauuuauuuuguu

SEQ ID NO: 3849320 - RNA, 17 nt, Human
ugaccuaguuuuccaug

SEQ ID NO: 3849321 - RNA, 17 nt, Human
ugaccuauaccuguguu

SEQ ID NO: 3849322 - RNA, 23 nt, Human
ugaccuauaccuguguuucuugc

SEQ ID NO: 3849323 - RNA, 18 nt, Human
ugaccucaaccugugaug

SEQ ID NO: 3849324 - RNA, 21 nt, Human
ugaccucaagauguccuccuu

SEQ ID NO: 3849325 - RNA, 20 nt, Human
ugaccucaagugaucugccc

SEQ ID NO: 3849326 - RNA, 19 nt, Human
ugaccucaggcacuagccu

SEQ ID NO: 3849327 - RNA, 22 nt, Human
ugaccucaggugauccacccac

SEQ ID NO: 3849328 - RNA, 22 nt, Human
ugaccucauuaaccgaugcuuu

SEQ ID NO: 3849329 - RNA, 12 nt, Human
ugaccucccagc

SEQ ID NO: 3849330 - RNA, 21 nt, Human
ugaccucccagugaccccuga

SEQ ID NO: 3849331 - RNA, 16 nt, Human
ugaccucccccuccuu

SEQ ID NO: 3849332 - RNA, 19 nt, Human
ugaccucccccuccuuccc

SEQ ID NO: 3849333 - RNA, 14 nt, Human
ugaccucccucuaa

SEQ ID NO: 3849334 - RNA, 15 nt, Human
ugaccuccggccagg

SEQ ID NO: 3849335 - RNA, 19 nt, Human
ugaccuccggccaggugcc

SEQ ID NO: 3849336 - RNA, 24 nt, Human
ugaccuccggccaggugccuccug

SEQ ID NO: 3849337 - RNA, 20 nt, Human
ugaccucucucucugggacu

SEQ ID NO: 3849338 - RNA, 16 nt, Human
ugaccucugcagcaau

SEQ ID NO: 3849339 - RNA, 18 nt, Human
ugaccucugcagcaauaa

SEQ ID NO: 3849340 - RNA, 23 nt, Human
ugaccucugcagcaauaaagcag

SEQ ID NO: 3849341 - RNA, 14 nt, Human
ugaccucugccuga

SEQ ID NO: 3849342 - RNA, 14 nt, Human
ugaccucuugcugu

SEQ ID NO: 3849343 - RNA, 19 nt, Human
ugaccucuugcugucucug

SEQ ID NO: 3849344 - RNA, 22 nt, Human
ugaccucuugcugucucugcuc

SEQ ID NO: 3849345 - RNA, 15 nt, Human
ugaccugaggaagcg

SEQ ID NO: 3849346 - RNA, 14 nt, Human
ugaccugaggcccu

SEQ ID NO: 3849347 - RNA, 15 nt, Human
ugaccugaggcugug

SEQ ID NO: 3849348 - RNA, 20 nt, Human
ugaccugcaggccaagagca

SEQ ID NO: 3849349 - RNA, 17 nt, Human
ugaccugcaucuaagcc

SEQ ID NO: 3849350 - RNA, 17 nt, Human
ugaccugcauuguaaau

SEQ ID NO: 3849351 - RNA, 19 nt, Human
ugaccugccaggcacacug

SEQ ID NO: 3849352 - RNA, 17 nt, Human
ugaccugccucccuuca

SEQ ID NO: 3849353 - RNA, 16 nt, Human
ugaccugcuaggccag

SEQ ID NO: 3849354 - RNA, 22 nt, Human
ugaccugcuaggccagagccca

SEQ ID NO: 3849355 - RNA, 17 nt, Human
ugaccugcuccgcugcu

SEQ ID NO: 3849356 - RNA, 19 nt, Human
ugaccugcuccgcugcucc

SEQ ID NO: 3849357 - RNA, 23 nt, Human
ugaccugcuccgcugcuccuugg

SEQ ID NO: 3849358 - RNA, 11 nt, Human
ugaccugcuga

SEQ ID NO: 3849359 - RNA, 15 nt, Human
ugaccugcugaccug

SEQ ID NO: 3849360 - RNA, 12 nt, Human
ugaccugcugag

SEQ ID NO: 3849361 - RNA, 17 nt, Human
ugaccugcugagcucug

SEQ ID NO: 3849362 - RNA, 18 nt, Human
ugccaccaccucuguggc

SEQ ID NO: 3849363 - RNA, 19 nt, Human
ugccaccaccucuguggca

SEQ ID NO: 3849364 - RNA, 15 nt, Human
ugccaccacgcccgg

SEQ ID NO: 3849365 - RNA, 13 nt, Human
ugccaccagagac

SEQ ID NO: 3849366 - RNA, 14 nt, Human
ugccaccagagacc

SEQ ID NO: 3849367 - RNA, 21 nt, Human
ugccaccagagaccguccuca

SEQ ID NO: 3849368 - RNA, 23 nt, Human
ugccaccagagaccguccucacc

SEQ ID NO: 3849369 - RNA, 14 nt, Human
ugccaccaggagaa

SEQ ID NO: 3849370 - RNA, 14 nt, Human
ugccaccaggccac

SEQ ID NO: 3849371 - RNA, 15 nt, Human
ugccaccauccugcu

SEQ ID NO: 3849372 - RNA, 19 nt, Human
ugccacccaccucccugcc

SEQ ID NO: 3849373 - RNA, 20 nt, Human
ugccacccaccucccugccu

SEQ ID NO: 3849374 - RNA, 22 nt, Human
ugccacccaccucccugccucc

SEQ ID NO: 3849375 - RNA, 17 nt, Human
ugccacccagccccagc

SEQ ID NO: 3849376 - RNA, 15 nt, Human
ugccaccccacccuc

SEQ ID NO: 3849377 - RNA, 14 nt, Human
ugccacccuaccug

SEQ ID NO: 3849378 - RNA, 14 nt, Human
ugccacccugggcu

SEQ ID NO: 3849379 - RNA, 19 nt, Human
ugccacccugggcucugug

SEQ ID NO: 3849380 - RNA, 22 nt, Human
ugccacccugggcucugugggc

SEQ ID NO: 3849381 - RNA, 10 nt, Human
ugccaccucc

SEQ ID NO: 3849382 - RNA, 17 nt, Human
ugccaccuccccccaca

SEQ ID NO: 3849383 - RNA, 13 nt, Human
ugccaccuccccu

SEQ ID NO: 3849384 - RNA, 21 nt, Human
ugccaccuccccuauccaccc

SEQ ID NO: 3849385 - RNA, 10 nt, Human
ugccaccugc

SEQ ID NO: 3849386 - RNA, 16 nt, Human
ugccaccuggggcagu

SEQ ID NO: 3849387 - RNA, 22 nt, Human
ugccacuacggaauaguuggcu

SEQ ID NO: 3849388 - RNA, 22 nt, Human
ugccacuaggcugggugcccac

SEQ ID NO: 3849389 - RNA, 23 nt, Human
ugccacuaggcugggugcccaca

SEQ ID NO: 3849390 - RNA, 11 nt, Human
ugccacucaca

SEQ ID NO: 3849391 - RNA, 22 nt, Human
ugccacucacacagccaggugc

SEQ ID NO: 3849392 - RNA, 14 nt, Human
ugccacucacuagg

SEQ ID NO: 3849393 - RNA, 17 nt, Human
ugccacucacuaggccc

SEQ ID NO: 3849394 - RNA, 21 nt, Human
ugccacucacuaggcccccac

SEQ ID NO: 3849395 - RNA, 22 nt, Human
ugccacucacuaggcccccacu

SEQ ID NO: 3849396 - RNA, 18 nt, Human
ugccacucauuccuguag

SEQ ID NO: 3849397 - RNA, 14 nt, Human
ugccacuccucccu

SEQ ID NO: 3849398 - RNA, 14 nt, Human
ugccacugcacucc

SEQ ID NO: 3849399 - RNA, 18 nt, Human
ugccacugcccgagcugg

SEQ ID NO: 3849400 - RNA, 19 nt, Human
ugccacugcccgagcuggu

SEQ ID NO: 3849401 - RNA, 21 nt, Human
ugccacugcccgagcuggugc

SEQ ID NO: 3849402 - RNA, 17 nt, Human
ugccacugccucuuccu

SEQ ID NO: 3849403 - RNA, 21 nt, Human
ugccacugccuucgcuucuug

SEQ ID NO: 3849404 - RNA, 14 nt, Human
ugccacuuaaugua

SEQ ID NO: 3849405 - RNA, 18 nt, Human
ugccacuuaauguauguu

SEQ ID NO: 3849406 - RNA, 20 nt, Human
ugccacuucacuccagccug

SEQ ID NO: 3849407 - RNA, 13 nt, Human
ugccacuuuccaa

SEQ ID NO: 3849408 - RNA, 15 nt, Human
ugccacuuugcacau

SEQ ID NO: 3849409 - RNA, 23 nt, Human
ugccacuuugguacauggccagu

SEQ ID NO: 3849410 - RNA, 12 nt, Human
ugccacuuuuua

SEQ ID NO: 3849411 - RNA, 14 nt, Human
ugccagaacaguuu

SEQ ID NO: 3849412 - RNA, 18 nt, Human
ugccagaacaguuuguac

SEQ ID NO: 3849413 - RNA, 18 nt, Human
ugccagaagauccccuca

SEQ ID NO: 3849414 - RNA, 20 nt, Human
ugccagaagauccccucagg

SEQ ID NO: 3849415 - RNA, 21 nt, Human
ugccagaagauccccucagga

SEQ ID NO: 3849416 - RNA, 22 nt, Human
ugccagaaguuguggauuucag

SEQ ID NO: 3849417 - RNA, 12 nt, Human
ugccagacaugu

SEQ ID NO: 3849418 - RNA, 17 nt, Human
ugccagacccccuggag

SEQ ID NO: 3849419 - RNA, 22 nt, Human
ugccagacgcucauucagcauc

SEQ ID NO: 3849420 - RNA, 21 nt, Human
ugccagacggcacccacccag

SEQ ID NO: 3849421 - RNA, 17 nt, Human
ugccagagauaaacuaa

SEQ ID NO: 3849422 - RNA, 19 nt, Human
ugccagagcaaagggccag

SEQ ID NO: 3849423 - RNA, 23 nt, Human
ugccagagcaaagggccaggaag

SEQ ID NO: 3849424 - RNA, 14 nt, Human
ugccagagccuggg

SEQ ID NO: 3849425 - RNA, 15 nt, Human
ugccagagccugggg

SEQ ID NO: 3849426 - RNA, 16 nt, Human
ugccagagccuggggc

SEQ ID NO: 3849427 - RNA, 18 nt, Human
ugccagagccuggggcuc

SEQ ID NO: 3849428 - RNA, 20 nt, Human
ugccagaggaauccuggcag

SEQ ID NO: 3849429 - RNA, 23 nt, Human
ugccagaggaauccuggcagccc

SEQ ID NO: 3849430 - RNA, 15 nt, Human
ugccagaggugggca

SEQ ID NO: 3849431 - RNA, 16 nt, Human
ugccagaggugggcag

SEQ ID NO: 3849432 - RNA, 17 nt, Human
ugccagaggugggcagg

SEQ ID NO: 3849433 - RNA, 11 nt, Human
ugccagaugcu

SEQ ID NO: 3849434 - RNA, 21 nt, Human
ugccagaugcugauguucagu

SEQ ID NO: 3849435 - RNA, 14 nt, Human
ugccagcaaagccc

SEQ ID NO: 3849436 - RNA, 11 nt, Human
ugccagcaacu

SEQ ID NO: 3849437 - RNA, 15 nt, Human
ugccagcaacugaau

SEQ ID NO: 3849438 - RNA, 18 nt, Human
ugccagcagcagcaggug

SEQ ID NO: 3849439 - RNA, 13 nt, Human
ugccagccaagcu

SEQ ID NO: 3849440 - RNA, 11 nt, Human
ugccagccagc

SEQ ID NO: 3849441 - RNA, 17 nt, Human
ugccagccagcagccag

SEQ ID NO: 3849442 - RNA, 19 nt, Human
ugccagcccccuaaaagca

SEQ ID NO: 3849443 - RNA, 22 nt, Human
ugccagccgagauagccaaggc

SEQ ID NO: 3849444 - RNA, 19 nt, Human
ugccagccgugaugcucag

SEQ ID NO: 3849445 - RNA, 16 nt, Human
ugccagccuggcuucu

SEQ ID NO: 3849446 - RNA, 17 nt, Human
ugccagccuggcuucug

SEQ ID NO: 3849447 - RNA, 18 nt, Human
ugccagccuggcuucugg

SEQ ID NO: 3849448 - RNA, 22 nt, Human
ugccagccuggcuucuggagcc

SEQ ID NO: 3849449 - RNA, 23 nt, Human
ugccagccuggcuucuggagccc

SEQ ID NO: 3849450 - RNA, 19 nt, Human
ugccagcuacuuccuccuc

SEQ ID NO: 3849451 - RNA, 13 nt, Human
ugccagcuauuuu

SEQ ID NO: 3849452 - RNA, 23 nt, Human
ugccagcugacaucuugaauccu

SEQ ID NO: 3849453 - RNA, 19 nt, Human
ugccagcugcugagccgca

SEQ ID NO: 3849454 - RNA, 12 nt, Human
ugccagcuggcc

SEQ ID NO: 3849455 - RNA, 16 nt, Human
ugccagcuggccuuug

SEQ ID NO: 3849456 - RNA, 19 nt, Human
ugccagcuggccuuuguaa

SEQ ID NO: 3849457 - RNA, 20 nt, Human
ugccagcuuuuccucccuug

SEQ ID NO: 3849458 - RNA, 19 nt, Human
ugccaggaaacucuugcua

SEQ ID NO: 3849459 - RNA, 19 nt, Human
ugccaggaagccagcaggc

SEQ ID NO: 3849460 - RNA, 22 nt, Human
ugccaggaagccagcaggcucu

SEQ ID NO: 3849461 - RNA, 20 nt, Human
ugccaggaccagucaaccug

SEQ ID NO: 3849462 - RNA, 16 nt, Human
ugccaggacuccccag

SEQ ID NO: 3849463 - RNA, 19 nt, Human
ugccaggagcacggcucug

SEQ ID NO: 3849464 - RNA, 22 nt, Human
ugccaggaggacccagggcucu

SEQ ID NO: 3849465 - RNA, 23 nt, Human
ugccaggaggacccagggcucug

SEQ ID NO: 3849466 - RNA, 24 nt, Human
ugccaggagggacaaaggagccug

SEQ ID NO: 3849467 - RNA, 14 nt, Human
ugccaggcacaggc

SEQ ID NO: 3849468 - RNA, 17 nt, Human
ugccaggcacaggcagg

SEQ ID NO: 3849469 - RNA, 19 nt, Human
ugccaggcacaggcagggc

SEQ ID NO: 3849470 - RNA, 16 nt, Human
ugccaggcaggggugg

SEQ ID NO: 3849471 - RNA, 14 nt, Human
ugccaggccagccu

SEQ ID NO: 3849472 - RNA, 15 nt, Human
guaggcuacagagaa

SEQ ID NO: 3849473 - RNA, 18 nt, Human
guaggcuacagagaagcc

SEQ ID NO: 3849474 - RNA, 20 nt, Human
guaggcuacagagaagccuu

SEQ ID NO: 3849475 - RNA, 21 nt, Human
guaggcuauuccugagagcug

SEQ ID NO: 3849476 - RNA, 19 nt, Human
guaggcucaacuagggagu

SEQ ID NO: 3849477 - RNA, 16 nt, Human
guagggaggaccacag

SEQ ID NO: 3849478 - RNA, 16 nt, Human
guagggaggcagccuc

SEQ ID NO: 3849479 - RNA, 21 nt, Human
guagggcgggaggauguucug

SEQ ID NO: 3849480 - RNA, 22 nt, Human
guagggcgggaggauguucugg

SEQ ID NO: 3849481 - RNA, 18 nt, Human
guagggcucugacaaagc

SEQ ID NO: 3849482 - RNA, 16 nt, Human
guagggggcuggagga

SEQ ID NO: 3849483 - RNA, 21 nt, Human
guagggggcuggaggagccca

SEQ ID NO: 3849484 - RNA, 20 nt, Human
guaggggucaaagaaaugcu

SEQ ID NO: 3849485 - RNA, 15 nt, Human
guaggggugugugug

SEQ ID NO: 3849486 - RNA, 22 nt, Human
guaggguaaaucaguaagaggu

SEQ ID NO: 3849487 - RNA, 17 nt, Human
guaggguaaggugccuu

SEQ ID NO: 3849488 - RNA, 23 nt, Human
guaggguuuaauccccaguaaaa

SEQ ID NO: 3849489 - RNA, 13 nt, Human
guagguacuuuug

SEQ ID NO: 3849490 - RNA, 22 nt, Human
guagguacuuuuugugaagacg

SEQ ID NO: 3849491 - RNA, 24 nt, Human
guagguggaagcuagacacaugaa

SEQ ID NO: 3849492 - RNA, 13 nt, Human
guagguugcacac

SEQ ID NO: 3849493 - RNA, 14 nt, Human
guagguugcacacu

SEQ ID NO: 3849494 - RNA, 20 nt, Human
guagguuggaagcuagcucc

SEQ ID NO: 3849495 - RNA, 19 nt, Human
guagguugggacaccaggg

SEQ ID NO: 3849496 - RNA, 14 nt, Human
guagguugggagaa

SEQ ID NO: 3849497 - RNA, 13 nt, Human
guaguaacacuaa

SEQ ID NO: 3849498 - RNA, 22 nt, Human
guaguacuccugcaaaauuuua

SEQ ID NO: 3849499 - RNA, 19 nt, Human
guaguacuucuucuguaau

SEQ ID NO: 3849500 - RNA, 21 nt, Human
guaguacuucuucuguaauau

SEQ ID NO: 3849501 - RNA, 22 nt, Human
guaguagcguuuuuuaaaugua

SEQ ID NO: 3849502 - RNA, 18 nt, Human
guaguagggucaggccac

SEQ ID NO: 3849503 - RNA, 22 nt, Human
guaguagucucauuacuuuuga

SEQ ID NO: 3849504 - RNA, 13 nt, Human
guaguaugauggg

SEQ ID NO: 3849505 - RNA, 21 nt, Human
guaucaaauacauuuaaaaca

SEQ ID NO: 3849506 - RNA, 20 nt, Human
guaucaaauauuagauguga

SEQ ID NO: 3849507 - RNA, 13 nt, Human
guaucaaauguaa

SEQ ID NO: 3849508 - RNA, 18 nt, Human
guaucaacccagaaacac

SEQ ID NO: 3849509 - RNA, 19 nt, Human
guaucaaguggcaugugcu

SEQ ID NO: 3849510 - RNA, 17 nt, Human
guaucacugucuuuccu

SEQ ID NO: 3849511 - RNA, 12 nt, Human
guaucagaggcc

SEQ ID NO: 3849512 - RNA, 14 nt, Human
guaucagaggccua

SEQ ID NO: 3849513 - RNA, 16 nt, Human
guaucagaggccuaua

SEQ ID NO: 3849514 - RNA, 14 nt, Human
guaucaggacccag

SEQ ID NO: 3849515 - RNA, 21 nt, Human
guaucaggacccagaggaagg

SEQ ID NO: 3849516 - RNA, 17 nt, Human
guaucaggacgagaaug

SEQ ID NO: 3849517 - RNA, 15 nt, Human
guaucaggucuccca

SEQ ID NO: 3849518 - RNA, 16 nt, Human
guaucaggugcugcca

SEQ ID NO: 3849519 - RNA, 22 nt, Human
guaucaggugcugccauccagg

SEQ ID NO: 3849520 - RNA, 22 nt, Human
guaucaguguuuuaaauucuga

SEQ ID NO: 3849521 - RNA, 16 nt, Human
guaucauauauuuaau

SEQ ID NO: 3849522 - RNA, 16 nt, Human
guaucauggaaauauu

SEQ ID NO: 3849523 - RNA, 19 nt, Human
guauccaaccaacuugguu

SEQ ID NO: 3849524 - RNA, 15 nt, Human
guauccaaugaaaua

SEQ ID NO: 3849525 - RNA, 17 nt, Human
guauccaguacauuuaa

SEQ ID NO: 3849526 - RNA, 18 nt, Human
guauccaguacauuuaau

SEQ ID NO: 3849527 - RNA, 14 nt, Human
guauccauauuuua

SEQ ID NO: 3849528 - RNA, 21 nt, Human
guauccauauuuuauuacugu

SEQ ID NO: 3849529 - RNA, 21 nt, Human
guauccauuaucauguguaau

SEQ ID NO: 3849530 - RNA, 19 nt, Human
guaucccaacuccuauaau

SEQ ID NO: 3849531 - RNA, 21 nt, Human
guaucccaugagccucagcau

SEQ ID NO: 3849532 - RNA, 20 nt, Human
guaucccgagucugggacac

SEQ ID NO: 3849533 - RNA, 18 nt, Human
guaucccuguuacugaua

SEQ ID NO: 3849534 - RNA, 13 nt, Human
guaucccuucuca

SEQ ID NO: 3849535 - RNA, 22 nt, Human
guauccucauuugggguagcua

SEQ ID NO: 3849536 - RNA, 21 nt, Human
guauccuccagguuuuucaau

SEQ ID NO: 3849537 - RNA, 18 nt, Human
guauccugcccaguguug

SEQ ID NO: 3849538 - RNA, 22 nt, Human
guauccuuaucuaguguuugau

SEQ ID NO: 3849539 - RNA, 19 nt, Human
guauccuuccaauuuggaa

SEQ ID NO: 3849540 - RNA, 15 nt, Human
guaucgauguuuuau

SEQ ID NO: 3849541 - RNA, 14 nt, Human
guaucggagacagu

SEQ ID NO: 3849542 - RNA, 15 nt, Human
guaucggagacagug

SEQ ID NO: 3849543 - RNA, 13 nt, Human
guaucggcacugu

SEQ ID NO: 3849544 - RNA, 16 nt, Human
guaucggcacuguaca

SEQ ID NO: 3849545 - RNA, 11 nt, Human
guaucgggggc

SEQ ID NO: 3849546 - RNA, 20 nt, Human
guaucgggggcuggggcagg

SEQ ID NO: 3849547 - RNA, 18 nt, Human
guaucuaagaauaauaaa

SEQ ID NO: 3849548 - RNA, 15 nt, Human
guaucuagugcagcu

SEQ ID NO: 3849549 - RNA, 17 nt, Human
guaucuaugcauuuucu

SEQ ID NO: 3849550 - RNA, 18 nt, Human
guaucuccggcucccagc

SEQ ID NO: 3849551 - RNA, 21 nt, Human
guaucuccggcucccagccuc

SEQ ID NO: 3849552 - RNA, 22 nt, Human
guaucuccggcucccagccuca

SEQ ID NO: 3849553 - RNA, 11 nt, Human
guaucucuuug

SEQ ID NO: 3849554 - RNA, 14 nt, Human
guaucugaguugcc

SEQ ID NO: 3849555 - RNA, 18 nt, Human
guaucugaguugccaaga

SEQ ID NO: 3849556 - RNA, 20 nt, Human
guaucugaguugccaagaca

SEQ ID NO: 3849557 - RNA, 17 nt, Human
guaucugcaggcagaca

SEQ ID NO: 3849558 - RNA, 19 nt, Human
guaucuuccauauuuggaa

SEQ ID NO: 3849559 - RNA, 21 nt, Human
guaucuuccauauuuggaaga

SEQ ID NO: 3849560 - RNA, 22 nt, Human
guaucuuccauauuuggaagaa

SEQ ID NO: 3849561 - RNA, 14 nt, Human
guaucuugcaguau

SEQ ID NO: 3849562 - RNA, 17 nt, Human
guaucuuucuaugcugc

SEQ ID NO: 3849563 - RNA, 20 nt, Human
guaucuuucuaugcugcuuu

SEQ ID NO: 3849564 - RNA, 14 nt, Human
guaugaaaaugagu

SEQ ID NO: 3849565 - RNA, 17 nt, Human
guaugaaacuaaagccu

SEQ ID NO: 3849566 - RNA, 14 nt, Human
guaugaaagauugu

SEQ ID NO: 3849567 - RNA, 13 nt, Human
guaugaaauuaua

SEQ ID NO: 3849568 - RNA, 15 nt, Human
guaugaauacagcag

SEQ ID NO: 3849569 - RNA, 18 nt, Human
guaugaauuauucaauuu

SEQ ID NO: 3849570 - RNA, 14 nt, Human
guaugaauuugagc

SEQ ID NO: 3849571 - RNA, 15 nt, Human
guaugaggcauuugu

SEQ ID NO: 3849572 - RNA, 20 nt, Human
guaugagucaaugugcagug

SEQ ID NO: 3849573 - RNA, 24 nt, Human
guaugauagguuauuuugauguaa

SEQ ID NO: 3849574 - RNA, 22 nt, Human
guaugaucacggcucacugcag

SEQ ID NO: 3849575 - RNA, 21 nt, Human
guaugauuacuggccuuuuuc

SEQ ID NO: 3849576 - RNA, 15 nt, Human
guaugcaagcaguuu

SEQ ID NO: 3849577 - RNA, 18 nt, Human
guaugcaagcaguuucaa

SEQ ID NO: 3849578 - RNA, 15 nt, Human
guaugcaguguagau

SEQ ID NO: 3849579 - RNA, 16 nt, Human
guaugcaugugaagaa

SEQ ID NO: 3849580 - RNA, 12 nt, Human
guaugcauguug

SEQ ID NO: 3849581 - RNA, 16 nt, Human
guaugcauguugucua

SEQ ID NO: 3849582 - RNA, 17 nt, Human
guaugcauuauuaaauu

SEQ ID NO: 3849583 - RNA, 15 nt, Human
guaugcgugugugug

SEQ ID NO: 3849584 - RNA, 12 nt, Human
guaugcugcuuu

SEQ ID NO: 3849585 - RNA, 18 nt, Human
guauggagagaaaacaga

SEQ ID NO: 3849586 - RNA, 13 nt, Human
guauggagcucag

SEQ ID NO: 3849587 - RNA, 15 nt, Human
guauggagcucagag

SEQ ID NO: 3849588 - RNA, 20 nt, Human
guauggauugggggggccaa

SEQ ID NO: 3849589 - RNA, 22 nt, Human
guauggcguaaguacagagaag

SEQ ID NO: 3849590 - RNA, 21 nt, Human
guauggcucugcaccccucug

SEQ ID NO: 3849591 - RNA, 16 nt, Human
guaugggagagaagag

SEQ ID NO: 3849592 - RNA, 21 nt, Human
guauggguuagggaaaacauu

SEQ ID NO: 3849593 - RNA, 13 nt, Human
guauggucuaaca

SEQ ID NO: 3849594 - RNA, 13 nt, Human
guauguaaaugug

SEQ ID NO: 3849595 - RNA, 14 nt, Human
guauguaaaugugc

SEQ ID NO: 3849596 - RNA, 16 nt, Human
guauguaauggaacuu

SEQ ID NO: 3849597 - RNA, 16 nt, Human
guauguagaagcauga

SEQ ID NO: 3849598 - RNA, 15 nt, Human
guauguauaauucaa

SEQ ID NO: 3849599 - RNA, 23 nt, Human
guauguauauuaaaaaagagaca

SEQ ID NO: 3849600 - RNA, 13 nt, Human
guauguauuagug

SEQ ID NO: 3849601 - RNA, 17 nt, Human
guaugucauuuccuuca

SEQ ID NO: 3849602 - RNA, 13 nt, Human
guauguccuuggu

SEQ ID NO: 3849603 - RNA, 13 nt, Human
guaugucuccagu

SEQ ID NO: 3849604 - RNA, 14 nt, Human
guaugucugguucu

SEQ ID NO: 3849605 - RNA, 17 nt, Human
guaugucugguucucaa

SEQ ID NO: 3849606 - RNA, 11 nt, Human
guaugucuguc

SEQ ID NO: 3849607 - RNA, 12 nt, Human
guauguggaagg

SEQ ID NO: 3849608 - RNA, 15 nt, Human
guaugugggauauug

SEQ ID NO: 3849609 - RNA, 13 nt, Human
guauguguuuaga

SEQ ID NO: 3849610 - RNA, 18 nt, Human
guauguuaaagagaauga

SEQ ID NO: 3849611 - RNA, 13 nt, Human
guauguuauagaa

SEQ ID NO: 3849612 - RNA, 19 nt, Human
guauguucuaaccuuuaca

SEQ ID NO: 3849613 - RNA, 13 nt, Human
guauguugucaaa

SEQ ID NO: 3849614 - RNA, 16 nt, Human
guauguugucaaagag

SEQ ID NO: 3849615 - RNA, 15 nt, Human
guauguuuguacuug

SEQ ID NO: 3849616 - RNA, 20 nt, Human
guauguuuuauauagcaaga

SEQ ID NO: 3849617 - RNA, 14 nt, Human
guauguuuuucagu

SEQ ID NO: 3849618 - RNA, 22 nt, Human
guauguuuuuuauuaugcugua

SEQ ID NO: 3849619 - RNA, 23 nt, Human
guauuaaaacauuggauuauccu

SEQ ID NO: 3849620 - RNA, 18 nt, Human
guauuaaaacuaaauuuc

SEQ ID NO: 3849621 - RNA, 20 nt, Human
guauuaaaacuaaauuucac

SEQ ID NO: 3849622 - RNA, 18 nt, Human
guauuaagaaaaucuauu

SEQ ID NO: 3849623 - RNA, 16 nt, Human
guauuaagaaaggaag

SEQ ID NO: 3849624 - RNA, 16 nt, Human
guauuaagaaugaaau

SEQ ID NO: 3849625 - RNA, 15 nt, Human
guauuaagcauauau

SEQ ID NO: 3849626 - RNA, 18 nt, Human
guauuaagcauauauuuu

SEQ ID NO: 3849627 - RNA, 21 nt, Human
guauuaagcauauauuuuuau

SEQ ID NO: 3849628 - RNA, 21 nt, Human
guauuaauaaauagagcaauu

SEQ ID NO: 3849629 - RNA, 14 nt, Human
guauuaauacuaaa

SEQ ID NO: 3849630 - RNA, 14 nt, Human
guauuaauauucau

SEQ ID NO: 3849631 - RNA, 16 nt, Human
guauuaaucuuggaua

SEQ ID NO: 3849632 - RNA, 15 nt, Human
guauuacauaaauaa

SEQ ID NO: 3849633 - RNA, 21 nt, Human
guauuacuagaagaugaauac

SEQ ID NO: 3849634 - RNA, 13 nt, Human
guauuacuucugc

SEQ ID NO: 3849635 - RNA, 14 nt, Human
guauuacuucugcu

SEQ ID NO: 3849636 - RNA, 15 nt, Human
guauuacuucugcua

SEQ ID NO: 3849637 - RNA, 18 nt, Human
ugaggugugggggcugca

SEQ ID NO: 3849638 - RNA, 21 nt, Human
ugaggugugggggcugcagca

SEQ ID NO: 3849639 - RNA, 17 nt, Human
ugagguuccucugccug

SEQ ID NO: 3849640 - RNA, 18 nt, Human
ugagguuccucugccugc

SEQ ID NO: 3849641 - RNA, 16 nt, Human
ugagguugcuagagaa

SEQ ID NO: 3849642 - RNA, 12 nt, Human
ugaguaaauauu

SEQ ID NO: 3849643 - RNA, 15 nt, Human
ugaguaaauauugag

SEQ ID NO: 3849644 - RNA, 22 nt, Human
ugaguaacugauuuguaacaag

SEQ ID NO: 3849645 - RNA, 23 nt, Human
ugaguaagagcuggugucugauu

SEQ ID NO: 3849646 - RNA, 17 nt, Human
ugaguacaaaugccuua

SEQ ID NO: 3849647 - RNA, 23 nt, Human
ugaguacagaguguggacucugg

SEQ ID NO: 3849648 - RNA, 20 nt, Human
ugaguacguugugcauuugg

SEQ ID NO: 3849649 - RNA, 21 nt, Human
ugaguacuccacacugcacaa

SEQ ID NO: 3849650 - RNA, 20 nt, Human
ugccuuccacgcugucucca

SEQ ID NO: 3849651 - RNA, 12 nt, Human
ugccuuccagau

SEQ ID NO: 3849652 - RNA, 17 nt, Human
ugccuuccagauccucu

SEQ ID NO: 3849653 - RNA, 20 nt, Human
ugccuuccagauccucucug

SEQ ID NO: 3849654 - RNA, 22 nt, Human
ugccuuccagauccucucuggg

SEQ ID NO: 3849655 - RNA, 17 nt, Human
ugccuuccauaauuaug

SEQ ID NO: 3849656 - RNA, 16 nt, Human
ugccuuccuaagccug

SEQ ID NO: 3849657 - RNA, 16 nt, Human
ugccuuccuccugggc

SEQ ID NO: 3849658 - RNA, 20 nt, Human
ugccuuccuuucuccaggac

SEQ ID NO: 3849659 - RNA, 22 nt, Human
ugccuuccuuucuccaggacca

SEQ ID NO: 3849660 - RNA, 20 nt, Human
ugccuucgucuuucccaugg

SEQ ID NO: 3849661 - RNA, 22 nt, Human
ugccuucguuaacuguguaugu

SEQ ID NO: 3849662 - RNA, 15 nt, Human
ugccuucuaaaggug

SEQ ID NO: 3849663 - RNA, 13 nt, Human
ugccuucucacca

SEQ ID NO: 3849664 - RNA, 19 nt, Human
ugccuucucaccagcugca

SEQ ID NO: 3849665 - RNA, 21 nt, Human
ugccuucucaccagcugcaaa

SEQ ID NO: 3849666 - RNA, 23 nt, Human
ugccuucucaccagcugcaaagu

SEQ ID NO: 3849667 - RNA, 19 nt, Human
ugccuucugacggcccugc

SEQ ID NO: 3849668 - RNA, 12 nt, Human
ugccuucugucc

SEQ ID NO: 3849669 - RNA, 13 nt, Human
ugccuucuucacc

SEQ ID NO: 3849670 - RNA, 17 nt, Human
ugccuucuucacccagc

SEQ ID NO: 3849671 - RNA, 22 nt, Human
ugccuucuucggggaacuccug

SEQ ID NO: 3849672 - RNA, 12 nt, Human
ugccuucuuuga

SEQ ID NO: 3849673 - RNA, 16 nt, Human
ugccuucuuugaagaa

SEQ ID NO: 3849674 - RNA, 16 nt, Human
ugccuugaaaaagaca

SEQ ID NO: 3849675 - RNA, 17 nt, Human
ugccuugaaccacuucc

SEQ ID NO: 3849676 - RNA, 19 nt, Human
ugccuugaaccugugagua

SEQ ID NO: 3849677 - RNA, 15 nt, Human
ugccuugaauaauaa

SEQ ID NO: 3849678 - RNA, 23 nt, Human
ugccuugaauauccccucccagu

SEQ ID NO: 3849679 - RNA, 14 nt, Human
ugccuugcagaacu

SEQ ID NO: 3849680 - RNA, 16 nt, Human
ugccuugcagaacugc

SEQ ID NO: 3849681 - RNA, 19 nt, Human
ugccuugcagaacugccau

SEQ ID NO: 3849682 - RNA, 12 nt, Human
ugccuugccuuu

SEQ ID NO: 3849683 - RNA, 20 nt, Human
ugccuugcuguuuguccuga

SEQ ID NO: 3849684 - RNA, 18 nt, Human
ugccuuggaaguugcaug

SEQ ID NO: 3849685 - RNA, 16 nt, Human
ugccuuggcucagaca

SEQ ID NO: 3849686 - RNA, 19 nt, Human
ugccuuggcucagacaugu

SEQ ID NO: 3849687 - RNA, 11 nt, Human
ugccuugggcu

SEQ ID NO: 3849688 - RNA, 17 nt, Human
ugccuugggcugcuccu

SEQ ID NO: 3849689 - RNA, 20 nt, Human
ugccuuggggaauuuccucu

SEQ ID NO: 3849690 - RNA, 21 nt, Human
ugccuuggggaauuuccucua

SEQ ID NO: 3849691 - RNA, 12 nt, Human
gucauuaaaggu

SEQ ID NO: 3849692 - RNA, 11 nt, Human
gucauuaaaug

SEQ ID NO: 3849693 - RNA, 13 nt, Human
gucauuagccuga

SEQ ID NO: 3849694 - RNA, 19 nt, Human
gucauuauccuugcuauga

SEQ ID NO: 3849695 - RNA, 17 nt, Human
gucauuauguuaauauu

SEQ ID NO: 3849696 - RNA, 16 nt, Human
gucauucguucugugg

SEQ ID NO: 3849697 - RNA, 18 nt, Human
gucauugcaguuuaagag

SEQ ID NO: 3849698 - RNA, 12 nt, Human
gucauugcuucu

SEQ ID NO: 3849699 - RNA, 16 nt, Human
gucauugcuucuucug

SEQ ID NO: 3849700 - RNA, 12 nt, Human
gucauuguaaug

SEQ ID NO: 3849701 - RNA, 15 nt, Human
gucauuguauguuau

SEQ ID NO: 3849702 - RNA, 13 nt, Human
gucauuuaaaugu

SEQ ID NO: 3849703 - RNA, 21 nt, Human
gucauuuauuuuaaaaaauga

SEQ ID NO: 3849704 - RNA, 13 nt, Human
gucauuucauguc

SEQ ID NO: 3849705 - RNA, 21 nt, Human
gucauuucauuccauugccua

SEQ ID NO: 3849706 - RNA, 12 nt, Human
gucauuuccaug

SEQ ID NO: 3849707 - RNA, 17 nt, Human
gucauuugagucucuua

SEQ ID NO: 3849708 - RNA, 22 nt, Human
gucauuugcugugaacugaaau

SEQ ID NO: 3849709 - RNA, 16 nt, Human
gucauuuguuaaaaua

SEQ ID NO: 3849710 - RNA, 17 nt, Human
gucauuuguugugaugu

SEQ ID NO: 3849711 - RNA, 21 nt, Human
gucauuuuaacuuuaucacau

SEQ ID NO: 3849712 - RNA, 12 nt, Human
gucauuuucauu

SEQ ID NO: 3849713 - RNA, 17 nt, Human
gucauuuugaagcuaau

SEQ ID NO: 3849714 - RNA, 17 nt, Human
gucauuuuggucuaagg

SEQ ID NO: 3849715 - RNA, 20 nt, Human
gucauuuuuacaauguaauu

SEQ ID NO: 3849716 - RNA, 22 nt, Human
gucauuuuuacaauguaauuau

SEQ ID NO: 3849717 - RNA, 19 nt, Human
gucauuuuuuuuaagaaaa

SEQ ID NO: 3849718 - RNA, 17 nt, Human
guccaaaaccgccagcu

SEQ ID NO: 3849719 - RNA, 18 nt, Human
guccaaaagauugcugaa

SEQ ID NO: 3849720 - RNA, 21 nt, Human
guccaaacugccuaagcccuc

SEQ ID NO: 3849721 - RNA, 17 nt, Human
guccaaagcagggucug

SEQ ID NO: 3849722 - RNA, 20 nt, Human
guccaaaggaggcuggcagg

SEQ ID NO: 3849723 - RNA, 20 nt, Human
guccaaauaacaaguaccaa

SEQ ID NO: 3849724 - RNA, 22 nt, Human
guccaaauguccuccagaagcc

SEQ ID NO: 3849725 - RNA, 18 nt, Human
guccaaauguuuacaggg

SEQ ID NO: 3849726 - RNA, 20 nt, Human
guccaaccuaaccccuuucc

SEQ ID NO: 3849727 - RNA, 21 nt, Human
guccaaccuaaccccuuuccu

SEQ ID NO: 3849728 - RNA, 17 nt, Human
guccaagaagcccagga

SEQ ID NO: 3849729 - RNA, 18 nt, Human
guccaagaagcccaggaa

SEQ ID NO: 3849730 - RNA, 21 nt, Human
guccaagaccagacucgccaa

SEQ ID NO: 3849731 - RNA, 20 nt, Human
guccaagauuccggauccua

SEQ ID NO: 3849732 - RNA, 24 nt, Human
guccaagcauaccaacacgagcag

SEQ ID NO: 3849733 - RNA, 22 nt, Human
guccaaggaaacuugaaucaaa

SEQ ID NO: 3849734 - RNA, 21 nt, Human
guccaagguuuaaagagucua

SEQ ID NO: 3849735 - RNA, 19 nt, Human
guccaagugugugugcgug

SEQ ID NO: 3849736 - RNA, 12 nt, Human
guccaauaagac

SEQ ID NO: 3849737 - RNA, 12 nt, Human
guccaauccuau

SEQ ID NO: 3849738 - RNA, 19 nt, Human
guccaaugagcuuucugaa

SEQ ID NO: 3849739 - RNA, 20 nt, Human
guccacaaaauaaccaaucc

SEQ ID NO: 3849740 - RNA, 15 nt, Human
guccacaacacacag

SEQ ID NO: 3849741 - RNA, 16 nt, Human
guccacagaugccucc

SEQ ID NO: 3849742 - RNA, 14 nt, Human
guccacagcuuccu

SEQ ID NO: 3849743 - RNA, 21 nt, Human
guccaccaugggguccuacca

SEQ ID NO: 3849744 - RNA, 13 nt, Human
guccacccaggag

SEQ ID NO: 3849745 - RNA, 15 nt, Human
guccacccaggagcc

SEQ ID NO: 3849746 - RNA, 23 nt, Human
guccacccaggagccccgaggcc

SEQ ID NO: 3849747 - RNA, 11 nt, Human
guccacccgcc

SEQ ID NO: 3849748 - RNA, 16 nt, Human
guccacccugccugcc

SEQ ID NO: 3849749 - RNA, 15 nt, Human
guccacggcucuagg

SEQ ID NO: 3849750 - RNA, 13 nt, Human
guccacuggggug

SEQ ID NO: 3849751 - RNA, 23 nt, Human
guccacuguguauagaaguagau

SEQ ID NO: 3849752 - RNA, 19 nt, Human
guccacuucugacagccuc

SEQ ID NO: 3849753 - RNA, 18 nt, Human
guccacuuuuccaguauu

SEQ ID NO: 3849754 - RNA, 19 nt, Human
guccacuuuuccaguauuu

SEQ ID NO: 3849755 - RNA, 21 nt, Human
guccacuuuuccaguauuuua

SEQ ID NO: 3849756 - RNA, 21 nt, Human
guccagaagaauauucaggac

SEQ ID NO: 3849757 - RNA, 11 nt, Human
guccagaagga

SEQ ID NO: 3849758 - RNA, 17 nt, Human
guccagaaggagacagg

SEQ ID NO: 3849759 - RNA, 20 nt, Human
guccagaaggagacaggcag

SEQ ID NO: 3849760 - RNA, 17 nt, Human
guccagaaggagggggu

SEQ ID NO: 3849761 - RNA, 12 nt, Human
guccagacagcc

SEQ ID NO: 3849762 - RNA, 20 nt, Human
guccagagagagaagugccc

SEQ ID NO: 3849763 - RNA, 23 nt, Human
guccagagagagaagugccccug

SEQ ID NO: 3849764 - RNA, 17 nt, Human
guccagauuuacacugg

SEQ ID NO: 3849765 - RNA, 21 nt, Human
guccagauuuacacugggaga

SEQ ID NO: 3849766 - RNA, 16 nt, Human
guccagcccuggcuga

SEQ ID NO: 3849767 - RNA, 20 nt, Human
guccagcccuggcugaagga

SEQ ID NO: 3849768 - RNA, 22 nt, Human
guccagccgccauugccaccag

SEQ ID NO: 3849769 - RNA, 14 nt, Human
guccagccugcccc

SEQ ID NO: 3849770 - RNA, 14 nt, Human
guccagcucuggag

SEQ ID NO: 3849771 - RNA, 14 nt, Human
guccagcuugcucu

SEQ ID NO: 3849772 - RNA, 18 nt, Human
guccaggaaaugugcaca

SEQ ID NO: 3849773 - RNA, 18 nt, Human
guccaggaacaagcuaau

SEQ ID NO: 3849774 - RNA, 13 nt, Human
guccaggagccug

SEQ ID NO: 3849775 - RNA, 15 nt, Human
guccaggccuacucc

SEQ ID NO: 3849776 - RNA, 20 nt, Human
guccaggccuacuccugucu

SEQ ID NO: 3849777 - RNA, 23 nt, Human
guccaggccuacuccugucuucu

SEQ ID NO: 3849778 - RNA, 24 nt, Human
guccaggccuacuccugucuucug

SEQ ID NO: 3849779 - RNA, 14 nt, Human
guccaggcugccgu

SEQ ID NO: 3849780 - RNA, 16 nt, Human
guccaggcugccgugg

SEQ ID NO: 3849781 - RNA, 11 nt, Human
guccaggggau

SEQ ID NO: 3849782 - RNA, 18 nt, Human
guccaggucgggcucagc

SEQ ID NO: 3849783 - RNA, 19 nt, Human
guccaguaagaucacuguu

SEQ ID NO: 3849784 - RNA, 20 nt, Human
guccaguaagaucacuguuu

SEQ ID NO: 3849785 - RNA, 21 nt, Human
guccaguaagaucacuguuua

SEQ ID NO: 3849786 - RNA, 19 nt, Human
guccaguccuaucugggcu

SEQ ID NO: 3849787 - RNA, 16 nt, Human
guccagucucuucugc

SEQ ID NO: 3849788 - RNA, 15 nt, Human
guccauacacuuugu

SEQ ID NO: 3849789 - RNA, 14 nt, Human
guccauaucacaca

SEQ ID NO: 3849790 - RNA, 17 nt, Human
guccauaucacacacau

SEQ ID NO: 3849791 - RNA, 21 nt, Human
guccauaucagaacugugcca

SEQ ID NO: 3849792 - RNA, 16 nt, Human
guccaucugcccgccu

SEQ ID NO: 3849793 - RNA, 17 nt, Human
guccaucugcccgccug

SEQ ID NO: 3849794 - RNA, 19 nt, Human
ugcagccucaaccuccugg

SEQ ID NO: 3849795 - RNA, 20 nt, Human
ugcagccucaaccuccuggg

SEQ ID NO: 3849796 - RNA, 19 nt, Human
ugcagccucaggacuggga

SEQ ID NO: 3849797 - RNA, 20 nt, Human
ugcagccucaggacugggag

SEQ ID NO: 3849798 - RNA, 22 nt, Human
ugcagccucaggacugggagcc

SEQ ID NO: 3849799 - RNA, 18 nt, Human
ugcagccuccgcuucccu

SEQ ID NO: 3849800 - RNA, 17 nt, Human
ugcagccuccuccugac

SEQ ID NO: 3849801 - RNA, 20 nt, Human
ugcagccucgaacuccuggg

SEQ ID NO: 3849802 - RNA, 21 nt, Human
ugcagccucgaacuccugggc

SEQ ID NO: 3849803 - RNA, 17 nt, Human
ugcagccugcaggaccu

SEQ ID NO: 3849804 - RNA, 14 nt, Human
ugcagccuggaggc

SEQ ID NO: 3849805 - RNA, 17 nt, Human
ugcagcgacuggcauac

SEQ ID NO: 3849806 - RNA, 19 nt, Human
ugcagcgcagcuggacucu

SEQ ID NO: 3849807 - RNA, 21 nt, Human
ugcagcucaaggaaaggccug

SEQ ID NO: 3849808 - RNA, 19 nt, Human
ugcagcucccuggcuucug

SEQ ID NO: 3849809 - RNA, 14 nt, Human
ugcagcucuuccug

SEQ ID NO: 3849810 - RNA, 19 nt, Human
ugcagcugaaauugaaaag

SEQ ID NO: 3849811 - RNA, 21 nt, Human
ugcagcugaaauugaaaaguu

SEQ ID NO: 3849812 - RNA, 15 nt, Human
ugcagcugaccucug

SEQ ID NO: 3849813 - RNA, 20 nt, Human
ugcagcugaccucuguuguc

SEQ ID NO: 3849814 - RNA, 21 nt, Human
ugcagcugaccucuguugucc

SEQ ID NO: 3849815 - RNA, 14 nt, Human
ugcagcugauuuua

SEQ ID NO: 3849816 - RNA, 22 nt, Human
ugcagcugauuuuaacaauaac

SEQ ID NO: 3849817 - RNA, 19 nt, Human
ugcagcuggaaaagggucu

SEQ ID NO: 3849818 - RNA, 14 nt, Human
ugcagcuggacaga

SEQ ID NO: 3849819 - RNA, 16 nt, Human
ugcagcuggacagagg

SEQ ID NO: 3849820 - RNA, 18 nt, Human
ugcagcuggacagagggg

SEQ ID NO: 3849821 - RNA, 15 nt, Human
ugcagcuguuuuguu

SEQ ID NO: 3849822 - RNA, 18 nt, Human
ugcagcuguuuuguugac

SEQ ID NO: 3849823 - RNA, 11 nt, Human
ugcagcuuccu

SEQ ID NO: 3849824 - RNA, 15 nt, Human
ugcagcuucuguccu

SEQ ID NO: 3849825 - RNA, 18 nt, Human
ugcagcuugggagagccc

SEQ ID NO: 3849826 - RNA, 22 nt, Human
ugcagcuugggagagccccugg

SEQ ID NO: 3849827 - RNA, 16 nt, Human
ugcagcuuguagccag

SEQ ID NO: 3849828 - RNA, 13 nt, Human
ugcagcuuuaugu

SEQ ID NO: 3849829 - RNA, 14 nt, Human
ugcagcuuugcaaa

SEQ ID NO: 3849830 - RNA, 18 nt, Human
ugcaggaaggagcugccu

SEQ ID NO: 3849831 - RNA, 19 nt, Human
ugcaggaaggagcugccug

SEQ ID NO: 3849832 - RNA, 12 nt, Human
ugcaggaaucaa

SEQ ID NO: 3849833 - RNA, 14 nt, Human
ugcaggaccucagg

SEQ ID NO: 3849834 - RNA, 16 nt, Human
ugcaggaccucaggug

SEQ ID NO: 3849835 - RNA, 18 nt, Human
ugcaggaccucaggugag

SEQ ID NO: 3849836 - RNA, 15 nt, Human
ugcaggacuugagaa

SEQ ID NO: 3849837 - RNA, 18 nt, Human
ugcaggacuugagaagac

SEQ ID NO: 3849838 - RNA, 13 nt, Human
ugcaggagcuucu

SEQ ID NO: 3849839 - RNA, 19 nt, Human
ugcaggauuuguucucugu

SEQ ID NO: 3849840 - RNA, 21 nt, Human
ugcaggcaccuuaguggcuuu

SEQ ID NO: 3849841 - RNA, 23 nt, Human
ugcaggcacucaaugcagccaga

SEQ ID NO: 3849842 - RNA, 13 nt, Human
ugcaggcagacac

SEQ ID NO: 3849843 - RNA, 11 nt, Human
ugcaggcaggc

SEQ ID NO: 3849844 - RNA, 21 nt, Human
ugcaggcaugcaugugcuugu

SEQ ID NO: 3849845 - RNA, 13 nt, Human
ugcaggcccaccc

SEQ ID NO: 3849846 - RNA, 14 nt, Human
ugcaggcccacccu

SEQ ID NO: 3849847 - RNA, 15 nt, Human
ugcaggcccacccug

SEQ ID NO: 3849848 - RNA, 17 nt, Human
ugcaggcccacccugcu

SEQ ID NO: 3849849 - RNA, 10 nt, Human
ugcaggcccc

SEQ ID NO: 3849850 - RNA, 12 nt, Human
ugcaggcccugg

SEQ ID NO: 3849851 - RNA, 20 nt, Human
ugcaggcccuggccuccccu

SEQ ID NO: 3849852 - RNA, 19 nt, Human
ugcaggcugagccacucuc

SEQ ID NO: 3849853 - RNA, 15 nt, Human
ugcaggcuggccagc

SEQ ID NO: 3849854 - RNA, 17 nt, Human
ugcaggcuggccagccg

SEQ ID NO: 3849855 - RNA, 15 nt, Human
ugcagggaaaauuau

SEQ ID NO: 3849856 - RNA, 16 nt, Human
ugcagggacaaagagg

SEQ ID NO: 3849857 - RNA, 23 nt, Human
ugcagggagcauggcugugagga

SEQ ID NO: 3849858 - RNA, 23 nt, Human
ugcagggagcugggcuuccagaa

SEQ ID NO: 3849859 - RNA, 15 nt, Human
ugcagggaugugggu

SEQ ID NO: 3849860 - RNA, 12 nt, Human
ugcagggcagcc

SEQ ID NO: 3849861 - RNA, 14 nt, Human
ugcagggcagcccc

SEQ ID NO: 3849862 - RNA, 13 nt, Human
ugcagggcaguca

SEQ ID NO: 3849863 - RNA, 14 nt, Human
ugcagggcagucau

SEQ ID NO: 3849864 - RNA, 21 nt, Human
ugcagggcagucauuggcugu

SEQ ID NO: 3849865 - RNA, 21 nt, Human
ugcagggccagaccugccugc

SEQ ID NO: 3849866 - RNA, 12 nt, Human
ugcagggccagg

SEQ ID NO: 3849867 - RNA, 15 nt, Human
ugcagggccauggcu

SEQ ID NO: 3849868 - RNA, 14 nt, Human
ugcagggccuccau

SEQ ID NO: 3849869 - RNA, 17 nt, Human
ugcagggcuuuaaaauu

SEQ ID NO: 3849870 - RNA, 22 nt, Human
ugcaggggauugaagcccucca

SEQ ID NO: 3849871 - RNA, 22 nt, Human
ugcaggggcaaacaccugcuga

SEQ ID NO: 3849872 - RNA, 13 nt, Human
ugcaggggcucug

SEQ ID NO: 3849873 - RNA, 22 nt, Human
ugcaggggugacggcccucauc

SEQ ID NO: 3849874 - RNA, 18 nt, Human
ugcaggguggugcuggga

SEQ ID NO: 3849875 - RNA, 17 nt, Human
ugcaggucccuaauaaa

SEQ ID NO: 3849876 - RNA, 18 nt, Human
ugcaggucccuaauaaag

SEQ ID NO: 3849877 - RNA, 19 nt, Human
ugcaggucccuaauaaagc

SEQ ID NO: 3849878 - RNA, 22 nt, Human
ugcaggucuuuaaaucauuuua

SEQ ID NO: 3849879 - RNA, 16 nt, Human
ugcaggugaaacccag

SEQ ID NO: 3849880 - RNA, 22 nt, Human
ugcaggugcuauuguuacucuu

SEQ ID NO: 3849881 - RNA, 16 nt, Human
ugcaggugcugcugcg

SEQ ID NO: 3849882 - RNA, 20 nt, Human
ugcagguggugucgggcccu

SEQ ID NO: 3849883 - RNA, 18 nt, Human
ugcagguuaguuacauau

SEQ ID NO: 3849884 - RNA, 12 nt, Human
ugcagguuccca

SEQ ID NO: 3849885 - RNA, 17 nt, Human
ugcagguugaagccaug

SEQ ID NO: 3849886 - RNA, 20 nt, Human
ugcagguuggaccccagaga

SEQ ID NO: 3849887 - RNA, 16 nt, Human
ugcagguuuguuacau

SEQ ID NO: 3849888 - RNA, 14 nt, Human
ugcagguuuucugu

SEQ ID NO: 3849889 - RNA, 14 nt, Human
ugcaguaaaucuuu

SEQ ID NO: 3849890 - RNA, 21 nt, Human
ugcaguaaaucuuuuacaacu

SEQ ID NO: 3849891 - RNA, 18 nt, Human
ugcaguaacuguuuuuua

SEQ ID NO: 3849892 - RNA, 15 nt, Human
ugcaguaacuuggga

SEQ ID NO: 3849893 - RNA, 17 nt, Human
ugcaguaacuugggagu

SEQ ID NO: 3849894 - RNA, 14 nt, Human
ugcaguacuaacau

SEQ ID NO: 3849895 - RNA, 18 nt, Human
ugcaguacuuuaccuccu

SEQ ID NO: 3849896 - RNA, 18 nt, Human
ugcaguacuuugugcauu

SEQ ID NO: 3849897 - RNA, 16 nt, Human
ugcaguagagucaucu

SEQ ID NO: 3849898 - RNA, 19 nt, Human
ugcaguagagucaucucca

SEQ ID NO: 3849899 - RNA, 20 nt, Human
ugcaguagauuuucuuuaaa

SEQ ID NO: 3849900 - RNA, 13 nt, Human
ugcaguauauuuc

SEQ ID NO: 3849901 - RNA, 21 nt, Human
ugcaguaucggcacuguacaa

SEQ ID NO: 3849902 - RNA, 17 nt, Human
ugcaguaugguacauuu

SEQ ID NO: 3849903 - RNA, 15 nt, Human
ugcagucacuggagg

SEQ ID NO: 3849904 - RNA, 16 nt, Human
ugcagucaucagaagu

SEQ ID NO: 3849905 - RNA, 22 nt, Human
ugcagucauggagaaccaccua

SEQ ID NO: 3849906 - RNA, 20 nt, Human
ugcagucccaagcggugucu

SEQ ID NO: 3849907 - RNA, 17 nt, Human
ugcaguccuacucaagc

SEQ ID NO: 3849908 - RNA, 13 nt, Human
ugcaguccuggga

SEQ ID NO: 3849909 - RNA, 23 nt, Human
ugcagucuccucuuuaaaacaaa

SEQ ID NO: 3849910 - RNA, 20 nt, Human
ugcagucucuauaccaauaa

SEQ ID NO: 3849911 - RNA, 22 nt, Human
ugcagucucuauaccaauaaag

SEQ ID NO: 3849912 - RNA, 21 nt, Human
ugcagucuggcugagcccugc

SEQ ID NO: 3849913 - RNA, 15 nt, Human
ugcagugagccaaga

SEQ ID NO: 3849914 - RNA, 10 nt, Human
ugcagugcag

SEQ ID NO: 3849915 - RNA, 17 nt, Human
ugcagugcucgcuguug

SEQ ID NO: 3849916 - RNA, 19 nt, Human
ugcagugcucgcuguugcu

SEQ ID NO: 3849917 - RNA, 20 nt, Human
ugcagugcucgcuguugcug

SEQ ID NO: 3849918 - RNA, 22 nt, Human
ugcagugcucgcuguugcugaa

SEQ ID NO: 3849919 - RNA, 18 nt, Human
gucucccucuccugccua

SEQ ID NO: 3849920 - RNA, 20 nt, Human
gucucccucuccugccuacu

SEQ ID NO: 3849921 - RNA, 14 nt, Human
gucucccuggcucc

SEQ ID NO: 3849922 - RNA, 13 nt, Human
gucucccuucucc

SEQ ID NO: 3849923 - RNA, 21 nt, Human
gucuccucacucccuucuacc

SEQ ID NO: 3849924 - RNA, 14 nt, Human
gucuccuccccuuc

SEQ ID NO: 3849925 - RNA, 13 nt, Human
gucuccucuuuaa

SEQ ID NO: 3849926 - RNA, 18 nt, Human
gucuccucuuuaaaacaa

SEQ ID NO: 3849927 - RNA, 19 nt, Human
gucuccucuuuguuuuguu

SEQ ID NO: 3849928 - RNA, 19 nt, Human
gucuccugcccccacaccu

SEQ ID NO: 3849929 - RNA, 22 nt, Human
gucuccugcccccacaccuggc

SEQ ID NO: 3849930 - RNA, 23 nt, Human
gucuccugcccccacaccuggcc

SEQ ID NO: 3849931 - RNA, 21 nt, Human
gucuccugugcccacauccca

SEQ ID NO: 3849932 - RNA, 16 nt, Human
gucuccuuuaagagcu

SEQ ID NO: 3849933 - RNA, 18 nt, Human
gucuccuuucaccccagg

SEQ ID NO: 3849934 - RNA, 15 nt, Human
gucuccuuugcacug

SEQ ID NO: 3849935 - RNA, 16 nt, Human
gucuccuuugcacuga

SEQ ID NO: 3849936 - RNA, 18 nt, Human
gucuccuuugcacugagg

SEQ ID NO: 3849937 - RNA, 20 nt, Human
gucuccuuugcacugagggc

SEQ ID NO: 3849938 - RNA, 13 nt, Human
gucucgaacuccu

SEQ ID NO: 3849939 - RNA, 14 nt, Human
gucugggggcacaa

SEQ ID NO: 3849940 - RNA, 19 nt, Human
gucugggggcacaagacug

SEQ ID NO: 3849941 - RNA, 20 nt, Human
gucugggggcacaagacuga

SEQ ID NO: 3849942 - RNA, 17 nt, Human
gucugggguucagcccc

SEQ ID NO: 3849943 - RNA, 18 nt, Human
gucugggguucagccccu

SEQ ID NO: 3849944 - RNA, 15 nt, Human
gucugggugcuacug

SEQ ID NO: 3849945 - RNA, 17 nt, Human
gucuggguggcucacuc

SEQ ID NO: 3849946 - RNA, 18 nt, Human
gucuggucuccucagccu

SEQ ID NO: 3849947 - RNA, 20 nt, Human
gucugguggccccguuucug

SEQ ID NO: 3849948 - RNA, 14 nt, Human
gucugguucucaau

SEQ ID NO: 3849949 - RNA, 18 nt, Human
gucuguaaaaucuuucuu

SEQ ID NO: 3849950 - RNA, 18 nt, Human
gucuguaaugacaaauaa

SEQ ID NO: 3849951 - RNA, 19 nt, Human
gucuguacacguguccugu

SEQ ID NO: 3849952 - RNA, 16 nt, Human
gucuguacugauucaa

SEQ ID NO: 3849953 - RNA, 19 nt, Human
gucuguagagggcccuggu

SEQ ID NO: 3849954 - RNA, 22 nt, Human
gucuguagagggcccugguguu

SEQ ID NO: 3849955 - RNA, 16 nt, Human
gucuguagguugcaca

SEQ ID NO: 3849956 - RNA, 19 nt, Human
gucuguagguugcacacuu

SEQ ID NO: 3849957 - RNA, 15 nt, Human
gucuguaucagugga

SEQ ID NO: 3849958 - RNA, 20 nt, Human
gucuguaucggagacaguga

SEQ ID NO: 3849959 - RNA, 14 nt, Human
gucuguauuucaug

SEQ ID NO: 3849960 - RNA, 21 nt, Human
gucuguauuucauguggcugu

SEQ ID NO: 3849961 - RNA, 22 nt, Human
gucugucaugaacauguuccug

SEQ ID NO: 3849962 - RNA, 15 nt, Human
gucugucccaccagc

SEQ ID NO: 3849963 - RNA, 16 nt, Human
gucugucccggggucc

SEQ ID NO: 3849964 - RNA, 21 nt, Human
gucugucccgggguccugugg

SEQ ID NO: 3849965 - RNA, 24 nt, Human
gucugucccgggguccuguggcag

SEQ ID NO: 3849966 - RNA, 15 nt, Human
gucugucuucacagc

SEQ ID NO: 3849967 - RNA, 13 nt, Human
gucugucuuccuu

SEQ ID NO: 3849968 - RNA, 21 nt, Human
gucugucuuccuuugcuuccc

SEQ ID NO: 3849969 - RNA, 20 nt, Human
gucugucuuuccugaaccau

SEQ ID NO: 3849970 - RNA, 18 nt, Human
gucugugaagugagaccu

SEQ ID NO: 3849971 - RNA, 21 nt, Human
gucugugaauuggaccauccu

SEQ ID NO: 3849972 - RNA, 15 nt, Human
gucugugagaugcua

SEQ ID NO: 3849973 - RNA, 22 nt, Human
gucugugagaugcuagaacucc

SEQ ID NO: 3849974 - RNA, 23 nt, Human
gucugugccccuuccgccacugg

SEQ ID NO: 3849975 - RNA, 13 nt, Human
gucugugccugga

SEQ ID NO: 3849976 - RNA, 12 nt, Human
gucugugcugag

SEQ ID NO: 3849977 - RNA, 16 nt, Human
gucuguggauuuuuuc

SEQ ID NO: 3849978 - RNA, 16 nt, Human
gucugugugaaugugg

SEQ ID NO: 3849979 - RNA, 20 nt, Human
gucugugugaugaacuuucu

SEQ ID NO: 3849980 - RNA, 17 nt, Human
gucugugugcaagugug

SEQ ID NO: 3849981 - RNA, 20 nt, Human
gucugugugcgcucugugga

SEQ ID NO: 3849982 - RNA, 21 nt, Human
gucugugugugaccccuccug

SEQ ID NO: 3849983 - RNA, 22 nt, Human
gucugugugugaccccuccugg

SEQ ID NO: 3849984 - RNA, 23 nt, Human
gucugugugugaccccuccuggg

SEQ ID NO: 3849985 - RNA, 20 nt, Human
gucuguguguguguaugugg

SEQ ID NO: 3849986 - RNA, 20 nt, Human
gucuguguuccaaccacuga

SEQ ID NO: 3849987 - RNA, 16 nt, Human
gucuguuaacuuaaua

SEQ ID NO: 3849988 - RNA, 16 nt, Human
gucuguuaugcuguga

SEQ ID NO: 3849989 - RNA, 18 nt, Human
gucuguucuguuucaagg

SEQ ID NO: 3849990 - RNA, 13 nt, Human
gucuguucuugaa

SEQ ID NO: 3849991 - RNA, 16 nt, Human
gucuguuggcaggcug

SEQ ID NO: 3849992 - RNA, 16 nt, Human
gucuguuuaagaaaag

SEQ ID NO: 3849993 - RNA, 20 nt, Human
gucuguuuaagaaaaguauu

SEQ ID NO: 3849994 - RNA, 12 nt, Human
gucuguuuacug

SEQ ID NO: 3849995 - RNA, 13 nt, Human
gucuguuuggacu

SEQ ID NO: 3849996 - RNA, 13 nt, Human
gucuguuuuauga

SEQ ID NO: 3849997 - RNA, 14 nt, Human
gucuguuuugugua

SEQ ID NO: 3849998 - RNA, 15 nt, Human
gucuguuuuguguac

SEQ ID NO: 3849999 - RNA, 17 nt, Human
gucuuaaacuaaaugug

SEQ ID NO: 3850000 - RNA, 17 nt, Human
gucuuaagaaauguaua

SEQ ID NO: 3850001 - RNA, 21 nt, Human
gucuuaagaaauguauaaacu

SEQ ID NO: 3850002 - RNA, 23 nt, Human
gucuuaagccuuuugcucacaaa

SEQ ID NO: 3850003 - RNA, 21 nt, Human
gucuuaauuaaaagaauauuu

SEQ ID NO: 3850004 - RNA, 13 nt, Human
gucuuaauuaagu

SEQ ID NO: 3850005 - RNA, 21 nt, Human
gucuuaauuauuauuuguguu

SEQ ID NO: 3850006 - RNA, 22 nt, Human
gucuuaauuuuugaaaaaagua

SEQ ID NO: 3850007 - RNA, 20 nt, Human
gucuuacuacagaaaugagg

SEQ ID NO: 3850008 - RNA, 20 nt, Human
gucuuagaaguggaccagga

SEQ ID NO: 3850009 - RNA, 22 nt, Human
gucuuagaaguggaccaggaca

SEQ ID NO: 3850010 - RNA, 23 nt, Human
gucuuagacuugaaauacuacuu

SEQ ID NO: 3850011 - RNA, 24 nt, Human
gucuuagacuugaaauacuacuua

SEQ ID NO: 3850012 - RNA, 19 nt, Human
gucuuauauauuguagaua

SEQ ID NO: 3850013 - RNA, 20 nt, Human
gucuuaucugagcugagcca

SEQ ID NO: 3850014 - RNA, 15 nt, Human
gucuuaugcuuccag

SEQ ID NO: 3850015 - RNA, 16 nt, Human
gucuuauucccuuccu

SEQ ID NO: 3850016 - RNA, 14 nt, Human
gucuuauuuauuau

SEQ ID NO: 3850017 - RNA, 14 nt, Human
gucuuauuuccuca

SEQ ID NO: 3850018 - RNA, 14 nt, Human
gucuuauuuuuaga

SEQ ID NO: 3850019 - RNA, 17 nt, Human
gucuucaaauugucuuu

SEQ ID NO: 3850020 - RNA, 21 nt, Human
gucuucaacauccugccagcc

SEQ ID NO: 3850021 - RNA, 22 nt, Human
gucuucaacauccugccagccc

SEQ ID NO: 3850022 - RNA, 21 nt, Human
gucuucaauuuguauaaaaug

SEQ ID NO: 3850023 - RNA, 19 nt, Human
gucuucagcauucccuccc

SEQ ID NO: 3850024 - RNA, 15 nt, Human
gucuucagccuagcc

SEQ ID NO: 3850025 - RNA, 23 nt, Human
gucuucagccucuuucugucccu

SEQ ID NO: 3850026 - RNA, 16 nt, Human
gucuucaguaagccgu

SEQ ID NO: 3850027 - RNA, 16 nt, Human
gucuucaugaaaugcu

SEQ ID NO: 3850028 - RNA, 21 nt, Human
gucuucauuaagcccucuucc

SEQ ID NO: 3850029 - RNA, 16 nt, Human
gucuucauuucauugu

SEQ ID NO: 3850030 - RNA, 14 nt, Human
gucuuccacaaaga

SEQ ID NO: 3850031 - RNA, 15 nt, Human
gucuucccuaccuca

SEQ ID NO: 3850032 - RNA, 17 nt, Human
gucuucccuagggcugg

SEQ ID NO: 3850033 - RNA, 18 nt, Human
gucuucccuagggcuggg

SEQ ID NO: 3850034 - RNA, 21 nt, Human
gucuucccuagggcugggugu

SEQ ID NO: 3850035 - RNA, 17 nt, Human
gucuuccgccccugccu

SEQ ID NO: 3850036 - RNA, 23 nt, Human
gucuuccgccccugccugccaug

SEQ ID NO: 3850037 - RNA, 23 nt, Human
gucuuccucccaaguggugccua

SEQ ID NO: 3850038 - RNA, 14 nt, Human
gucuuccugugggg

SEQ ID NO: 3850039 - RNA, 15 nt, Human
gucuuccuucugccu

SEQ ID NO: 3850040 - RNA, 19 nt, Human
gucuuccuuugcuucccuu

SEQ ID NO: 3850041 - RNA, 20 nt, Human
gucuucguacaguucuucgg

SEQ ID NO: 3850042 - RNA, 23 nt, Human
gucuucuaaacuuccccaucuuc

SEQ ID NO: 3850043 - RNA, 20 nt, Human
gucuucucacaagccagcca

SEQ ID NO: 3850044 - RNA, 18 nt, Human
gucuucucaggcucugcc

SEQ ID NO: 3850045 - RNA, 20 nt, Human
gucuucucauagcauuaacu

SEQ ID NO: 3850046 - RNA, 23 nt, Human
gucuucucauagcauuaacuaau

SEQ ID NO: 3850047 - RNA, 20 nt, Human
gucuucuccaacaccaccuc

SEQ ID NO: 3850048 - RNA, 12 nt, Human
gucuucucccca

SEQ ID NO: 3850049 - RNA, 16 nt, Human
gucuucucugucucag

SEQ ID NO: 3850050 - RNA, 15 nt, Human
gucuucugccuguua

SEQ ID NO: 3850051 - RNA, 18 nt, Human
gucuucuggacaggcucu

SEQ ID NO: 3850052 - RNA, 18 nt, Human
gucuucuguauauaaaug

SEQ ID NO: 3850053 - RNA, 20 nt, Human
gucuucuguauauaaauggg

SEQ ID NO: 3850054 - RNA, 12 nt, Human
gucuucuuggcc

SEQ ID NO: 3850055 - RNA, 12 nt, Human
gucuugaaagau

SEQ ID NO: 3850056 - RNA, 20 nt, Human
gucuugaacuccuggccuca

SEQ ID NO: 3850057 - RNA, 21 nt, Human
gucuugaacuccuggccucaa

SEQ ID NO: 3850058 - RNA, 15 nt, Human
gucuugaaguccugg

SEQ ID NO: 3850059 - RNA, 18 nt, Human
gucuugauucagucacau

SEQ ID NO: 3850060 - RNA, 21 nt, Human
gucuugcaauggcagccuugg

SEQ ID NO: 3850061 - RNA, 21 nt, Human
gucuugcagugauuaaggucu

SEQ ID NO: 3850062 - RNA, 15 nt, Human
gucuugccuuuuuca

SEQ ID NO: 3850063 - RNA, 17 nt, Human
gucuugccuuuuucauu

SEQ ID NO: 3850064 - RNA, 12 nt, Human
gucuugcugugg

SEQ ID NO: 3850065 - RNA, 16 nt, Human
gucuuggaacuugccu

SEQ ID NO: 3850066 - RNA, 22 nt, Human
gucuuggaacuugccugccuuu

SEQ ID NO: 3850067 - RNA, 22 nt, Human
gucuuggaauuccauuugagga

SEQ ID NO: 3850068 - RNA, 15 nt, Human
gucuuggacacugua

SEQ ID NO: 3850069 - RNA, 18 nt, Human
gucuuggacacuguacaa

SEQ ID NO: 3850070 - RNA, 17 nt, Human
gucuuggagcugagccu

SEQ ID NO: 3850071 - RNA, 15 nt, Human
gucuuggcggcagca

SEQ ID NO: 3850072 - RNA, 18 nt, Human
gucuuggcggcagcagcc

SEQ ID NO: 3850073 - RNA, 16 nt, Human
gucuugggcagagcug

SEQ ID NO: 3850074 - RNA, 15 nt, Human
gucuugguacuugcu

SEQ ID NO: 3850075 - RNA, 15 nt, Human
gucuugguguaauuu

SEQ ID NO: 3850076 - RNA, 18 nt, Human
gucuugguuucucucuac

SEQ ID NO: 3850077 - RNA, 20 nt, Human
gucuuguaauauuuuguauu

SEQ ID NO: 3850078 - RNA, 15 nt, Human
gucuugucucagauu

SEQ ID NO: 3850079 - RNA, 21 nt, Human
gucuuguuaauauucuuucaa

SEQ ID NO: 3850080 - RNA, 22 nt, Human
gucuuguuaauauucuuucaau

SEQ ID NO: 3850081 - RNA, 16 nt, Human
gucuuguuagaaaaca

SEQ ID NO: 3850082 - RNA, 14 nt, Human
gugauguuugcucu

SEQ ID NO: 3850083 - RNA, 14 nt, Human
gugauuaaacgugc

SEQ ID NO: 3850084 - RNA, 17 nt, Human
gugauuaaagcuaagga

SEQ ID NO: 3850085 - RNA, 16 nt, Human
gugauuaccagggacu

SEQ ID NO: 3850086 - RNA, 23 nt, Human
gugauuccacuacaccuggcuga

SEQ ID NO: 3850087 - RNA, 18 nt, Human
gugauucgagcuauauuu

SEQ ID NO: 3850088 - RNA, 16 nt, Human
gugauucuaaugucuu

SEQ ID NO: 3850089 - RNA, 20 nt, Human
gugauucuccugccucagcc

SEQ ID NO: 3850090 - RNA, 13 nt, Human
gugauucugccuu

SEQ ID NO: 3850091 - RNA, 13 nt, Human
gugauugcagcuu

SEQ ID NO: 3850092 - RNA, 22 nt, Human
gugauugcagcuuuauguucau

SEQ ID NO: 3850093 - RNA, 17 nt, Human
gugauugggaauaaaua

SEQ ID NO: 3850094 - RNA, 20 nt, Human
gugauugggaauaaauaugc

SEQ ID NO: 3850095 - RNA, 18 nt, Human
gugauuuaauaguguuaa

SEQ ID NO: 3850096 - RNA, 16 nt, Human
gugauuuaauccaguu

SEQ ID NO: 3850097 - RNA, 21 nt, Human
gugauuuagaacuguauguca

SEQ ID NO: 3850098 - RNA, 15 nt, Human
gugauuugaaggucu

SEQ ID NO: 3850099 - RNA, 19 nt, Human
gugauuugacuguuuuuac

SEQ ID NO: 3850100 - RNA, 16 nt, Human
gugauuuuaaaugugu

SEQ ID NO: 3850101 - RNA, 16 nt, Human
gugauuuuaacucugu

SEQ ID NO: 3850102 - RNA, 19 nt, Human
gugauuuuaacucugucuu

SEQ ID NO: 3850103 - RNA, 18 nt, Human
gugauuuuuguaauuuuu

SEQ ID NO: 3850104 - RNA, 21 nt, Human
gugcaaaaagcugaguauggu

SEQ ID NO: 3850105 - RNA, 20 nt, Human
gugcaaaacagcguuuaaga

SEQ ID NO: 3850106 - RNA, 19 nt, Human
gugcaaaacaugcuaccug

SEQ ID NO: 3850107 - RNA, 21 nt, Human
gugcaaaaggcuugcagaacu

SEQ ID NO: 3850108 - RNA, 18 nt, Human
gugcaaacccacucagag

SEQ ID NO: 3850109 - RNA, 22 nt, Human
gugcaaaguucccuacuuccug

SEQ ID NO: 3850110 - RNA, 17 nt, Human
gugcaaauggaagacaa

SEQ ID NO: 3850111 - RNA, 18 nt, Human
gugcaaauugucacagga

SEQ ID NO: 3850112 - RNA, 22 nt, Human
gugcaacaagguccucugucag

SEQ ID NO: 3850113 - RNA, 20 nt, Human
gugcaacagcacuggcucuc

SEQ ID NO: 3850114 - RNA, 22 nt, Human
gugcaacccaaggacugaggga

SEQ ID NO: 3850115 - RNA, 19 nt, Human
gugcaaccucgcugagggc

SEQ ID NO: 3850116 - RNA, 13 nt, Human
gugcaaccucugc

SEQ ID NO: 3850117 - RNA, 17 nt, Human
gugcaaccucugcuucc

SEQ ID NO: 3850118 - RNA, 21 nt, Human
gugcaaccucugcuucccagg

SEQ ID NO: 3850119 - RNA, 19 nt, Human
gugcaagcgacgacagaug

SEQ ID NO: 3850120 - RNA, 19 nt, Human
gugcaaggaccuaaaacau

SEQ ID NO: 3850121 - RNA, 12 nt, Human
gugcaaggcagc

SEQ ID NO: 3850122 - RNA, 14 nt, Human
gugcaaggcagccg

SEQ ID NO: 3850123 - RNA, 15 nt, Human
gugcaagugugugca

SEQ ID NO: 3850124 - RNA, 20 nt, Human
gugcaagugugugcaugugu

SEQ ID NO: 3850125 - RNA, 22 nt, Human
gugcaauaaaucugacccagug

SEQ ID NO: 3850126 - RNA, 12 nt, Human
gugcaauagaag

SEQ ID NO: 3850127 - RNA, 13 nt, Human
gugcaauauauuu

SEQ ID NO: 3850128 - RNA, 15 nt, Human
gugcaauauauuuug

SEQ ID NO: 3850129 - RNA, 20 nt, Human
gugcaauauauuuuguaugc

SEQ ID NO: 3850130 - RNA, 17 nt, Human
gugcaauguaaauauuu

SEQ ID NO: 3850131 - RNA, 20 nt, Human
gugcaauguaaauauuuuaa

SEQ ID NO: 3850132 - RNA, 21 nt, Human
gugcaaugucugagugaaccu

SEQ ID NO: 3850133 - RNA, 17 nt, Human
gugcaauguguauaaac

SEQ ID NO: 3850134 - RNA, 21 nt, Human
gugcaauuuguuugugcuucu

SEQ ID NO: 3850135 - RNA, 14 nt, Human
gugcacaaaguggc

SEQ ID NO: 3850136 - RNA, 21 nt, Human
aagaggcugguuuuggcaucu

SEQ ID NO: 3850137 - RNA, 17 nt, Human
aagagggacgccugggg

SEQ ID NO: 3850138 - RNA, 17 nt, Human
aagagggagaagcauga

SEQ ID NO: 3850139 - RNA, 22 nt, Human
aagagggagggagggcuccaga

SEQ ID NO: 3850140 - RNA, 16 nt, Human
aagagggcacacacug

SEQ ID NO: 3850141 - RNA, 19 nt, Human
aagagggccugugggagcc

SEQ ID NO: 3850142 - RNA, 16 nt, Human
aagaggggguggaggg

SEQ ID NO: 3850143 - RNA, 22 nt, Human
aagagggucugaggaauccaga

SEQ ID NO: 3850144 - RNA, 23 nt, Human
aagaggguuuuagguagaaaaac

SEQ ID NO: 3850145 - RNA, 16 nt, Human
aagagguacaggguuu

SEQ ID NO: 3850146 - RNA, 17 nt, Human
aagagguacaggguuuu

SEQ ID NO: 3850147 - RNA, 13 nt, Human
aagagguguuauu

SEQ ID NO: 3850148 - RNA, 21 nt, Human
aagagguuuggcuccugccca

SEQ ID NO: 3850149 - RNA, 18 nt, Human
aagagguuuuaaaaaaau

SEQ ID NO: 3850150 - RNA, 14 nt, Human
aagagguuuuaaag

SEQ ID NO: 3850151 - RNA, 18 nt, Human
aagaguaaaggaaaugau

SEQ ID NO: 3850152 - RNA, 21 nt, Human
aagaguagcaaguucuagaga

SEQ ID NO: 3850153 - RNA, 23 nt, Human
aagaguagcaaguucuagagaag

SEQ ID NO: 3850154 - RNA, 17 nt, Human
aagaguagcauuucauu

SEQ ID NO: 3850155 - RNA, 18 nt, Human
aagaguagcauuucauuc

SEQ ID NO: 3850156 - RNA, 19 nt, Human
aagaguagcauuucauucu

SEQ ID NO: 3850157 - RNA, 12 nt, Human
aagaguaggaag

SEQ ID NO: 3850158 - RNA, 16 nt, Human
aagaguaggaagacuu

SEQ ID NO: 3850159 - RNA, 18 nt, Human
aagaguaggaagacuuug

SEQ ID NO: 3850160 - RNA, 19 nt, Human
aagaguauuuuugacagaa

SEQ ID NO: 3850161 - RNA, 13 nt, Human
aagagucuaaaga

SEQ ID NO: 3850162 - RNA, 24 nt, Human
aagagucuaaagauggaguuucua

SEQ ID NO: 3850163 - RNA, 23 nt, Human
aagagucuagauucaaagguucu

SEQ ID NO: 3850164 - RNA, 15 nt, Human
aagagucuauugucu

SEQ ID NO: 3850165 - RNA, 22 nt, Human
aagagugacaguggauugcauu

SEQ ID NO: 3850166 - RNA, 13 nt, Human
aagagugauugca

SEQ ID NO: 3850167 - RNA, 21 nt, Human
aagaguggccccaccuggccc

SEQ ID NO: 3850168 - RNA, 22 nt, Human
aagaguggccccaccuggcccu

SEQ ID NO: 3850169 - RNA, 19 nt, Human
aagagugggggagagcagg

SEQ ID NO: 3850170 - RNA, 13 nt, Human
aagaguguacugg

SEQ ID NO: 3850171 - RNA, 14 nt, Human
aagaguucaagaaa

SEQ ID NO: 3850172 - RNA, 16 nt, Human
aagaguucaagaaaua

SEQ ID NO: 3850173 - RNA, 22 nt, Human
aagaguugccccgucucuguuc

SEQ ID NO: 3850174 - RNA, 17 nt, Human
aagaguugugcacgcag

SEQ ID NO: 3850175 - RNA, 19 nt, Human
aagaguuugccuuauaaau

SEQ ID NO: 3850176 - RNA, 13 nt, Human
aagaguuuuggga

SEQ ID NO: 3850177 - RNA, 21 nt, Human
aagauaaacguggauguuacu

SEQ ID NO: 3850178 - RNA, 12 nt, Human
aagauaaagaug

SEQ ID NO: 3850179 - RNA, 17 nt, Human
aagauaaagaugaucua

SEQ ID NO: 3850180 - RNA, 19 nt, Human
aagauaacaagaucuuuca

SEQ ID NO: 3850181 - RNA, 19 nt, Human
aagauaaggucugaauaau

SEQ ID NO: 3850182 - RNA, 21 nt, Human
aagauaaguguauuuuucaau

SEQ ID NO: 3850183 - RNA, 16 nt, Human
aagauaaguuggaaac

SEQ ID NO: 3850184 - RNA, 20 nt, Human
aagauaaguuggaaacacua

SEQ ID NO: 3850185 - RNA, 22 nt, Human
aagauaaguuggaaacacuaaa

SEQ ID NO: 3850186 - RNA, 16 nt, Human
aagauaauaauauaug

SEQ ID NO: 3850187 - RNA, 19 nt, Human
aagauaauauuaaggaaga

SEQ ID NO: 3850188 - RNA, 21 nt, Human
aagauaauauuaaggaagaca

SEQ ID NO: 3850189 - RNA, 15 nt, Human
aagauaaucucagug

SEQ ID NO: 3850190 - RNA, 12 nt, Human
aagauaauuaua

SEQ ID NO: 3850191 - RNA, 15 nt, Human
aagauaauucacugu

SEQ ID NO: 3850192 - RNA, 21 nt, Human
aagauaauugcuauuuauuuu

SEQ ID NO: 3850193 - RNA, 19 nt, Human
aagauaauuguugaaauuu

SEQ ID NO: 3850194 - RNA, 20 nt, Human
aagauacaaauuaauuuuac

SEQ ID NO: 3850195 - RNA, 21 nt, Human
aagauacacucaagcaugaag

SEQ ID NO: 3850196 - RNA, 22 nt, Human
aagauacagaacucuuucaaaa

SEQ ID NO: 3850197 - RNA, 13 nt, Human
aagauacaucaca

SEQ ID NO: 3850198 - RNA, 15 nt, Human
aagauaccaucagca

SEQ ID NO: 3850199 - RNA, 14 nt, Human
aagauaccuuaaaa

SEQ ID NO: 3850200 - RNA, 17 nt, Human
aagauaccuuaaaauuu

SEQ ID NO: 3850201 - RNA, 21 nt, Human
aagauaccuuaaaauuugaaa

SEQ ID NO: 3850202 - RNA, 15 nt, Human
aagauacgacuuuau

SEQ ID NO: 3850203 - RNA, 13 nt, Human
aagauacugaaau

SEQ ID NO: 3850204 - RNA, 16 nt, Human
aagauacugaaauaaa

SEQ ID NO: 3850205 - RNA, 22 nt, Human
aagauacuuggaccgaguagag

SEQ ID NO: 3850206 - RNA, 12 nt, Human
aagauacuuugu

SEQ ID NO: 3850207 - RNA, 16 nt, Human
aagauacuuuguauug

SEQ ID NO: 3850208 - RNA, 13 nt, Human
aagauagaagaaa

SEQ ID NO: 3850209 - RNA, 16 nt, Human
aagauagacagguccu

SEQ ID NO: 3850210 - RNA, 17 nt, Human
aagauagaguaaaaaga

SEQ ID NO: 3850211 - RNA, 16 nt, Human
aagauagauccuuuua

SEQ ID NO: 3850212 - RNA, 14 nt, Human
aagauagcagggca

SEQ ID NO: 3850213 - RNA, 15 nt, Human
aagauagcugugacu

SEQ ID NO: 3850214 - RNA, 17 nt, Human
aagauagcuucacccca

SEQ ID NO: 3850215 - RNA, 14 nt, Human
aagauaggcucugc

SEQ ID NO: 3850216 - RNA, 15 nt, Human
aagauaggcucugca

SEQ ID NO: 3850217 - RNA, 18 nt, Human
aagauaggcucugcacag

SEQ ID NO: 3850218 - RNA, 21 nt, Human
aagauaguguaacuugcuuaa

SEQ ID NO: 3850219 - RNA, 21 nt, Human
aagauauacuuguuuuuguaa

SEQ ID NO: 3850220 - RNA, 19 nt, Human
aagauauauuaaaaauaua

SEQ ID NO: 3850221 - RNA, 12 nt, Human
aagauauggaca

SEQ ID NO: 3850222 - RNA, 19 nt, Human
aagauaugugaagaaaaau

SEQ ID NO: 3850223 - RNA, 15 nt, Human
aagauauuguacaua

SEQ ID NO: 3850224 - RNA, 16 nt, Human
aagauauuguacauaa

SEQ ID NO: 3850225 - RNA, 15 nt, Human
aagauauuguucaaa

SEQ ID NO: 3850226 - RNA, 21 nt, Human
gugcauuggaagaccccaccc

SEQ ID NO: 3850227 - RNA, 17 nt, Human
gugcauugggauuuuag

SEQ ID NO: 3850228 - RNA, 19 nt, Human
gugcauugggauuuuagaa

SEQ ID NO: 3850229 - RNA, 23 nt, Human
gugcauuugugcuagaaauuuuc

SEQ ID NO: 3850230 - RNA, 23 nt, Human
gugccaaaaacaacaacaaaaug

SEQ ID NO: 3850231 - RNA, 21 nt, Human
gugccaaagaaaguggucuua

SEQ ID NO: 3850232 - RNA, 13 nt, Human
gugccaacacuca

SEQ ID NO: 3850233 - RNA, 21 nt, Human
gugccaacaguguuaggccug

SEQ ID NO: 3850234 - RNA, 18 nt, Human
gugccaaguccagguccu

SEQ ID NO: 3850235 - RNA, 21 nt, Human
gugccaaguccagguccuggu

SEQ ID NO: 3850236 - RNA, 17 nt, Human
gugccaauauguauugu

SEQ ID NO: 3850237 - RNA, 14 nt, Human
gugccaauuucaag

SEQ ID NO: 3850238 - RNA, 16 nt, Human
gugccaccaugccuca

SEQ ID NO: 3850239 - RNA, 18 nt, Human
gugccacccaccagggcg

SEQ ID NO: 3850240 - RNA, 18 nt, Human
gugccaccccgagggcug

SEQ ID NO: 3850241 - RNA, 21 nt, Human
gugccacccugggcucugugg

SEQ ID NO: 3850242 - RNA, 19 nt, Human
gugccacugcacuccaggc

SEQ ID NO: 3850243 - RNA, 23 nt, Human
gugccacugcccgagcuggugca

SEQ ID NO: 3850244 - RNA, 14 nt, Human
gugccagaagcuac

SEQ ID NO: 3850245 - RNA, 14 nt, Human
gugccagagccugg

SEQ ID NO: 3850246 - RNA, 15 nt, Human
gugccagagccuggg

SEQ ID NO: 3850247 - RNA, 18 nt, Human
gugccagagccuggggcu

SEQ ID NO: 3850248 - RNA, 22 nt, Human
gugccagaggaauccuggcagc

SEQ ID NO: 3850249 - RNA, 18 nt, Human
gugccagaggugggcagg

SEQ ID NO: 3850250 - RNA, 20 nt, Human
gugccagaggugggcaggug

SEQ ID NO: 3850251 - RNA, 17 nt, Human
gugccagcaaagcccca

SEQ ID NO: 3850252 - RNA, 12 nt, Human
gugccagcaacu

SEQ ID NO: 3850253 - RNA, 21 nt, Human
gugccagcaacugaauaaaua

SEQ ID NO: 3850254 - RNA, 13 nt, Human
gugccagccuucc

SEQ ID NO: 3850255 - RNA, 19 nt, Human
gugccagccuuccucugca

SEQ ID NO: 3850256 - RNA, 16 nt, Human
gugccaggaccaguca

SEQ ID NO: 3850257 - RNA, 21 nt, Human
gugccaggacuccccaggcca

SEQ ID NO: 3850258 - RNA, 23 nt, Human
gugccaggacuccccaggccagg

SEQ ID NO: 3850259 - RNA, 17 nt, Human
gugccaggcccggggcu

SEQ ID NO: 3850260 - RNA, 20 nt, Human
gugccaggcccggggcuggc

SEQ ID NO: 3850261 - RNA, 16 nt, Human
gugccaggugagguca

SEQ ID NO: 3850262 - RNA, 15 nt, Human
gugccagucgcgcug

SEQ ID NO: 3850263 - RNA, 17 nt, Human
gugccagucgcgcugcc

SEQ ID NO: 3850264 - RNA, 18 nt, Human
gugccagucuugugucug

SEQ ID NO: 3850265 - RNA, 17 nt, Human
gugccauagucacaugg

SEQ ID NO: 3850266 - RNA, 14 nt, Human
gugccaucagugcc

SEQ ID NO: 3850267 - RNA, 22 nt, Human
gugccauguaaauccccacugg

SEQ ID NO: 3850268 - RNA, 13 nt, Human
gugccauugucuu

SEQ ID NO: 3850269 - RNA, 14 nt, Human
gugccauugucuuu

SEQ ID NO: 3850270 - RNA, 16 nt, Human
gugcccaagcucagaa

SEQ ID NO: 3850271 - RNA, 20 nt, Human
gugcccaagcucagaaggcu

SEQ ID NO: 3850272 - RNA, 14 nt, Human
gugcccacagcccg

SEQ ID NO: 3850273 - RNA, 22 nt, Human
gugcccacagcccgcaugcagc

SEQ ID NO: 3850274 - RNA, 20 nt, Human
gugcccacaucccaggcuuc

SEQ ID NO: 3850275 - RNA, 23 nt, Human
gugcccacauguguccaucccag

SEQ ID NO: 3850276 - RNA, 23 nt, Human
gugcccacccugggagacagacc

SEQ ID NO: 3850277 - RNA, 16 nt, Human
gugcccagaauaaguu

SEQ ID NO: 3850278 - RNA, 20 nt, Human
gugcccagagaugggacugg

SEQ ID NO: 3850279 - RNA, 23 nt, Human
gugcccagcuagcugcagagcca

SEQ ID NO: 3850280 - RNA, 19 nt, Human
gugcccaggggcccacagg

SEQ ID NO: 3850281 - RNA, 20 nt, Human
gugcccaugggcacugcugg

SEQ ID NO: 3850282 - RNA, 15 nt, Human
gugccccaggaccag

SEQ ID NO: 3850283 - RNA, 21 nt, Human
gugccccaggaccagcucagg

SEQ ID NO: 3850284 - RNA, 18 nt, Human
gugccccaugccugucca

SEQ ID NO: 3850285 - RNA, 13 nt, Human
gugcccccacuga

SEQ ID NO: 3850286 - RNA, 15 nt, Human
gugcccccacugacc

SEQ ID NO: 3850287 - RNA, 12 nt, Human
gugcccccagac

SEQ ID NO: 3850288 - RNA, 20 nt, Human
gugccccccauccuggccca

SEQ ID NO: 3850289 - RNA, 20 nt, Human
gugcccccuccucucccauc

SEQ ID NO: 3850290 - RNA, 13 nt, Human
gugccccugcugc

SEQ ID NO: 3850291 - RNA, 22 nt, Human
gugccccuuccgccacuggggc

SEQ ID NO: 3850292 - RNA, 15 nt, Human
gugcccgccaccaca

SEQ ID NO: 3850293 - RNA, 21 nt, Human
gugcccuccugagggaggacc

SEQ ID NO: 3850294 - RNA, 14 nt, Human
gugcccucgcugcu

SEQ ID NO: 3850295 - RNA, 15 nt, Human
gugcccucgcugcuu

SEQ ID NO: 3850296 - RNA, 21 nt, Human
gugcccucucccacccucuuc

SEQ ID NO: 3850297 - RNA, 14 nt, Human
gugcccucugggcu

SEQ ID NO: 3850298 - RNA, 16 nt, Human
gugcccucugggcucu

SEQ ID NO: 3850299 - RNA, 19 nt, Human
gugcccucugggcucugag

SEQ ID NO: 3850300 - RNA, 21 nt, Human
ugcccugcccaccuggccucu

SEQ ID NO: 3850301 - RNA, 22 nt, Human
ugcccugcccaccuggccucug

SEQ ID NO: 3850302 - RNA, 23 nt, Human
ugcccugcccaccuggccucugc

SEQ ID NO: 3850303 - RNA, 14 nt, Human
ugcccugcccugcc

SEQ ID NO: 3850304 - RNA, 17 nt, Human
ugcccugccugagggcc

SEQ ID NO: 3850305 - RNA, 12 nt, Human
ugcccugcuccc

SEQ ID NO: 3850306 - RNA, 22 nt, Human
ugcccugcugagucccaggcug

SEQ ID NO: 3850307 - RNA, 23 nt, Human
ugcccugcugagucccaggcuga

SEQ ID NO: 3850308 - RNA, 11 nt, Human
ugcccugcugc

SEQ ID NO: 3850309 - RNA, 23 nt, Human
ugcccugcugccgccucccagcc

SEQ ID NO: 3850310 - RNA, 16 nt, Human
ugcccuggagguggcu

SEQ ID NO: 3850311 - RNA, 13 nt, Human
ugcccuggcccug

SEQ ID NO: 3850312 - RNA, 18 nt, Human
ugcccuggcccugaggug

SEQ ID NO: 3850313 - RNA, 11 nt, Human
ugcccuggcug

SEQ ID NO: 3850314 - RNA, 13 nt, Human
ugcccugggaaac

SEQ ID NO: 3850315 - RNA, 13 nt, Human
ugcccugggaggc

SEQ ID NO: 3850316 - RNA, 18 nt, Human
ugcccugguccagggaag

SEQ ID NO: 3850317 - RNA, 21 nt, Human
ugcccugguccagggaagcug

SEQ ID NO: 3850318 - RNA, 14 nt, Human
ugcccuggugcugc

SEQ ID NO: 3850319 - RNA, 18 nt, Human
ugcccuggugcugccaca

SEQ ID NO: 3850320 - RNA, 14 nt, Human
ugcccugguggaga

SEQ ID NO: 3850321 - RNA, 22 nt, Human
ugcccugguggagaaagcacug

SEQ ID NO: 3850322 - RNA, 15 nt, Human
ugcccugguuucacu

SEQ ID NO: 3850323 - RNA, 22 nt, Human
ugcccugguuucacuggcccaa

SEQ ID NO: 3850324 - RNA, 19 nt, Human
ugcccugguuuccugcccu

SEQ ID NO: 3850325 - RNA, 23 nt, Human
ugcccugguuuccugcccuggga

SEQ ID NO: 3850326 - RNA, 14 nt, Human
ugcccugugggacc

SEQ ID NO: 3850327 - RNA, 18 nt, Human
ugcccugugggaccccag

SEQ ID NO: 3850328 - RNA, 15 nt, Human
ugcccuguguacuuc

SEQ ID NO: 3850329 - RNA, 15 nt, Human
ugcccuuaaaucaua

SEQ ID NO: 3850330 - RNA, 17 nt, Human
ugcccuucacaguguuu

SEQ ID NO: 3850331 - RNA, 14 nt, Human
ugcccuucacccca

SEQ ID NO: 3850332 - RNA, 14 nt, Human
ugcccuucuccuua

SEQ ID NO: 3850333 - RNA, 16 nt, Human
ugcccuucuuucuacc

SEQ ID NO: 3850334 - RNA, 14 nt, Human
ugcccuugcccuga

SEQ ID NO: 3850335 - RNA, 17 nt, Human
ugcccuugcccugaccu

SEQ ID NO: 3850336 - RNA, 17 nt, Human
ugcccuugucccacuca

SEQ ID NO: 3850337 - RNA, 15 nt, Human
ugcccuugucugaga

SEQ ID NO: 3850338 - RNA, 15 nt, Human
ugcccuuuguccucc

SEQ ID NO: 3850339 - RNA, 20 nt, Human
ugcccuuuguccuccugcug

SEQ ID NO: 3850340 - RNA, 19 nt, Human
ugcccuuuuuucugccucc

SEQ ID NO: 3850341 - RNA, 21 nt, Human
ugcccuuuuuucugccuccuu

SEQ ID NO: 3850342 - RNA, 19 nt, Human
ugccgaaugugcagguuug

SEQ ID NO: 3850343 - RNA, 22 nt, Human
ugccgaaugugcagguuuguua

SEQ ID NO: 3850344 - RNA, 14 nt, Human
ugccgacacgcucc

SEQ ID NO: 3850345 - RNA, 13 nt, Human
ugccgacacuguu

SEQ ID NO: 3850346 - RNA, 19 nt, Human
ugccgaccccuaguucccu

SEQ ID NO: 3850347 - RNA, 23 nt, Human
ugccgaccgaggcuggagcuggc

SEQ ID NO: 3850348 - RNA, 14 nt, Human
ugccgaccucgucc

SEQ ID NO: 3850349 - RNA, 22 nt, Human
ugccgaccucguccucccccug

SEQ ID NO: 3850350 - RNA, 13 nt, Human
ugccgcaccccag

SEQ ID NO: 3850351 - RNA, 15 nt, Human
ugccgcaccccagag

SEQ ID NO: 3850352 - RNA, 15 nt, Human
ugccgcagagcuggc

SEQ ID NO: 3850353 - RNA, 17 nt, Human
ugccgcagagcuggccg

SEQ ID NO: 3850354 - RNA, 16 nt, Human
ugccgccccacccaga

SEQ ID NO: 3850355 - RNA, 17 nt, Human
ugccgcccccuccugaa

SEQ ID NO: 3850356 - RNA, 18 nt, Human
ugccgcccccuccugaac

SEQ ID NO: 3850357 - RNA, 17 nt, Human
ugccgccgccucgccca

SEQ ID NO: 3850358 - RNA, 20 nt, Human
ugccgccgccucgcccaccg

SEQ ID NO: 3850359 - RNA, 18 nt, Human
ugccgccgcuagguagag

SEQ ID NO: 3850360 - RNA, 22 nt, Human
ugccgccgcuagguagagucug

SEQ ID NO: 3850361 - RNA, 14 nt, Human
ugccgccucccagc

SEQ ID NO: 3850362 - RNA, 16 nt, Human
ugccgccucccagccu

SEQ ID NO: 3850363 - RNA, 20 nt, Human
ugccgccugcacuccucagg

SEQ ID NO: 3850364 - RNA, 12 nt, Human
ugccgccugccc

SEQ ID NO: 3850365 - RNA, 16 nt, Human
ugccgcgucgcccucc

SEQ ID NO: 3850366 - RNA, 18 nt, Human
ugccgcuaccucccuccc

SEQ ID NO: 3850367 - RNA, 23 nt, Human
ugccggacccggaggccgaggcc

SEQ ID NO: 3850368 - RNA, 21 nt, Human
ugccggagaggaagagacacu

SEQ ID NO: 3850369 - RNA, 18 nt, Human
ugccggauacaaacuggu

SEQ ID NO: 3850370 - RNA, 16 nt, Human
ugggcagagcugcauc

SEQ ID NO: 3850371 - RNA, 15 nt, Human
ugggcagaggaaagc

SEQ ID NO: 3850372 - RNA, 23 nt, Human
ugggcagaggaccaggcuguagg

SEQ ID NO: 3850373 - RNA, 21 nt, Human
ugggcagccagaccagcaggc

SEQ ID NO: 3850374 - RNA, 14 nt, Human
ugggcagccaggcu

SEQ ID NO: 3850375 - RNA, 16 nt, Human
ugggcagccaggcugc

SEQ ID NO: 3850376 - RNA, 11 nt, Human
ugggcagcccg

SEQ ID NO: 3850377 - RNA, 13 nt, Human
ugggcagcgcccu

SEQ ID NO: 3850378 - RNA, 17 nt, Human
ugggcagcgcccuuccu

SEQ ID NO: 3850379 - RNA, 15 nt, Human
ugggcagcugccucc

SEQ ID NO: 3850380 - RNA, 19 nt, Human
ugggcagcuuagggcccug

SEQ ID NO: 3850381 - RNA, 21 nt, Human
ugggcagcuuagggcccugga

SEQ ID NO: 3850382 - RNA, 22 nt, Human
ugggcagcuuagggcccuggag

SEQ ID NO: 3850383 - RNA, 13 nt, Human
ugggcaggaaaag

SEQ ID NO: 3850384 - RNA, 13 nt, Human
ugggcaggaccuc

SEQ ID NO: 3850385 - RNA, 16 nt, Human
ugggcaggaccucaga

SEQ ID NO: 3850386 - RNA, 13 nt, Human
ugggcaggaggga

SEQ ID NO: 3850387 - RNA, 16 nt, Human
ugggcaggagggaggu

SEQ ID NO: 3850388 - RNA, 13 nt, Human
ugggcagggagcg

SEQ ID NO: 3850389 - RNA, 17 nt, Human
ugggcagggaggcacca

SEQ ID NO: 3850390 - RNA, 21 nt, Human
ugggcagggaggcaccauuca

SEQ ID NO: 3850391 - RNA, 15 nt, Human
ugggcaggugggagc

SEQ ID NO: 3850392 - RNA, 16 nt, Human
ugggcaguuuuuugaa

SEQ ID NO: 3850393 - RNA, 15 nt, Human
ugggcauaaacuguu

SEQ ID NO: 3850394 - RNA, 22 nt, Human
ugggcauagaugcaggugagcc

SEQ ID NO: 3850395 - RNA, 20 nt, Human
ugggcauggggugggccucu

SEQ ID NO: 3850396 - RNA, 20 nt, Human
ugggcaugguaccagcccug

SEQ ID NO: 3850397 - RNA, 21 nt, Human
ugggcaugguaccagcccugg

SEQ ID NO: 3850398 - RNA, 12 nt, Human
ugggcauggugc

SEQ ID NO: 3850399 - RNA, 20 nt, Human
ugggcaugguguucuccugc

SEQ ID NO: 3850400 - RNA, 16 nt, Human
ugggcaugugggcuuc

SEQ ID NO: 3850401 - RNA, 13 nt, Human
ugggcauucaaau

SEQ ID NO: 3850402 - RNA, 18 nt, Human
ugggcauugauggggaag

SEQ ID NO: 3850403 - RNA, 23 nt, Human
ugggcauugauggggaaggaggc

SEQ ID NO: 3850404 - RNA, 17 nt, Human
ugggccaccccuccuag

SEQ ID NO: 3850405 - RNA, 16 nt, Human
ugggccaccgccuugc

SEQ ID NO: 3850406 - RNA, 22 nt, Human
ugggccacuucuggguggggca

SEQ ID NO: 3850407 - RNA, 21 nt, Human
ugggccagaaguaccagacua

SEQ ID NO: 3850408 - RNA, 18 nt, Human
ugggccagacaugccaca

SEQ ID NO: 3850409 - RNA, 16 nt, Human
ugggccagccccuccc

SEQ ID NO: 3850410 - RNA, 14 nt, Human
ugggccaggacagg

SEQ ID NO: 3850411 - RNA, 17 nt, Human
ugggccaggacaggccc

SEQ ID NO: 3850412 - RNA, 13 nt, Human
ugggccagggcug

SEQ ID NO: 3850413 - RNA, 20 nt, Human
ugggccagucuguggaucag

SEQ ID NO: 3850414 - RNA, 17 nt, Human
ugggccauacuggccuc

SEQ ID NO: 3850415 - RNA, 14 nt, Human
ugggccauguccaa

SEQ ID NO: 3850416 - RNA, 19 nt, Human
ugggccauguccaaagagg

SEQ ID NO: 3850417 - RNA, 23 nt, Human
ugggccauguccaaagaggcugc

SEQ ID NO: 3850418 - RNA, 19 nt, Human
ugggccauucuccacagca

SEQ ID NO: 3850419 - RNA, 14 nt, Human
ugggcccaacccug

SEQ ID NO: 3850420 - RNA, 16 nt, Human
ugggcccaacccuguc

SEQ ID NO: 3850421 - RNA, 22 nt, Human
ugggcccaagacagaugcccca

SEQ ID NO: 3850422 - RNA, 16 nt, Human
ugggcccacaccuccu

SEQ ID NO: 3850423 - RNA, 14 nt, Human
ugggcccacauccg

SEQ ID NO: 3850424 - RNA, 14 nt, Human
ugggcccagcuggg

SEQ ID NO: 3850425 - RNA, 15 nt, Human
ugggcccagcugggc

SEQ ID NO: 3850426 - RNA, 17 nt, Human
ugggcccaggaccagcu

SEQ ID NO: 3850427 - RNA, 19 nt, Human
ugggcccagggacaccagc

SEQ ID NO: 3850428 - RNA, 17 nt, Human
ugggcccaucucccugc

SEQ ID NO: 3850429 - RNA, 18 nt, Human
ugggcccaucucccugcu

SEQ ID NO: 3850430 - RNA, 17 nt, Human
ugggccccaccaccuag

SEQ ID NO: 3850431 - RNA, 18 nt, Human
ugggccccaccaccuagg

SEQ ID NO: 3850432 - RNA, 23 nt, Human
ugggccccaccaccuaggccacu

SEQ ID NO: 3850433 - RNA, 14 nt, Human
ugggccccagccca

SEQ ID NO: 3850434 - RNA, 17 nt, Human
ugggccccagcccaccc

SEQ ID NO: 3850435 - RNA, 18 nt, Human
ugggccccagcccacccu

SEQ ID NO: 3850436 - RNA, 20 nt, Human
ugggccccagcccacccucc

SEQ ID NO: 3850437 - RNA, 22 nt, Human
ugggccccagcccacccuccug

SEQ ID NO: 3850438 - RNA, 21 nt, Human
ugggcccccaaauggaaaugg

SEQ ID NO: 3850439 - RNA, 11 nt, Human
ugggccccucc

SEQ ID NO: 3850440 - RNA, 18 nt, Human
ugggccccucccuaccuc

SEQ ID NO: 3850441 - RNA, 20 nt, Human
ugggccccucccuaccucaa

SEQ ID NO: 3850442 - RNA, 15 nt, Human
ugggccccucuccca

SEQ ID NO: 3850443 - RNA, 15 nt, Human
ugggccccugccaga

SEQ ID NO: 3850444 - RNA, 15 nt, Human
ugggccccugccucu

SEQ ID NO: 3850445 - RNA, 23 nt, Human
ugggccccugccucucugcaggu

SEQ ID NO: 3850446 - RNA, 13 nt, Human
ugggcccucucuu

SEQ ID NO: 3850447 - RNA, 13 nt, Human
ugggcccucuggu

SEQ ID NO: 3850448 - RNA, 22 nt, Human
ugggcccugagucugggcagcu

SEQ ID NO: 3850449 - RNA, 12 nt, Human
ugggcccugcau

SEQ ID NO: 3850450 - RNA, 14 nt, Human
ugggcccugcaugu

SEQ ID NO: 3850451 - RNA, 18 nt, Human
ugggcccugccucuguuu

SEQ ID NO: 3850452 - RNA, 19 nt, Human
ugggccgggacccagggcc

SEQ ID NO: 3850453 - RNA, 20 nt, Human
ugggccguaucuccggcucc

SEQ ID NO: 3850454 - RNA, 14 nt, Human
ugggccuaggcugc

SEQ ID NO: 3850455 - RNA, 15 nt, Human
ugggccuauggagag

SEQ ID NO: 3850456 - RNA, 17 nt, Human
ugggccuauggagagcc

SEQ ID NO: 3850457 - RNA, 21 nt, Human
ugggccuauggagagcccugg

SEQ ID NO: 3850458 - RNA, 16 nt, Human
ugggccucaaggacuu

SEQ ID NO: 3850459 - RNA, 22 nt, Human
ugggccuccugugugugcgccu

SEQ ID NO: 3850460 - RNA, 15 nt, Human
ugggccucggccccu

SEQ ID NO: 3850461 - RNA, 18 nt, Human
ugggccugcuccagaccu

SEQ ID NO: 3850462 - RNA, 17 nt, Human
ugggccugcugcugaga

SEQ ID NO: 3850463 - RNA, 12 nt, Human
ugggccuggcau

SEQ ID NO: 3850464 - RNA, 15 nt, Human
ugggccugggcuccu

SEQ ID NO: 3850465 - RNA, 17 nt, Human
ugggccugggcuccugg

SEQ ID NO: 3850466 - RNA, 22 nt, Human
ugggccuggucucacccuggag

SEQ ID NO: 3850467 - RNA, 23 nt, Human
ugggccugguuaaauaaggcagg

SEQ ID NO: 3850468 - RNA, 15 nt, Human
ugggccuuaggaaga

SEQ ID NO: 3850469 - RNA, 23 nt, Human
ugggccuuagugggccagggcug

SEQ ID NO: 3850470 - RNA, 11 nt, Human
ugggccuucag

SEQ ID NO: 3850471 - RNA, 18 nt, Human
ugggccuucagggaguga

SEQ ID NO: 3850472 - RNA, 13 nt, Human
ugggccuugcuac

SEQ ID NO: 3850473 - RNA, 13 nt, Human
ugggccuuggccu

SEQ ID NO: 3850474 - RNA, 16 nt, Human
ugggcgcccuggaagc

SEQ ID NO: 3850475 - RNA, 20 nt, Human
ugggcgcccuggaagccggc

SEQ ID NO: 3850476 - RNA, 17 nt, Human
ugggcgccgugcugggc

SEQ ID NO: 3850477 - RNA, 22 nt, Human
ugggcgcugguccuuucuuccg

SEQ ID NO: 3850478 - RNA, 15 nt, Human
ugggcggcacagccu

SEQ ID NO: 3850479 - RNA, 16 nt, Human
ugggcggcugagagcc

SEQ ID NO: 3850480 - RNA, 15 nt, Human
ugggcggggccuugc

SEQ ID NO: 3850481 - RNA, 21 nt, Human
ugggcguacgcuggugcugag

SEQ ID NO: 3850482 - RNA, 19 nt, Human
ugggcguggucacugcugu

SEQ ID NO: 3850483 - RNA, 20 nt, Human
ugggcguggucacugcuguc

SEQ ID NO: 3850484 - RNA, 13 nt, Human
ugggcuacaagga

SEQ ID NO: 3850485 - RNA, 19 nt, Human
ugggcuacaugcugggguc

SEQ ID NO: 3850486 - RNA, 16 nt, Human
ugggcuacuuuguccu

SEQ ID NO: 3850487 - RNA, 19 nt, Human
ugggcuauuuggacucagg

SEQ ID NO: 3850488 - RNA, 18 nt, Human
ugggcucaaccagaaaag

SEQ ID NO: 3850489 - RNA, 21 nt, Human
ugggcucaagcaauccuccug

SEQ ID NO: 3850490 - RNA, 13 nt, Human
ugggcuccccucu

SEQ ID NO: 3850491 - RNA, 16 nt, Human
ugggcucccguguuuu

SEQ ID NO: 3850492 - RNA, 15 nt, Human
ugggcucccuuccca

SEQ ID NO: 3850493 - RNA, 14 nt, Human
ugggcucccuuccu

SEQ ID NO: 3850494 - RNA, 23 nt, Human
ugggcuccuccagggugugugcu

SEQ ID NO: 3850495 - RNA, 11 nt, Human
ugggcuccugg

SEQ ID NO: 3850496 - RNA, 13 nt, Human
ugggcuccuggac

SEQ ID NO: 3850497 - RNA, 16 nt, Human
ugggcucgucuuugca

SEQ ID NO: 3850498 - RNA, 16 nt, Human
ugggcucuccaccuca

SEQ ID NO: 3850499 - RNA, 19 nt, Human
ugggcucuccaccucagcc

SEQ ID NO: 3850500 - RNA, 20 nt, Human
ugggcucuccaccucagccu

SEQ ID NO: 3850501 - RNA, 22 nt, Human
ugggcucugcaauuccccucug

SEQ ID NO: 3850502 - RNA, 12 nt, Human
ugggcucugccc

SEQ ID NO: 3850503 - RNA, 19 nt, Human
ugggcucugccccagcucu

SEQ ID NO: 3850504 - RNA, 13 nt, Human
ugggcucugcuga

SEQ ID NO: 3850505 - RNA, 14 nt, Human
ugggcucugggagc

SEQ ID NO: 3850506 - RNA, 12 nt, Human
ugggcucugugc

SEQ ID NO: 3850507 - RNA, 17 nt, Human
ugggcucugugggcugc

SEQ ID NO: 3850508 - RNA, 19 nt, Human
ugggcugaacacuccaauu

SEQ ID NO: 3850509 - RNA, 18 nt, Human
ugcuaccaguauuuagaa

SEQ ID NO: 3850510 - RNA, 15 nt, Human
ugcuacccucccugc

SEQ ID NO: 3850511 - RNA, 17 nt, Human
ugcuacccucccugcug

SEQ ID NO: 3850512 - RNA, 19 nt, Human
ugcuacccucccugcuguc

SEQ ID NO: 3850513 - RNA, 21 nt, Human
ugcuacccucccugcuguccc

SEQ ID NO: 3850514 - RNA, 15 nt, Human
ugcuaccguugacuu

SEQ ID NO: 3850515 - RNA, 14 nt, Human
guggucacugcugu

SEQ ID NO: 3850516 - RNA, 15 nt, Human
guggucacugcuguc

SEQ ID NO: 3850517 - RNA, 22 nt, Human
guggucaggcguagaucaccag

SEQ ID NO: 3850518 - RNA, 23 nt, Human
guggucccaacaggaggacaauu

SEQ ID NO: 3850519 - RNA, 14 nt, Human
ugcucccagcagcc

SEQ ID NO: 3850520 - RNA, 13 nt, Human
ugcuccccacagc

SEQ ID NO: 3850521 - RNA, 14 nt, Human
ugcuccccacagcg

SEQ ID NO: 3850522 - RNA, 21 nt, Human
ugcuccccacagcgucccugg

SEQ ID NO: 3850523 - RNA, 13 nt, Human
ugcuccccacguc

SEQ ID NO: 3850524 - RNA, 17 nt, Human
ugcuccccagcccuggc

SEQ ID NO: 3850525 - RNA, 18 nt, Human
ugcuccccagcccuggcu

SEQ ID NO: 3850526 - RNA, 23 nt, Human
ugcuccccagcccuggcucugca

SEQ ID NO: 3850527 - RNA, 21 nt, Human
ugcucccccacccccucccca

SEQ ID NO: 3850528 - RNA, 15 nt, Human
ugcucccccauccuc

SEQ ID NO: 3850529 - RNA, 19 nt, Human
ugcucccccauccuccccu

SEQ ID NO: 3850530 - RNA, 20 nt, Human
ugcucccccauccuccccuu

SEQ ID NO: 3850531 - RNA, 22 nt, Human
ugcucccccauccuccccuucc

SEQ ID NO: 3850532 - RNA, 13 nt, Human
ugcucccccuuuu

SEQ ID NO: 3850533 - RNA, 17 nt, Human
ugcuccccucccuccuc

SEQ ID NO: 3850534 - RNA, 16 nt, Human
ugcuccccuuccccuu

SEQ ID NO: 3850535 - RNA, 19 nt, Human
ugcucccuaagccagccug

SEQ ID NO: 3850536 - RNA, 16 nt, Human
ugcucccuaccaccuc

SEQ ID NO: 3850537 - RNA, 20 nt, Human
ugcucccuaccaccucccca

SEQ ID NO: 3850538 - RNA, 19 nt, Human
ugcucccuccccugcccug

SEQ ID NO: 3850539 - RNA, 15 nt, Human
ugcucccugaagcca

SEQ ID NO: 3850540 - RNA, 17 nt, Human
ugcucccugaagccagc

SEQ ID NO: 3850541 - RNA, 21 nt, Human
ugcucccugacugggggcaga

SEQ ID NO: 3850542 - RNA, 18 nt, Human
ugcucccugguucugaug

SEQ ID NO: 3850543 - RNA, 21 nt, Human
ugcuccgcugcuccuuggcuu

SEQ ID NO: 3850544 - RNA, 18 nt, Human
ugcuccgugccuccacca

SEQ ID NO: 3850545 - RNA, 17 nt, Human
ugcuccguggaggaggu

SEQ ID NO: 3850546 - RNA, 11 nt, Human
ugcuccuccag

SEQ ID NO: 3850547 - RNA, 21 nt, Human
ugcuccuccagggccacgugc

SEQ ID NO: 3850548 - RNA, 13 nt, Human
ugcuccucccugg

SEQ ID NO: 3850549 - RNA, 14 nt, Human
ugcuccucccuggc

SEQ ID NO: 3850550 - RNA, 23 nt, Human
ugcuccucccuggcugcccuggc

SEQ ID NO: 3850551 - RNA, 12 nt, Human
ugcuccucucca

SEQ ID NO: 3850552 - RNA, 15 nt, Human
ugcuccucuccaggc

SEQ ID NO: 3850553 - RNA, 15 nt, Human
ugcuccucuucccca

SEQ ID NO: 3850554 - RNA, 20 nt, Human
ugcuccuggagccuuugaau

SEQ ID NO: 3850555 - RNA, 18 nt, Human
ugcuccuggaucucccug

SEQ ID NO: 3850556 - RNA, 19 nt, Human
ugcuccuggcccacugcau

SEQ ID NO: 3850557 - RNA, 17 nt, Human
ugcuccuggccuugcug

SEQ ID NO: 3850558 - RNA, 20 nt, Human
ugcuccuuagcugccaagcc

SEQ ID NO: 3850559 - RNA, 13 nt, Human
ugcuccuucccca

SEQ ID NO: 3850560 - RNA, 12 nt, Human
ugcuccuugggc

SEQ ID NO: 3850561 - RNA, 19 nt, Human
ugcuccuugggcccuuuga

SEQ ID NO: 3850562 - RNA, 21 nt, Human
ugcuccuugggcccuuugagu

SEQ ID NO: 3850563 - RNA, 15 nt, Human
ugcuccuuguuccua

SEQ ID NO: 3850564 - RNA, 23 nt, Human
ugcuccuuguuccuagaguagag

SEQ ID NO: 3850565 - RNA, 23 nt, Human
ugcucgcccuccuuucugugccc

SEQ ID NO: 3850566 - RNA, 13 nt, Human
ugcucgcccugcg

SEQ ID NO: 3850567 - RNA, 14 nt, Human
ugcucgcccugcgg

SEQ ID NO: 3850568 - RNA, 22 nt, Human
ugcucgccucggaucagcugag

SEQ ID NO: 3850569 - RNA, 14 nt, Human
ugcucgcuguugcu

SEQ ID NO: 3850570 - RNA, 15 nt, Human
ugcucgcuguugcug

SEQ ID NO: 3850571 - RNA, 19 nt, Human
ugcucgcuguugcugaaua

SEQ ID NO: 3850572 - RNA, 20 nt, Human
ugcucggagaagagcgcagu

SEQ ID NO: 3850573 - RNA, 15 nt, Human
ugcucggggugcaca

SEQ ID NO: 3850574 - RNA, 17 nt, Human
ugcucggggugcacagg

SEQ ID NO: 3850575 - RNA, 18 nt, Human
ugcucggggugcacagga

SEQ ID NO: 3850576 - RNA, 20 nt, Human
ugcucggggugcacaggagg

SEQ ID NO: 3850577 - RNA, 21 nt, Human
ugcucggggugcacaggaggg

SEQ ID NO: 3850578 - RNA, 15 nt, Human
ugcucuaaaauauuu

SEQ ID NO: 3850579 - RNA, 16 nt, Human
ugcucuaacagcccuc

SEQ ID NO: 3850580 - RNA, 15 nt, Human
ugcucuaagcacacg

SEQ ID NO: 3850581 - RNA, 18 nt, Human
ugcucuagaugagcuggg

SEQ ID NO: 3850582 - RNA, 21 nt, Human
ugcucuagaugagcugggccg

SEQ ID NO: 3850583 - RNA, 14 nt, Human
ugcucuagugccuu

SEQ ID NO: 3850584 - RNA, 14 nt, Human
ugcucuagugggac

SEQ ID NO: 3850585 - RNA, 23 nt, Human
ugcucuaucucacagcacacuca

SEQ ID NO: 3850586 - RNA, 18 nt, Human
ugcucuaugcuuuccaaa

SEQ ID NO: 3850587 - RNA, 20 nt, Human
ugcucuaugugcuuguaaaa

SEQ ID NO: 3850588 - RNA, 21 nt, Human
ugcucucaaaccccugaccuc

SEQ ID NO: 3850589 - RNA, 22 nt, Human
ugcucucacuguuuguuuuuau

SEQ ID NO: 3850590 - RNA, 17 nt, Human
ugcucuccaagcccagu

SEQ ID NO: 3850591 - RNA, 14 nt, Human
ugcucuccccugcc

SEQ ID NO: 3850592 - RNA, 16 nt, Human
ugcucuccccugcccu

SEQ ID NO: 3850593 - RNA, 20 nt, Human
ugcucucccgguucuuccag

SEQ ID NO: 3850594 - RNA, 21 nt, Human
ugcucucccucuucucaagug

SEQ ID NO: 3850595 - RNA, 22 nt, Human
ugcucucccucuucucaagugc

SEQ ID NO: 3850596 - RNA, 10 nt, Human
ugcucuccuc

SEQ ID NO: 3850597 - RNA, 11 nt, Human
ugcucuccucu

SEQ ID NO: 3850598 - RNA, 15 nt, Human
ugcucuccucuucua

SEQ ID NO: 3850599 - RNA, 14 nt, Human
ugcucucuacccag

SEQ ID NO: 3850600 - RNA, 16 nt, Human
ugcucucuacccagcc

SEQ ID NO: 3850601 - RNA, 17 nt, Human
ugcucucuacccagccc

SEQ ID NO: 3850602 - RNA, 17 nt, Human
ugcucucucaaauuguc

SEQ ID NO: 3850603 - RNA, 20 nt, Human
ugcucucucaaauugucagc

SEQ ID NO: 3850604 - RNA, 17 nt, Human
ugcucucugcagccagc

SEQ ID NO: 3850605 - RNA, 12 nt, Human
ugcucucugcca

SEQ ID NO: 3850606 - RNA, 13 nt, Human
ugcucucuguguc

SEQ ID NO: 3850607 - RNA, 11 nt, Human
ugcucugagaa

SEQ ID NO: 3850608 - RNA, 18 nt, Human
ugcucugaggcuuccaga

SEQ ID NO: 3850609 - RNA, 20 nt, Human
ugcucugaggcuuccagaga

SEQ ID NO: 3850610 - RNA, 19 nt, Human
ugcucugaugaagaggagu

SEQ ID NO: 3850611 - RNA, 15 nt, Human
ugcucugcaggcacc

SEQ ID NO: 3850612 - RNA, 22 nt, Human
ugcucugcgugucaccugugcu

SEQ ID NO: 3850613 - RNA, 10 nt, Human
ugcucugcug

SEQ ID NO: 3850614 - RNA, 12 nt, Human
ugcucuggaccu

SEQ ID NO: 3850615 - RNA, 13 nt, Human
ugcucuggaccug

SEQ ID NO: 3850616 - RNA, 23 nt, Human
ugcucugguuguuucuguuccaa

SEQ ID NO: 3850617 - RNA, 16 nt, Human
ugcucuguuugugggg

SEQ ID NO: 3850618 - RNA, 15 nt, Human
ugcucuuaagccuaa

SEQ ID NO: 3850619 - RNA, 13 nt, Human
ugcucuuaauugc

SEQ ID NO: 3850620 - RNA, 15 nt, Human
ugcucuuaauugcca

SEQ ID NO: 3850621 - RNA, 21 nt, Human
ugcucuuaauugccaccucua

SEQ ID NO: 3850622 - RNA, 21 nt, Human
ugcucuuacuacacugaggag

SEQ ID NO: 3850623 - RNA, 18 nt, Human
ugcucuuagcugucugcu

SEQ ID NO: 3850624 - RNA, 17 nt, Human
ugcucuuaugccauuug

SEQ ID NO: 3850625 - RNA, 14 nt, Human
ugcucuuauuucau

SEQ ID NO: 3850626 - RNA, 23 nt, Human
ugcucuucuguggaccacugcau

SEQ ID NO: 3850627 - RNA, 15 nt, Human
ugcucuugaacuccu

SEQ ID NO: 3850628 - RNA, 20 nt, Human
ugcucuugaacuccugaccu

SEQ ID NO: 3850629 - RNA, 15 nt, Human
ugcucuuggcuggac

SEQ ID NO: 3850630 - RNA, 19 nt, Human
ugcucuugggcaauauucu

SEQ ID NO: 3850631 - RNA, 21 nt, Human
ugcucuugggcaauauucucu

SEQ ID NO: 3850632 - RNA, 14 nt, Human
ugcucuuguagccc

SEQ ID NO: 3850633 - RNA, 23 nt, Human
ugcucuugucccacgugucuucc

SEQ ID NO: 3850634 - RNA, 18 nt, Human
ugcucuuguccuagcuug

SEQ ID NO: 3850635 - RNA, 15 nt, Human
ugcucuuguuuuuau

SEQ ID NO: 3850636 - RNA, 20 nt, Human
ugcucuuucccacccagccu

SEQ ID NO: 3850637 - RNA, 23 nt, Human
ugcucuuucccccuuccaucucu

SEQ ID NO: 3850638 - RNA, 12 nt, Human
ugcucuuucucu

SEQ ID NO: 3850639 - RNA, 13 nt, Human
ugcucuuucucug

SEQ ID NO: 3850640 - RNA, 14 nt, Human
ugcucuuucucugc

SEQ ID NO: 3850641 - RNA, 16 nt, Human
ugcucuuucucugcca

SEQ ID NO: 3850642 - RNA, 18 nt, Human
ugcucuuucucugccagu

SEQ ID NO: 3850643 - RNA, 20 nt, Human
ugcucuuuguuuugugucuc

SEQ ID NO: 3850644 - RNA, 15 nt, Human
ugcucuuuuuuacuc

SEQ ID NO: 3850645 - RNA, 20 nt, Human
ugcugaaaaccaucuggccu

SEQ ID NO: 3850646 - RNA, 23 nt, Human
ugcugaaaaccaucuggccuggc

SEQ ID NO: 3850647 - RNA, 14 nt, Human
ugcugaaaauggua

SEQ ID NO: 3850648 - RNA, 16 nt, Human
ugcugaaaauguccuu

SEQ ID NO: 3850649 - RNA, 16 nt, Human
ugcugaaaccaagggg

SEQ ID NO: 3850650 - RNA, 22 nt, Human
ugcugaaagagaaaagaggggu

SEQ ID NO: 3850651 - RNA, 20 nt, Human
ugcugaaagcccaaguaggg

SEQ ID NO: 3850652 - RNA, 21 nt, Human
ugcugaacauugcauauaacu

SEQ ID NO: 3850653 - RNA, 22 nt, Human
ugcugaagcuuauuaaugcuaa

SEQ ID NO: 3850654 - RNA, 23 nt, Human
ugcugaagcuuauuaaugcuaag

SEQ ID NO: 3850655 - RNA, 22 nt, Human
ugcugaagggaccuugaagggu

SEQ ID NO: 3850656 - RNA, 20 nt, Human
ugcugaauguugggacugcu

SEQ ID NO: 3850657 - RNA, 17 nt, Human
ugcugaauuuucacaug

SEQ ID NO: 3850658 - RNA, 23 nt, Human
ugcugaauuuucacaugaacaua

SEQ ID NO: 3850659 - RNA, 19 nt, Human
ugcugcuucucccaggcaa

SEQ ID NO: 3850660 - RNA, 21 nt, Human
ugcugcuucugaauacaaauu

SEQ ID NO: 3850661 - RNA, 19 nt, Human
ugcugcuuuaauugugaau

SEQ ID NO: 3850662 - RNA, 19 nt, Human
ugcugcuuuccccuguggg

SEQ ID NO: 3850663 - RNA, 16 nt, Human
ugcugcuuugauauau

SEQ ID NO: 3850664 - RNA, 23 nt, Human
ugcugcuuuuugagguggcacuu

SEQ ID NO: 3850665 - RNA, 19 nt, Human
ugcuggaaccugcaaaaaa

SEQ ID NO: 3850666 - RNA, 15 nt, Human
ugcuggaagcccagc

SEQ ID NO: 3850667 - RNA, 20 nt, Human
ugcuggacggcauuccugcu

SEQ ID NO: 3850668 - RNA, 16 nt, Human
ugcuggacgucuuucu

SEQ ID NO: 3850669 - RNA, 19 nt, Human
ugcuggacugucauagaaa

SEQ ID NO: 3850670 - RNA, 13 nt, Human
ugcuggagaagag

SEQ ID NO: 3850671 - RNA, 18 nt, Human
ugcuggagaagagaggag

SEQ ID NO: 3850672 - RNA, 12 nt, Human
ugcuggagaggu

SEQ ID NO: 3850673 - RNA, 13 nt, Human
ugcuggagccugu

SEQ ID NO: 3850674 - RNA, 19 nt, Human
ugcuggagccuguguaaca

SEQ ID NO: 3850675 - RNA, 21 nt, Human
ugcuggagccuguguaacagc

SEQ ID NO: 3850676 - RNA, 13 nt, Human
ugcuggagcucug

SEQ ID NO: 3850677 - RNA, 13 nt, Human
ugcuggaggacug

SEQ ID NO: 3850678 - RNA, 15 nt, Human
ugcuggaggugggag

SEQ ID NO: 3850679 - RNA, 15 nt, Human
guggucggugggacc

SEQ ID NO: 3850680 - RNA, 18 nt, Human
guggucuccacuggggau

SEQ ID NO: 3850681 - RNA, 14 nt, Human
guggucugaauguu

SEQ ID NO: 3850682 - RNA, 23 nt, Human
guggucugaauguucugacauua

SEQ ID NO: 3850683 - RNA, 24 nt, Human
guggucugaauguucugacauuaa

SEQ ID NO: 3850684 - RNA, 15 nt, Human
guggucugcaggcag

SEQ ID NO: 3850685 - RNA, 19 nt, Human
guggucugcucgggcccag

SEQ ID NO: 3850686 - RNA, 13 nt, Human
guggucuguuggc

SEQ ID NO: 3850687 - RNA, 19 nt, Human
guggucuucaaauugucuu

SEQ ID NO: 3850688 - RNA, 15 nt, Human
guggucuuuguaaga

SEQ ID NO: 3850689 - RNA, 19 nt, Human
guggucuuuguaagagugu

SEQ ID NO: 3850690 - RNA, 14 nt, Human
guggucuuuuccuc

SEQ ID NO: 3850691 - RNA, 14 nt, Human
guggugaccucugc

SEQ ID NO: 3850692 - RNA, 15 nt, Human
guggugacuuuggau

SEQ ID NO: 3850693 - RNA, 21 nt, Human
guggugagaggcauccaguau

SEQ ID NO: 3850694 - RNA, 17 nt, Human
guggugcgagugcguga

SEQ ID NO: 3850695 - RNA, 18 nt, Human
guggugcucaguuguaga

SEQ ID NO: 3850696 - RNA, 15 nt, Human
guggugcugacaaag

SEQ ID NO: 3850697 - RNA, 22 nt, Human
gugguggaaacuuuucuuaaaa

SEQ ID NO: 3850698 - RNA, 22 nt, Human
gugguggagccaguaaacagag

SEQ ID NO: 3850699 - RNA, 16 nt, Human
gugguggcacaggccc

SEQ ID NO: 3850700 - RNA, 21 nt, Human
gugguggcagggccuagcugc

SEQ ID NO: 3850701 - RNA, 13 nt, Human
gugguggccucag

SEQ ID NO: 3850702 - RNA, 14 nt, Human
gugguggccucagc

SEQ ID NO: 3850703 - RNA, 18 nt, Human
gugguggccuggucccug

SEQ ID NO: 3850704 - RNA, 18 nt, Human
gugguggcucacgccugu

SEQ ID NO: 3850705 - RNA, 18 nt, Human
gugguggcucaugccugu

SEQ ID NO: 3850706 - RNA, 18 nt, Human
guggugggacagggaccc

SEQ ID NO: 3850707 - RNA, 22 nt, Human
gugguggguucuuuggaaggag

SEQ ID NO: 3850708 - RNA, 11 nt, Human
guggugucacu

SEQ ID NO: 3850709 - RNA, 14 nt, Human
gugguguggagaag

SEQ ID NO: 3850710 - RNA, 22 nt, Human
gugguguggagaagccacaggc

SEQ ID NO: 3850711 - RNA, 15 nt, Human
gugguguuuccuggc

SEQ ID NO: 3850712 - RNA, 19 nt, Human
gugguguuuccuggcacug

SEQ ID NO: 3850713 - RNA, 13 nt, Human
gugguuacacagu

SEQ ID NO: 3850714 - RNA, 18 nt, Human
gugguuauggagagggug

SEQ ID NO: 3850715 - RNA, 22 nt, Human
gugguucacucuuggagccugc

SEQ ID NO: 3850716 - RNA, 18 nt, Human
gugguuccccaccgaagu

SEQ ID NO: 3850717 - RNA, 13 nt, Human
gugguuccucugc

SEQ ID NO: 3850718 - RNA, 19 nt, Human
gugguucuacaaucuauuu

SEQ ID NO: 3850719 - RNA, 19 nt, Human
gugguugcuguuuuccucc

SEQ ID NO: 3850720 - RNA, 18 nt, Human
gugguuuaggcuauuugu

SEQ ID NO: 3850721 - RNA, 18 nt, Human
gugguuuaguguaaaaau

SEQ ID NO: 3850722 - RNA, 17 nt, Human
gugguuugaucauuucu

SEQ ID NO: 3850723 - RNA, 21 nt, Human
gugguuugguuccucucuggu

SEQ ID NO: 3850724 - RNA, 23 nt, Human
gugguuuuagauuuucugguucu

SEQ ID NO: 3850725 - RNA, 18 nt, Human
gugguuuuccccucccug

SEQ ID NO: 3850726 - RNA, 19 nt, Human
gugguuuuccccucccugg

SEQ ID NO: 3850727 - RNA, 20 nt, Human
gugguuuuccccucccuggg

SEQ ID NO: 3850728 - RNA, 12 nt, Human
gugguuuucuua

SEQ ID NO: 3850729 - RNA, 19 nt, Human
gugguuuucuuuugccaug

SEQ ID NO: 3850730 - RNA, 16 nt, Human
gugguuuuucuuuucu

SEQ ID NO: 3850731 - RNA, 15 nt, Human
guguaaaaaaaccac

SEQ ID NO: 3850732 - RNA, 12 nt, Human
guguaaaaauga

SEQ ID NO: 3850733 - RNA, 17 nt, Human
guguaaaauauuuugaa

SEQ ID NO: 3850734 - RNA, 15 nt, Human
guguaaaaugugaag

SEQ ID NO: 3850735 - RNA, 14 nt, Human
guguaaacacaucu

SEQ ID NO: 3850736 - RNA, 15 nt, Human
guguaaacacaucua

SEQ ID NO: 3850737 - RNA, 13 nt, Human
guguaaaguuagu

SEQ ID NO: 3850738 - RNA, 16 nt, Human
guguaaaguuagucua

SEQ ID NO: 3850739 - RNA, 23 nt, Human
guguaacagcuccuugggaggaa

SEQ ID NO: 3850740 - RNA, 15 nt, Human
guguaacuugcuuaa

SEQ ID NO: 3850741 - RNA, 20 nt, Human
guguaacuugcuuaaauuuc

SEQ ID NO: 3850742 - RNA, 21 nt, Human
guguaacuugcuuaaauuucu

SEQ ID NO: 3850743 - RNA, 18 nt, Human
guguaagaaauacagacu

SEQ ID NO: 3850744 - RNA, 21 nt, Human
guguaagauuuguuuuuaaac

SEQ ID NO: 3850745 - RNA, 19 nt, Human
guguaagggccagaaauau

SEQ ID NO: 3850746 - RNA, 21 nt, Human
guguaaguauucuuauuuaau

SEQ ID NO: 3850747 - RNA, 22 nt, Human
guguaagugugaguaagagcug

SEQ ID NO: 3850748 - RNA, 14 nt, Human
guguaauaaagugu

SEQ ID NO: 3850749 - RNA, 15 nt, Human
guguaauaaaguguu

SEQ ID NO: 3850750 - RNA, 13 nt, Human
guguaauaagaca

SEQ ID NO: 3850751 - RNA, 15 nt, Human
guguaauaagacaua

SEQ ID NO: 3850752 - RNA, 14 nt, Human
guguaaucaauaaa

SEQ ID NO: 3850753 - RNA, 15 nt, Human
guguaaucaauaaac

SEQ ID NO: 3850754 - RNA, 16 nt, Human
guguaaucaauaaacg

SEQ ID NO: 3850755 - RNA, 22 nt, Human
guguaauguagcguguuuacau

SEQ ID NO: 3850756 - RNA, 20 nt, Human
guguaauuuaaaauugugau

SEQ ID NO: 3850757 - RNA, 22 nt, Human
guguaauuuaaaauugugaugu

SEQ ID NO: 3850758 - RNA, 23 nt, Human
guguaauuuaaaauugugaugug

SEQ ID NO: 3850759 - RNA, 15 nt, Human
guguaauuucuuugc

SEQ ID NO: 3850760 - RNA, 23 nt, Human
guguaauuuuguucuaguuuuca

SEQ ID NO: 3850761 - RNA, 15 nt, Human
guguaauuuuucugu

SEQ ID NO: 3850762 - RNA, 16 nt, Human
guguaauuuuucugua

SEQ ID NO: 3850763 - RNA, 15 nt, Human
guguacacgggacug

SEQ ID NO: 3850764 - RNA, 21 nt, Human
guguacacgggacugacgcaa

SEQ ID NO: 3850765 - RNA, 12 nt, Human
guguacagugug

SEQ ID NO: 3850766 - RNA, 14 nt, Human
guguacauaacuga

SEQ ID NO: 3850767 - RNA, 19 nt, Human
guguacccccgcccaggcu

SEQ ID NO: 3850768 - RNA, 20 nt, Human
guguaccgcgucuacccugg

SEQ ID NO: 3850769 - RNA, 20 nt, Human
guguaccuguguacauaacu

SEQ ID NO: 3850770 - RNA, 16 nt, Human
guguacguggagaggg

SEQ ID NO: 3850771 - RNA, 20 nt, Human
guguacguggagagggauga

SEQ ID NO: 3850772 - RNA, 18 nt, Human
guguacucacugaagccu

SEQ ID NO: 3850773 - RNA, 17 nt, Human
guguacucuggccucug

SEQ ID NO: 3850774 - RNA, 18 nt, Human
guguacucuggccucugu

SEQ ID NO: 3850775 - RNA, 12 nt, Human
guguacuguaua

SEQ ID NO: 3850776 - RNA, 11 nt, Human
guguacugugu

SEQ ID NO: 3850777 - RNA, 23 nt, Human
guguagaagcauuccuucuuuga

SEQ ID NO: 3850778 - RNA, 15 nt, Human
guguagaguuaagaa

SEQ ID NO: 3850779 - RNA, 14 nt, Human
guguagccaagguc

SEQ ID NO: 3850780 - RNA, 14 nt, Human
guguagccugugca

SEQ ID NO: 3850781 - RNA, 13 nt, Human
guguagccuuuuu

SEQ ID NO: 3850782 - RNA, 15 nt, Human
guguagcuacagaga

SEQ ID NO: 3850783 - RNA, 22 nt, Human
guguagcugugaccugcugagc

SEQ ID NO: 3850784 - RNA, 15 nt, Human
guguaggcuuuacuu

SEQ ID NO: 3850785 - RNA, 20 nt, Human
guguaggcuuuacuuagcuu

SEQ ID NO: 3850786 - RNA, 15 nt, Human
guguaguucauguaa

SEQ ID NO: 3850787 - RNA, 17 nt, Human
guguaguugaacugaua

SEQ ID NO: 3850788 - RNA, 12 nt, Human
guguauaaacaa

SEQ ID NO: 3850789 - RNA, 13 nt, Human
guguauauauaca

SEQ ID NO: 3850790 - RNA, 14 nt, Human
guguauauguaugu

SEQ ID NO: 3850791 - RNA, 19 nt, Human
guguauauuauuuggcagu

SEQ ID NO: 3850792 - RNA, 16 nt, Human
guguaugacuaaagag

SEQ ID NO: 3850793 - RNA, 16 nt, Human
guguauguagaagcau

SEQ ID NO: 3850794 - RNA, 16 nt, Human
guguaugugugugugu

SEQ ID NO: 3850795 - RNA, 16 nt, Human
guguauguuuuucagu

SEQ ID NO: 3850796 - RNA, 13 nt, Human
guguauuccaaga

SEQ ID NO: 3850797 - RNA, 20 nt, Human
guguauuccaagacaugucu

SEQ ID NO: 3850798 - RNA, 18 nt, Human
guguauuuaacagggagg

SEQ ID NO: 3850799 - RNA, 17 nt, Human
guguauuuauugaagaa

SEQ ID NO: 3850800 - RNA, 20 nt, Human
guguauuuauugaagaaaca

SEQ ID NO: 3850801 - RNA, 22 nt, Human
guguauuuauuuuccuccccag

SEQ ID NO: 3850802 - RNA, 14 nt, Human
guguauuucauuua

SEQ ID NO: 3850803 - RNA, 19 nt, Human
guguauuuccagugcaauu

SEQ ID NO: 3850804 - RNA, 21 nt, Human
uggaagugugggucugugugu

SEQ ID NO: 3850805 - RNA, 23 nt, Human
uggaagugugggucugugugugu

SEQ ID NO: 3850806 - RNA, 18 nt, Human
uggaaguguguguggcag

SEQ ID NO: 3850807 - RNA, 18 nt, Human
uggaaguuaaagugaggc

SEQ ID NO: 3850808 - RNA, 20 nt, Human
uggaaguuuagcucugagaa

SEQ ID NO: 3850809 - RNA, 18 nt, Human
uggaauaaaaggcuugaa

SEQ ID NO: 3850810 - RNA, 22 nt, Human
uggaauaaaaggcuugaagcug

SEQ ID NO: 3850811 - RNA, 15 nt, Human
uggaauaacauguaa

SEQ ID NO: 3850812 - RNA, 19 nt, Human
uggaauaacauguaauuaa

SEQ ID NO: 3850813 - RNA, 18 nt, Human
uggaauaagacagagacc

SEQ ID NO: 3850814 - RNA, 22 nt, Human
uggaauacuaaaaaucaugaga

SEQ ID NO: 3850815 - RNA, 12 nt, Human
uggaauacuuuu

SEQ ID NO: 3850816 - RNA, 13 nt, Human
uggaauacuuuuu

SEQ ID NO: 3850817 - RNA, 17 nt, Human
uggaauaggaauaagcu

SEQ ID NO: 3850818 - RNA, 18 nt, Human
uggaauaguauccuccag

SEQ ID NO: 3850819 - RNA, 20 nt, Human
uggaauaguauccuccaggu

SEQ ID NO: 3850820 - RNA, 23 nt, Human
uggaauaguauccuccagguuuu

SEQ ID NO: 3850821 - RNA, 21 nt, Human
uggaauauaaggaaagcaaua

SEQ ID NO: 3850822 - RNA, 12 nt, Human
uggaauauuaaa

SEQ ID NO: 3850823 - RNA, 23 nt, Human
uggaauauuccccuaucucuaga

SEQ ID NO: 3850824 - RNA, 21 nt, Human
uggaaucaggaauauuuucca

SEQ ID NO: 3850825 - RNA, 23 nt, Human
uggaaucaggaauauuuuccaaa

SEQ ID NO: 3850826 - RNA, 20 nt, Human
uggaaucauuguccagagcu

SEQ ID NO: 3850827 - RNA, 19 nt, Human
uggaaucuaccaacuguuu

SEQ ID NO: 3850828 - RNA, 19 nt, Human
uggaaucuagaagaaauga

SEQ ID NO: 3850829 - RNA, 22 nt, Human
uggaaucuagaagaaaugaaau

SEQ ID NO: 3850830 - RNA, 17 nt, Human
uggaaugaauuaaauaa

SEQ ID NO: 3850831 - RNA, 15 nt, Human
uggaaugagaauuua

SEQ ID NO: 3850832 - RNA, 17 nt, Human
uggaaugagugugcaug

SEQ ID NO: 3850833 - RNA, 15 nt, Human
uggaaugcacucaga

SEQ ID NO: 3850834 - RNA, 16 nt, Human
uggaaugcuuccuaga

SEQ ID NO: 3850835 - RNA, 15 nt, Human
uggaauggauuuuuc

SEQ ID NO: 3850836 - RNA, 17 nt, Human
uggaaugguuauaaaag

SEQ ID NO: 3850837 - RNA, 23 nt, Human
uggaauguggccccugaacaaga

SEQ ID NO: 3850838 - RNA, 17 nt, Human
uggaauuaaaacaaugu

SEQ ID NO: 3850839 - RNA, 17 nt, Human
uggaauuaaccuggugc

SEQ ID NO: 3850840 - RNA, 18 nt, Human
uggaauuaaccuggugcu

SEQ ID NO: 3850841 - RNA, 20 nt, Human
uggaauuaaccuggugcugg

SEQ ID NO: 3850842 - RNA, 21 nt, Human
uggaauuaugcuggcuucuga

SEQ ID NO: 3850843 - RNA, 14 nt, Human
uggaauucacaaag

SEQ ID NO: 3850844 - RNA, 13 nt, Human
uggaauucuaaca

SEQ ID NO: 3850845 - RNA, 22 nt, Human
uggaauucuuagucacaaaaua

SEQ ID NO: 3850846 - RNA, 16 nt, Human
uggaauugauuugcau

SEQ ID NO: 3850847 - RNA, 17 nt, Human
uggaauugauuugcauu

SEQ ID NO: 3850848 - RNA, 19 nt, Human
uggaauugauuugcauuga

SEQ ID NO: 3850849 - RNA, 11 nt, Human
uggaauugcuu

SEQ ID NO: 3850850 - RNA, 18 nt, Human
uggaauugcuuaccaaag

SEQ ID NO: 3850851 - RNA, 17 nt, Human
uggaauugggagcuugg

SEQ ID NO: 3850852 - RNA, 14 nt, Human
uggaauuguggcua

SEQ ID NO: 3850853 - RNA, 20 nt, Human
uggaauuguggcuauccuga

SEQ ID NO: 3850854 - RNA, 18 nt, Human
uggaauuuauaauucagu

SEQ ID NO: 3850855 - RNA, 16 nt, Human
uggaauuugccugcug

SEQ ID NO: 3850856 - RNA, 14 nt, Human
uggaauuuguaagu

SEQ ID NO: 3850857 - RNA, 17 nt, Human
uggaauuuuccuccuuu

SEQ ID NO: 3850858 - RNA, 21 nt, Human
uggaauuuuccuccuuucucu

SEQ ID NO: 3850859 - RNA, 23 nt, Human
uggaauuuugcaaagauuuaauc

SEQ ID NO: 3850860 - RNA, 20 nt, Human
uggaauuuuuauuaugcaua

SEQ ID NO: 3850861 - RNA, 24 nt, Human
uggaauuuuuauuaugcauaacug

SEQ ID NO: 3850862 - RNA, 19 nt, Human
uggaauuuuugcuugacuu

SEQ ID NO: 3850863 - RNA, 21 nt, Human
uggaauuuuugcuugacuuca

SEQ ID NO: 3850864 - RNA, 15 nt, Human
uggaauuuuuuauuc

SEQ ID NO: 3850865 - RNA, 20 nt, Human
uggaauuuuuuauucuugug

SEQ ID NO: 3850866 - RNA, 19 nt, Human
uggacaaaacaagaaagac

SEQ ID NO: 3850867 - RNA, 14 nt, Human
uggacaaaauggaa

SEQ ID NO: 3850868 - RNA, 19 nt, Human
uggacaaacccuucuuuua

SEQ ID NO: 3850869 - RNA, 16 nt, Human
uggacaaacuggaguc

SEQ ID NO: 3850870 - RNA, 20 nt, Human
uggacaaaugugaagaugca

SEQ ID NO: 3850871 - RNA, 16 nt, Human
uggacaagagguacag

SEQ ID NO: 3850872 - RNA, 14 nt, Human
uggacaaggagguc

SEQ ID NO: 3850873 - RNA, 16 nt, Human
uggacaaucaugaaau

SEQ ID NO: 3850874 - RNA, 13 nt, Human
uggacacaggccu

SEQ ID NO: 3850875 - RNA, 15 nt, Human
uggacacagggugac

SEQ ID NO: 3850876 - RNA, 18 nt, Human
uggacaccaggagucccu

SEQ ID NO: 3850877 - RNA, 21 nt, Human
uggacaccaggagucccuggu

SEQ ID NO: 3850878 - RNA, 21 nt, Human
uggacaccccuuauccaggac

SEQ ID NO: 3850879 - RNA, 15 nt, Human
uggacaccggaaaca

SEQ ID NO: 3850880 - RNA, 12 nt, Human
uggacaccugcc

SEQ ID NO: 3850881 - RNA, 13 nt, Human
uggacaccugccc

SEQ ID NO: 3850882 - RNA, 15 nt, Human
uggacacgcucagug

SEQ ID NO: 3850883 - RNA, 16 nt, Human
uggacacuacacccag

SEQ ID NO: 3850884 - RNA, 18 nt, Human
uggacacuacacccagca

SEQ ID NO: 3850885 - RNA, 12 nt, Human
guuagaucuagu

SEQ ID NO: 3850886 - RNA, 11 nt, Human
guuagauguuu

SEQ ID NO: 3850887 - RNA, 16 nt, Human
guuagauuaagaaaua

SEQ ID NO: 3850888 - RNA, 14 nt, Human
guuagcacuguuga

SEQ ID NO: 3850889 - RNA, 17 nt, Human
guuagccaauauuuuuc

SEQ ID NO: 3850890 - RNA, 22 nt, Human
guuagcguuucggccuucauaa

SEQ ID NO: 3850891 - RNA, 15 nt, Human
guuagcuccuguggc

SEQ ID NO: 3850892 - RNA, 20 nt, Human
guuagcuccuguggccccac

SEQ ID NO: 3850893 - RNA, 11 nt, Human
guuagcuggag

SEQ ID NO: 3850894 - RNA, 17 nt, Human
guuaggaaauaaaaccu

SEQ ID NO: 3850895 - RNA, 18 nt, Human
guuaggaaauaaaaccuu

SEQ ID NO: 3850896 - RNA, 22 nt, Human
guuaggaaauaaaaccuuucaa

SEQ ID NO: 3850897 - RNA, 17 nt, Human
guuaggaugcucaguug

SEQ ID NO: 3850898 - RNA, 15 nt, Human
guuaggauuuaacag

SEQ ID NO: 3850899 - RNA, 18 nt, Human
guuaggcugggcccagag

SEQ ID NO: 3850900 - RNA, 20 nt, Human
guuagggaaaacauuccauc

SEQ ID NO: 3850901 - RNA, 15 nt, Human
guuagggaagagaaa

SEQ ID NO: 3850902 - RNA, 18 nt, Human
guuagggaagagaaacag

SEQ ID NO: 3850903 - RNA, 15 nt, Human
guuagguacagagac

SEQ ID NO: 3850904 - RNA, 15 nt, Human
guuaggucucaauac

SEQ ID NO: 3850905 - RNA, 23 nt, Human
guuaguaacaugaggggacauuu

SEQ ID NO: 3850906 - RNA, 20 nt, Human
guuaguaaucuguauaauac

SEQ ID NO: 3850907 - RNA, 21 nt, Human
guuaguagcauguugagccag

SEQ ID NO: 3850908 - RNA, 20 nt, Human
guuagucgugagcucuugug

SEQ ID NO: 3850909 - RNA, 22 nt, Human
guuagucucuuguauuaaacuc

SEQ ID NO: 3850910 - RNA, 17 nt, Human
guuaguguuuuaagaaa

SEQ ID NO: 3850911 - RNA, 21 nt, Human
guuaguguuuuaagaaaugua

SEQ ID NO: 3850912 - RNA, 17 nt, Human
guuaguuauagaugucu

SEQ ID NO: 3850913 - RNA, 13 nt, Human
guuaguuucuugg

SEQ ID NO: 3850914 - RNA, 16 nt, Human
guuaguuucuuuggga

SEQ ID NO: 3850915 - RNA, 16 nt, Human
guuaguuuguauauau

SEQ ID NO: 3850916 - RNA, 22 nt, Human
guuauaaaaaaugguucagaau

SEQ ID NO: 3850917 - RNA, 12 nt, Human
guuauaaaagug

SEQ ID NO: 3850918 - RNA, 14 nt, Human
guuauaaagauaca

SEQ ID NO: 3850919 - RNA, 18 nt, Human
guuauacaaccuucauuu

SEQ ID NO: 3850920 - RNA, 18 nt, Human
guuauacaguuauaaaau

SEQ ID NO: 3850921 - RNA, 20 nt, Human
guuauacaguuauaaaauua

SEQ ID NO: 3850922 - RNA, 17 nt, Human
guuauacaugacacuga

SEQ ID NO: 3850923 - RNA, 19 nt, Human
guuauacaugacacugaaa

SEQ ID NO: 3850924 - RNA, 19 nt, Human
guuauagaacuucauggau

SEQ ID NO: 3850925 - RNA, 20 nt, Human
guuauagacagucguuccca

SEQ ID NO: 3850926 - RNA, 18 nt, Human
guuauagguccuuuagaa

SEQ ID NO: 3850927 - RNA, 21 nt, Human
guuauagguccuuuagaaaca

SEQ ID NO: 3850928 - RNA, 15 nt, Human
guuauaguauaucug

SEQ ID NO: 3850929 - RNA, 16 nt, Human
guuauaguauaucugg

SEQ ID NO: 3850930 - RNA, 21 nt, Human
guuauagugaauacugcuaca

SEQ ID NO: 3850931 - RNA, 15 nt, Human
guuauagugaauuau

SEQ ID NO: 3850932 - RNA, 15 nt, Human
guuauagugcaauau

SEQ ID NO: 3850933 - RNA, 16 nt, Human
guuauauaaagagaaa

SEQ ID NO: 3850934 - RNA, 19 nt, Human
guuauauaaagagaaaauu

SEQ ID NO: 3850935 - RNA, 16 nt, Human
guuauauauaaauaua

SEQ ID NO: 3850936 - RNA, 16 nt, Human
guuauauccccugcua

SEQ ID NO: 3850937 - RNA, 21 nt, Human
guuauauuucagauguaaugu

SEQ ID NO: 3850938 - RNA, 17 nt, Human
guuaucaaaauagucua

SEQ ID NO: 3850939 - RNA, 16 nt, Human
guuaucacugugcagu

SEQ ID NO: 3850940 - RNA, 13 nt, Human
guuaucaugaauu

SEQ ID NO: 3850941 - RNA, 16 nt, Human
guuaucaugaauuuua

SEQ ID NO: 3850942 - RNA, 20 nt, Human
guuaucaugaauuuuaaagu

SEQ ID NO: 3850943 - RNA, 23 nt, Human
guuaucauguuaguaauaccucu

SEQ ID NO: 3850944 - RNA, 17 nt, Human
guuaucauuuuuuccug

SEQ ID NO: 3850945 - RNA, 20 nt, Human
guuaucauuuuuuccuguuu

SEQ ID NO: 3850946 - RNA, 20 nt, Human
guuauccaccugccuuggcu

SEQ ID NO: 3850947 - RNA, 21 nt, Human
guuaucccuuccuuuuagccu

SEQ ID NO: 3850948 - RNA, 16 nt, Human
guucauguaaauaaua

SEQ ID NO: 3850949 - RNA, 20 nt, Human
guucauguuuggugcauaga

SEQ ID NO: 3850950 - RNA, 16 nt, Human
guucauucauauuaca

SEQ ID NO: 3850951 - RNA, 18 nt, Human
guucauuugugugcucau

SEQ ID NO: 3850952 - RNA, 18 nt, Human
guucauuuguuauucuua

SEQ ID NO: 3850953 - RNA, 15 nt, Human
guucauuuguuuguu

SEQ ID NO: 3850954 - RNA, 19 nt, Human
guuccaaaagccaauggcu

SEQ ID NO: 3850955 - RNA, 15 nt, Human
guuccaaaugaaugu

SEQ ID NO: 3850956 - RNA, 17 nt, Human
guuccaaccacugaauc

SEQ ID NO: 3850957 - RNA, 13 nt, Human
guuccaagacauu

SEQ ID NO: 3850958 - RNA, 15 nt, Human
guuccaagacauugu

SEQ ID NO: 3850959 - RNA, 21 nt, Human
guuccaagacauugucaauaa

SEQ ID NO: 3850960 - RNA, 16 nt, Human
guuccaagagucuaaa

SEQ ID NO: 3850961 - RNA, 13 nt, Human
guuccaaggccag

SEQ ID NO: 3850962 - RNA, 19 nt, Human
guuccaaguccaauaagac

SEQ ID NO: 3850963 - RNA, 20 nt, Human
guuccacagaguaagacauu

SEQ ID NO: 3850964 - RNA, 14 nt, Human
guuccacaguugcc

SEQ ID NO: 3850965 - RNA, 18 nt, Human
guuccacaguugccacca

SEQ ID NO: 3850966 - RNA, 14 nt, Human
guuccacugagcuc

SEQ ID NO: 3850967 - RNA, 15 nt, Human
guuccacugagcucc

SEQ ID NO: 3850968 - RNA, 14 nt, Human
guuccagaaaguaa

SEQ ID NO: 3850969 - RNA, 23 nt, Human
guuccagcaauucuccugccuca

SEQ ID NO: 3850970 - RNA, 13 nt, Human
guuccagccugcc

SEQ ID NO: 3850971 - RNA, 20 nt, Human
guuccagggucccucugugu

SEQ ID NO: 3850972 - RNA, 23 nt, Human
guuccaucuccuauaaucuguca

SEQ ID NO: 3850973 - RNA, 21 nt, Human
guuccauuguuuggagacauu

SEQ ID NO: 3850974 - RNA, 21 nt, Human
guucccaagagcaucaugccu

SEQ ID NO: 3850975 - RNA, 22 nt, Human
guucccagugacacuucagaga

SEQ ID NO: 3850976 - RNA, 23 nt, Human
guucccauccucuucuuuuagca

SEQ ID NO: 3850977 - RNA, 14 nt, Human
guucccauguuaaa

SEQ ID NO: 3850978 - RNA, 20 nt, Human
guucccauuugcuccuuucu

SEQ ID NO: 3850979 - RNA, 17 nt, Human
guuccccacuggagcag

SEQ ID NO: 3850980 - RNA, 20 nt, Human
guuccccacuguaucuaggc

SEQ ID NO: 3850981 - RNA, 19 nt, Human
guuccccaucuggguccuu

SEQ ID NO: 3850982 - RNA, 23 nt, Human
guuccccaucuggguccuugcac

SEQ ID NO: 3850983 - RNA, 21 nt, Human
guucccccuucacaaagccca

SEQ ID NO: 3850984 - RNA, 23 nt, Human
guuccccuaguaagugccuucca

SEQ ID NO: 3850985 - RNA, 22 nt, Human
guuccccuccuccacucucccc

SEQ ID NO: 3850986 - RNA, 18 nt, Human
guucccguuucuccaccu

SEQ ID NO: 3850987 - RNA, 15 nt, Human
guucccucucccugu

SEQ ID NO: 3850988 - RNA, 17 nt, Human
guucccucugcucagcc

SEQ ID NO: 3850989 - RNA, 21 nt, Human
guucccucugcuccuggagcc

SEQ ID NO: 3850990 - RNA, 17 nt, Human
guucccugaaaacccag

SEQ ID NO: 3850991 - RNA, 15 nt, Human
guucccugaaacacg

SEQ ID NO: 3850992 - RNA, 18 nt, Human
guucccuguucuuccucc

SEQ ID NO: 3850993 - RNA, 14 nt, Human
guucccuuggccuc

SEQ ID NO: 3850994 - RNA, 19 nt, Human
guucccuuuccuuccaucc

SEQ ID NO: 3850995 - RNA, 20 nt, Human
guucccuuugacgccauccc

SEQ ID NO: 3850996 - RNA, 21 nt, Human
guucccuuugacgccauccca

SEQ ID NO: 3850997 - RNA, 17 nt, Human
guucccuuugcuccacc

SEQ ID NO: 3850998 - RNA, 20 nt, Human
guucccuuugucuuucaaac

SEQ ID NO: 3850999 - RNA, 20 nt, Human
guuccgaaaccaaagaagaa

SEQ ID NO: 3851000 - RNA, 21 nt, Human
guuccgaaaccaaagaagaaa

SEQ ID NO: 3851001 - RNA, 14 nt, Human
guuccgcacuuucc

SEQ ID NO: 3851002 - RNA, 22 nt, Human
guuccggaauccuguccucagc

SEQ ID NO: 3851003 - RNA, 21 nt, Human
guuccuaagaagcuucuaaua

SEQ ID NO: 3851004 - RNA, 15 nt, Human
guuccuacacaggac

SEQ ID NO: 3851005 - RNA, 16 nt, Human
guuccuacacaggaca

SEQ ID NO: 3851006 - RNA, 18 nt, Human
guuccuacacaggacagg

SEQ ID NO: 3851007 - RNA, 16 nt, Human
guuccuaggggaauga

SEQ ID NO: 3851008 - RNA, 22 nt, Human
guuccuaggggaaugagggggc

SEQ ID NO: 3851009 - RNA, 17 nt, Human
guuccuccccgccuucc

SEQ ID NO: 3851010 - RNA, 23 nt, Human
guuccuccccuccuccuggacuc

SEQ ID NO: 3851011 - RNA, 13 nt, Human
guuccucgcccug

SEQ ID NO: 3851012 - RNA, 22 nt, Human
guuccucucugguggcucuuug

SEQ ID NO: 3851013 - RNA, 12 nt, Human
guuccucugccu

SEQ ID NO: 3851014 - RNA, 13 nt, Human
guuccucugccug

SEQ ID NO: 3851015 - RNA, 14 nt, Human
guuccucuuugcau

SEQ ID NO: 3851016 - RNA, 21 nt, Human
guuccugaauucuauuugcug

SEQ ID NO: 3851017 - RNA, 21 nt, Human
guuccugacaucacagcagcc

SEQ ID NO: 3851018 - RNA, 12 nt, Human
guuccugcaugc

SEQ ID NO: 3851019 - RNA, 22 nt, Human
guuccugcugcugucugggugc

SEQ ID NO: 3851020 - RNA, 12 nt, Human
guuccuggcaau

SEQ ID NO: 3851021 - RNA, 14 nt, Human
guuccuggcaguuu

SEQ ID NO: 3851022 - RNA, 23 nt, Human
guuccuggcaguuuaaaaaaauu

SEQ ID NO: 3851023 - RNA, 15 nt, Human
guuccugugcacagc

SEQ ID NO: 3851024 - RNA, 16 nt, Human
guuccugugcacagcc

SEQ ID NO: 3851025 - RNA, 14 nt, Human
guuccuuacugcag

SEQ ID NO: 3851026 - RNA, 15 nt, Human
guuccuuacugcaga

SEQ ID NO: 3851027 - RNA, 13 nt, Human
guuccuuagaccu

SEQ ID NO: 3851028 - RNA, 12 nt, Human
guuccuucccaa

SEQ ID NO: 3851029 - RNA, 14 nt, Human
guuccuucccaauc

SEQ ID NO: 3851030 - RNA, 19 nt, Human
guuccuuccucugagccuu

SEQ ID NO: 3851031 - RNA, 20 nt, Human
guuccuucuggugucugcuu

SEQ ID NO: 3851032 - RNA, 18 nt, Human
guucgacagugaauauuc

SEQ ID NO: 3851033 - RNA, 13 nt, Human
guucgcagagcuu

SEQ ID NO: 3851034 - RNA, 17 nt, Human
guucgcagccacccuga

SEQ ID NO: 3851035 - RNA, 16 nt, Human
guucgccuggagcccu

SEQ ID NO: 3851036 - RNA, 12 nt, Human
guucgcuuggcu

SEQ ID NO: 3851037 - RNA, 18 nt, Human
guucggauuuggggugga

SEQ ID NO: 3851038 - RNA, 14 nt, Human
guucguucuguuua

SEQ ID NO: 3851039 - RNA, 23 nt, Human
guucguucuuguucuguuuuguu

SEQ ID NO: 3851040 - RNA, 12 nt, Human
guucuaaagcuc

SEQ ID NO: 3851041 - RNA, 12 nt, Human
guucuaaaguuc

SEQ ID NO: 3851042 - RNA, 13 nt, Human
guucuaaaguucu

SEQ ID NO: 3851043 - RNA, 22 nt, Human
guucuaacagugaaguuuuacu

SEQ ID NO: 3851044 - RNA, 13 nt, Human
guucuaaccuccu

SEQ ID NO: 3851045 - RNA, 16 nt, Human
guucuaaccuuuacau

SEQ ID NO: 3851046 - RNA, 22 nt, Human
guucuaagaugugauauucuaa

SEQ ID NO: 3851047 - RNA, 13 nt, Human
guucuaagauucu

SEQ ID NO: 3851048 - RNA, 22 nt, Human
guucuaaggccuaggauucuaa

SEQ ID NO: 3851049 - RNA, 17 nt, Human
guucuaaggcucugaga

SEQ ID NO: 3851050 - RNA, 17 nt, Human
uggagaaauuauuuaau

SEQ ID NO: 3851051 - RNA, 19 nt, Human
uggagaaauuauuuaauaa

SEQ ID NO: 3851052 - RNA, 21 nt, Human
uggagaaauuauuuaauaaaa

SEQ ID NO: 3851053 - RNA, 17 nt, Human
uggagaacuccuagggu

SEQ ID NO: 3851054 - RNA, 14 nt, Human
uggagaagaacuga

SEQ ID NO: 3851055 - RNA, 14 nt, Human
uggagaagcacacu

SEQ ID NO: 3851056 - RNA, 18 nt, Human
uggagaagccacaggccu

SEQ ID NO: 3851057 - RNA, 22 nt, Human
uggagaagccacaggccugaga

SEQ ID NO: 3851058 - RNA, 21 nt, Human
uggagaagcucccugaaguaa

SEQ ID NO: 3851059 - RNA, 15 nt, Human
uggagaagcugcagg

SEQ ID NO: 3851060 - RNA, 18 nt, Human
uggagaagcugcaggcuu

SEQ ID NO: 3851061 - RNA, 11 nt, Human
uggagaaggaa

SEQ ID NO: 3851062 - RNA, 16 nt, Human
uggagaaucacaggcu

SEQ ID NO: 3851063 - RNA, 19 nt, Human
uggagaaucacaggcuggg

SEQ ID NO: 3851064 - RNA, 21 nt, Human
uggagaaugcaccauacucau

SEQ ID NO: 3851065 - RNA, 20 nt, Human
uggagacaaugcagaugcca

SEQ ID NO: 3851066 - RNA, 18 nt, Human
uggagacaaugucugcag

SEQ ID NO: 3851067 - RNA, 22 nt, Human
uggagacaaugucugcagcccu

SEQ ID NO: 3851068 - RNA, 12 nt, Human
uggagacagccc

SEQ ID NO: 3851069 - RNA, 21 nt, Human
uggagacagccccagagcagg

SEQ ID NO: 3851070 - RNA, 19 nt, Human
uggagaccaugcagagcgc

SEQ ID NO: 3851071 - RNA, 19 nt, Human
uggagacccugcaaacaga

SEQ ID NO: 3851072 - RNA, 19 nt, Human
uggagaccucuccuuccua

SEQ ID NO: 3851073 - RNA, 14 nt, Human
uggagaccuuaccc

SEQ ID NO: 3851074 - RNA, 12 nt, Human
uggagacgugga

SEQ ID NO: 3851075 - RNA, 13 nt, Human
uggagacuccugc

SEQ ID NO: 3851076 - RNA, 14 nt, Human
uggagacuccugcc

SEQ ID NO: 3851077 - RNA, 20 nt, Human
uggagacugcuucccauccu

SEQ ID NO: 3851078 - RNA, 20 nt, Human
uggagacuggggggcuugaa

SEQ ID NO: 3851079 - RNA, 17 nt, Human
uggagacugucucaaga

SEQ ID NO: 3851080 - RNA, 20 nt, Human
uggagacugucuggcccccc

SEQ ID NO: 3851081 - RNA, 21 nt, Human
uggagacugucuggccccccu

SEQ ID NO: 3851082 - RNA, 11 nt, Human
uggagagaagu

SEQ ID NO: 3851083 - RNA, 16 nt, Human
uggagagcccugggac

SEQ ID NO: 3851084 - RNA, 18 nt, Human
uggagagcccugggaccg

SEQ ID NO: 3851085 - RNA, 20 nt, Human
uggagagcuagaaccuggag

SEQ ID NO: 3851086 - RNA, 11 nt, Human
uggagagcugg

SEQ ID NO: 3851087 - RNA, 20 nt, Human
uggagagcuggagccuggug

SEQ ID NO: 3851088 - RNA, 19 nt, Human
uggagagcuggugcccgga

SEQ ID NO: 3851089 - RNA, 21 nt, Human
uggagaggagggaugcugccu

SEQ ID NO: 3851090 - RNA, 22 nt, Human
uggagaggagggaugcugccug

SEQ ID NO: 3851091 - RNA, 16 nt, Human
uggagagggaauguga

SEQ ID NO: 3851092 - RNA, 15 nt, Human
uguauguaaaugugc

SEQ ID NO: 3851093 - RNA, 21 nt, Human
uguauguaacaauuguuuguu

SEQ ID NO: 3851094 - RNA, 15 nt, Human
uguauguagaagcau

SEQ ID NO: 3851095 - RNA, 13 nt, Human
uguauguauaauu

SEQ ID NO: 3851096 - RNA, 15 nt, Human
uguauguauaauuca

SEQ ID NO: 3851097 - RNA, 17 nt, Human
uguaugucaaagcuuug

SEQ ID NO: 3851098 - RNA, 21 nt, Human
uguaugucagacauccauguu

SEQ ID NO: 3851099 - RNA, 18 nt, Human
uguaugucucgugguagg

SEQ ID NO: 3851100 - RNA, 11 nt, Human
uguaugucugu

SEQ ID NO: 3851101 - RNA, 14 nt, Human
uguaugucuuggac

SEQ ID NO: 3851102 - RNA, 19 nt, Human
uguaugucuuggacacugu

SEQ ID NO: 3851103 - RNA, 17 nt, Human
uguaugugcgugugugc

SEQ ID NO: 3851104 - RNA, 12 nt, Human
uguaugugugaa

SEQ ID NO: 3851105 - RNA, 15 nt, Human
uguauguguguuuuu

SEQ ID NO: 3851106 - RNA, 17 nt, Human
uggccagggugagagcu

SEQ ID NO: 3851107 - RNA, 16 nt, Human
uggccagguggccacu

SEQ ID NO: 3851108 - RNA, 14 nt, Human
uggccaguccaggc

SEQ ID NO: 3851109 - RNA, 21 nt, Human
uggccaguccaggcugccgug

SEQ ID NO: 3851110 - RNA, 23 nt, Human
uggccaguccaggcugccguggg

SEQ ID NO: 3851111 - RNA, 16 nt, Human
uggccaguggcuggau

SEQ ID NO: 3851112 - RNA, 23 nt, Human
uggccaguggcuggaucugugag

SEQ ID NO: 3851113 - RNA, 14 nt, Human
uggccagugucugu

SEQ ID NO: 3851114 - RNA, 22 nt, Human
uggccauaagcaacaauuuuca

SEQ ID NO: 3851115 - RNA, 18 nt, Human
uggccauauuuaccucag

SEQ ID NO: 3851116 - RNA, 19 nt, Human
uggccauauuuaccucagc

SEQ ID NO: 3851117 - RNA, 23 nt, Human
uggccauauuuaccucagccugg

SEQ ID NO: 3851118 - RNA, 15 nt, Human
uggccaucccuguga

SEQ ID NO: 3851119 - RNA, 16 nt, Human
uggccaucuccacccc

SEQ ID NO: 3851120 - RNA, 15 nt, Human
uggccaugacccugc

SEQ ID NO: 3851121 - RNA, 15 nt, Human
uggccaugccucagc

SEQ ID NO: 3851122 - RNA, 18 nt, Human
uggccaugccucagcccu

SEQ ID NO: 3851123 - RNA, 17 nt, Human
uggccaugcuccucuuc

SEQ ID NO: 3851124 - RNA, 13 nt, Human
uggccauggccug

SEQ ID NO: 3851125 - RNA, 14 nt, Human
uggccaugggaggc

SEQ ID NO: 3851126 - RNA, 15 nt, Human
uggccaugggaggcc

SEQ ID NO: 3851127 - RNA, 16 nt, Human
uggccaugggaggccu

SEQ ID NO: 3851128 - RNA, 23 nt, Human
uggccaugggaggccuuucccua

SEQ ID NO: 3851129 - RNA, 16 nt, Human
uggccaugguaccccc

SEQ ID NO: 3851130 - RNA, 20 nt, Human
uggccaugguccccaagacc

SEQ ID NO: 3851131 - RNA, 22 nt, Human
uggccauucuuuuuuucuuggc

SEQ ID NO: 3851132 - RNA, 19 nt, Human
uggccauuuagccaccauc

SEQ ID NO: 3851133 - RNA, 19 nt, Human
uggcccaaguggcagagcu

SEQ ID NO: 3851134 - RNA, 21 nt, Human
uggcccaaguggcagagcuug

SEQ ID NO: 3851135 - RNA, 14 nt, Human
uggcccaccaggcc

SEQ ID NO: 3851136 - RNA, 23 nt, Human
uggcccaccccacccacuucugc

SEQ ID NO: 3851137 - RNA, 13 nt, Human
uggcccacugcau

SEQ ID NO: 3851138 - RNA, 10 nt, Human
uggcccagcc

SEQ ID NO: 3851139 - RNA, 22 nt, Human
uggcccagccaaacccugucug

SEQ ID NO: 3851140 - RNA, 19 nt, Human
uggcccagcccugcuggcc

SEQ ID NO: 3851141 - RNA, 20 nt, Human
uggcccagcccugcuggccg

SEQ ID NO: 3851142 - RNA, 23 nt, Human
uggcccagccggccucucuggcc

SEQ ID NO: 3851143 - RNA, 11 nt, Human
uggcccagccu

SEQ ID NO: 3851144 - RNA, 20 nt, Human
uggcccagcggccccuccca

SEQ ID NO: 3851145 - RNA, 21 nt, Human
uggcccagcggccccucccac

SEQ ID NO: 3851146 - RNA, 13 nt, Human
uggcccagcuccc

SEQ ID NO: 3851147 - RNA, 19 nt, Human
uggcccaggaguuuggcca

SEQ ID NO: 3851148 - RNA, 13 nt, Human
uggcccagggcau

SEQ ID NO: 3851149 - RNA, 17 nt, Human
uggcccagggcccagag

SEQ ID NO: 3851150 - RNA, 20 nt, Human
uggcccagggcccagagccc

SEQ ID NO: 3851151 - RNA, 23 nt, Human
uggcccagggcccagagcccagc

SEQ ID NO: 3851152 - RNA, 19 nt, Human
uggcccagggggcuuccug

SEQ ID NO: 3851153 - RNA, 18 nt, Human
uggcccaggguggccaca

SEQ ID NO: 3851154 - RNA, 17 nt, Human
uggcccaggugaguccu

SEQ ID NO: 3851155 - RNA, 13 nt, Human
uggcccaguguca

SEQ ID NO: 3851156 - RNA, 20 nt, Human
uggcccauagaaacaugaca

SEQ ID NO: 3851157 - RNA, 23 nt, Human
uggcccaucaguguacccccgcc

SEQ ID NO: 3851158 - RNA, 17 nt, Human
uggcccauccccccuca

SEQ ID NO: 3851159 - RNA, 15 nt, Human
uggcccauucuacuu

SEQ ID NO: 3851160 - RNA, 21 nt, Human
uggcccauucuacuugcucug

SEQ ID NO: 3851161 - RNA, 20 nt, Human
uggccccaagggcaaaauuc

SEQ ID NO: 3851162 - RNA, 18 nt, Human
uggccccacccugggccc

SEQ ID NO: 3851163 - RNA, 23 nt, Human
uggccccaccuggcccucucuga

SEQ ID NO: 3851164 - RNA, 18 nt, Human
uggccccagcccugcugg

SEQ ID NO: 3851165 - RNA, 20 nt, Human
uggccccagcccugcugggg

SEQ ID NO: 3851166 - RNA, 18 nt, Human
uggccccagccuggccca

SEQ ID NO: 3851167 - RNA, 15 nt, Human
uggccccaggaccug

SEQ ID NO: 3851168 - RNA, 14 nt, Human
uggccccagggcac

SEQ ID NO: 3851169 - RNA, 19 nt, Human
uggccccaugucucucaga

SEQ ID NO: 3851170 - RNA, 17 nt, Human
uggcccccacaugguga

SEQ ID NO: 3851171 - RNA, 18 nt, Human
uggcccccacuggcugug

SEQ ID NO: 3851172 - RNA, 15 nt, Human
uggccccccuggucc

SEQ ID NO: 3851173 - RNA, 21 nt, Human
uggccccccugguccccuccu

SEQ ID NO: 3851174 - RNA, 16 nt, Human
uggcccccgagcuggg

SEQ ID NO: 3851175 - RNA, 17 nt, Human
uggcccccgagcugggg

SEQ ID NO: 3851176 - RNA, 19 nt, Human
uggcccccgagcugggggc

SEQ ID NO: 3851177 - RNA, 23 nt, Human
uggcccccgggaggacgggaccc

SEQ ID NO: 3851178 - RNA, 17 nt, Human
uggcccccuuucccggg

SEQ ID NO: 3851179 - RNA, 18 nt, Human
uggcccccuuucccgggc

SEQ ID NO: 3851180 - RNA, 20 nt, Human
uggccccgccgccugguacu

SEQ ID NO: 3851181 - RNA, 21 nt, Human
uggccccucaaaucguccagc

SEQ ID NO: 3851182 - RNA, 13 nt, Human
uggccccucaggg

SEQ ID NO: 3851183 - RNA, 14 nt, Human
uggccccucugacc

SEQ ID NO: 3851184 - RNA, 16 nt, Human
uggccccucugaccug

SEQ ID NO: 3851185 - RNA, 18 nt, Human
uggccccucugaccugca

SEQ ID NO: 3851186 - RNA, 14 nt, Human
uggccccugaacaa

SEQ ID NO: 3851187 - RNA, 23 nt, Human
uggccccuuugggcccugcaugu

SEQ ID NO: 3851188 - RNA, 14 nt, Human
uggcccgacagccu

SEQ ID NO: 3851189 - RNA, 14 nt, Human
uggcccucaguuuc

SEQ ID NO: 3851190 - RNA, 17 nt, Human
uggcccucuccccugcc

SEQ ID NO: 3851191 - RNA, 19 nt, Human
uggcccucuccccugcccc

SEQ ID NO: 3851192 - RNA, 18 nt, Human
uggcccucucccuuaccc

SEQ ID NO: 3851193 - RNA, 24 nt, Human
uggcccucucugaaggaggccacc

SEQ ID NO: 3851194 - RNA, 15 nt, Human
uggcccucugguaga

SEQ ID NO: 3851195 - RNA, 14 nt, Human
uggcccucuucuua

SEQ ID NO: 3851196 - RNA, 16 nt, Human
uggcccugaggugugg

SEQ ID NO: 3851197 - RNA, 18 nt, Human
uggcccugaggugugggg

SEQ ID NO: 3851198 - RNA, 12 nt, Human
uggcccugcccu

SEQ ID NO: 3851199 - RNA, 11 nt, Human
uggcccugccu

SEQ ID NO: 3851200 - RNA, 16 nt, Human
uggcccugccuucuuc

SEQ ID NO: 3851201 - RNA, 13 nt, Human
uggcccuggcccu

SEQ ID NO: 3851202 - RNA, 14 nt, Human
uggcccuggccugc

SEQ ID NO: 3851203 - RNA, 17 nt, Human
uggcccuggccugcugg

SEQ ID NO: 3851204 - RNA, 19 nt, Human
uggcccuggcucugcuguc

SEQ ID NO: 3851205 - RNA, 22 nt, Human
uggcccugggagaaucgcuccu

SEQ ID NO: 3851206 - RNA, 12 nt, Human
uggcccugggcg

SEQ ID NO: 3851207 - RNA, 21 nt, Human
uggcccugggcggggcguggg

SEQ ID NO: 3851208 - RNA, 16 nt, Human
uggcccuggggccugu

SEQ ID NO: 3851209 - RNA, 13 nt, Human
uggcccugggguc

SEQ ID NO: 3851210 - RNA, 19 nt, Human
uggcccuggggucccacga

SEQ ID NO: 3851211 - RNA, 22 nt, Human
uggcccugucccucccaccucu

SEQ ID NO: 3851212 - RNA, 21 nt, Human
uggcccuuacuugcuucucua

SEQ ID NO: 3851213 - RNA, 18 nt, Human
uggcccuuccuccuccac

SEQ ID NO: 3851214 - RNA, 20 nt, Human
uggcccuuccuccuccacca

SEQ ID NO: 3851215 - RNA, 17 nt, Human
uggcccuuccuggacag

SEQ ID NO: 3851216 - RNA, 18 nt, Human
uggcccuuuccuuccaga

SEQ ID NO: 3851217 - RNA, 16 nt, Human
uggccgaggacuuuga

SEQ ID NO: 3851218 - RNA, 18 nt, Human
uggccgaggguccuggcu

SEQ ID NO: 3851219 - RNA, 20 nt, Human
uggccgaggguccuggcucc

SEQ ID NO: 3851220 - RNA, 19 nt, Human
uggccgaguccaagcuggg

SEQ ID NO: 3851221 - RNA, 22 nt, Human
uggccgcaccuaaagcagccag

SEQ ID NO: 3851222 - RNA, 15 nt, Human
uggccgcccccugcc

SEQ ID NO: 3851223 - RNA, 23 nt, Human
uggccgcgccaaauaaugucucu

SEQ ID NO: 3851224 - RNA, 16 nt, Human
uggccggacacccgac

SEQ ID NO: 3851225 - RNA, 22 nt, Human
uggccggagcaaacucugcugu

SEQ ID NO: 3851226 - RNA, 14 nt, Human
uggccggccagcca

SEQ ID NO: 3851227 - RNA, 17 nt, Human
uggccggccagccagcc

SEQ ID NO: 3851228 - RNA, 23 nt, Human
uggccgggaccccgagccuggcu

SEQ ID NO: 3851229 - RNA, 13 nt, Human
uggccgggcacag

SEQ ID NO: 3851230 - RNA, 16 nt, Human
uggccgggcacagcug

SEQ ID NO: 3851231 - RNA, 12 nt, Human
uggccgggcagg

SEQ ID NO: 3851232 - RNA, 22 nt, Human
uggccggucugcaagucagagg

SEQ ID NO: 3851233 - RNA, 14 nt, Human
uggccgugggccug

SEQ ID NO: 3851234 - RNA, 19 nt, Human
uggccgugggccuggggua

SEQ ID NO: 3851235 - RNA, 19 nt, Human
uggccguugauguuggcug

SEQ ID NO: 3851236 - RNA, 21 nt, Human
guuuggauauguaaaacauuu

SEQ ID NO: 3851237 - RNA, 16 nt, Human
guuuggauguaauuua

SEQ ID NO: 3851238 - RNA, 16 nt, Human
guuuggauuuuuaauu

SEQ ID NO: 3851239 - RNA, 18 nt, Human
guuuggcgggccaaggac

SEQ ID NO: 3851240 - RNA, 18 nt, Human
guuuggcugugucuaaac

SEQ ID NO: 3851241 - RNA, 22 nt, Human
guuuggcugugucuaaacugca

SEQ ID NO: 3851242 - RNA, 19 nt, Human
guuugggauccuauugaac

SEQ ID NO: 3851243 - RNA, 16 nt, Human
guuugggccccucucc

SEQ ID NO: 3851244 - RNA, 22 nt, Human
guuuggggaaugcggccgcauu

SEQ ID NO: 3851245 - RNA, 21 nt, Human
guuuggggcaggaguagcuga

SEQ ID NO: 3851246 - RNA, 23 nt, Human
guuuggggcaggaguagcugagc

SEQ ID NO: 3851247 - RNA, 17 nt, Human
guuuggggcgaggcaga

SEQ ID NO: 3851248 - RNA, 20 nt, Human
guuuggguaaaauacuuuua

SEQ ID NO: 3851249 - RNA, 17 nt, Human
guuuggguuuuuuuccu

SEQ ID NO: 3851250 - RNA, 16 nt, Human
guuuggugcaaaguau

SEQ ID NO: 3851251 - RNA, 15 nt, Human
guuugguguguuccc

SEQ ID NO: 3851252 - RNA, 13 nt, Human
guuugguuuacau

SEQ ID NO: 3851253 - RNA, 14 nt, Human
guuugguuuacauu

SEQ ID NO: 3851254 - RNA, 15 nt, Human
guuugguuuacauuu

SEQ ID NO: 3851255 - RNA, 20 nt, Human
guuugguuuacauuuaaagc

SEQ ID NO: 3851256 - RNA, 17 nt, Human
guuugguuuuaaaauac

SEQ ID NO: 3851257 - RNA, 13 nt, Human
guuugguuuuuau

SEQ ID NO: 3851258 - RNA, 22 nt, Human
guuugguuuuuauuucuccuuu

SEQ ID NO: 3851259 - RNA, 15 nt, Human
guuuguaaauaagag

SEQ ID NO: 3851260 - RNA, 17 nt, Human
guuuguaaauaagagau

SEQ ID NO: 3851261 - RNA, 18 nt, Human
guuuguaaauaagagauu

SEQ ID NO: 3851262 - RNA, 20 nt, Human
guuuguaaauguuauuucug

SEQ ID NO: 3851263 - RNA, 15 nt, Human
guuuguaacaagaaa

SEQ ID NO: 3851264 - RNA, 13 nt, Human
guuuguaugaaac

SEQ ID NO: 3851265 - RNA, 13 nt, Human
guuuguaugugug

SEQ ID NO: 3851266 - RNA, 21 nt, Human
guuugucauuagccugaguag

SEQ ID NO: 3851267 - RNA, 15 nt, Human
guuugucuauuuuaa

SEQ ID NO: 3851268 - RNA, 18 nt, Human
guuugucucaguuggaaa

SEQ ID NO: 3851269 - RNA, 14 nt, Human
guuugucucuucug

SEQ ID NO: 3851270 - RNA, 18 nt, Human
guuugucugucuucauag

SEQ ID NO: 3851271 - RNA, 11 nt, Human
guuugucuguu

SEQ ID NO: 3851272 - RNA, 18 nt, Human
guuugucuguuuguuuca

SEQ ID NO: 3851273 - RNA, 20 nt, Human
guuugucuuggauauauagg

SEQ ID NO: 3851274 - RNA, 16 nt, Human
guuugugacagggcgg

SEQ ID NO: 3851275 - RNA, 22 nt, Human
uggccucaagaucaaugaaaug

SEQ ID NO: 3851276 - RNA, 23 nt, Human
uggccucaagugauucuccugcc

SEQ ID NO: 3851277 - RNA, 12 nt, Human
uggccucagacu

SEQ ID NO: 3851278 - RNA, 24 nt, Human
uggccucagacugcacccaggagg

SEQ ID NO: 3851279 - RNA, 13 nt, Human
uggccucagcugc

SEQ ID NO: 3851280 - RNA, 18 nt, Human
uggccucagcugccucac

SEQ ID NO: 3851281 - RNA, 18 nt, Human
uggccucauguggcugga

SEQ ID NO: 3851282 - RNA, 20 nt, Human
uggccucauguggcuggaag

SEQ ID NO: 3851283 - RNA, 23 nt, Human
uggccuccaaguccacaguggaa

SEQ ID NO: 3851284 - RNA, 21 nt, Human
uggccuccacaguucgaccug

SEQ ID NO: 3851285 - RNA, 23 nt, Human
uggccuccaggcccgucugucca

SEQ ID NO: 3851286 - RNA, 14 nt, Human
uggccucccaacuc

SEQ ID NO: 3851287 - RNA, 21 nt, Human
uggccucccaacucaccccag

SEQ ID NO: 3851288 - RNA, 23 nt, Human
uggccucccaacucaccccagcc

SEQ ID NO: 3851289 - RNA, 14 nt, Human
uggccucccacccg

SEQ ID NO: 3851290 - RNA, 15 nt, Human
uggccucccccacuu

SEQ ID NO: 3851291 - RNA, 14 nt, Human
uggccuccccugcc

SEQ ID NO: 3851292 - RNA, 17 nt, Human
uggccuccccugccacc

SEQ ID NO: 3851293 - RNA, 23 nt, Human
uggccuccccugccaccaggcca

SEQ ID NO: 3851294 - RNA, 20 nt, Human
uggccuccggcgucagccuc

SEQ ID NO: 3851295 - RNA, 16 nt, Human
uggccuccugccucua

SEQ ID NO: 3851296 - RNA, 15 nt, Human
uggccucgccuggcc

SEQ ID NO: 3851297 - RNA, 16 nt, Human
uggccucgccuggccu

SEQ ID NO: 3851298 - RNA, 19 nt, Human
uggccucgggacaccugcc

SEQ ID NO: 3851299 - RNA, 23 nt, Human
uggccucgggacaccugcccugc

SEQ ID NO: 3851300 - RNA, 17 nt, Human
uggccucucuauccucu

SEQ ID NO: 3851301 - RNA, 13 nt, Human
uggccucugcacu

SEQ ID NO: 3851302 - RNA, 20 nt, Human
uggccucugcacuccccugc

SEQ ID NO: 3851303 - RNA, 14 nt, Human
uggccucugcuuuc

SEQ ID NO: 3851304 - RNA, 15 nt, Human
uggccucugucauau

SEQ ID NO: 3851305 - RNA, 14 nt, Human
uggccucuucuaga

SEQ ID NO: 3851306 - RNA, 19 nt, Human
uggccucuugagcaguggc

SEQ ID NO: 3851307 - RNA, 22 nt, Human
uggccucuuugucuaaaacaau

SEQ ID NO: 3851308 - RNA, 14 nt, Human
uggccucuuuucag

SEQ ID NO: 3851309 - RNA, 19 nt, Human
uggccugaaccacaggaga

SEQ ID NO: 3851310 - RNA, 20 nt, Human
uggccugaaccacaggagag

SEQ ID NO: 3851311 - RNA, 19 nt, Human
uggccugagagucagcucu

SEQ ID NO: 3851312 - RNA, 18 nt, Human
uggccugagcugggauga

SEQ ID NO: 3851313 - RNA, 22 nt, Human
uggccugaucagaccacggcuc

SEQ ID NO: 3851314 - RNA, 17 nt, Human
uggccugcaaacuggga

SEQ ID NO: 3851315 - RNA, 18 nt, Human
uggccugcaaacugggaa

SEQ ID NO: 3851316 - RNA, 18 nt, Human
uggccugccuugaagcca

SEQ ID NO: 3851317 - RNA, 23 nt, Human
uggccuggagcacaaagacccug

SEQ ID NO: 3851318 - RNA, 16 nt, Human
uggccuggaggugggg

SEQ ID NO: 3851319 - RNA, 22 nt, Human
uggccuggaggugggguuggga

SEQ ID NO: 3851320 - RNA, 12 nt, Human
uggccuggaucu

SEQ ID NO: 3851321 - RNA, 10 nt, Human
uggccuggcc

SEQ ID NO: 3851322 - RNA, 18 nt, Human
uggccuggccaggagcuc

SEQ ID NO: 3851323 - RNA, 21 nt, Human
uggccuggccaggagcucuuc

SEQ ID NO: 3851324 - RNA, 13 nt, Human
uggccuggccagu

SEQ ID NO: 3851325 - RNA, 14 nt, Human
uggccuggccagug

SEQ ID NO: 3851326 - RNA, 17 nt, Human
uggccuggccagugccc

SEQ ID NO: 3851327 - RNA, 15 nt, Human
uggccuggcccugcc

SEQ ID NO: 3851328 - RNA, 18 nt, Human
uggccuggcccugcccug

SEQ ID NO: 3851329 - RNA, 20 nt, Human
uggccuggcccugcccugag

SEQ ID NO: 3851330 - RNA, 16 nt, Human
uggccuggccggcaac

SEQ ID NO: 3851331 - RNA, 16 nt, Human
uggccuggccuggccc

SEQ ID NO: 3851332 - RNA, 13 nt, Human
uggccugggagag

SEQ ID NO: 3851333 - RNA, 17 nt, Human
uggccugggagagcugg

SEQ ID NO: 3851334 - RNA, 24 nt, Human
uggccugggccguaucuccggcuc

SEQ ID NO: 3851335 - RNA, 14 nt, Human
uggccugggccucc

SEQ ID NO: 3851336 - RNA, 11 nt, Human
uggccuggggc

SEQ ID NO: 3851337 - RNA, 22 nt, Human
uggccugugcgaucccacccgu

SEQ ID NO: 3851338 - RNA, 15 nt, Human
uggccuguggccugu

SEQ ID NO: 3851339 - RNA, 12 nt, Human
uggccuguggcu

SEQ ID NO: 3851340 - RNA, 17 nt, Human
uggccuguggcugucgg

SEQ ID NO: 3851341 - RNA, 16 nt, Human
uggccugugucacuca

SEQ ID NO: 3851342 - RNA, 20 nt, Human
uggccugugucccaugaccc

SEQ ID NO: 3851343 - RNA, 22 nt, Human
uggccugugucccaugacccac

SEQ ID NO: 3851344 - RNA, 23 nt, Human
uggccuguuuuagaagguucucu

SEQ ID NO: 3851345 - RNA, 13 nt, Human
uggccuuccccag

SEQ ID NO: 3851346 - RNA, 16 nt, Human
uggccuuccccagccu

SEQ ID NO: 3851347 - RNA, 15 nt, Human
uggccuucggcccca

SEQ ID NO: 3851348 - RNA, 18 nt, Human
uggccuucggccuccauc

SEQ ID NO: 3851349 - RNA, 22 nt, Human
uggccuucggccuccauccuga

SEQ ID NO: 3851350 - RNA, 23 nt, Human
uggccuucggccuccauccugag

SEQ ID NO: 3851351 - RNA, 18 nt, Human
uggccuugggauccaggc

SEQ ID NO: 3851352 - RNA, 18 nt, Human
uggccuugggcccucugg

SEQ ID NO: 3851353 - RNA, 20 nt, Human
uggccuuguccucagccagu

SEQ ID NO: 3851354 - RNA, 16 nt, Human
uggccuugugguccaa

SEQ ID NO: 3851355 - RNA, 22 nt, Human
uggccuuguucucucuauggua

SEQ ID NO: 3851356 - RNA, 14 nt, Human
uggccuuugcgcuc

SEQ ID NO: 3851357 - RNA, 19 nt, Human
uggccuuugcgcuccuggc

SEQ ID NO: 3851358 - RNA, 17 nt, Human
uggccuuuguaagugca

SEQ ID NO: 3851359 - RNA, 13 nt, Human
uggccuuuuccua

SEQ ID NO: 3851360 - RNA, 16 nt, Human
uggccuuuuccuauuu

SEQ ID NO: 3851361 - RNA, 20 nt, Human
uggccuuuuucauuuaucua

SEQ ID NO: 3851362 - RNA, 14 nt, Human
uggcgagccauuug

SEQ ID NO: 3851363 - RNA, 14 nt, Human
uggcgaugccagcc

SEQ ID NO: 3851364 - RNA, 16 nt, Human
uggcgaugccagccaa

SEQ ID NO: 3851365 - RNA, 23 nt, Human
uggcgcagcauauucaggaagcu

SEQ ID NO: 3851366 - RNA, 16 nt, Human
uggcgcagccaaggcc

SEQ ID NO: 3851367 - RNA, 14 nt, Human
uggcgcaggugggc

SEQ ID NO: 3851368 - RNA, 17 nt, Human
uggcgccuccgagggac

SEQ ID NO: 3851369 - RNA, 13 nt, Human
uggcgcuaggcau

SEQ ID NO: 3851370 - RNA, 15 nt, Human
uggcgcugccccugg

SEQ ID NO: 3851371 - RNA, 20 nt, Human
uggcgcuuagagaggacaau

SEQ ID NO: 3851372 - RNA, 14 nt, Human
uggcggagaguuuu

SEQ ID NO: 3851373 - RNA, 15 nt, Human
uggcggcagcagcca

SEQ ID NO: 3851374 - RNA, 23 nt, Human
uggcggccccaacucgggcuccc

SEQ ID NO: 3851375 - RNA, 14 nt, Human
uggcggccccagca

SEQ ID NO: 3851376 - RNA, 19 nt, Human
uggcgggaugggccaccgc

SEQ ID NO: 3851377 - RNA, 14 nt, Human
uggcgggcgccugu

SEQ ID NO: 3851378 - RNA, 17 nt, Human
uggcgggcgccuguagu

SEQ ID NO: 3851379 - RNA, 15 nt, Human
uggcguaaguacaga

SEQ ID NO: 3851380 - RNA, 19 nt, Human
uaaaaauauggaacuucua

SEQ ID NO: 3851381 - RNA, 15 nt, Human
uaaaaauauguacaa

SEQ ID NO: 3851382 - RNA, 22 nt, Human
uaaaaauauuguguugugaaug

SEQ ID NO: 3851383 - RNA, 13 nt, Human
uaaaaaucaacuu

SEQ ID NO: 3851384 - RNA, 14 nt, Human
uaaaaaucaacuuu

SEQ ID NO: 3851385 - RNA, 14 nt, Human
uaaaaaucacacug

SEQ ID NO: 3851386 - RNA, 16 nt, Human
uaaaaaucacacugua

SEQ ID NO: 3851387 - RNA, 20 nt, Human
uaaaaaucauaaacugugug

SEQ ID NO: 3851388 - RNA, 17 nt, Human
uaaaaaucauugauugu

SEQ ID NO: 3851389 - RNA, 15 nt, Human
uaaaaaucucaaauu

SEQ ID NO: 3851390 - RNA, 15 nt, Human
uaaaaaucucuuuuc

SEQ ID NO: 3851391 - RNA, 18 nt, Human
uaaaaaugaaauuauuua

SEQ ID NO: 3851392 - RNA, 14 nt, Human
uaaaaaugaaauuu

SEQ ID NO: 3851393 - RNA, 14 nt, Human
uaaaaaugaauccu

SEQ ID NO: 3851394 - RNA, 15 nt, Human
uaaaaaugagguacu

SEQ ID NO: 3851395 - RNA, 18 nt, Human
uaaaaaugagugugaagg

SEQ ID NO: 3851396 - RNA, 17 nt, Human
uaaaaaugauacugaug

SEQ ID NO: 3851397 - RNA, 20 nt, Human
uaaaaaugcaaaaaaaauua

SEQ ID NO: 3851398 - RNA, 16 nt, Human
uaaaaaugcaaauccu

SEQ ID NO: 3851399 - RNA, 15 nt, Human
uaaaaauggacaaaa

SEQ ID NO: 3851400 - RNA, 19 nt, Human
uaaaaauggcucagaugcc

SEQ ID NO: 3851401 - RNA, 20 nt, Human
uaaaaaugggacuucuuuuc

SEQ ID NO: 3851402 - RNA, 20 nt, Human
uaaaaaugguaucaaaauua

SEQ ID NO: 3851403 - RNA, 16 nt, Human
uaaaaaugguggcuuc

SEQ ID NO: 3851404 - RNA, 23 nt, Human
uaaaaaugguggcuucagcucca

SEQ ID NO: 3851405 - RNA, 19 nt, Human
uaaaaaugguuuaaauggu

SEQ ID NO: 3851406 - RNA, 19 nt, Human
uaaaaauguaaauauucua

SEQ ID NO: 3851407 - RNA, 23 nt, Human
uaaaaauguuuuuucauguguuu

SEQ ID NO: 3851408 - RNA, 23 nt, Human
uaaaaauuaaauuggaaagcagg

SEQ ID NO: 3851409 - RNA, 19 nt, Human
uaaaaauuaaggcaacuga

SEQ ID NO: 3851410 - RNA, 19 nt, Human
uaaaaauuccagaaugaag

SEQ ID NO: 3851411 - RNA, 17 nt, Human
uaaaaauugugaucaga

SEQ ID NO: 3851412 - RNA, 12 nt, Human
uaaaaauuguua

SEQ ID NO: 3851413 - RNA, 15 nt, Human
uaaaaauuuacuaca

SEQ ID NO: 3851414 - RNA, 13 nt, Human
uaaaacaaaaaac

SEQ ID NO: 3851415 - RNA, 15 nt, Human
uaaaacaaaaaacaa

SEQ ID NO: 3851416 - RNA, 21 nt, Human
uaaaacaaaaaacaauauuua

SEQ ID NO: 3851417 - RNA, 22 nt, Human
uaaaacaaaaaacaauauuuau

SEQ ID NO: 3851418 - RNA, 16 nt, Human
uaaaacaaaagcucau

SEQ ID NO: 3851419 - RNA, 14 nt, Human
uaaaacaaagccac

SEQ ID NO: 3851420 - RNA, 22 nt, Human
uaaaacaaagccacuuucaauc

SEQ ID NO: 3851421 - RNA, 15 nt, Human
uaaaacaacacucac

SEQ ID NO: 3851422 - RNA, 19 nt, Human
uaaaacaacagauguacga

SEQ ID NO: 3851423 - RNA, 16 nt, Human
uaaaacaacagcucga

SEQ ID NO: 3851424 - RNA, 18 nt, Human
uaaaacaagaaaguuucc

SEQ ID NO: 3851425 - RNA, 23 nt, Human
uaaaacaauaaaauuuuuuuuca

SEQ ID NO: 3851426 - RNA, 18 nt, Human
uaaaacaauauuguuucu

SEQ ID NO: 3851427 - RNA, 13 nt, Human
uaaaacaaugaau

SEQ ID NO: 3851428 - RNA, 14 nt, Human
uaaaacacacaggu

SEQ ID NO: 3851429 - RNA, 23 nt, Human
uaaaacaccuaaauaaccaaucu

SEQ ID NO: 3851430 - RNA, 16 nt, Human
uaaaacaccucugcuu

SEQ ID NO: 3851431 - RNA, 22 nt, Human
uaaaacaccucugcuuucugau

SEQ ID NO: 3851432 - RNA, 17 nt, Human
uaaaacacuuucaaaac

SEQ ID NO: 3851433 - RNA, 18 nt, Human
uaaaacagcugucucuaa

SEQ ID NO: 3851434 - RNA, 21 nt, Human
uaaaacagguuauaacagugu

SEQ ID NO: 3851435 - RNA, 17 nt, Human
uaaaacaguauuuauuu

SEQ ID NO: 3851436 - RNA, 22 nt, Human
uaaaacaguauuuauuuuguaa

SEQ ID NO: 3851437 - RNA, 16 nt, Human
uaaaacaucauuccuu

SEQ ID NO: 3851438 - RNA, 17 nt, Human
uaaaacaucauuccuuu

SEQ ID NO: 3851439 - RNA, 12 nt, Human
uaaaacauguaa

SEQ ID NO: 3851440 - RNA, 15 nt, Human
uaaaacauuaaaaua

SEQ ID NO: 3851441 - RNA, 19 nt, Human
uaaaacauuaaaauauaau

SEQ ID NO: 3851442 - RNA, 13 nt, Human
uaaaacauuaaga

SEQ ID NO: 3851443 - RNA, 16 nt, Human
uaaaacauuaagaaaa

SEQ ID NO: 3851444 - RNA, 20 nt, Human
uaaaacauuauagauuuuca

SEQ ID NO: 3851445 - RNA, 17 nt, Human
uaaaacauuggauuauc

SEQ ID NO: 3851446 - RNA, 16 nt, Human
uaaaacauuuuaaaug

SEQ ID NO: 3851447 - RNA, 17 nt, Human
uaaaacauuuuaaaugg

SEQ ID NO: 3851448 - RNA, 21 nt, Human
uaaaacauuuuaaauggacag

SEQ ID NO: 3851449 - RNA, 22 nt, Human
uaaaacauuuuaaauggacaga

SEQ ID NO: 3851450 - RNA, 18 nt, Human
uaaaacauuuucacacaa

SEQ ID NO: 3851451 - RNA, 13 nt, Human
uaaaaccaaagag

SEQ ID NO: 3851452 - RNA, 13 nt, Human
uaaaaccacagca

SEQ ID NO: 3851453 - RNA, 17 nt, Human
uaaaaccaggcuuucua

SEQ ID NO: 3851454 - RNA, 21 nt, Human
uaaaaccccagccaacucauu

SEQ ID NO: 3851455 - RNA, 18 nt, Human
uaaaaccccaucucuaca

SEQ ID NO: 3851456 - RNA, 17 nt, Human
uaaaaccugcuuuucaa

SEQ ID NO: 3851457 - RNA, 14 nt, Human
uaaaaccugggauu

SEQ ID NO: 3851458 - RNA, 14 nt, Human
uaaaaccuuucaaa

SEQ ID NO: 3851459 - RNA, 18 nt, Human
uaaaacgcaguugcaaac

SEQ ID NO: 3851460 - RNA, 10 nt, Human
uaaaacuaaa

SEQ ID NO: 3851461 - RNA, 17 nt, Human
uaaaacuaaauuucacu

SEQ ID NO: 3851462 - RNA, 17 nt, Human
uaaaacugaagucugaa

SEQ ID NO: 3851463 - RNA, 16 nt, Human
uaaaacuggcaucuga

SEQ ID NO: 3851464 - RNA, 22 nt, Human
uaaaacuguacuuugauucaca

SEQ ID NO: 3851465 - RNA, 22 nt, Human
uaaaacuuauccuccaugaaua

SEQ ID NO: 3851466 - RNA, 13 nt, Human
uaaaacuucuuaa

SEQ ID NO: 3851467 - RNA, 13 nt, Human
uaaaacuuuccuc

SEQ ID NO: 3851468 - RNA, 23 nt, Human
uaaaacuuuuuauauuuuauaca

SEQ ID NO: 3851469 - RNA, 15 nt, Human
uaaaagaaaaaauga

SEQ ID NO: 3851470 - RNA, 17 nt, Human
uaaaagaaaaaaugaca

SEQ ID NO: 3851471 - RNA, 21 nt, Human
uaaaagaaaauaaaaaaaaga

SEQ ID NO: 3851472 - RNA, 22 nt, Human
uaaaagaaaauaaaaaaaagaa

SEQ ID NO: 3851473 - RNA, 14 nt, Human
uaaaagaaacuuuc

SEQ ID NO: 3851474 - RNA, 22 nt, Human
uaaaagaaagccucagagaauu

SEQ ID NO: 3851475 - RNA, 15 nt, Human
uaaaagaaaggguuc

SEQ ID NO: 3851476 - RNA, 17 nt, Human
uaaaagaaaugcacaau

SEQ ID NO: 3851477 - RNA, 21 nt, Human
uaaaagaaaugcacaaugucu

SEQ ID NO: 3851478 - RNA, 22 nt, Human
uaaaagaaaugcacaaugucuu

SEQ ID NO: 3851479 - RNA, 23 nt, Human
uaaaagaauauuuuaacuuccuu

SEQ ID NO: 3851480 - RNA, 15 nt, Human
uaaaagaaugacuau

SEQ ID NO: 3851481 - RNA, 17 nt, Human
uguggaaucuggaguga

SEQ ID NO: 3851482 - RNA, 17 nt, Human
uguggaauguuggauaa

SEQ ID NO: 3851483 - RNA, 13 nt, Human
uguggacacagcu

SEQ ID NO: 3851484 - RNA, 19 nt, Human
uguggaccacugcaugagc

SEQ ID NO: 3851485 - RNA, 12 nt, Human
uguggacucugg

SEQ ID NO: 3851486 - RNA, 23 nt, Human
uguggagaaauaaaaauaccucu

SEQ ID NO: 3851487 - RNA, 12 nt, Human
uguggagaagcg

SEQ ID NO: 3851488 - RNA, 21 nt, Human
uguggagaagcggcuggcagc

SEQ ID NO: 3851489 - RNA, 18 nt, Human
uguggagacaaugucugc

SEQ ID NO: 3851490 - RNA, 22 nt, Human
uguggagacugcuccugagccc

SEQ ID NO: 3851491 - RNA, 19 nt, Human
uguggagagggaaugugaa

SEQ ID NO: 3851492 - RNA, 14 nt, Human
uguggagccaggcg

SEQ ID NO: 3851493 - RNA, 18 nt, Human
uguggagcccgcaccccc

SEQ ID NO: 3851494 - RNA, 20 nt, Human
uguggagccgaggccuaccc

SEQ ID NO: 3851495 - RNA, 21 nt, Human
uguggaggaaggauuguaaaa

SEQ ID NO: 3851496 - RNA, 20 nt, Human
uguggaggaguccaggccau

SEQ ID NO: 3851497 - RNA, 21 nt, Human
uguggagguacacucuuauag

SEQ ID NO: 3851498 - RNA, 12 nt, Human
uguggagugggg

SEQ ID NO: 3851499 - RNA, 14 nt, Human
uguggauaacaaag

SEQ ID NO: 3851500 - RNA, 15 nt, Human
uguggauauaaaaug

SEQ ID NO: 3851501 - RNA, 23 nt, Human
uguggaugagcccucagaacccu

SEQ ID NO: 3851502 - RNA, 22 nt, Human
uguggaugccgauuucuguaaa

SEQ ID NO: 3851503 - RNA, 21 nt, Human
uguggaugccuguggaagagu

SEQ ID NO: 3851504 - RNA, 22 nt, Human
uguggaugccuguggaagagug

SEQ ID NO: 3851505 - RNA, 19 nt, Human
uguggauguuuuaauucca

SEQ ID NO: 3851506 - RNA, 19 nt, Human
uguggauuuaacagaaaug

SEQ ID NO: 3851507 - RNA, 16 nt, Human
uguggauuuuuuccua

SEQ ID NO: 3851508 - RNA, 19 nt, Human
uguggcaauagugggcccu

SEQ ID NO: 3851509 - RNA, 18 nt, Human
uguggcaaucugugggcu

SEQ ID NO: 3851510 - RNA, 18 nt, Human
uguggcacuugccugggu

SEQ ID NO: 3851511 - RNA, 19 nt, Human
uguggcacuugccuggguc

SEQ ID NO: 3851512 - RNA, 19 nt, Human
uguggcagaguuacaguuc

SEQ ID NO: 3851513 - RNA, 21 nt, Human
uguggcaguaaagagaaacuu

SEQ ID NO: 3851514 - RNA, 11 nt, Human
uguggcagugg

SEQ ID NO: 3851515 - RNA, 12 nt, Human
uguggcaguggu

SEQ ID NO: 3851516 - RNA, 15 nt, Human
uguggcauugaaaug

SEQ ID NO: 3851517 - RNA, 24 nt, Human
uguggccaaaggagggucaggaag

SEQ ID NO: 3851518 - RNA, 14 nt, Human
uguggccaaggagc

SEQ ID NO: 3851519 - RNA, 17 nt, Human
uguggccaaggagcugc

SEQ ID NO: 3851520 - RNA, 20 nt, Human
uguggccaaggagcugcuau

SEQ ID NO: 3851521 - RNA, 12 nt, Human
uguggccaggcu

SEQ ID NO: 3851522 - RNA, 12 nt, Human
uguggccccacc

SEQ ID NO: 3851523 - RNA, 17 nt, Human
uguggccccacccuggg

SEQ ID NO: 3851524 - RNA, 21 nt, Human
ugguccuagaggcccuuugcu

SEQ ID NO: 3851525 - RNA, 16 nt, Human
ugguccuaggcuggaa

SEQ ID NO: 3851526 - RNA, 15 nt, Human
ugguccucuugccuc

SEQ ID NO: 3851527 - RNA, 19 nt, Human
ugguccugacucaacaugu

SEQ ID NO: 3851528 - RNA, 14 nt, Human
ugguccugagaccu

SEQ ID NO: 3851529 - RNA, 13 nt, Human
ugguccugcugca

SEQ ID NO: 3851530 - RNA, 15 nt, Human
ugguccugcugcagu

SEQ ID NO: 3851531 - RNA, 23 nt, Human
ugguccugcugcaguugccaguc

SEQ ID NO: 3851532 - RNA, 14 nt, Human
ugguccuggggcuc

SEQ ID NO: 3851533 - RNA, 15 nt, Human
ugguccuuucuuccg

SEQ ID NO: 3851534 - RNA, 20 nt, Human
uggucgaaaguuaguaggau

SEQ ID NO: 3851535 - RNA, 23 nt, Human
uggucgagaaagaggcaccagga

SEQ ID NO: 3851536 - RNA, 20 nt, Human
uggucgaggaguaacaauac

SEQ ID NO: 3851537 - RNA, 23 nt, Human
uggucuaacacuggcauguucaa

SEQ ID NO: 3851538 - RNA, 15 nt, Human
uggucuaauguuuaa

SEQ ID NO: 3851539 - RNA, 21 nt, Human
uggucuaauguuuaagcagaa

SEQ ID NO: 3851540 - RNA, 15 nt, Human
uggucuacacugugc

SEQ ID NO: 3851541 - RNA, 16 nt, Human
uggucuacacugugcu

SEQ ID NO: 3851542 - RNA, 23 nt, Human
uguugccuauaagccaaaauuaa

SEQ ID NO: 3851543 - RNA, 22 nt, Human
uguugccuugaaccacuucccu

SEQ ID NO: 3851544 - RNA, 14 nt, Human
uguugcuaacagca

SEQ ID NO: 3851545 - RNA, 16 nt, Human
uguugcuauaauaaag

SEQ ID NO: 3851546 - RNA, 21 nt, Human
uguugcucaaaucuauucaga

SEQ ID NO: 3851547 - RNA, 17 nt, Human
uguugcucucugugucu

SEQ ID NO: 3851548 - RNA, 14 nt, Human
uguugcugccaacc

SEQ ID NO: 3851549 - RNA, 16 nt, Human
uguugcuggaucagga

SEQ ID NO: 3851550 - RNA, 16 nt, Human
uguugcuguugauguu

SEQ ID NO: 3851551 - RNA, 13 nt, Human
uguugcuuacaau

SEQ ID NO: 3851552 - RNA, 20 nt, Human
uguugcuuagucacuuauuu

SEQ ID NO: 3851553 - RNA, 14 nt, Human
uguugcuuauguug

SEQ ID NO: 3851554 - RNA, 16 nt, Human
uguugcuuuguugcac

SEQ ID NO: 3851555 - RNA, 21 nt, Human
uguugcuuuugugaacuuuuu

SEQ ID NO: 3851556 - RNA, 13 nt, Human
uguuggaaaguaa

SEQ ID NO: 3851557 - RNA, 14 nt, Human
uguuggacaaaugu

SEQ ID NO: 3851558 - RNA, 16 nt, Human
uguuggacaaauguga

SEQ ID NO: 3851559 - RNA, 17 nt, Human
uguuggagaagaacuga

SEQ ID NO: 3851560 - RNA, 20 nt, Human
uguuggagaagaacugaaau

SEQ ID NO: 3851561 - RNA, 14 nt, Human
uguuggaucuucaa

SEQ ID NO: 3851562 - RNA, 20 nt, Human
uguuggauuuguuuaaaagg

SEQ ID NO: 3851563 - RNA, 20 nt, Human
uguuggauuuuugucuugug

SEQ ID NO: 3851564 - RNA, 19 nt, Human
uguuggcacauccuaugca

SEQ ID NO: 3851565 - RNA, 23 nt, Human
uguuggcagaugcagcucuuccu

SEQ ID NO: 3851566 - RNA, 11 nt, Human
uguuggccagg

SEQ ID NO: 3851567 - RNA, 18 nt, Human
uguuggccaggcugcucu

SEQ ID NO: 3851568 - RNA, 15 nt, Human
uguuggccaggcugg

SEQ ID NO: 3851569 - RNA, 15 nt, Human
uguuggccucugcaa

SEQ ID NO: 3851570 - RNA, 21 nt, Human
uguuggcguaggcuacagaga

SEQ ID NO: 3851571 - RNA, 15 nt, Human
uguuggcuaaugaag

SEQ ID NO: 3851572 - RNA, 14 nt, Human
uguugggagagggc

SEQ ID NO: 3851573 - RNA, 17 nt, Human
uguugggagagggcgca

SEQ ID NO: 3851574 - RNA, 20 nt, Human
uguugggagagggcgcaggc

SEQ ID NO: 3851575 - RNA, 18 nt, Human
uguugggauacugcaggg

SEQ ID NO: 3851576 - RNA, 17 nt, Human
uguugggauuccugacc

SEQ ID NO: 3851577 - RNA, 13 nt, Human
uguugggccagga

SEQ ID NO: 3851578 - RNA, 16 nt, Human
uguugggccaggagcc

SEQ ID NO: 3851579 - RNA, 17 nt, Human
uguugggguggguauaa

SEQ ID NO: 3851580 - RNA, 23 nt, Human
uguugggguggguauaaaagaug

SEQ ID NO: 3851581 - RNA, 15 nt, Human
uguugguauuuaucu

SEQ ID NO: 3851582 - RNA, 15 nt, Human
uguuggucuguacug

SEQ ID NO: 3851583 - RNA, 11 nt, Human
uguuggugcac

SEQ ID NO: 3851584 - RNA, 14 nt, Human
uguugguuccaagc

SEQ ID NO: 3851585 - RNA, 19 nt, Human
uguugguugcacuuuguag

SEQ ID NO: 3851586 - RNA, 15 nt, Human
uguugguugguuuuc

SEQ ID NO: 3851587 - RNA, 19 nt, Human
uguugguuguuuuuuccuu

SEQ ID NO: 3851588 - RNA, 20 nt, Human
uguugguuguuuuuuccuuu

SEQ ID NO: 3851589 - RNA, 17 nt, Human
uguugguuuacuuucaa

SEQ ID NO: 3851590 - RNA, 17 nt, Human
uguugguuuugacugga

SEQ ID NO: 3851591 - RNA, 17 nt, Human
uguuguaaaaagaaaaa

SEQ ID NO: 3851592 - RNA, 22 nt, Human
uguuguaaaacaaaauuugacu

SEQ ID NO: 3851593 - RNA, 15 nt, Human
uguuguaaauuagga

SEQ ID NO: 3851594 - RNA, 24 nt, Human
uguuguaacuuauguagauauuug

SEQ ID NO: 3851595 - RNA, 15 nt, Human
uguuguaagaauucu

SEQ ID NO: 3851596 - RNA, 16 nt, Human
uguuguaagaauucug

SEQ ID NO: 3851597 - RNA, 14 nt, Human
uguuguaagcaaca

SEQ ID NO: 3851598 - RNA, 16 nt, Human
uguuguacauuuauga

SEQ ID NO: 3851599 - RNA, 17 nt, Human
uguuguacauuuaugau

SEQ ID NO: 3851600 - RNA, 23 nt, Human
uguuguacauuuaugauuuaaua

SEQ ID NO: 3851601 - RNA, 21 nt, Human
uguuguacucaauuuuaacaa

SEQ ID NO: 3851602 - RNA, 21 nt, Human
uguuguagauacaaucagcug

SEQ ID NO: 3851603 - RNA, 14 nt, Human
uguuguauaaauuu

SEQ ID NO: 3851604 - RNA, 16 nt, Human
uguuguauuaacaaaa

SEQ ID NO: 3851605 - RNA, 14 nt, Human
uguuguauucauug

SEQ ID NO: 3851606 - RNA, 13 nt, Human
uguuguauuuuaa

SEQ ID NO: 3851607 - RNA, 20 nt, Human
uguugucaagaauagcauug

SEQ ID NO: 3851608 - RNA, 13 nt, Human
uguugucaccuuc

SEQ ID NO: 3851609 - RNA, 19 nt, Human
uguugucauugcuuuacug

SEQ ID NO: 3851610 - RNA, 20 nt, Human
uguugucauugcuuuacugg

SEQ ID NO: 3851611 - RNA, 21 nt, Human
uguugucauuguaaacaaacu

SEQ ID NO: 3851612 - RNA, 13 nt, Human
uguugucccuucu

SEQ ID NO: 3851613 - RNA, 16 nt, Human
uguuguccuuuucaua

SEQ ID NO: 3851614 - RNA, 13 nt, Human
uguugucugcaac

SEQ ID NO: 3851615 - RNA, 12 nt, Human
uguugucuugaa

SEQ ID NO: 3851616 - RNA, 19 nt, Human
uguugugaauaauuacagu

SEQ ID NO: 3851617 - RNA, 14 nt, Human
uguugugauguauu

SEQ ID NO: 3851618 - RNA, 13 nt, Human
uguugugaugucu

SEQ ID NO: 3851619 - RNA, 15 nt, Human
uguugugcuuucaag

SEQ ID NO: 3851620 - RNA, 14 nt, Human
uguugugugccucu

SEQ ID NO: 3851621 - RNA, 15 nt, Human
uguugugugccucua

SEQ ID NO: 3851622 - RNA, 21 nt, Human
uguuguuaaugaaaaugucag

SEQ ID NO: 3851623 - RNA, 21 nt, Human
uguuguuaucuguuugagaaa

SEQ ID NO: 3851624 - RNA, 17 nt, Human
uguuguuaugaugugcu

SEQ ID NO: 3851625 - RNA, 14 nt, Human
uguuguuaugcuau

SEQ ID NO: 3851626 - RNA, 13 nt, Human
uguuguuauuuaa

SEQ ID NO: 3851627 - RNA, 14 nt, Human
uguuguuccuuuug

SEQ ID NO: 3851628 - RNA, 22 nt, Human
uguuguucuguuaacugaauac

SEQ ID NO: 3851629 - RNA, 20 nt, Human
uguuguuuauaauaaaaaua

SEQ ID NO: 3851630 - RNA, 21 nt, Human
uguuguuuauaauaaaaauau

SEQ ID NO: 3851631 - RNA, 13 nt, Human
uguuguuucagug

SEQ ID NO: 3851632 - RNA, 16 nt, Human
uguuguuucuuaaaua

SEQ ID NO: 3851633 - RNA, 20 nt, Human
uguuguuucuuaauuuggaa

SEQ ID NO: 3851634 - RNA, 15 nt, Human
uguuguuucuuucua

SEQ ID NO: 3851635 - RNA, 12 nt, Human
uguuguuuguau

SEQ ID NO: 3851636 - RNA, 18 nt, Human
uguuguuuuacuaaagaa

SEQ ID NO: 3851637 - RNA, 11 nt, Human
uguuguuuugu

SEQ ID NO: 3851638 - RNA, 19 nt, Human
uguuguuuuguacagaugu

SEQ ID NO: 3851639 - RNA, 15 nt, Human
uguuguuuuuggaug

SEQ ID NO: 3851640 - RNA, 18 nt, Human
uguuuaaaaaaccacaug

SEQ ID NO: 3851641 - RNA, 19 nt, Human
uguuuaaaaaaguuuaaaa

SEQ ID NO: 3851642 - RNA, 20 nt, Human
uguuuaaaaaccgaauaaau

SEQ ID NO: 3851643 - RNA, 12 nt, Human
uguuuaaaacau

SEQ ID NO: 3851644 - RNA, 16 nt, Human
uguuuaaaacaucauu

SEQ ID NO: 3851645 - RNA, 15 nt, Human
uguuuaaaauaaaau

SEQ ID NO: 3851646 - RNA, 13 nt, Human
uguuuaaaaucau

SEQ ID NO: 3851647 - RNA, 17 nt, Human
uguuuaaaaucauuucu

SEQ ID NO: 3851648 - RNA, 14 nt, Human
uguuuaaaauguaa

SEQ ID NO: 3851649 - RNA, 22 nt, Human
uguuuaaaauguaauuuaaaug

SEQ ID NO: 3851650 - RNA, 13 nt, Human
uguuuaaaauuuc

SEQ ID NO: 3851651 - RNA, 21 nt, Human
uguuuaaaauuucuuagaaaa

SEQ ID NO: 3851652 - RNA, 14 nt, Human
uguuuaaaccuuuu

SEQ ID NO: 3851653 - RNA, 13 nt, Human
uguuuaaaguggc

SEQ ID NO: 3851654 - RNA, 12 nt, Human
uguuuaaaguuc

SEQ ID NO: 3851655 - RNA, 19 nt, Human
uguuuaacuuaaucaauua

SEQ ID NO: 3851656 - RNA, 21 nt, Human
uguuuaagaaaaguauuuuga

SEQ ID NO: 3851657 - RNA, 14 nt, Human
uguuuaagaugggc

SEQ ID NO: 3851658 - RNA, 14 nt, Human
uguuuaagauuuaa

SEQ ID NO: 3851659 - RNA, 22 nt, Human
uguuuaagauuuaauuugccaa

SEQ ID NO: 3851660 - RNA, 19 nt, Human
uguuuaagcagaauuggaa

SEQ ID NO: 3851661 - RNA, 17 nt, Human
uguuuaauaaagcgaaa

SEQ ID NO: 3851662 - RNA, 20 nt, Human
uguuuaauauugagaaagaa

SEQ ID NO: 3851663 - RNA, 20 nt, Human
uguuuaaucauauaaauaga

SEQ ID NO: 3851664 - RNA, 23 nt, Human
uguuuaaucauauaaauagaaug

SEQ ID NO: 3851665 - RNA, 24 nt, Human
uguuuaaucauauaaauagaaugu

SEQ ID NO: 3851666 - RNA, 14 nt, Human
uguuuaaucuguua

SEQ ID NO: 3851667 - RNA, 13 nt, Human
uguuuaaugugaa

SEQ ID NO: 3851668 - RNA, 14 nt, Human
uguuuaaugugaac

SEQ ID NO: 3851669 - RNA, 17 nt, Human
uguuuaaugugaacuug

SEQ ID NO: 3851670 - RNA, 21 nt, Human
uaaauguagcuucagucauua

SEQ ID NO: 3851671 - RNA, 22 nt, Human
uaaauguauaaauauacaguau

SEQ ID NO: 3851672 - RNA, 19 nt, Human
uaaauguaucuuauucaca

SEQ ID NO: 3851673 - RNA, 14 nt, Human
uaaaugucccuaau

SEQ ID NO: 3851674 - RNA, 15 nt, Human
uaaaugucuaaugua

SEQ ID NO: 3851675 - RNA, 12 nt, Human
uaaaugucuguu

SEQ ID NO: 3851676 - RNA, 20 nt, Human
uaaaugucuuuaaugcaaua

SEQ ID NO: 3851677 - RNA, 17 nt, Human
uaaaugucuuuguaagu

SEQ ID NO: 3851678 - RNA, 21 nt, Human
uaaaugucuuuuuuuuaaugu

SEQ ID NO: 3851679 - RNA, 23 nt, Human
uaaaugucuuuuuuuuaaugugc

SEQ ID NO: 3851680 - RNA, 16 nt, Human
uaaauguguguaugug

SEQ ID NO: 3851681 - RNA, 13 nt, Human
uaaauguuaaaga

SEQ ID NO: 3851682 - RNA, 17 nt, Human
uaaauguuaaagaugua

SEQ ID NO: 3851683 - RNA, 23 nt, Human
uaaauguuaauggauuucagaag

SEQ ID NO: 3851684 - RNA, 16 nt, Human
uaaauguuaccucuga

SEQ ID NO: 3851685 - RNA, 21 nt, Human
uaaauguuaguuucuugguaa

SEQ ID NO: 3851686 - RNA, 21 nt, Human
uaaauguuaugacuauguaaa

SEQ ID NO: 3851687 - RNA, 15 nt, Human
uaaauguuauguaua

SEQ ID NO: 3851688 - RNA, 16 nt, Human
uaaauguuauguauau

SEQ ID NO: 3851689 - RNA, 13 nt, Human
uaaauguucuaug

SEQ ID NO: 3851690 - RNA, 20 nt, Human
uaaauguugaaagaucaaaa

SEQ ID NO: 3851691 - RNA, 21 nt, Human
uaaauguuucuuuuaaagacc

SEQ ID NO: 3851692 - RNA, 22 nt, Human
uaaauguuuggcauguaaaugu

SEQ ID NO: 3851693 - RNA, 16 nt, Human
uaaauguuuuauaagu

SEQ ID NO: 3851694 - RNA, 17 nt, Human
uaaauguuuuauaaguu

SEQ ID NO: 3851695 - RNA, 21 nt, Human
uaaauguuuuguaaacuuuga

SEQ ID NO: 3851696 - RNA, 12 nt, Human
uaaauuaaacaa

SEQ ID NO: 3851697 - RNA, 13 nt, Human
uaaauuaaacaau

SEQ ID NO: 3851698 - RNA, 22 nt, Human
uaaauuaaacaauuuauuuuau

SEQ ID NO: 3851699 - RNA, 19 nt, Human
uaaauuaaagccuuuagua

SEQ ID NO: 3851700 - RNA, 15 nt, Human
uaaauuaaauaaaau

SEQ ID NO: 3851701 - RNA, 18 nt, Human
uaaauuaacuuuuauaaa

SEQ ID NO: 3851702 - RNA, 20 nt, Human
uaaauuaacuuuuauaaacu

SEQ ID NO: 3851703 - RNA, 13 nt, Human
uaaauuaagacau

SEQ ID NO: 3851704 - RNA, 16 nt, Human
uaaauuacagaaauuu

SEQ ID NO: 3851705 - RNA, 16 nt, Human
uaaauuacauuuguaa

SEQ ID NO: 3851706 - RNA, 13 nt, Human
uaaauuagaaaau

SEQ ID NO: 3851707 - RNA, 16 nt, Human
uaaauuagaaaauauu

SEQ ID NO: 3851708 - RNA, 18 nt, Human
uaaauuaguauuuauuua

SEQ ID NO: 3851709 - RNA, 22 nt, Human
uaaauuauaacuuaaaauauuu

SEQ ID NO: 3851710 - RNA, 15 nt, Human
uaaauuauaaggacu

SEQ ID NO: 3851711 - RNA, 15 nt, Human
uaaauuauacaaauu

SEQ ID NO: 3851712 - RNA, 19 nt, Human
uaaauuauaguguagaaaa

SEQ ID NO: 3851713 - RNA, 22 nt, Human
uguuuagucuugucucagauuu

SEQ ID NO: 3851714 - RNA, 23 nt, Human
uguuuagucuugucucagauuuu

SEQ ID NO: 3851715 - RNA, 13 nt, Human
uguuuaguggaaa

SEQ ID NO: 3851716 - RNA, 19 nt, Human
uguuuauaaaucuuaugcu

SEQ ID NO: 3851717 - RNA, 16 nt, Human
uguuuauauaaaugcu

SEQ ID NO: 3851718 - RNA, 17 nt, Human
uguuuauauggaagaaa

SEQ ID NO: 3851719 - RNA, 15 nt, Human
uguuuauauguguug

SEQ ID NO: 3851720 - RNA, 15 nt, Human
uguuuaucagauaca

SEQ ID NO: 3851721 - RNA, 17 nt, Human
uguuuauccuuucauau

SEQ ID NO: 3851722 - RNA, 22 nt, Human
uguuuauggcaauuuaacaugu

SEQ ID NO: 3851723 - RNA, 13 nt, Human
uguuuaugguaaa

SEQ ID NO: 3851724 - RNA, 15 nt, Human
uguuuauguaaacaa

SEQ ID NO: 3851725 - RNA, 14 nt, Human
uguuuauguaauuu

SEQ ID NO: 3851726 - RNA, 17 nt, Human
uguuuauguaauuucag

SEQ ID NO: 3851727 - RNA, 13 nt, Human
uguuuaugugugu

SEQ ID NO: 3851728 - RNA, 13 nt, Human
uguuuauuaaaua

SEQ ID NO: 3851729 - RNA, 13 nt, Human
uguuuauuaacaa

SEQ ID NO: 3851730 - RNA, 19 nt, Human
uguuuauuaacaaauuaug

SEQ ID NO: 3851731 - RNA, 14 nt, Human
uguuuauuacagua

SEQ ID NO: 3851732 - RNA, 15 nt, Human
uguuuauuacuucca

SEQ ID NO: 3851733 - RNA, 16 nt, Human
uguuuauucaaacuga

SEQ ID NO: 3851734 - RNA, 21 nt, Human
uguuuauucaaacugaaaagc

SEQ ID NO: 3851735 - RNA, 16 nt, Human
uguuuauucuucuaga

SEQ ID NO: 3851736 - RNA, 21 nt, Human
uguuuauucuugaugaaaagc

SEQ ID NO: 3851737 - RNA, 14 nt, Human
uguuuauugaguuu

SEQ ID NO: 3851738 - RNA, 14 nt, Human
uguuuauuucuguu

SEQ ID NO: 3851739 - RNA, 16 nt, Human
uguuuauuuuauauua

SEQ ID NO: 3851740 - RNA, 16 nt, Human
uguuuauuuuucauau

SEQ ID NO: 3851741 - RNA, 13 nt, Human
uguuucaaacaua

SEQ ID NO: 3851742 - RNA, 19 nt, Human
uguuucaaacauauauaac

SEQ ID NO: 3851743 - RNA, 17 nt, Human
uguuucaaacaugccca

SEQ ID NO: 3851744 - RNA, 21 nt, Human
uguuucaaguggggcucgcca

SEQ ID NO: 3851745 - RNA, 12 nt, Human
uguuucacaguu

SEQ ID NO: 3851746 - RNA, 17 nt, Human
uguuucacuacucagca

SEQ ID NO: 3851747 - RNA, 15 nt, Human
uguuucagauuuuuu

SEQ ID NO: 3851748 - RNA, 22 nt, Human
uguuucagguucaguauuaugu

SEQ ID NO: 3851749 - RNA, 10 nt, Human
uguuucagug

SEQ ID NO: 3851750 - RNA, 21 nt, Human
uguuucauguuuugugacuau

SEQ ID NO: 3851751 - RNA, 22 nt, Human
uguuucauguuuugugacuaua

SEQ ID NO: 3851752 - RNA, 21 nt, Human
uguuuccaauguuuagcaaau

SEQ ID NO: 3851753 - RNA, 20 nt, Human
uguuuccagacuuccuugag

SEQ ID NO: 3851754 - RNA, 23 nt, Human
uguuuccagacuuccuugagaca

SEQ ID NO: 3851755 - RNA, 18 nt, Human
uguuuccagcagaagaca

SEQ ID NO: 3851756 - RNA, 13 nt, Human
uguuuccagcauu

SEQ ID NO: 3851757 - RNA, 19 nt, Human
uguuuccauauuuuauagg

SEQ ID NO: 3851758 - RNA, 22 nt, Human
uguuucccauaauuuucuucau

SEQ ID NO: 3851759 - RNA, 22 nt, Human
uguuuccccacaaaacaaagca

SEQ ID NO: 3851760 - RNA, 20 nt, Human
uguuucccuuucacuggcau

SEQ ID NO: 3851761 - RNA, 16 nt, Human
uguuuccucuuccaaa

SEQ ID NO: 3851762 - RNA, 21 nt, Human
uguuuccugacauugucuccu

SEQ ID NO: 3851763 - RNA, 23 nt, Human
uguuuccuggcacugcuuccagu

SEQ ID NO: 3851764 - RNA, 23 nt, Human
uguuucgcggguaacugggguug

SEQ ID NO: 3851765 - RNA, 21 nt, Human
uguuucgcugauauauguguu

SEQ ID NO: 3851766 - RNA, 15 nt, Human
uguuucgugaaguau

SEQ ID NO: 3851767 - RNA, 21 nt, Human
uguuucuaauaaagaaagcag

SEQ ID NO: 3851768 - RNA, 20 nt, Human
uguuucuagagccugcugga

SEQ ID NO: 3851769 - RNA, 21 nt, Human
uguuucuagcacuggccugca

SEQ ID NO: 3851770 - RNA, 16 nt, Human
uguuucuaguugagga

SEQ ID NO: 3851771 - RNA, 24 nt, Human
uguuucuauucucuccucagacug

SEQ ID NO: 3851772 - RNA, 19 nt, Human
uguuucuauugacuucaau

SEQ ID NO: 3851773 - RNA, 15 nt, Human
uguuucucccccugg

SEQ ID NO: 3851774 - RNA, 16 nt, Human
uguuucucccccuggg

SEQ ID NO: 3851775 - RNA, 14 nt, Human
uguuucucuuuccu

SEQ ID NO: 3851776 - RNA, 22 nt, Human
uguuucucuuugauuauuugca

SEQ ID NO: 3851777 - RNA, 14 nt, Human
uguuucugaaaaga

SEQ ID NO: 3851778 - RNA, 21 nt, Human
uguuucugaaaauuccagaaa

SEQ ID NO: 3851779 - RNA, 12 nt, Human
uguuucugacuc

SEQ ID NO: 3851780 - RNA, 19 nt, Human
uguuucugacucugagcua

SEQ ID NO: 3851781 - RNA, 17 nt, Human
uguuucugagaaaagaa

SEQ ID NO: 3851782 - RNA, 21 nt, Human
uguuucugcaguagucucugu

SEQ ID NO: 3851783 - RNA, 18 nt, Human
uguuucuggcuuagaaca

SEQ ID NO: 3851784 - RNA, 20 nt, Human
uguuucuguccuguaacugu

SEQ ID NO: 3851785 - RNA, 22 nt, Human
uguuucuguccuguaacuguua

SEQ ID NO: 3851786 - RNA, 12 nt, Human
uguuucuguuau

SEQ ID NO: 3851787 - RNA, 14 nt, Human
uguuucuguuauua

SEQ ID NO: 3851788 - RNA, 19 nt, Human
uguuucuguuauuaacaaa

SEQ ID NO: 3851789 - RNA, 17 nt, Human
uguuucuguucaccuuc

SEQ ID NO: 3851790 - RNA, 13 nt, Human
uguuucuguucca

SEQ ID NO: 3851791 - RNA, 16 nt, Human
uguuucuuaauuugga

SEQ ID NO: 3851792 - RNA, 17 nt, Human
uguuucuuccaaagcac

SEQ ID NO: 3851793 - RNA, 18 nt, Human
uguuucuuccaaagcaca

SEQ ID NO: 3851794 - RNA, 21 nt, Human
uguuucuuccuguuaauguau

SEQ ID NO: 3851795 - RNA, 16 nt, Human
uguuucuugcuuguac

SEQ ID NO: 3851796 - RNA, 17 nt, Human
uguuucuuguuuauuga

SEQ ID NO: 3851797 - RNA, 12 nt, Human
uguuucuuugau

SEQ ID NO: 3851798 - RNA, 21 nt, Human
uguuucuuuuguauguaaaug

SEQ ID NO: 3851799 - RNA, 19 nt, Human
uguuugaaaauaguuuauu

SEQ ID NO: 3851800 - RNA, 16 nt, Human
uguuugaaaucaucgg

SEQ ID NO: 3851801 - RNA, 13 nt, Human
uguuugaaaucuu

SEQ ID NO: 3851802 - RNA, 22 nt, Human
uguuugaaaugaggucuguuua

SEQ ID NO: 3851803 - RNA, 21 nt, Human
uguuugacaaagaaacccaag

SEQ ID NO: 3851804 - RNA, 22 nt, Human
uguuugacaaaguuacugauuc

SEQ ID NO: 3851805 - RNA, 12 nt, Human
uguuugaugcag

SEQ ID NO: 3851806 - RNA, 19 nt, Human
uguuugaugcauuaaaaga

SEQ ID NO: 3851807 - RNA, 21 nt, Human
uguuugaugcauuaaaagaaa

SEQ ID NO: 3851808 - RNA, 22 nt, Human
uguuugauucagacagcugccu

SEQ ID NO: 3851809 - RNA, 17 nt, Human
uguuugcagccugcucu

SEQ ID NO: 3851810 - RNA, 13 nt, Human
uguuugcauauaa

SEQ ID NO: 3851811 - RNA, 22 nt, Human
uguuugcaugugaaaaucaaau

SEQ ID NO: 3851812 - RNA, 13 nt, Human
uguuugccaggac

SEQ ID NO: 3851813 - RNA, 18 nt, Human
uguuugccaggacaugca

SEQ ID NO: 3851814 - RNA, 15 nt, Human
uaacuguaucuugag

SEQ ID NO: 3851815 - RNA, 23 nt, Human
uaacuguccguaguaucagagau

SEQ ID NO: 3851816 - RNA, 17 nt, Human
uaacuguccuguccugc

SEQ ID NO: 3851817 - RNA, 13 nt, Human
uaacugugaaguu

SEQ ID NO: 3851818 - RNA, 17 nt, Human
uaacugugcugaaugcu

SEQ ID NO: 3851819 - RNA, 19 nt, Human
uaacuguguauguacauau

SEQ ID NO: 3851820 - RNA, 11 nt, Human
uaacuguuacc

SEQ ID NO: 3851821 - RNA, 14 nt, Human
uaacuguuaccauu

SEQ ID NO: 3851822 - RNA, 17 nt, Human
uaacuguuauuuauaau

SEQ ID NO: 3851823 - RNA, 19 nt, Human
uaacuguuuauauguguug

SEQ ID NO: 3851824 - RNA, 18 nt, Human
uaacuuaaaaaaaugaca

SEQ ID NO: 3851825 - RNA, 17 nt, Human
uaacuuaaaaauguaaa

SEQ ID NO: 3851826 - RNA, 19 nt, Human
uaacuuaaaaauguaaaua

SEQ ID NO: 3851827 - RNA, 16 nt, Human
uaacuuaaaauauuuu

SEQ ID NO: 3851828 - RNA, 16 nt, Human
uaacuuaaauaguauu

SEQ ID NO: 3851829 - RNA, 13 nt, Human
uaacuuaauaauc

SEQ ID NO: 3851830 - RNA, 21 nt, Human
uaacuuaauaaucaagagccu

SEQ ID NO: 3851831 - RNA, 15 nt, Human
uaacuuaaucaauua

SEQ ID NO: 3851832 - RNA, 18 nt, Human
uaacuuaaugaaaacaau

SEQ ID NO: 3851833 - RNA, 15 nt, Human
uaacuuaauugcuau

SEQ ID NO: 3851834 - RNA, 14 nt, Human
uaacuuacaaagau

SEQ ID NO: 3851835 - RNA, 17 nt, Human
uaacuuacccuguauau

SEQ ID NO: 3851836 - RNA, 18 nt, Human
uaacuuacccuuagggag

SEQ ID NO: 3851837 - RNA, 15 nt, Human
uaacuuagcaugugu

SEQ ID NO: 3851838 - RNA, 16 nt, Human
uaacuuaguuuugcau

SEQ ID NO: 3851839 - RNA, 17 nt, Human
uaacuuauguagauauu

SEQ ID NO: 3851840 - RNA, 19 nt, Human
uaacuuauguagauauuug

SEQ ID NO: 3851841 - RNA, 13 nt, Human
uaacuucacauau

SEQ ID NO: 3851842 - RNA, 15 nt, Human
uaacuuccaaauaaa

SEQ ID NO: 3851843 - RNA, 19 nt, Human
uaacuuccaaauaaauaau

SEQ ID NO: 3851844 - RNA, 17 nt, Human
uaacuuccaauuuacau

SEQ ID NO: 3851845 - RNA, 12 nt, Human
uaacuucuaaaa

SEQ ID NO: 3851846 - RNA, 14 nt, Human
uaacuucuaaaacu

SEQ ID NO: 3851847 - RNA, 16 nt, Human
uaacuucuaaaacugu

SEQ ID NO: 3851848 - RNA, 23 nt, Human
uaacuucuaaaacuguacuuuga

SEQ ID NO: 3851849 - RNA, 12 nt, Human
uaacuucuguuu

SEQ ID NO: 3851850 - RNA, 16 nt, Human
uaacuucuguuuuacc

SEQ ID NO: 3851851 - RNA, 23 nt, Human
uaacuucuuauggaauugauuug

SEQ ID NO: 3851852 - RNA, 15 nt, Human
uaacuugaguuuuau

SEQ ID NO: 3851853 - RNA, 21 nt, Human
uaacuugaguuuuauuuauuu

SEQ ID NO: 3851854 - RNA, 22 nt, Human
uaacuugauccauuucuaauua

SEQ ID NO: 3851855 - RNA, 15 nt, Human
uaacuugaugcaugu

SEQ ID NO: 3851856 - RNA, 15 nt, Human
uaacuugcaccucug

SEQ ID NO: 3851857 - RNA, 16 nt, Human
uaacuugcuuaaaugu

SEQ ID NO: 3851858 - RNA, 19 nt, Human
uaacuugcuuaaauuucuu

SEQ ID NO: 3851859 - RNA, 20 nt, Human
uaacuugcuuaaauuucuua

SEQ ID NO: 3851860 - RNA, 17 nt, Human
uaacuuggaugaguuuu

SEQ ID NO: 3851861 - RNA, 12 nt, Human
uaacuuggcuca

SEQ ID NO: 3851862 - RNA, 19 nt, Human
uaacuugggagugugguuu

SEQ ID NO: 3851863 - RNA, 19 nt, Human
uaacuugguuauacaugac

SEQ ID NO: 3851864 - RNA, 22 nt, Human
uaacuugguuauacaugacacu

SEQ ID NO: 3851865 - RNA, 16 nt, Human
uaacuugucuuuggac

SEQ ID NO: 3851866 - RNA, 20 nt, Human
uaacuugucuuuggacccug

SEQ ID NO: 3851867 - RNA, 15 nt, Human
uaacuuuaaguuuca

SEQ ID NO: 3851868 - RNA, 17 nt, Human
uaacuuuauaaauccag

SEQ ID NO: 3851869 - RNA, 20 nt, Human
uaacuuuauucuugaaagaa

SEQ ID NO: 3851870 - RNA, 13 nt, Human
uaacuuucagaag

SEQ ID NO: 3851871 - RNA, 19 nt, Human
uaacuuucauuaaagcauu

SEQ ID NO: 3851872 - RNA, 15 nt, Human
uaacuuucucuauga

SEQ ID NO: 3851873 - RNA, 15 nt, Human
uaacuuuggguuaaa

SEQ ID NO: 3851874 - RNA, 18 nt, Human
uaacuuugguuaaaaucu

SEQ ID NO: 3851875 - RNA, 21 nt, Human
uaacuuuguuuuauuuucaaa

SEQ ID NO: 3851876 - RNA, 21 nt, Human
uaacuuuuauaaacuuuaccu

SEQ ID NO: 3851877 - RNA, 20 nt, Human
uaacuuuucaaugacauuuu

SEQ ID NO: 3851878 - RNA, 13 nt, Human
uaacuuuuguaag

SEQ ID NO: 3851879 - RNA, 18 nt, Human
uaacuuuuguaagacaaa

SEQ ID NO: 3851880 - RNA, 10 nt, Human
uaagaaaaac

SEQ ID NO: 3851881 - RNA, 16 nt, Human
uaagaaaaaggaugca

SEQ ID NO: 3851882 - RNA, 18 nt, Human
uaagaaaaaggaugcaca

SEQ ID NO: 3851883 - RNA, 16 nt, Human
uaagaaaacaaucaca

SEQ ID NO: 3851884 - RNA, 14 nt, Human
uaagaaaagagaua

SEQ ID NO: 3851885 - RNA, 14 nt, Human
uaagaaaagauuuu

SEQ ID NO: 3851886 - RNA, 15 nt, Human
uaagaaaauaaaugu

SEQ ID NO: 3851887 - RNA, 19 nt, Human
uaagaaaauacaauaaacu

SEQ ID NO: 3851888 - RNA, 18 nt, Human
uaagaaaaugcuagaaga

SEQ ID NO: 3851889 - RNA, 20 nt, Human
uaagaaacaacucuuugaga

SEQ ID NO: 3851890 - RNA, 20 nt, Human
uaagaaacacacugaggcag

SEQ ID NO: 3851891 - RNA, 19 nt, Human
uaagaaaccaaucaagaua

SEQ ID NO: 3851892 - RNA, 19 nt, Human
uaagaaacuuuuuuauuua

SEQ ID NO: 3851893 - RNA, 21 nt, Human
uaagaaagacaucuuucucuu

SEQ ID NO: 3851894 - RNA, 15 nt, Human
uaagaaagugaagca

SEQ ID NO: 3851895 - RNA, 16 nt, Human
uaagaaauacuguaca

SEQ ID NO: 3851896 - RNA, 13 nt, Human
uaagaaauagaau

SEQ ID NO: 3851897 - RNA, 15 nt, Human
uaagaaauaucugug

SEQ ID NO: 3851898 - RNA, 19 nt, Human
uaagaaaucaaagagagaa

SEQ ID NO: 3851899 - RNA, 24 nt, Human
uaagaaaucuaguauuucaugcug

SEQ ID NO: 3851900 - RNA, 15 nt, Human
uaagaaauugaauac

SEQ ID NO: 3851901 - RNA, 18 nt, Human
uaagaaauugaauacuuu

SEQ ID NO: 3851902 - RNA, 18 nt, Human
uaagaacaaaagcgaccc

SEQ ID NO: 3851903 - RNA, 13 nt, Human
uaagaaccccucu

SEQ ID NO: 3851904 - RNA, 17 nt, Human
uaagaaccccucugcuu

SEQ ID NO: 3851905 - RNA, 14 nt, Human
uaagaaccuggaac

SEQ ID NO: 3851906 - RNA, 16 nt, Human
uaagaacuaaagaaga

SEQ ID NO: 3851907 - RNA, 21 nt, Human
uaagaacuacaaacaaaauuu

SEQ ID NO: 3851908 - RNA, 22 nt, Human
uaagaagaaaauugcugugccu

SEQ ID NO: 3851909 - RNA, 17 nt, Human
uaagaagaaguucaugu

SEQ ID NO: 3851910 - RNA, 21 nt, Human
uaagaagaaugcuuaaucaga

SEQ ID NO: 3851911 - RNA, 15 nt, Human
uaagaagacaugaac

SEQ ID NO: 3851912 - RNA, 14 nt, Human
uaagaagagacugg

SEQ ID NO: 3851913 - RNA, 21 nt, Human
uaagaagcuguuguacauuua

SEQ ID NO: 3851914 - RNA, 14 nt, Human
uaagaagcuucuaa

SEQ ID NO: 3851915 - RNA, 20 nt, Human
uaagaagcuucuaauaaauu

SEQ ID NO: 3851916 - RNA, 22 nt, Human
uaagaagcuucuaauaaauuau

SEQ ID NO: 3851917 - RNA, 15 nt, Human
uaagaaggcaauauu

SEQ ID NO: 3851918 - RNA, 20 nt, Human
uaagaagggauggauuccaa

SEQ ID NO: 3851919 - RNA, 13 nt, Human
uguaucugagcag

SEQ ID NO: 3851920 - RNA, 15 nt, Human
uguaucugaguugcc

SEQ ID NO: 3851921 - RNA, 19 nt, Human
uguaucugaguugccaaga

SEQ ID NO: 3851922 - RNA, 19 nt, Human
uguaucugucuuuccacuc

SEQ ID NO: 3851923 - RNA, 21 nt, Human
uguaucuugggggacagggcu

SEQ ID NO: 3851924 - RNA, 21 nt, Human
uguaugaaaaauuggggagga

SEQ ID NO: 3851925 - RNA, 13 nt, Human
uguaugaaaacau

SEQ ID NO: 3851926 - RNA, 22 nt, Human
uguaugaaagauggcugugccu

SEQ ID NO: 3851927 - RNA, 14 nt, Human
uguaugaaauauau

SEQ ID NO: 3851928 - RNA, 20 nt, Human
uguaugaacuuuaucuaaag

SEQ ID NO: 3851929 - RNA, 14 nt, Human
uguaugacuaaaga

SEQ ID NO: 3851930 - RNA, 21 nt, Human
uguaugacuaaagagagaaug

SEQ ID NO: 3851931 - RNA, 16 nt, Human
uguaugacugcacaug

SEQ ID NO: 3851932 - RNA, 17 nt, Human
uguaugaguagccaggg

SEQ ID NO: 3851933 - RNA, 22 nt, Human
uguaugauauuccauaguauau

SEQ ID NO: 3851934 - RNA, 13 nt, Human
uguaugaucaaau

SEQ ID NO: 3851935 - RNA, 18 nt, Human
uguaugaucaaauguuua

SEQ ID NO: 3851936 - RNA, 19 nt, Human
uguaugaucaaauguuuaa

SEQ ID NO: 3851937 - RNA, 17 nt, Human
uguaugaucugugccuu

SEQ ID NO: 3851938 - RNA, 13 nt, Human
uguaugauguguu

SEQ ID NO: 3851939 - RNA, 18 nt, Human
uguaugauguguugugau

SEQ ID NO: 3851940 - RNA, 15 nt, Human
uguaugauuuauaaa

SEQ ID NO: 3851941 - RNA, 17 nt, Human
uguaugcaacaggcacu

SEQ ID NO: 3851942 - RNA, 18 nt, Human
uguaugcaagcaguuuca

SEQ ID NO: 3851943 - RNA, 17 nt, Human
uguaugcacaugaacuu

SEQ ID NO: 3851944 - RNA, 18 nt, Human
uguaugcacaugaacuua

SEQ ID NO: 3851945 - RNA, 14 nt, Human
uguaugcacuuugu

SEQ ID NO: 3851946 - RNA, 18 nt, Human
uguaugcagcuaucuggu

SEQ ID NO: 3851947 - RNA, 12 nt, Human
uguaugcauaau

SEQ ID NO: 3851948 - RNA, 22 nt, Human
uguaugcauaauaauccugcaa

SEQ ID NO: 3851949 - RNA, 13 nt, Human
uguaugcauguug

SEQ ID NO: 3851950 - RNA, 15 nt, Human
uguaugcauguuguc

SEQ ID NO: 3851951 - RNA, 22 nt, Human
uguaugccuuuaaaucugugau

SEQ ID NO: 3851952 - RNA, 12 nt, Human
uguaugcugcuu

SEQ ID NO: 3851953 - RNA, 12 nt, Human
uguaugcuggac

SEQ ID NO: 3851954 - RNA, 14 nt, Human
uguaugcuucauac

SEQ ID NO: 3851955 - RNA, 18 nt, Human
uguauggaauacaguguu

SEQ ID NO: 3851956 - RNA, 19 nt, Human
uguauggaauacaguguua

SEQ ID NO: 3851957 - RNA, 17 nt, Human
uguauggagagaaaaca

SEQ ID NO: 3851958 - RNA, 21 nt, Human
uguauggauaguaaaauucua

SEQ ID NO: 3851959 - RNA, 23 nt, Human
ugucaaccagacagagggucaca

SEQ ID NO: 3851960 - RNA, 15 nt, Human
ugucaacuucaacau

SEQ ID NO: 3851961 - RNA, 19 nt, Human
ugucaagaagaugaucaga

SEQ ID NO: 3851962 - RNA, 19 nt, Human
ugucaagagggucugagga

SEQ ID NO: 3851963 - RNA, 18 nt, Human
ugucaagccauuuuuaca

SEQ ID NO: 3851964 - RNA, 16 nt, Human
ugucaagccugugcaa

SEQ ID NO: 3851965 - RNA, 18 nt, Human
ugucaagccugugcaaaa

SEQ ID NO: 3851966 - RNA, 20 nt, Human
ugucaagccugugcaaaaaa

SEQ ID NO: 3851967 - RNA, 19 nt, Human
ugucaagcugaccuugcug

SEQ ID NO: 3851968 - RNA, 17 nt, Human
ugucaagucucugcugg

SEQ ID NO: 3851969 - RNA, 18 nt, Human
ugucaagucucugcuggc

SEQ ID NO: 3851970 - RNA, 18 nt, Human
ugucaaguggcaaagcug

SEQ ID NO: 3851971 - RNA, 17 nt, Human
ugucaagugucaguaag

SEQ ID NO: 3851972 - RNA, 15 nt, Human
ugucaaguugugcuu

SEQ ID NO: 3851973 - RNA, 21 nt, Human
ugucaauaaaauccauacauu

SEQ ID NO: 3851974 - RNA, 23 nt, Human
ugucaauaaacagcuucaugccu

SEQ ID NO: 3851975 - RNA, 17 nt, Human
ugucaauauuaaauaca

SEQ ID NO: 3851976 - RNA, 17 nt, Human
ugucaauccagauggug

SEQ ID NO: 3851977 - RNA, 17 nt, Human
ugucaaugagagcauaa

SEQ ID NO: 3851978 - RNA, 17 nt, Human
ugucaaugauuauuuuc

SEQ ID NO: 3851979 - RNA, 13 nt, Human
ugucaaugugugc

SEQ ID NO: 3851980 - RNA, 15 nt, Human
ugucaauuacaggaa

SEQ ID NO: 3851981 - RNA, 19 nt, Human
ugucaauuacaggaaguac

SEQ ID NO: 3851982 - RNA, 16 nt, Human
ugucaauuaccagaaa

SEQ ID NO: 3851983 - RNA, 19 nt, Human
ugucaauuuauaaugauua

SEQ ID NO: 3851984 - RNA, 19 nt, Human
ugucaauuucccugacucc

SEQ ID NO: 3851985 - RNA, 16 nt, Human
ugucaauuucuguguu

SEQ ID NO: 3851986 - RNA, 16 nt, Human
ugucacaauaaaugua

SEQ ID NO: 3851987 - RNA, 16 nt, Human
ugucacaaugagauug

SEQ ID NO: 3851988 - RNA, 13 nt, Human
ugucacacacuuu

SEQ ID NO: 3851989 - RNA, 15 nt, Human
ugucacaggcagguc

SEQ ID NO: 3851990 - RNA, 18 nt, Human
ugucacaggguguucuuu

SEQ ID NO: 3851991 - RNA, 17 nt, Human
ugucacaguaaaaauaa

SEQ ID NO: 3851992 - RNA, 18 nt, Human
ugucacauggugccccua

SEQ ID NO: 3851993 - RNA, 20 nt, Human
ugucacauggugccccuagc

SEQ ID NO: 3851994 - RNA, 14 nt, Human
ugucacauugcauu

SEQ ID NO: 3851995 - RNA, 22 nt, Human
ugucaccacccugcucauccac

SEQ ID NO: 3851996 - RNA, 16 nt, Human
ugucaccaccuuccca

SEQ ID NO: 3851997 - RNA, 15 nt, Human
ugucaccagaucuga

SEQ ID NO: 3851998 - RNA, 23 nt, Human
ugucacccaaaccggcaggugcg

SEQ ID NO: 3851999 - RNA, 15 nt, Human
ugucaccccagagcc

SEQ ID NO: 3852000 - RNA, 16 nt, Human
ugucaccccagagcca

SEQ ID NO: 3852001 - RNA, 19 nt, Human
ugucaccggauccugggug

SEQ ID NO: 3852002 - RNA, 18 nt, Human
ugucaccguggaccuucc

SEQ ID NO: 3852003 - RNA, 13 nt, Human
ugucaccugaaga

SEQ ID NO: 3852004 - RNA, 13 nt, Human
ugucaccuuuucu

SEQ ID NO: 3852005 - RNA, 16 nt, Human
ugucaccuuuucuugc

SEQ ID NO: 3852006 - RNA, 20 nt, Human
ugucaccuuuucuugccuga

SEQ ID NO: 3852007 - RNA, 16 nt, Human
ugucacgauugucauc

SEQ ID NO: 3852008 - RNA, 13 nt, Human
ugucacguacugu

SEQ ID NO: 3852009 - RNA, 12 nt, Human
ugucacucaggc

SEQ ID NO: 3852010 - RNA, 22 nt, Human
ugucacucauugcugagccucu

SEQ ID NO: 3852011 - RNA, 18 nt, Human
ugucacugacacaaagga

SEQ ID NO: 3852012 - RNA, 20 nt, Human
ugucacugacacaaaggaag

SEQ ID NO: 3852013 - RNA, 21 nt, Human
ugucacugcuuuuggccugga

SEQ ID NO: 3852014 - RNA, 14 nt, Human
ugucacuggcugcc

SEQ ID NO: 3852015 - RNA, 17 nt, Human
ugucacuggcugccucc

SEQ ID NO: 3852016 - RNA, 23 nt, Human
ugucacugguagaccaaaauaaa

SEQ ID NO: 3852017 - RNA, 12 nt, Human
ugucacuguggu

SEQ ID NO: 3852018 - RNA, 13 nt, Human
ugucacuguuucu

SEQ ID NO: 3852019 - RNA, 13 nt, Human
ugucacuugcaug

SEQ ID NO: 3852020 - RNA, 15 nt, Human
ugucacuugugcuuu

SEQ ID NO: 3852021 - RNA, 12 nt, Human
ugucacuuuuug

SEQ ID NO: 3852022 - RNA, 15 nt, Human
ugucacuuuuugagg

SEQ ID NO: 3852023 - RNA, 19 nt, Human
ugucagaaaaacaauaaga

SEQ ID NO: 3852024 - RNA, 16 nt, Human
ugucagaaaccaguua

SEQ ID NO: 3852025 - RNA, 13 nt, Human
ugucagacacaga

SEQ ID NO: 3852026 - RNA, 23 nt, Human
ugucagacagaacuugaaugugu

SEQ ID NO: 3852027 - RNA, 15 nt, Human
ugucagacccuggag

SEQ ID NO: 3852028 - RNA, 12 nt, Human
ugucagacuuua

SEQ ID NO: 3852029 - RNA, 13 nt, Human
ugucagagcuggg

SEQ ID NO: 3852030 - RNA, 16 nt, Human
ugucagaguucugcuc

SEQ ID NO: 3852031 - RNA, 23 nt, Human
ugucagauauuuuuucagaaaua

SEQ ID NO: 3852032 - RNA, 24 nt, Human
ugucagauccaggagcuccagugu

SEQ ID NO: 3852033 - RNA, 17 nt, Human
ugucagaugagaacaaa

SEQ ID NO: 3852034 - RNA, 19 nt, Human
ugucagaugagaacaaagc

SEQ ID NO: 3852035 - RNA, 20 nt, Human
ugucagaugagaacaaagcu

SEQ ID NO: 3852036 - RNA, 23 nt, Human
ugucagaugagaacaaagcuguu

SEQ ID NO: 3852037 - RNA, 15 nt, Human
ugucagaugcccgag

SEQ ID NO: 3852038 - RNA, 23 nt, Human
ugucagcaaaaagcaaaaucauu

SEQ ID NO: 3852039 - RNA, 12 nt, Human
ugucagcaugaa

SEQ ID NO: 3852040 - RNA, 16 nt, Human
ugucagcaugaauuug

SEQ ID NO: 3852041 - RNA, 20 nt, Human
ugucagcaugaauuuguaau

SEQ ID NO: 3852042 - RNA, 20 nt, Human
ugucagccauugcacccagc

SEQ ID NO: 3852043 - RNA, 22 nt, Human
ugucagccgagccgggccuggg

SEQ ID NO: 3852044 - RNA, 23 nt, Human
ugucagccgagccgggccugggg

SEQ ID NO: 3852045 - RNA, 16 nt, Human
ugucagccgggcccug

SEQ ID NO: 3852046 - RNA, 21 nt, Human
ugucagccgggcccugaguaa

SEQ ID NO: 3852047 - RNA, 23 nt, Human
ugucagcgcagguuuaguuuacu

SEQ ID NO: 3852048 - RNA, 21 nt, Human
ugucagcuccccucggagaag

SEQ ID NO: 3852049 - RNA, 16 nt, Human
ugucagcugaaccugg

SEQ ID NO: 3852050 - RNA, 23 nt, Human
ugucagcugcaagguacucuggu

SEQ ID NO: 3852051 - RNA, 19 nt, Human
ugucaggaaaacacccagg

SEQ ID NO: 3852052 - RNA, 20 nt, Human
ugucaggaacagaaggauga

SEQ ID NO: 3852053 - RNA, 17 nt, Human
ugucaggaagaaaucac

SEQ ID NO: 3852054 - RNA, 14 nt, Human
ugucaggagagcag

SEQ ID NO: 3852055 - RNA, 19 nt, Human
ugucaggauugcgagagau

SEQ ID NO: 3852056 - RNA, 22 nt, Human
ugucaggauugcgagagaugug

SEQ ID NO: 3852057 - RNA, 19 nt, Human
ugucaggccuucaggguuc

SEQ ID NO: 3852058 - RNA, 18 nt, Human
ugucaggcugaaaacaau

SEQ ID NO: 3852059 - RNA, 17 nt, Human
ugucaggcugcuggcgc

SEQ ID NO: 3852060 - RNA, 19 nt, Human
ugucaggcugcuggcgccu

SEQ ID NO: 3852061 - RNA, 20 nt, Human
ugucaggcugcuggcgccuc

SEQ ID NO: 3852062 - RNA, 17 nt, Human
ugucagguggggcagcu

SEQ ID NO: 3852063 - RNA, 18 nt, Human
ugucagguggggcagcuu

SEQ ID NO: 3852064 - RNA, 15 nt, Human
ugucagguuauuuau

SEQ ID NO: 3852065 - RNA, 14 nt, Human
ugucaguauccagg

SEQ ID NO: 3852066 - RNA, 22 nt, Human
ugucaguauguggaaguguggg

SEQ ID NO: 3852067 - RNA, 16 nt, Human
ugucaguauuauucua

SEQ ID NO: 3852068 - RNA, 16 nt, Human
ugucagucacagccac

SEQ ID NO: 3852069 - RNA, 17 nt, Human
ugucagucacagccacc

SEQ ID NO: 3852070 - RNA, 22 nt, Human
ugucagucacagccaccccuga

SEQ ID NO: 3852071 - RNA, 23 nt, Human
ugucagugccgccgccucgccca

SEQ ID NO: 3852072 - RNA, 20 nt, Human
ugucaguggggcucucugag

SEQ ID NO: 3852073 - RNA, 20 nt, Human
ugucagugugacugaucucu

SEQ ID NO: 3852074 - RNA, 18 nt, Human
ugucaguuguuauuuauu

SEQ ID NO: 3852075 - RNA, 19 nt, Human
ugucaguuucagauccuga

SEQ ID NO: 3852076 - RNA, 23 nt, Human
ugucauaacauccagagcuuugu

SEQ ID NO: 3852077 - RNA, 12 nt, Human
ugucauacagag

SEQ ID NO: 3852078 - RNA, 18 nt, Human
ugucauacagagaaguca

SEQ ID NO: 3852079 - RNA, 23 nt, Human
ugucauaguucugagcugccagu

SEQ ID NO: 3852080 - RNA, 18 nt, Human
ugucauauauuacuagca

SEQ ID NO: 3852081 - RNA, 22 nt, Human
ugucaucaauugaauggucagc

SEQ ID NO: 3852082 - RNA, 13 nt, Human
ugucaucacucua

SEQ ID NO: 3852083 - RNA, 17 nt, Human
uuaauguauauaaaaau

SEQ ID NO: 3852084 - RNA, 13 nt, Human
uuaauguauguua

SEQ ID NO: 3852085 - RNA, 22 nt, Human
uuaaugucaauucuugccaaau

SEQ ID NO: 3852086 - RNA, 18 nt, Human
uuaaugucacaggcaggu

SEQ ID NO: 3852087 - RNA, 13 nt, Human
uuaaugugaacuu

SEQ ID NO: 3852088 - RNA, 23 nt, Human
uuaaugugaccuagcaauaggca

SEQ ID NO: 3852089 - RNA, 17 nt, Human
uuaaugugcuguguaaa

SEQ ID NO: 3852090 - RNA, 16 nt, Human
uuaaugugguugaaga

SEQ ID NO: 3852091 - RNA, 23 nt, Human
uuaauguucugaauaauuucuua

SEQ ID NO: 3852092 - RNA, 22 nt, Human
uuaauguuuccuuuaauuuuuu

SEQ ID NO: 3852093 - RNA, 16 nt, Human
uuaauguuuuaaaugu

SEQ ID NO: 3852094 - RNA, 15 nt, Human
uuaauguuuucaaaa

SEQ ID NO: 3852095 - RNA, 11 nt, Human
uuaauguuuuu

SEQ ID NO: 3852096 - RNA, 14 nt, Human
uuaauuaaaaacua

SEQ ID NO: 3852097 - RNA, 19 nt, Human
uuaauuaaaaacuaguagu

SEQ ID NO: 3852098 - RNA, 22 nt, Human
uuaauuaaaacacaacaucuuu

SEQ ID NO: 3852099 - RNA, 16 nt, Human
uuaauuaaacauugug

SEQ ID NO: 3852100 - RNA, 19 nt, Human
uuaauuaaauagcuuuugu

SEQ ID NO: 3852101 - RNA, 22 nt, Human
uuaauuaagcaaagcacccauu

SEQ ID NO: 3852102 - RNA, 20 nt, Human
uuaauuaaugaaauaucugu

SEQ ID NO: 3852103 - RNA, 15 nt, Human
ugugacaggcagcag

SEQ ID NO: 3852104 - RNA, 16 nt, Human
ugugacauacccccuc

SEQ ID NO: 3852105 - RNA, 19 nt, Human
ugugacaugcgggcugggc

SEQ ID NO: 3852106 - RNA, 16 nt, Human
ugugacauggugccug

SEQ ID NO: 3852107 - RNA, 17 nt, Human
ugugacauggugccuga

SEQ ID NO: 3852108 - RNA, 18 nt, Human
ugugacauggugccugag

SEQ ID NO: 3852109 - RNA, 22 nt, Human
ugugacauggugccugagaggc

SEQ ID NO: 3852110 - RNA, 13 nt, Human
ugugacauuccuu

SEQ ID NO: 3852111 - RNA, 18 nt, Human
ugugacauuuauauauug

SEQ ID NO: 3852112 - RNA, 21 nt, Human
ugugacauuugucauuuucau

SEQ ID NO: 3852113 - RNA, 15 nt, Human
ugugacauuuuacau

SEQ ID NO: 3852114 - RNA, 22 nt, Human
ugugaccaacuguguuguauua

SEQ ID NO: 3852115 - RNA, 15 nt, Human
ugugaccacaacaug

SEQ ID NO: 3852116 - RNA, 13 nt, Human
ugugaccaccacc

SEQ ID NO: 3852117 - RNA, 22 nt, Human
ugugacccagcacugcccaaag

SEQ ID NO: 3852118 - RNA, 15 nt, Human
ugugacccccagcuc

SEQ ID NO: 3852119 - RNA, 16 nt, Human
ugugacccccagcucc

SEQ ID NO: 3852120 - RNA, 14 nt, Human
ugugaccccuccug

SEQ ID NO: 3852121 - RNA, 17 nt, Human
ugugacccuccaaaugg

SEQ ID NO: 3852122 - RNA, 13 nt, Human
ugugaccucaggc

SEQ ID NO: 3852123 - RNA, 14 nt, Human
ugugaccugagggc

SEQ ID NO: 3852124 - RNA, 13 nt, Human
ugugaccugcuga

SEQ ID NO: 3852125 - RNA, 16 nt, Human
ugugaccugcugagcu

SEQ ID NO: 3852126 - RNA, 17 nt, Human
ugugaccugcugagcuc

SEQ ID NO: 3852127 - RNA, 16 nt, Human
ugugaccuuaguguuu

SEQ ID NO: 3852128 - RNA, 14 nt, Human
ugugaccuucucua

SEQ ID NO: 3852129 - RNA, 19 nt, Human
ugugacuaauuguauaaca

SEQ ID NO: 3852130 - RNA, 23 nt, Human
ugugacuaauuguauaacagguu

SEQ ID NO: 3852131 - RNA, 18 nt, Human
ugugacuaggaaaaaauu

SEQ ID NO: 3852132 - RNA, 20 nt, Human
ugugacuagugcugaagcuu

SEQ ID NO: 3852133 - RNA, 23 nt, Human
ugugacuagugcugaagcuuauu

SEQ ID NO: 3852134 - RNA, 16 nt, Human
ugugacucuggcuugg

SEQ ID NO: 3852135 - RNA, 17 nt, Human
ugugacucuggcuuggc

SEQ ID NO: 3852136 - RNA, 14 nt, Human
ugugacucuuucca

SEQ ID NO: 3852137 - RNA, 17 nt, Human
ugugacucuuuccaacc

SEQ ID NO: 3852138 - RNA, 22 nt, Human
ugugacugauguuacaucacag

SEQ ID NO: 3852139 - RNA, 18 nt, Human
uuagcuggccacauggcg

SEQ ID NO: 3852140 - RNA, 17 nt, Human
uuagcugucugcucaga

SEQ ID NO: 3852141 - RNA, 10 nt, Human
uuagcugugc

SEQ ID NO: 3852142 - RNA, 16 nt, Human
uuagcugugugaaaua

SEQ ID NO: 3852143 - RNA, 19 nt, Human
uuagcuguuauuucuauuu

SEQ ID NO: 3852144 - RNA, 15 nt, Human
uuagcuuaucaauuu

SEQ ID NO: 3852145 - RNA, 17 nt, Human
uuagcuuaucaauuugu

SEQ ID NO: 3852146 - RNA, 19 nt, Human
uuagcuuugcucugccaac

SEQ ID NO: 3852147 - RNA, 12 nt, Human
uuagcuuugugu

SEQ ID NO: 3852148 - RNA, 20 nt, Human
uuagcuuuuuaaaacauuag

SEQ ID NO: 3852149 - RNA, 18 nt, Human
uuaggaaaaucacuuugu

SEQ ID NO: 3852150 - RNA, 12 nt, Human
uuaggaaauaaa

SEQ ID NO: 3852151 - RNA, 18 nt, Human
uuaggaagcaagcuuaau

SEQ ID NO: 3852152 - RNA, 22 nt, Human
uuaggaaguugacuuauaguac

SEQ ID NO: 3852153 - RNA, 23 nt, Human
uuaggaauuaaguuaucuuuaaa

SEQ ID NO: 3852154 - RNA, 12 nt, Human
uuaggagaagcc

SEQ ID NO: 3852155 - RNA, 13 nt, Human
uuaggagaagcca

SEQ ID NO: 3852156 - RNA, 21 nt, Human
uuaggagagaagguagggguu

SEQ ID NO: 3852157 - RNA, 21 nt, Human
uuaggaguucgagaccagccu

SEQ ID NO: 3852158 - RNA, 19 nt, Human
uuaggaugcucaguugcua

SEQ ID NO: 3852159 - RNA, 17 nt, Human
uuaggaugguaaaguua

SEQ ID NO: 3852160 - RNA, 18 nt, Human
uuaggauguugaaaaagu

SEQ ID NO: 3852161 - RNA, 15 nt, Human
uuaggcagacucuuu

SEQ ID NO: 3852162 - RNA, 16 nt, Human
uuaggcagacucuuua

SEQ ID NO: 3852163 - RNA, 23 nt, Human
uuaggcagcagcuuuuaauacag

SEQ ID NO: 3852164 - RNA, 14 nt, Human
uuaggcagggaagu

SEQ ID NO: 3852165 - RNA, 20 nt, Human
uuaggcaguauaaagaauag

SEQ ID NO: 3852166 - RNA, 22 nt, Human
uuaggccaaaaaaauguaagau

SEQ ID NO: 3852167 - RNA, 18 nt, Human
uuaggccaaagacaaaua

SEQ ID NO: 3852168 - RNA, 14 nt, Human
uuaggccucugaga

SEQ ID NO: 3852169 - RNA, 18 nt, Human
uuaggccuggcacagugu

SEQ ID NO: 3852170 - RNA, 16 nt, Human
uuaggcuauucacaac

SEQ ID NO: 3852171 - RNA, 22 nt, Human
uuaggcuauuuguaaaucugcc

SEQ ID NO: 3852172 - RNA, 16 nt, Human
uuaggcugggcccaga

SEQ ID NO: 3852173 - RNA, 18 nt, Human
uuaggcugguggcccagg

SEQ ID NO: 3852174 - RNA, 15 nt, Human
uuagggaaaacauuc

SEQ ID NO: 3852175 - RNA, 17 nt, Human
uuagggaagagaaacag

SEQ ID NO: 3852176 - RNA, 13 nt, Human
uuagggagaaaau

SEQ ID NO: 3852177 - RNA, 14 nt, Human
uuagggagagaaga

SEQ ID NO: 3852178 - RNA, 15 nt, Human
uuagggagagaagau

SEQ ID NO: 3852179 - RNA, 18 nt, Human
uuagggagagucauauuu

SEQ ID NO: 3852180 - RNA, 17 nt, Human
uuagggaguauucuaau

SEQ ID NO: 3852181 - RNA, 12 nt, Human
uuagggcagcuu

SEQ ID NO: 3852182 - RNA, 14 nt, Human
uuagggcccuggag

SEQ ID NO: 3852183 - RNA, 15 nt, Human
uuagggcccuggagg

SEQ ID NO: 3852184 - RNA, 14 nt, Human
uuaggguacauuua

SEQ ID NO: 3852185 - RNA, 15 nt, Human
uuaggguacauuuau

SEQ ID NO: 3852186 - RNA, 15 nt, Human
uuagggugcagccac

SEQ ID NO: 3852187 - RNA, 20 nt, Human
uuaggguugguuccuuucca

SEQ ID NO: 3852188 - RNA, 23 nt, Human
uuagguaagaaguuuuaaaaagc

SEQ ID NO: 3852189 - RNA, 13 nt, Human
uuagguacuauuc

SEQ ID NO: 3852190 - RNA, 14 nt, Human
uuagguagaaaaac

SEQ ID NO: 3852191 - RNA, 16 nt, Human
uuaggucucuguugac

SEQ ID NO: 3852192 - RNA, 22 nt, Human
uuaggugcaauuucaagguucu

SEQ ID NO: 3852193 - RNA, 21 nt, Human
uuaggugugacugaauuucuu

SEQ ID NO: 3852194 - RNA, 14 nt, Human
uuagguuaggacuu

SEQ ID NO: 3852195 - RNA, 17 nt, Human
uuagguugugaaugcag

SEQ ID NO: 3852196 - RNA, 16 nt, Human
uuagguuuuguacaau

SEQ ID NO: 3852197 - RNA, 18 nt, Human
uuaguaaagucaaggaga

SEQ ID NO: 3852198 - RNA, 17 nt, Human
uuaguaaaugucuuugu

SEQ ID NO: 3852199 - RNA, 18 nt, Human
uuaguaaaugucuuugua

SEQ ID NO: 3852200 - RNA, 22 nt, Human
uuaguaacauaauaaauuaaaa

SEQ ID NO: 3852201 - RNA, 14 nt, Human
uuaguaaggcugug

SEQ ID NO: 3852202 - RNA, 13 nt, Human
uuaguaaucugua

SEQ ID NO: 3852203 - RNA, 12 nt, Human
uuaguaaugcua

SEQ ID NO: 3852204 - RNA, 17 nt, Human
uuaguaauuucuuuuuu

SEQ ID NO: 3852205 - RNA, 15 nt, Human
uuaguacccaccuga

SEQ ID NO: 3852206 - RNA, 17 nt, Human
uuaguacuuuauagaag

SEQ ID NO: 3852207 - RNA, 19 nt, Human
uuaguacuuuauagaagaa

SEQ ID NO: 3852208 - RNA, 13 nt, Human
uuaguagagacag

SEQ ID NO: 3852209 - RNA, 14 nt, Human
uuaguagagacagg

SEQ ID NO: 3852210 - RNA, 17 nt, Human
uuaguagagacaggguu

SEQ ID NO: 3852211 - RNA, 22 nt, Human
uuaguagagguacacuugugaa

SEQ ID NO: 3852212 - RNA, 13 nt, Human
uuaguagcauguu

SEQ ID NO: 3852213 - RNA, 20 nt, Human
uuaguauauuuauauaauua

SEQ ID NO: 3852214 - RNA, 17 nt, Human
uuaguaucuaacaugua

SEQ ID NO: 3852215 - RNA, 13 nt, Human
uuaguaucuuuug

SEQ ID NO: 3852216 - RNA, 13 nt, Human
uuaguauuaucuu

SEQ ID NO: 3852217 - RNA, 14 nt, Human
uuaguauucauucu

SEQ ID NO: 3852218 - RNA, 11 nt, Human
uuaguauugca

SEQ ID NO: 3852219 - RNA, 17 nt, Human
uuaguauugcaaaguca

SEQ ID NO: 3852220 - RNA, 12 nt, Human
uuaguauuguug

SEQ ID NO: 3852221 - RNA, 16 nt, Human
uuaguauuguuguccu

SEQ ID NO: 3852222 - RNA, 17 nt, Human
uuaguauuguuguccuu

SEQ ID NO: 3852223 - RNA, 20 nt, Human
uuaguauuguuguccuuuuc

SEQ ID NO: 3852224 - RNA, 23 nt, Human
uuaguauuguuguccuuuucaua

SEQ ID NO: 3852225 - RNA, 14 nt, Human
uuagucauagaaga

SEQ ID NO: 3852226 - RNA, 17 nt, Human
uuagucccucaugcaaa

SEQ ID NO: 3852227 - RNA, 13 nt, Human
uuaguccuugcuu

SEQ ID NO: 3852228 - RNA, 16 nt, Human
uuagucgugagcucuu

SEQ ID NO: 3852229 - RNA, 21 nt, Human
uuagucgugagcucuugugag

SEQ ID NO: 3852230 - RNA, 22 nt, Human
uuagucucuuguauuaaacucu

SEQ ID NO: 3852231 - RNA, 20 nt, Human
uuagucucuuuauuccuagu

SEQ ID NO: 3852232 - RNA, 15 nt, Human
uuagucugcaaaaug

SEQ ID NO: 3852233 - RNA, 14 nt, Human
uuagucuuuauacu

SEQ ID NO: 3852234 - RNA, 17 nt, Human
uuagugacuaaaccauu

SEQ ID NO: 3852235 - RNA, 16 nt, Human
uuagugauauuucucu

SEQ ID NO: 3852236 - RNA, 23 nt, Human
uuagugauauuucucuaguaguu

SEQ ID NO: 3852237 - RNA, 19 nt, Human
uuagugcuaagugugaacu

SEQ ID NO: 3852238 - RNA, 20 nt, Human
uuagugcuaagugugaacug

SEQ ID NO: 3852239 - RNA, 21 nt, Human
uuagugcuaagugugaacugg

SEQ ID NO: 3852240 - RNA, 16 nt, Human
uuaguggcucaacauu

SEQ ID NO: 3852241 - RNA, 23 nt, Human
uuaguggcucaacauuguguucc

SEQ ID NO: 3852242 - RNA, 15 nt, Human
uuagugggccagggc

SEQ ID NO: 3852243 - RNA, 13 nt, Human
uuaguguaaaaau

SEQ ID NO: 3852244 - RNA, 14 nt, Human
uuaguguaaaaaug

SEQ ID NO: 3852245 - RNA, 17 nt, Human
uuaguguaaaaaugaga

SEQ ID NO: 3852246 - RNA, 18 nt, Human
uuaguguaaaaaugagaa

SEQ ID NO: 3852247 - RNA, 13 nt, Human
uuaguguauccau

SEQ ID NO: 3852248 - RNA, 16 nt, Human
uuaguguaugcuuuga

SEQ ID NO: 3852249 - RNA, 16 nt, Human
uuauagauucuaaaga

SEQ ID NO: 3852250 - RNA, 18 nt, Human
uuauagcaacaacaauug

SEQ ID NO: 3852251 - RNA, 23 nt, Human
uuauagcacuuugaaauaccuca

SEQ ID NO: 3852252 - RNA, 16 nt, Human
uuauagccucugucug

SEQ ID NO: 3852253 - RNA, 17 nt, Human
uuauagcuauuacuguc

SEQ ID NO: 3852254 - RNA, 16 nt, Human
uuauagcucuaauguu

SEQ ID NO: 3852255 - RNA, 18 nt, Human
uuauagcucuaauguuug

SEQ ID NO: 3852256 - RNA, 20 nt, Human
uuauagcucuaauguuugca

SEQ ID NO: 3852257 - RNA, 13 nt, Human
uuauaguacauga

SEQ ID NO: 3852258 - RNA, 17 nt, Human
uuauaguacuagagaua

SEQ ID NO: 3852259 - RNA, 18 nt, Human
uuauaguacugacagaua

SEQ ID NO: 3852260 - RNA, 15 nt, Human
uuauagugaauacug

SEQ ID NO: 3852261 - RNA, 21 nt, Human
uuauagugaauacugcuacag

SEQ ID NO: 3852262 - RNA, 22 nt, Human
uuauagugcaauauauuuugua

SEQ ID NO: 3852263 - RNA, 17 nt, Human
uuauaguggaaaaacac

SEQ ID NO: 3852264 - RNA, 15 nt, Human
uuauaguuacugugu

SEQ ID NO: 3852265 - RNA, 20 nt, Human
uuauaguugugggugggaga

SEQ ID NO: 3852266 - RNA, 15 nt, Human
uuauaguuucugagg

SEQ ID NO: 3852267 - RNA, 12 nt, Human
uuauaguuugua

SEQ ID NO: 3852268 - RNA, 15 nt, Human
uuauaguuuguacau

SEQ ID NO: 3852269 - RNA, 16 nt, Human
uuauaguuuguacaug

SEQ ID NO: 3852270 - RNA, 16 nt, Human
uuauauaaaguauucu

SEQ ID NO: 3852271 - RNA, 22 nt, Human
uuauauaaaguauucuuuuucu

SEQ ID NO: 3852272 - RNA, 15 nt, Human
uuauauaaauuuuuu

SEQ ID NO: 3852273 - RNA, 16 nt, Human
uuauauaaucauuauu

SEQ ID NO: 3852274 - RNA, 20 nt, Human
uuauauaaucauuauuacuu

SEQ ID NO: 3852275 - RNA, 15 nt, Human
uuauauaauuauguu

SEQ ID NO: 3852276 - RNA, 17 nt, Human
uuauauaauuauguuau

SEQ ID NO: 3852277 - RNA, 20 nt, Human
uuauauaauugccaaaaagu

SEQ ID NO: 3852278 - RNA, 20 nt, Human
uuauauacaauaauggaaaa

SEQ ID NO: 3852279 - RNA, 23 nt, Human
uuauauacagaggaaaucuguaa

SEQ ID NO: 3852280 - RNA, 16 nt, Human
uuauauacuuguuguu

SEQ ID NO: 3852281 - RNA, 22 nt, Human
uuauauagauuauaacuugucu

SEQ ID NO: 3852282 - RNA, 13 nt, Human
uuauauagcaaga

SEQ ID NO: 3852283 - RNA, 14 nt, Human
uuauauagcuugaa

SEQ ID NO: 3852284 - RNA, 18 nt, Human
uuauauagcuugaaacau

SEQ ID NO: 3852285 - RNA, 18 nt, Human
uuauauaguuuacuauuu

SEQ ID NO: 3852286 - RNA, 23 nt, Human
uuauauauaaauauauuauuacu

SEQ ID NO: 3852287 - RNA, 16 nt, Human
uuauauaugaaaacua

SEQ ID NO: 3852288 - RNA, 18 nt, Human
uuauauaugaaaacuaua

SEQ ID NO: 3852289 - RNA, 17 nt, Human
uuauauauggacauggc

SEQ ID NO: 3852290 - RNA, 13 nt, Human
uuauauaugugaa

SEQ ID NO: 3852291 - RNA, 13 nt, Human
uuauauauuauau

SEQ ID NO: 3852292 - RNA, 13 nt, Human
uuauauauuuaua

SEQ ID NO: 3852293 - RNA, 17 nt, Human
uuauaucagacugcuuu

SEQ ID NO: 3852294 - RNA, 16 nt, Human
uuauaucauauguaua

SEQ ID NO: 3852295 - RNA, 14 nt, Human
uuauaucaugcaaa

SEQ ID NO: 3852296 - RNA, 21 nt, Human
uuauaucgaaauaguuacagg

SEQ ID NO: 3852297 - RNA, 21 nt, Human
uuauaucugaggaauucugua

SEQ ID NO: 3852298 - RNA, 23 nt, Human
uuauaucugaggaauucuguaua

SEQ ID NO: 3852299 - RNA, 15 nt, Human
uuauaucuuguagcu

SEQ ID NO: 3852300 - RNA, 15 nt, Human
uuauaugaacauaca

SEQ ID NO: 3852301 - RNA, 15 nt, Human
uuauaugaagaaaau

SEQ ID NO: 3852302 - RNA, 16 nt, Human
uuauaugaagauaagu

SEQ ID NO: 3852303 - RNA, 19 nt, Human
uuauaugcuuacugauaua

SEQ ID NO: 3852304 - RNA, 15 nt, Human
uuauauggaaauaua

SEQ ID NO: 3852305 - RNA, 18 nt, Human
uuauauggaaauauauau

SEQ ID NO: 3852306 - RNA, 14 nt, Human
ugugcauuuucuaa

SEQ ID NO: 3852307 - RNA, 17 nt, Human
ugugccaauauguauug

SEQ ID NO: 3852308 - RNA, 13 nt, Human
ugugccagagccu

SEQ ID NO: 3852309 - RNA, 14 nt, Human
ugugccagagccug

SEQ ID NO: 3852310 - RNA, 15 nt, Human
ugugccagagccugg

SEQ ID NO: 3852311 - RNA, 17 nt, Human
ugugccagagccugggg

SEQ ID NO: 3852312 - RNA, 22 nt, Human
ugugccagagccuggggcucua

SEQ ID NO: 3852313 - RNA, 19 nt, Human
ugugccaggugaaggaggc

SEQ ID NO: 3852314 - RNA, 22 nt, Human
ugugccauagaguuuaacacaa

SEQ ID NO: 3852315 - RNA, 16 nt, Human
ugugccauagucacau

SEQ ID NO: 3852316 - RNA, 22 nt, Human
ugugccauuuuaaaaaaaaagg

SEQ ID NO: 3852317 - RNA, 12 nt, Human
ugugcccaaguu

SEQ ID NO: 3852318 - RNA, 20 nt, Human
ugugcccacaucccaggcuu

SEQ ID NO: 3852319 - RNA, 21 nt, Human
ugugcccacaucccaggcuuc

SEQ ID NO: 3852320 - RNA, 14 nt, Human
ugugcccacccucc

SEQ ID NO: 3852321 - RNA, 17 nt, Human
ugugcccagaauacuga

SEQ ID NO: 3852322 - RNA, 14 nt, Human
ugugcccagcucag

SEQ ID NO: 3852323 - RNA, 16 nt, Human
ugugcccagcucaguc

SEQ ID NO: 3852324 - RNA, 12 nt, Human
ugugcccaguua

SEQ ID NO: 3852325 - RNA, 22 nt, Human
ugugcccaguuaaucuugcuuu

SEQ ID NO: 3852326 - RNA, 19 nt, Human
ugugcccaugggcacugcu

SEQ ID NO: 3852327 - RNA, 23 nt, Human
ugugccccaugccuguccagccu

SEQ ID NO: 3852328 - RNA, 16 nt, Human
ugugcccccagacgca

SEQ ID NO: 3852329 - RNA, 22 nt, Human
ugugcccccagacgcacguggg

SEQ ID NO: 3852330 - RNA, 16 nt, Human
ugugcccccagggucc

SEQ ID NO: 3852331 - RNA, 22 nt, Human
ugugcccccaggguccugggag

SEQ ID NO: 3852332 - RNA, 13 nt, Human
ugugccccccauc

SEQ ID NO: 3852333 - RNA, 21 nt, Human
ugugccccccauccuggccca

SEQ ID NO: 3852334 - RNA, 16 nt, Human
ugugccccuugacaac

SEQ ID NO: 3852335 - RNA, 20 nt, Human
ugugcccuaaaguguauuuu

SEQ ID NO: 3852336 - RNA, 13 nt, Human
ugugcccucccug

SEQ ID NO: 3852337 - RNA, 12 nt, Human
ugugcccucugg

SEQ ID NO: 3852338 - RNA, 14 nt, Human
ugugcccucugggc

SEQ ID NO: 3852339 - RNA, 17 nt, Human
ugugcccucugggcucu

SEQ ID NO: 3852340 - RNA, 18 nt, Human
ugugcccucugggcucug

SEQ ID NO: 3852341 - RNA, 14 nt, Human
ugugcccuggugga

SEQ ID NO: 3852342 - RNA, 16 nt, Human
ugugccgaaugugcag

SEQ ID NO: 3852343 - RNA, 15 nt, Human
ugugccgacagaagg

SEQ ID NO: 3852344 - RNA, 23 nt, Human
ugugccuaaauaaguuauaaaga

SEQ ID NO: 3852345 - RNA, 15 nt, Human
ugugccuaacaccag

SEQ ID NO: 3852346 - RNA, 14 nt, Human
ugugccuaaugugu

SEQ ID NO: 3852347 - RNA, 15 nt, Human
ugugccuaauguguu

SEQ ID NO: 3852348 - RNA, 17 nt, Human
ugugccuaauguguuug

SEQ ID NO: 3852349 - RNA, 17 nt, Human
ugugccuauagucccag

SEQ ID NO: 3852350 - RNA, 19 nt, Human
ugugccuauugcuagagcu

SEQ ID NO: 3852351 - RNA, 16 nt, Human
ugugccucccugguga

SEQ ID NO: 3852352 - RNA, 21 nt, Human
ugugccuccucccucccucuc

SEQ ID NO: 3852353 - RNA, 20 nt, Human
ugugccucgcuccccacucu

SEQ ID NO: 3852354 - RNA, 16 nt, Human
ugugccucuagcugaa

SEQ ID NO: 3852355 - RNA, 20 nt, Human
ugugccucuagcugaauuga

SEQ ID NO: 3852356 - RNA, 12 nt, Human
ugugccucugcc

SEQ ID NO: 3852357 - RNA, 17 nt, Human
ugugccucugggacugg

SEQ ID NO: 3852358 - RNA, 18 nt, Human
ugugccugacugcccagc

SEQ ID NO: 3852359 - RNA, 23 nt, Human
ugugccugcuucagccucccaca

SEQ ID NO: 3852360 - RNA, 15 nt, Human
ugugccuggcucaga

SEQ ID NO: 3852361 - RNA, 21 nt, Human
ugugccugggggaguuuuccu

SEQ ID NO: 3852362 - RNA, 12 nt, Human
ugugccuggggu

SEQ ID NO: 3852363 - RNA, 20 nt, Human
ugugccuggguggacauggc

SEQ ID NO: 3852364 - RNA, 13 nt, Human
ugugccugugugc

SEQ ID NO: 3852365 - RNA, 15 nt, Human
ugugccuuauguuga

SEQ ID NO: 3852366 - RNA, 23 nt, Human
ugugccuucgucuuucccauggg

SEQ ID NO: 3852367 - RNA, 21 nt, Human
ugugccuucucucucccuuuu

SEQ ID NO: 3852368 - RNA, 16 nt, Human
ugugccuucuuuugau

SEQ ID NO: 3852369 - RNA, 16 nt, Human
ugugccuuugcaaauc

SEQ ID NO: 3852370 - RNA, 18 nt, Human
ugugccuuugcaaaucag

SEQ ID NO: 3852371 - RNA, 20 nt, Human
ugugccuuugcaaaucagug

SEQ ID NO: 3852372 - RNA, 19 nt, Human
ugugcgcuaaacuuuucug

SEQ ID NO: 3852373 - RNA, 22 nt, Human
ugugcgcuaaacuuuucugaua

SEQ ID NO: 3852374 - RNA, 14 nt, Human
ugugcguccugucg

SEQ ID NO: 3852375 - RNA, 14 nt, Human
ugugcgugaaacac

SEQ ID NO: 3852376 - RNA, 16 nt, Human
ugugcgugaaacacac

SEQ ID NO: 3852377 - RNA, 15 nt, Human
ugugcgugcaugugc

SEQ ID NO: 3852378 - RNA, 19 nt, Human
ugugcgugguggucccugg

SEQ ID NO: 3852379 - RNA, 15 nt, Human
ugugcuacaggggcc

SEQ ID NO: 3852380 - RNA, 17 nt, Human
ugugcuacaggggccag

SEQ ID NO: 3852381 - RNA, 14 nt, Human
ugugcuacuuugcc

SEQ ID NO: 3852382 - RNA, 15 nt, Human
ugugcuacuuugccu

SEQ ID NO: 3852383 - RNA, 16 nt, Human
ugugcuagaauacuuu

SEQ ID NO: 3852384 - RNA, 18 nt, Human
ugugcuagaauacuuuuu

SEQ ID NO: 3852385 - RNA, 18 nt, Human
ugugcuauaguauuugau

SEQ ID NO: 3852386 - RNA, 17 nt, Human
ugugcuauuaauauuug

SEQ ID NO: 3852387 - RNA, 18 nt, Human
ugugcuauuaauauuugu

SEQ ID NO: 3852388 - RNA, 20 nt, Human
ugugcucaaaauuugaagaa

SEQ ID NO: 3852389 - RNA, 15 nt, Human
ugugcucagaagggc

SEQ ID NO: 3852390 - RNA, 14 nt, Human
ugugcucagaauua

SEQ ID NO: 3852391 - RNA, 12 nt, Human
ugugcucagaga

SEQ ID NO: 3852392 - RNA, 22 nt, Human
ugugcucagagaccugaagugu

SEQ ID NO: 3852393 - RNA, 17 nt, Human
ugugcucaggagcccug

SEQ ID NO: 3852394 - RNA, 14 nt, Human
uuauuuuuuacauu

SEQ ID NO: 3852395 - RNA, 13 nt, Human
uuauuuuuuauac

SEQ ID NO: 3852396 - RNA, 14 nt, Human
uuauuuuuuauaca

SEQ ID NO: 3852397 - RNA, 13 nt, Human
uuauuuuuuccca

SEQ ID NO: 3852398 - RNA, 17 nt, Human
uuauuuuuuucugaauu

SEQ ID NO: 3852399 - RNA, 14 nt, Human
uucaaaaaaacacu

SEQ ID NO: 3852400 - RNA, 16 nt, Human
uucaaaaaacuuguaa

SEQ ID NO: 3852401 - RNA, 15 nt, Human
uucaaaaacuguauu

SEQ ID NO: 3852402 - RNA, 13 nt, Human
uucaaaaacuguu

SEQ ID NO: 3852403 - RNA, 21 nt, Human
uucaaaaacuguuuuggguag

SEQ ID NO: 3852404 - RNA, 21 nt, Human
uucaaaaagucuacgcucucc

SEQ ID NO: 3852405 - RNA, 15 nt, Human
uucaaaaauauaacu

SEQ ID NO: 3852406 - RNA, 18 nt, Human
uucaaaaaucugaagauu

SEQ ID NO: 3852407 - RNA, 21 nt, Human
uucaaaaaucugaagauuguu

SEQ ID NO: 3852408 - RNA, 22 nt, Human
uucaaaaaucugaagauuguuu

SEQ ID NO: 3852409 - RNA, 11 nt, Human
uucaaaaaugu

SEQ ID NO: 3852410 - RNA, 13 nt, Human
uucaaaaauuugg

SEQ ID NO: 3852411 - RNA, 17 nt, Human
uucaaaaauuuggaauu

SEQ ID NO: 3852412 - RNA, 23 nt, Human
uucaaaacaaacagaugcucuga

SEQ ID NO: 3852413 - RNA, 12 nt, Human
uucaaaagaaag

SEQ ID NO: 3852414 - RNA, 21 nt, Human
uucaaaagaaucagaaacagg

SEQ ID NO: 3852415 - RNA, 20 nt, Human
uucaaaagguauuauacaug

SEQ ID NO: 3852416 - RNA, 22 nt, Human
uucaaaaguaaugccucugucu

SEQ ID NO: 3852417 - RNA, 15 nt, Human
uucaaaaguuccaag

SEQ ID NO: 3852418 - RNA, 14 nt, Human
uucaaaauaaaaac

SEQ ID NO: 3852419 - RNA, 17 nt, Human
uucaaaauaaaaaugag

SEQ ID NO: 3852420 - RNA, 17 nt, Human
uucaaaauaaaauauca

SEQ ID NO: 3852421 - RNA, 15 nt, Human
uucaaaauauuuaaa

SEQ ID NO: 3852422 - RNA, 22 nt, Human
uucaaaauauuuaaaaaugucu

SEQ ID NO: 3852423 - RNA, 19 nt, Human
uucaaaauccuuccaaaga

SEQ ID NO: 3852424 - RNA, 19 nt, Human
uucaaaaugauuuccucug

SEQ ID NO: 3852425 - RNA, 14 nt, Human
uucaaaauguauau

SEQ ID NO: 3852426 - RNA, 18 nt, Human
uucaaaaugucuguagcu

SEQ ID NO: 3852427 - RNA, 16 nt, Human
uucaaaauuaaaucug

SEQ ID NO: 3852428 - RNA, 18 nt, Human
uucaaaauucuaaaugua

SEQ ID NO: 3852429 - RNA, 21 nt, Human
uucaaaauuguuacaaauugu

SEQ ID NO: 3852430 - RNA, 17 nt, Human
uucaaacacaaaugcag

SEQ ID NO: 3852431 - RNA, 14 nt, Human
uucaaacggccuca

SEQ ID NO: 3852432 - RNA, 12 nt, Human
uucaaacuacuu

SEQ ID NO: 3852433 - RNA, 21 nt, Human
uucaaacuggggccuccagaa

SEQ ID NO: 3852434 - RNA, 13 nt, Human
uucaaacugugaa

SEQ ID NO: 3852435 - RNA, 19 nt, Human
uucaaacuuacuauuuuga

SEQ ID NO: 3852436 - RNA, 22 nt, Human
uucaaagcaauugaaaugcauu

SEQ ID NO: 3852437 - RNA, 21 nt, Human
uucaaagcaccaaaauaagaa

SEQ ID NO: 3852438 - RNA, 23 nt, Human
uucaaagcaccaaaauaagaaaa

SEQ ID NO: 3852439 - RNA, 16 nt, Human
uucaaagcaugaaaug

SEQ ID NO: 3852440 - RNA, 16 nt, Human
uucaaagccaagaccu

SEQ ID NO: 3852441 - RNA, 21 nt, Human
uucaaagccaagaccucacac

SEQ ID NO: 3852442 - RNA, 23 nt, Human
uucaaagccaaguuuauauacaa

SEQ ID NO: 3852443 - RNA, 13 nt, Human
uucaaagccacau

SEQ ID NO: 3852444 - RNA, 14 nt, Human
uucaaagccauuuu

SEQ ID NO: 3852445 - RNA, 12 nt, Human
uucaaagccuuc

SEQ ID NO: 3852446 - RNA, 20 nt, Human
uucaaagcuguguguuugga

SEQ ID NO: 3852447 - RNA, 23 nt, Human
uucaaagcuguguguuuggaaga

SEQ ID NO: 3852448 - RNA, 22 nt, Human
uucaaagcuuuuuccagaggcu

SEQ ID NO: 3852449 - RNA, 19 nt, Human
uucaaagucaugauguuuu

SEQ ID NO: 3852450 - RNA, 11 nt, Human
uucaaagucuc

SEQ ID NO: 3852451 - RNA, 20 nt, Human
uucaaagucucaaugaaaua

SEQ ID NO: 3852452 - RNA, 16 nt, Human
uucaaaguugccuaaa

SEQ ID NO: 3852453 - RNA, 17 nt, Human
uucaaaguugccuaaau

SEQ ID NO: 3852454 - RNA, 23 nt, Human
uucaaaguugccuaaauccauuu

SEQ ID NO: 3852455 - RNA, 15 nt, Human
uucaaauccuuccaa

SEQ ID NO: 3852456 - RNA, 19 nt, Human
uucaaaucguuuauuucac

SEQ ID NO: 3852457 - RNA, 22 nt, Human
uucaaaugauuuuuacaaguuu

SEQ ID NO: 3852458 - RNA, 16 nt, Human
uucaaauggguuuucc

SEQ ID NO: 3852459 - RNA, 21 nt, Human
uucaaauggguuuuccacgcu

SEQ ID NO: 3852460 - RNA, 18 nt, Human
uucaaauguauuacagug

SEQ ID NO: 3852461 - RNA, 16 nt, Human
uucaaauucuucugaa

SEQ ID NO: 3852462 - RNA, 18 nt, Human
uucaaauugagagaaugg

SEQ ID NO: 3852463 - RNA, 19 nt, Human
uucaaauuggacuuucaaa

SEQ ID NO: 3852464 - RNA, 16 nt, Human
uucaaauugucuuuug

SEQ ID NO: 3852465 - RNA, 15 nt, Human
uucaacaauucuaaa

SEQ ID NO: 3852466 - RNA, 23 nt, Human
uucaacagacccccucuagaaau

SEQ ID NO: 3852467 - RNA, 20 nt, Human
uucaacagcaagugugaaua

SEQ ID NO: 3852468 - RNA, 15 nt, Human
uucaacaucaauguu

SEQ ID NO: 3852469 - RNA, 17 nt, Human
uucaacauccugccagc

SEQ ID NO: 3852470 - RNA, 18 nt, Human
uucaaccagggauuguuu

SEQ ID NO: 3852471 - RNA, 16 nt, Human
uucaaccaugaagucu

SEQ ID NO: 3852472 - RNA, 15 nt, Human
uucaaccauucccca

SEQ ID NO: 3852473 - RNA, 17 nt, Human
uucaaccauuccccaug

SEQ ID NO: 3852474 - RNA, 20 nt, Human
uucaaccauuccccauggga

SEQ ID NO: 3852475 - RNA, 17 nt, Human
uucaacccacagcuacu

SEQ ID NO: 3852476 - RNA, 20 nt, Human
uucaacccccuuaacuguau

SEQ ID NO: 3852477 - RNA, 13 nt, Human
uucaacccuggag

SEQ ID NO: 3852478 - RNA, 23 nt, Human
uucaaccucuagaauuuuaagcc

SEQ ID NO: 3852479 - RNA, 16 nt, Human
uucaacggaaagugcu

SEQ ID NO: 3852480 - RNA, 18 nt, Human
uucaacuauuuuauuauc

SEQ ID NO: 3852481 - RNA, 12 nt, Human
uucaacucagac

SEQ ID NO: 3852482 - RNA, 17 nt, Human
uucaacugaccagccuc

SEQ ID NO: 3852483 - RNA, 21 nt, Human
uucaacugccaaaaugcucua

SEQ ID NO: 3852484 - RNA, 13 nt, Human
uucaacuuugaau

SEQ ID NO: 3852485 - RNA, 20 nt, Human
uucaacuuugaauaaagaau

SEQ ID NO: 3852486 - RNA, 13 nt, Human
uucaagaaacuga

SEQ ID NO: 3852487 - RNA, 12 nt, Human
uucaagaaauaa

SEQ ID NO: 3852488 - RNA, 17 nt, Human
uucaagaaaugaagagc

SEQ ID NO: 3852489 - RNA, 14 nt, Human
uucaagaccagccu

SEQ ID NO: 3852490 - RNA, 17 nt, Human
uucaagaccagccuggc

SEQ ID NO: 3852491 - RNA, 18 nt, Human
uucaagaccuucucccca

SEQ ID NO: 3852492 - RNA, 18 nt, Human
uucaagagauuuaauuaa

SEQ ID NO: 3852493 - RNA, 15 nt, Human
uucaagaggagcccc

SEQ ID NO: 3852494 - RNA, 13 nt, Human
uucaagaucaaaa

SEQ ID NO: 3852495 - RNA, 16 nt, Human
uucaagcaauccuccc

SEQ ID NO: 3852496 - RNA, 17 nt, Human
uucaagcagauuggaga

SEQ ID NO: 3852497 - RNA, 18 nt, Human
uucaagcagucgugccug

SEQ ID NO: 3852498 - RNA, 15 nt, Human
uucaagcauuaagaa

SEQ ID NO: 3852499 - RNA, 20 nt, Human
uucaagccugugcaaugcau

SEQ ID NO: 3852500 - RNA, 20 nt, Human
uucaagcgauucuucugccu

SEQ ID NO: 3852501 - RNA, 19 nt, Human
uucaaggaguaugcaggga

SEQ ID NO: 3852502 - RNA, 18 nt, Human
uucaaggauccugagcca

SEQ ID NO: 3852503 - RNA, 14 nt, Human
uucaaggcacucua

SEQ ID NO: 3852504 - RNA, 16 nt, Human
uucaaggcacucuaga

SEQ ID NO: 3852505 - RNA, 17 nt, Human
uucaaggcacucuagau

SEQ ID NO: 3852506 - RNA, 18 nt, Human
uucaaggcacucuagauu

SEQ ID NO: 3852507 - RNA, 21 nt, Human
uucaaggcacucuagauucca

SEQ ID NO: 3852508 - RNA, 22 nt, Human
uucaaggcacucuagauuccau

SEQ ID NO: 3852509 - RNA, 17 nt, Human
uucaaguacacugaauu

SEQ ID NO: 3852510 - RNA, 21 nt, Human
uucaaguauuagggguaauau

SEQ ID NO: 3852511 - RNA, 14 nt, Human
uucaaguauuuaag

SEQ ID NO: 3852512 - RNA, 19 nt, Human
uucaagucaguucugugau

SEQ ID NO: 3852513 - RNA, 22 nt, Human
uacacccccucuucugagcaca

SEQ ID NO: 3852514 - RNA, 16 nt, Human
uacaccgacuagccag

SEQ ID NO: 3852515 - RNA, 17 nt, Human
uacaccgacuagccagg

SEQ ID NO: 3852516 - RNA, 12 nt, Human
uacaccuaacuc

SEQ ID NO: 3852517 - RNA, 22 nt, Human
uacaccuaacucaccuaacuca

SEQ ID NO: 3852518 - RNA, 13 nt, Human
uacaccuggcuga

SEQ ID NO: 3852519 - RNA, 14 nt, Human
uacaccuggcugag

SEQ ID NO: 3852520 - RNA, 14 nt, Human
uacaccuugccuug

SEQ ID NO: 3852521 - RNA, 14 nt, Human
uacaccuugcuuuu

SEQ ID NO: 3852522 - RNA, 19 nt, Human
uacaccuugcuuuuuuacu

SEQ ID NO: 3852523 - RNA, 20 nt, Human
uacaccuuucuccuuuguac

SEQ ID NO: 3852524 - RNA, 14 nt, Human
uacacgaaagagag

SEQ ID NO: 3852525 - RNA, 16 nt, Human
uacacgaaagagagag

SEQ ID NO: 3852526 - RNA, 18 nt, Human
uacacgaauagacaucaa

SEQ ID NO: 3852527 - RNA, 21 nt, Human
uacacgaccauuugauaggga

SEQ ID NO: 3852528 - RNA, 17 nt, Human
uacacgcuuuugugaug

SEQ ID NO: 3852529 - RNA, 17 nt, Human
uacacguguccuguagu

SEQ ID NO: 3852530 - RNA, 14 nt, Human
uacacuaagagaga

SEQ ID NO: 3852531 - RNA, 14 nt, Human
uacacuaguuguuu

SEQ ID NO: 3852532 - RNA, 13 nt, Human
uacacuaucuuaa

SEQ ID NO: 3852533 - RNA, 17 nt, Human
uacacuccagccugagc

SEQ ID NO: 3852534 - RNA, 18 nt, Human
uacacuccagccugagca

SEQ ID NO: 3852535 - RNA, 14 nt, Human
uacacuccagugag

SEQ ID NO: 3852536 - RNA, 19 nt, Human
uacacucguaugauacuuc

SEQ ID NO: 3852537 - RNA, 22 nt, Human
uacacucuccugggccccuccc

SEQ ID NO: 3852538 - RNA, 13 nt, Human
uacacucuuauag

SEQ ID NO: 3852539 - RNA, 18 nt, Human
uguuggcacaugccugua

SEQ ID NO: 3852540 - RNA, 18 nt, Human
uguuggcaggcuggccag

SEQ ID NO: 3852541 - RNA, 14 nt, Human
uguuggccaggcug

SEQ ID NO: 3852542 - RNA, 16 nt, Human
uguuggccaggcuggu

SEQ ID NO: 3852543 - RNA, 17 nt, Human
uguuggccuccggccuc

SEQ ID NO: 3852544 - RNA, 23 nt, Human
uguuggcguaggcuacagagaag

SEQ ID NO: 3852545 - RNA, 23 nt, Human
uguuggcguggggccuuugucag

SEQ ID NO: 3852546 - RNA, 14 nt, Human
uguuggcuagccuc

SEQ ID NO: 3852547 - RNA, 22 nt, Human
uguuggcugggaacucaccugg

SEQ ID NO: 3852548 - RNA, 23 nt, Human
uguugggaaaaaggccucugucc

SEQ ID NO: 3852549 - RNA, 19 nt, Human
uguugggaaacuuggcucg

SEQ ID NO: 3852550 - RNA, 18 nt, Human
uguugggagugaggaugu

SEQ ID NO: 3852551 - RNA, 18 nt, Human
uguugggaucgcauugca

SEQ ID NO: 3852552 - RNA, 15 nt, Human
uguugggauuccuga

SEQ ID NO: 3852553 - RNA, 20 nt, Human
uguuggggaagggccugccc

SEQ ID NO: 3852554 - RNA, 15 nt, Human
uguuggggcaguggu

SEQ ID NO: 3852555 - RNA, 18 nt, Human
uguugggguggguauaaa

SEQ ID NO: 3852556 - RNA, 20 nt, Human
uguugggguggguauaaaag

SEQ ID NO: 3852557 - RNA, 14 nt, Human
uguuggucauuuua

SEQ ID NO: 3852558 - RNA, 19 nt, Human
uguugguuccaagcccugg

SEQ ID NO: 3852559 - RNA, 15 nt, Human
uguugguugcacuuu

SEQ ID NO: 3852560 - RNA, 13 nt, Human
uguugguuuacuu

SEQ ID NO: 3852561 - RNA, 14 nt, Human
uguugguuuugacu

SEQ ID NO: 3852562 - RNA, 21 nt, Human
uguugguuuugggggugugag

SEQ ID NO: 3852563 - RNA, 15 nt, Human
uguugguuuuuaaag

SEQ ID NO: 3852564 - RNA, 13 nt, Human
uguuguaaaaaga

SEQ ID NO: 3852565 - RNA, 15 nt, Human
uguuguaaaaagaaa

SEQ ID NO: 3852566 - RNA, 17 nt, Human
uguuguaaaacaaaauu

SEQ ID NO: 3852567 - RNA, 16 nt, Human
uguuguaaacauuucu

SEQ ID NO: 3852568 - RNA, 15 nt, Human
uguuguaaagaguug

SEQ ID NO: 3852569 - RNA, 21 nt, Human
uguuguaaauauuuauguaaa

SEQ ID NO: 3852570 - RNA, 18 nt, Human
uguuguaaccugcuguga

SEQ ID NO: 3852571 - RNA, 12 nt, Human
uguuguaacuua

SEQ ID NO: 3852572 - RNA, 19 nt, Human
uguuguaacuuauguagau

SEQ ID NO: 3852573 - RNA, 16 nt, Human
uguuguaaugcugcac

SEQ ID NO: 3852574 - RNA, 15 nt, Human
uguuguaauucuuca

SEQ ID NO: 3852575 - RNA, 19 nt, Human
uguuguaauucuucaguug

SEQ ID NO: 3852576 - RNA, 13 nt, Human
uguuguacauuua

SEQ ID NO: 3852577 - RNA, 14 nt, Human
uguuguacauuuau

SEQ ID NO: 3852578 - RNA, 15 nt, Human
uguuguacauuuaug

SEQ ID NO: 3852579 - RNA, 18 nt, Human
uguuguacauuuaugauu

SEQ ID NO: 3852580 - RNA, 23 nt, Human
uguuguagagaaaacaugcagaa

SEQ ID NO: 3852581 - RNA, 11 nt, Human
uguuguagugu

SEQ ID NO: 3852582 - RNA, 13 nt, Human
uguugucaaagag

SEQ ID NO: 3852583 - RNA, 13 nt, Human
uguugucagcuga

SEQ ID NO: 3852584 - RNA, 11 nt, Human
uguugucauug

SEQ ID NO: 3852585 - RNA, 16 nt, Human
uguugucauugcuuua

SEQ ID NO: 3852586 - RNA, 19 nt, Human
uguugucauuguaaacaaa

SEQ ID NO: 3852587 - RNA, 17 nt, Human
uguuguccaacuauuua

SEQ ID NO: 3852588 - RNA, 17 nt, Human
uguuguccgguuuacuu

SEQ ID NO: 3852589 - RNA, 17 nt, Human
uguuguccuuuugucuu

SEQ ID NO: 3852590 - RNA, 18 nt, Human
uguugucguaaagauuug

SEQ ID NO: 3852591 - RNA, 15 nt, Human
uguugucucuucucc

SEQ ID NO: 3852592 - RNA, 17 nt, Human
uguugucucuucuccuu

SEQ ID NO: 3852593 - RNA, 15 nt, Human
uguugucucuugagu

SEQ ID NO: 3852594 - RNA, 16 nt, Human
uguugucugcaacucu

SEQ ID NO: 3852595 - RNA, 20 nt, Human
uguugugaauaauuacagug

SEQ ID NO: 3852596 - RNA, 12 nt, Human
uguugugaaugu

SEQ ID NO: 3852597 - RNA, 13 nt, Human
uguugugaauguu

SEQ ID NO: 3852598 - RNA, 13 nt, Human
uguugugcuuuua

SEQ ID NO: 3852599 - RNA, 21 nt, Human
uguuguggguucuauguuuac

SEQ ID NO: 3852600 - RNA, 16 nt, Human
uguuguguacagacuu

SEQ ID NO: 3852601 - RNA, 21 nt, Human
uguugugugccucuagcugaa

SEQ ID NO: 3852602 - RNA, 13 nt, Human
uguugugugugca

SEQ ID NO: 3852603 - RNA, 15 nt, Human
uguugugugugcagg

SEQ ID NO: 3852604 - RNA, 14 nt, Human
uguuguguguggga

SEQ ID NO: 3852605 - RNA, 14 nt, Human
uguuguuaugaugu

SEQ ID NO: 3852606 - RNA, 18 nt, Human
uguuguuccuuuugaaag

SEQ ID NO: 3852607 - RNA, 18 nt, Human
uguuguucuguuaacuga

SEQ ID NO: 3852608 - RNA, 16 nt, Human
uguuguucuuacaaac

SEQ ID NO: 3852609 - RNA, 23 nt, Human
uguuguucuuggcaauaaauuuu

SEQ ID NO: 3852610 - RNA, 20 nt, Human
uguuguugcuucuugugaag

SEQ ID NO: 3852611 - RNA, 13 nt, Human
uguuguugguugu

SEQ ID NO: 3852612 - RNA, 13 nt, Human
uguuguuuaaugu

SEQ ID NO: 3852613 - RNA, 15 nt, Human
uguuguuuauaauaa

SEQ ID NO: 3852614 - RNA, 14 nt, Human
uguuguuucaguga

SEQ ID NO: 3852615 - RNA, 21 nt, Human
uguuguuucagugaauaugcc

SEQ ID NO: 3852616 - RNA, 21 nt, Human
uguuguuucuuaaauaagaaa

SEQ ID NO: 3852617 - RNA, 13 nt, Human
uguuguuucuuuc

SEQ ID NO: 3852618 - RNA, 14 nt, Human
uguuguuucuuucu

SEQ ID NO: 3852619 - RNA, 17 nt, Human
uguuguuugaaaauauu

SEQ ID NO: 3852620 - RNA, 14 nt, Human
uguuguuuguaaau

SEQ ID NO: 3852621 - RNA, 21 nt, Human
uguuguuuguaaauaagagau

SEQ ID NO: 3852622 - RNA, 16 nt, Human
uguuguuuuguacaga

SEQ ID NO: 3852623 - RNA, 17 nt, Human
uguuuaaaaaaguuuaa

SEQ ID NO: 3852624 - RNA, 18 nt, Human
uguuuaaaaaaguuuaaa

SEQ ID NO: 3852625 - RNA, 22 nt, Human
uguuuaaaaaaguuuaaaaugu

SEQ ID NO: 3852626 - RNA, 12 nt, Human
uguuuaaaacac

SEQ ID NO: 3852627 - RNA, 15 nt, Human
uguuuaaaacaucau

SEQ ID NO: 3852628 - RNA, 12 nt, Human
uguuuaaaacuu

SEQ ID NO: 3852629 - RNA, 14 nt, Human
uguuuaaaauaaaa

SEQ ID NO: 3852630 - RNA, 21 nt, Human
uguuuaaaauaaaaugaaaau

SEQ ID NO: 3852631 - RNA, 18 nt, Human
uguuuaaaaucauuucug

SEQ ID NO: 3852632 - RNA, 13 nt, Human
uguuuaaaaugua

SEQ ID NO: 3852633 - RNA, 20 nt, Human
uguuuaaaauguaauuuaaa

SEQ ID NO: 3852634 - RNA, 23 nt, Human
uguuuaaagguuucuauuuucuc

SEQ ID NO: 3852635 - RNA, 15 nt, Human
uguuuaaauaaagua

SEQ ID NO: 3852636 - RNA, 18 nt, Human
uguuuaagaaaaguauuu

SEQ ID NO: 3852637 - RNA, 17 nt, Human
uguuuaagacacuuccg

SEQ ID NO: 3852638 - RNA, 12 nt, Human
uguuuaagagac

SEQ ID NO: 3852639 - RNA, 18 nt, Human
uguuuaagauuuaauuug

SEQ ID NO: 3852640 - RNA, 20 nt, Human
uguuuaagauuuaauuugcc

SEQ ID NO: 3852641 - RNA, 14 nt, Human
uguuuaagcagaau

SEQ ID NO: 3852642 - RNA, 21 nt, Human
uguuuaaguguuguaaauauu

SEQ ID NO: 3852643 - RNA, 14 nt, Human
uguuuaauauuuaa

SEQ ID NO: 3852644 - RNA, 21 nt, Human
uguuuaaucauaguuacugug

SEQ ID NO: 3852645 - RNA, 16 nt, Human
uguuuaaucauauaaa

SEQ ID NO: 3852646 - RNA, 15 nt, Human
uguuuaaugugaacu

SEQ ID NO: 3852647 - RNA, 16 nt, Human
uguuuaaugugaacuu

SEQ ID NO: 3852648 - RNA, 19 nt, Human
uguuuaaugugaacuugua

SEQ ID NO: 3852649 - RNA, 16 nt, Human
uguuuaauguucugug

SEQ ID NO: 3852650 - RNA, 14 nt, Human
uguuuaauuucuuc

SEQ ID NO: 3852651 - RNA, 23 nt, Human
uguuuaauuucuucaaaauguau

SEQ ID NO: 3852652 - RNA, 19 nt, Human
uguuuacaaaaucagguaa

SEQ ID NO: 3852653 - RNA, 18 nt, Human
uguuuacacucuuuguaa

SEQ ID NO: 3852654 - RNA, 14 nt, Human
uguuuacagaggac

SEQ ID NO: 3852655 - RNA, 23 nt, Human
uguuuacagcacuacucugugcc

SEQ ID NO: 3852656 - RNA, 22 nt, Human
uguuuacagggagccuccugcc

SEQ ID NO: 3852657 - RNA, 13 nt, Human
uguuuacaugcuu

SEQ ID NO: 3852658 - RNA, 20 nt, Human
uguuuacauuuuauggugcc

SEQ ID NO: 3852659 - RNA, 14 nt, Human
uguuuaccauuuuu

SEQ ID NO: 3852660 - RNA, 19 nt, Human
uguuuacuugaauaguauu

SEQ ID NO: 3852661 - RNA, 22 nt, Human
uguuuagaacacugguuuaaag

SEQ ID NO: 3852662 - RNA, 23 nt, Human
uguuuagaauugaagguuuuuga

SEQ ID NO: 3852663 - RNA, 16 nt, Human
uguuuagauaauacac

SEQ ID NO: 3852664 - RNA, 12 nt, Human
uguuuagauuug

SEQ ID NO: 3852665 - RNA, 17 nt, Human
uguuuagauuuuguguu

SEQ ID NO: 3852666 - RNA, 18 nt, Human
uguuuaggggaucuggaa

SEQ ID NO: 3852667 - RNA, 19 nt, Human
uguuuaguaaacucaauaa

SEQ ID NO: 3852668 - RNA, 14 nt, Human
uguuuaguaaucau

SEQ ID NO: 3852669 - RNA, 19 nt, Human
uguuuagucuugucucaga

SEQ ID NO: 3852670 - RNA, 20 nt, Human
uguuuagucuugucucagau

SEQ ID NO: 3852671 - RNA, 15 nt, Human
uguuuagucuuuaua

SEQ ID NO: 3852672 - RNA, 16 nt, Human
uguuuaguucagcaaa

SEQ ID NO: 3852673 - RNA, 22 nt, Human
uguuuauaaaauauaaacaaag

SEQ ID NO: 3852674 - RNA, 23 nt, Human
uguuuauaaaauauaaacaaaga

SEQ ID NO: 3852675 - RNA, 20 nt, Human
uguuuauaacuauucaguug

SEQ ID NO: 3852676 - RNA, 16 nt, Human
uguuuauaauaaaaau

SEQ ID NO: 3852677 - RNA, 16 nt, Human
uguuuauaccuuugcc

SEQ ID NO: 3852678 - RNA, 13 nt, Human
uguuuauagcauu

SEQ ID NO: 3852679 - RNA, 14 nt, Human
uguuuauauaaaug

SEQ ID NO: 3852680 - RNA, 21 nt, Human
uacaguagauuuuccaaaugu

SEQ ID NO: 3852681 - RNA, 22 nt, Human
uacaguaggagcccagcucuga

SEQ ID NO: 3852682 - RNA, 18 nt, Human
uacaguagugagaagaau

SEQ ID NO: 3852683 - RNA, 15 nt, Human
uacaguaucucaggg

SEQ ID NO: 3852684 - RNA, 21 nt, Human
uacaguauggggguuguaaau

SEQ ID NO: 3852685 - RNA, 22 nt, Human
uacguuccuauugucauuaaag

SEQ ID NO: 3852686 - RNA, 13 nt, Human
uacguuucuuuaa

SEQ ID NO: 3852687 - RNA, 23 nt, Human
uacguuucuuuaaccuuguauaa

SEQ ID NO: 3852688 - RNA, 18 nt, Human
uacuaaaaaaaagaugaa

SEQ ID NO: 3852689 - RNA, 23 nt, Human
uacuaaaaagaaggaaaaugauc

SEQ ID NO: 3852690 - RNA, 15 nt, Human
uacuaaaaaguauaa

SEQ ID NO: 3852691 - RNA, 14 nt, Human
uacuaaaaaugcaa

SEQ ID NO: 3852692 - RNA, 12 nt, Human
uacuaaaauaua

SEQ ID NO: 3852693 - RNA, 14 nt, Human
uacuaaagaaagau

SEQ ID NO: 3852694 - RNA, 15 nt, Human
uacuaaagaaagauu

SEQ ID NO: 3852695 - RNA, 13 nt, Human
uacuaaauuuaaa

SEQ ID NO: 3852696 - RNA, 14 nt, Human
uacuaacacaagga

SEQ ID NO: 3852697 - RNA, 15 nt, Human
uacuaacuaaacucu

SEQ ID NO: 3852698 - RNA, 12 nt, Human
uacuaacuucua

SEQ ID NO: 3852699 - RNA, 20 nt, Human
uacuaacuucuaaaacugua

SEQ ID NO: 3852700 - RNA, 13 nt, Human
uacuaacuuuccu

SEQ ID NO: 3852701 - RNA, 19 nt, Human
uacuaaggaagauuacuca

SEQ ID NO: 3852702 - RNA, 16 nt, Human
uacuaaggacguuguu

SEQ ID NO: 3852703 - RNA, 12 nt, Human
uacuaaggauac

SEQ ID NO: 3852704 - RNA, 20 nt, Human
uacuaaggauacaggcugga

SEQ ID NO: 3852705 - RNA, 22 nt, Human
uacuaaguucacauuagaauua

SEQ ID NO: 3852706 - RNA, 16 nt, Human
uacuaauaaacuaaua

SEQ ID NO: 3852707 - RNA, 19 nt, Human
uacuaauaaucuuguuucu

SEQ ID NO: 3852708 - RNA, 16 nt, Human
uacuaaugauguuuuc

SEQ ID NO: 3852709 - RNA, 13 nt, Human
uacuaauuccaca

SEQ ID NO: 3852710 - RNA, 18 nt, Human
uacuaauuuuacacauua

SEQ ID NO: 3852711 - RNA, 12 nt, Human
uacuacaguccu

SEQ ID NO: 3852712 - RNA, 22 nt, Human
uacuacaguccucccaucucac

SEQ ID NO: 3852713 - RNA, 21 nt, Human
uacuacaguuguuuuuugaaa

SEQ ID NO: 3852714 - RNA, 14 nt, Human
uacuacaguuuuua

SEQ ID NO: 3852715 - RNA, 15 nt, Human
uacuaccaaugccaa

SEQ ID NO: 3852716 - RNA, 13 nt, Human
uacuaccugugua

SEQ ID NO: 3852717 - RNA, 13 nt, Human
uacuaccuugaaa

SEQ ID NO: 3852718 - RNA, 20 nt, Human
uacuaccuugaaaauaagaa

SEQ ID NO: 3852719 - RNA, 17 nt, Human
uacuacuagaugucuuu

SEQ ID NO: 3852720 - RNA, 16 nt, Human
uacuacugaaucucua

SEQ ID NO: 3852721 - RNA, 16 nt, Human
uacuacugaccagaca

SEQ ID NO: 3852722 - RNA, 20 nt, Human
uacuacugaccagacaagcu

SEQ ID NO: 3852723 - RNA, 14 nt, Human
uacuacuguguaag

SEQ ID NO: 3852724 - RNA, 17 nt, Human
uacuagaagaugaauac

SEQ ID NO: 3852725 - RNA, 22 nt, Human
uacuagaagaugaauacaaaca

SEQ ID NO: 3852726 - RNA, 16 nt, Human
uacuagauuugggaga

SEQ ID NO: 3852727 - RNA, 21 nt, Human
uacuagcaaaauaaaacauag

SEQ ID NO: 3852728 - RNA, 17 nt, Human
uacuagcauaugaguuu

SEQ ID NO: 3852729 - RNA, 20 nt, Human
uacuagcuuuucaaacaaga

SEQ ID NO: 3852730 - RNA, 15 nt, Human
uacuaggauacugcu

SEQ ID NO: 3852731 - RNA, 18 nt, Human
uacuaggcaguuagagau

SEQ ID NO: 3852732 - RNA, 23 nt, Human
uacuaggcuuaauaccuggguga

SEQ ID NO: 3852733 - RNA, 15 nt, Human
uacuagggaccuggg

SEQ ID NO: 3852734 - RNA, 16 nt, Human
uacuagguaacuucau

SEQ ID NO: 3852735 - RNA, 19 nt, Human
uacuagguaacuucauauu

SEQ ID NO: 3852736 - RNA, 16 nt, Human
uacuaguacuguguac

SEQ ID NO: 3852737 - RNA, 17 nt, Human
uacuaguacuguguacu

SEQ ID NO: 3852738 - RNA, 21 nt, Human
uacuagucaccagagacuuua

SEQ ID NO: 3852739 - RNA, 14 nt, Human
uuaaacuuaugaau

SEQ ID NO: 3852740 - RNA, 17 nt, Human
uuaaacuucucugaagg

SEQ ID NO: 3852741 - RNA, 18 nt, Human
uuaaacuucucugaaggg

SEQ ID NO: 3852742 - RNA, 15 nt, Human
uuaaacuugugaaug

SEQ ID NO: 3852743 - RNA, 17 nt, Human
uuaaacuuuuaauucau

SEQ ID NO: 3852744 - RNA, 18 nt, Human
uuaaacuuuuaauucauu

SEQ ID NO: 3852745 - RNA, 14 nt, Human
uuaaagaaaggaaa

SEQ ID NO: 3852746 - RNA, 16 nt, Human
uuaaagaaaggaaaag

SEQ ID NO: 3852747 - RNA, 20 nt, Human
uuaaagaaauauguauucug

SEQ ID NO: 3852748 - RNA, 12 nt, Human
uuaaagaagacc

SEQ ID NO: 3852749 - RNA, 19 nt, Human
uuaaagaauucaaauuuua

SEQ ID NO: 3852750 - RNA, 12 nt, Human
uuaaagacagag

SEQ ID NO: 3852751 - RNA, 12 nt, Human
uuaaagagucua

SEQ ID NO: 3852752 - RNA, 15 nt, Human
uuaaagagucuagau

SEQ ID NO: 3852753 - RNA, 17 nt, Human
uuaaagagucuagauuc

SEQ ID NO: 3852754 - RNA, 19 nt, Human
uuaaagagucuagauucaa

SEQ ID NO: 3852755 - RNA, 14 nt, Human
uuaaagauauuguu

SEQ ID NO: 3852756 - RNA, 17 nt, Human
uuaaagauauuguucaa

SEQ ID NO: 3852757 - RNA, 17 nt, Human
uuaaagaugaacucuga

SEQ ID NO: 3852758 - RNA, 18 nt, Human
uuaaagaugaacucugaa

SEQ ID NO: 3852759 - RNA, 15 nt, Human
uuaaagauguagcaa

SEQ ID NO: 3852760 - RNA, 21 nt, Human
uuaaagauguagcaaacccug

SEQ ID NO: 3852761 - RNA, 14 nt, Human
uuaaagauuuauca

SEQ ID NO: 3852762 - RNA, 21 nt, Human
uuaaagauuuaucaaaucagu

SEQ ID NO: 3852763 - RNA, 14 nt, Human
uuaaagcaaaggag

SEQ ID NO: 3852764 - RNA, 23 nt, Human
uuaaagcaacugucuauuucugc

SEQ ID NO: 3852765 - RNA, 22 nt, Human
uuaaagcagagggacuuuguau

SEQ ID NO: 3852766 - RNA, 20 nt, Human
uuaaagcagguucuuguugg

SEQ ID NO: 3852767 - RNA, 14 nt, Human
uuaaagcauugcug

SEQ ID NO: 3852768 - RNA, 20 nt, Human
uuaaagcauugcuguuaugu

SEQ ID NO: 3852769 - RNA, 15 nt, Human
uuaaagcauuuacuu

SEQ ID NO: 3852770 - RNA, 17 nt, Human
uuaaagcauuuacuuug

SEQ ID NO: 3852771 - RNA, 18 nt, Human
uuaaagccauguuuauua

SEQ ID NO: 3852772 - RNA, 18 nt, Human
uuaaagccauucugauua

SEQ ID NO: 3852773 - RNA, 19 nt, Human
uuaaagcuaaaguaucugu

SEQ ID NO: 3852774 - RNA, 20 nt, Human
uuaaagcuuauuaaaacuca

SEQ ID NO: 3852775 - RNA, 15 nt, Human
uuaaagcuuuugaug

SEQ ID NO: 3852776 - RNA, 17 nt, Human
uuaaaggaaaaaauguu

SEQ ID NO: 3852777 - RNA, 16 nt, Human
uuaaaggcccagcccc

SEQ ID NO: 3852778 - RNA, 17 nt, Human
uuaaaggcuaccuuauu

SEQ ID NO: 3852779 - RNA, 20 nt, Human
uuaaaggcuucucucucacc

SEQ ID NO: 3852780 - RNA, 15 nt, Human
uuaaagggaaauuga

SEQ ID NO: 3852781 - RNA, 15 nt, Human
uuaaagggaagaaaa

SEQ ID NO: 3852782 - RNA, 18 nt, Human
uuaaagggaagaaaacac

SEQ ID NO: 3852783 - RNA, 17 nt, Human
uuaaagggcccaaugaa

SEQ ID NO: 3852784 - RNA, 21 nt, Human
uuaaaggggcagaaaaacucu

SEQ ID NO: 3852785 - RNA, 17 nt, Human
uuaaaggugucuuccuc

SEQ ID NO: 3852786 - RNA, 18 nt, Human
uuaaaguaugaaucuaug

SEQ ID NO: 3852787 - RNA, 23 nt, Human
uuaaaguauguuauugcauaauu

SEQ ID NO: 3852788 - RNA, 13 nt, Human
uuaaaguauucuu

SEQ ID NO: 3852789 - RNA, 12 nt, Human
uuaaaguauuuu

SEQ ID NO: 3852790 - RNA, 12 nt, Human
uuaaagucugaa

SEQ ID NO: 3852791 - RNA, 21 nt, Human
uuaaagugacuaauggcauga

SEQ ID NO: 3852792 - RNA, 21 nt, Human
uuaaaguguccauugacaugu

SEQ ID NO: 3852793 - RNA, 22 nt, Human
uuaaaguguccauugacaugua

SEQ ID NO: 3852794 - RNA, 22 nt, Human
uuaaaguguuucagcuaaggga

SEQ ID NO: 3852795 - RNA, 11 nt, Human
uuaaaguucug

SEQ ID NO: 3852796 - RNA, 15 nt, Human
uuaaaguucugugua

SEQ ID NO: 3852797 - RNA, 21 nt, Human
uuaaaguugguauuaauaaaa

SEQ ID NO: 3852798 - RNA, 19 nt, Human
uuaaaguuucaaaaaucug

SEQ ID NO: 3852799 - RNA, 13 nt, Human
uuaaauaaaagug

SEQ ID NO: 3852800 - RNA, 14 nt, Human
uuaaauaaaaguga

SEQ ID NO: 3852801 - RNA, 20 nt, Human
uuaaauaaaagugaucaaua

SEQ ID NO: 3852802 - RNA, 12 nt, Human
uuaaauaaaaua

SEQ ID NO: 3852803 - RNA, 13 nt, Human
uuaaauaaaauca

SEQ ID NO: 3852804 - RNA, 20 nt, Human
uuaaauaaaauugaaaguaa

SEQ ID NO: 3852805 - RNA, 12 nt, Human
uuaaauaaacuu

SEQ ID NO: 3852806 - RNA, 20 nt, Human
uuaaauaaacuuuuuuucaa

SEQ ID NO: 3852807 - RNA, 21 nt, Human
uuaaauaaacuuuuuuucaau

SEQ ID NO: 3852808 - RNA, 23 nt, Human
uuaaauaaacuuuuuuucaaugu

SEQ ID NO: 3852809 - RNA, 18 nt, Human
uuaaauaaaugucauuaa

SEQ ID NO: 3852810 - RNA, 13 nt, Human
uuaaauaaauugu

SEQ ID NO: 3852811 - RNA, 15 nt, Human
uuaaauaaauuguau

SEQ ID NO: 3852812 - RNA, 20 nt, Human
uuaaauaaauuguauauuca

SEQ ID NO: 3852813 - RNA, 16 nt, Human
uuaaauaaauuugacu

SEQ ID NO: 3852814 - RNA, 17 nt, Human
uuaaauaaauuugacuu

SEQ ID NO: 3852815 - RNA, 15 nt, Human
uuaaauaagaaacuu

SEQ ID NO: 3852816 - RNA, 13 nt, Human
uuaaauaagauuc

SEQ ID NO: 3852817 - RNA, 17 nt, Human
uuaaauaagauucuaac

SEQ ID NO: 3852818 - RNA, 18 nt, Human
uuaaauaaugcuucagau

SEQ ID NO: 3852819 - RNA, 15 nt, Human
uuaaauaaugugaaa

SEQ ID NO: 3852820 - RNA, 16 nt, Human
uuaaauaaugugaaac

SEQ ID NO: 3852821 - RNA, 18 nt, Human
uuaaauaaugugaaacug

SEQ ID NO: 3852822 - RNA, 19 nt, Human
uuaaauaaugugaaacugg

SEQ ID NO: 3852823 - RNA, 22 nt, Human
uuaaauaaugugaaacuggauu

SEQ ID NO: 3852824 - RNA, 13 nt, Human
uuaaauaauuuaa

SEQ ID NO: 3852825 - RNA, 21 nt, Human
uuaaauaauuuaacuacccuu

SEQ ID NO: 3852826 - RNA, 15 nt, Human
uuaaauacaaaacuu

SEQ ID NO: 3852827 - RNA, 18 nt, Human
uuaaauacagacacuaag

SEQ ID NO: 3852828 - RNA, 14 nt, Human
uuaaauacaggaaa

SEQ ID NO: 3852829 - RNA, 15 nt, Human
uuaaauacaggaaac

SEQ ID NO: 3852830 - RNA, 19 nt, Human
uuaaauacaggaaacaguu

SEQ ID NO: 3852831 - RNA, 14 nt, Human
uuccuccugggccc

SEQ ID NO: 3852832 - RNA, 13 nt, Human
uuccuccugugua

SEQ ID NO: 3852833 - RNA, 21 nt, Human
uuccuccuucacuguuucauc

SEQ ID NO: 3852834 - RNA, 15 nt, Human
uuccucgcuucuuuc

SEQ ID NO: 3852835 - RNA, 18 nt, Human
uuccucucacuaaacuuu

SEQ ID NO: 3852836 - RNA, 21 nt, Human
uuccucucauccuuuucuccu

SEQ ID NO: 3852837 - RNA, 15 nt, Human
uuccucuccacacag

SEQ ID NO: 3852838 - RNA, 12 nt, Human
uuccucuccacc

SEQ ID NO: 3852839 - RNA, 17 nt, Human
uuccucuccacccuccc

SEQ ID NO: 3852840 - RNA, 18 nt, Human
uuccucuccacugccuuc

SEQ ID NO: 3852841 - RNA, 15 nt, Human
uuccucuccuuccuu

SEQ ID NO: 3852842 - RNA, 19 nt, Human
uuccucuccuucguauccc

SEQ ID NO: 3852843 - RNA, 16 nt, Human
uuccucucgcggcccu

SEQ ID NO: 3852844 - RNA, 20 nt, Human
uuccucucgcggcccucagu

SEQ ID NO: 3852845 - RNA, 21 nt, Human
uuccucucgcggcccucagua

SEQ ID NO: 3852846 - RNA, 14 nt, Human
uuccucucuaagug

SEQ ID NO: 3852847 - RNA, 14 nt, Human
uuccucucuccaga

SEQ ID NO: 3852848 - RNA, 11 nt, Human
uuccucucugg

SEQ ID NO: 3852849 - RNA, 18 nt, Human
uuccucucuuuguucuca

SEQ ID NO: 3852850 - RNA, 14 nt, Human
uuccucugagccuu

SEQ ID NO: 3852851 - RNA, 17 nt, Human
uuccucugagccuuggg

SEQ ID NO: 3852852 - RNA, 21 nt, Human
uuccucugaggcugaaauuca

SEQ ID NO: 3852853 - RNA, 21 nt, Human
uuccucugaggcuggauccua

SEQ ID NO: 3852854 - RNA, 10 nt, Human
uuccucugca

SEQ ID NO: 3852855 - RNA, 13 nt, Human
uuccucugcagcu

SEQ ID NO: 3852856 - RNA, 22 nt, Human
uuccucugcagcugaccucugu

SEQ ID NO: 3852857 - RNA, 20 nt, Human
uuccucugcccuuccugcag

SEQ ID NO: 3852858 - RNA, 16 nt, Human
uuccucugccugcccc

SEQ ID NO: 3852859 - RNA, 13 nt, Human
uuccucugcuuug

SEQ ID NO: 3852860 - RNA, 19 nt, Human
uuccucuuagaagaauauu

SEQ ID NO: 3852861 - RNA, 22 nt, Human
uuccucuuagaagaauauugua

SEQ ID NO: 3852862 - RNA, 12 nt, Human
uuccucuuccaa

SEQ ID NO: 3852863 - RNA, 15 nt, Human
uuccucuugaaccag

SEQ ID NO: 3852864 - RNA, 15 nt, Human
uuccucuugacccug

SEQ ID NO: 3852865 - RNA, 18 nt, Human
uuccucuugacccugcac

SEQ ID NO: 3852866 - RNA, 12 nt, Human
uuccucuuugca

SEQ ID NO: 3852867 - RNA, 15 nt, Human
uuccucuuugcaugg

SEQ ID NO: 3852868 - RNA, 17 nt, Human
uuccucuuugcauggaa

SEQ ID NO: 3852869 - RNA, 15 nt, Human
uuccucuuugcuuug

SEQ ID NO: 3852870 - RNA, 22 nt, Human
uuccucuuugcuuugcuuucug

SEQ ID NO: 3852871 - RNA, 14 nt, Human
uuccugaaccgaug

SEQ ID NO: 3852872 - RNA, 19 nt, Human
uuccugaagaaccaguccc

SEQ ID NO: 3852873 - RNA, 13 nt, Human
uuccugacacuuu

SEQ ID NO: 3852874 - RNA, 16 nt, Human
uuccugacaucacagc

SEQ ID NO: 3852875 - RNA, 17 nt, Human
uuccugacaucacagca

SEQ ID NO: 3852876 - RNA, 19 nt, Human
uuccugacaucacagcagc

SEQ ID NO: 3852877 - RNA, 15 nt, Human
uuccugacauugucu

SEQ ID NO: 3852878 - RNA, 23 nt, Human
uuccugacgaaacuggccccgga

SEQ ID NO: 3852879 - RNA, 19 nt, Human
uuccugacgagauaagcag

SEQ ID NO: 3852880 - RNA, 18 nt, Human
uuccugagauuuccuccu

SEQ ID NO: 3852881 - RNA, 16 nt, Human
uuccugagcuuggcca

SEQ ID NO: 3852882 - RNA, 15 nt, Human
uuccugaggcugggc

SEQ ID NO: 3852883 - RNA, 17 nt, Human
uuccugauaauaauuga

SEQ ID NO: 3852884 - RNA, 19 nt, Human
uuccugauaauaauugauc

SEQ ID NO: 3852885 - RNA, 17 nt, Human
uuccugaugacccaggc

SEQ ID NO: 3852886 - RNA, 18 nt, Human
uuccugaugcuucuucag

SEQ ID NO: 3852887 - RNA, 22 nt, Human
uuccugaugguacaggaaagcu

SEQ ID NO: 3852888 - RNA, 20 nt, Human
uuccugauugguuucucuuc

SEQ ID NO: 3852889 - RNA, 18 nt, Human
uuccugcagccuggaggc

SEQ ID NO: 3852890 - RNA, 18 nt, Human
uuccugcauuugugaaau

SEQ ID NO: 3852891 - RNA, 17 nt, Human
uuccugccaccagucac

SEQ ID NO: 3852892 - RNA, 15 nt, Human
uuccugccagccccu

SEQ ID NO: 3852893 - RNA, 13 nt, Human
uuccugccccagg

SEQ ID NO: 3852894 - RNA, 18 nt, Human
uuccugccccaggccuga

SEQ ID NO: 3852895 - RNA, 13 nt, Human
uuccugccccucu

SEQ ID NO: 3852896 - RNA, 16 nt, Human
uuccugcccugggagg

SEQ ID NO: 3852897 - RNA, 15 nt, Human
uuccugccugucucc

SEQ ID NO: 3852898 - RNA, 23 nt, Human
uuccugcggagugaagaggggca

SEQ ID NO: 3852899 - RNA, 13 nt, Human
uuccugcugcugu

SEQ ID NO: 3852900 - RNA, 18 nt, Human
uuccugcugcugucuggg

SEQ ID NO: 3852901 - RNA, 21 nt, Human
uuccugcugcugucugggugc

SEQ ID NO: 3852902 - RNA, 17 nt, Human
uuccugcuuccucagag

SEQ ID NO: 3852903 - RNA, 18 nt, Human
uuccugcuuccucagagg

SEQ ID NO: 3852904 - RNA, 13 nt, Human
uuccugcuugcca

SEQ ID NO: 3852905 - RNA, 17 nt, Human
uuccuggaauugccagc

SEQ ID NO: 3852906 - RNA, 15 nt, Human
uuccuggacagcugu

SEQ ID NO: 3852907 - RNA, 24 nt, Human
uuccuggacagcugugccucgcuc

SEQ ID NO: 3852908 - RNA, 12 nt, Human
uuccuggacauc

SEQ ID NO: 3852909 - RNA, 20 nt, Human
uuccuggacauccucuucug

SEQ ID NO: 3852910 - RNA, 13 nt, Human
uuccuggagcccg

SEQ ID NO: 3852911 - RNA, 23 nt, Human
uuccuggcaauaguguguucuga

SEQ ID NO: 3852912 - RNA, 20 nt, Human
uuccuggcacugcuuccagu

SEQ ID NO: 3852913 - RNA, 18 nt, Human
uuccuggcuuuuuaacuc

SEQ ID NO: 3852914 - RNA, 17 nt, Human
uuccugggaaauauucc

SEQ ID NO: 3852915 - RNA, 21 nt, Human
uuccugggaaauauucccuag

SEQ ID NO: 3852916 - RNA, 20 nt, Human
uuccugggcacacgcugcuc

SEQ ID NO: 3852917 - RNA, 15 nt, Human
uuccuggggugcccu

SEQ ID NO: 3852918 - RNA, 21 nt, Human
uuccuggggugcccuccacug

SEQ ID NO: 3852919 - RNA, 23 nt, Human
uuccuggguggcuacucugugcc

SEQ ID NO: 3852920 - RNA, 19 nt, Human
uuccugguacccagccauc

SEQ ID NO: 3852921 - RNA, 21 nt, Human
uuccugguacccagccaucug

SEQ ID NO: 3852922 - RNA, 11 nt, Human
uuccuguaaca

SEQ ID NO: 3852923 - RNA, 21 nt, Human
uuccuguaacacaagccacag

SEQ ID NO: 3852924 - RNA, 23 nt, Human
uuccuguaacacaagccacagaa

SEQ ID NO: 3852925 - RNA, 20 nt, Human
uuccuguauuuguucccaag

SEQ ID NO: 3852926 - RNA, 17 nt, Human
uuccugucacccugagg

SEQ ID NO: 3852927 - RNA, 16 nt, Human
uuccuguccagcucca

SEQ ID NO: 3852928 - RNA, 17 nt, Human
uuccuguccagcuccaa

SEQ ID NO: 3852929 - RNA, 11 nt, Human
uuccuguccca

SEQ ID NO: 3852930 - RNA, 18 nt, Human
uuccuguccgcccucuuc

SEQ ID NO: 3852931 - RNA, 19 nt, Human
uuccugucuuauccuccac

SEQ ID NO: 3852932 - RNA, 15 nt, Human
uuccugugcacagcc

SEQ ID NO: 3852933 - RNA, 14 nt, Human
uuccugugccaggu

SEQ ID NO: 3852934 - RNA, 16 nt, Human
uuccugugccagguga

SEQ ID NO: 3852935 - RNA, 21 nt, Human
uuccuguggauguaaagugau

SEQ ID NO: 3852936 - RNA, 11 nt, Human
uuccuguguca

SEQ ID NO: 3852937 - RNA, 18 nt, Human
uuccugugucaauccaga

SEQ ID NO: 3852938 - RNA, 14 nt, Human
uuccuguguccuga

SEQ ID NO: 3852939 - RNA, 11 nt, Human
uuccugugucu

SEQ ID NO: 3852940 - RNA, 14 nt, Human
uuccuguuaaugua

SEQ ID NO: 3852941 - RNA, 23 nt, Human
uuccuguuagguauuagaaagug

SEQ ID NO: 3852942 - RNA, 19 nt, Human
uuccuguucaguaauaaaa

SEQ ID NO: 3852943 - RNA, 15 nt, Human
uuccuguucugaacu

SEQ ID NO: 3852944 - RNA, 20 nt, Human
uuccuguuggauuuguuuaa

SEQ ID NO: 3852945 - RNA, 16 nt, Human
uuccuguuucugaaaa

SEQ ID NO: 3852946 - RNA, 17 nt, Human
uuccuguuugggaagag

SEQ ID NO: 3852947 - RNA, 17 nt, Human
uuccuguuuguugaagg

SEQ ID NO: 3852948 - RNA, 22 nt, Human
uuccuguuuuuauuauuaacaa

SEQ ID NO: 3852949 - RNA, 13 nt, Human
uuccuuaaacugu

SEQ ID NO: 3852950 - RNA, 16 nt, Human
uuccuuaaacugugug

SEQ ID NO: 3852951 - RNA, 12 nt, Human
uuccuuaaguau

SEQ ID NO: 3852952 - RNA, 19 nt, Human
uuccuuaagucagaacagc

SEQ ID NO: 3852953 - RNA, 13 nt, Human
uuccuuacauaaa

SEQ ID NO: 3852954 - RNA, 16 nt, Human
uuccuuacauaaacau

SEQ ID NO: 3852955 - RNA, 17 nt, Human
uuccuuacauaaacauc

SEQ ID NO: 3852956 - RNA, 16 nt, Human
uuccuuaccuuuaccc

SEQ ID NO: 3852957 - RNA, 13 nt, Human
uuccuuaccuuuu

SEQ ID NO: 3852958 - RNA, 20 nt, Human
uuccuuacuuuuuauauaua

SEQ ID NO: 3852959 - RNA, 21 nt, Human
uuccuuagcuuagaccucagc

SEQ ID NO: 3852960 - RNA, 20 nt, Human
uuccuuauuugcuucauugu

SEQ ID NO: 3852961 - RNA, 14 nt, Human
uuccuucagcacuu

SEQ ID NO: 3852962 - RNA, 16 nt, Human
uuccuucagcacuuua

SEQ ID NO: 3852963 - RNA, 14 nt, Human
uuccuucagugccu

SEQ ID NO: 3852964 - RNA, 19 nt, Human
uuccuucagugccuuaugg

SEQ ID NO: 3852965 - RNA, 21 nt, Human
uuccuuccaaugucuggagac

SEQ ID NO: 3852966 - RNA, 15 nt, Human
uuccuuccacuaacu

SEQ ID NO: 3852967 - RNA, 20 nt, Human
uuccuuccaucccuaccccc

SEQ ID NO: 3852968 - RNA, 13 nt, Human
uuccuucccucaa

SEQ ID NO: 3852969 - RNA, 15 nt, Human
uuccuucccugcugu

SEQ ID NO: 3852970 - RNA, 20 nt, Human
uuccuucccugggcugugcu

SEQ ID NO: 3852971 - RNA, 19 nt, Human
uuccuucccuuuucuguuc

SEQ ID NO: 3852972 - RNA, 11 nt, Human
uuccuuccuaa

SEQ ID NO: 3852973 - RNA, 20 nt, Human
uuccuucucccaucucuucc

SEQ ID NO: 3852974 - RNA, 15 nt, Human
uuccuucucugaaca

SEQ ID NO: 3852975 - RNA, 13 nt, Human
uuccuucuguaaa

SEQ ID NO: 3852976 - RNA, 19 nt, Human
uuccuucuuugauaauguu

SEQ ID NO: 3852977 - RNA, 16 nt, Human
uucugcccccagccca

SEQ ID NO: 3852978 - RNA, 15 nt, Human
uucugcccugcccac

SEQ ID NO: 3852979 - RNA, 16 nt, Human
uucugccgcagcccug

SEQ ID NO: 3852980 - RNA, 23 nt, Human
uucugccgcagcccugcagaggg

SEQ ID NO: 3852981 - RNA, 16 nt, Human
uucugccgugugcccu

SEQ ID NO: 3852982 - RNA, 12 nt, Human
uucugccuccuu

SEQ ID NO: 3852983 - RNA, 13 nt, Human
uucugccuccuuu

SEQ ID NO: 3852984 - RNA, 13 nt, Human
uucugccucucaa

SEQ ID NO: 3852985 - RNA, 16 nt, Human
uucugccucuccaggc

SEQ ID NO: 3852986 - RNA, 17 nt, Human
uucugccucucuaggac

SEQ ID NO: 3852987 - RNA, 18 nt, Human
uucugccugcccaggccc

SEQ ID NO: 3852988 - RNA, 13 nt, Human
uucugccuguuau

SEQ ID NO: 3852989 - RNA, 20 nt, Human
uucugccuguuauaacucug

SEQ ID NO: 3852990 - RNA, 14 nt, Human
uucugccuucucau

SEQ ID NO: 3852991 - RNA, 10 nt, Human
uucugccuuu

SEQ ID NO: 3852992 - RNA, 16 nt, Human
uucugccuuugauguu

SEQ ID NO: 3852993 - RNA, 14 nt, Human
uucugcgccucagg

SEQ ID NO: 3852994 - RNA, 16 nt, Human
uucugcuaccucacug

SEQ ID NO: 3852995 - RNA, 21 nt, Human
uucugcuacuuugcugcuaug

SEQ ID NO: 3852996 - RNA, 12 nt, Human
uucugcucagcu

SEQ ID NO: 3852997 - RNA, 14 nt, Human
uucugcucagcucu

SEQ ID NO: 3852998 - RNA, 20 nt, Human
uucugcucaucauucucugu

SEQ ID NO: 3852999 - RNA, 15 nt, Human
uucugcucauucuaa

SEQ ID NO: 3853000 - RNA, 13 nt, Human
uucugcuccaccc

SEQ ID NO: 3853001 - RNA, 15 nt, Human
uucugcuccacccuu

SEQ ID NO: 3853002 - RNA, 16 nt, Human
uucugcuccacccuug

SEQ ID NO: 3853003 - RNA, 14 nt, Human
uucugcuccucucc

SEQ ID NO: 3853004 - RNA, 14 nt, Human
uucugcugaauuuu

SEQ ID NO: 3853005 - RNA, 17 nt, Human
uucugcuggcaucaaga

SEQ ID NO: 3853006 - RNA, 13 nt, Human
uucugcuggccug

SEQ ID NO: 3853007 - RNA, 14 nt, Human
uucugcuggccugg

SEQ ID NO: 3853008 - RNA, 15 nt, Human
uucugcuggccugga

SEQ ID NO: 3853009 - RNA, 18 nt, Human
uucugcuggccuggaucu

SEQ ID NO: 3853010 - RNA, 14 nt, Human
uucugcuguucucu

SEQ ID NO: 3853011 - RNA, 16 nt, Human
uucugcuuaggagaga

SEQ ID NO: 3853012 - RNA, 16 nt, Human
uucugcuucagccucc

SEQ ID NO: 3853013 - RNA, 15 nt, Human
uucugcuuuaaaaau

SEQ ID NO: 3853014 - RNA, 13 nt, Human
uucugcuuuagac

SEQ ID NO: 3853015 - RNA, 15 nt, Human
uucugcuuucaucuu

SEQ ID NO: 3853016 - RNA, 23 nt, Human
uucugcuuuguugugugccucua

SEQ ID NO: 3853017 - RNA, 21 nt, Human
uucugcuuuuaccaugccccu

SEQ ID NO: 3853018 - RNA, 14 nt, Human
uucuggaauuuguu

SEQ ID NO: 3853019 - RNA, 18 nt, Human
uucuggaauuuguucaag

SEQ ID NO: 3853020 - RNA, 16 nt, Human
uucuggaccucugggu

SEQ ID NO: 3853021 - RNA, 10 nt, Human
uucuggagcc

SEQ ID NO: 3853022 - RNA, 15 nt, Human
uucuggagcccuugg

SEQ ID NO: 3853023 - RNA, 15 nt, Human
uucuggauauagcua

SEQ ID NO: 3853024 - RNA, 20 nt, Human
uucuggaugcauuucucugg

SEQ ID NO: 3853025 - RNA, 21 nt, Human
uucuggauuccccaucucagg

SEQ ID NO: 3853026 - RNA, 15 nt, Human
uucuggccaggaagc

SEQ ID NO: 3853027 - RNA, 14 nt, Human
uucuggccucccac

SEQ ID NO: 3853028 - RNA, 14 nt, Human
uucuggccugccuu

SEQ ID NO: 3853029 - RNA, 20 nt, Human
uucuggccuuuccucucucc

SEQ ID NO: 3853030 - RNA, 20 nt, Human
uucuggcuaugcauuugaaa

SEQ ID NO: 3853031 - RNA, 14 nt, Human
uucuggcucccucu

SEQ ID NO: 3853032 - RNA, 17 nt, Human
uucuggcuccucaaaca

SEQ ID NO: 3853033 - RNA, 11 nt, Human
uucuggcugcc

SEQ ID NO: 3853034 - RNA, 15 nt, Human
uucuggcuguuugag

SEQ ID NO: 3853035 - RNA, 20 nt, Human
uucuggcuuccuucucucaa

SEQ ID NO: 3853036 - RNA, 18 nt, Human
uucuggcuuuaagccuuc

SEQ ID NO: 3853037 - RNA, 13 nt, Human
uucugggaagcaa

SEQ ID NO: 3853038 - RNA, 10 nt, Human
uucugggaca

SEQ ID NO: 3853039 - RNA, 11 nt, Human
uucugggacac

SEQ ID NO: 3853040 - RNA, 15 nt, Human
uucugggccugacca

SEQ ID NO: 3853041 - RNA, 12 nt, Human
uucugggcucuu

SEQ ID NO: 3853042 - RNA, 23 nt, Human
uucuggggagcuggacaguggag

SEQ ID NO: 3853043 - RNA, 19 nt, Human
uucuggggcaggcugggcc

SEQ ID NO: 3853044 - RNA, 21 nt, Human
uucuggggcaggcugggccau

SEQ ID NO: 3853045 - RNA, 21 nt, Human
uucuggggccccuuuuuacuc

SEQ ID NO: 3853046 - RNA, 18 nt, Human
uucuggguggccucggga

SEQ ID NO: 3853047 - RNA, 16 nt, Human
uucugguaaaaagaaa

SEQ ID NO: 3853048 - RNA, 15 nt, Human
uucugguacucuccu

SEQ ID NO: 3853049 - RNA, 18 nt, Human
uucugguagauagaaaua

SEQ ID NO: 3853050 - RNA, 19 nt, Human
uucugguagauagaaauaa

SEQ ID NO: 3853051 - RNA, 14 nt, Human
uucuggugugaacu

SEQ ID NO: 3853052 - RNA, 18 nt, Human
uucugguguuggacaagc

SEQ ID NO: 3853053 - RNA, 17 nt, Human
uucugguuccagggucc

SEQ ID NO: 3853054 - RNA, 10 nt, Human
uucuguaaaa

SEQ ID NO: 3853055 - RNA, 16 nt, Human
uucuguaaaauggaaa

SEQ ID NO: 3853056 - RNA, 19 nt, Human
uucuguaaacucaaaacuu

SEQ ID NO: 3853057 - RNA, 23 nt, Human
uucuguaaacucaaaacuuaaca

SEQ ID NO: 3853058 - RNA, 15 nt, Human
uucuguaagaaaccu

SEQ ID NO: 3853059 - RNA, 20 nt, Human
uucuguaauauuuacaaugu

SEQ ID NO: 3853060 - RNA, 19 nt, Human
uucuguacauagccuauau

SEQ ID NO: 3853061 - RNA, 17 nt, Human
uucuguaccaaaguguu

SEQ ID NO: 3853062 - RNA, 11 nt, Human
uucuguaccag

SEQ ID NO: 3853063 - RNA, 14 nt, Human
uucuguaccaguua

SEQ ID NO: 3853064 - RNA, 13 nt, Human
uucuguacuuuuu

SEQ ID NO: 3853065 - RNA, 18 nt, Human
uucuguagaaaugguugu

SEQ ID NO: 3853066 - RNA, 13 nt, Human
uucuguagauucu

SEQ ID NO: 3853067 - RNA, 13 nt, Human
uucuguauaaaug

SEQ ID NO: 3853068 - RNA, 21 nt, Human
uucuguauacaacccuggcau

SEQ ID NO: 3853069 - RNA, 24 nt, Human
uucuguauacaacccuggcauuau

SEQ ID NO: 3853070 - RNA, 11 nt, Human
uucuguauaga

SEQ ID NO: 3853071 - RNA, 18 nt, Human
uucuguauagacaggaga

SEQ ID NO: 3853072 - RNA, 13 nt, Human
uucuguauagauu

SEQ ID NO: 3853073 - RNA, 17 nt, Human
uucuguauauacuuuuu

SEQ ID NO: 3853074 - RNA, 21 nt, Human
uucuguaucuacuuuaauaaa

SEQ ID NO: 3853075 - RNA, 16 nt, Human
uucuguauuugaaagu

SEQ ID NO: 3853076 - RNA, 19 nt, Human
uucuguauuugaaagugcc

SEQ ID NO: 3853077 - RNA, 11 nt, Human
uucuguauuuu

SEQ ID NO: 3853078 - RNA, 18 nt, Human
uucuguauuuuguuuuug

SEQ ID NO: 3853079 - RNA, 16 nt, Human
uucugucacucaggcu

SEQ ID NO: 3853080 - RNA, 16 nt, Human
uucugucagaugagaa

SEQ ID NO: 3853081 - RNA, 13 nt, Human
uucuguccugcug

SEQ ID NO: 3853082 - RNA, 15 nt, Human
uucuguccuguaacu

SEQ ID NO: 3853083 - RNA, 15 nt, Human
uucuguccugugagg

SEQ ID NO: 3853084 - RNA, 23 nt, Human
uucuguccugugagguuucccaa

SEQ ID NO: 3853085 - RNA, 14 nt, Human
uucuguccuucaga

SEQ ID NO: 3853086 - RNA, 14 nt, Human
uucugucguuaaaa

SEQ ID NO: 3853087 - RNA, 14 nt, Human
uucugucucucccu

SEQ ID NO: 3853088 - RNA, 17 nt, Human
uucugugaugagcugau

SEQ ID NO: 3853089 - RNA, 13 nt, Human
uucugugcccagc

SEQ ID NO: 3853090 - RNA, 13 nt, Human
uucugugcccucc

SEQ ID NO: 3853091 - RNA, 13 nt, Human
uucugugccugaa

SEQ ID NO: 3853092 - RNA, 23 nt, Human
uucugugcuguuacaguuuucuu

SEQ ID NO: 3853093 - RNA, 22 nt, Human
uucuguggaaaguguaaagcau

SEQ ID NO: 3853094 - RNA, 18 nt, Human
uucuguggggacuccggc

SEQ ID NO: 3853095 - RNA, 22 nt, Human
uucuguggguccgauaauaucu

SEQ ID NO: 3853096 - RNA, 23 nt, Human
uucuguggguuucuaaagcugcc

SEQ ID NO: 3853097 - RNA, 20 nt, Human
uucugugguuccucugcuca

SEQ ID NO: 3853098 - RNA, 22 nt, Human
uucugugguuucauguuaguua

SEQ ID NO: 3853099 - RNA, 18 nt, Human
uucugugguuuuccccuc

SEQ ID NO: 3853100 - RNA, 21 nt, Human
uucuguguaucucuuucacau

SEQ ID NO: 3853101 - RNA, 16 nt, Human
uucuguguauuuaauu

SEQ ID NO: 3853102 - RNA, 23 nt, Human
uucuguguauuuaauuguaaacu

SEQ ID NO: 3853103 - RNA, 16 nt, Human
uucugugugucaguuu

SEQ ID NO: 3853104 - RNA, 13 nt, Human
uucuguguguucc

SEQ ID NO: 3853105 - RNA, 17 nt, Human
uucuguguguuccuggc

SEQ ID NO: 3853106 - RNA, 17 nt, Human
uucuguguuuaauuucu

SEQ ID NO: 3853107 - RNA, 18 nt, Human
uucuguguuuauaaaaua

SEQ ID NO: 3853108 - RNA, 14 nt, Human
uucuguuaaaaucu

SEQ ID NO: 3853109 - RNA, 15 nt, Human
uucuguuaaaaucua

SEQ ID NO: 3853110 - RNA, 22 nt, Human
uucuguuaaaaugcaugauugc

SEQ ID NO: 3853111 - RNA, 13 nt, Human
uucuguuaacuga

SEQ ID NO: 3853112 - RNA, 16 nt, Human
uucuguuaacugaaua

SEQ ID NO: 3853113 - RNA, 17 nt, Human
uucuguuaacugaauac

SEQ ID NO: 3853114 - RNA, 21 nt, Human
uucuguuaacugaauaccacu

SEQ ID NO: 3853115 - RNA, 16 nt, Human
uucuguuacaaaaugu

SEQ ID NO: 3853116 - RNA, 17 nt, Human
uucuguuacaaaaugua

SEQ ID NO: 3853117 - RNA, 20 nt, Human
uucuguuacaaaauguaacu

SEQ ID NO: 3853118 - RNA, 22 nt, Human
uucuguuacaaaauguaacugu

SEQ ID NO: 3853119 - RNA, 20 nt, Human
uagaaauguagguccucaga

SEQ ID NO: 3853120 - RNA, 17 nt, Human
uagaaauguuugcugaa

SEQ ID NO: 3853121 - RNA, 15 nt, Human
uagaaauuuccagag

SEQ ID NO: 3853122 - RNA, 16 nt, Human
uagaaauuuccagaga

SEQ ID NO: 3853123 - RNA, 17 nt, Human
uagaaauuuuacaauag

SEQ ID NO: 3853124 - RNA, 16 nt, Human
uucuuguaaauguguu

SEQ ID NO: 3853125 - RNA, 18 nt, Human
uucuuguaaauguguugg

SEQ ID NO: 3853126 - RNA, 11 nt, Human
uucuuguaauu

SEQ ID NO: 3853127 - RNA, 23 nt, Human
uucuuguaauuuaaacaggccca

SEQ ID NO: 3853128 - RNA, 13 nt, Human
uucuuguaauuuu

SEQ ID NO: 3853129 - RNA, 12 nt, Human
uucuuguauuaa

SEQ ID NO: 3853130 - RNA, 14 nt, Human
uucuugucaaaaaa

SEQ ID NO: 3853131 - RNA, 15 nt, Human
uucuugucagacaua

SEQ ID NO: 3853132 - RNA, 17 nt, Human
uucuugucuauaaagca

SEQ ID NO: 3853133 - RNA, 14 nt, Human
uucuugucuuuauu

SEQ ID NO: 3853134 - RNA, 20 nt, Human
uagacaguuuguaaauguua

SEQ ID NO: 3853135 - RNA, 21 nt, Human
uagacaguuuguaaauguuau

SEQ ID NO: 3853136 - RNA, 18 nt, Human
uagacauggagguucuaa

SEQ ID NO: 3853137 - RNA, 13 nt, Human
uagacauucuguc

SEQ ID NO: 3853138 - RNA, 21 nt, Human
uagacauuucucuuacugcaa

SEQ ID NO: 3853139 - RNA, 23 nt, Human
uagacauuucucuuacugcaaau

SEQ ID NO: 3853140 - RNA, 19 nt, Human
uagacauuuuaacaagaag

SEQ ID NO: 3853141 - RNA, 21 nt, Human
uagacauuuuaacaagaagau

SEQ ID NO: 3853142 - RNA, 18 nt, Human
uagaccaaggaacaaaaa

SEQ ID NO: 3853143 - RNA, 17 nt, Human
uagaccaccaagccuug

SEQ ID NO: 3853144 - RNA, 17 nt, Human
uagaccaggauuucuaa

SEQ ID NO: 3853145 - RNA, 14 nt, Human
uagaccccuggcug

SEQ ID NO: 3853146 - RNA, 15 nt, Human
uagaccccuggcugg

SEQ ID NO: 3853147 - RNA, 20 nt, Human
uagacccugggugggcucug

SEQ ID NO: 3853148 - RNA, 23 nt, Human
uagaccgcucucuuuucuguacu

SEQ ID NO: 3853149 - RNA, 21 nt, Human
uagaccuauaauccuugauaa

SEQ ID NO: 3853150 - RNA, 11 nt, Human
uagaccucagc

SEQ ID NO: 3853151 - RNA, 12 nt, Human
uagaccucagcc

SEQ ID NO: 3853152 - RNA, 14 nt, Human
uagaccucagccug

SEQ ID NO: 3853153 - RNA, 16 nt, Human
uagaccucagccugug

SEQ ID NO: 3853154 - RNA, 22 nt, Human
uagaccucagccugugcugccc

SEQ ID NO: 3853155 - RNA, 16 nt, Human
uagaccuccagcuguu

SEQ ID NO: 3853156 - RNA, 19 nt, Human
uagaccuuguuacuucuga

SEQ ID NO: 3853157 - RNA, 17 nt, Human
uagaccuuuucauuugu

SEQ ID NO: 3853158 - RNA, 21 nt, Human
uagaccuuuuuuuuuuuucca

SEQ ID NO: 3853159 - RNA, 12 nt, Human
uagacuaaaaga

SEQ ID NO: 3853160 - RNA, 13 nt, Human
uagacuagagaaa

SEQ ID NO: 3853161 - RNA, 21 nt, Human
uagacuagcaaucucuucauu

SEQ ID NO: 3853162 - RNA, 14 nt, Human
uagacuauaaaugu

SEQ ID NO: 3853163 - RNA, 14 nt, Human
uagacuauauacau

SEQ ID NO: 3853164 - RNA, 18 nt, Human
uagacucaucuuacugua

SEQ ID NO: 3853165 - RNA, 21 nt, Human
uagacucaucuuacuguaccu

SEQ ID NO: 3853166 - RNA, 21 nt, Human
uagacucggggugcuuccuug

SEQ ID NO: 3853167 - RNA, 19 nt, Human
uagacucuguaacaucacu

SEQ ID NO: 3853168 - RNA, 17 nt, Human
uagacucugucuaccug

SEQ ID NO: 3853169 - RNA, 22 nt, Human
uagacucugucuaccuggucug

SEQ ID NO: 3853170 - RNA, 16 nt, Human
uagacucuuacuuuuu

SEQ ID NO: 3853171 - RNA, 16 nt, Human
uagacucuucacuguu

SEQ ID NO: 3853172 - RNA, 22 nt, Human
uagacugacuuguuugucuucc

SEQ ID NO: 3853173 - RNA, 14 nt, Human
uagacugccagcuc

SEQ ID NO: 3853174 - RNA, 16 nt, Human
uagacugccagcucuu

SEQ ID NO: 3853175 - RNA, 19 nt, Human
uagacuggaaaaaaugagc

SEQ ID NO: 3853176 - RNA, 13 nt, Human
uagacuggugacu

SEQ ID NO: 3853177 - RNA, 20 nt, Human
uagacuucgacucaggaucc

SEQ ID NO: 3853178 - RNA, 15 nt, Human
uagacuucuguuuuc

SEQ ID NO: 3853179 - RNA, 16 nt, Human
uagacuucuguuuuca

SEQ ID NO: 3853180 - RNA, 17 nt, Human
uagacuucuguuuucaa

SEQ ID NO: 3853181 - RNA, 10 nt, Human
uagacuugaa

SEQ ID NO: 3853182 - RNA, 14 nt, Human
uagacuugaaaaga

SEQ ID NO: 3853183 - RNA, 18 nt, Human
uagacuugaaaagagaca

SEQ ID NO: 3853184 - RNA, 20 nt, Human
uagacuugaaaagagacagg

SEQ ID NO: 3853185 - RNA, 18 nt, Human
uagacuugugcugaucgu

SEQ ID NO: 3853186 - RNA, 16 nt, Human
uagacuuuaggcuuuc

SEQ ID NO: 3853187 - RNA, 18 nt, Human
uagacuuuaggcuuucag

SEQ ID NO: 3853188 - RNA, 12 nt, Human
uagacuuucugu

SEQ ID NO: 3853189 - RNA, 22 nt, Human
uagacuuuuccaauaugugauu

SEQ ID NO: 3853190 - RNA, 19 nt, Human
uagagaaaccguccucuuu

SEQ ID NO: 3853191 - RNA, 21 nt, Human
uagagaaaccguccucuuuuu

SEQ ID NO: 3853192 - RNA, 20 nt, Human
uagagaacacgcguauuuac

SEQ ID NO: 3853193 - RNA, 14 nt, Human
uagagaacugaaaa

SEQ ID NO: 3853194 - RNA, 16 nt, Human
uagagaacuguggccg

SEQ ID NO: 3853195 - RNA, 13 nt, Human
uagagaagcaagu

SEQ ID NO: 3853196 - RNA, 17 nt, Human
uagagaaggaaagcuuu

SEQ ID NO: 3853197 - RNA, 13 nt, Human
uagagaaggaccc

SEQ ID NO: 3853198 - RNA, 22 nt, Human
uagagaaggacccggaggggcc

SEQ ID NO: 3853199 - RNA, 14 nt, Human
uagagaaugcacag

SEQ ID NO: 3853200 - RNA, 14 nt, Human
uagagacagaagca

SEQ ID NO: 3853201 - RNA, 22 nt, Human
uagagacagagcgacagagcag

SEQ ID NO: 3853202 - RNA, 11 nt, Human
uagagacaggg

SEQ ID NO: 3853203 - RNA, 19 nt, Human
uagagacgggguuucacca

SEQ ID NO: 3853204 - RNA, 14 nt, Human
uagagacuguagau

SEQ ID NO: 3853205 - RNA, 15 nt, Human
uagagacuguagauu

SEQ ID NO: 3853206 - RNA, 19 nt, Human
uagagacuguagauugcuu

SEQ ID NO: 3853207 - RNA, 16 nt, Human
uagagagagaccacuu

SEQ ID NO: 3853208 - RNA, 13 nt, Human
uagagaggaaaag

SEQ ID NO: 3853209 - RNA, 20 nt, Human
uagagauaugcagaaggaag

SEQ ID NO: 3853210 - RNA, 21 nt, Human
uagagauauuuuguaaaaugu

SEQ ID NO: 3853211 - RNA, 19 nt, Human
uagagaucugguuuugcua

SEQ ID NO: 3853212 - RNA, 20 nt, Human
uagagaucugguuuugcuau

SEQ ID NO: 3853213 - RNA, 21 nt, Human
uagagaucugguuuugcuauu

SEQ ID NO: 3853214 - RNA, 13 nt, Human
uagagaugccucc

SEQ ID NO: 3853215 - RNA, 15 nt, Human
uagagaugccucccu

SEQ ID NO: 3853216 - RNA, 14 nt, Human
uagagauggaggag

SEQ ID NO: 3853217 - RNA, 19 nt, Human
uagagauuaccuccugaga

SEQ ID NO: 3853218 - RNA, 21 nt, Human
uagagcaaaauugauguguuu

SEQ ID NO: 3853219 - RNA, 22 nt, Human
uagagcaaaauugauguguuua

SEQ ID NO: 3853220 - RNA, 17 nt, Human
uagagcacacuguagca

SEQ ID NO: 3853221 - RNA, 20 nt, Human
uagagcaccuaguccaguga

SEQ ID NO: 3853222 - RNA, 14 nt, Human
uagagcagcccaaa

SEQ ID NO: 3853223 - RNA, 20 nt, Human
uagagcaggcguucagcuca

SEQ ID NO: 3853224 - RNA, 23 nt, Human
uagagcagggauuaaccucugca

SEQ ID NO: 3853225 - RNA, 15 nt, Human
uagagcauugccauu

SEQ ID NO: 3853226 - RNA, 12 nt, Human
uagagccaggca

SEQ ID NO: 3853227 - RNA, 14 nt, Human
uagagccugaggga

SEQ ID NO: 3853228 - RNA, 17 nt, Human
uagagcuagucuuucac

SEQ ID NO: 3853229 - RNA, 13 nt, Human
uagagcuccuccc

SEQ ID NO: 3853230 - RNA, 14 nt, Human
uagagcugauccag

SEQ ID NO: 3853231 - RNA, 17 nt, Human
uagaggaaaaaaaugac

SEQ ID NO: 3853232 - RNA, 13 nt, Human
uagaggaaaagaa

SEQ ID NO: 3853233 - RNA, 19 nt, Human
uagaggaaauaagaaaaau

SEQ ID NO: 3853234 - RNA, 20 nt, Human
uagaggaaauaagaaaaauc

SEQ ID NO: 3853235 - RNA, 22 nt, Human
uagaggagaaacuggaacucuc

SEQ ID NO: 3853236 - RNA, 20 nt, Human
uagaggcaugggcuugcugu

SEQ ID NO: 3853237 - RNA, 15 nt, Human
uagaggccagccugg

SEQ ID NO: 3853238 - RNA, 16 nt, Human
uagaggccagccuggc

SEQ ID NO: 3853239 - RNA, 18 nt, Human
uagaggcccuuugcuguc

SEQ ID NO: 3853240 - RNA, 21 nt, Human
uagaggccugacugccaagcc

SEQ ID NO: 3853241 - RNA, 21 nt, Human
uagaggcuucuccgccagccu

SEQ ID NO: 3853242 - RNA, 20 nt, Human
uagagggaccucucccaggg

SEQ ID NO: 3853243 - RNA, 22 nt, Human
uagagggacggccaagaaugua

SEQ ID NO: 3853244 - RNA, 23 nt, Human
uagagggacggccaagaauguac

SEQ ID NO: 3853245 - RNA, 14 nt, Human
uagagggaggggcc

SEQ ID NO: 3853246 - RNA, 13 nt, Human
uagagguacacuu

SEQ ID NO: 3853247 - RNA, 18 nt, Human
uagagguacacuugugaa

SEQ ID NO: 3853248 - RNA, 19 nt, Human
uagagguacacuugugaau

SEQ ID NO: 3853249 - RNA, 17 nt, Human
uagagguauaauugugu

SEQ ID NO: 3853250 - RNA, 16 nt, Human
uagagguucaaagaua

SEQ ID NO: 3853251 - RNA, 19 nt, Human
uagagguucaaagauauuu

SEQ ID NO: 3853252 - RNA, 21 nt, Human
uagagguucaaagauauuuug

SEQ ID NO: 3853253 - RNA, 14 nt, Human
uagagguuuuauga

SEQ ID NO: 3853254 - RNA, 17 nt, Human
uagaguaaaaagaaaac

SEQ ID NO: 3853255 - RNA, 13 nt, Human
uagaguaagaaau

SEQ ID NO: 3853256 - RNA, 17 nt, Human
uagaguacacugccugc

SEQ ID NO: 3853257 - RNA, 21 nt, Human
uagaguacacugccugccuua

SEQ ID NO: 3853258 - RNA, 21 nt, Human
uagagucaacuacacaaagca

SEQ ID NO: 3853259 - RNA, 23 nt, Human
uagagucaucuccaucagcugua

SEQ ID NO: 3853260 - RNA, 14 nt, Human
uagagucauuguaa

SEQ ID NO: 3853261 - RNA, 15 nt, Human
uagagucauuguaau

SEQ ID NO: 3853262 - RNA, 13 nt, Human
uagaguccucacu

SEQ ID NO: 3853263 - RNA, 15 nt, Human
uagagucugagggcu

SEQ ID NO: 3853264 - RNA, 16 nt, Human
uagagugagggccuga

SEQ ID NO: 3853265 - RNA, 13 nt, Human
uagagugucuuaa

SEQ ID NO: 3853266 - RNA, 18 nt, Human
uagagugugauguaugug

SEQ ID NO: 3853267 - RNA, 13 nt, Human
uagaguuaagaag

SEQ ID NO: 3853268 - RNA, 13 nt, Human
uagaguuagacug

SEQ ID NO: 3853269 - RNA, 13 nt, Human
uuauuuugaugua

SEQ ID NO: 3853270 - RNA, 21 nt, Human
uuauuuuggagauuauaauaa

SEQ ID NO: 3853271 - RNA, 14 nt, Human
uuauuuuguaauua

SEQ ID NO: 3853272 - RNA, 21 nt, Human
uuauuuuguucauacauauuu

SEQ ID NO: 3853273 - RNA, 16 nt, Human
uuauuuuuaaaaagaa

SEQ ID NO: 3853274 - RNA, 13 nt, Human
uuauuuuuaaaau

SEQ ID NO: 3853275 - RNA, 18 nt, Human
uuauuuuuacauucugaa

SEQ ID NO: 3853276 - RNA, 16 nt, Human
uuauuuuuauaauugu

SEQ ID NO: 3853277 - RNA, 13 nt, Human
uuauuuuuauaca

SEQ ID NO: 3853278 - RNA, 19 nt, Human
uuauuuuuauauagcuuga

SEQ ID NO: 3853279 - RNA, 20 nt, Human
uuauuuuuauaucagccuga

SEQ ID NO: 3853280 - RNA, 19 nt, Human
uuauuuuucauauugugcc

SEQ ID NO: 3853281 - RNA, 13 nt, Human
uuauuuuucuaaa

SEQ ID NO: 3853282 - RNA, 14 nt, Human
uuauuuuucuaaac

SEQ ID NO: 3853283 - RNA, 15 nt, Human
uuauuuuucuguuac

SEQ ID NO: 3853284 - RNA, 23 nt, Human
uuauuuuugacaguguugaaaau

SEQ ID NO: 3853285 - RNA, 23 nt, Human
uuauuuuuguuucuuccaaagca

SEQ ID NO: 3853286 - RNA, 23 nt, Human
uuauuuuuuaaagaaaucuauuu

SEQ ID NO: 3853287 - RNA, 16 nt, Human
uuauuuuuuaauuauu

SEQ ID NO: 3853288 - RNA, 18 nt, Human
uuauuuuuuacauuauua

SEQ ID NO: 3853289 - RNA, 15 nt, Human
uuauuuuuuauacag

SEQ ID NO: 3853290 - RNA, 12 nt, Human
uuauuuuuucag

SEQ ID NO: 3853291 - RNA, 16 nt, Human
uuauuuuuucagaccg

SEQ ID NO: 3853292 - RNA, 20 nt, Human
uuauuuuuucagaccgaaaa

SEQ ID NO: 3853293 - RNA, 16 nt, Human
uuauuuuuuuaaaauu

SEQ ID NO: 3853294 - RNA, 20 nt, Human
uuauuuuuuuaagcuguaaa

SEQ ID NO: 3853295 - RNA, 15 nt, Human
uuauuuuuuucugau

SEQ ID NO: 3853296 - RNA, 16 nt, Human
uuauuuuuuucugauu

SEQ ID NO: 3853297 - RNA, 13 nt, Human
uuauuuuuuugaa

SEQ ID NO: 3853298 - RNA, 21 nt, Human
uucaaaaaaaaaaaaaagaga

SEQ ID NO: 3853299 - RNA, 14 nt, Human
uucaaaaaguguuu

SEQ ID NO: 3853300 - RNA, 17 nt, Human
uucaaaaaguguuuauu

SEQ ID NO: 3853301 - RNA, 13 nt, Human
uucaaaaauuuca

SEQ ID NO: 3853302 - RNA, 17 nt, Human
uucaaaaccuuuugaaa

SEQ ID NO: 3853303 - RNA, 13 nt, Human
uucaaaagaaagu

SEQ ID NO: 3853304 - RNA, 14 nt, Human
uucaaaagacaugu

SEQ ID NO: 3853305 - RNA, 15 nt, Human
uucaaaagauaauau

SEQ ID NO: 3853306 - RNA, 16 nt, Human
uucaaaaguaaugccu

SEQ ID NO: 3853307 - RNA, 21 nt, Human
uucaaaaguaaugccucuguc

SEQ ID NO: 3853308 - RNA, 14 nt, Human
uucaaaaguuccaa

SEQ ID NO: 3853309 - RNA, 17 nt, Human
uucaaaaguugaaauua

SEQ ID NO: 3853310 - RNA, 19 nt, Human
uucaaaauaggguauauuu

SEQ ID NO: 3853311 - RNA, 14 nt, Human
uucaaaauauugag

SEQ ID NO: 3853312 - RNA, 13 nt, Human
uucaaaauauuua

SEQ ID NO: 3853313 - RNA, 16 nt, Human
uucaaaauccuuccaa

SEQ ID NO: 3853314 - RNA, 22 nt, Human
uucaaaaugauuuccucuguaa

SEQ ID NO: 3853315 - RNA, 16 nt, Human
uucaaaauuguuacaa

SEQ ID NO: 3853316 - RNA, 13 nt, Human
uucaaacaagaau

SEQ ID NO: 3853317 - RNA, 14 nt, Human
uucaaacaagaaug

SEQ ID NO: 3853318 - RNA, 15 nt, Human
uucaaacauauauaa

SEQ ID NO: 3853319 - RNA, 15 nt, Human
uucaaacauuuacca

SEQ ID NO: 3853320 - RNA, 22 nt, Human
uucaaacuccaagguucccuug

SEQ ID NO: 3853321 - RNA, 13 nt, Human
uucaaacugaaaa

SEQ ID NO: 3853322 - RNA, 21 nt, Human
uucaaacuguaaaccaauuuu

SEQ ID NO: 3853323 - RNA, 16 nt, Human
uucaaacuuuggaaca

SEQ ID NO: 3853324 - RNA, 13 nt, Human
uucaaagauauuu

SEQ ID NO: 3853325 - RNA, 12 nt, Human
uucaaagaugcu

SEQ ID NO: 3853326 - RNA, 15 nt, Human
uucaaagcaaauguc

SEQ ID NO: 3853327 - RNA, 19 nt, Human
uucaaagcaauugaaaugc

SEQ ID NO: 3853328 - RNA, 13 nt, Human
uucaaagccagcg

SEQ ID NO: 3853329 - RNA, 23 nt, Human
uucaaagccagcguccuccucug

SEQ ID NO: 3853330 - RNA, 11 nt, Human
uucaaagcuga

SEQ ID NO: 3853331 - RNA, 16 nt, Human
uucaaagcuugaagau

SEQ ID NO: 3853332 - RNA, 16 nt, Human
uucaaaggaacauugu

SEQ ID NO: 3853333 - RNA, 19 nt, Human
uucaaaggagcaagaacuu

SEQ ID NO: 3853334 - RNA, 13 nt, Human
uucaaaguguuau

SEQ ID NO: 3853335 - RNA, 11 nt, Human
uucaaaguugc

SEQ ID NO: 3853336 - RNA, 14 nt, Human
uucaaaguuuaaua

SEQ ID NO: 3853337 - RNA, 21 nt, Human
uucaaaguuuuguuguacuua

SEQ ID NO: 3853338 - RNA, 22 nt, Human
uucaaaucaaucuguaaaacua

SEQ ID NO: 3853339 - RNA, 23 nt, Human
uucaaaucaaucuguaaaacuaa

SEQ ID NO: 3853340 - RNA, 22 nt, Human
uagcguuuaaggugagcauaaa

SEQ ID NO: 3853341 - RNA, 15 nt, Human
uagcuaacuguaaau

SEQ ID NO: 3853342 - RNA, 14 nt, Human
uagcuaagccaaga

SEQ ID NO: 3853343 - RNA, 20 nt, Human
uagcuaauaaaaagcuuuug

SEQ ID NO: 3853344 - RNA, 21 nt, Human
uagcuaauaaaaagcuuuugu

SEQ ID NO: 3853345 - RNA, 22 nt, Human
uagcuaauaaaaagcuuuuguc

SEQ ID NO: 3853346 - RNA, 13 nt, Human
uagcuaauggaaa

SEQ ID NO: 3853347 - RNA, 13 nt, Human
uagcuaauuauuu

SEQ ID NO: 3853348 - RNA, 11 nt, Human
uagcuacagag

SEQ ID NO: 3853349 - RNA, 14 nt, Human
uagcuacagagaaa

SEQ ID NO: 3853350 - RNA, 17 nt, Human
uagcuacagagaaacca

SEQ ID NO: 3853351 - RNA, 22 nt, Human
uagcuacagagaaaccagcuuc

SEQ ID NO: 3853352 - RNA, 24 nt, Human
uagcuacagagaaaccagcuuccu

SEQ ID NO: 3853353 - RNA, 23 nt, Human
uagcuacaggaagcaccccaugc

SEQ ID NO: 3853354 - RNA, 21 nt, Human
uagcuacccaaaagagaaaaa

SEQ ID NO: 3853355 - RNA, 16 nt, Human
uagcuacuaauuuuaa

SEQ ID NO: 3853356 - RNA, 18 nt, Human
uagcuagacuggugacug

SEQ ID NO: 3853357 - RNA, 19 nt, Human
uagcuagaggaaccaaccc

SEQ ID NO: 3853358 - RNA, 17 nt, Human
uagcuaggugacauaua

SEQ ID NO: 3853359 - RNA, 16 nt, Human
uagcuauauccaugua

SEQ ID NO: 3853360 - RNA, 17 nt, Human
uagcuauauccauguac

SEQ ID NO: 3853361 - RNA, 15 nt, Human
uagcuauuacugucu

SEQ ID NO: 3853362 - RNA, 11 nt, Human
uagcuauuuuu

SEQ ID NO: 3853363 - RNA, 18 nt, Human
uagcucaaacguggcuuu

SEQ ID NO: 3853364 - RNA, 23 nt, Human
uagcucaagagaaaaguugacac

SEQ ID NO: 3853365 - RNA, 12 nt, Human
uagcucaaugag

SEQ ID NO: 3853366 - RNA, 21 nt, Human
uagcucaaugagcauguuuag

SEQ ID NO: 3853367 - RNA, 18 nt, Human
uagcucagccccagccca

SEQ ID NO: 3853368 - RNA, 19 nt, Human
uagcucagccccagcccag

SEQ ID NO: 3853369 - RNA, 20 nt, Human
uagcucaggugucccugcac

SEQ ID NO: 3853370 - RNA, 11 nt, Human
uagcucaguuu

SEQ ID NO: 3853371 - RNA, 20 nt, Human
uagcuccacacccucuccca

SEQ ID NO: 3853372 - RNA, 13 nt, Human
uagcuccccuccu

SEQ ID NO: 3853373 - RNA, 15 nt, Human
uagcuccccuccucu

SEQ ID NO: 3853374 - RNA, 16 nt, Human
uagcuccuccccuucc

SEQ ID NO: 3853375 - RNA, 19 nt, Human
uagcuccuccccuuccucu

SEQ ID NO: 3853376 - RNA, 13 nt, Human
uagcuccuguggc

SEQ ID NO: 3853377 - RNA, 14 nt, Human
uagcuccuguggcc

SEQ ID NO: 3853378 - RNA, 14 nt, Human
uagcucuaaaaucu

SEQ ID NO: 3853379 - RNA, 14 nt, Human
uagcucucuaggcc

SEQ ID NO: 3853380 - RNA, 15 nt, Human
uagcucucuaggccu

SEQ ID NO: 3853381 - RNA, 11 nt, Human
uagcucugggg

SEQ ID NO: 3853382 - RNA, 23 nt, Human
uagcucuggggugggcaguuuuu

SEQ ID NO: 3853383 - RNA, 17 nt, Human
uagcucuguacaucuuu

SEQ ID NO: 3853384 - RNA, 13 nt, Human
uagcucuuuguca

SEQ ID NO: 3853385 - RNA, 22 nt, Human
uagcugaagaauugaaaaguuu

SEQ ID NO: 3853386 - RNA, 15 nt, Human
uagcugaauguuuuu

SEQ ID NO: 3853387 - RNA, 21 nt, Human
uagcugaugaacuuauucugu

SEQ ID NO: 3853388 - RNA, 17 nt, Human
uagcugcaaaggacaga

SEQ ID NO: 3853389 - RNA, 12 nt, Human
uagcugcagaac

SEQ ID NO: 3853390 - RNA, 23 nt, Human
uagcugcauccuccaagaaucua

SEQ ID NO: 3853391 - RNA, 14 nt, Human
uagcugccaagccc

SEQ ID NO: 3853392 - RNA, 16 nt, Human
uagcugccaagcccca

SEQ ID NO: 3853393 - RNA, 21 nt, Human
uagcugccaagccccauccug

SEQ ID NO: 3853394 - RNA, 19 nt, Human
uagcuggaacuacaggcuc

SEQ ID NO: 3853395 - RNA, 12 nt, Human
uagcuggagccu

SEQ ID NO: 3853396 - RNA, 23 nt, Human
uagcugggauuuuaaacuagaug

SEQ ID NO: 3853397 - RNA, 22 nt, Human
uagcugguuuccucauuccuga

SEQ ID NO: 3853398 - RNA, 16 nt, Human
uagcugugaccucucc

SEQ ID NO: 3853399 - RNA, 14 nt, Human
uagcugugaccugc

SEQ ID NO: 3853400 - RNA, 19 nt, Human
uagcugugaccugcugagc

SEQ ID NO: 3853401 - RNA, 20 nt, Human
uagcugugaccugcugagcu

SEQ ID NO: 3853402 - RNA, 24 nt, Human
uagcugugaccugcugagcucuga

SEQ ID NO: 3853403 - RNA, 14 nt, Human
uagcugugggggug

SEQ ID NO: 3853404 - RNA, 17 nt, Human
uagcuguuauuucuauu

SEQ ID NO: 3853405 - RNA, 16 nt, Human
uagcuguugagcuguu

SEQ ID NO: 3853406 - RNA, 17 nt, Human
uagcuguugagcuguuu

SEQ ID NO: 3853407 - RNA, 12 nt, Human
uagcuuaagaaa

SEQ ID NO: 3853408 - RNA, 15 nt, Human
uagcuuaagaaaaaa

SEQ ID NO: 3853409 - RNA, 21 nt, Human
uagcuuacaagccagcuggag

SEQ ID NO: 3853410 - RNA, 17 nt, Human
uagcuuacaugagaaca

SEQ ID NO: 3853411 - RNA, 19 nt, Human
uagcuuacaugagaacaga

SEQ ID NO: 3853412 - RNA, 12 nt, Human
uagcuuaugaaa

SEQ ID NO: 3853413 - RNA, 16 nt, Human
uagcuuaugaaaagaa

SEQ ID NO: 3853414 - RNA, 15 nt, Human
uagcuuauuauugaa

SEQ ID NO: 3853415 - RNA, 21 nt, Human
uugccccaacccccagcaccc

SEQ ID NO: 3853416 - RNA, 15 nt, Human
uugccccccuggccu

SEQ ID NO: 3853417 - RNA, 21 nt, Human
uugcccccgugagccaauccc

SEQ ID NO: 3853418 - RNA, 22 nt, Human
uugccccggccccggccccagc

SEQ ID NO: 3853419 - RNA, 23 nt, Human
uugccccuggggcuuccauccca

SEQ ID NO: 3853420 - RNA, 19 nt, Human
uugccccuuucucuuuucc

SEQ ID NO: 3853421 - RNA, 16 nt, Human
uugcccuagauaguuu

SEQ ID NO: 3853422 - RNA, 15 nt, Human
uugcccuagaugagc

SEQ ID NO: 3853423 - RNA, 12 nt, Human
uugcccugaccu

SEQ ID NO: 3853424 - RNA, 18 nt, Human
uugcccugaccucccagc

SEQ ID NO: 3853425 - RNA, 21 nt, Human
uugcccugaccucccagcccu

SEQ ID NO: 3853426 - RNA, 13 nt, Human
uugcccuguuaaa

SEQ ID NO: 3853427 - RNA, 18 nt, Human
uugcccuucacaguguuu

SEQ ID NO: 3853428 - RNA, 14 nt, Human
uugcccuugcccug

SEQ ID NO: 3853429 - RNA, 15 nt, Human
uugcccuugcccuga

SEQ ID NO: 3853430 - RNA, 17 nt, Human
uugcccuugcccugacc

SEQ ID NO: 3853431 - RNA, 20 nt, Human
uugcccuuucuguaccauuu

SEQ ID NO: 3853432 - RNA, 15 nt, Human
uugccgaaacuggaa

SEQ ID NO: 3853433 - RNA, 18 nt, Human
uugccgaaacuggaaguu

SEQ ID NO: 3853434 - RNA, 18 nt, Human
uugccgcgucgcccuccc

SEQ ID NO: 3853435 - RNA, 21 nt, Human
uugccgcgucgcccucccagg

SEQ ID NO: 3853436 - RNA, 16 nt, Human
uugccgguggugcagg

SEQ ID NO: 3853437 - RNA, 18 nt, Human
uugccgucuaccugaggg

SEQ ID NO: 3853438 - RNA, 18 nt, Human
uugccguggcaucuuaaa

SEQ ID NO: 3853439 - RNA, 22 nt, Human
uugccuaaauuuaaugcugccu

SEQ ID NO: 3853440 - RNA, 22 nt, Human
uugccuaagaauaaacauuugu

SEQ ID NO: 3853441 - RNA, 20 nt, Human
uugccuaaguauuaaaacau

SEQ ID NO: 3853442 - RNA, 20 nt, Human
uugccuaauaugaugacugu

SEQ ID NO: 3853443 - RNA, 14 nt, Human
uugccuagacagcu

SEQ ID NO: 3853444 - RNA, 17 nt, Human
uugccuauauuuuccug

SEQ ID NO: 3853445 - RNA, 18 nt, Human
uugccuauauuuuccuga

SEQ ID NO: 3853446 - RNA, 24 nt, Human
uugccuauucccacaccuccacag

SEQ ID NO: 3853447 - RNA, 18 nt, Human
uugccucagcuuccccag

SEQ ID NO: 3853448 - RNA, 17 nt, Human
uugccucaguaaaauga

SEQ ID NO: 3853449 - RNA, 21 nt, Human
uugccuccccauuucccaucu

SEQ ID NO: 3853450 - RNA, 19 nt, Human
uugccuccuguguacugug

SEQ ID NO: 3853451 - RNA, 21 nt, Human
uugccuccuguguacuguguc

SEQ ID NO: 3853452 - RNA, 14 nt, Human
uugccucggcuccu

SEQ ID NO: 3853453 - RNA, 16 nt, Human
uugccucggcuccugc

SEQ ID NO: 3853454 - RNA, 15 nt, Human
uugccucucuguuug

SEQ ID NO: 3853455 - RNA, 18 nt, Human
uugccucugccucugaca

SEQ ID NO: 3853456 - RNA, 17 nt, Human
uugccucuguccccuuc

SEQ ID NO: 3853457 - RNA, 13 nt, Human
uugccucugugcu

SEQ ID NO: 3853458 - RNA, 14 nt, Human
uugccucugugcug

SEQ ID NO: 3853459 - RNA, 21 nt, Human
uugccucuuuuaccugcugcu

SEQ ID NO: 3853460 - RNA, 22 nt, Human
uugccugaacauccuuccuucc

SEQ ID NO: 3853461 - RNA, 23 nt, Human
uugccugaacauccuuccuuccc

SEQ ID NO: 3853462 - RNA, 19 nt, Human
uugccugaacuccugccau

SEQ ID NO: 3853463 - RNA, 13 nt, Human
uugccugcagaga

SEQ ID NO: 3853464 - RNA, 23 nt, Human
uugccugccuuuccauccauggc

SEQ ID NO: 3853465 - RNA, 19 nt, Human
uugccugcggucaaggcca

SEQ ID NO: 3853466 - RNA, 22 nt, Human
uugccugcguuuuggaagcucu

SEQ ID NO: 3853467 - RNA, 13 nt, Human
uugccugguacag

SEQ ID NO: 3853468 - RNA, 14 nt, Human
uugccugguacagu

SEQ ID NO: 3853469 - RNA, 15 nt, Human
uugccugguacagua

SEQ ID NO: 3853470 - RNA, 16 nt, Human
uugccugguuuugucu

SEQ ID NO: 3853471 - RNA, 19 nt, Human
uugccuguaacaagccaga

SEQ ID NO: 3853472 - RNA, 12 nt, Human
uugccugugcca

SEQ ID NO: 3853473 - RNA, 22 nt, Human
uugccuguucaguuacagaaag

SEQ ID NO: 3853474 - RNA, 17 nt, Human
uugccuuauuaaaguuc

SEQ ID NO: 3853475 - RNA, 20 nt, Human
uugccuuccuuucuccagga

SEQ ID NO: 3853476 - RNA, 20 nt, Human
uugccuucucaccagcugca

SEQ ID NO: 3853477 - RNA, 19 nt, Human
uugccuucuucacccagcu

SEQ ID NO: 3853478 - RNA, 14 nt, Human
uugccuucuuugaa

SEQ ID NO: 3853479 - RNA, 16 nt, Human
uugccuucuuugaaga

SEQ ID NO: 3853480 - RNA, 17 nt, Human
uugccuucuuugaagaa

SEQ ID NO: 3853481 - RNA, 18 nt, Human
uugccuugaaccacuucc

SEQ ID NO: 3853482 - RNA, 13 nt, Human
uugccuuucucga

SEQ ID NO: 3853483 - RNA, 17 nt, Human
uugccuuugaauguuaa

SEQ ID NO: 3853484 - RNA, 19 nt, Human
uugccuuuuaauuuuuaau

SEQ ID NO: 3853485 - RNA, 12 nt, Human
uugccuuuuuca

SEQ ID NO: 3853486 - RNA, 15 nt, Human
uugccuuuuucauua

SEQ ID NO: 3853487 - RNA, 16 nt, Human
uugccuuuuucauuau

SEQ ID NO: 3853488 - RNA, 20 nt, Human
uugccuuuuucauuuuccaa

SEQ ID NO: 3853489 - RNA, 21 nt, Human
uugcgaauauuuuguaaauua

SEQ ID NO: 3853490 - RNA, 19 nt, Human
uugcgaauccaagcucccu

SEQ ID NO: 3853491 - RNA, 22 nt, Human
uugcgacggagagaaaaaagaa

SEQ ID NO: 3853492 - RNA, 18 nt, Human
uugcguaacuggcugugu

SEQ ID NO: 3853493 - RNA, 15 nt, Human
uugcguggacucugc

SEQ ID NO: 3853494 - RNA, 16 nt, Human
uugcguuacacccuuu

SEQ ID NO: 3853495 - RNA, 19 nt, Human
uugcguuagaaugaggagg

SEQ ID NO: 3853496 - RNA, 20 nt, Human
uugcguuggucucugcauuu

SEQ ID NO: 3853497 - RNA, 17 nt, Human
uugcuaaacacugcgcu

SEQ ID NO: 3853498 - RNA, 15 nt, Human
uugcuaaauguaaca

SEQ ID NO: 3853499 - RNA, 12 nt, Human
uugcuaacugaa

SEQ ID NO: 3853500 - RNA, 16 nt, Human
uugcuaacugaacuuu

SEQ ID NO: 3853501 - RNA, 19 nt, Human
uugcuaacugaacuuugaa

SEQ ID NO: 3853502 - RNA, 13 nt, Human
uugcuaagaaggg

SEQ ID NO: 3853503 - RNA, 13 nt, Human
uugcuaagaugcu

SEQ ID NO: 3853504 - RNA, 20 nt, Human
uugcuaagaugcucuaucuu

SEQ ID NO: 3853505 - RNA, 19 nt, Human
uugcuaaguaaaucucuuc

SEQ ID NO: 3853506 - RNA, 21 nt, Human
uugcuaaguaaaucucuucug

SEQ ID NO: 3853507 - RNA, 16 nt, Human
uugcuaagugaggaug

SEQ ID NO: 3853508 - RNA, 21 nt, Human
uugcuaaucagugucucacac

SEQ ID NO: 3853509 - RNA, 18 nt, Human
uugcuaaucggguuguca

SEQ ID NO: 3853510 - RNA, 20 nt, Human
uucacauucuuauaaauaug

SEQ ID NO: 3853511 - RNA, 19 nt, Human
uucacauuguuugcugcua

SEQ ID NO: 3853512 - RNA, 19 nt, Human
uucacauuuuccuuuucaa

SEQ ID NO: 3853513 - RNA, 17 nt, Human
uucacauuuuuguauuu

SEQ ID NO: 3853514 - RNA, 15 nt, Human
uucaccaaaauuauc

SEQ ID NO: 3853515 - RNA, 14 nt, Human
uucaccaaaucuug

SEQ ID NO: 3853516 - RNA, 22 nt, Human
uucaccaccaaaugccaagaaa

SEQ ID NO: 3853517 - RNA, 12 nt, Human
uucaccauguaa

SEQ ID NO: 3853518 - RNA, 20 nt, Human
uucaccauguaaaacaaaaa

SEQ ID NO: 3853519 - RNA, 15 nt, Human
uucaccauuauaaug

SEQ ID NO: 3853520 - RNA, 20 nt, Human
uucaccauuauaaugaauuu

SEQ ID NO: 3853521 - RNA, 14 nt, Human
uucacccacagaaa

SEQ ID NO: 3853522 - RNA, 18 nt, Human
uucacccaggccuauguu

SEQ ID NO: 3853523 - RNA, 18 nt, Human
uucacccaucuuaucaag

SEQ ID NO: 3853524 - RNA, 14 nt, Human
uucaccccacccuu

SEQ ID NO: 3853525 - RNA, 17 nt, Human
uucaccccagggccuga

SEQ ID NO: 3853526 - RNA, 22 nt, Human
uucaccccagggccugagccug

SEQ ID NO: 3853527 - RNA, 21 nt, Human
uucaccccaguggccacucag

SEQ ID NO: 3853528 - RNA, 23 nt, Human
uucaccccccacucaccaguguc

SEQ ID NO: 3853529 - RNA, 19 nt, Human
uucacccccuuuccuggac

SEQ ID NO: 3853530 - RNA, 21 nt, Human
uucaccccggcaggcccugca

SEQ ID NO: 3853531 - RNA, 17 nt, Human
uucaccccucccuuucu

SEQ ID NO: 3853532 - RNA, 18 nt, Human
uucacccuuaacccaagg

SEQ ID NO: 3853533 - RNA, 22 nt, Human
uucacccuuaacccaaggagca

SEQ ID NO: 3853534 - RNA, 20 nt, Human
uucaccuaagagauucugau

SEQ ID NO: 3853535 - RNA, 18 nt, Human
uucaccuauuucaaaaau

SEQ ID NO: 3853536 - RNA, 22 nt, Human
uucaccucacugaaaacaucug

SEQ ID NO: 3853537 - RNA, 17 nt, Human
uucaccuccuaaaacaa

SEQ ID NO: 3853538 - RNA, 12 nt, Human
uucaccugagca

SEQ ID NO: 3853539 - RNA, 17 nt, Human
uucaccuguaaaacuuu

SEQ ID NO: 3853540 - RNA, 13 nt, Human
uucaccuguaaac

SEQ ID NO: 3853541 - RNA, 18 nt, Human
uucaccuguaaaccugag

SEQ ID NO: 3853542 - RNA, 21 nt, Human
uucaccuguuuuuaagcuguu

SEQ ID NO: 3853543 - RNA, 23 nt, Human
uucaccuucguuuacuaugccug

SEQ ID NO: 3853544 - RNA, 22 nt, Human
uucaccuugggaugaugccuca

SEQ ID NO: 3853545 - RNA, 14 nt, Human
uucaccuuuguagc

SEQ ID NO: 3853546 - RNA, 14 nt, Human
uucaccuuuguccc

SEQ ID NO: 3853547 - RNA, 19 nt, Human
uucaccuuuguccccaccg

SEQ ID NO: 3853548 - RNA, 22 nt, Human
uucacggaaguuuucaaugaug

SEQ ID NO: 3853549 - RNA, 22 nt, Human
uucacgugcagcagcaacacaa

SEQ ID NO: 3853550 - RNA, 17 nt, Human
uucacuacuuuaauaaa

SEQ ID NO: 3853551 - RNA, 23 nt, Human
uucacuagugaccccuucccugu

SEQ ID NO: 3853552 - RNA, 20 nt, Human
uucacuauuuuuauuuauau

SEQ ID NO: 3853553 - RNA, 15 nt, Human
uucacucaagcacug

SEQ ID NO: 3853554 - RNA, 19 nt, Human
uucacucacugucaaugau

SEQ ID NO: 3853555 - RNA, 24 nt, Human
uucacuccggugugccugcagccc

SEQ ID NO: 3853556 - RNA, 14 nt, Human
uucacuccugcugu

SEQ ID NO: 3853557 - RNA, 14 nt, Human
uucacucuccuugg

SEQ ID NO: 3853558 - RNA, 15 nt, Human
uugucagagcuggga

SEQ ID NO: 3853559 - RNA, 23 nt, Human
uugucagggaguguucccuaucc

SEQ ID NO: 3853560 - RNA, 23 nt, Human
uugucauaucagcacauauuuuc

SEQ ID NO: 3853561 - RNA, 18 nt, Human
uugucaugguuacaaacu

SEQ ID NO: 3853562 - RNA, 12 nt, Human
uugucauuaaag

SEQ ID NO: 3853563 - RNA, 14 nt, Human
uugucauuagccug

SEQ ID NO: 3853564 - RNA, 14 nt, Human
uuccaaagaaaguu

SEQ ID NO: 3853565 - RNA, 16 nt, Human
uuccaaagaauucuua

SEQ ID NO: 3853566 - RNA, 21 nt, Human
uuccaaagaguagaauugcau

SEQ ID NO: 3853567 - RNA, 19 nt, Human
uuccaaagcacauugaaag

SEQ ID NO: 3853568 - RNA, 13 nt, Human
uuccaaaguacac

SEQ ID NO: 3853569 - RNA, 14 nt, Human
uuccaaauaaauaa

SEQ ID NO: 3853570 - RNA, 20 nt, Human
uuccaaauaauauguuuccu

SEQ ID NO: 3853571 - RNA, 17 nt, Human
uuccaaaugaauguugu

SEQ ID NO: 3853572 - RNA, 13 nt, Human
uuccaaauuauuu

SEQ ID NO: 3853573 - RNA, 19 nt, Human
uuccaaauuauuucuuaau

SEQ ID NO: 3853574 - RNA, 15 nt, Human
uuccaaauucacaag

SEQ ID NO: 3853575 - RNA, 23 nt, Human
uuccaaauucacaaguuguguuu

SEQ ID NO: 3853576 - RNA, 20 nt, Human
uuccaaauucaguuucauaa

SEQ ID NO: 3853577 - RNA, 16 nt, Human
uuccaacaaaggguuu

SEQ ID NO: 3853578 - RNA, 21 nt, Human
uuccaacaaaggguuuuaaug

SEQ ID NO: 3853579 - RNA, 17 nt, Human
uuccaacaccacagaca

SEQ ID NO: 3853580 - RNA, 17 nt, Human
uuccaaccauuuaucuu

SEQ ID NO: 3853581 - RNA, 18 nt, Human
uuccaaccauuuaucuug

SEQ ID NO: 3853582 - RNA, 19 nt, Human
uuccaacucguauagcaug

SEQ ID NO: 3853583 - RNA, 15 nt, Human
uuccaacugcugccc

SEQ ID NO: 3853584 - RNA, 22 nt, Human
uuccaacuguauauauucccaa

SEQ ID NO: 3853585 - RNA, 13 nt, Human
uuccaagaaagau

SEQ ID NO: 3853586 - RNA, 12 nt, Human
uuccaagacagu

SEQ ID NO: 3853587 - RNA, 14 nt, Human
uuccaagacaguau

SEQ ID NO: 3853588 - RNA, 12 nt, Human
uuccaagacauu

SEQ ID NO: 3853589 - RNA, 19 nt, Human
uuccaagacauugucaaua

SEQ ID NO: 3853590 - RNA, 16 nt, Human
uuccaagaccugacuc

SEQ ID NO: 3853591 - RNA, 18 nt, Human
uuccaagacuccagcccu

SEQ ID NO: 3853592 - RNA, 15 nt, Human
uuccaagacucuaga

SEQ ID NO: 3853593 - RNA, 22 nt, Human
uuccaagagccugagagugagg

SEQ ID NO: 3853594 - RNA, 14 nt, Human
uuccaagagucuaa

SEQ ID NO: 3853595 - RNA, 17 nt, Human
uuccaagagucuaaaga

SEQ ID NO: 3853596 - RNA, 18 nt, Human
uuccaaggagcugagaau

SEQ ID NO: 3853597 - RNA, 16 nt, Human
uuccaaggaguuccau

SEQ ID NO: 3853598 - RNA, 13 nt, Human
uuccaaguaauau

SEQ ID NO: 3853599 - RNA, 16 nt, Human
uuccaauaugaugacu

SEQ ID NO: 3853600 - RNA, 24 nt, Human
uuccaauauuucugcuuucuuuga

SEQ ID NO: 3853601 - RNA, 19 nt, Human
uuccaaugccucuugucuu

SEQ ID NO: 3853602 - RNA, 13 nt, Human
uuccaaugucugc

SEQ ID NO: 3853603 - RNA, 16 nt, Human
uuccaaugucuggaga

SEQ ID NO: 3853604 - RNA, 17 nt, Human
uuccaaugucuggagac

SEQ ID NO: 3853605 - RNA, 23 nt, Human
uuccaauuauuuauaauaaauca

SEQ ID NO: 3853606 - RNA, 13 nt, Human
uuccaauuuggaa

SEQ ID NO: 3853607 - RNA, 13 nt, Human
uuccaauuuuccu

SEQ ID NO: 3853608 - RNA, 14 nt, Human
uuccaauuuuccuu

SEQ ID NO: 3853609 - RNA, 16 nt, Human
uuccacaaagaaaauu

SEQ ID NO: 3853610 - RNA, 22 nt, Human
uuccacaagagcccaggccucc

SEQ ID NO: 3853611 - RNA, 22 nt, Human
uuccacacccccaccccuugcu

SEQ ID NO: 3853612 - RNA, 10 nt, Human
uuccacagac

SEQ ID NO: 3853613 - RNA, 12 nt, Human
uuccacagacgg

SEQ ID NO: 3853614 - RNA, 20 nt, Human
uuccacagaguaagacauug

SEQ ID NO: 3853615 - RNA, 12 nt, Human
uuccacagauug

SEQ ID NO: 3853616 - RNA, 19 nt, Human
uuccacagauuguuucuau

SEQ ID NO: 3853617 - RNA, 17 nt, Human
uuccacaguugccacca

SEQ ID NO: 3853618 - RNA, 16 nt, Human
uuccacaugcucugag

SEQ ID NO: 3853619 - RNA, 15 nt, Human
uuccaccacagccag

SEQ ID NO: 3853620 - RNA, 12 nt, Human
uuccacccaggg

SEQ ID NO: 3853621 - RNA, 18 nt, Human
uuccaccccaagagaacu

SEQ ID NO: 3853622 - RNA, 13 nt, Human
uuccacccccucc

SEQ ID NO: 3853623 - RNA, 11 nt, Human
uuccacccugg

SEQ ID NO: 3853624 - RNA, 15 nt, Human
uuccaccucacccca

SEQ ID NO: 3853625 - RNA, 12 nt, Human
uuccaccucccu

SEQ ID NO: 3853626 - RNA, 13 nt, Human
uuccaccucccuc

SEQ ID NO: 3853627 - RNA, 15 nt, Human
uuccaccucccuccc

SEQ ID NO: 3853628 - RNA, 17 nt, Human
uuccaccugcucugcug

SEQ ID NO: 3853629 - RNA, 17 nt, Human
uuccaccuuaaauuaaa

SEQ ID NO: 3853630 - RNA, 18 nt, Human
uuccaccuuaaauuaaac

SEQ ID NO: 3853631 - RNA, 15 nt, Human
uuccacgcugucucc

SEQ ID NO: 3853632 - RNA, 24 nt, Human
uuccacggagccacuccucugacu

SEQ ID NO: 3853633 - RNA, 19 nt, Human
uuccacguacugcagccuc

SEQ ID NO: 3853634 - RNA, 19 nt, Human
uuccacguguuuuauuccu

SEQ ID NO: 3853635 - RNA, 16 nt, Human
uuccacuacaccuggc

SEQ ID NO: 3853636 - RNA, 19 nt, Human
uuccacuacaccuggcuga

SEQ ID NO: 3853637 - RNA, 15 nt, Human
uuccacuacugcuac

SEQ ID NO: 3853638 - RNA, 23 nt, Human
uuccacucuggauucagccuucu

SEQ ID NO: 3853639 - RNA, 16 nt, Human
uuccacugaaguagug

SEQ ID NO: 3853640 - RNA, 13 nt, Human
uuccacugcaaaa

SEQ ID NO: 3853641 - RNA, 22 nt, Human
uuccacugugcagguucccacu

SEQ ID NO: 3853642 - RNA, 18 nt, Human
uuccacuuauagccucug

SEQ ID NO: 3853643 - RNA, 21 nt, Human
uuccacuucuuccuuucucuu

SEQ ID NO: 3853644 - RNA, 21 nt, Human
uuccacuugagugucaagcug

SEQ ID NO: 3853645 - RNA, 15 nt, Human
uuccacuuuguucuu

SEQ ID NO: 3853646 - RNA, 21 nt, Human
uuccagaaaaccccagcaucc

SEQ ID NO: 3853647 - RNA, 22 nt, Human
uuccagaaaggauauuuaagaa

SEQ ID NO: 3853648 - RNA, 22 nt, Human
uuccagaagaagagaagcugcu

SEQ ID NO: 3853649 - RNA, 23 nt, Human
uuccagaagaagagaagcugcug

SEQ ID NO: 3853650 - RNA, 19 nt, Human
uuccagaauaucugggauu

SEQ ID NO: 3853651 - RNA, 11 nt, Human
uuccagaaucc

SEQ ID NO: 3853652 - RNA, 14 nt, Human
uuccagaaugcugu

SEQ ID NO: 3853653 - RNA, 18 nt, Human
uuccagaaugcuguacau

SEQ ID NO: 3853654 - RNA, 14 nt, Human
uuccagaccugaag

SEQ ID NO: 3853655 - RNA, 23 nt, Human
uuccagacugcuuccaauuuucu

SEQ ID NO: 3853656 - RNA, 20 nt, Human
uuccagagacaaauauuucu

SEQ ID NO: 3853657 - RNA, 20 nt, Human
uuccagagaguccucuggau

SEQ ID NO: 3853658 - RNA, 18 nt, Human
uuccagagaguggcuccu

SEQ ID NO: 3853659 - RNA, 11 nt, Human
uuccagagcau

SEQ ID NO: 3853660 - RNA, 13 nt, Human
uuccagagcauuc

SEQ ID NO: 3853661 - RNA, 15 nt, Human
uuccagagcugccag

SEQ ID NO: 3853662 - RNA, 20 nt, Human
uuccagaggcuauuauuuuc

SEQ ID NO: 3853663 - RNA, 15 nt, Human
uuccagaucccaggc

SEQ ID NO: 3853664 - RNA, 16 nt, Human
uuccagauccucucug

SEQ ID NO: 3853665 - RNA, 19 nt, Human
uuccagauggucauccaga

SEQ ID NO: 3853666 - RNA, 21 nt, Human
uuccagcaauucuccugccuc

SEQ ID NO: 3853667 - RNA, 20 nt, Human
uuccagcacaaccuucaagc

SEQ ID NO: 3853668 - RNA, 16 nt, Human
uuccagcagaagacaa

SEQ ID NO: 3853669 - RNA, 22 nt, Human
uuccagcagaagacaaaaagac

SEQ ID NO: 3853670 - RNA, 12 nt, Human
uuccagcaggag

SEQ ID NO: 3853671 - RNA, 13 nt, Human
uuccagcaggagg

SEQ ID NO: 3853672 - RNA, 21 nt, Human
uuccagcauuuagcuggccac

SEQ ID NO: 3853673 - RNA, 15 nt, Human
uuccagccagggcug

SEQ ID NO: 3853674 - RNA, 14 nt, Human
uuccagccccucug

SEQ ID NO: 3853675 - RNA, 23 nt, Human
uuccagcuagugacccacaugcc

SEQ ID NO: 3853676 - RNA, 24 nt, Human
uuccagcuagugacccacaugcca

SEQ ID NO: 3853677 - RNA, 23 nt, Human
uuccagcucaccccccacacuca

SEQ ID NO: 3853678 - RNA, 13 nt, Human
uuccagcuccuca

SEQ ID NO: 3853679 - RNA, 14 nt, Human
uuccagcuccugua

SEQ ID NO: 3853680 - RNA, 20 nt, Human
uuccagcugcugucuucugg

SEQ ID NO: 3853681 - RNA, 21 nt, Human
uuccaggaaacuccacaucug

SEQ ID NO: 3853682 - RNA, 23 nt, Human
uuccaggaaacuccacaucugcc

SEQ ID NO: 3853683 - RNA, 13 nt, Human
uuccaggcagccu

SEQ ID NO: 3853684 - RNA, 19 nt, Human
uuccaggcagccucuguca

SEQ ID NO: 3853685 - RNA, 21 nt, Human
uuccaggcuaaacauccaaua

SEQ ID NO: 3853686 - RNA, 20 nt, Human
uuccaggcugcauagaagga

SEQ ID NO: 3853687 - RNA, 13 nt, Human
uuccaggcuggga

SEQ ID NO: 3853688 - RNA, 17 nt, Human
uuccaggcugggagagc

SEQ ID NO: 3853689 - RNA, 18 nt, Human
uuccaggcuucugcuggg

SEQ ID NO: 3853690 - RNA, 15 nt, Human
uuccagggaggggcc

SEQ ID NO: 3853691 - RNA, 17 nt, Human
uuccaggggaaccugcc

SEQ ID NO: 3853692 - RNA, 17 nt, Human
uuccaggggugggacac

SEQ ID NO: 3853693 - RNA, 16 nt, Human
uuccagggucccucug

SEQ ID NO: 3853694 - RNA, 18 nt, Human
uuccagguaucuccagga

SEQ ID NO: 3853695 - RNA, 19 nt, Human
uuccagguaucuccaggau

SEQ ID NO: 3853696 - RNA, 18 nt, Human
uuccagguuuaagcuguu

SEQ ID NO: 3853697 - RNA, 15 nt, Human
uuccagguuuaagua

SEQ ID NO: 3853698 - RNA, 12 nt, Human
uuccaguauuuu

SEQ ID NO: 3853699 - RNA, 11 nt, Human
uuccagucucc

SEQ ID NO: 3853700 - RNA, 16 nt, Human
uuccagugaggcucug

SEQ ID NO: 3853701 - RNA, 19 nt, Human
uuccagugaggcucugccc

SEQ ID NO: 3853702 - RNA, 21 nt, Human
uuccagugaggcucugcccuu

SEQ ID NO: 3853703 - RNA, 16 nt, Human
uaucaguuacucagcc

SEQ ID NO: 3853704 - RNA, 21 nt, Human
uaucaguugagcuucauauac

SEQ ID NO: 3853705 - RNA, 21 nt, Human
uaucaguuugcuagcagaaau

SEQ ID NO: 3853706 - RNA, 20 nt, Human
uaucaguuuguccuguagag

SEQ ID NO: 3853707 - RNA, 18 nt, Human
uaucaguuuuauagcuuu

SEQ ID NO: 3853708 - RNA, 18 nt, Human
uaucauagaaauguaacu

SEQ ID NO: 3853709 - RNA, 15 nt, Human
uaucauaguuaacau

SEQ ID NO: 3853710 - RNA, 19 nt, Human
uaucauauauuuaaucuua

SEQ ID NO: 3853711 - RNA, 21 nt, Human
uaucaucagcauaccuuuauu

SEQ ID NO: 3853712 - RNA, 14 nt, Human
uaucaucaguauug

SEQ ID NO: 3853713 - RNA, 15 nt, Human
uaucaucaguauuga

SEQ ID NO: 3853714 - RNA, 23 nt, Human
uaucaucaguguagaaccuaauu

SEQ ID NO: 3853715 - RNA, 17 nt, Human
uaucauccacacaugaa

SEQ ID NO: 3853716 - RNA, 22 nt, Human
uaucauccacauuguuuuaaaa

SEQ ID NO: 3853717 - RNA, 16 nt, Human
uaucaucuaccuagau

SEQ ID NO: 3853718 - RNA, 11 nt, Human
uaucaugaagc

SEQ ID NO: 3853719 - RNA, 13 nt, Human
uaucaugaagccu

SEQ ID NO: 3853720 - RNA, 16 nt, Human
uaucaugaagccugug

SEQ ID NO: 3853721 - RNA, 19 nt, Human
uaucaugaauuuuaaagua

SEQ ID NO: 3853722 - RNA, 13 nt, Human
uaucaugcaaaau

SEQ ID NO: 3853723 - RNA, 16 nt, Human
uaucaugcaaaugcug

SEQ ID NO: 3853724 - RNA, 21 nt, Human
uaucaugcuuuaaaguguaau

SEQ ID NO: 3853725 - RNA, 23 nt, Human
uaucaugcuuuaaaguguaauaa

SEQ ID NO: 3853726 - RNA, 18 nt, Human
uaucauggaaauauuaug

SEQ ID NO: 3853727 - RNA, 23 nt, Human
uaucauggaaauauuaugcaaau

SEQ ID NO: 3853728 - RNA, 12 nt, Human
uaucauggucuc

SEQ ID NO: 3853729 - RNA, 22 nt, Human
uaucauguaaagaaaugucuua

SEQ ID NO: 3853730 - RNA, 16 nt, Human
uaucaugucaaacgug

SEQ ID NO: 3853731 - RNA, 11 nt, Human
uaucaugugua

SEQ ID NO: 3853732 - RNA, 13 nt, Human
uaucauguguaau

SEQ ID NO: 3853733 - RNA, 16 nt, Human
uaucauguuaguaaua

SEQ ID NO: 3853734 - RNA, 19 nt, Human
uaucauguuaguaauaccu

SEQ ID NO: 3853735 - RNA, 13 nt, Human
uaucauuaaaguu

SEQ ID NO: 3853736 - RNA, 22 nt, Human
uaucauucaaguguaaaauauu

SEQ ID NO: 3853737 - RNA, 14 nt, Human
uaucauucagcaac

SEQ ID NO: 3853738 - RNA, 13 nt, Human
uaucauucaucuu

SEQ ID NO: 3853739 - RNA, 19 nt, Human
uaucauucaucuucuucuu

SEQ ID NO: 3853740 - RNA, 19 nt, Human
uaucauugcuuccuccucc

SEQ ID NO: 3853741 - RNA, 20 nt, Human
uaucauuuaauaauauacuu

SEQ ID NO: 3853742 - RNA, 17 nt, Human
uaucauuuuagaagacu

SEQ ID NO: 3853743 - RNA, 21 nt, Human
uaucauuuucugcauuuaacc

SEQ ID NO: 3853744 - RNA, 22 nt, Human
uaucauuuuuguacaguuugcu

SEQ ID NO: 3853745 - RNA, 15 nt, Human
uaucauuuuuuccug

SEQ ID NO: 3853746 - RNA, 13 nt, Human
uauccaaaagcuu

SEQ ID NO: 3853747 - RNA, 18 nt, Human
uauccaaaauguguauuu

SEQ ID NO: 3853748 - RNA, 17 nt, Human
uauccaaaucugaagau

SEQ ID NO: 3853749 - RNA, 15 nt, Human
uauccaaucaaucuu

SEQ ID NO: 3853750 - RNA, 23 nt, Human
uauccacagagagucccacugcc

SEQ ID NO: 3853751 - RNA, 23 nt, Human
uauccaccaaaagggcucccuga

SEQ ID NO: 3853752 - RNA, 15 nt, Human
uauccaccaccuccc

SEQ ID NO: 3853753 - RNA, 13 nt, Human
uauccacccagcc

SEQ ID NO: 3853754 - RNA, 19 nt, Human
uauccacccagcccauucu

SEQ ID NO: 3853755 - RNA, 17 nt, Human
uauccacgagagcgcag

SEQ ID NO: 3853756 - RNA, 18 nt, Human
uauccacuuugcacagcu

SEQ ID NO: 3853757 - RNA, 14 nt, Human
uauccagaaaacug

SEQ ID NO: 3853758 - RNA, 21 nt, Human
uauccagguaauccaagauau

SEQ ID NO: 3853759 - RNA, 19 nt, Human
uauccaggucaacagaaug

SEQ ID NO: 3853760 - RNA, 14 nt, Human
uauccauaaaaaaa

SEQ ID NO: 3853761 - RNA, 19 nt, Human
uauccauagugacuuuuca

SEQ ID NO: 3853762 - RNA, 22 nt, Human
uauccaugacaggccugaagau

SEQ ID NO: 3853763 - RNA, 18 nt, Human
uauccauggggaagggau

SEQ ID NO: 3853764 - RNA, 19 nt, Human
uauccaugggggcagggca

SEQ ID NO: 3853765 - RNA, 18 nt, Human
uauccauuaucaugugua

SEQ ID NO: 3853766 - RNA, 15 nt, Human
uauccauuucucaug

SEQ ID NO: 3853767 - RNA, 16 nt, Human
uaucccaagaaugcaa

SEQ ID NO: 3853768 - RNA, 18 nt, Human
uaucccaagaaugcaaga

SEQ ID NO: 3853769 - RNA, 20 nt, Human
uaucccaccuccaucccaga

SEQ ID NO: 3853770 - RNA, 16 nt, Human
uaucccacggaaaaug

SEQ ID NO: 3853771 - RNA, 21 nt, Human
uaucccacggaaaaugccaau

SEQ ID NO: 3853772 - RNA, 16 nt, Human
uaucccaucccauccc

SEQ ID NO: 3853773 - RNA, 13 nt, Human
uauccccaaauua

SEQ ID NO: 3853774 - RNA, 13 nt, Human
uauccccaucucc

SEQ ID NO: 3853775 - RNA, 15 nt, Human
uucguuuguuuguuu

SEQ ID NO: 3853776 - RNA, 13 nt, Human
uucuaaaacugua

SEQ ID NO: 3853777 - RNA, 15 nt, Human
uucuaaaacuguacu

SEQ ID NO: 3853778 - RNA, 20 nt, Human
uucuaaaacuguacuuugau

SEQ ID NO: 3853779 - RNA, 13 nt, Human
uucuaaaagaaua

SEQ ID NO: 3853780 - RNA, 22 nt, Human
uucuaaaaucuuauaguucuag

SEQ ID NO: 3853781 - RNA, 19 nt, Human
uucuaaaaugugauguucu

SEQ ID NO: 3853782 - RNA, 14 nt, Human
uucuaaacagagau

SEQ ID NO: 3853783 - RNA, 19 nt, Human
uucuaaacuaggcuccuuc

SEQ ID NO: 3853784 - RNA, 13 nt, Human
uucuaaagacagg

SEQ ID NO: 3853785 - RNA, 12 nt, Human
uucuaaagauag

SEQ ID NO: 3853786 - RNA, 15 nt, Human
uucuaaagauggaaa

SEQ ID NO: 3853787 - RNA, 13 nt, Human
uucuaaagauucu

SEQ ID NO: 3853788 - RNA, 22 nt, Human
uucuaaagauucuauaguucua

SEQ ID NO: 3853789 - RNA, 16 nt, Human
uucuaaagcucugaca

SEQ ID NO: 3853790 - RNA, 13 nt, Human
uucuaaagcugcc

SEQ ID NO: 3853791 - RNA, 17 nt, Human
uucuaaagcugccagcc

SEQ ID NO: 3853792 - RNA, 16 nt, Human
uucuaaaggcuaccuu

SEQ ID NO: 3853793 - RNA, 20 nt, Human
uucuaaaggcuaccuuugua

SEQ ID NO: 3853794 - RNA, 13 nt, Human
uucuaaaguaaaa

SEQ ID NO: 3853795 - RNA, 15 nt, Human
uucuaaaguaaaaac

SEQ ID NO: 3853796 - RNA, 17 nt, Human
uucuaaaguacugagca

SEQ ID NO: 3853797 - RNA, 12 nt, Human
uucuaaaguucu

SEQ ID NO: 3853798 - RNA, 14 nt, Human
uucuaaaguucuaa

SEQ ID NO: 3853799 - RNA, 18 nt, Human
uucuaaaguucuaagauu

SEQ ID NO: 3853800 - RNA, 21 nt, Human
uucuaaauaaaaguuuuacaa

SEQ ID NO: 3853801 - RNA, 14 nt, Human
uucuaaaugaagug

SEQ ID NO: 3853802 - RNA, 23 nt, Human
uucuaaaugcauauccugagcca

SEQ ID NO: 3853803 - RNA, 14 nt, Human
uucuaacaagucau

SEQ ID NO: 3853804 - RNA, 17 nt, Human
uucuaaccaagaggcug

SEQ ID NO: 3853805 - RNA, 18 nt, Human
uucuaaccagagcaagcu

SEQ ID NO: 3853806 - RNA, 14 nt, Human
uucuaaccuggagg

SEQ ID NO: 3853807 - RNA, 21 nt, Human
uucuaaccuugaaugcugcca

SEQ ID NO: 3853808 - RNA, 14 nt, Human
uucuaaccuuuaca

SEQ ID NO: 3853809 - RNA, 15 nt, Human
uucuaaccuuuacau

SEQ ID NO: 3853810 - RNA, 22 nt, Human
uucuaacuacaaagguuuaaau

SEQ ID NO: 3853811 - RNA, 15 nt, Human
uucuaacuccaguga

SEQ ID NO: 3853812 - RNA, 17 nt, Human
uucuaacucugauguaa

SEQ ID NO: 3853813 - RNA, 14 nt, Human
uucuaacuucauaa

SEQ ID NO: 3853814 - RNA, 20 nt, Human
uucuaagaaacauuuauauu

SEQ ID NO: 3853815 - RNA, 18 nt, Human
uucuaagaaauaucugug

SEQ ID NO: 3853816 - RNA, 19 nt, Human
uucuaagaaauaucuguga

SEQ ID NO: 3853817 - RNA, 13 nt, Human
uucuaagaaguga

SEQ ID NO: 3853818 - RNA, 12 nt, Human
uucuaagacuca

SEQ ID NO: 3853819 - RNA, 20 nt, Human
uucuaagacucaaauguucu

SEQ ID NO: 3853820 - RNA, 19 nt, Human
uucuaagaugugauauucu

SEQ ID NO: 3853821 - RNA, 12 nt, Human
uucuaagauucu

SEQ ID NO: 3853822 - RNA, 13 nt, Human
uucuaagauucua

SEQ ID NO: 3853823 - RNA, 16 nt, Human
uucuaagauucuaaug

SEQ ID NO: 3853824 - RNA, 14 nt, Human
uucuaagauucuga

SEQ ID NO: 3853825 - RNA, 13 nt, Human
uucuaaggaagac

SEQ ID NO: 3853826 - RNA, 14 nt, Human
uucuaaggaauaug

SEQ ID NO: 3853827 - RNA, 23 nt, Human
uucuaaggaccugaaauuccaaa

SEQ ID NO: 3853828 - RNA, 21 nt, Human
uucuaagguccgguguucuaa

SEQ ID NO: 3853829 - RNA, 15 nt, Human
uucuaaguaaaacca

SEQ ID NO: 3853830 - RNA, 18 nt, Human
uucuaaguaaauacaauu

SEQ ID NO: 3853831 - RNA, 20 nt, Human
uucuaaguaaauacaauuuu

SEQ ID NO: 3853832 - RNA, 21 nt, Human
uucuaaguaaauacaauuuuu

SEQ ID NO: 3853833 - RNA, 21 nt, Human
uucuaaguuucuaagauucua

SEQ ID NO: 3853834 - RNA, 16 nt, Human
uucuaauaaauuauac

SEQ ID NO: 3853835 - RNA, 20 nt, Human
uucuaauaagcuaguugaau

SEQ ID NO: 3853836 - RNA, 23 nt, Human
uucuaauaagcuaguugaauacu

SEQ ID NO: 3853837 - RNA, 15 nt, Human
uucuaauaauuucua

SEQ ID NO: 3853838 - RNA, 12 nt, Human
uucuaauagaac

SEQ ID NO: 3853839 - RNA, 19 nt, Human
uucuaauauuuauugcuuu

SEQ ID NO: 3853840 - RNA, 15 nt, Human
uucuaaucugcuaug

SEQ ID NO: 3853841 - RNA, 21 nt, Human
uucuaaugaggagagaaaaua

SEQ ID NO: 3853842 - RNA, 13 nt, Human
uucuaaugaugau

SEQ ID NO: 3853843 - RNA, 16 nt, Human
uucuaauggaaugguu

SEQ ID NO: 3853844 - RNA, 13 nt, Human
uucuaaugucuuc

SEQ ID NO: 3853845 - RNA, 14 nt, Human
uucuaaugucuuca

SEQ ID NO: 3853846 - RNA, 16 nt, Human
uucuaaugucuucauu

SEQ ID NO: 3853847 - RNA, 13 nt, Human
uucuaauguuucu

SEQ ID NO: 3853848 - RNA, 23 nt, Human
uucuaauuauguagcucuuuguc

SEQ ID NO: 3853849 - RNA, 13 nt, Human
uaucuacuugugu

SEQ ID NO: 3853850 - RNA, 16 nt, Human
uaucuagauacuguau

SEQ ID NO: 3853851 - RNA, 13 nt, Human
uaucuagauguaa

SEQ ID NO: 3853852 - RNA, 17 nt, Human
uaucuagauguaaauuu

SEQ ID NO: 3853853 - RNA, 21 nt, Human
uaucuagguuuaugacaguaa

SEQ ID NO: 3853854 - RNA, 19 nt, Human
uaucuagugcagcugauuu

SEQ ID NO: 3853855 - RNA, 18 nt, Human
uaucuauaaaauagauau

SEQ ID NO: 3853856 - RNA, 14 nt, Human
uaucuauaauuuac

SEQ ID NO: 3853857 - RNA, 19 nt, Human
uaucuauaauuuaccuaag

SEQ ID NO: 3853858 - RNA, 20 nt, Human
uaucuauacauaucuuuauu

SEQ ID NO: 3853859 - RNA, 14 nt, Human
uaucuauauaaaau

SEQ ID NO: 3853860 - RNA, 15 nt, Human
uaucuauauaaaaua

SEQ ID NO: 3853861 - RNA, 18 nt, Human
uaucuauauaaaauaacu

SEQ ID NO: 3853862 - RNA, 16 nt, Human
uaucuauauauaauuc

SEQ ID NO: 3853863 - RNA, 19 nt, Human
uaucuauauguacuuguca

SEQ ID NO: 3853864 - RNA, 15 nt, Human
uaucuauauuuuaca

SEQ ID NO: 3853865 - RNA, 14 nt, Human
uaucuauauuuuug

SEQ ID NO: 3853866 - RNA, 12 nt, Human
uaucuauuaaua

SEQ ID NO: 3853867 - RNA, 18 nt, Human
uaucuauuaauauaugua

SEQ ID NO: 3853868 - RNA, 16 nt, Human
uaucuauucugagaaa

SEQ ID NO: 3853869 - RNA, 23 nt, Human
uaucucaaacaauugaagucaau

SEQ ID NO: 3853870 - RNA, 12 nt, Human
uaucucacacuc

SEQ ID NO: 3853871 - RNA, 20 nt, Human
uaucucagaaagugccugac

SEQ ID NO: 3853872 - RNA, 16 nt, Human
uaucucagauauuugc

SEQ ID NO: 3853873 - RNA, 18 nt, Human
uaucucagauauuugcac

SEQ ID NO: 3853874 - RNA, 18 nt, Human
uaucuccagcggcccugu

SEQ ID NO: 3853875 - RNA, 13 nt, Human
uaucucccccagc

SEQ ID NO: 3853876 - RNA, 17 nt, Human
uaucucccccagcccca

SEQ ID NO: 3853877 - RNA, 13 nt, Human
uaucuccugacag

SEQ ID NO: 3853878 - RNA, 21 nt, Human
uaucuccugacagaaggugcc

SEQ ID NO: 3853879 - RNA, 21 nt, Human
uaucuccuuuguauucugucu

SEQ ID NO: 3853880 - RNA, 16 nt, Human
uaucucgaacauggaa

SEQ ID NO: 3853881 - RNA, 17 nt, Human
uaucucuauuuaauauu

SEQ ID NO: 3853882 - RNA, 16 nt, Human
uaucucuauuugagaa

SEQ ID NO: 3853883 - RNA, 20 nt, Human
uaucucucucucuuuuugga

SEQ ID NO: 3853884 - RNA, 13 nt, Human
uaucucucugugc

SEQ ID NO: 3853885 - RNA, 15 nt, Human
uaucucugaagcaug

SEQ ID NO: 3853886 - RNA, 16 nt, Human
uaucucugaagcaugu

SEQ ID NO: 3853887 - RNA, 23 nt, Human
uaucucugaagcauguuucaugu

SEQ ID NO: 3853888 - RNA, 17 nt, Human
uaucucugugugcacaa

SEQ ID NO: 3853889 - RNA, 12 nt, Human
uaucucuguguu

SEQ ID NO: 3853890 - RNA, 12 nt, Human
uaucucuucagu

SEQ ID NO: 3853891 - RNA, 16 nt, Human
uaucucuucagucucu

SEQ ID NO: 3853892 - RNA, 21 nt, Human
uaucucuuuuauauuuguagg

SEQ ID NO: 3853893 - RNA, 13 nt, Human
uaucugaaaacug

SEQ ID NO: 3853894 - RNA, 13 nt, Human
uaucugaaaguca

SEQ ID NO: 3853895 - RNA, 17 nt, Human
uaucugaacauuuacua

SEQ ID NO: 3853896 - RNA, 19 nt, Human
uaucugaacauuuacuaca

SEQ ID NO: 3853897 - RNA, 21 nt, Human
uaucugaaggagauuuuccuu

SEQ ID NO: 3853898 - RNA, 19 nt, Human
uaucugaauuuuuaaacaa

SEQ ID NO: 3853899 - RNA, 16 nt, Human
uaucugagcugagcca

SEQ ID NO: 3853900 - RNA, 19 nt, Human
uaucugaggaauucuguau

SEQ ID NO: 3853901 - RNA, 21 nt, Human
uaucugaggcacaugucagca

SEQ ID NO: 3853902 - RNA, 17 nt, Human
uaucugagggaggaggc

SEQ ID NO: 3853903 - RNA, 18 nt, Human
uaucugagggaggaggcc

SEQ ID NO: 3853904 - RNA, 23 nt, Human
uaucugagggaggaggccaccuc

SEQ ID NO: 3853905 - RNA, 17 nt, Human
uaucugaguugccaaga

SEQ ID NO: 3853906 - RNA, 19 nt, Human
uaucugaguugccaagaca

SEQ ID NO: 3853907 - RNA, 21 nt, Human
uaucugaguugccaagacaaa

SEQ ID NO: 3853908 - RNA, 23 nt, Human
uaucugaguugccaagacaaauc

SEQ ID NO: 3853909 - RNA, 22 nt, Human
uaucugcaagugagguguguca

SEQ ID NO: 3853910 - RNA, 16 nt, Human
uaucugcaggcagaca

SEQ ID NO: 3853911 - RNA, 19 nt, Human
uaucugcccaccucggccu

SEQ ID NO: 3853912 - RNA, 20 nt, Human
uaucugccucucuuguaauu

SEQ ID NO: 3853913 - RNA, 20 nt, Human
uaucugccuuuauuguguuu

SEQ ID NO: 3853914 - RNA, 11 nt, Human
uaucugcuguc

SEQ ID NO: 3853915 - RNA, 12 nt, Human
uaucugcugucc

SEQ ID NO: 3853916 - RNA, 23 nt, Human
uaucuggaggccuuccagcugcu

SEQ ID NO: 3853917 - RNA, 16 nt, Human
uaucuggauucaaauu

SEQ ID NO: 3853918 - RNA, 19 nt, Human
uaucuggauucaaauuuau

SEQ ID NO: 3853919 - RNA, 23 nt, Human
uaucuggcccucgacacucacca

SEQ ID NO: 3853920 - RNA, 19 nt, Human
uaucuggccuaaaaucuug

SEQ ID NO: 3853921 - RNA, 19 nt, Human
uaucugggauucuacuuua

SEQ ID NO: 3853922 - RNA, 11 nt, Human
uaucugggcuu

SEQ ID NO: 3853923 - RNA, 15 nt, Human
uaucugggcuuccug

SEQ ID NO: 3853924 - RNA, 16 nt, Human
uaucugggcuuccugg

SEQ ID NO: 3853925 - RNA, 20 nt, Human
uaucugggcuuccuggagca

SEQ ID NO: 3853926 - RNA, 19 nt, Human
uaucugguauuaaaugcca

SEQ ID NO: 3853927 - RNA, 18 nt, Human
uaucuguaaguuuugaau

SEQ ID NO: 3853928 - RNA, 16 nt, Human
uaucuguaucucucuc

SEQ ID NO: 3853929 - RNA, 11 nt, Human
uaucuguauuu

SEQ ID NO: 3853930 - RNA, 17 nt, Human
uaucugugcgugaaaca

SEQ ID NO: 3853931 - RNA, 14 nt, Human
uaucugugcucagg

SEQ ID NO: 3853932 - RNA, 15 nt, Human
uaucuguuagaugcu

SEQ ID NO: 3853933 - RNA, 18 nt, Human
uaucuguucauauggaua

SEQ ID NO: 3853934 - RNA, 16 nt, Human
uaucuguuuacagugu

SEQ ID NO: 3853935 - RNA, 17 nt, Human
uaucuguuuacaguguu

SEQ ID NO: 3853936 - RNA, 16 nt, Human
uaucuuacgaaaaaau

SEQ ID NO: 3853937 - RNA, 17 nt, Human
uaucuuacuauuucaca

SEQ ID NO: 3853938 - RNA, 18 nt, Human
uaucuuacuauuucacaa

SEQ ID NO: 3853939 - RNA, 23 nt, Human
uaucuuauaaaguggaaguaugu

SEQ ID NO: 3853940 - RNA, 23 nt, Human
uaucuuaucucagauauuugcac

SEQ ID NO: 3853941 - RNA, 23 nt, Human
uuuaccagcauacccacacaaau

SEQ ID NO: 3853942 - RNA, 23 nt, Human
uuuaccagccuccguauuucaga

SEQ ID NO: 3853943 - RNA, 18 nt, Human
uuuaccagggauguagau

SEQ ID NO: 3853944 - RNA, 15 nt, Human
uuuaccauacauuua

SEQ ID NO: 3853945 - RNA, 20 nt, Human
uuuaccaugccccugagcaa

SEQ ID NO: 3853946 - RNA, 14 nt, Human
uuuaccauuuguaa

SEQ ID NO: 3853947 - RNA, 21 nt, Human
uuuacccaauaagauacauca

SEQ ID NO: 3853948 - RNA, 19 nt, Human
uuuacccuaaugucuucau

SEQ ID NO: 3853949 - RNA, 22 nt, Human
uuuacccuaaugucuucauaaa

SEQ ID NO: 3853950 - RNA, 16 nt, Human
uuuacccuauaucuau

SEQ ID NO: 3853951 - RNA, 16 nt, Human
uuuacccucuuugcug

SEQ ID NO: 3853952 - RNA, 13 nt, Human
uuuacccuucagg

SEQ ID NO: 3853953 - RNA, 13 nt, Human
uuuacccuuggcu

SEQ ID NO: 3853954 - RNA, 13 nt, Human
uuuaccucagccu

SEQ ID NO: 3853955 - RNA, 22 nt, Human
uuuaccugaagucuuuguacag

SEQ ID NO: 3853956 - RNA, 16 nt, Human
uuuaccugcaaaaaau

SEQ ID NO: 3853957 - RNA, 14 nt, Human
uuuaccugcugcuu

SEQ ID NO: 3853958 - RNA, 19 nt, Human
uuuaccuuuuuuauacaua

SEQ ID NO: 3853959 - RNA, 20 nt, Human
uuuaccuuuuuuauacauaa

SEQ ID NO: 3853960 - RNA, 21 nt, Human
uuuaccuuuuuuauacauaaa

SEQ ID NO: 3853961 - RNA, 18 nt, Human
uuuacgcuuugauucaua

SEQ ID NO: 3853962 - RNA, 13 nt, Human
uuuacggacaccc

SEQ ID NO: 3853963 - RNA, 17 nt, Human
uuuacuaaaauggacug

SEQ ID NO: 3853964 - RNA, 14 nt, Human
uuuacuaauagaca

SEQ ID NO: 3853965 - RNA, 17 nt, Human
uuuacuaauagacaauu

SEQ ID NO: 3853966 - RNA, 21 nt, Human
uuuacuacaauauguacauuu

SEQ ID NO: 3853967 - RNA, 14 nt, Human
uuuacuacagcuau

SEQ ID NO: 3853968 - RNA, 23 nt, Human
uuuacuagggaucccucaucugu

SEQ ID NO: 3853969 - RNA, 13 nt, Human
uuuacuauuuuac

SEQ ID NO: 3853970 - RNA, 19 nt, Human
uuuacucauccuccaggaa

SEQ ID NO: 3853971 - RNA, 21 nt, Human
uuuacucauccuccaggaacu

SEQ ID NO: 3853972 - RNA, 13 nt, Human
uuuacuccagugg

SEQ ID NO: 3853973 - RNA, 16 nt, Human
uuuacuccucacacuu

SEQ ID NO: 3853974 - RNA, 12 nt, Human
uuuacucugccu

SEQ ID NO: 3853975 - RNA, 18 nt, Human
uuuacugacccuggggcu

SEQ ID NO: 3853976 - RNA, 17 nt, Human
uuuacugagcuucucug

SEQ ID NO: 3853977 - RNA, 18 nt, Human
uuuacugagcuucucugu

SEQ ID NO: 3853978 - RNA, 14 nt, Human
uuuacugcauucuu

SEQ ID NO: 3853979 - RNA, 11 nt, Human
uuuacugccac

SEQ ID NO: 3853980 - RNA, 22 nt, Human
uuuacugccugaauaaagagcc

SEQ ID NO: 3853981 - RNA, 17 nt, Human
uuuacugcucugagaau

SEQ ID NO: 3853982 - RNA, 19 nt, Human
uuuacuggacaaagaauuc

SEQ ID NO: 3853983 - RNA, 19 nt, Human
uuuacugguugcauggaaa

SEQ ID NO: 3853984 - RNA, 16 nt, Human
uuuacugucuuaauua

SEQ ID NO: 3853985 - RNA, 15 nt, Human
uuuacugugauguuu

SEQ ID NO: 3853986 - RNA, 19 nt, Human
uuuacuguuauccuauuua

SEQ ID NO: 3853987 - RNA, 22 nt, Human
uuuacuguuugauauaccaaau

SEQ ID NO: 3853988 - RNA, 11 nt, Human
uuuacuuaaac

SEQ ID NO: 3853989 - RNA, 15 nt, Human
uuuacuuaaagauuu

SEQ ID NO: 3853990 - RNA, 20 nt, Human
uuuacuuaaagauuuaucaa

SEQ ID NO: 3853991 - RNA, 15 nt, Human
uuuacuuaacuguuu

SEQ ID NO: 3853992 - RNA, 14 nt, Human
uuuacuuaagacuu

SEQ ID NO: 3853993 - RNA, 16 nt, Human
uuuacuuaucuuaugc

SEQ ID NO: 3853994 - RNA, 12 nt, Human
uauuaaaacauu

SEQ ID NO: 3853995 - RNA, 17 nt, Human
uauuaaaacuaaauuuc

SEQ ID NO: 3853996 - RNA, 22 nt, Human
uuucaggguuuucugagggaaa

SEQ ID NO: 3853997 - RNA, 16 nt, Human
uuucaggugcucaaaa

SEQ ID NO: 3853998 - RNA, 19 nt, Human
uuucagguuuuaguuuuua

SEQ ID NO: 3853999 - RNA, 18 nt, Human
uuucagguuuuguaaaga

SEQ ID NO: 3854000 - RNA, 19 nt, Human
uuucaguaaaccugucuga

SEQ ID NO: 3854001 - RNA, 20 nt, Human
uuucaguauuagugauguca

SEQ ID NO: 3854002 - RNA, 21 nt, Human
uuucaguauuuuggagaaauu

SEQ ID NO: 3854003 - RNA, 22 nt, Human
uuucagugucaaauaaacacug

SEQ ID NO: 3854004 - RNA, 23 nt, Human
uuucagugucaaauaaacacugu

SEQ ID NO: 3854005 - RNA, 13 nt, Human
uuucaguucaaag

SEQ ID NO: 3854006 - RNA, 17 nt, Human
uuucaguucaaagucau

SEQ ID NO: 3854007 - RNA, 12 nt, Human
uuucaguuccaa

SEQ ID NO: 3854008 - RNA, 18 nt, Human
uuucaguucuaggaaaau

SEQ ID NO: 3854009 - RNA, 21 nt, Human
uuucaguuuauuugaaccaau

SEQ ID NO: 3854010 - RNA, 15 nt, Human
uuucauaaaaggaga

SEQ ID NO: 3854011 - RNA, 12 nt, Human
uuucauaaagca

SEQ ID NO: 3854012 - RNA, 18 nt, Human
uuucauaacuuauugcug

SEQ ID NO: 3854013 - RNA, 19 nt, Human
uuucauaagauauuuuauu

SEQ ID NO: 3854014 - RNA, 19 nt, Human
uuucauaaguauuucaaau

SEQ ID NO: 3854015 - RNA, 12 nt, Human
uuucauaaucuu

SEQ ID NO: 3854016 - RNA, 13 nt, Human
uuucauaauuugu

SEQ ID NO: 3854017 - RNA, 21 nt, Human
uuucauacagcauuacaaauu

SEQ ID NO: 3854018 - RNA, 17 nt, Human
uuucauacucuagauuu

SEQ ID NO: 3854019 - RNA, 18 nt, Human
uuucauacucuagauuuu

SEQ ID NO: 3854020 - RNA, 15 nt, Human
uuucauagcuaaaaa

SEQ ID NO: 3854021 - RNA, 13 nt, Human
uuucauauaaagu

SEQ ID NO: 3854022 - RNA, 16 nt, Human
uuucauauuugcacua

SEQ ID NO: 3854023 - RNA, 13 nt, Human
uuucauauuuuag

SEQ ID NO: 3854024 - RNA, 22 nt, Human
uuucaucauucacuucacugug

SEQ ID NO: 3854025 - RNA, 20 nt, Human
uuucauccacuagugcaaau

SEQ ID NO: 3854026 - RNA, 20 nt, Human
uuucauccauaacugaacau

SEQ ID NO: 3854027 - RNA, 23 nt, Human
uuucaucccuaugggauucagug

SEQ ID NO: 3854028 - RNA, 15 nt, Human
uuucauccuugucuu

SEQ ID NO: 3854029 - RNA, 13 nt, Human
uuucaucuauuuc

SEQ ID NO: 3854030 - RNA, 16 nt, Human
uuucaucugcucuccu

SEQ ID NO: 3854031 - RNA, 17 nt, Human
uuucaucugcucuccuu

SEQ ID NO: 3854032 - RNA, 22 nt, Human
uuucaucuucaguugucucuga

SEQ ID NO: 3854033 - RNA, 19 nt, Human
uuucaugauaaugaacaga

SEQ ID NO: 3854034 - RNA, 22 nt, Human
uuucaugauaaugaacagaaca

SEQ ID NO: 3854035 - RNA, 21 nt, Human
uuucaugauuagcaaguuaca

SEQ ID NO: 3854036 - RNA, 19 nt, Human
uuucaugcucugcaaaagg

SEQ ID NO: 3854037 - RNA, 19 nt, Human
uuucaugcuguucaugaaa

SEQ ID NO: 3854038 - RNA, 13 nt, Human
uuucauggacacu

SEQ ID NO: 3854039 - RNA, 18 nt, Human
uuucauguaaacugugca

SEQ ID NO: 3854040 - RNA, 19 nt, Human
uuucauguaaacugugcac

SEQ ID NO: 3854041 - RNA, 14 nt, Human
uuucauguaaauaa

SEQ ID NO: 3854042 - RNA, 12 nt, Human
uuucauguacaa

SEQ ID NO: 3854043 - RNA, 18 nt, Human
uuucauguacaagaugaa

SEQ ID NO: 3854044 - RNA, 11 nt, Human
uuucauguacu

SEQ ID NO: 3854045 - RNA, 16 nt, Human
uuucauguacugcauu

SEQ ID NO: 3854046 - RNA, 12 nt, Human
uuucaugugcuc

SEQ ID NO: 3854047 - RNA, 17 nt, Human
uuucauguuuugugacu

SEQ ID NO: 3854048 - RNA, 13 nt, Human
uuucauuaaagca

SEQ ID NO: 3854049 - RNA, 16 nt, Human
uuucauuaaagcauuu

SEQ ID NO: 3854050 - RNA, 14 nt, Human
uuucauuaaaggcu

SEQ ID NO: 3854051 - RNA, 14 nt, Human
uuucauuacaaugg

SEQ ID NO: 3854052 - RNA, 13 nt, Human
uuucauuagcaaa

SEQ ID NO: 3854053 - RNA, 19 nt, Human
uuucauuagcaaaaaaagu

SEQ ID NO: 3854054 - RNA, 18 nt, Human
uuucauuauguaaaaugu

SEQ ID NO: 3854055 - RNA, 19 nt, Human
uuucauuauuuuauuauga

SEQ ID NO: 3854056 - RNA, 20 nt, Human
uuucauuauuuuauuaugaa

SEQ ID NO: 3854057 - RNA, 17 nt, Human
uuucauuccaaagggga

SEQ ID NO: 3854058 - RNA, 12 nt, Human
uuucauuccauu

SEQ ID NO: 3854059 - RNA, 16 nt, Human
uuucauuccauugccu

SEQ ID NO: 3854060 - RNA, 17 nt, Human
uuucauuccauugccua

SEQ ID NO: 3854061 - RNA, 13 nt, Human
uuucauucuucuc

SEQ ID NO: 3854062 - RNA, 16 nt, Human
uuucauugccaguguc

SEQ ID NO: 3854063 - RNA, 19 nt, Human
uuucauugccagugucuuu

SEQ ID NO: 3854064 - RNA, 15 nt, Human
uuucauugcugugac

SEQ ID NO: 3854065 - RNA, 14 nt, Human
uuucauuguaaaac

SEQ ID NO: 3854066 - RNA, 15 nt, Human
uuucauuguaugaug

SEQ ID NO: 3854067 - RNA, 18 nt, Human
uuucauuguaugaugugu

SEQ ID NO: 3854068 - RNA, 20 nt, Human
uuucauuguaugauguguug

SEQ ID NO: 3854069 - RNA, 21 nt, Human
uuucauuuacucuaaaaacug

SEQ ID NO: 3854070 - RNA, 14 nt, Human
uuucauuuaucuau

SEQ ID NO: 3854071 - RNA, 17 nt, Human
uuucauuuaucuauaau

SEQ ID NO: 3854072 - RNA, 13 nt, Human
uuucauuugccua

SEQ ID NO: 3854073 - RNA, 16 nt, Human
uuucauuuuaaaaagu

SEQ ID NO: 3854074 - RNA, 21 nt, Human
uuucauuuuacaguuacuuuu

SEQ ID NO: 3854075 - RNA, 17 nt, Human
uuucauuuuauuuuaau

SEQ ID NO: 3854076 - RNA, 18 nt, Human
uuucauuuucugcaagcc

SEQ ID NO: 3854077 - RNA, 20 nt, Human
uuucauuuuuugcaucagua

SEQ ID NO: 3854078 - RNA, 15 nt, Human
uuucauuuuuuucca

SEQ ID NO: 3854079 - RNA, 20 nt, Human
uuucauuuuuuuccaggcug

SEQ ID NO: 3854080 - RNA, 13 nt, Human
uuuccaaaggcau

SEQ ID NO: 3854081 - RNA, 12 nt, Human
uuuccaaaguac

SEQ ID NO: 3854082 - RNA, 15 nt, Human
uuuccaaauaaaaug

SEQ ID NO: 3854083 - RNA, 19 nt, Human
uuuccaaccggcuuugugg

SEQ ID NO: 3854084 - RNA, 16 nt, Human
uuuccaagagcugagg

SEQ ID NO: 3854085 - RNA, 12 nt, Human
uuuccaagcaaa

SEQ ID NO: 3854086 - RNA, 21 nt, Human
uuuccaaguaauauaauggaa

SEQ ID NO: 3854087 - RNA, 14 nt, Human
uuuccaauauguga

SEQ ID NO: 3854088 - RNA, 15 nt, Human
uuuccaauaugugau

SEQ ID NO: 3854089 - RNA, 20 nt, Human
uuuccacaagauucccagag

SEQ ID NO: 3854090 - RNA, 20 nt, Human
uuuccacauaaggaaacugg

SEQ ID NO: 3854091 - RNA, 19 nt, Human
uuuccaccacagccagcac

SEQ ID NO: 3854092 - RNA, 15 nt, Human
uuuccacccccuccc

SEQ ID NO: 3854093 - RNA, 23 nt, Human
uuuccacggagccacuccucuga

SEQ ID NO: 3854094 - RNA, 13 nt, Human
uuuccacuacugc

SEQ ID NO: 3854095 - RNA, 15 nt, Human
uuuccacuacugcua

SEQ ID NO: 3854096 - RNA, 16 nt, Human
uuuccacuucuuccuu

SEQ ID NO: 3854097 - RNA, 12 nt, Human
uuuccacuuugu

SEQ ID NO: 3854098 - RNA, 23 nt, Human
uuuccacuuuguucuuuaggaga

SEQ ID NO: 3854099 - RNA, 19 nt, Human
uuuccagacuuccuugaga

SEQ ID NO: 3854100 - RNA, 17 nt, Human
uuuccagagcauuccag

SEQ ID NO: 3854101 - RNA, 19 nt, Human
uuuccagaggcuauuauuu

SEQ ID NO: 3854102 - RNA, 23 nt, Human
uuuccagcagaagacaaaaagac

SEQ ID NO: 3854103 - RNA, 17 nt, Human
uuuccagcauucccagg

SEQ ID NO: 3854104 - RNA, 22 nt, Human
uuuccaggacuguuucaaacau

SEQ ID NO: 3854105 - RNA, 22 nt, Human
uuuccaggcugguucggauuug

SEQ ID NO: 3854106 - RNA, 18 nt, Human
uuuccaggcuucugcugg

SEQ ID NO: 3854107 - RNA, 13 nt, Human
uuuccagggaggg

SEQ ID NO: 3854108 - RNA, 19 nt, Human
uuuccagguuuaagcuguu

SEQ ID NO: 3854109 - RNA, 15 nt, Human
uuuccagucuccacc

SEQ ID NO: 3854110 - RNA, 20 nt, Human
uuuccagucuccaccaggaa

SEQ ID NO: 3854111 - RNA, 19 nt, Human
uuuccagugagcuuaucau

SEQ ID NO: 3854112 - RNA, 12 nt, Human
uuuccagugcaa

SEQ ID NO: 3854113 - RNA, 16 nt, Human
uuuccaguuaaggacc

SEQ ID NO: 3854114 - RNA, 15 nt, Human
uuuccauaaggaaug

SEQ ID NO: 3854115 - RNA, 22 nt, Human
uuuccauauggauuuucuauug

SEQ ID NO: 3854116 - RNA, 21 nt, Human
uuuccauauuuuuuuccuuac

SEQ ID NO: 3854117 - RNA, 13 nt, Human
uuuccaucuaaaa

SEQ ID NO: 3854118 - RNA, 16 nt, Human
uuuccaucuaaaaaua

SEQ ID NO: 3854119 - RNA, 17 nt, Human
uuuccaugaaguuugaa

SEQ ID NO: 3854120 - RNA, 15 nt, Human
uuuccauguaugcau

SEQ ID NO: 3854121 - RNA, 20 nt, Human
uuuccauguaugcauaauaa

SEQ ID NO: 3854122 - RNA, 13 nt, Human
uuuccauuauuua

SEQ ID NO: 3854123 - RNA, 21 nt, Human
uuuccauuauuuauauuaguu

SEQ ID NO: 3854124 - RNA, 13 nt, Human
uuuccauuccaga

SEQ ID NO: 3854125 - RNA, 21 nt, Human
uuuccauugguuuaccuguga

SEQ ID NO: 3854126 - RNA, 12 nt, Human
uuucccaacucu

SEQ ID NO: 3854127 - RNA, 20 nt, Human
uuucccacaccguguaaacc

SEQ ID NO: 3854128 - RNA, 22 nt, Human
uuucccaccccaaccugcucuc

SEQ ID NO: 3854129 - RNA, 16 nt, Human
uuucccaggacccuga

SEQ ID NO: 3854130 - RNA, 12 nt, Human
uuucccauaauu

SEQ ID NO: 3854131 - RNA, 15 nt, Human
uuucccaugauuuca

SEQ ID NO: 3854132 - RNA, 22 nt, Human
uuucccauuugugccagaggaa

SEQ ID NO: 3854133 - RNA, 19 nt, Human
uuuccccaacagugugaag

SEQ ID NO: 3854134 - RNA, 15 nt, Human
uuuccccagacuugu

SEQ ID NO: 3854135 - RNA, 19 nt, Human
uuuccccaggggaaaauga

SEQ ID NO: 3854136 - RNA, 12 nt, Human
uuuccccccacu

SEQ ID NO: 3854137 - RNA, 19 nt, Human
uuuccccccacucucccca

SEQ ID NO: 3854138 - RNA, 17 nt, Human
uuucccccuuggcucuc

SEQ ID NO: 3854139 - RNA, 13 nt, Human
uuucccccuuucu

SEQ ID NO: 3854140 - RNA, 18 nt, Human
uuucuagagccugcugga

SEQ ID NO: 3854141 - RNA, 17 nt, Human
uuucuagaguuccuacc

SEQ ID NO: 3854142 - RNA, 18 nt, Human
uuucuagauacaauaaau

SEQ ID NO: 3854143 - RNA, 19 nt, Human
uuucuagcauauauguguc

SEQ ID NO: 3854144 - RNA, 18 nt, Human
uuucuagcuaauggaaaa

SEQ ID NO: 3854145 - RNA, 22 nt, Human
uuucuagcuagaaauaugauuu

SEQ ID NO: 3854146 - RNA, 21 nt, Human
uuucuaggaagaauuuuaaaa

SEQ ID NO: 3854147 - RNA, 20 nt, Human
uuucuagggcugggaaacac

SEQ ID NO: 3854148 - RNA, 21 nt, Human
uuucuagguaggaaauguggu

SEQ ID NO: 3854149 - RNA, 23 nt, Human
uuucuaggucaaggccugucccu

SEQ ID NO: 3854150 - RNA, 19 nt, Human
uuucuaguggucuuuguaa

SEQ ID NO: 3854151 - RNA, 19 nt, Human
uuucuaguguaucaaaaug

SEQ ID NO: 3854152 - RNA, 16 nt, Human
uuucuaguugaggagu

SEQ ID NO: 3854153 - RNA, 16 nt, Human
uuucuauaacagauau

SEQ ID NO: 3854154 - RNA, 22 nt, Human
uuucuauagccaaaaauagcua

SEQ ID NO: 3854155 - RNA, 15 nt, Human
uuucuauauuuucau

SEQ ID NO: 3854156 - RNA, 20 nt, Human
uuucuaucauuuuuguacag

SEQ ID NO: 3854157 - RNA, 19 nt, Human
uuucuaucguucucucuuu

SEQ ID NO: 3854158 - RNA, 16 nt, Human
uuucuaucuaaaugau

SEQ ID NO: 3854159 - RNA, 13 nt, Human
uuucuaugaaaua

SEQ ID NO: 3854160 - RNA, 21 nt, Human
uuucuaugaguggaaaaagcc

SEQ ID NO: 3854161 - RNA, 20 nt, Human
uuucuaugcugcuuuuauau

SEQ ID NO: 3854162 - RNA, 22 nt, Human
uugaaucauguaguaucaaaua

SEQ ID NO: 3854163 - RNA, 21 nt, Human
uugaaucuauugggauuuucu

SEQ ID NO: 3854164 - RNA, 17 nt, Human
uugaaucuauuuaucuu

SEQ ID NO: 3854165 - RNA, 15 nt, Human
uugaaucucauaauu

SEQ ID NO: 3854166 - RNA, 22 nt, Human
uugaaucuugucucaaugcuca

SEQ ID NO: 3854167 - RNA, 23 nt, Human
uugaaucuugucucaaugcucau

SEQ ID NO: 3854168 - RNA, 13 nt, Human
uugaaucuuuaau

SEQ ID NO: 3854169 - RNA, 12 nt, Human
uugaaugaaaaa

SEQ ID NO: 3854170 - RNA, 15 nt, Human
uugaaugaaaaauuu

SEQ ID NO: 3854171 - RNA, 18 nt, Human
uugaaugaaaaauuuaag

SEQ ID NO: 3854172 - RNA, 22 nt, Human
uugaaugaaaaauuuaagcauu

SEQ ID NO: 3854173 - RNA, 21 nt, Human
uugaaugacaacagaagcuuc

SEQ ID NO: 3854174 - RNA, 12 nt, Human
uugaaugaugcc

SEQ ID NO: 3854175 - RNA, 23 nt, Human
uugaaugcauuuuguuugguauu

SEQ ID NO: 3854176 - RNA, 13 nt, Human
uugaaugcugcca

SEQ ID NO: 3854177 - RNA, 16 nt, Human
uugaaugcuuccugac

SEQ ID NO: 3854178 - RNA, 20 nt, Human
uugaaugcuuuuugaauguu

SEQ ID NO: 3854179 - RNA, 18 nt, Human
uugaauggccugccuuga

SEQ ID NO: 3854180 - RNA, 23 nt, Human
uugaauggucagcguugcauguc

SEQ ID NO: 3854181 - RNA, 12 nt, Human
uugaaugucuuu

SEQ ID NO: 3854182 - RNA, 17 nt, Human
uugaaugucuuuugaau

SEQ ID NO: 3854183 - RNA, 13 nt, Human
uugaaugugucag

SEQ ID NO: 3854184 - RNA, 14 nt, Human
uugaauguuaaagg

SEQ ID NO: 3854185 - RNA, 22 nt, Human
uugaauguuaaagggauauuuu

SEQ ID NO: 3854186 - RNA, 13 nt, Human
uugaauguuaaau

SEQ ID NO: 3854187 - RNA, 20 nt, Human
uugaauguuaaauaaauugu

SEQ ID NO: 3854188 - RNA, 17 nt, Human
uugaauuaaauuaggaa

SEQ ID NO: 3854189 - RNA, 23 nt, Human
uugaauuagaaacauaaauaaaa

SEQ ID NO: 3854190 - RNA, 20 nt, Human
uugaauuaucuugguugaaa

SEQ ID NO: 3854191 - RNA, 22 nt, Human
uugaauuccuaaaauuauggaa

SEQ ID NO: 3854192 - RNA, 23 nt, Human
uugaauugcauuuuuuaaaacaa

SEQ ID NO: 3854193 - RNA, 15 nt, Human
uugaauuguaacugu

SEQ ID NO: 3854194 - RNA, 13 nt, Human
uugaauuuaacaa

SEQ ID NO: 3854195 - RNA, 19 nt, Human
uugaauuuaacaaugcgaa

SEQ ID NO: 3854196 - RNA, 18 nt, Human
uugaauuuacuggacaua

SEQ ID NO: 3854197 - RNA, 18 nt, Human
uugaauuuauuggcuuuu

SEQ ID NO: 3854198 - RNA, 17 nt, Human
uugaauuucacugucuu

SEQ ID NO: 3854199 - RNA, 15 nt, Human
uugaauuuuaaaucu

SEQ ID NO: 3854200 - RNA, 22 nt, Human
uugaauuuucaagcaucuccug

SEQ ID NO: 3854201 - RNA, 13 nt, Human
uugaauuuucauu

SEQ ID NO: 3854202 - RNA, 16 nt, Human
uugaauuuucauuuua

SEQ ID NO: 3854203 - RNA, 17 nt, Human
uugaauuuucauuuuac

SEQ ID NO: 3854204 - RNA, 23 nt, Human
uugaauuuucauuuuacaguuac

SEQ ID NO: 3854205 - RNA, 17 nt, Human
uugaauuuuguguuaga

SEQ ID NO: 3854206 - RNA, 22 nt, Human
uugaauuuuuuuuaacauuccu

SEQ ID NO: 3854207 - RNA, 21 nt, Human
uugacaaaaccuaacuugcgc

SEQ ID NO: 3854208 - RNA, 20 nt, Human
uugacaaaauguuauuuccc

SEQ ID NO: 3854209 - RNA, 18 nt, Human
uugacaaaggcaagcacu

SEQ ID NO: 3854210 - RNA, 20 nt, Human
uugacaaagucaagccacau

SEQ ID NO: 3854211 - RNA, 13 nt, Human
uugacaaaucugu

SEQ ID NO: 3854212 - RNA, 14 nt, Human
uugacaaaucugug

SEQ ID NO: 3854213 - RNA, 20 nt, Human
uugacaaaucuguguauauu

SEQ ID NO: 3854214 - RNA, 16 nt, Human
uugacaaccaugagac

SEQ ID NO: 3854215 - RNA, 18 nt, Human
uugacaacuggcaggcag

SEQ ID NO: 3854216 - RNA, 14 nt, Human
uugacaagcuggcu

SEQ ID NO: 3854217 - RNA, 18 nt, Human
uugacaaggucaaauuua

SEQ ID NO: 3854218 - RNA, 14 nt, Human
uugacaauaaaaua

SEQ ID NO: 3854219 - RNA, 15 nt, Human
uugacaauaaaauau

SEQ ID NO: 3854220 - RNA, 18 nt, Human
uugacaauaaaugugcuu

SEQ ID NO: 3854221 - RNA, 15 nt, Human
uugacaauuccuaga

SEQ ID NO: 3854222 - RNA, 22 nt, Human
uugacaccagcuguucuguccc

SEQ ID NO: 3854223 - RNA, 23 nt, Human
uugacacuagcccaaugaaauga

SEQ ID NO: 3854224 - RNA, 18 nt, Human
uugacacuauaucuguau

SEQ ID NO: 3854225 - RNA, 11 nt, Human
uugacacugaa

SEQ ID NO: 3854226 - RNA, 12 nt, Human
uugacacugaaa

SEQ ID NO: 3854227 - RNA, 21 nt, Human
uugacacugaaaguuuuguaa

SEQ ID NO: 3854228 - RNA, 22 nt, Human
uugacacugaaaguuuuguaaa

SEQ ID NO: 3854229 - RNA, 14 nt, Human
uugacacugaacuu

SEQ ID NO: 3854230 - RNA, 15 nt, Human
uugacacugcucuaa

SEQ ID NO: 3854231 - RNA, 19 nt, Human
uugacacuuaaaaaugguu

SEQ ID NO: 3854232 - RNA, 18 nt, Human
uugacacuuuucauauca

SEQ ID NO: 3854233 - RNA, 16 nt, Human
uugacagaacacuguc

SEQ ID NO: 3854234 - RNA, 20 nt, Human
uugacagaauauguuucaaa

SEQ ID NO: 3854235 - RNA, 18 nt, Human
uugacagcuuugcugcug

SEQ ID NO: 3854236 - RNA, 19 nt, Human
uugacaggauuauuggaaa

SEQ ID NO: 3854237 - RNA, 22 nt, Human
uugacaguaacuugguuauaca

SEQ ID NO: 3854238 - RNA, 23 nt, Human
uugacaguaacuugguuauacau

SEQ ID NO: 3854239 - RNA, 19 nt, Human
uugacauaaaguugauaaa

SEQ ID NO: 3854240 - RNA, 14 nt, Human
uugacauagucugg

SEQ ID NO: 3854241 - RNA, 16 nt, Human
uugacauauuuaaugu

SEQ ID NO: 3854242 - RNA, 18 nt, Human
uugacauauuuaauguuu

SEQ ID NO: 3854243 - RNA, 22 nt, Human
uugacaucaguuccuuugugug

SEQ ID NO: 3854244 - RNA, 14 nt, Human
uugacauguggaaa

SEQ ID NO: 3854245 - RNA, 22 nt, Human
uugacauuaagaauguugguuu

SEQ ID NO: 3854246 - RNA, 20 nt, Human
uugacauucugaaugcuucu

SEQ ID NO: 3854247 - RNA, 18 nt, Human
uugacauugcguuugacc

SEQ ID NO: 3854248 - RNA, 11 nt, Human
uugacauuuaa

SEQ ID NO: 3854249 - RNA, 18 nt, Human
uugaccaagaacugcaug

SEQ ID NO: 3854250 - RNA, 21 nt, Human
uugaccagcagaucccagcuc

SEQ ID NO: 3854251 - RNA, 18 nt, Human
uugaccaguauaaaauua

SEQ ID NO: 3854252 - RNA, 19 nt, Human
uugaccaguauaaaauuac

SEQ ID NO: 3854253 - RNA, 17 nt, Human
uugaccaucugcuuuua

SEQ ID NO: 3854254 - RNA, 17 nt, Human
uugaccauucuccaccu

SEQ ID NO: 3854255 - RNA, 24 nt, Human
uugaccauucuccaccugccaggg

SEQ ID NO: 3854256 - RNA, 14 nt, Human
uugacccacaagaa

SEQ ID NO: 3854257 - RNA, 12 nt, Human
uugacccugcac

SEQ ID NO: 3854258 - RNA, 21 nt, Human
uugaccgugaggccagagaca

SEQ ID NO: 3854259 - RNA, 23 nt, Human
uugaccucacagugacccuuccc

SEQ ID NO: 3854260 - RNA, 19 nt, Human
uugaccuccucccuguuau

SEQ ID NO: 3854261 - RNA, 15 nt, Human
uugaccucugcagca

SEQ ID NO: 3854262 - RNA, 19 nt, Human
uugaccugaggcugugguc

SEQ ID NO: 3854263 - RNA, 19 nt, Human
uugaccugcauuguaaaua

SEQ ID NO: 3854264 - RNA, 22 nt, Human
uugaccugccucccuucaugca

SEQ ID NO: 3854265 - RNA, 21 nt, Human
uugaccugcuccgcugcuccu

SEQ ID NO: 3854266 - RNA, 22 nt, Human
uugaccuggauggggcaggcca

SEQ ID NO: 3854267 - RNA, 14 nt, Human
uugaccuuuguaca

SEQ ID NO: 3854268 - RNA, 15 nt, Human
uugaccuuuguacag

SEQ ID NO: 3854269 - RNA, 21 nt, Human
uugaccuuuuauguaguaauu

SEQ ID NO: 3854270 - RNA, 16 nt, Human
uugacgaagucucuuu

SEQ ID NO: 3854271 - RNA, 18 nt, Human
uugacgagucaccuucca

SEQ ID NO: 3854272 - RNA, 17 nt, Human
uugacgauuccuucucu

SEQ ID NO: 3854273 - RNA, 15 nt, Human
uugacgccaucccag

SEQ ID NO: 3854274 - RNA, 22 nt, Human
uugacuaacucaaauacacauu

SEQ ID NO: 3854275 - RNA, 14 nt, Human
uugacuaauuuuac

SEQ ID NO: 3854276 - RNA, 16 nt, Human
uugacuagaaaauuua

SEQ ID NO: 3854277 - RNA, 17 nt, Human
uugacuaucaaacugaa

SEQ ID NO: 3854278 - RNA, 19 nt, Human
uugacucaccuguuacuug

SEQ ID NO: 3854279 - RNA, 13 nt, Human
uugacucaggagc

SEQ ID NO: 3854280 - RNA, 13 nt, Human
uugacucaucuua

SEQ ID NO: 3854281 - RNA, 15 nt, Human
uugacucaucuuaua

SEQ ID NO: 3854282 - RNA, 23 nt, Human
uugacuccuugugguuuauguca

SEQ ID NO: 3854283 - RNA, 22 nt, Human
uugcuaucuggaggccuuccag

SEQ ID NO: 3854284 - RNA, 14 nt, Human
uugcuaucuuaauu

SEQ ID NO: 3854285 - RNA, 16 nt, Human
uugcuaucuuaauuuu

SEQ ID NO: 3854286 - RNA, 20 nt, Human
uugcuaugagcuggggaugu

SEQ ID NO: 3854287 - RNA, 21 nt, Human
uugcuaugugccuuauguuga

SEQ ID NO: 3854288 - RNA, 23 nt, Human
uugcuauguuacuauuuucuaca

SEQ ID NO: 3854289 - RNA, 22 nt, Human
uugcuauuagacuguaggaaga

SEQ ID NO: 3854290 - RNA, 17 nt, Human
uugcuauucugucccua

SEQ ID NO: 3854291 - RNA, 19 nt, Human
uugcuauuguaaauauguu

SEQ ID NO: 3854292 - RNA, 19 nt, Human
uugcucacaguuauuacau

SEQ ID NO: 3854293 - RNA, 13 nt, Human
uugcucacccagu

SEQ ID NO: 3854294 - RNA, 13 nt, Human
uugcucaccuggg

SEQ ID NO: 3854295 - RNA, 16 nt, Human
uugcuccaccccacuc

SEQ ID NO: 3854296 - RNA, 20 nt, Human
uugcuccaccccacucacag

SEQ ID NO: 3854297 - RNA, 22 nt, Human
uugcuccccuuccccuuccuuc

SEQ ID NO: 3854298 - RNA, 16 nt, Human
uugcuccgccuggccu

SEQ ID NO: 3854299 - RNA, 11 nt, Human
uugcuccuccu

SEQ ID NO: 3854300 - RNA, 18 nt, Human
uugcuccuggccuugcug

SEQ ID NO: 3854301 - RNA, 22 nt, Human
uugcucuaaaauauuuaugaag

SEQ ID NO: 3854302 - RNA, 23 nt, Human
uugcucuaucucacagcacacuc

SEQ ID NO: 3854303 - RNA, 18 nt, Human
uugcucuaugcuuuccaa

SEQ ID NO: 3854304 - RNA, 19 nt, Human
uugcucuaugcuuuccaaa

SEQ ID NO: 3854305 - RNA, 13 nt, Human
uugcucucccggu

SEQ ID NO: 3854306 - RNA, 20 nt, Human
uugcucucuggccuuuuccu

SEQ ID NO: 3854307 - RNA, 21 nt, Human
uugcucucuuuuauucugugc

SEQ ID NO: 3854308 - RNA, 12 nt, Human
uugcucugcacc

SEQ ID NO: 3854309 - RNA, 17 nt, Human
uugcucugcaggcaccu

SEQ ID NO: 3854310 - RNA, 14 nt, Human
uugcucuggaccug

SEQ ID NO: 3854311 - RNA, 17 nt, Human
uugcugaaaaaugggca

SEQ ID NO: 3854312 - RNA, 19 nt, Human
uugcugaaauuuuauaugc

SEQ ID NO: 3854313 - RNA, 23 nt, Human
uugcugaaggcuaaauucacagc

SEQ ID NO: 3854314 - RNA, 23 nt, Human
uugcugacaaccauuaaagucag

SEQ ID NO: 3854315 - RNA, 12 nt, Human
uugcugacuuag

SEQ ID NO: 3854316 - RNA, 11 nt, Human
uugcugagccu

SEQ ID NO: 3854317 - RNA, 22 nt, Human
uugcugagccucugcuccccag

SEQ ID NO: 3854318 - RNA, 18 nt, Human
uugcugauggugcaauga

SEQ ID NO: 3854319 - RNA, 17 nt, Human
uugcugauuuuauucuu

SEQ ID NO: 3854320 - RNA, 19 nt, Human
uugcugauuuuauucuuga

SEQ ID NO: 3854321 - RNA, 13 nt, Human
uugcugcaaaccu

SEQ ID NO: 3854322 - RNA, 18 nt, Human
uugcugccaaccauaccu

SEQ ID NO: 3854323 - RNA, 21 nt, Human
uugcugccaaccauaccuucc

SEQ ID NO: 3854324 - RNA, 16 nt, Human
uugcugccucagagca

SEQ ID NO: 3854325 - RNA, 16 nt, Human
uugcugcuaauauuuu

SEQ ID NO: 3854326 - RNA, 20 nt, Human
uugcugcuaauauuuuccuc

SEQ ID NO: 3854327 - RNA, 19 nt, Human
uugcugcuccuuagcugcc

SEQ ID NO: 3854328 - RNA, 13 nt, Human
uugcugcugaagg

SEQ ID NO: 3854329 - RNA, 17 nt, Human
uugcugcugauaaugua

SEQ ID NO: 3854330 - RNA, 21 nt, Human
uugcugcugauuuaaacacau

SEQ ID NO: 3854331 - RNA, 15 nt, Human
uugcugcugccucuu

SEQ ID NO: 3854332 - RNA, 16 nt, Human
uugcugcuugaggcaa

SEQ ID NO: 3854333 - RNA, 18 nt, Human
uugcugcuuuuccuuggg

SEQ ID NO: 3854334 - RNA, 23 nt, Human
uugcuggacggggacuggggaug

SEQ ID NO: 3854335 - RNA, 17 nt, Human
uugcuggaucaggaagc

SEQ ID NO: 3854336 - RNA, 14 nt, Human
uugcuggccccagc

SEQ ID NO: 3854337 - RNA, 23 nt, Human
uugcuggccccagcccugcuggg

SEQ ID NO: 3854338 - RNA, 22 nt, Human
uugcugggagcugaaaaaucac

SEQ ID NO: 3854339 - RNA, 20 nt, Human
uugcugggcaguuuuucugu

SEQ ID NO: 3854340 - RNA, 20 nt, Human
uugcuggggccgaaagaaca

SEQ ID NO: 3854341 - RNA, 15 nt, Human
uugcugguaaaauga

SEQ ID NO: 3854342 - RNA, 17 nt, Human
uugcuggucuuguaaga

SEQ ID NO: 3854343 - RNA, 16 nt, Human
uugcuguaagaugucu

SEQ ID NO: 3854344 - RNA, 19 nt, Human
uugcuguaagaugucuguu

SEQ ID NO: 3854345 - RNA, 20 nt, Human
uugcuguagaagauggcacu

SEQ ID NO: 3854346 - RNA, 16 nt, Human
uugcuguaggaucuaa

SEQ ID NO: 3854347 - RNA, 21 nt, Human
uugcuguaugcugaucaucgc

SEQ ID NO: 3854348 - RNA, 17 nt, Human
uugcugucaagccauuu

SEQ ID NO: 3854349 - RNA, 12 nt, Human
uugcugucucug

SEQ ID NO: 3854350 - RNA, 15 nt, Human
uugcugucucugcuc

SEQ ID NO: 3854351 - RNA, 16 nt, Human
uugcugucucugcucg

SEQ ID NO: 3854352 - RNA, 18 nt, Human
uugcugucugcagccuug

SEQ ID NO: 3854353 - RNA, 18 nt, Human
uugcugugaacaauuguc

SEQ ID NO: 3854354 - RNA, 14 nt, Human
uugcugugaacuga

SEQ ID NO: 3854355 - RNA, 15 nt, Human
uugcugugaggcugu

SEQ ID NO: 3854356 - RNA, 20 nt, Human
uugcugugaggcuguccugu

SEQ ID NO: 3854357 - RNA, 16 nt, Human
uugcugugccucccaa

SEQ ID NO: 3854358 - RNA, 20 nt, Human
uugcugugcuucaaacuacu

SEQ ID NO: 3854359 - RNA, 17 nt, Human
uugcuguggucucuuug

SEQ ID NO: 3854360 - RNA, 20 nt, Human
uugcugugucauaccaggcc

SEQ ID NO: 3854361 - RNA, 20 nt, Human
uugcuguguccaacuccagu

SEQ ID NO: 3854362 - RNA, 19 nt, Human
uugcugugugucccaggca

SEQ ID NO: 3854363 - RNA, 17 nt, Human
uugcuguguuuaauuug

SEQ ID NO: 3854364 - RNA, 18 nt, Human
uugcuguguuuaauuuga

SEQ ID NO: 3854365 - RNA, 15 nt, Human
uuugggccccucucc

SEQ ID NO: 3854366 - RNA, 13 nt, Human
uuugggcccugca

SEQ ID NO: 3854367 - RNA, 10 nt, Human
uuugggcucu

SEQ ID NO: 3854368 - RNA, 14 nt, Human
uuugggcugcccug

SEQ ID NO: 3854369 - RNA, 20 nt, Human
uuugggcuucagcugccagu

SEQ ID NO: 3854370 - RNA, 23 nt, Human
uuugggcuuguuguuuguaacaa

SEQ ID NO: 3854371 - RNA, 14 nt, Human
uuuggggauauuuu

SEQ ID NO: 3854372 - RNA, 18 nt, Human
uuugggggacguuucuca

SEQ ID NO: 3854373 - RNA, 20 nt, Human
uuugggggguuuucuugccu

SEQ ID NO: 3854374 - RNA, 21 nt, Human
uuugggguacccacugcucug

SEQ ID NO: 3854375 - RNA, 16 nt, Human
uuuggggucuuugugg

SEQ ID NO: 3854376 - RNA, 22 nt, Human
uuuggguauguuuaaucuguua

SEQ ID NO: 3854377 - RNA, 14 nt, Human
uuuggguccaggag

SEQ ID NO: 3854378 - RNA, 15 nt, Human
uuuggguccaggagg

SEQ ID NO: 3854379 - RNA, 22 nt, Human
uuuggguuaauauggcucuuca

SEQ ID NO: 3854380 - RNA, 15 nt, Human
uuuggguuacaguau

SEQ ID NO: 3854381 - RNA, 17 nt, Human
uuuggguuuauuuggaa

SEQ ID NO: 3854382 - RNA, 18 nt, Human
uuugguaaggggaauuga

SEQ ID NO: 3854383 - RNA, 16 nt, Human
uuugguacaaaaauaa

SEQ ID NO: 3854384 - RNA, 18 nt, Human
uuugguacuuauuacugc

SEQ ID NO: 3854385 - RNA, 23 nt, Human
uuugguaguggaaaaaaaaaaga

SEQ ID NO: 3854386 - RNA, 22 nt, Human
uuugguauuacacuguauuugu

SEQ ID NO: 3854387 - RNA, 15 nt, Human
uuuggucaacacuaa

SEQ ID NO: 3854388 - RNA, 23 nt, Human
uuuggucccgugcagcuucuguc

SEQ ID NO: 3854389 - RNA, 13 nt, Human
uuuggucccuggg

SEQ ID NO: 3854390 - RNA, 22 nt, Human
uuugguccuaagucccugcccc

SEQ ID NO: 3854391 - RNA, 21 nt, Human
uuugguccuucaaaggcuugu

SEQ ID NO: 3854392 - RNA, 19 nt, Human
uuuggucgaggaguaacaa

SEQ ID NO: 3854393 - RNA, 17 nt, Human
uuuggucuacacugugc

SEQ ID NO: 3854394 - RNA, 15 nt, Human
uuuggucucccuggg

SEQ ID NO: 3854395 - RNA, 21 nt, Human
uuuggucuggacugacagcau

SEQ ID NO: 3854396 - RNA, 14 nt, Human
uuuggucugggacu

SEQ ID NO: 3854397 - RNA, 20 nt, Human
uuuggucuuuaaugaaaagc

SEQ ID NO: 3854398 - RNA, 18 nt, Human
uuuggugauuacauuuua

SEQ ID NO: 3854399 - RNA, 14 nt, Human
uuuggugauucaaa

SEQ ID NO: 3854400 - RNA, 18 nt, Human
uuuggugcauagaacugg

SEQ ID NO: 3854401 - RNA, 15 nt, Human
uuuggugccuuuccu

SEQ ID NO: 3854402 - RNA, 12 nt, Human
uuuggugcuuuu

SEQ ID NO: 3854403 - RNA, 15 nt, Human
uuugguggagauaaa

SEQ ID NO: 3854404 - RNA, 20 nt, Human
uuugguggggguagagcuga

SEQ ID NO: 3854405 - RNA, 21 nt, Human
uuuggugguuuaaaaauggua

SEQ ID NO: 3854406 - RNA, 19 nt, Human
uuugguguguggagaugca

SEQ ID NO: 3854407 - RNA, 19 nt, Human
uuugguuaagucuguuuua

SEQ ID NO: 3854408 - RNA, 15 nt, Human
uuugguuaaguuggc

SEQ ID NO: 3854409 - RNA, 16 nt, Human
uuugguuauagugcaa

SEQ ID NO: 3854410 - RNA, 21 nt, Human
uuugguuauagugcaauauau

SEQ ID NO: 3854411 - RNA, 20 nt, Human
uuugguucauuaauucuaua

SEQ ID NO: 3854412 - RNA, 12 nt, Human
uuugguucugug

SEQ ID NO: 3854413 - RNA, 20 nt, Human
uuugguucuucucaaaagaa

SEQ ID NO: 3854414 - RNA, 20 nt, Human
uuugguuugcuuugguuuau

SEQ ID NO: 3854415 - RNA, 19 nt, Human
uuugguuuucacauuggaa

SEQ ID NO: 3854416 - RNA, 21 nt, Human
uuuguaaaagaacaguaaaca

SEQ ID NO: 3854417 - RNA, 23 nt, Human
uuuguaaaagaacaguaaacauu

SEQ ID NO: 3854418 - RNA, 14 nt, Human
uuuguaaaaugaca

SEQ ID NO: 3854419 - RNA, 23 nt, Human
uuuguaaaaugacaaucaugugu

SEQ ID NO: 3854420 - RNA, 15 nt, Human
uuuguaaaauguauu

SEQ ID NO: 3854421 - RNA, 16 nt, Human
uuuguaaaauguauua

SEQ ID NO: 3854422 - RNA, 13 nt, Human
uuuguaaacauuu

SEQ ID NO: 3854423 - RNA, 22 nt, Human
uuuguaaacucaaaauauuugu

SEQ ID NO: 3854424 - RNA, 22 nt, Human
uuuguaaagaaauuuacuauau

SEQ ID NO: 3854425 - RNA, 23 nt, Human
uuuguaaagaaauuuacuauaua

SEQ ID NO: 3854426 - RNA, 22 nt, Human
uuuguggcagaaguguuucaug

SEQ ID NO: 3854427 - RNA, 22 nt, Human
uuuguggccaaggagcugcuau

SEQ ID NO: 3854428 - RNA, 12 nt, Human
uuuguggcuggg

SEQ ID NO: 3854429 - RNA, 20 nt, Human
uuugugggggacuguaaguu

SEQ ID NO: 3854430 - RNA, 20 nt, Human
uuuguggguuuuuauuuccu

SEQ ID NO: 3854431 - RNA, 22 nt, Human
uuuguguaauaaaguguuuuca

SEQ ID NO: 3854432 - RNA, 13 nt, Human
uuuguguacuuuu

SEQ ID NO: 3854433 - RNA, 17 nt, Human
uuuguguacuuuuaaga

SEQ ID NO: 3854434 - RNA, 13 nt, Human
uuuguguauuuaa

SEQ ID NO: 3854435 - RNA, 20 nt, Human
uuuguguauuuaacagggag

SEQ ID NO: 3854436 - RNA, 12 nt, Human
uuuguguccucc

SEQ ID NO: 3854437 - RNA, 16 nt, Human
uuuguguccuccagga

SEQ ID NO: 3854438 - RNA, 19 nt, Human
uuuguguccuccaggagcu

SEQ ID NO: 3854439 - RNA, 15 nt, Human
uuuguguguugucuu

SEQ ID NO: 3854440 - RNA, 13 nt, Human
uuuguguuccaaa

SEQ ID NO: 3854441 - RNA, 12 nt, Human
uuuguguucugu

SEQ ID NO: 3854442 - RNA, 14 nt, Human
uuuguguucuucuu

SEQ ID NO: 3854443 - RNA, 13 nt, Human
uuuguguuguaau

SEQ ID NO: 3854444 - RNA, 14 nt, Human
uuuguguuguaauu

SEQ ID NO: 3854445 - RNA, 22 nt, Human
uuuguguuguaauucuucaguu

SEQ ID NO: 3854446 - RNA, 12 nt, Human
uuuguguuuauu

SEQ ID NO: 3854447 - RNA, 17 nt, Human
uuuguguuugguuuaca

SEQ ID NO: 3854448 - RNA, 14 nt, Human
uuuguuaaaaauaa

SEQ ID NO: 3854449 - RNA, 21 nt, Human
uuuguuaaaacuggcaucuga

SEQ ID NO: 3854450 - RNA, 17 nt, Human
uuuguuaaauauuuaca

SEQ ID NO: 3854451 - RNA, 22 nt, Human
uuuguuaaauauuuacauauga

SEQ ID NO: 3854452 - RNA, 16 nt, Human
uuuguuaacuuugggu

SEQ ID NO: 3854453 - RNA, 16 nt, Human
uuuguuaauaucacuc

SEQ ID NO: 3854454 - RNA, 13 nt, Human
uuuguuaccuuua

SEQ ID NO: 3854455 - RNA, 12 nt, Human
uuuguuacuguu

SEQ ID NO: 3854456 - RNA, 14 nt, Human
uuuguuacuguucu

SEQ ID NO: 3854457 - RNA, 18 nt, Human
uuuguuacuguucuugcu

SEQ ID NO: 3854458 - RNA, 22 nt, Human
uuuguuaguaugaggcauuugu

SEQ ID NO: 3854459 - RNA, 13 nt, Human
uuuguuauucuua

SEQ ID NO: 3854460 - RNA, 16 nt, Human
uuuguuauucuuaaga

SEQ ID NO: 3854461 - RNA, 12 nt, Human
uuuguuauuugu

SEQ ID NO: 3854462 - RNA, 20 nt, Human
uuuguuauuuucaguauuuu

SEQ ID NO: 3854463 - RNA, 15 nt, Human
uuuguuauuuugcaa

SEQ ID NO: 3854464 - RNA, 16 nt, Human
uuuguuauuuugcaac

SEQ ID NO: 3854465 - RNA, 17 nt, Human
uuuguucacugaaggug

SEQ ID NO: 3854466 - RNA, 13 nt, Human
uuuguucauacau

SEQ ID NO: 3854467 - RNA, 19 nt, Human
uuuguucauccuauuguug

SEQ ID NO: 3854468 - RNA, 13 nt, Human
uuuguucaucugu

SEQ ID NO: 3854469 - RNA, 15 nt, Human
uuuguucccaagagc

SEQ ID NO: 3854470 - RNA, 19 nt, Human
uuuguuccccacuggagca

SEQ ID NO: 3854471 - RNA, 12 nt, Human
uuuguuccccuc

SEQ ID NO: 3854472 - RNA, 13 nt, Human
uuuguuccccucc

SEQ ID NO: 3854473 - RNA, 19 nt, Human
uuuguuccccuccuccacu

SEQ ID NO: 3854474 - RNA, 12 nt, Human
uuuguucccugu

SEQ ID NO: 3854475 - RNA, 16 nt, Human
uuuguucuaguuuuca

SEQ ID NO: 3854476 - RNA, 21 nt, Human
uuuguucucugggagaaaauc

SEQ ID NO: 3854477 - RNA, 15 nt, Human
uuuguugacauucug

SEQ ID NO: 3854478 - RNA, 20 nt, Human
uuuguugacauucugaaugc

SEQ ID NO: 3854479 - RNA, 16 nt, Human
uuuguugauucucucc

SEQ ID NO: 3854480 - RNA, 23 nt, Human
uuuguugcacugaaguuugauaa

SEQ ID NO: 3854481 - RNA, 23 nt, Human
uuuguuggaagguuuggugugug

SEQ ID NO: 3854482 - RNA, 13 nt, Human
uuuguugguuggu

SEQ ID NO: 3854483 - RNA, 23 nt, Human
uuuguugugugccucuagcugaa

SEQ ID NO: 3854484 - RNA, 15 nt, Human
uuuguugugugugca

SEQ ID NO: 3854485 - RNA, 12 nt, Human
uuuguuguuugu

SEQ ID NO: 3854486 - RNA, 19 nt, Human
uuuguuguuuguuuagucu

SEQ ID NO: 3854487 - RNA, 14 nt, Human
uuuguuuaaaaagg

SEQ ID NO: 3854488 - RNA, 22 nt, Human
uuuguuucaaugagguguccaa

SEQ ID NO: 3854489 - RNA, 12 nt, Human
uuuguuuccucu

SEQ ID NO: 3854490 - RNA, 13 nt, Human
uuuguuugaugca

SEQ ID NO: 3854491 - RNA, 11 nt, Human
uuuguuuguuu

SEQ ID NO: 3854492 - RNA, 15 nt, Human
uuuguuuguuuaauu

SEQ ID NO: 3854493 - RNA, 15 nt, Human
uuuguuuguuugggu

SEQ ID NO: 3854494 - RNA, 15 nt, Human
uuuguuuguuuuccu

SEQ ID NO: 3854495 - RNA, 14 nt, Human
uuuguuuguuuugu

SEQ ID NO: 3854496 - RNA, 14 nt, Human
uuuguuuuaaaauu

SEQ ID NO: 3854497 - RNA, 20 nt, Human
uuuguuuuaaggaagaaaaa

SEQ ID NO: 3854498 - RNA, 12 nt, Human
uuuguuuugcac

SEQ ID NO: 3854499 - RNA, 11 nt, Human
uuuguuuuguu

SEQ ID NO: 3854500 - RNA, 15 nt, Human
uuuguuuuguuuaca

SEQ ID NO: 3854501 - RNA, 17 nt, Human
uuuguuuuguuuuuaca

SEQ ID NO: 3854502 - RNA, 16 nt, Human
uuuguuuuuaaacugu

SEQ ID NO: 3854503 - RNA, 14 nt, Human
uuuguuuuuaugaa

SEQ ID NO: 3854504 - RNA, 17 nt, Human
uuuguuuuuauuaaaag

SEQ ID NO: 3854505 - RNA, 18 nt, Human
uuuguuuuuauuuaaauu

SEQ ID NO: 3854506 - RNA, 13 nt, Human
uuuguuuuucuca

SEQ ID NO: 3854507 - RNA, 15 nt, Human
uuuguuuuuuaaaaa

SEQ ID NO: 3854508 - RNA, 19 nt, Human
uuuguuuuuugaaguguug

SEQ ID NO: 3854509 - RNA, 18 nt, Human
uuuguuuuuugagucuuu

SEQ ID NO: 3854510 - RNA, 13 nt, Human
uuuguuuuuuggu

SEQ ID NO: 3854511 - RNA, 15 nt, Human
uuuguuuuuuugcca

SEQ ID NO: 3854512 - RNA, 13 nt, Human
uuuuaaaaaaaua

SEQ ID NO: 3854513 - RNA, 18 nt, Human
uuuuaaaaaaauaaaaca

SEQ ID NO: 3854514 - RNA, 20 nt, Human
uuuuaaaaaaauaaaacauu

SEQ ID NO: 3854515 - RNA, 18 nt, Human
uuuuaaaaaauauuuucu

SEQ ID NO: 3854516 - RNA, 16 nt, Human
uuuuaaaaaaugguca

SEQ ID NO: 3854517 - RNA, 22 nt, Human
uuuuaaaaagaaacaagaugcu

SEQ ID NO: 3854518 - RNA, 11 nt, Human
uuuuaaaaagu

SEQ ID NO: 3854519 - RNA, 21 nt, Human
uuuuaaaaauacauaucgcug

SEQ ID NO: 3854520 - RNA, 15 nt, Human
uuuuaaaaaucauaa

SEQ ID NO: 3854521 - RNA, 23 nt, Human
uuuuaaaaaucauaaacugugug

SEQ ID NO: 3854522 - RNA, 21 nt, Human
uuuuaaaaaucuaagcagcuu

SEQ ID NO: 3854523 - RNA, 23 nt, Human
uuuuaaaaauguccugccuuuua

SEQ ID NO: 3854524 - RNA, 19 nt, Human
uuuuaaaaauuguuauuua

SEQ ID NO: 3854525 - RNA, 14 nt, Human
uuuuaaaacuacuu

SEQ ID NO: 3854526 - RNA, 15 nt, Human
uuuuaaaacuacuua

SEQ ID NO: 3854527 - RNA, 20 nt, Human
uuuuaaaacuacuuagcacu

SEQ ID NO: 3854528 - RNA, 15 nt, Human
uuuuaaaagacaaga

SEQ ID NO: 3854529 - RNA, 23 nt, Human
uuuuaaaagacaagacuucagua

SEQ ID NO: 3854530 - RNA, 23 nt, Human
uuuuaaaagagacaaacuguaaa

SEQ ID NO: 3854531 - RNA, 15 nt, Human
uauuuucuaaagacu

SEQ ID NO: 3854532 - RNA, 15 nt, Human
uauuuucuauguacu

SEQ ID NO: 3854533 - RNA, 17 nt, Human
uauuuucuauguacuag

SEQ ID NO: 3854534 - RNA, 21 nt, Human
uauuuucuauguacuaguacu

SEQ ID NO: 3854535 - RNA, 19 nt, Human
uauuuucuauuuuaagacu

SEQ ID NO: 3854536 - RNA, 17 nt, Human
uauuuucuccaaauguu

SEQ ID NO: 3854537 - RNA, 20 nt, Human
uauuuucucuguacuuuuca

SEQ ID NO: 3854538 - RNA, 22 nt, Human
uauuuucugguagauagaaaua

SEQ ID NO: 3854539 - RNA, 13 nt, Human
uauuuucugugug

SEQ ID NO: 3854540 - RNA, 15 nt, Human
uauuuucuguguguu

SEQ ID NO: 3854541 - RNA, 18 nt, Human
uauuuucuguguguuccu

SEQ ID NO: 3854542 - RNA, 21 nt, Human
uauuuucuguguguuccuggc

SEQ ID NO: 3854543 - RNA, 14 nt, Human
uauuuucuguucua

SEQ ID NO: 3854544 - RNA, 16 nt, Human
uauuuucuuuugaauu

SEQ ID NO: 3854545 - RNA, 14 nt, Human
uauuuugaaaagcu

SEQ ID NO: 3854546 - RNA, 20 nt, Human
uauuuugaaaagcuucuuaa

SEQ ID NO: 3854547 - RNA, 17 nt, Human
uauuuugaaauggaaau

SEQ ID NO: 3854548 - RNA, 12 nt, Human
uauuuugaaauu

SEQ ID NO: 3854549 - RNA, 15 nt, Human
uauuuugaaguuuac

SEQ ID NO: 3854550 - RNA, 18 nt, Human
uauuuugaaguuuacauu

SEQ ID NO: 3854551 - RNA, 13 nt, Human
uauuuugaaucaa

SEQ ID NO: 3854552 - RNA, 16 nt, Human
uauuuugaaugugaag

SEQ ID NO: 3854553 - RNA, 17 nt, Human
uauuuugacauaaaguu

SEQ ID NO: 3854554 - RNA, 17 nt, Human
uauuuugaugcagcauu

SEQ ID NO: 3854555 - RNA, 17 nt, Human
uauuuugauguaaagau

SEQ ID NO: 3854556 - RNA, 14 nt, Human
uauuuugcacaguu

SEQ ID NO: 3854557 - RNA, 23 nt, Human
uauuuugccaagggcauaaauua

SEQ ID NO: 3854558 - RNA, 16 nt, Human
uauuuugccauuuagc

SEQ ID NO: 3854559 - RNA, 15 nt, Human
uauuuugcuuuguga

SEQ ID NO: 3854560 - RNA, 23 nt, Human
uauuuuggauuguauauuguguu

SEQ ID NO: 3854561 - RNA, 14 nt, Human
uauuuugguacuuu

SEQ ID NO: 3854562 - RNA, 14 nt, Human
uauuuuguaaaaug

SEQ ID NO: 3854563 - RNA, 17 nt, Human
uauuuuguaaaauguau

SEQ ID NO: 3854564 - RNA, 19 nt, Human
uauuuuguaaaauguauua

SEQ ID NO: 3854565 - RNA, 20 nt, Human
uauuuuguaaacucaaaaua

SEQ ID NO: 3854566 - RNA, 15 nt, Human
uauuuuguauauauc

SEQ ID NO: 3854567 - RNA, 22 nt, Human
uauuuuguaugcaagcaguuuc

SEQ ID NO: 3854568 - RNA, 17 nt, Human
uauuuuguauuguggua

SEQ ID NO: 3854569 - RNA, 18 nt, Human
uauuuugucauaucaaau

SEQ ID NO: 3854570 - RNA, 14 nt, Human
uauuuugugaguuu

SEQ ID NO: 3854571 - RNA, 17 nt, Human
uauuuugugaguuuguu

SEQ ID NO: 3854572 - RNA, 23 nt, Human
uauuuugugaguuuguuucuuug

SEQ ID NO: 3854573 - RNA, 17 nt, Human
uuuugcaagguaaaauu

SEQ ID NO: 3854574 - RNA, 17 nt, Human
uuuugcaagguuccaca

SEQ ID NO: 3854575 - RNA, 10 nt, Human
uuuugcacag

SEQ ID NO: 3854576 - RNA, 21 nt, Human
uuuugcaccccaugcuguuga

SEQ ID NO: 3854577 - RNA, 21 nt, Human
uuuugcacugaggauauucag

SEQ ID NO: 3854578 - RNA, 14 nt, Human
uuuugcagcaguga

SEQ ID NO: 3854579 - RNA, 12 nt, Human
uuuugcagcuuu

SEQ ID NO: 3854580 - RNA, 13 nt, Human
uuuugcaguaacu

SEQ ID NO: 3854581 - RNA, 16 nt, Human
uuuugcaguaacuguu

SEQ ID NO: 3854582 - RNA, 15 nt, Human
uuuugcauaauuuca

SEQ ID NO: 3854583 - RNA, 19 nt, Human
uuuugcaugcaugcaaaug

SEQ ID NO: 3854584 - RNA, 21 nt, Human
uuuugcaugcaugcaaaugag

SEQ ID NO: 3854585 - RNA, 16 nt, Human
uuuugcauggcacuug

SEQ ID NO: 3854586 - RNA, 18 nt, Human
uuuugcauuuaaaacaga

SEQ ID NO: 3854587 - RNA, 13 nt, Human
uuuugcauuuaug

SEQ ID NO: 3854588 - RNA, 15 nt, Human
uuuugccaacauugc

SEQ ID NO: 3854589 - RNA, 18 nt, Human
uuuugccaauuugcacau

SEQ ID NO: 3854590 - RNA, 16 nt, Human
uuuugccacagcuuuu

SEQ ID NO: 3854591 - RNA, 16 nt, Human
ucaagcagucgugccu

SEQ ID NO: 3854592 - RNA, 17 nt, Human
ucaagcagucgugccug

SEQ ID NO: 3854593 - RNA, 18 nt, Human
ucaagcagucgugccugu

SEQ ID NO: 3854594 - RNA, 21 nt, Human
ucaagcagucgugccuguguc

SEQ ID NO: 3854595 - RNA, 22 nt, Human
ucaagcagucgugccugugucc

SEQ ID NO: 3854596 - RNA, 20 nt, Human
ucaagcagucuacccaccuc

SEQ ID NO: 3854597 - RNA, 22 nt, Human
ucaagcaucuccugaggaucag

SEQ ID NO: 3854598 - RNA, 12 nt, Human
ucaagcaugaag

SEQ ID NO: 3854599 - RNA, 17 nt, Human
ucaagccaagcagccaa

SEQ ID NO: 3854600 - RNA, 19 nt, Human
ucaagccaagcagccaagc

SEQ ID NO: 3854601 - RNA, 16 nt, Human
ucaagccauguauaaa

SEQ ID NO: 3854602 - RNA, 20 nt, Human
ucaagccauguauaaaugug

SEQ ID NO: 3854603 - RNA, 16 nt, Human
ucaagcccaggaggac

SEQ ID NO: 3854604 - RNA, 16 nt, Human
ucaagcccgcggggac

SEQ ID NO: 3854605 - RNA, 13 nt, Human
ucaagcccugcag

SEQ ID NO: 3854606 - RNA, 14 nt, Human
ucaagccugccuag

SEQ ID NO: 3854607 - RNA, 15 nt, Human
ucaagccugugcaaa

SEQ ID NO: 3854608 - RNA, 19 nt, Human
ucaagccugugcaaaaaaa

SEQ ID NO: 3854609 - RNA, 15 nt, Human
ucaagcgauucuccu

SEQ ID NO: 3854610 - RNA, 19 nt, Human
ucaagcgauucuucugcuu

SEQ ID NO: 3854611 - RNA, 16 nt, Human
ucaagcuagaaggcca

SEQ ID NO: 3854612 - RNA, 20 nt, Human
ucaagcuagaaggccacaug

SEQ ID NO: 3854613 - RNA, 13 nt, Human
ucaagcuccuccu

SEQ ID NO: 3854614 - RNA, 16 nt, Human
ucaagcuccuccuccc

SEQ ID NO: 3854615 - RNA, 18 nt, Human
ucaagcuccuccucccug

SEQ ID NO: 3854616 - RNA, 18 nt, Human
ucaagcucugagggaaag

SEQ ID NO: 3854617 - RNA, 21 nt, Human
ucaagcugaguauuaaaaugu

SEQ ID NO: 3854618 - RNA, 19 nt, Human
ucaagcuguugaagucuca

SEQ ID NO: 3854619 - RNA, 19 nt, Human
ucaaggaaaggggguccca

SEQ ID NO: 3854620 - RNA, 18 nt, Human
ucaaggaacuugaaaaau

SEQ ID NO: 3854621 - RNA, 16 nt, Human
ucaaggaauuucuuaa

SEQ ID NO: 3854622 - RNA, 19 nt, Human
ucaaggaauuucuuaacuu

SEQ ID NO: 3854623 - RNA, 21 nt, Human
ucaaggacacgggccugucca

SEQ ID NO: 3854624 - RNA, 18 nt, Human
ucaaggacuugaaagcau

SEQ ID NO: 3854625 - RNA, 19 nt, Human
ucaaggauaccuucuuauu

SEQ ID NO: 3854626 - RNA, 14 nt, Human
ucaaggauccugag

SEQ ID NO: 3854627 - RNA, 13 nt, Human
ucaaggcacucua

SEQ ID NO: 3854628 - RNA, 15 nt, Human
ucaaggcacucuaga

SEQ ID NO: 3854629 - RNA, 21 nt, Human
ucaaggcacucuagauuccau

SEQ ID NO: 3854630 - RNA, 14 nt, Human
ucaaggcacugccu

SEQ ID NO: 3854631 - RNA, 16 nt, Human
ucaaggcacugccuga

SEQ ID NO: 3854632 - RNA, 16 nt, Human
ucaaggccucccacag

SEQ ID NO: 3854633 - RNA, 19 nt, Human
ucaaggccucccacaguga

SEQ ID NO: 3854634 - RNA, 13 nt, Human
ucaaggccugcuc

SEQ ID NO: 3854635 - RNA, 18 nt, Human
ucaaggcgugaggauggg

SEQ ID NO: 3854636 - RNA, 14 nt, Human
ucaaggcuucaguc

SEQ ID NO: 3854637 - RNA, 17 nt, Human
ucaaggcuucagucuca

SEQ ID NO: 3854638 - RNA, 19 nt, Human
ucaagggcagcuuugcuca

SEQ ID NO: 3854639 - RNA, 20 nt, Human
ucaagggcagcuuugcucau

SEQ ID NO: 3854640 - RNA, 21 nt, Human
ucaagggcagcuuugcucaua

SEQ ID NO: 3854641 - RNA, 14 nt, Human
ucaagggcuguagg

SEQ ID NO: 3854642 - RNA, 15 nt, Human
ucaagggcugucauu

SEQ ID NO: 3854643 - RNA, 18 nt, Human
ucaagggcuuacuauuuc

SEQ ID NO: 3854644 - RNA, 15 nt, Human
ucaagggcuuuccug

SEQ ID NO: 3854645 - RNA, 13 nt, Human
ucaaggggucacu

SEQ ID NO: 3854646 - RNA, 13 nt, Human
ucaagggucaggc

SEQ ID NO: 3854647 - RNA, 16 nt, Human
ucaagggucaggccuu

SEQ ID NO: 3854648 - RNA, 14 nt, Human
ucaaggucugcuuu

SEQ ID NO: 3854649 - RNA, 15 nt, Human
ucaaggucugcuuuu

SEQ ID NO: 3854650 - RNA, 19 nt, Human
ucaaguaauccaccugccu

SEQ ID NO: 3854651 - RNA, 17 nt, Human
ucaaguaauucugcugu

SEQ ID NO: 3854652 - RNA, 16 nt, Human
ucaaguaauugugaaa

SEQ ID NO: 3854653 - RNA, 17 nt, Human
ucaaguagacuacuguu

SEQ ID NO: 3854654 - RNA, 19 nt, Human
ucaaguagacuacuguuca

SEQ ID NO: 3854655 - RNA, 21 nt, Human
ucaaguagacuacuguucagc

SEQ ID NO: 3854656 - RNA, 21 nt, Human
ucaaguagcugggauuuuaaa

SEQ ID NO: 3854657 - RNA, 15 nt, Human
ucaaguauagaaaau

SEQ ID NO: 3854658 - RNA, 15 nt, Human
ucaaguauccuuguu

SEQ ID NO: 3854659 - RNA, 16 nt, Human
ucaaguauuggcaaag

SEQ ID NO: 3854660 - RNA, 20 nt, Human
ucaaguauuuuguguuugga

SEQ ID NO: 3854661 - RNA, 15 nt, Human
ucaagucaccuccuu

SEQ ID NO: 3854662 - RNA, 21 nt, Human
ucaagucauggcagguacagu

SEQ ID NO: 3854663 - RNA, 22 nt, Human
ucaaguccuuaccucuuccgga

SEQ ID NO: 3854664 - RNA, 22 nt, Human
ucaagucuaccaaccuguucaa

SEQ ID NO: 3854665 - RNA, 18 nt, Human
ucaagucuaccaauuaua

SEQ ID NO: 3854666 - RNA, 17 nt, Human
ucaagucugugccugga

SEQ ID NO: 3854667 - RNA, 21 nt, Human
ucaagucugugccuggagcuc

SEQ ID NO: 3854668 - RNA, 19 nt, Human
ucaagucuguuuacugcaa

SEQ ID NO: 3854669 - RNA, 18 nt, Human
ucaagugauucuccugcc

SEQ ID NO: 3854670 - RNA, 19 nt, Human
ucaagugauucuccugccu

SEQ ID NO: 3854671 - RNA, 22 nt, Human
ucaagugauucuccugccucag

SEQ ID NO: 3854672 - RNA, 15 nt, Human
ucaagugauucucuu

SEQ ID NO: 3854673 - RNA, 19 nt, Human
ucaaguggcaaagcuguuc

SEQ ID NO: 3854674 - RNA, 18 nt, Human
ucaaguggggcucgccau

SEQ ID NO: 3854675 - RNA, 14 nt, Human
ucaaguuaaaguga

SEQ ID NO: 3854676 - RNA, 15 nt, Human
ucaaguuagcucagg

SEQ ID NO: 3854677 - RNA, 16 nt, Human
ucaaguucaaggacca

SEQ ID NO: 3854678 - RNA, 16 nt, Human
ucaaguucuaagauuc

SEQ ID NO: 3854679 - RNA, 18 nt, Human
ucaaguucuaagauucua

SEQ ID NO: 3854680 - RNA, 15 nt, Human
ucaaguugaggggcu

SEQ ID NO: 3854681 - RNA, 21 nt, Human
ucaaguugauuagaaagacca

SEQ ID NO: 3854682 - RNA, 14 nt, Human
ucaaguugugcuug

SEQ ID NO: 3854683 - RNA, 18 nt, Human
ucaaguuuccaagcaaau

SEQ ID NO: 3854684 - RNA, 19 nt, Human
ucaaguuuccaagcaaaug

SEQ ID NO: 3854685 - RNA, 23 nt, Human
ucaaguuuccaagcaaauguuac

SEQ ID NO: 3854686 - RNA, 20 nt, Human
ucaaguuugggucugugcug

SEQ ID NO: 3854687 - RNA, 16 nt, Human
ucaauaaaaaaaagaa

SEQ ID NO: 3854688 - RNA, 13 nt, Human
ucaauaaaaaauu

SEQ ID NO: 3854689 - RNA, 14 nt, Human
ucaauaaaauccau

SEQ ID NO: 3854690 - RNA, 17 nt, Human
ucaauaaaauuauagcu

SEQ ID NO: 3854691 - RNA, 17 nt, Human
ucaauaaacaacagcug

SEQ ID NO: 3854692 - RNA, 18 nt, Human
ucaauaaacaacagcuga

SEQ ID NO: 3854693 - RNA, 19 nt, Human
ucaauaaacagcaggugau

SEQ ID NO: 3854694 - RNA, 22 nt, Human
ucaauaaacgauuuaauucucu

SEQ ID NO: 3854695 - RNA, 16 nt, Human
ucaauaaaguauuuaa

SEQ ID NO: 3854696 - RNA, 21 nt, Human
ucaauaaagugcuuuaaaaag

SEQ ID NO: 3854697 - RNA, 13 nt, Human
ucaauaaaguuug

SEQ ID NO: 3854698 - RNA, 18 nt, Human
ucaauaaaguuugaucuu

SEQ ID NO: 3854699 - RNA, 12 nt, Human
ucaauaaaucuu

SEQ ID NO: 3854700 - RNA, 20 nt, Human
ucaauaagcaucaaacucuu

SEQ ID NO: 3854701 - RNA, 15 nt, Human
ucaauaauauauuuu

SEQ ID NO: 3854702 - RNA, 18 nt, Human
ucaauacacuaguuguuu

SEQ ID NO: 3854703 - RNA, 15 nt, Human
ucaauacagauauau

SEQ ID NO: 3854704 - RNA, 16 nt, Human
ucaauacagauauauu

SEQ ID NO: 3854705 - RNA, 20 nt, Human
ucaauacaguacaggcagca

SEQ ID NO: 3854706 - RNA, 16 nt, Human
ucaauagaucuccagc

SEQ ID NO: 3854707 - RNA, 12 nt, Human
ucaauagccacu

SEQ ID NO: 3854708 - RNA, 13 nt, Human
ucaauagccacua

SEQ ID NO: 3854709 - RNA, 23 nt, Human
ucaauagcccaggauauauuuua

SEQ ID NO: 3854710 - RNA, 14 nt, Human
ucaauaggaaaaac

SEQ ID NO: 3854711 - RNA, 17 nt, Human
ucaauaggaaaaacuga

SEQ ID NO: 3854712 - RNA, 18 nt, Human
ucaauaggaaaaacugau

SEQ ID NO: 3854713 - RNA, 17 nt, Human
ucaauagucaagaaaaa

SEQ ID NO: 3854714 - RNA, 19 nt, Human
ucaauaguguccuaugcaa

SEQ ID NO: 3854715 - RNA, 18 nt, Human
ucaauaguucaaggaacu

SEQ ID NO: 3854716 - RNA, 17 nt, Human
ucaauauauugaacuuu

SEQ ID NO: 3854717 - RNA, 22 nt, Human
ucaauauauugaacuuuuguac

SEQ ID NO: 3854718 - RNA, 18 nt, Human
uuguugcuguugauguuu

SEQ ID NO: 3854719 - RNA, 12 nt, Human
uuguugcuuugu

SEQ ID NO: 3854720 - RNA, 23 nt, Human
uuguuggagucaaaaagaaccac

SEQ ID NO: 3854721 - RNA, 23 nt, Human
uuguuggcuuucccuuaucaaac

SEQ ID NO: 3854722 - RNA, 20 nt, Human
uuguugggauuccugaccca

SEQ ID NO: 3854723 - RNA, 21 nt, Human
uuguugggauuccugacccag

SEQ ID NO: 3854724 - RNA, 16 nt, Human
uuguuggggcuuuaca

SEQ ID NO: 3854725 - RNA, 16 nt, Human
uuguugguugguuuuc

SEQ ID NO: 3854726 - RNA, 21 nt, Human
uuguuguaaagcaauaaaauu

SEQ ID NO: 3854727 - RNA, 12 nt, Human
uuguuguacuua

SEQ ID NO: 3854728 - RNA, 20 nt, Human
uuguuguagauugauuguau

SEQ ID NO: 3854729 - RNA, 16 nt, Human
uuguuguccuuuucau

SEQ ID NO: 3854730 - RNA, 16 nt, Human
uuguugugaugucuuu

SEQ ID NO: 3854731 - RNA, 14 nt, Human
uuguugugcuuuua

SEQ ID NO: 3854732 - RNA, 11 nt, Human
uuguugugggu

SEQ ID NO: 3854733 - RNA, 15 nt, Human
uuguugugugugcag

SEQ ID NO: 3854734 - RNA, 14 nt, Human
uuguuguucuguua

SEQ ID NO: 3854735 - RNA, 14 nt, Human
uuguuguuucagug

SEQ ID NO: 3854736 - RNA, 21 nt, Human
uuguuguuucuuaauuuggaa

SEQ ID NO: 3854737 - RNA, 14 nt, Human
uuguuguuugccau

SEQ ID NO: 3854738 - RNA, 16 nt, Human
uuguuguuuuuaagau

SEQ ID NO: 3854739 - RNA, 14 nt, Human
uuguuuaaaaucau

SEQ ID NO: 3854740 - RNA, 18 nt, Human
uuguuuaaaaucauuucu

SEQ ID NO: 3854741 - RNA, 15 nt, Human
uuguuuacaugcuua

SEQ ID NO: 3854742 - RNA, 16 nt, Human
uuguuuacuuaaagau

SEQ ID NO: 3854743 - RNA, 15 nt, Human
uuguuuagaagaagu

SEQ ID NO: 3854744 - RNA, 19 nt, Human
uuguuuagauuuuguguuu

SEQ ID NO: 3854745 - RNA, 20 nt, Human
uuguuuagauuuuguguuua

SEQ ID NO: 3854746 - RNA, 19 nt, Human
uuguuuaucuagauguaaa

SEQ ID NO: 3854747 - RNA, 20 nt, Human
uuguuuauguaaauguuugu

SEQ ID NO: 3854748 - RNA, 23 nt, Human
uuguuuauugaauucauuucacu

SEQ ID NO: 3854749 - RNA, 15 nt, Human
uuguuuauugaguuu

SEQ ID NO: 3854750 - RNA, 24 nt, Human
uuguuuauugaguuuguagguaaa

SEQ ID NO: 3854751 - RNA, 20 nt, Human
uuguuuauuuaucagugaca

SEQ ID NO: 3854752 - RNA, 11 nt, Human
uuguuucagug

SEQ ID NO: 3854753 - RNA, 22 nt, Human
uuguuucagugaauaugccugu

SEQ ID NO: 3854754 - RNA, 22 nt, Human
uuguuuccccacaaaacaaagc

SEQ ID NO: 3854755 - RNA, 23 nt, Human
uuguuuccuccccuaucuguauu

SEQ ID NO: 3854756 - RNA, 21 nt, Human
uuguuuccucuuccaaaguaa

SEQ ID NO: 3854757 - RNA, 15 nt, Human
ucaauccccucauuc

SEQ ID NO: 3854758 - RNA, 15 nt, Human
ucaauccuaccuguu

SEQ ID NO: 3854759 - RNA, 14 nt, Human
ucaauccucuaagc

SEQ ID NO: 3854760 - RNA, 20 nt, Human
ucaauccugugugguuuagu

SEQ ID NO: 3854761 - RNA, 15 nt, Human
ucaauccuuguucag

SEQ ID NO: 3854762 - RNA, 18 nt, Human
ucaaucucaauccugcag

SEQ ID NO: 3854763 - RNA, 18 nt, Human
ucaaucucaauugcuuug

SEQ ID NO: 3854764 - RNA, 24 nt, Human
ucaaucucguauagaagucuucau

SEQ ID NO: 3854765 - RNA, 16 nt, Human
ucaaucucugauucug

SEQ ID NO: 3854766 - RNA, 17 nt, Human
ucaaucuucaauccuug

SEQ ID NO: 3854767 - RNA, 15 nt, Human
ucaaucuugcaugua

SEQ ID NO: 3854768 - RNA, 17 nt, Human
ucaaucuugcauguaac

SEQ ID NO: 3854769 - RNA, 17 nt, Human
ucaaugaacaagcauuc

SEQ ID NO: 3854770 - RNA, 15 nt, Human
ucaaugaagccagcu

SEQ ID NO: 3854771 - RNA, 21 nt, Human
ucaaugaagccagcucacagu

SEQ ID NO: 3854772 - RNA, 23 nt, Human
ucaaugaaugaaugaauggcuaa

SEQ ID NO: 3854773 - RNA, 19 nt, Human
ucaaugagagcauaauuua

SEQ ID NO: 3854774 - RNA, 12 nt, Human
ucaaugaucuag

SEQ ID NO: 3854775 - RNA, 13 nt, Human
ucaaugaucuagg

SEQ ID NO: 3854776 - RNA, 20 nt, Human
ucaaugcaagagugauugca

SEQ ID NO: 3854777 - RNA, 13 nt, Human
ucaaugcagcccc

SEQ ID NO: 3854778 - RNA, 15 nt, Human
ucaaugcaguugucu

SEQ ID NO: 3854779 - RNA, 22 nt, Human
ucaaugccccugaauuuaaaua

SEQ ID NO: 3854780 - RNA, 17 nt, Human
ucaaugcgcaaaaugca

SEQ ID NO: 3854781 - RNA, 12 nt, Human
ucaaugcucaua

SEQ ID NO: 3854782 - RNA, 18 nt, Human
ucaaugcuuuauuuguaa

SEQ ID NO: 3854783 - RNA, 23 nt, Human
ucaauggccuaaaacuggccuga

SEQ ID NO: 3854784 - RNA, 18 nt, Human
ucaauggcgcagugccuc

SEQ ID NO: 3854785 - RNA, 22 nt, Human
ucaauggcugcugaagcugccu

SEQ ID NO: 3854786 - RNA, 22 nt, Human
ucaaugggaaauacuacuccug

SEQ ID NO: 3854787 - RNA, 17 nt, Human
ucaaugggcucuuccaa

SEQ ID NO: 3854788 - RNA, 18 nt, Human
ucaaugguuugcaaggaa

SEQ ID NO: 3854789 - RNA, 19 nt, Human
ucaaugguuugcaaggaag

SEQ ID NO: 3854790 - RNA, 18 nt, Human
ucaaugugauucuaaugu

SEQ ID NO: 3854791 - RNA, 22 nt, Human
ucaaugugauucuaaugucuuc

SEQ ID NO: 3854792 - RNA, 13 nt, Human
ucaaugugcagug

SEQ ID NO: 3854793 - RNA, 16 nt, Human
ucaauguguauaaauu

SEQ ID NO: 3854794 - RNA, 17 nt, Human
ucaauguguauaaauug

SEQ ID NO: 3854795 - RNA, 16 nt, Human
ucaaugugucuuucua

SEQ ID NO: 3854796 - RNA, 12 nt, Human
ucaaugugugca

SEQ ID NO: 3854797 - RNA, 20 nt, Human
ucaauguucacgcaacuuga

SEQ ID NO: 3854798 - RNA, 21 nt, Human
ucaauguucacgcaacuugaa

SEQ ID NO: 3854799 - RNA, 22 nt, Human
ucaauguucacgcaacuugaaa

SEQ ID NO: 3854800 - RNA, 11 nt, Human
ucaauguucau

SEQ ID NO: 3854801 - RNA, 14 nt, Human
ucaauguucauugu

SEQ ID NO: 3854802 - RNA, 21 nt, Human
ucaauguuuaugcaaggaagg

SEQ ID NO: 3854803 - RNA, 18 nt, Human
ucaauguuucuucuaggu

SEQ ID NO: 3854804 - RNA, 18 nt, Human
ucaauguuuuuaaaaauc

SEQ ID NO: 3854805 - RNA, 11 nt, Human
ucaauuaaacg

SEQ ID NO: 3854806 - RNA, 16 nt, Human
ucaauuaaacggauua

SEQ ID NO: 3854807 - RNA, 17 nt, Human
ucaauuaaacggauuau

SEQ ID NO: 3854808 - RNA, 20 nt, Human
ucaauuaaacggauuauuuu

SEQ ID NO: 3854809 - RNA, 14 nt, Human
ucaauuaaauguag

SEQ ID NO: 3854810 - RNA, 18 nt, Human
ucaauuacaggaaguacu

SEQ ID NO: 3854811 - RNA, 19 nt, Human
ucaauuacaggaaguacug

SEQ ID NO: 3854812 - RNA, 14 nt, Human
ucaauuacauguuu

SEQ ID NO: 3854813 - RNA, 20 nt, Human
ucaauuagcguuuaagguga

SEQ ID NO: 3854814 - RNA, 22 nt, Human
ucaauuauacuacuucuaaggu

SEQ ID NO: 3854815 - RNA, 17 nt, Human
ucaauuauuucccccau

SEQ ID NO: 3854816 - RNA, 15 nt, Human
ucaauucaaaaaugu

SEQ ID NO: 3854817 - RNA, 17 nt, Human
ucaauucaaaaauguac

SEQ ID NO: 3854818 - RNA, 15 nt, Human
ucaauucaaagcugu

SEQ ID NO: 3854819 - RNA, 17 nt, Human
ucaauucaacacucccu

SEQ ID NO: 3854820 - RNA, 15 nt, Human
ucaauucaauuugga

SEQ ID NO: 3854821 - RNA, 16 nt, Human
ucaauucauauuuaug

SEQ ID NO: 3854822 - RNA, 15 nt, Human
ucaauuccaacaguu

SEQ ID NO: 3854823 - RNA, 18 nt, Human
ucaauuccaacaguuuaa

SEQ ID NO: 3854824 - RNA, 20 nt, Human
ucaauuccaacaguuuaaug

SEQ ID NO: 3854825 - RNA, 21 nt, Human
ucaauuccaacaguuuaauga

SEQ ID NO: 3854826 - RNA, 18 nt, Human
ucaauucccaccuaugag

SEQ ID NO: 3854827 - RNA, 22 nt, Human
ucaauucccccuggccaccacc

SEQ ID NO: 3854828 - RNA, 14 nt, Human
ucaauuccucuggg

SEQ ID NO: 3854829 - RNA, 15 nt, Human
ucaauuccucuggga

SEQ ID NO: 3854830 - RNA, 16 nt, Human
ucaauuccucugggaa

SEQ ID NO: 3854831 - RNA, 20 nt, Human
ucaauucuguagguuaaaaa

SEQ ID NO: 3854832 - RNA, 17 nt, Human
ucaauucuucccuaucu

SEQ ID NO: 3854833 - RNA, 14 nt, Human
ucaauugcuuugua

SEQ ID NO: 3854834 - RNA, 18 nt, Human
ucaauuguaaauugaauc

SEQ ID NO: 3854835 - RNA, 17 nt, Human
ucaauugucacuuuuua

SEQ ID NO: 3854836 - RNA, 16 nt, Human
ucaauugugaaaaaau

SEQ ID NO: 3854837 - RNA, 20 nt, Human
ucaauugugaaaaaauuuac

SEQ ID NO: 3854838 - RNA, 19 nt, Human
ucaauuuaaacccauuuua

SEQ ID NO: 3854839 - RNA, 23 nt, Human
ucaauuuaaacccauuuuaguca

SEQ ID NO: 3854840 - RNA, 14 nt, Human
ucaauuuaaguguu

SEQ ID NO: 3854841 - RNA, 13 nt, Human
ucaauuuaugaau

SEQ ID NO: 3854842 - RNA, 19 nt, Human
ucaauuucaauuuugucug

SEQ ID NO: 3854843 - RNA, 13 nt, Human
ucaauuuccaaga

SEQ ID NO: 3854844 - RNA, 14 nt, Human
ucaauuucucccca

SEQ ID NO: 3854845 - RNA, 15 nt, Human
ucaauuucuccccag

SEQ ID NO: 3854846 - RNA, 16 nt, Human
ucaauuuguauaaaau

SEQ ID NO: 3854847 - RNA, 21 nt, Human
ucaauuuguucagucuuucau

SEQ ID NO: 3854848 - RNA, 14 nt, Human
ucaauuuuuaggaa

SEQ ID NO: 3854849 - RNA, 23 nt, Human
ucaauuuuucuuauuucauuucu

SEQ ID NO: 3854850 - RNA, 16 nt, Human
ucacaaaaauuugaac

SEQ ID NO: 3854851 - RNA, 23 nt, Human
ucacaaaaauuugaacacuggcu

SEQ ID NO: 3854852 - RNA, 17 nt, Human
ucacaaaaccuggcaca

SEQ ID NO: 3854853 - RNA, 22 nt, Human
ucacaaaauuuuauuccuauau

SEQ ID NO: 3854854 - RNA, 18 nt, Human
ucacaaagaguucuggaa

SEQ ID NO: 3854855 - RNA, 12 nt, Human
ucacaaagccca

SEQ ID NO: 3854856 - RNA, 16 nt, Human
ucacaaagcccaaggg

SEQ ID NO: 3854857 - RNA, 17 nt, Human
ucacaaaguggaacgaa

SEQ ID NO: 3854858 - RNA, 11 nt, Human
ucacaaauaaa

SEQ ID NO: 3854859 - RNA, 21 nt, Human
ucacaaauauuaaaaagucuu

SEQ ID NO: 3854860 - RNA, 14 nt, Human
ucacaaaugacuuu

SEQ ID NO: 3854861 - RNA, 19 nt, Human
ucacaaaugacuuuauuau

SEQ ID NO: 3854862 - RNA, 23 nt, Human
ucacaaaugauauuaaaaauugg

SEQ ID NO: 3854863 - RNA, 15 nt, Human
ucacuccuaccuggu

SEQ ID NO: 3854864 - RNA, 18 nt, Human
ucacuccuaccugguaau

SEQ ID NO: 3854865 - RNA, 20 nt, Human
ucacuccugagaccccuggc

SEQ ID NO: 3854866 - RNA, 20 nt, Human
ucacuccuguuacuuaccua

SEQ ID NO: 3854867 - RNA, 15 nt, Human
ucacuccuuuuaaag

SEQ ID NO: 3854868 - RNA, 16 nt, Human
ucacuccuuuuaaaga

SEQ ID NO: 3854869 - RNA, 17 nt, Human
ucacuccuuuuaaagaa

SEQ ID NO: 3854870 - RNA, 18 nt, Human
ucacucgauaauaaagua

SEQ ID NO: 3854871 - RNA, 16 nt, Human
ucacucuaagauguua

SEQ ID NO: 3854872 - RNA, 20 nt, Human
ucacucuacuuagcaugucc

SEQ ID NO: 3854873 - RNA, 18 nt, Human
ucacucuagucaaugaca

SEQ ID NO: 3854874 - RNA, 11 nt, Human
ucacucucagg

SEQ ID NO: 3854875 - RNA, 18 nt, Human
ucacucuccauuuaauaa

SEQ ID NO: 3854876 - RNA, 15 nt, Human
ucacucugaguguuu

SEQ ID NO: 3854877 - RNA, 20 nt, Human
ucacucugaguguuuuauga

SEQ ID NO: 3854878 - RNA, 13 nt, Human
ucacucugccagg

SEQ ID NO: 3854879 - RNA, 20 nt, Human
ucacucugccagggcagugc

SEQ ID NO: 3854880 - RNA, 13 nt, Human
ucacucuggcagc

SEQ ID NO: 3854881 - RNA, 16 nt, Human
ucacucuggcagcuca

SEQ ID NO: 3854882 - RNA, 18 nt, Human
ucacucuggcagcucaga

SEQ ID NO: 3854883 - RNA, 19 nt, Human
ucacucuggcagcucagag

SEQ ID NO: 3854884 - RNA, 13 nt, Human
ucacucuggccuc

SEQ ID NO: 3854885 - RNA, 21 nt, Human
ucacucugggcacacucugcc

SEQ ID NO: 3854886 - RNA, 16 nt, Human
ucacucugucaucuuu

SEQ ID NO: 3854887 - RNA, 19 nt, Human
ucacucugugucugagugg

SEQ ID NO: 3854888 - RNA, 20 nt, Human
ucacucuuaugcuguaccca

SEQ ID NO: 3854889 - RNA, 13 nt, Human
ucacucuucucag

SEQ ID NO: 3854890 - RNA, 14 nt, Human
ucacucuucucagc

SEQ ID NO: 3854891 - RNA, 13 nt, Human
ucacucuuggagc

SEQ ID NO: 3854892 - RNA, 21 nt, Human
ucacucuuuauagugcacaaa

SEQ ID NO: 3854893 - RNA, 17 nt, Human
ucacugaaaacaucugg

SEQ ID NO: 3854894 - RNA, 20 nt, Human
ucacugaaaacaucuggaag

SEQ ID NO: 3854895 - RNA, 22 nt, Human
ucacugaaaauuggacagauug

SEQ ID NO: 3854896 - RNA, 14 nt, Human
ucacugaaacaugg

SEQ ID NO: 3854897 - RNA, 23 nt, Human
ucacugaaacuucaagcaccagg

SEQ ID NO: 3854898 - RNA, 14 nt, Human
ucacugaaauaaaa

SEQ ID NO: 3854899 - RNA, 23 nt, Human
ucacugaaauaaaagcuauauaa

SEQ ID NO: 3854900 - RNA, 21 nt, Human
ucacugaacuuugcugagccu

SEQ ID NO: 3854901 - RNA, 14 nt, Human
ucacugacacaaag

SEQ ID NO: 3854902 - RNA, 15 nt, Human
ucacugagacagccc

SEQ ID NO: 3854903 - RNA, 17 nt, Human
ucacugagacagcccgg

SEQ ID NO: 3854904 - RNA, 21 nt, Human
ucacugagacagcccgggcuc

SEQ ID NO: 3854905 - RNA, 18 nt, Human
ucacugagaccaaggcuu

SEQ ID NO: 3854906 - RNA, 14 nt, Human
ucacugagcacugu

SEQ ID NO: 3854907 - RNA, 18 nt, Human
ucacugagcacuguuuuc

SEQ ID NO: 3854908 - RNA, 22 nt, Human
ucacugagcacuguuuucuagu

SEQ ID NO: 3854909 - RNA, 17 nt, Human
ucacugaguuuuccaug

SEQ ID NO: 3854910 - RNA, 17 nt, Human
ucacugauguacaauua

SEQ ID NO: 3854911 - RNA, 21 nt, Human
ucacugauguacaauuaaaaa

SEQ ID NO: 3854912 - RNA, 17 nt, Human
ucacugcaacaugauga

SEQ ID NO: 3854913 - RNA, 14 nt, Human
ucacugcaaccucc

SEQ ID NO: 3854914 - RNA, 18 nt, Human
ucacugcaaccucuaccu

SEQ ID NO: 3854915 - RNA, 19 nt, Human
ucacugcaaccucugccuc

SEQ ID NO: 3854916 - RNA, 20 nt, Human
ucacugcacagugcaucuca

SEQ ID NO: 3854917 - RNA, 22 nt, Human
ucacugcacagugcaucucagc

SEQ ID NO: 3854918 - RNA, 12 nt, Human
ucacugcagccu

SEQ ID NO: 3854919 - RNA, 13 nt, Human
ucacugcagccuc

SEQ ID NO: 3854920 - RNA, 14 nt, Human
ucacugcagccucc

SEQ ID NO: 3854921 - RNA, 22 nt, Human
ucacugcagccuccgcuucccu

SEQ ID NO: 3854922 - RNA, 23 nt, Human
ucacugcagccuccgcuucccug

SEQ ID NO: 3854923 - RNA, 14 nt, Human
ucacugcagccucg

SEQ ID NO: 3854924 - RNA, 19 nt, Human
ucacugcauccuccgccuc

SEQ ID NO: 3854925 - RNA, 18 nt, Human
ucacugcauuauucucuu

SEQ ID NO: 3854926 - RNA, 15 nt, Human
ucacugccacacucu

SEQ ID NO: 3854927 - RNA, 20 nt, Human
ucacugccacuuugcacauu

SEQ ID NO: 3854928 - RNA, 15 nt, Human
ucacugccaggccag

SEQ ID NO: 3854929 - RNA, 19 nt, Human
ucacugccaggccagccuc

SEQ ID NO: 3854930 - RNA, 18 nt, Human
ucacugcccgcacacccu

SEQ ID NO: 3854931 - RNA, 13 nt, Human
ucacugccucccc

SEQ ID NO: 3854932 - RNA, 14 nt, Human
ucacugccugcaga

SEQ ID NO: 3854933 - RNA, 15 nt, Human
ucacugccugcagag

SEQ ID NO: 3854934 - RNA, 14 nt, Human
ucacugcucccuga

SEQ ID NO: 3854935 - RNA, 18 nt, Human
ucacugcucccugaagcc

SEQ ID NO: 3854936 - RNA, 13 nt, Human
ucacugcuggcug

SEQ ID NO: 3854937 - RNA, 14 nt, Human
ucacugcuggcugc

SEQ ID NO: 3854938 - RNA, 18 nt, Human
ucacugcuggcugccuua

SEQ ID NO: 3854939 - RNA, 22 nt, Human
ucacugcuggcugccuuagaac

SEQ ID NO: 3854940 - RNA, 17 nt, Human
ucacugcuuaacuucac

SEQ ID NO: 3854941 - RNA, 17 nt, Human
ucacugcuuuuggccug

SEQ ID NO: 3854942 - RNA, 18 nt, Human
ucacugcuuuuggccugg

SEQ ID NO: 3854943 - RNA, 19 nt, Human
ucacugcuuuuggccugga

SEQ ID NO: 3854944 - RNA, 17 nt, Human
ucacuggaaaggggaga

SEQ ID NO: 3854945 - RNA, 14 nt, Human
ucacuggagcacaa

SEQ ID NO: 3854946 - RNA, 17 nt, Human
ucacuggagcaccaggc

SEQ ID NO: 3854947 - RNA, 14 nt, Human
ucacuggagcccag

SEQ ID NO: 3854948 - RNA, 11 nt, Human
ucacuggcucu

SEQ ID NO: 3854949 - RNA, 15 nt, Human
ucacuggcucuccaa

SEQ ID NO: 3854950 - RNA, 20 nt, Human
ucacuggcucuccaagugcc

SEQ ID NO: 3854951 - RNA, 18 nt, Human
ucacuggcucuccuggcc

SEQ ID NO: 3854952 - RNA, 15 nt, Human
ucacuggcugccucc

SEQ ID NO: 3854953 - RNA, 18 nt, Human
ucacuggcugccuccacu

SEQ ID NO: 3854954 - RNA, 21 nt, Human
ucacuggcugccuccacuccc

SEQ ID NO: 3854955 - RNA, 21 nt, Human
ucucacggccacacagcugcc

SEQ ID NO: 3854956 - RNA, 20 nt, Human
ucucacgggcaguagcugug

SEQ ID NO: 3854957 - RNA, 13 nt, Human
ucucacuaaacuu

SEQ ID NO: 3854958 - RNA, 16 nt, Human
ucucacuauaccagua

SEQ ID NO: 3854959 - RNA, 16 nt, Human
ucucacuauguugccc

SEQ ID NO: 3854960 - RNA, 17 nt, Human
ucucacuauguugccca

SEQ ID NO: 3854961 - RNA, 21 nt, Human
ucucacuauguugcccaggca

SEQ ID NO: 3854962 - RNA, 23 nt, Human
ucucacuauguugcccaggcagg

SEQ ID NO: 3854963 - RNA, 12 nt, Human
ucucacuccacc

SEQ ID NO: 3854964 - RNA, 13 nt, Human
ucucacuccacca

SEQ ID NO: 3854965 - RNA, 15 nt, Human
ucucacuccaccacc

SEQ ID NO: 3854966 - RNA, 18 nt, Human
ucucacuccaccacccaa

SEQ ID NO: 3854967 - RNA, 12 nt, Human
ucucacucccca

SEQ ID NO: 3854968 - RNA, 13 nt, Human
ucucacuccccau

SEQ ID NO: 3854969 - RNA, 15 nt, Human
ucucacuccccaugc

SEQ ID NO: 3854970 - RNA, 17 nt, Human
ucucacucccuucuccu

SEQ ID NO: 3854971 - RNA, 16 nt, Human
ucucacuccuaccugg

SEQ ID NO: 3854972 - RNA, 17 nt, Human
ucucacuccuaccuggu

SEQ ID NO: 3854973 - RNA, 20 nt, Human
ucucacuccuuuuggugugu

SEQ ID NO: 3854974 - RNA, 23 nt, Human
ucucacuccuuuugguguguugg

SEQ ID NO: 3854975 - RNA, 22 nt, Human
ucucacucugucgcccagucug

SEQ ID NO: 3854976 - RNA, 14 nt, Human
ucucacugcuugaa

SEQ ID NO: 3854977 - RNA, 17 nt, Human
ucucacuguguacauaa

SEQ ID NO: 3854978 - RNA, 17 nt, Human
ucucacuguucccucug

SEQ ID NO: 3854979 - RNA, 21 nt, Human
ucucacuguucccucugcucc

SEQ ID NO: 3854980 - RNA, 14 nt, Human
ucucacuguugccc

SEQ ID NO: 3854981 - RNA, 15 nt, Human
ucucacuguugccca

SEQ ID NO: 3854982 - RNA, 19 nt, Human
ucucacuguugcccaggcu

SEQ ID NO: 3854983 - RNA, 20 nt, Human
ucucacuguugcccaggcug

SEQ ID NO: 3854984 - RNA, 19 nt, Human
uccuuccaaaaauuauuau

SEQ ID NO: 3854985 - RNA, 19 nt, Human
uccuuccaaagaauucuua

SEQ ID NO: 3854986 - RNA, 20 nt, Human
uccuuccaacugcugcccca

SEQ ID NO: 3854987 - RNA, 12 nt, Human
uccuuccaccuc

SEQ ID NO: 3854988 - RNA, 16 nt, Human
uccuuccagcuaguga

SEQ ID NO: 3854989 - RNA, 18 nt, Human
uccuuccaguauaaccag

SEQ ID NO: 3854990 - RNA, 15 nt, Human
uccuuccaucaaaua

SEQ ID NO: 3854991 - RNA, 18 nt, Human
uccuucccaaaggacucc

SEQ ID NO: 3854992 - RNA, 14 nt, Human
uccuucccacucuu

SEQ ID NO: 3854993 - RNA, 18 nt, Human
uccuucccagcugccccu

SEQ ID NO: 3854994 - RNA, 12 nt, Human
uccuucccucuc

SEQ ID NO: 3854995 - RNA, 14 nt, Human
uccuucccucucug

SEQ ID NO: 3854996 - RNA, 12 nt, Human
uccuucccuggg

SEQ ID NO: 3854997 - RNA, 19 nt, Human
uccuucccugugccuccuc

SEQ ID NO: 3854998 - RNA, 15 nt, Human
uccuucccuucucca

SEQ ID NO: 3854999 - RNA, 17 nt, Human
uccuucccuuuucuguu

SEQ ID NO: 3855000 - RNA, 16 nt, Human
uccuuccgcuuggagc

SEQ ID NO: 3855001 - RNA, 23 nt, Human
uccuuccuacacccuuggacuug

SEQ ID NO: 3855002 - RNA, 21 nt, Human
uccuuccucacaccaggcuug

SEQ ID NO: 3855003 - RNA, 10 nt, Human
uccuuccugc

SEQ ID NO: 3855004 - RNA, 15 nt, Human
uccuuccuggccuga

SEQ ID NO: 3855005 - RNA, 18 nt, Human
uccuucuaguuucccaca

SEQ ID NO: 3855006 - RNA, 15 nt, Human
uccuucuauucuagc

SEQ ID NO: 3855007 - RNA, 13 nt, Human
uccuucuccuccu

SEQ ID NO: 3855008 - RNA, 20 nt, Human
uccuucucucaccuccuaaa

SEQ ID NO: 3855009 - RNA, 15 nt, Human
uccuucucugaacac

SEQ ID NO: 3855010 - RNA, 18 nt, Human
uccuucucugaacacagg

SEQ ID NO: 3855011 - RNA, 24 nt, Human
uccuucugagcccgguaagagcaa

SEQ ID NO: 3855012 - RNA, 16 nt, Human
uccuucugagcuccug

SEQ ID NO: 3855013 - RNA, 18 nt, Human
uccuucugagcuccuguc

SEQ ID NO: 3855014 - RNA, 15 nt, Human
uccuucugccuuuuu

SEQ ID NO: 3855015 - RNA, 21 nt, Human
uccuucuggcagauucaaauc

SEQ ID NO: 3855016 - RNA, 20 nt, Human
uccuucuggccuuuccucuc

SEQ ID NO: 3855017 - RNA, 19 nt, Human
uccuucuguccuacucugu

SEQ ID NO: 3855018 - RNA, 17 nt, Human
uccuucuugccuucaga

SEQ ID NO: 3855019 - RNA, 13 nt, Human
uccuucuuugaua

SEQ ID NO: 3855020 - RNA, 19 nt, Human
uccuucuuugauaauguua

SEQ ID NO: 3855021 - RNA, 13 nt, Human
uccuucuuugccc

SEQ ID NO: 3855022 - RNA, 15 nt, Human
uccuucuuugggaua

SEQ ID NO: 3855023 - RNA, 20 nt, Human
uccuugaagaacugcaggcc

SEQ ID NO: 3855024 - RNA, 12 nt, Human
uccuugaagccg

SEQ ID NO: 3855025 - RNA, 13 nt, Human
uccuugaagguau

SEQ ID NO: 3855026 - RNA, 19 nt, Human
uccuugaauaucuuucgau

SEQ ID NO: 3855027 - RNA, 20 nt, Human
uccuugaccugcauuguaaa

SEQ ID NO: 3855028 - RNA, 14 nt, Human
uccuugaccuuccu

SEQ ID NO: 3855029 - RNA, 23 nt, Human
uccuugagacacggagcccagcc

SEQ ID NO: 3855030 - RNA, 16 nt, Human
uccuugagagaccagg

SEQ ID NO: 3855031 - RNA, 16 nt, Human
uccuugagugcucuug

SEQ ID NO: 3855032 - RNA, 13 nt, Human
uccuugauaacag

SEQ ID NO: 3855033 - RNA, 16 nt, Human
uccuugaucuguauau

SEQ ID NO: 3855034 - RNA, 22 nt, Human
uccuugauuuaucacacaaagc

SEQ ID NO: 3855035 - RNA, 21 nt, Human
uccuugcaagguuaagcaagg

SEQ ID NO: 3855036 - RNA, 14 nt, Human
uccuugcaccccuc

SEQ ID NO: 3855037 - RNA, 15 nt, Human
uccuugcaccccuca

SEQ ID NO: 3855038 - RNA, 22 nt, Human
uccuugcaccccucacucuggc

SEQ ID NO: 3855039 - RNA, 22 nt, Human
uccuugcaucaaggggucacuu

SEQ ID NO: 3855040 - RNA, 17 nt, Human
uccuugcaucaauuuuu

SEQ ID NO: 3855041 - RNA, 16 nt, Human
uccuugccuccugugu

SEQ ID NO: 3855042 - RNA, 17 nt, Human
uccuugcuccuggccuu

SEQ ID NO: 3855043 - RNA, 14 nt, Human
uccuugcucugcac

SEQ ID NO: 3855044 - RNA, 19 nt, Human
uccuugcuguccuaggcca

SEQ ID NO: 3855045 - RNA, 17 nt, Human
uccuugcuuccugucuu

SEQ ID NO: 3855046 - RNA, 15 nt, Human
uccuugcuuguuaca

SEQ ID NO: 3855047 - RNA, 20 nt, Human
uccuuggaaaucaaauguaa

SEQ ID NO: 3855048 - RNA, 16 nt, Human
uccuuggaaguuucau

SEQ ID NO: 3855049 - RNA, 16 nt, Human
uccuuggacucauuuu

SEQ ID NO: 3855050 - RNA, 19 nt, Human
uccuuggagaaaugaaaac

SEQ ID NO: 3855051 - RNA, 21 nt, Human
uccuuggcaggcugauuucua

SEQ ID NO: 3855052 - RNA, 10 nt, Human
uccuuggccu

SEQ ID NO: 3855053 - RNA, 23 nt, Human
uccuuggccuagcccacccugcu

SEQ ID NO: 3855054 - RNA, 14 nt, Human
uccuugggaggaag

SEQ ID NO: 3855055 - RNA, 20 nt, Human
uccuugggaggaagcagaau

SEQ ID NO: 3855056 - RNA, 20 nt, Human
uccuugggaggccccacugg

SEQ ID NO: 3855057 - RNA, 13 nt, Human
uccuugggcacuu

SEQ ID NO: 3855058 - RNA, 14 nt, Human
ucccugggccugcu

SEQ ID NO: 3855059 - RNA, 15 nt, Human
ucccugggccugcug

SEQ ID NO: 3855060 - RNA, 17 nt, Human
ucccugggccugcugcu

SEQ ID NO: 3855061 - RNA, 20 nt, Human
ucccugggccugcugcugag

SEQ ID NO: 3855062 - RNA, 15 nt, Human
ucccugggcugugcu

SEQ ID NO: 3855063 - RNA, 20 nt, Human
ucccugggggaagcccugga

SEQ ID NO: 3855064 - RNA, 14 nt, Human
ucccuggggugggg

SEQ ID NO: 3855065 - RNA, 17 nt, Human
ucccugguaagaaaaag

SEQ ID NO: 3855066 - RNA, 19 nt, Human
ucccuggugagagggccgg

SEQ ID NO: 3855067 - RNA, 18 nt, Human
ucccugguggcagcucac

SEQ ID NO: 3855068 - RNA, 21 nt, Human
ucccugguggcagcucaccuc

SEQ ID NO: 3855069 - RNA, 22 nt, Human
ucccugguggcagcucaccucu

SEQ ID NO: 3855070 - RNA, 18 nt, Human
ucccugguucaagcgauu

SEQ ID NO: 3855071 - RNA, 12 nt, Human
ucccugguucug

SEQ ID NO: 3855072 - RNA, 15 nt, Human
ucccuguaacuugau

SEQ ID NO: 3855073 - RNA, 22 nt, Human
ucccugucaccaagcucacagu

SEQ ID NO: 3855074 - RNA, 15 nt, Human
ucccugucaccucuu

SEQ ID NO: 3855075 - RNA, 12 nt, Human
ucccuguccacc

SEQ ID NO: 3855076 - RNA, 13 nt, Human
ucccuguccaccc

SEQ ID NO: 3855077 - RNA, 14 nt, Human
ucccugucccucua

SEQ ID NO: 3855078 - RNA, 12 nt, Human
ucccuguccucc

SEQ ID NO: 3855079 - RNA, 14 nt, Human
ucccuguccuccuc

SEQ ID NO: 3855080 - RNA, 15 nt, Human
ucccuguccuccucg

SEQ ID NO: 3855081 - RNA, 17 nt, Human
ucccugucuuuccuaag

SEQ ID NO: 3855082 - RNA, 16 nt, Human
ucccugugccuccucc

SEQ ID NO: 3855083 - RNA, 19 nt, Human
ucccugugccuccucccuc

SEQ ID NO: 3855084 - RNA, 16 nt, Human
ucccugugucauuuca

SEQ ID NO: 3855085 - RNA, 20 nt, Human
ucccuguguccaccuguggg

SEQ ID NO: 3855086 - RNA, 22 nt, Human
ucccuguguccaccugugggug

SEQ ID NO: 3855087 - RNA, 15 nt, Human
ucccuguuauuuuca

SEQ ID NO: 3855088 - RNA, 21 nt, Human
ucccuguuauuuucaaguagc

SEQ ID NO: 3855089 - RNA, 23 nt, Human
ucccuguuauuuucaaguagcug

SEQ ID NO: 3855090 - RNA, 15 nt, Human
ucccuguucuuccuc

SEQ ID NO: 3855091 - RNA, 21 nt, Human
ucccuguugacgaagucucuu

SEQ ID NO: 3855092 - RNA, 18 nt, Human
ucccuguuggucgguggg

SEQ ID NO: 3855093 - RNA, 14 nt, Human
ucccuguuuaauau

SEQ ID NO: 3855094 - RNA, 15 nt, Human
ucccuguuuaauauu

SEQ ID NO: 3855095 - RNA, 21 nt, Human
ucccuguuuaauauuuaaaca

SEQ ID NO: 3855096 - RNA, 19 nt, Human
ucccuguuugaagccugcc

SEQ ID NO: 3855097 - RNA, 20 nt, Human
ucccuguuugaagccugccc

SEQ ID NO: 3855098 - RNA, 11 nt, Human
ucccuguuuuc

SEQ ID NO: 3855099 - RNA, 19 nt, Human
ucccuguuuuccccccaag

SEQ ID NO: 3855100 - RNA, 15 nt, Human
ucccuguuuucugag

SEQ ID NO: 3855101 - RNA, 18 nt, Human
ucccuuaagaaugaguuu

SEQ ID NO: 3855102 - RNA, 22 nt, Human
ucccuuaagaaugaguuucuua

SEQ ID NO: 3855103 - RNA, 20 nt, Human
ucccuuaagggguaucaugu

SEQ ID NO: 3855104 - RNA, 10 nt, Human
ucccuuaccc

SEQ ID NO: 3855105 - RNA, 22 nt, Human
ucccuuacgugaguccuggcau

SEQ ID NO: 3855106 - RNA, 21 nt, Human
ucccuucaaccauuccccaug

SEQ ID NO: 3855107 - RNA, 14 nt, Human
ucccuucagccccc

SEQ ID NO: 3855108 - RNA, 21 nt, Human
ucccuucaguacccucucagc

SEQ ID NO: 3855109 - RNA, 23 nt, Human
ucccuucaguacccucucagcuc

SEQ ID NO: 3855110 - RNA, 17 nt, Human
ucccuucaugcauggaa

SEQ ID NO: 3855111 - RNA, 18 nt, Human
ucccuucaugcauggaaa

SEQ ID NO: 3855112 - RNA, 16 nt, Human
ucccuuccacaccccc

SEQ ID NO: 3855113 - RNA, 20 nt, Human
ucccuuccaccugcucugcu

SEQ ID NO: 3855114 - RNA, 20 nt, Human
ucccuuccacugccucugcc

SEQ ID NO: 3855115 - RNA, 22 nt, Human
ucccuuccagauggucauccag

SEQ ID NO: 3855116 - RNA, 22 nt, Human
ucccuuccaguuuauuccagag

SEQ ID NO: 3855117 - RNA, 17 nt, Human
ucccuucccaccucucu

SEQ ID NO: 3855118 - RNA, 21 nt, Human
ucccuucccacuggaggcaug

SEQ ID NO: 3855119 - RNA, 22 nt, Human
ucccuucccaugacccaggcug

SEQ ID NO: 3855120 - RNA, 17 nt, Human
ucccuucccccauaagc

SEQ ID NO: 3855121 - RNA, 12 nt, Human
ucccuuccccuc

SEQ ID NO: 3855122 - RNA, 20 nt, Human
ucccuucccuaaagugaugg

SEQ ID NO: 3855123 - RNA, 13 nt, Human
ucccuucccuccu

SEQ ID NO: 3855124 - RNA, 16 nt, Human
ucccuucccuccuccc

SEQ ID NO: 3855125 - RNA, 17 nt, Human
ucccuucccuuccacug

SEQ ID NO: 3855126 - RNA, 21 nt, Human
ucccuuccgacccucugggaa

SEQ ID NO: 3855127 - RNA, 14 nt, Human
ucccuuccuauucc

SEQ ID NO: 3855128 - RNA, 12 nt, Human
ucccuuccucuu

SEQ ID NO: 3855129 - RNA, 15 nt, Human
ucccuuccugccagc

SEQ ID NO: 3855130 - RNA, 16 nt, Human
ucccuuccuuccucuc

SEQ ID NO: 3855131 - RNA, 19 nt, Human
ucccuuccuuccucuccug

SEQ ID NO: 3855132 - RNA, 19 nt, Human
ucccuuccuuuucccugcu

SEQ ID NO: 3855133 - RNA, 16 nt, Human
ucccuucucacagcac

SEQ ID NO: 3855134 - RNA, 13 nt, Human
ucccuucuccuuc

SEQ ID NO: 3855135 - RNA, 14 nt, Human
ucccuucucuucca

SEQ ID NO: 3855136 - RNA, 15 nt, Human
ucccuucugcuacug

SEQ ID NO: 3855137 - RNA, 20 nt, Human
ucccuucugcuacuggcaaa

SEQ ID NO: 3855138 - RNA, 16 nt, Human
ucccuucuucugucau

SEQ ID NO: 3855139 - RNA, 23 nt, Human
ucccuucuugcauccuuccuaua

SEQ ID NO: 3855140 - RNA, 13 nt, Human
ucccuucuugguu

SEQ ID NO: 3855141 - RNA, 17 nt, Human
ucccuucuuuuucuucu

SEQ ID NO: 3855142 - RNA, 21 nt, Human
ucccuugaccaggccugggcc

SEQ ID NO: 3855143 - RNA, 22 nt, Human
ucccuugaugcacagagaagcu

SEQ ID NO: 3855144 - RNA, 21 nt, Human
ucccuugccauccuaaaagcc

SEQ ID NO: 3855145 - RNA, 15 nt, Human
ucccuugcuggcccc

SEQ ID NO: 3855146 - RNA, 17 nt, Human
ucccuugcuggccccag

SEQ ID NO: 3855147 - RNA, 23 nt, Human
ucccuugcuggccccagcccugc

SEQ ID NO: 3855148 - RNA, 23 nt, Human
ucccuugcuugccugcagggcca

SEQ ID NO: 3855149 - RNA, 21 nt, Human
ucccuugcuuuucccucuuuu

SEQ ID NO: 3855150 - RNA, 22 nt, Human
ucccuugcuuuucccucuuuuc

SEQ ID NO: 3855151 - RNA, 19 nt, Human
ucccuuggaaaccugcccu

SEQ ID NO: 3855152 - RNA, 23 nt, Human
ucccuuggaaaccugcccugccu

SEQ ID NO: 3855153 - RNA, 15 nt, Human
ucccuuggacauuuu

SEQ ID NO: 3855154 - RNA, 19 nt, Human
ucccuuggacauuuuaugu

SEQ ID NO: 3855155 - RNA, 21 nt, Human
ucccuuggacauuuuaugucu

SEQ ID NO: 3855156 - RNA, 19 nt, Human
ucccuuggauuguccccga

SEQ ID NO: 3855157 - RNA, 12 nt, Human
ucccuuggccuc

SEQ ID NO: 3855158 - RNA, 13 nt, Human
ucccuuggccuca

SEQ ID NO: 3855159 - RNA, 16 nt, Human
ucccuuggccucagaa

SEQ ID NO: 3855160 - RNA, 14 nt, Human
ucccuugggcuccc

SEQ ID NO: 3855161 - RNA, 16 nt, Human
ucccuuguagcuccuc

SEQ ID NO: 3855162 - RNA, 16 nt, Human
ucccuuguggcccucu

SEQ ID NO: 3855163 - RNA, 13 nt, Human
ucccuuguucucu

SEQ ID NO: 3855164 - RNA, 15 nt, Human
ucccuuuccccagca

SEQ ID NO: 3855165 - RNA, 17 nt, Human
ucccuuuccuuccaucc

SEQ ID NO: 3855166 - RNA, 19 nt, Human
ucccuuuccuuccaucccu

SEQ ID NO: 3855167 - RNA, 16 nt, Human
ucccuuuccuuccuaa

SEQ ID NO: 3855168 - RNA, 17 nt, Human
ucccuuuccuuccuaau

SEQ ID NO: 3855169 - RNA, 15 nt, Human
ucccuuucuccccug

SEQ ID NO: 3855170 - RNA, 17 nt, Human
ucccuuucuccccugcc

SEQ ID NO: 3855171 - RNA, 13 nt, Human
ucccuuucuuggc

SEQ ID NO: 3855172 - RNA, 17 nt, Human
ucccuuucuuggccagu

SEQ ID NO: 3855173 - RNA, 19 nt, Human
ucccuuugacgccauccca

SEQ ID NO: 3855174 - RNA, 21 nt, Human
ucccuuugacgccaucccagc

SEQ ID NO: 3855175 - RNA, 17 nt, Human
ucccuuugcccagaaag

SEQ ID NO: 3855176 - RNA, 12 nt, Human
ucccuuugcucc

SEQ ID NO: 3855177 - RNA, 14 nt, Human
ucccuuugcuccac

SEQ ID NO: 3855178 - RNA, 20 nt, Human
ucccuuugcuccaccccacu

SEQ ID NO: 3855179 - RNA, 22 nt, Human
ucccuuugcuccaccccacuca

SEQ ID NO: 3855180 - RNA, 18 nt, Human
ucccuuugucuuucaaac

SEQ ID NO: 3855181 - RNA, 18 nt, Human
ucccuuuuaaacacauuu

SEQ ID NO: 3855182 - RNA, 13 nt, Human
ucccuuuuacaua

SEQ ID NO: 3855183 - RNA, 19 nt, Human
ucccuuuuacauacugcug

SEQ ID NO: 3855184 - RNA, 20 nt, Human
ucccuuuuacauacugcugu

SEQ ID NO: 3855185 - RNA, 13 nt, Human
ucccuuuucuguu

SEQ ID NO: 3855186 - RNA, 15 nt, Human
ucccuuuugcaucau

SEQ ID NO: 3855187 - RNA, 20 nt, Human
ucccuuuuucauaaauuauu

SEQ ID NO: 3855188 - RNA, 14 nt, Human
ucccuuuuuccuug

SEQ ID NO: 3855189 - RNA, 15 nt, Human
ucccuuuuuccuugu

SEQ ID NO: 3855190 - RNA, 21 nt, Human
ucccuuuuuccuuguccccac

SEQ ID NO: 3855191 - RNA, 22 nt, Human
ucccuuuuuuggcugcugaagg

SEQ ID NO: 3855192 - RNA, 14 nt, Human
uccgaaaucagcag

SEQ ID NO: 3855193 - RNA, 20 nt, Human
uccgaaaugcugucuuucuu

SEQ ID NO: 3855194 - RNA, 16 nt, Human
uccgaaccuccucugu

SEQ ID NO: 3855195 - RNA, 20 nt, Human
uccgaccacuaauugccaag

SEQ ID NO: 3855196 - RNA, 18 nt, Human
uccgaccacuuccagggg

SEQ ID NO: 3855197 - RNA, 13 nt, Human
uccgaccagacac

SEQ ID NO: 3855198 - RNA, 15 nt, Human
uccgacccucuggga

SEQ ID NO: 3855199 - RNA, 17 nt, Human
uccgacccucugggaac

SEQ ID NO: 3855200 - RNA, 21 nt, Human
uccgacccucugggaaccucc

SEQ ID NO: 3855201 - RNA, 21 nt, Human
ucuaaacguaagcacuguuuu

SEQ ID NO: 3855202 - RNA, 13 nt, Human
ucuaaacugcccc

SEQ ID NO: 3855203 - RNA, 19 nt, Human
ucuaaacuggagacugugu

SEQ ID NO: 3855204 - RNA, 13 nt, Human
ucuaaagaccaaa

SEQ ID NO: 3855205 - RNA, 18 nt, Human
ucuaaagaccaaacuuca

SEQ ID NO: 3855206 - RNA, 12 nt, Human
ucuaaagagcac

SEQ ID NO: 3855207 - RNA, 12 nt, Human
ucuaaagagcau

SEQ ID NO: 3855208 - RNA, 14 nt, Human
ucuaaagagcaucu

SEQ ID NO: 3855209 - RNA, 21 nt, Human
ucuaaagauggaguuucuaag

SEQ ID NO: 3855210 - RNA, 13 nt, Human
ucuaaagcugcca

SEQ ID NO: 3855211 - RNA, 15 nt, Human
ucuaaagcugccagc

SEQ ID NO: 3855212 - RNA, 17 nt, Human
ucuaaaggaguuuaugu

SEQ ID NO: 3855213 - RNA, 17 nt, Human
ucuaaaggcuaccuuug

SEQ ID NO: 3855214 - RNA, 18 nt, Human
ucuaaaggcuaccuuugu

SEQ ID NO: 3855215 - RNA, 17 nt, Human
ucuaaagguccacaggu

SEQ ID NO: 3855216 - RNA, 23 nt, Human
ucuaaagguccacaggucuagac

SEQ ID NO: 3855217 - RNA, 18 nt, Human
ucuaaagguggugaggca

SEQ ID NO: 3855218 - RNA, 17 nt, Human
ucuaaaguaauugguua

SEQ ID NO: 3855219 - RNA, 12 nt, Human
ucuaaaguuaua

SEQ ID NO: 3855220 - RNA, 15 nt, Human
ucuaaaguucuaaga

SEQ ID NO: 3855221 - RNA, 16 nt, Human
ucuaaaguucuaagau

SEQ ID NO: 3855222 - RNA, 19 nt, Human
ucuaaaguucuaagauucu

SEQ ID NO: 3855223 - RNA, 21 nt, Human
ucuaaaguucuaagauucuga

SEQ ID NO: 3855224 - RNA, 13 nt, Human
ucuaaaguuuaca

SEQ ID NO: 3855225 - RNA, 15 nt, Human
ucuaaauaaaauaua

SEQ ID NO: 3855226 - RNA, 13 nt, Human
ucuaaauagccaa

SEQ ID NO: 3855227 - RNA, 21 nt, Human
ucuaaauagccaacacccauc

SEQ ID NO: 3855228 - RNA, 20 nt, Human
ucuaaauaucccuuggacau

SEQ ID NO: 3855229 - RNA, 17 nt, Human
ucuaaauauucagaauc

SEQ ID NO: 3855230 - RNA, 13 nt, Human
ucuaaauauuucc

SEQ ID NO: 3855231 - RNA, 17 nt, Human
ucuaaaucauauauaau

SEQ ID NO: 3855232 - RNA, 16 nt, Human
ucuaaaucuauuuauu

SEQ ID NO: 3855233 - RNA, 22 nt, Human
ucuaaaucuccaaaauaaaacu

SEQ ID NO: 3855234 - RNA, 23 nt, Human
ucuaaaugggaaaguauucugua

SEQ ID NO: 3855235 - RNA, 21 nt, Human
ucuaaauguuuggcauguaaa

SEQ ID NO: 3855236 - RNA, 20 nt, Human
ucuaaauuaaagccuuuagu

SEQ ID NO: 3855237 - RNA, 20 nt, Human
ucuaaauucuuuauuucugu

SEQ ID NO: 3855238 - RNA, 14 nt, Human
ucuaaauugaauaa

SEQ ID NO: 3855239 - RNA, 22 nt, Human
ucuaaauuugaauguuaagcag

SEQ ID NO: 3855240 - RNA, 12 nt, Human
ucuaacaaguca

SEQ ID NO: 3855241 - RNA, 23 nt, Human
ucuaacaagucauagguuaauau

SEQ ID NO: 3855242 - RNA, 12 nt, Human
ucuaacagcccu

SEQ ID NO: 3855243 - RNA, 21 nt, Human
ucuaacagcccuccucugcac

SEQ ID NO: 3855244 - RNA, 17 nt, Human
ucuaacagcucaggauc

SEQ ID NO: 3855245 - RNA, 19 nt, Human
ucuaacagcucaggaucuc

SEQ ID NO: 3855246 - RNA, 16 nt, Human
ucuaacaggggcuggu

SEQ ID NO: 3855247 - RNA, 15 nt, Human
ucuaaccaaaugcau

SEQ ID NO: 3855248 - RNA, 17 nt, Human
ucuaaccacagcuccuu

SEQ ID NO: 3855249 - RNA, 18 nt, Human
ucuaaccagagcaagcuu

SEQ ID NO: 3855250 - RNA, 14 nt, Human
ucuaacccucccau

SEQ ID NO: 3855251 - RNA, 20 nt, Human
ucuaaccuugaaugcugcca

SEQ ID NO: 3855252 - RNA, 21 nt, Human
ucuaaccuugaaugcugccag

SEQ ID NO: 3855253 - RNA, 22 nt, Human
ucuaaccuuuacaugaggacuc

SEQ ID NO: 3855254 - RNA, 15 nt, Human
ucuaacgccugagcc

SEQ ID NO: 3855255 - RNA, 17 nt, Human
ucuaacuacaaagguuu

SEQ ID NO: 3855256 - RNA, 19 nt, Human
ucuaacuagaaaucugcca

SEQ ID NO: 3855257 - RNA, 13 nt, Human
ucuaacucagcaa

SEQ ID NO: 3855258 - RNA, 17 nt, Human
ucuaacucugauguaaa

SEQ ID NO: 3855259 - RNA, 17 nt, Human
ucuaacugugcucaaga

SEQ ID NO: 3855260 - RNA, 13 nt, Human
ucuaagaaacauu

SEQ ID NO: 3855261 - RNA, 23 nt, Human
ucuaagaaacauuggaagcaggu

SEQ ID NO: 3855262 - RNA, 17 nt, Human
ucuaagaaacauuuaua

SEQ ID NO: 3855263 - RNA, 18 nt, Human
ucuaagaaacauuuauau

SEQ ID NO: 3855264 - RNA, 12 nt, Human
ucuaagaaagaa

SEQ ID NO: 3855265 - RNA, 13 nt, Human
ucuaagaaagaac

SEQ ID NO: 3855266 - RNA, 13 nt, Human
ucuaagaaaucaa

SEQ ID NO: 3855267 - RNA, 19 nt, Human
ucuaagaaauugaauacuu

SEQ ID NO: 3855268 - RNA, 16 nt, Human
ucuaagacuauauaua

SEQ ID NO: 3855269 - RNA, 21 nt, Human
ucuaagacuauauauauaaau

SEQ ID NO: 3855270 - RNA, 23 nt, Human
ucuaagacuauauauauaaaugu

SEQ ID NO: 3855271 - RNA, 16 nt, Human
ucuaagacucaaaugu

SEQ ID NO: 3855272 - RNA, 19 nt, Human
ucuaagacucaaauguucu

SEQ ID NO: 3855273 - RNA, 19 nt, Human
ucuaagacuuacucuaaga

SEQ ID NO: 3855274 - RNA, 20 nt, Human
ucuaagagaacaaugugcua

SEQ ID NO: 3855275 - RNA, 17 nt, Human
ucuaagaucuuagauuc

SEQ ID NO: 3855276 - RNA, 19 nt, Human
ucuaagaugugauauucua

SEQ ID NO: 3855277 - RNA, 24 nt, Human
ucuaagaugugauauucuaagacu

SEQ ID NO: 3855278 - RNA, 12 nt, Human
ucuaagauguua

SEQ ID NO: 3855279 - RNA, 21 nt, Human
ucuaagauucauccauuuauu

SEQ ID NO: 3855280 - RNA, 12 nt, Human
ucuaagauucua

SEQ ID NO: 3855281 - RNA, 15 nt, Human
ucuaagauucuaaag

SEQ ID NO: 3855282 - RNA, 17 nt, Human
ucuaagauucuaaugau

SEQ ID NO: 3855283 - RNA, 20 nt, Human
ucuaagauucuaaugaugau

SEQ ID NO: 3855284 - RNA, 15 nt, Human
ucuaagauucuagau

SEQ ID NO: 3855285 - RNA, 16 nt, Human
ucuaagauucuagauc

SEQ ID NO: 3855286 - RNA, 19 nt, Human
ucuaagauucuagaucaga

SEQ ID NO: 3855287 - RNA, 14 nt, Human
ucuaagccugaagg

SEQ ID NO: 3855288 - RNA, 15 nt, Human
ucuaagcugcagcuu

SEQ ID NO: 3855289 - RNA, 17 nt, Human
ucuaaggaccugaaauu

SEQ ID NO: 3855290 - RNA, 23 nt, Human
ucuaaggaccugaaauuccaaag

SEQ ID NO: 3855291 - RNA, 19 nt, Human
ucuaaggaugucacagggc

SEQ ID NO: 3855292 - RNA, 18 nt, Human
ucuaaggccuaggauucu

SEQ ID NO: 3855293 - RNA, 19 nt, Human
ucuaaggccuaggauucua

SEQ ID NO: 3855294 - RNA, 13 nt, Human
ucuaaggcucuga

SEQ ID NO: 3855295 - RNA, 14 nt, Human
ucuaaguaaaacca

SEQ ID NO: 3855296 - RNA, 15 nt, Human
ucuaaguaaaaccac

SEQ ID NO: 3855297 - RNA, 22 nt, Human
ucuaaguaaaaccacagcaguu

SEQ ID NO: 3855298 - RNA, 19 nt, Human
ucuaaguaaauacaauuuu

SEQ ID NO: 3855299 - RNA, 19 nt, Human
ucuaagucaauccaagagu

SEQ ID NO: 3855300 - RNA, 15 nt, Human
ucuaagucauguaug

SEQ ID NO: 3855301 - RNA, 18 nt, Human
ucuaagugccucacauuu

SEQ ID NO: 3855302 - RNA, 14 nt, Human
ucuaaguguuugcu

SEQ ID NO: 3855303 - RNA, 14 nt, Human
ucuaaguuaauuua

SEQ ID NO: 3855304 - RNA, 17 nt, Human
ucuaaguuccacugagc

SEQ ID NO: 3855305 - RNA, 19 nt, Human
ucuaaguugaguauauuau

SEQ ID NO: 3855306 - RNA, 12 nt, Human
ucuaaguuucua

SEQ ID NO: 3855307 - RNA, 13 nt, Human
ucuaaguuucuaa

SEQ ID NO: 3855308 - RNA, 20 nt, Human
ucuaaguuucuaagauucua

SEQ ID NO: 3855309 - RNA, 22 nt, Human
ucuaaguuucuaagauucuaaa

SEQ ID NO: 3855310 - RNA, 22 nt, Human
ucuaaguuuuaggguacaugug

SEQ ID NO: 3855311 - RNA, 23 nt, Human
ucuaaguuuuaggguacaugugc

SEQ ID NO: 3855312 - RNA, 13 nt, Human
ucuaauaaauuau

SEQ ID NO: 3855313 - RNA, 14 nt, Human
ucuaauaauaaaua

SEQ ID NO: 3855314 - RNA, 15 nt, Human
ucuaauaauaaauag

SEQ ID NO: 3855315 - RNA, 15 nt, Human
ucuaauaauuucuaa

SEQ ID NO: 3855316 - RNA, 16 nt, Human
ucuaauaccucugugu

SEQ ID NO: 3855317 - RNA, 21 nt, Human
ucuaauagcggguuacuuuca

SEQ ID NO: 3855318 - RNA, 17 nt, Human
ucuaauaguauaaaccc

SEQ ID NO: 3855319 - RNA, 16 nt, Human
ucuaauauauccacac

SEQ ID NO: 3855320 - RNA, 17 nt, Human
ucuaauaucauucacua

SEQ ID NO: 3855321 - RNA, 20 nt, Human
ucuaauaucccagaaaaagu

SEQ ID NO: 3855322 - RNA, 22 nt, Human
ucuaauauuuauugcuuuauaa

SEQ ID NO: 3855323 - RNA, 12 nt, Human
ucuaaucaaaag

SEQ ID NO: 3855324 - RNA, 17 nt, Human
ucuaaucgaaagaaaau

SEQ ID NO: 3855325 - RNA, 20 nt, Human
ucuaaucgaaagaaaauggg

SEQ ID NO: 3855326 - RNA, 19 nt, Human
ucuaaugacauucaauaaa

SEQ ID NO: 3855327 - RNA, 22 nt, Human
acuaacacuauuuuaugcaaau

SEQ ID NO: 3855328 - RNA, 21 nt, Human
acuaacacucagaagccuggg

SEQ ID NO: 3855329 - RNA, 17 nt, Human
acuaacagauaagcaag

SEQ ID NO: 3855330 - RNA, 18 nt, Human
acuaacaggccaaagagu

SEQ ID NO: 3855331 - RNA, 13 nt, Human
acuaaccacgcug

SEQ ID NO: 3855332 - RNA, 16 nt, Human
acuaaccagcagaaau

SEQ ID NO: 3855333 - RNA, 13 nt, Human
acuaaccugaccg

SEQ ID NO: 3855334 - RNA, 15 nt, Human
acuaaccuggguucc

SEQ ID NO: 3855335 - RNA, 22 nt, Human
acuaaccuugccugguacagua

SEQ ID NO: 3855336 - RNA, 18 nt, Human
acuaacguugagccccug

SEQ ID NO: 3855337 - RNA, 22 nt, Human
acuaacuaaaacaaagccacuu

SEQ ID NO: 3855338 - RNA, 14 nt, Human
acuaacuaaacucu

SEQ ID NO: 3855339 - RNA, 23 nt, Human
acuaacuagagcagcccuggagu

SEQ ID NO: 3855340 - RNA, 23 nt, Human
acuaacuaugcauggugccccag

SEQ ID NO: 3855341 - RNA, 15 nt, Human
acuaacucaaauaca

SEQ ID NO: 3855342 - RNA, 18 nt, Human
acuaacuucuaaaacugu

SEQ ID NO: 3855343 - RNA, 14 nt, Human
acuaagaaaagaua

SEQ ID NO: 3855344 - RNA, 13 nt, Human
acuaagaaacuuu

SEQ ID NO: 3855345 - RNA, 14 nt, Human
acuaagaaacuuuu

SEQ ID NO: 3855346 - RNA, 13 nt, Human
acuaagaagaaaa

SEQ ID NO: 3855347 - RNA, 16 nt, Human
acuaagagaaguugua

SEQ ID NO: 3855348 - RNA, 21 nt, Human
acuaagaucgguuaacaaaua

SEQ ID NO: 3855349 - RNA, 18 nt, Human
acuaagaugacauugcua

SEQ ID NO: 3855350 - RNA, 21 nt, Human
acuaagauucuuuuaaauuag

SEQ ID NO: 3855351 - RNA, 18 nt, Human
acuaagccacaagaaauu

SEQ ID NO: 3855352 - RNA, 18 nt, Human
acuaagcccugucgagac

SEQ ID NO: 3855353 - RNA, 21 nt, Human
acuaagcuuugccagcugcug

SEQ ID NO: 3855354 - RNA, 20 nt, Human
acuaaggaguaaucugugua

SEQ ID NO: 3855355 - RNA, 21 nt, Human
acuaaggggcccggccagcca

SEQ ID NO: 3855356 - RNA, 15 nt, Human
acuaagucucuuuuu

SEQ ID NO: 3855357 - RNA, 23 nt, Human
acuaagucucuuuuuuacaaagg

SEQ ID NO: 3855358 - RNA, 18 nt, Human
acuaaguuauaguauauc

SEQ ID NO: 3855359 - RNA, 14 nt, Human
acuaauaaaauauu

SEQ ID NO: 3855360 - RNA, 16 nt, Human
acuaauaaaauauuuu

SEQ ID NO: 3855361 - RNA, 19 nt, Human
acuaauaaaauauuuucug

SEQ ID NO: 3855362 - RNA, 19 nt, Human
acuaauaaacuaauaauug

SEQ ID NO: 3855363 - RNA, 23 nt, Human
acuaauaaucuuguuucugaaaa

SEQ ID NO: 3855364 - RNA, 14 nt, Human
acuaauaauugcag

SEQ ID NO: 3855365 - RNA, 17 nt, Human
acuaauagaauaaaggc

SEQ ID NO: 3855366 - RNA, 20 nt, Human
acuaauagaauaaaggcagu

SEQ ID NO: 3855367 - RNA, 20 nt, Human
acuaauauauuuaaaaauaa

SEQ ID NO: 3855368 - RNA, 13 nt, Human
acuaauauuucug

SEQ ID NO: 3855369 - RNA, 19 nt, Human
acuaauauuuuaugugaga

SEQ ID NO: 3855370 - RNA, 22 nt, Human
acuaaugaccacaccugccucu

SEQ ID NO: 3855371 - RNA, 13 nt, Human
acuaaugauguuu

SEQ ID NO: 3855372 - RNA, 15 nt, Human
acuaaugcaaacugg

SEQ ID NO: 3855373 - RNA, 12 nt, Human
acuaauggcaug

SEQ ID NO: 3855374 - RNA, 16 nt, Human
acuaauggcaugagaa

SEQ ID NO: 3855375 - RNA, 18 nt, Human
acuaauggggcggugaga

SEQ ID NO: 3855376 - RNA, 16 nt, Human
acuaauuaacauauaa

SEQ ID NO: 3855377 - RNA, 13 nt, Human
acuaauuccacac

SEQ ID NO: 3855378 - RNA, 17 nt, Human
acuaauuguauaacagg

SEQ ID NO: 3855379 - RNA, 19 nt, Human
acuaauuguauaacagguu

SEQ ID NO: 3855380 - RNA, 22 nt, Human
acuaauuguauaacagguuauu

SEQ ID NO: 3855381 - RNA, 15 nt, Human
acuaauuuaaaaaau

SEQ ID NO: 3855382 - RNA, 20 nt, Human
acuaauuucaaaaugcuuuu

SEQ ID NO: 3855383 - RNA, 18 nt, Human
acuacaaagguuuaaaug

SEQ ID NO: 3855384 - RNA, 22 nt, Human
acuacaaagguuuaaaugaaca

SEQ ID NO: 3855385 - RNA, 23 nt, Human
acuacaaagguuuaaaugaacaa

SEQ ID NO: 3855386 - RNA, 13 nt, Human
acuacaaaucaag

SEQ ID NO: 3855387 - RNA, 13 nt, Human
acuacaagucagc

SEQ ID NO: 3855388 - RNA, 18 nt, Human
acuacaauauguacauuu

SEQ ID NO: 3855389 - RNA, 13 nt, Human
acuacacacagua

SEQ ID NO: 3855390 - RNA, 22 nt, Human
acuacacacuguguacugcagu

SEQ ID NO: 3855391 - RNA, 20 nt, Human
acuacacagucugcaagauu

SEQ ID NO: 3855392 - RNA, 19 nt, Human
acuacacauucaauaagca

SEQ ID NO: 3855393 - RNA, 13 nt, Human
acuacacauuuuu

SEQ ID NO: 3855394 - RNA, 15 nt, Human
acuacacauuuuuaa

SEQ ID NO: 3855395 - RNA, 21 nt, Human
acuacacauuuuuaaauuguu

SEQ ID NO: 3855396 - RNA, 13 nt, Human
acuacaccacaca

SEQ ID NO: 3855397 - RNA, 14 nt, Human
acuacaccacacac

SEQ ID NO: 3855398 - RNA, 13 nt, Human
acuacacccagca

SEQ ID NO: 3855399 - RNA, 14 nt, Human
acuacacccagcaa

SEQ ID NO: 3855400 - RNA, 15 nt, Human
acuacacccagcaau

SEQ ID NO: 3855401 - RNA, 16 nt, Human
acuacacccagcaaua

SEQ ID NO: 3855402 - RNA, 13 nt, Human
acuacaccuggcu

SEQ ID NO: 3855403 - RNA, 17 nt, Human
acuacacuccagccuga

SEQ ID NO: 3855404 - RNA, 18 nt, Human
acuacacuccagccugag

SEQ ID NO: 3855405 - RNA, 14 nt, Human
acuacacugaggag

SEQ ID NO: 3855406 - RNA, 17 nt, Human
acuacagcuucagugau

SEQ ID NO: 3855407 - RNA, 17 nt, Human
acuacaguauuacucuu

SEQ ID NO: 3855408 - RNA, 20 nt, Human
acuacagucaagauagaaag

SEQ ID NO: 3855409 - RNA, 13 nt, Human
acuacaguuuguu

SEQ ID NO: 3855410 - RNA, 16 nt, Human
acuacauauugaauag

SEQ ID NO: 3855411 - RNA, 19 nt, Human
acuacaucgcccuccacau

SEQ ID NO: 3855412 - RNA, 12 nt, Human
acuacaugcacu

SEQ ID NO: 3855413 - RNA, 20 nt, Human
acuacaugcagcccaugccc

SEQ ID NO: 3855414 - RNA, 17 nt, Human
acgaucacaaaugacuu

SEQ ID NO: 3855415 - RNA, 19 nt, Human
acgaucacaaaugacuuua

SEQ ID NO: 3855416 - RNA, 18 nt, Human
acgaucaggcacagguca

SEQ ID NO: 3855417 - RNA, 20 nt, Human
acgauccugccacccuguag

SEQ ID NO: 3855418 - RNA, 21 nt, Human
acgauccugccacccuguagc

SEQ ID NO: 3855419 - RNA, 14 nt, Human
acgauccuucaaag

SEQ ID NO: 3855420 - RNA, 14 nt, Human
acgaugaaaaacuu

SEQ ID NO: 3855421 - RNA, 16 nt, Human
acgauguggcccuggc

SEQ ID NO: 3855422 - RNA, 18 nt, Human
acgauguggcccuggccu

SEQ ID NO: 3855423 - RNA, 15 nt, Human
acgauuuaauucucu

SEQ ID NO: 3855424 - RNA, 18 nt, Human
acgauuuagaaagaagcc

SEQ ID NO: 3855425 - RNA, 20 nt, Human
acgauuucuguuuagauaau

SEQ ID NO: 3855426 - RNA, 23 nt, Human
acgauuucuguuuagauaauaca

SEQ ID NO: 3855427 - RNA, 16 nt, Human
acgcaaagagagauuu

SEQ ID NO: 3855428 - RNA, 17 nt, Human
acgcaaagagagauuuu

SEQ ID NO: 3855429 - RNA, 19 nt, Human
acgcacacacacacacagg

SEQ ID NO: 3855430 - RNA, 20 nt, Human
acgcacacacacacacagga

SEQ ID NO: 3855431 - RNA, 15 nt, Human
acgcaccagcccaga

SEQ ID NO: 3855432 - RNA, 14 nt, Human
acgcaccugccuca

SEQ ID NO: 3855433 - RNA, 11 nt, Human
acgcacgcaca

SEQ ID NO: 3855434 - RNA, 15 nt, Human
acgcacggcagccac

SEQ ID NO: 3855435 - RNA, 19 nt, Human
acgcacgugggucuucagg

SEQ ID NO: 3855436 - RNA, 17 nt, Human
acgcagaugauccauga

SEQ ID NO: 3855437 - RNA, 12 nt, Human
acgcagccagga

SEQ ID NO: 3855438 - RNA, 20 nt, Human
acgcagcccuagagccugcc

SEQ ID NO: 3855439 - RNA, 21 nt, Human
acgcagcccuagagccugccu

SEQ ID NO: 3855440 - RNA, 22 nt, Human
acgcagcccuagagccugccug

SEQ ID NO: 3855441 - RNA, 23 nt, Human
acgcagcccuagagccugccugg

SEQ ID NO: 3855442 - RNA, 24 nt, Human
acgcagcccuagagccugccugga

SEQ ID NO: 3855443 - RNA, 19 nt, Human
acgcaggcccccaggugcc

SEQ ID NO: 3855444 - RNA, 22 nt, Human
acgcaggcccccaggugccagu

SEQ ID NO: 3855445 - RNA, 17 nt, Human
acgcagggguugcagug

SEQ ID NO: 3855446 - RNA, 15 nt, Human
acgcauccagcaaga

SEQ ID NO: 3855447 - RNA, 22 nt, Human
acgccacagcccuuuugucucu

SEQ ID NO: 3855448 - RNA, 18 nt, Human
acgccaccauuccuggaa

SEQ ID NO: 3855449 - RNA, 20 nt, Human
acgccacucauuucaucuca

SEQ ID NO: 3855450 - RNA, 16 nt, Human
acgccagacuucccac

SEQ ID NO: 3855451 - RNA, 17 nt, Human
acgccagggaccccaga

SEQ ID NO: 3855452 - RNA, 18 nt, Human
acgccaggggaaaaucag

SEQ ID NO: 3855453 - RNA, 11 nt, Human
acgccauccca

SEQ ID NO: 3855454 - RNA, 14 nt, Human
acgccaucccagcc

SEQ ID NO: 3855455 - RNA, 16 nt, Human
acgccaucccagcccc

SEQ ID NO: 3855456 - RNA, 17 nt, Human
acgccaucccagcccca

SEQ ID NO: 3855457 - RNA, 18 nt, Human
acgccaucccagccccaa

SEQ ID NO: 3855458 - RNA, 15 nt, Human
acgcccacuucccug

SEQ ID NO: 3855459 - RNA, 14 nt, Human
acgcccccccccac

SEQ ID NO: 3855460 - RNA, 20 nt, Human
acgcccguccugccuguggc

SEQ ID NO: 3855461 - RNA, 13 nt, Human
acgcccuauuuuu

SEQ ID NO: 3855462 - RNA, 19 nt, Human
acgcccuccccuccccugc

SEQ ID NO: 3855463 - RNA, 22 nt, Human
acgcccuccccuccccugcugc

SEQ ID NO: 3855464 - RNA, 18 nt, Human
acgcccuuuccuccucag

SEQ ID NO: 3855465 - RNA, 21 nt, Human
acgcccuuuccuccucaggca

SEQ ID NO: 3855466 - RNA, 20 nt, Human
acgccgcccuaaaagcacac

SEQ ID NO: 3855467 - RNA, 22 nt, Human
acgccggggacagaggccugcc

SEQ ID NO: 3855468 - RNA, 17 nt, Human
acgccuagccucacgcu

SEQ ID NO: 3855469 - RNA, 16 nt, Human
acgccuaugaucccag

SEQ ID NO: 3855470 - RNA, 15 nt, Human
acgccucccacuggg

SEQ ID NO: 3855471 - RNA, 18 nt, Human
acgccugagcccagggag

SEQ ID NO: 3855472 - RNA, 17 nt, Human
uccagggcuggacugag

SEQ ID NO: 3855473 - RNA, 17 nt, Human
uccaggggccccuccag

SEQ ID NO: 3855474 - RNA, 22 nt, Human
uccaggggcugcuuccuccugg

SEQ ID NO: 3855475 - RNA, 14 nt, Human
uccagggguccuag

SEQ ID NO: 3855476 - RNA, 19 nt, Human
uccaggggugggacacccu

SEQ ID NO: 3855477 - RNA, 14 nt, Human
uccagggguuuaca

SEQ ID NO: 3855478 - RNA, 16 nt, Human
uccagggucccucugu

SEQ ID NO: 3855479 - RNA, 15 nt, Human
uccaggguggcagca

SEQ ID NO: 3855480 - RNA, 17 nt, Human
uccagguaccuugaccu

SEQ ID NO: 3855481 - RNA, 18 nt, Human
uccagguaccuugaccuu

SEQ ID NO: 3855482 - RNA, 17 nt, Human
uccagguacgcacagac

SEQ ID NO: 3855483 - RNA, 19 nt, Human
uccagguagagggugugua

SEQ ID NO: 3855484 - RNA, 15 nt, Human
uccagguaucuccag

SEQ ID NO: 3855485 - RNA, 18 nt, Human
uccagguaucuccaggau

SEQ ID NO: 3855486 - RNA, 21 nt, Human
uccagguccugguggggcagc

SEQ ID NO: 3855487 - RNA, 19 nt, Human
uccaggucgggcucagcuc

SEQ ID NO: 3855488 - RNA, 20 nt, Human
uccaggucgggcucagcucu

SEQ ID NO: 3855489 - RNA, 15 nt, Human
uccaggugcacaagc

SEQ ID NO: 3855490 - RNA, 18 nt, Human
uccaggugcacaagcucc

SEQ ID NO: 3855491 - RNA, 21 nt, Human
uccaggugcacaagcuccaag

SEQ ID NO: 3855492 - RNA, 14 nt, Human
uccaggugcagagg

SEQ ID NO: 3855493 - RNA, 14 nt, Human
uccagguggcauca

SEQ ID NO: 3855494 - RNA, 18 nt, Human
uccagguguuacuguaau

SEQ ID NO: 3855495 - RNA, 20 nt, Human
uccagguucaacccacagcu

SEQ ID NO: 3855496 - RNA, 17 nt, Human
uccagguucccucccag

SEQ ID NO: 3855497 - RNA, 18 nt, Human
uccagguucccucccaga

SEQ ID NO: 3855498 - RNA, 13 nt, Human
uccagguuuuuca

SEQ ID NO: 3855499 - RNA, 22 nt, Human
uccagguuuuucaauuaaacgg

SEQ ID NO: 3855500 - RNA, 18 nt, Human
uccaguaagaucacuguu

SEQ ID NO: 3855501 - RNA, 19 nt, Human
uccaguaagaucacuguuu

SEQ ID NO: 3855502 - RNA, 22 nt, Human
uccaguaagaucacuguuuaga

SEQ ID NO: 3855503 - RNA, 15 nt, Human
uccaguaccuugcuu

SEQ ID NO: 3855504 - RNA, 15 nt, Human
uccaguacuggagcu

SEQ ID NO: 3855505 - RNA, 16 nt, Human
uccaguaggauccagu

SEQ ID NO: 3855506 - RNA, 21 nt, Human
uccaguauaagacuacugaau

SEQ ID NO: 3855507 - RNA, 15 nt, Human
uccaguaucuugaag

SEQ ID NO: 3855508 - RNA, 16 nt, Human
uccaguaucuugaaga

SEQ ID NO: 3855509 - RNA, 19 nt, Human
uccaguauucuugucaaaa

SEQ ID NO: 3855510 - RNA, 16 nt, Human
uccaguccaaggaaac

SEQ ID NO: 3855511 - RNA, 14 nt, Human
uccaguccccagaa

SEQ ID NO: 3855512 - RNA, 15 nt, Human
uccaguccccagaac

SEQ ID NO: 3855513 - RNA, 21 nt, Human
uccaguccccagaacucugcc

SEQ ID NO: 3855514 - RNA, 18 nt, Human
uccaguccuaucugggcu

SEQ ID NO: 3855515 - RNA, 15 nt, Human
uccaguccugcucuc

SEQ ID NO: 3855516 - RNA, 17 nt, Human
uccaguccugcucucua

SEQ ID NO: 3855517 - RNA, 16 nt, Human
uccagucucccaacuu

SEQ ID NO: 3855518 - RNA, 22 nt, Human
uccagucucuuguacagcguuu

SEQ ID NO: 3855519 - RNA, 13 nt, Human
uccagucugcugc

SEQ ID NO: 3855520 - RNA, 15 nt, Human
uccagucugcugccc

SEQ ID NO: 3855521 - RNA, 18 nt, Human
uccagucugcugcccucc

SEQ ID NO: 3855522 - RNA, 22 nt, Human
uccagucugcugcccuccaucc

SEQ ID NO: 3855523 - RNA, 13 nt, Human
uccagucuuccac

SEQ ID NO: 3855524 - RNA, 19 nt, Human
uccagucuuccaccuggaa

SEQ ID NO: 3855525 - RNA, 17 nt, Human
uccagugaccucucucu

SEQ ID NO: 3855526 - RNA, 18 nt, Human
uccagugagacagcucug

SEQ ID NO: 3855527 - RNA, 18 nt, Human
uccagugagcuuaucaug

SEQ ID NO: 3855528 - RNA, 15 nt, Human
uccagugaggcucug

SEQ ID NO: 3855529 - RNA, 16 nt, Human
uccagugaggcucugc

SEQ ID NO: 3855530 - RNA, 18 nt, Human
uccagugaggcucugccc

SEQ ID NO: 3855531 - RNA, 23 nt, Human
uccagugaggcucugcccuuggu

SEQ ID NO: 3855532 - RNA, 18 nt, Human
uccagugcaacacugaag

SEQ ID NO: 3855533 - RNA, 17 nt, Human
uccagugccagcaauga

SEQ ID NO: 3855534 - RNA, 22 nt, Human
uccaguggaagaagaaaacacu

SEQ ID NO: 3855535 - RNA, 22 nt, Human
uccaguggagguuugucgggca

SEQ ID NO: 3855536 - RNA, 22 nt, Human
uccaguggccuggcuccgcugu

SEQ ID NO: 3855537 - RNA, 20 nt, Human
uccagugguccauggaaugc

SEQ ID NO: 3855538 - RNA, 23 nt, Human
uccagugguuugagacacugguu

SEQ ID NO: 3855539 - RNA, 15 nt, Human
uccaguguccugagc

SEQ ID NO: 3855540 - RNA, 19 nt, Human
uccaguguccugagcucag

SEQ ID NO: 3855541 - RNA, 22 nt, Human
uccaguguccugagcucagcgu

SEQ ID NO: 3855542 - RNA, 21 nt, Human
uccaguguccuuagaacauuu

SEQ ID NO: 3855543 - RNA, 18 nt, Human
uccagugugggcuugacc

SEQ ID NO: 3855544 - RNA, 19 nt, Human
uccaguuaaaaaaaauuuu

SEQ ID NO: 3855545 - RNA, 21 nt, Human
uccaguuaaaaaaaauuuuaa

SEQ ID NO: 3855546 - RNA, 22 nt, Human
uccaguuaaaaaaaauuuuaau

SEQ ID NO: 3855547 - RNA, 14 nt, Human
uccaguuaaccaag

SEQ ID NO: 3855548 - RNA, 14 nt, Human
uccaguuaguucuc

SEQ ID NO: 3855549 - RNA, 16 nt, Human
uccaguuauaagaaga

SEQ ID NO: 3855550 - RNA, 21 nt, Human
uccaguucaucgauuuucuau

SEQ ID NO: 3855551 - RNA, 13 nt, Human
uccaguucccacu

SEQ ID NO: 3855552 - RNA, 15 nt, Human
uccaguuccuuuaga

SEQ ID NO: 3855553 - RNA, 17 nt, Human
uccaguuccuuuagaaa

SEQ ID NO: 3855554 - RNA, 21 nt, Human
uccaguugaaguuaguggaaa

SEQ ID NO: 3855555 - RNA, 13 nt, Human
uccaguuuauucc

SEQ ID NO: 3855556 - RNA, 15 nt, Human
uccaguuuauuccag

SEQ ID NO: 3855557 - RNA, 19 nt, Human
uccaguuugcaccuguccc

SEQ ID NO: 3855558 - RNA, 17 nt, Human
uccaguuugucuuggau

SEQ ID NO: 3855559 - RNA, 17 nt, Human
uccaguuuuguuuggac

SEQ ID NO: 3855560 - RNA, 20 nt, Human
uccaguuuuguuuggaccaa

SEQ ID NO: 3855561 - RNA, 14 nt, Human
uccaguuuuucaua

SEQ ID NO: 3855562 - RNA, 23 nt, Human
uccauaaacagacuguuaauuau

SEQ ID NO: 3855563 - RNA, 17 nt, Human
uccauaaagaagauguu

SEQ ID NO: 3855564 - RNA, 17 nt, Human
uccauaaauccuugaug

SEQ ID NO: 3855565 - RNA, 16 nt, Human
uccauaaggaauguag

SEQ ID NO: 3855566 - RNA, 22 nt, Human
uccauaaugcauucuucucugu

SEQ ID NO: 3855567 - RNA, 12 nt, Human
uccauaauguau

SEQ ID NO: 3855568 - RNA, 16 nt, Human
uccauaauguucugcu

SEQ ID NO: 3855569 - RNA, 17 nt, Human
uuuauacaaauuagaaa

SEQ ID NO: 3855570 - RNA, 11 nt, Human
uuuauacacau

SEQ ID NO: 3855571 - RNA, 13 nt, Human
uuuauacagcugu

SEQ ID NO: 3855572 - RNA, 21 nt, Human
uuuauacagcuguauugucug

SEQ ID NO: 3855573 - RNA, 18 nt, Human
uuuauacaguagugagaa

SEQ ID NO: 3855574 - RNA, 19 nt, Human
uuuauacaguuuuaaagaa

SEQ ID NO: 3855575 - RNA, 20 nt, Human
uuuauacauaaacaagacca

SEQ ID NO: 3855576 - RNA, 21 nt, Human
uuuauacauuaguaaaugucu

SEQ ID NO: 3855577 - RNA, 16 nt, Human
uuuauaccuguuuaaa

SEQ ID NO: 3855578 - RNA, 18 nt, Human
uuuauaccuguuuaaauu

SEQ ID NO: 3855579 - RNA, 18 nt, Human
uuuauacucuuucuguau

SEQ ID NO: 3855580 - RNA, 20 nt, Human
uuuauacucuuucuguauau

SEQ ID NO: 3855581 - RNA, 21 nt, Human
uuuauagaauaaugugggaag

SEQ ID NO: 3855582 - RNA, 17 nt, Human
uuuauagcuauuacugu

SEQ ID NO: 3855583 - RNA, 12 nt, Human
uuuauaggaaaa

SEQ ID NO: 3855584 - RNA, 13 nt, Human
uuuauaguaauga

SEQ ID NO: 3855585 - RNA, 15 nt, Human
uuuauagugcacaaa

SEQ ID NO: 3855586 - RNA, 13 nt, Human
uuuauaguggaaa

SEQ ID NO: 3855587 - RNA, 14 nt, Human
uuuauaguuaaucu

SEQ ID NO: 3855588 - RNA, 17 nt, Human
uuuauaguuaaucuaua

SEQ ID NO: 3855589 - RNA, 18 nt, Human
uuuauaguuaaucuauaa

SEQ ID NO: 3855590 - RNA, 14 nt, Human
uuuauauaaaugcu

SEQ ID NO: 3855591 - RNA, 17 nt, Human
uuuauauaauaaaguau

SEQ ID NO: 3855592 - RNA, 20 nt, Human
uuuauauaauaaaguauucc

SEQ ID NO: 3855593 - RNA, 14 nt, Human
uuuauauaauaucu

SEQ ID NO: 3855594 - RNA, 22 nt, Human
uuuauauaaugguaugcuugca

SEQ ID NO: 3855595 - RNA, 14 nt, Human
uuuauauaauuaug

SEQ ID NO: 3855596 - RNA, 17 nt, Human
uuuauauaauuauguua

SEQ ID NO: 3855597 - RNA, 16 nt, Human
uuuauauacaauaaug

SEQ ID NO: 3855598 - RNA, 15 nt, Human
uuuauauauacagua

SEQ ID NO: 3855599 - RNA, 19 nt, Human
uuuauauauauauauaaag

SEQ ID NO: 3855600 - RNA, 20 nt, Human
uuuauauauauauauaaaga

SEQ ID NO: 3855601 - RNA, 14 nt, Human
uuuauauauuauau

SEQ ID NO: 3855602 - RNA, 17 nt, Human
uuuauauauuauaugga

SEQ ID NO: 3855603 - RNA, 23 nt, Human
uuuauauauugguaacauccuuu

SEQ ID NO: 3855604 - RNA, 21 nt, Human
uuuauauauuuaaaaguguca

SEQ ID NO: 3855605 - RNA, 15 nt, Human
uuuauauauuuauaa

SEQ ID NO: 3855606 - RNA, 15 nt, Human
uuuauaucacauguu

SEQ ID NO: 3855607 - RNA, 17 nt, Human
uuuauaucagccugagu

SEQ ID NO: 3855608 - RNA, 16 nt, Human
uuuauaucaugcaaaa

SEQ ID NO: 3855609 - RNA, 16 nt, Human
uuuauauccauuuuua

SEQ ID NO: 3855610 - RNA, 16 nt, Human
uuuauaucuguaugua

SEQ ID NO: 3855611 - RNA, 20 nt, Human
uuuauaugcuuacugauaua

SEQ ID NO: 3855612 - RNA, 17 nt, Human
uuuauaugcuucuguuu

SEQ ID NO: 3855613 - RNA, 19 nt, Human
uuuauaugcuucuguuuua

SEQ ID NO: 3855614 - RNA, 14 nt, Human
uuuauauguacugu

SEQ ID NO: 3855615 - RNA, 14 nt, Human
uuuauauuaaugua

SEQ ID NO: 3855616 - RNA, 16 nt, Human
uuuauauuaauguacu

SEQ ID NO: 3855617 - RNA, 16 nt, Human
uuuauauuacacuaca

SEQ ID NO: 3855618 - RNA, 20 nt, Human
uuuauauuaguugcuuuguu

SEQ ID NO: 3855619 - RNA, 18 nt, Human
uuuauauuuaauuauuaa

SEQ ID NO: 3855620 - RNA, 14 nt, Human
uuuauauuuaguga

SEQ ID NO: 3855621 - RNA, 13 nt, Human
uuuauauuucaag

SEQ ID NO: 3855622 - RNA, 22 nt, Human
uuuauauuuccuuuaugugaau

SEQ ID NO: 3855623 - RNA, 23 nt, Human
uuuauauuuucaauucaaaaaug

SEQ ID NO: 3855624 - RNA, 13 nt, Human
uuuauauuuuccc

SEQ ID NO: 3855625 - RNA, 14 nt, Human
uuuauauuuucccu

SEQ ID NO: 3855626 - RNA, 12 nt, Human
uuuauauuuuua

SEQ ID NO: 3855627 - RNA, 17 nt, Human
uuuaucaacucaagaau

SEQ ID NO: 3855628 - RNA, 20 nt, Human
uuuaucaaugugucuuucua

SEQ ID NO: 3855629 - RNA, 22 nt, Human
uuuaucacaaccaccguuacaa

SEQ ID NO: 3855630 - RNA, 13 nt, Human
uuuaucacuuuuu

SEQ ID NO: 3855631 - RNA, 20 nt, Human
uuuaucacuuuuugaacuaa

SEQ ID NO: 3855632 - RNA, 22 nt, Human
uuuaucagauacaucacugcuu

SEQ ID NO: 3855633 - RNA, 14 nt, Human
uuuaucagauugcu

SEQ ID NO: 3855634 - RNA, 15 nt, Human
uuuaucagcaaaaaa

SEQ ID NO: 3855635 - RNA, 18 nt, Human
uuuaucagugacagaguu

SEQ ID NO: 3855636 - RNA, 22 nt, Human
uuuaucaguuuccagucucaaa

SEQ ID NO: 3855637 - RNA, 15 nt, Human
uuuaucaugaagccu

SEQ ID NO: 3855638 - RNA, 16 nt, Human
uuuaucaugcaugucc

SEQ ID NO: 3855639 - RNA, 22 nt, Human
uuuaucaugcauguccuguaaa

SEQ ID NO: 3855640 - RNA, 17 nt, Human
uuuaucaugugaaauca

SEQ ID NO: 3855641 - RNA, 14 nt, Human
uuuaucauucaagu

SEQ ID NO: 3855642 - RNA, 15 nt, Human
uuuaucauucaagug

SEQ ID NO: 3855643 - RNA, 16 nt, Human
uuuauccaaaaugugu

SEQ ID NO: 3855644 - RNA, 19 nt, Human
uuuauccagaaaacuguga

SEQ ID NO: 3855645 - RNA, 21 nt, Human
uuuauccauucaacugaaaau

SEQ ID NO: 3855646 - RNA, 15 nt, Human
uuuauccauuuguaa

SEQ ID NO: 3855647 - RNA, 16 nt, Human
uuuaucccaaaguugu

SEQ ID NO: 3855648 - RNA, 16 nt, Human
uuuaucccucaccugu

SEQ ID NO: 3855649 - RNA, 18 nt, Human
uuuaucccuuaagaauga

SEQ ID NO: 3855650 - RNA, 16 nt, Human
uuuauccuaucucucc

SEQ ID NO: 3855651 - RNA, 15 nt, Human
uuuaucgcugggaaa

SEQ ID NO: 3855652 - RNA, 16 nt, Human
uuuaucgucacugcuu

SEQ ID NO: 3855653 - RNA, 21 nt, Human
uuuaucgucacugcuuaacuu

SEQ ID NO: 3855654 - RNA, 20 nt, Human
uuuaucuaauaccucugugu

SEQ ID NO: 3855655 - RNA, 22 nt, Human
uuuaucuacccaagggcagaaa

SEQ ID NO: 3855656 - RNA, 12 nt, Human
uuuaucuauaua

SEQ ID NO: 3855657 - RNA, 16 nt, Human
uuuaucuauuguaaga

SEQ ID NO: 3855658 - RNA, 20 nt, Human
uuuaucuauuguaagauaaa

SEQ ID NO: 3855659 - RNA, 21 nt, Human
uuuaucucagauguuaaaaua

SEQ ID NO: 3855660 - RNA, 19 nt, Human
uuuaucugccucucuugua

SEQ ID NO: 3855661 - RNA, 16 nt, Human
uuuaucuguaguaaac

SEQ ID NO: 3855662 - RNA, 12 nt, Human
uuuaucuuuuua

SEQ ID NO: 3855663 - RNA, 18 nt, Human
uuuaugaaaauaaauagc

SEQ ID NO: 3855664 - RNA, 12 nt, Human
uuuaugaagaaa

SEQ ID NO: 3855665 - RNA, 22 nt, Human
uuuaugaagaaaaaauacauuu

SEQ ID NO: 3855666 - RNA, 15 nt, Human
uuuaugaagaaaaua

SEQ ID NO: 3855667 - RNA, 16 nt, Human
uuuaugaagaaaauac

SEQ ID NO: 3855668 - RNA, 17 nt, Human
uuuaugaaggcaaaaaa

SEQ ID NO: 3855669 - RNA, 12 nt, Human
uuuaugaaguuu

SEQ ID NO: 3855670 - RNA, 14 nt, Human
uuuaugaauauaau

SEQ ID NO: 3855671 - RNA, 18 nt, Human
uuuaugaauuaaaguaau

SEQ ID NO: 3855672 - RNA, 17 nt, Human
uuuaugagaaagccuuc

SEQ ID NO: 3855673 - RNA, 20 nt, Human
uuuaugagaaauguaaugcg

SEQ ID NO: 3855674 - RNA, 20 nt, Human
uuuaugagaugcugguuuuc

SEQ ID NO: 3855675 - RNA, 12 nt, Human
uuuaugagccag

SEQ ID NO: 3855676 - RNA, 16 nt, Human
uuuaugagcucaugua

SEQ ID NO: 3855677 - RNA, 16 nt, Human
uuuaugaguacuuuuu

SEQ ID NO: 3855678 - RNA, 16 nt, Human
uuuaugauaucccuga

SEQ ID NO: 3855679 - RNA, 22 nt, Human
uuuaugauauuuuuuuaagucu

SEQ ID NO: 3855680 - RNA, 13 nt, Human
uuuaugauccagc

SEQ ID NO: 3855681 - RNA, 21 nt, Human
uuuaugccggaugugcuuuuc

SEQ ID NO: 3855682 - RNA, 16 nt, Human
uuuaugcuuuaaacau

SEQ ID NO: 3855683 - RNA, 20 nt, Human
uuuauggcagacauugugcu

SEQ ID NO: 3855684 - RNA, 12 nt, Human
uuuauggccuca

SEQ ID NO: 3855685 - RNA, 16 nt, Human
uuuauggcuuuugugc

SEQ ID NO: 3855686 - RNA, 20 nt, Human
uuuauggcuuuugugcauua

SEQ ID NO: 3855687 - RNA, 19 nt, Human
uuuauggugccuaguauug

SEQ ID NO: 3855688 - RNA, 24 nt, Human
uuuauggugccuaguauugacaaa

SEQ ID NO: 3855689 - RNA, 14 nt, Human
uuuauguagcacau

SEQ ID NO: 3855690 - RNA, 21 nt, Human
uuuauguauguuuacacuguc

SEQ ID NO: 3855691 - RNA, 19 nt, Human
uuuaugucuaaagagcuuu

SEQ ID NO: 3855692 - RNA, 16 nt, Human
uuuaugugaauuuuua

SEQ ID NO: 3855693 - RNA, 16 nt, Human
uuuaugugaucaauuu

SEQ ID NO: 3855694 - RNA, 12 nt, Human
uuuaugugaugg

SEQ ID NO: 3855695 - RNA, 16 nt, Human
uuuaugugcuauuaau

SEQ ID NO: 3855696 - RNA, 22 nt, Human
uuuaugugugaggagcugcugg

SEQ ID NO: 3855697 - RNA, 20 nt, Human
uuuauguuaagggaagaauu

SEQ ID NO: 3855698 - RNA, 20 nt, Human
uuuauguuacuacaugcacu

SEQ ID NO: 3855699 - RNA, 19 nt, Human
uuuauguuccauuaaacga

SEQ ID NO: 3855700 - RNA, 13 nt, Human
uuuauguugacau

SEQ ID NO: 3855701 - RNA, 20 nt, Human
uuuauguugaccuaagauuu

SEQ ID NO: 3855702 - RNA, 17 nt, Human
uuuauguuguauagauu

SEQ ID NO: 3855703 - RNA, 22 nt, Human
uuuauguuugucuuuuaaugcu

SEQ ID NO: 3855704 - RNA, 12 nt, Human
uuuauguuuugu

SEQ ID NO: 3855705 - RNA, 17 nt, Human
uuuauguuuuguuucug

SEQ ID NO: 3855706 - RNA, 13 nt, Human
uuuauuaaaaacu

SEQ ID NO: 3855707 - RNA, 14 nt, Human
uuuauuaaaauauu

SEQ ID NO: 3855708 - RNA, 19 nt, Human
uuuauuaaaauauuucagg

SEQ ID NO: 3855709 - RNA, 21 nt, Human
uuuauuaaaauauuucagguu

SEQ ID NO: 3855710 - RNA, 13 nt, Human
uuuauuaaaaucu

SEQ ID NO: 3855711 - RNA, 23 nt, Human
uuuauuaaaaugauuguaaaaua

SEQ ID NO: 3855712 - RNA, 16 nt, Human
uuuauuaaagaaaaaa

SEQ ID NO: 3855713 - RNA, 12 nt, Human
uuuauuaaauag

SEQ ID NO: 3855714 - RNA, 17 nt, Human
ucaguucccuuggccuc

SEQ ID NO: 3855715 - RNA, 16 nt, Human
ucaguucuaggaaaau

SEQ ID NO: 3855716 - RNA, 19 nt, Human
ucaguucuagucucucugg

SEQ ID NO: 3855717 - RNA, 17 nt, Human
ucaguucucuucacuca

SEQ ID NO: 3855718 - RNA, 17 nt, Human
ucaguugcaauaauacu

SEQ ID NO: 3855719 - RNA, 16 nt, Human
ucaguugcuaaacacu

SEQ ID NO: 3855720 - RNA, 18 nt, Human
ucaguugcuaaacacugc

SEQ ID NO: 3855721 - RNA, 18 nt, Human
ucaguugcucaaaaagaa

SEQ ID NO: 3855722 - RNA, 15 nt, Human
ucaguugcuugucuu

SEQ ID NO: 3855723 - RNA, 16 nt, Human
ucaguugguaagcuuc

SEQ ID NO: 3855724 - RNA, 20 nt, Human
ucaguugguguguuuuuggg

SEQ ID NO: 3855725 - RNA, 19 nt, Human
ucaguugguugugucuuuu

SEQ ID NO: 3855726 - RNA, 16 nt, Human
ucaguuguguuuuuua

SEQ ID NO: 3855727 - RNA, 15 nt, Human
ucaguuguuauuuau

SEQ ID NO: 3855728 - RNA, 19 nt, Human
ucaguuguuuguuuuugcu

SEQ ID NO: 3855729 - RNA, 16 nt, Human
ucaguuuaucuguuca

SEQ ID NO: 3855730 - RNA, 16 nt, Human
ucaguuucaacaugaa

SEQ ID NO: 3855731 - RNA, 17 nt, Human
ucaguuucacagaaaau

SEQ ID NO: 3855732 - RNA, 18 nt, Human
ucaguuucacagaaaaua

SEQ ID NO: 3855733 - RNA, 19 nt, Human
ucaguuucauaaaaggaga

SEQ ID NO: 3855734 - RNA, 16 nt, Human
ucaguuuccuggucug

SEQ ID NO: 3855735 - RNA, 22 nt, Human
ucaguuucuucugcgccucagg

SEQ ID NO: 3855736 - RNA, 15 nt, Human
ucaguuugcagagua

SEQ ID NO: 3855737 - RNA, 13 nt, Human
ucaguuuuaacua

SEQ ID NO: 3855738 - RNA, 20 nt, Human
ucaguuuuccucucaauaaa

SEQ ID NO: 3855739 - RNA, 15 nt, Human
ucaguuuuugugaaa

SEQ ID NO: 3855740 - RNA, 17 nt, Human
ucaguuuuugugaaaag

SEQ ID NO: 3855741 - RNA, 20 nt, Human
ucaguuuuuuguuuuacaau

SEQ ID NO: 3855742 - RNA, 15 nt, Human
ucauaaaaacugcuu

SEQ ID NO: 3855743 - RNA, 20 nt, Human
ucauaaaaagcaaaacaaaa

SEQ ID NO: 3855744 - RNA, 16 nt, Human
ucauaaacugugugca

SEQ ID NO: 3855745 - RNA, 14 nt, Human
ucauaaagaauugu

SEQ ID NO: 3855746 - RNA, 24 nt, Human
ucauaaagaggcguugcuuucacu

SEQ ID NO: 3855747 - RNA, 15 nt, Human
ucauaaaguacuuga

SEQ ID NO: 3855748 - RNA, 11 nt, Human
ucauaaaguca

SEQ ID NO: 3855749 - RNA, 19 nt, Human
ucauaaaguuagaaucuau

SEQ ID NO: 3855750 - RNA, 24 nt, Human
ucauaaauucaaaccuaaguugcu

SEQ ID NO: 3855751 - RNA, 16 nt, Human
ucauaaauuuacuuua

SEQ ID NO: 3855752 - RNA, 16 nt, Human
ucauaaauuuaugguu

SEQ ID NO: 3855753 - RNA, 21 nt, Human
uuugagagaaauaugaagaac

SEQ ID NO: 3855754 - RNA, 16 nt, Human
uuugagaguucuaaau

SEQ ID NO: 3855755 - RNA, 18 nt, Human
uuugagaucuaaaaauaa

SEQ ID NO: 3855756 - RNA, 15 nt, Human
uuugagcaauuuucg

SEQ ID NO: 3855757 - RNA, 20 nt, Human
uuugagcuacuggauucuua

SEQ ID NO: 3855758 - RNA, 17 nt, Human
uuugaggaaauuugcag

SEQ ID NO: 3855759 - RNA, 16 nt, Human
uuugaggagcauguuu

SEQ ID NO: 3855760 - RNA, 21 nt, Human
uuugaggauauauuuucacuu

SEQ ID NO: 3855761 - RNA, 17 nt, Human
uuugaggauuaguuuag

SEQ ID NO: 3855762 - RNA, 18 nt, Human
uuugaggauuaguuuaga

SEQ ID NO: 3855763 - RNA, 19 nt, Human
uuugaggauuaguuuagaa

SEQ ID NO: 3855764 - RNA, 22 nt, Human
uuugaggauuaguuuagaacag

SEQ ID NO: 3855765 - RNA, 23 nt, Human
uuugaggauuaguuuagaacagg

SEQ ID NO: 3855766 - RNA, 15 nt, Human
uuugaggcaaaagaa

SEQ ID NO: 3855767 - RNA, 15 nt, Human
uuugaggcugcagcg

SEQ ID NO: 3855768 - RNA, 20 nt, Human
uuugaggcuuucagguuuua

SEQ ID NO: 3855769 - RNA, 23 nt, Human
uuugagguuggaaaauaucuuug

SEQ ID NO: 3855770 - RNA, 20 nt, Human
uuugagguuuuuaagccuua

SEQ ID NO: 3855771 - RNA, 19 nt, Human
uuugaguagauauuacuuu

SEQ ID NO: 3855772 - RNA, 20 nt, Human
uuugaguagauauuacuuua

SEQ ID NO: 3855773 - RNA, 21 nt, Human
uuugaguagauauuacuuuau

SEQ ID NO: 3855774 - RNA, 19 nt, Human
uuugagucaaagacuuaaa

SEQ ID NO: 3855775 - RNA, 12 nt, Human
uuugagucuuuu

SEQ ID NO: 3855776 - RNA, 16 nt, Human
uuugagugaggguuuc

SEQ ID NO: 3855777 - RNA, 13 nt, Human
uuugaguucuaca

SEQ ID NO: 3855778 - RNA, 20 nt, Human
uuugauaaaaauuuagaaca

SEQ ID NO: 3855779 - RNA, 16 nt, Human
uuugauaaaauaaaug

SEQ ID NO: 3855780 - RNA, 14 nt, Human
uuugauaaaguagu

SEQ ID NO: 3855781 - RNA, 14 nt, Human
uuugauaaauagug

SEQ ID NO: 3855782 - RNA, 15 nt, Human
uuugauaagaaaacc

SEQ ID NO: 3855783 - RNA, 20 nt, Human
uuugauaaucaacugggcug

SEQ ID NO: 3855784 - RNA, 15 nt, Human
uuugauaaugauaaa

SEQ ID NO: 3855785 - RNA, 15 nt, Human
uuugauaauguuaaa

SEQ ID NO: 3855786 - RNA, 17 nt, Human
uuugauaauguuaaauu

SEQ ID NO: 3855787 - RNA, 23 nt, Human
uuugauaauguuaaauuuguaag

SEQ ID NO: 3855788 - RNA, 17 nt, Human
uuugauacauaauaaaa

SEQ ID NO: 3855789 - RNA, 23 nt, Human
uuugauacauaauaaaaaauuau

SEQ ID NO: 3855790 - RNA, 16 nt, Human
uuugauacauauguga

SEQ ID NO: 3855791 - RNA, 17 nt, Human
uuugauaccccugggga

SEQ ID NO: 3855792 - RNA, 17 nt, Human
uuugauacuaagcauug

SEQ ID NO: 3855793 - RNA, 12 nt, Human
uuugauacuuau

SEQ ID NO: 3855794 - RNA, 23 nt, Human
uuugauauagaaguauaaagaau

SEQ ID NO: 3855795 - RNA, 17 nt, Human
uuugauaucacagucua

SEQ ID NO: 3855796 - RNA, 19 nt, Human
uuugauaucacagucuaau

SEQ ID NO: 3855797 - RNA, 15 nt, Human
uuugauaugaguaua

SEQ ID NO: 3855798 - RNA, 15 nt, Human
uuugauauuaaauuu

SEQ ID NO: 3855799 - RNA, 21 nt, Human
uuugauauuauacaggaaagc

SEQ ID NO: 3855800 - RNA, 13 nt, Human
uuugaucaugaau

SEQ ID NO: 3855801 - RNA, 15 nt, Human
uuugaucuucaacaa

SEQ ID NO: 3855802 - RNA, 18 nt, Human
uuugaucuucaacaaauu

SEQ ID NO: 3855803 - RNA, 18 nt, Human
uuugaucuuccucugcua

SEQ ID NO: 3855804 - RNA, 16 nt, Human
uuugaugaaagcugau

SEQ ID NO: 3855805 - RNA, 19 nt, Human
uuugaugacuggcauuuua

SEQ ID NO: 3855806 - RNA, 12 nt, Human
uuugaugauaaa

SEQ ID NO: 3855807 - RNA, 16 nt, Human
uuugaugcaugucuuu

SEQ ID NO: 3855808 - RNA, 22 nt, Human
uuugaugcaugucuuuuaaaau

SEQ ID NO: 3855809 - RNA, 18 nt, Human
uuugaugcuggagagguu

SEQ ID NO: 3855810 - RNA, 16 nt, Human
uuugaugucagcaguu

SEQ ID NO: 3855811 - RNA, 16 nt, Human
uuugaugucauguguu

SEQ ID NO: 3855812 - RNA, 21 nt, Human
uuugauguguuguucuuggca

SEQ ID NO: 3855813 - RNA, 13 nt, Human
uuugauuaaauuc

SEQ ID NO: 3855814 - RNA, 16 nt, Human
uuugauuaacaaauau

SEQ ID NO: 3855815 - RNA, 18 nt, Human
uuugauuaauccagaaua

SEQ ID NO: 3855816 - RNA, 14 nt, Human
uuugauuauuguau

SEQ ID NO: 3855817 - RNA, 15 nt, Human
uuugauuauuugcau

SEQ ID NO: 3855818 - RNA, 22 nt, Human
uuugauuauuugcauguuaugu

SEQ ID NO: 3855819 - RNA, 15 nt, Human
uuugauucaaaauau

SEQ ID NO: 3855820 - RNA, 12 nt, Human
uuugauucacau

SEQ ID NO: 3855821 - RNA, 14 nt, Human
uuugauucacaugu

SEQ ID NO: 3855822 - RNA, 16 nt, Human
uuugauucacauguuu

SEQ ID NO: 3855823 - RNA, 18 nt, Human
uuugauucacauguuuuc

SEQ ID NO: 3855824 - RNA, 20 nt, Human
uuugauucacauguuuucaa

SEQ ID NO: 3855825 - RNA, 21 nt, Human
uuugauucacauguuuucaaa

SEQ ID NO: 3855826 - RNA, 18 nt, Human
uuugauuuacagcaagua

SEQ ID NO: 3855827 - RNA, 12 nt, Human
uuugauuuaugc

SEQ ID NO: 3855828 - RNA, 14 nt, Human
uuugauuucauuaa

SEQ ID NO: 3855829 - RNA, 14 nt, Human
uuugauuuguacag

SEQ ID NO: 3855830 - RNA, 18 nt, Human
uuugcaaaaaauguuuuu

SEQ ID NO: 3855831 - RNA, 22 nt, Human
uuugcaaaaauccaaauauugu

SEQ ID NO: 3855832 - RNA, 19 nt, Human
uuugcaaacuuuauuuuca

SEQ ID NO: 3855833 - RNA, 19 nt, Human
uuugcaaagaaagaaaaaa

SEQ ID NO: 3855834 - RNA, 22 nt, Human
uuugcaaaguauuguaaauuau

SEQ ID NO: 3855835 - RNA, 18 nt, Human
uuugcaaaguguauuagg

SEQ ID NO: 3855836 - RNA, 13 nt, Human
uuugcaacauuua

SEQ ID NO: 3855837 - RNA, 14 nt, Human
uuugcaagccagau

SEQ ID NO: 3855838 - RNA, 18 nt, Human
uuugcaagucauggcugu

SEQ ID NO: 3855839 - RNA, 21 nt, Human
uuugcaagucauggcugugcc

SEQ ID NO: 3855840 - RNA, 15 nt, Human
uuugcaauaacagcu

SEQ ID NO: 3855841 - RNA, 17 nt, Human
uuugcaauaaugcagua

SEQ ID NO: 3855842 - RNA, 19 nt, Human
uuugcaauggcuauauggc

SEQ ID NO: 3855843 - RNA, 19 nt, Human
uuugcacauguuuccucua

SEQ ID NO: 3855844 - RNA, 16 nt, Human
uuugcacauuaaauga

SEQ ID NO: 3855845 - RNA, 13 nt, Human
uuugcacauuuug

SEQ ID NO: 3855846 - RNA, 18 nt, Human
uuugcacauuuugauuuu

SEQ ID NO: 3855847 - RNA, 13 nt, Human
uuugcaccccucc

SEQ ID NO: 3855848 - RNA, 15 nt, Human
uuugcaccugucccc

SEQ ID NO: 3855849 - RNA, 16 nt, Human
uuugcaccuuucuagu

SEQ ID NO: 3855850 - RNA, 19 nt, Human
uuugcacgacgcccucucc

SEQ ID NO: 3855851 - RNA, 15 nt, Human
uuugcacucuuguuu

SEQ ID NO: 3855852 - RNA, 12 nt, Human
uuugcacugagg

SEQ ID NO: 3855853 - RNA, 18 nt, Human
uuugcacugaggauauuc

SEQ ID NO: 3855854 - RNA, 17 nt, Human
uuugcacugagggccac

SEQ ID NO: 3855855 - RNA, 22 nt, Human
uuugcacugagggccacacuau

SEQ ID NO: 3855856 - RNA, 14 nt, Human
uuugcacuguuuaa

SEQ ID NO: 3855857 - RNA, 19 nt, Human
uuugcagaaaagcaccugc

SEQ ID NO: 3855858 - RNA, 14 nt, Human
uuugcagaaacaga

SEQ ID NO: 3855859 - RNA, 18 nt, Human
uuuuaaaaaaagaaaaug

SEQ ID NO: 3855860 - RNA, 21 nt, Human
uuuuaaaaaaauaaaacauuu

SEQ ID NO: 3855861 - RNA, 18 nt, Human
uuuuaaaaaacugcugac

SEQ ID NO: 3855862 - RNA, 21 nt, Human
uuuuaaaaaacugcugacugu

SEQ ID NO: 3855863 - RNA, 14 nt, Human
uuuuaaaaaacuuu

SEQ ID NO: 3855864 - RNA, 17 nt, Human
uuuuaaaaaagcuuaaa

SEQ ID NO: 3855865 - RNA, 21 nt, Human
uuuuaaaaaagggaguuuuug

SEQ ID NO: 3855866 - RNA, 11 nt, Human
uuuuaaaaaca

SEQ ID NO: 3855867 - RNA, 14 nt, Human
uuuuaaaaagcaaa

SEQ ID NO: 3855868 - RNA, 14 nt, Human
uuuuaaaaauacau

SEQ ID NO: 3855869 - RNA, 12 nt, Human
uuuuaaaaauga

SEQ ID NO: 3855870 - RNA, 15 nt, Human
uuuuaaaaaugaauc

SEQ ID NO: 3855871 - RNA, 20 nt, Human
uuuuaaaacacauguuuuua

SEQ ID NO: 3855872 - RNA, 13 nt, Human
uuuuaaaacccag

SEQ ID NO: 3855873 - RNA, 18 nt, Human
uuuuaaaacuacuuagca

SEQ ID NO: 3855874 - RNA, 20 nt, Human
uuuuaaaacuggaccuguau

SEQ ID NO: 3855875 - RNA, 14 nt, Human
uuuuaaaagaauga

SEQ ID NO: 3855876 - RNA, 21 nt, Human
uuuuaaaagaaugauuaugaa

SEQ ID NO: 3855877 - RNA, 14 nt, Human
uuuuaaaagagaca

SEQ ID NO: 3855878 - RNA, 18 nt, Human
uuuuaaaaguaaauguac

SEQ ID NO: 3855879 - RNA, 15 nt, Human
uuuuaaaaguuucaa

SEQ ID NO: 3855880 - RNA, 22 nt, Human
uuuuaaaaguuucaaugugauu

SEQ ID NO: 3855881 - RNA, 12 nt, Human
uuuuaaaauacu

SEQ ID NO: 3855882 - RNA, 23 nt, Human
uuuuaaaauagaaauuuuguaag

SEQ ID NO: 3855883 - RNA, 21 nt, Human
uuuuaaaauagcguucuugua

SEQ ID NO: 3855884 - RNA, 17 nt, Human
uuuuaaaaucuuuucua

SEQ ID NO: 3855885 - RNA, 18 nt, Human
uuuuaaaaucuuuucuau

SEQ ID NO: 3855886 - RNA, 12 nt, Human
uuuuaaaaugag

SEQ ID NO: 3855887 - RNA, 22 nt, Human
uuuuaaaaugagaaaucuaaaa

SEQ ID NO: 3855888 - RNA, 23 nt, Human
uuuuaaaauuguacaugaacaug

SEQ ID NO: 3855889 - RNA, 11 nt, Human
uuuuaaaauuu

SEQ ID NO: 3855890 - RNA, 15 nt, Human
uuuuaaaauuuguuc

SEQ ID NO: 3855891 - RNA, 18 nt, Human
uuuuaaacacauuaggaa

SEQ ID NO: 3855892 - RNA, 21 nt, Human
uuuuaaacaucaaucuuuaaa

SEQ ID NO: 3855893 - RNA, 21 nt, Human
uuuuaaaccauaaaaagcuga

SEQ ID NO: 3855894 - RNA, 12 nt, Human
uuuuaaacuaga

SEQ ID NO: 3855895 - RNA, 15 nt, Human
uuuuaaacuagauga

SEQ ID NO: 3855896 - RNA, 17 nt, Human
uuuuaaacuagaugacc

SEQ ID NO: 3855897 - RNA, 13 nt, Human
uuuuaaacuguac

SEQ ID NO: 3855898 - RNA, 17 nt, Human
uuuuaaacuguacagug

SEQ ID NO: 3855899 - RNA, 20 nt, Human
uuuuaaacuguguacauaac

SEQ ID NO: 3855900 - RNA, 23 nt, Human
uuuuaaagaauaugacuuuuuau

SEQ ID NO: 3855901 - RNA, 14 nt, Human
uuuuaaagaauuuc

SEQ ID NO: 3855902 - RNA, 13 nt, Human
uuuuaaagacaug

SEQ ID NO: 3855903 - RNA, 14 nt, Human
uuuuaaagugauua

SEQ ID NO: 3855904 - RNA, 14 nt, Human
uuuuaaagugcaaa

SEQ ID NO: 3855905 - RNA, 17 nt, Human
uuuuaaaguuaguaucu

SEQ ID NO: 3855906 - RNA, 14 nt, Human
uuuuaaaguugaua

SEQ ID NO: 3855907 - RNA, 21 nt, Human
uuuuaaauaaacuuuuuuuca

SEQ ID NO: 3855908 - RNA, 21 nt, Human
uuuuaaaucuaaaucuauuua

SEQ ID NO: 3855909 - RNA, 14 nt, Human
uuuuaaauguacag

SEQ ID NO: 3855910 - RNA, 22 nt, Human
uuuuaaauguacagacauauuu

SEQ ID NO: 3855911 - RNA, 12 nt, Human
uuuuaaauguau

SEQ ID NO: 3855912 - RNA, 17 nt, Human
uuuuaaauuaauaucuu

SEQ ID NO: 3855913 - RNA, 19 nt, Human
uuuuaaauuagaaaauauu

SEQ ID NO: 3855914 - RNA, 19 nt, Human
uuuuaaauuauaaggacug

SEQ ID NO: 3855915 - RNA, 21 nt, Human
uuuuaaauuauaaggacugca

SEQ ID NO: 3855916 - RNA, 18 nt, Human
uuuuaaauuuucuucagu

SEQ ID NO: 3855917 - RNA, 19 nt, Human
uuuuaaauuuucuucaguu

SEQ ID NO: 3855918 - RNA, 18 nt, Human
uuuuaaauuuuguaauga

SEQ ID NO: 3855919 - RNA, 16 nt, Human
uuuuaacaaaagcaag

SEQ ID NO: 3855920 - RNA, 20 nt, Human
uuuuaacaaaagcaagacug

SEQ ID NO: 3855921 - RNA, 19 nt, Human
uuuuaacaauaacuacugu

SEQ ID NO: 3855922 - RNA, 18 nt, Human
uuuuaacacacauaaagg

SEQ ID NO: 3855923 - RNA, 19 nt, Human
uuuuaacacacauaaagga

SEQ ID NO: 3855924 - RNA, 19 nt, Human
uuuuaacaccugaugugua

SEQ ID NO: 3855925 - RNA, 21 nt, Human
uuuuaaccaaaggugaaggaa

SEQ ID NO: 3855926 - RNA, 18 nt, Human
uuuuaaccauggcagggu

SEQ ID NO: 3855927 - RNA, 21 nt, Human
uuuuaaccauugucuuguucu

SEQ ID NO: 3855928 - RNA, 18 nt, Human
uuuuaaccccgucaacaa

SEQ ID NO: 3855929 - RNA, 21 nt, Human
uuuuaaccccgucaacaaauc

SEQ ID NO: 3855930 - RNA, 12 nt, Human
uuuuaacuagaa

SEQ ID NO: 3855931 - RNA, 13 nt, Human
uuuuaacucaaua

SEQ ID NO: 3855932 - RNA, 12 nt, Human
uuuuaacucacc

SEQ ID NO: 3855933 - RNA, 13 nt, Human
uuuuaacuucuuu

SEQ ID NO: 3855934 - RNA, 11 nt, Human
uuuuaacuuug

SEQ ID NO: 3855935 - RNA, 19 nt, Human
ucaugggccacugcuuuuc

SEQ ID NO: 3855936 - RNA, 17 nt, Human
ucaugggccccucugac

SEQ ID NO: 3855937 - RNA, 19 nt, Human
ucauggggggagcacccug

SEQ ID NO: 3855938 - RNA, 21 nt, Human
ucauggggugaugcugggcug

SEQ ID NO: 3855939 - RNA, 23 nt, Human
ucaugguagagaccgagccucug

SEQ ID NO: 3855940 - RNA, 14 nt, Human
ucauggugaaaaug

SEQ ID NO: 3855941 - RNA, 14 nt, Human
ucauggugcucaga

SEQ ID NO: 3855942 - RNA, 15 nt, Human
ucaugguguaauaag

SEQ ID NO: 3855943 - RNA, 16 nt, Human
ucaugguguguuacac

SEQ ID NO: 3855944 - RNA, 15 nt, Human
ucauguaaaacagaa

SEQ ID NO: 3855945 - RNA, 16 nt, Human
ucauguaaacugugca

SEQ ID NO: 3855946 - RNA, 16 nt, Human
ucauguaaagaaaugu

SEQ ID NO: 3855947 - RNA, 22 nt, Human
ucauguaaagaaaugucuuaau

SEQ ID NO: 3855948 - RNA, 18 nt, Human
ucauguaaauaauacauu

SEQ ID NO: 3855949 - RNA, 20 nt, Human
ucauguaaauacuguuggug

SEQ ID NO: 3855950 - RNA, 22 nt, Human
ucauguaaauugacuguacuag

SEQ ID NO: 3855951 - RNA, 16 nt, Human
ucauguaaauuuugua

SEQ ID NO: 3855952 - RNA, 23 nt, Human
ucauguaaauuuuguaugaaaaa

SEQ ID NO: 3855953 - RNA, 15 nt, Human
ucauguaauccucaa

SEQ ID NO: 3855954 - RNA, 13 nt, Human
ucauguaauuuua

SEQ ID NO: 3855955 - RNA, 18 nt, Human
ucauguacaagaugaagg

SEQ ID NO: 3855956 - RNA, 16 nt, Human
ucauguaguaucaaau

SEQ ID NO: 3855957 - RNA, 19 nt, Human
ucauguaguaucaaauauu

SEQ ID NO: 3855958 - RNA, 12 nt, Human
ucauguauguuu

SEQ ID NO: 3855959 - RNA, 17 nt, Human
ucaugucaacuucuggc

SEQ ID NO: 3855960 - RNA, 20 nt, Human
ucauguccccaaaccugcaa

SEQ ID NO: 3855961 - RNA, 16 nt, Human
ucaugugaaaucauuc

SEQ ID NO: 3855962 - RNA, 17 nt, Human
ucaugugacucuuucca

SEQ ID NO: 3855963 - RNA, 15 nt, Human
ucaugugauccuuuu

SEQ ID NO: 3855964 - RNA, 19 nt, Human
ucauguggaauauaaagau

SEQ ID NO: 3855965 - RNA, 14 nt, Human
ucauguguauaaaa

SEQ ID NO: 3855966 - RNA, 23 nt, Human
ucauguguguccacgacugucuc

SEQ ID NO: 3855967 - RNA, 15 nt, Human
ucauguguucccuuu

SEQ ID NO: 3855968 - RNA, 20 nt, Human
ucauguuaaccucugcuuuu

SEQ ID NO: 3855969 - RNA, 19 nt, Human
ucauguuaguaauaccucu

SEQ ID NO: 3855970 - RNA, 22 nt, Human
ucauguucccacuucaaaacaa

SEQ ID NO: 3855971 - RNA, 14 nt, Human
ucauguuccuucaa

SEQ ID NO: 3855972 - RNA, 22 nt, Human
ucauguugcacacccacucagc

SEQ ID NO: 3855973 - RNA, 13 nt, Human
ucauguuguuaaa

SEQ ID NO: 3855974 - RNA, 14 nt, Human
ucauguuuaagaaa

SEQ ID NO: 3855975 - RNA, 16 nt, Human
ucauguuuaagaaauu

SEQ ID NO: 3855976 - RNA, 17 nt, Human
ucauguuuacagaggac

SEQ ID NO: 3855977 - RNA, 23 nt, Human
ucauguuuauaacuauucaguug

SEQ ID NO: 3855978 - RNA, 15 nt, Human
ucauguuuaugaaaa

SEQ ID NO: 3855979 - RNA, 22 nt, Human
ucauguuuaugaaaauaaauag

SEQ ID NO: 3855980 - RNA, 17 nt, Human
ucauguuuaugagaaac

SEQ ID NO: 3855981 - RNA, 11 nt, Human
ucauguuucuu

SEQ ID NO: 3855982 - RNA, 14 nt, Human
ucauguuugcuuca

SEQ ID NO: 3855983 - RNA, 20 nt, Human
ucauguuugcuucauaaaug

SEQ ID NO: 3855984 - RNA, 21 nt, Human
ucauguuuggugcauagaacu

SEQ ID NO: 3855985 - RNA, 17 nt, Human
uuuugcaccccaugcug

SEQ ID NO: 3855986 - RNA, 16 nt, Human
uuuugcaccccuccca

SEQ ID NO: 3855987 - RNA, 13 nt, Human
uuuugcagaagag

SEQ ID NO: 3855988 - RNA, 15 nt, Human
uuuugcaguaacugu

SEQ ID NO: 3855989 - RNA, 21 nt, Human
uuuugcauaguucuagugcag

SEQ ID NO: 3855990 - RNA, 20 nt, Human
uuuugcaucucacaaacaua

SEQ ID NO: 3855991 - RNA, 15 nt, Human
uuuugcauucaaauu

SEQ ID NO: 3855992 - RNA, 19 nt, Human
uuuugccaauuugcacauu

SEQ ID NO: 3855993 - RNA, 22 nt, Human
uuuugccacuaauuuuaguauu

SEQ ID NO: 3855994 - RNA, 23 nt, Human
uuuugccauguuggccaggcugg

SEQ ID NO: 3855995 - RNA, 15 nt, Human
uuuugccauuaaacu

SEQ ID NO: 3855996 - RNA, 18 nt, Human
uuuugcccuucacagugu

SEQ ID NO: 3855997 - RNA, 17 nt, Human
uuuugccuucauuaccu

SEQ ID NO: 3855998 - RNA, 21 nt, Human
uuuugcgguucaggaaaauug

SEQ ID NO: 3855999 - RNA, 21 nt, Human
uuuugcuauuagacuguagga

SEQ ID NO: 3856000 - RNA, 15 nt, Human
uuuugcucuaaaaua

SEQ ID NO: 3856001 - RNA, 13 nt, Human
uuuugcugagacu

SEQ ID NO: 3856002 - RNA, 19 nt, Human
uuuugcugagacuaaucuu

SEQ ID NO: 3856003 - RNA, 14 nt, Human
uuuugcugcuucug

SEQ ID NO: 3856004 - RNA, 13 nt, Human
uuuugcuggaaua

SEQ ID NO: 3856005 - RNA, 23 nt, Human
uuuugcuuguuauauuaagcaga

SEQ ID NO: 3856006 - RNA, 13 nt, Human
uuuugcuuuaauu

SEQ ID NO: 3856007 - RNA, 17 nt, Human
uuuugcuuuaauuuuag

SEQ ID NO: 3856008 - RNA, 18 nt, Human
uuuugcuuuaauuuuagc

SEQ ID NO: 3856009 - RNA, 21 nt, Human
uuuugcuuucgaacugcuagu

SEQ ID NO: 3856010 - RNA, 19 nt, Human
uuuugcuuuuaauuaaaua

SEQ ID NO: 3856011 - RNA, 17 nt, Human
uuuuggaaagucagaau

SEQ ID NO: 3856012 - RNA, 16 nt, Human
uuuuggaaucuagaag

SEQ ID NO: 3856013 - RNA, 22 nt, Human
uuuuggaaucuagaagaaauga

SEQ ID NO: 3856014 - RNA, 17 nt, Human
uuuuggacuccaucucu

SEQ ID NO: 3856015 - RNA, 15 nt, Human
uuuuggacuuuguua

SEQ ID NO: 3856016 - RNA, 16 nt, Human
uuuuggauuguauauu

SEQ ID NO: 3856017 - RNA, 19 nt, Human
uuuuggcaaaacucuacuu

SEQ ID NO: 3856018 - RNA, 22 nt, Human
uuuuggcaaugacucaaagucu

SEQ ID NO: 3856019 - RNA, 19 nt, Human
uuuuggcacugagauauuu

SEQ ID NO: 3856020 - RNA, 21 nt, Human
uuuugggaaaugcugauuuaa

SEQ ID NO: 3856021 - RNA, 18 nt, Human
uuuugggaaguuaaaggg

SEQ ID NO: 3856022 - RNA, 12 nt, Human
uuuugggauguc

SEQ ID NO: 3856023 - RNA, 16 nt, Human
uuuuggggagccagaa

SEQ ID NO: 3856024 - RNA, 17 nt, Human
uuuuggguuuauuugga

SEQ ID NO: 3856025 - RNA, 19 nt, Human
uuuugguacuuauuacugc

SEQ ID NO: 3856026 - RNA, 16 nt, Human
uuuugguuuuguuccc

SEQ ID NO: 3856027 - RNA, 20 nt, Human
uuuugguuuuguuccccucc

SEQ ID NO: 3856028 - RNA, 16 nt, Human
uuuuguaaaauguauu

SEQ ID NO: 3856029 - RNA, 18 nt, Human
uuuuguaaaauguauuau

SEQ ID NO: 3856030 - RNA, 14 nt, Human
uuuuguaaacauuu

SEQ ID NO: 3856031 - RNA, 15 nt, Human
uuuuguaaacauuua

SEQ ID NO: 3856032 - RNA, 17 nt, Human
uuuuguaaacauuuauu

SEQ ID NO: 3856033 - RNA, 14 nt, Human
uuuuguaaaguuuc

SEQ ID NO: 3856034 - RNA, 14 nt, Human
uuuuguaagacaaa

SEQ ID NO: 3856035 - RNA, 15 nt, Human
uuuuguaagaugcug

SEQ ID NO: 3856036 - RNA, 16 nt, Human
uuuuguaauaagcaau

SEQ ID NO: 3856037 - RNA, 15 nt, Human
uuuuguaauuauugu

SEQ ID NO: 3856038 - RNA, 12 nt, Human
uuuuguacaucu

SEQ ID NO: 3856039 - RNA, 11 nt, Human
uuuuguaccag

SEQ ID NO: 3856040 - RNA, 14 nt, Human
uuuuguaccaguga

SEQ ID NO: 3856041 - RNA, 17 nt, Human
uuuuguacuguaaagag

SEQ ID NO: 3856042 - RNA, 23 nt, Human
uuuuguaggggucaaagaaaugc

SEQ ID NO: 3856043 - RNA, 15 nt, Human
uuuuguagguacuuu

SEQ ID NO: 3856044 - RNA, 14 nt, Human
uuuuguauaauugg

SEQ ID NO: 3856045 - RNA, 15 nt, Human
uuuuguauaauugua

SEQ ID NO: 3856046 - RNA, 19 nt, Human
uuuuguauacaaauauauu

SEQ ID NO: 3856047 - RNA, 21 nt, Human
uuuuguauacaaauauauugu

SEQ ID NO: 3856048 - RNA, 23 nt, Human
uuuuguaugaaauauaugugaaa

SEQ ID NO: 3856049 - RNA, 14 nt, Human
uuuuguauguaaau

SEQ ID NO: 3856050 - RNA, 17 nt, Human
uuuuguauguuaaagag

SEQ ID NO: 3856051 - RNA, 22 nt, Human
uuuuguauucaauuaaagaaau

SEQ ID NO: 3856052 - RNA, 17 nt, Human
uuuuguauucucugagc

SEQ ID NO: 3856053 - RNA, 10 nt, Human
uuuuguauuu

SEQ ID NO: 3856054 - RNA, 18 nt, Human
uuuuguauuuucaugaaa

SEQ ID NO: 3856055 - RNA, 15 nt, Human
uuuuguauuuuuaau

SEQ ID NO: 3856056 - RNA, 18 nt, Human
uuuugucacuuuuucuga

SEQ ID NO: 3856057 - RNA, 15 nt, Human
uuuugucuaauuaaa

SEQ ID NO: 3856058 - RNA, 11 nt, Human
uuuugucucug

SEQ ID NO: 3856059 - RNA, 12 nt, Human
uuuugucucugc

SEQ ID NO: 3856060 - RNA, 22 nt, Human
uuuugugaaaugaaaacaugua

SEQ ID NO: 3856061 - RNA, 22 nt, Human
uuuugugaaauuuuucauauuu

SEQ ID NO: 3856062 - RNA, 16 nt, Human
uuuugugaagcccugu

SEQ ID NO: 3856063 - RNA, 13 nt, Human
uuuugugagaugu

SEQ ID NO: 3856064 - RNA, 14 nt, Human
uuuugugaguuugu

SEQ ID NO: 3856065 - RNA, 17 nt, Human
uuuugugcauuaucuag

SEQ ID NO: 3856066 - RNA, 17 nt, Human
uuuugugguuuggaaua

SEQ ID NO: 3856067 - RNA, 17 nt, Human
uuuuguguaaugaaaau

SEQ ID NO: 3856068 - RNA, 13 nt, Human
uuuuguguccucc

SEQ ID NO: 3856069 - RNA, 18 nt, Human
uuuugugugaccaacugu

SEQ ID NO: 3856070 - RNA, 16 nt, Human
uuuuguguugaagagc

SEQ ID NO: 3856071 - RNA, 16 nt, Human
uuuuguuaacugauuu

SEQ ID NO: 3856072 - RNA, 10 nt, Human
uuuuguuacu

SEQ ID NO: 3856073 - RNA, 12 nt, Human
uuuuguuacugu

SEQ ID NO: 3856074 - RNA, 13 nt, Human
uuuuguuacuguu

SEQ ID NO: 3856075 - RNA, 14 nt, Human
uuuuguuacuguuc

SEQ ID NO: 3856076 - RNA, 16 nt, Human
uuuuguuacuguucuu

SEQ ID NO: 3856077 - RNA, 18 nt, Human
uuuuguuacuguucuugc

SEQ ID NO: 3856078 - RNA, 19 nt, Human
uuuuguuacuguucuugcu

SEQ ID NO: 3856079 - RNA, 17 nt, Human
uuuuguucauacauauu

SEQ ID NO: 3856080 - RNA, 24 nt, Human
uuuuguucauuucauccuuucacu

SEQ ID NO: 3856081 - RNA, 22 nt, Human
uuuuguucccauccucuucuuu

SEQ ID NO: 3856082 - RNA, 14 nt, Human
uuuuguuccccucc

SEQ ID NO: 3856083 - RNA, 15 nt, Human
uuuuguuccccuccu

SEQ ID NO: 3856084 - RNA, 23 nt, Human
uuuuguucgcauggucacacacu

SEQ ID NO: 3856085 - RNA, 22 nt, Human
uuuuguucuuacacauacaguu

SEQ ID NO: 3856086 - RNA, 13 nt, Human
uuuuguugacauu

SEQ ID NO: 3856087 - RNA, 19 nt, Human
uuuuguugauuaaaacauu

SEQ ID NO: 3856088 - RNA, 11 nt, Human
uuuuguugcac

SEQ ID NO: 3856089 - RNA, 21 nt, Human
uuuuguuggcauagcucuggg

SEQ ID NO: 3856090 - RNA, 13 nt, Human
uuuuguugugugu

SEQ ID NO: 3856091 - RNA, 23 nt, Human
uuuuguuguuucuuaauuuggaa

SEQ ID NO: 3856092 - RNA, 13 nt, Human
uuuuguuucugua

SEQ ID NO: 3856093 - RNA, 15 nt, Human
uuuuguuucuuccaa

SEQ ID NO: 3856094 - RNA, 20 nt, Human
uuuuguuugaugcaggcacu

SEQ ID NO: 3856095 - RNA, 22 nt, Human
uuuuguuugcuaucuuaauuuu

SEQ ID NO: 3856096 - RNA, 19 nt, Human
uuuuguuuggcaaggaaag

SEQ ID NO: 3856097 - RNA, 15 nt, Human
uuuuguuugguaaau

SEQ ID NO: 3856098 - RNA, 19 nt, Human
uuuuguuugguauuguauu

SEQ ID NO: 3856099 - RNA, 13 nt, Human
uuuuguuugguua

SEQ ID NO: 3856100 - RNA, 14 nt, Human
uuuuguuuguuucu

SEQ ID NO: 3856101 - RNA, 21 nt, Human
uuuuguuuguuucuuuguguu

SEQ ID NO: 3856102 - RNA, 13 nt, Human
uuuuguuuuacaa

SEQ ID NO: 3856103 - RNA, 20 nt, Human
uuuuguuuuuauuaaaagga

SEQ ID NO: 3856104 - RNA, 16 nt, Human
uuuuguuuuugucuua

SEQ ID NO: 3856105 - RNA, 16 nt, Human
uuuuguuuuuugaguc

SEQ ID NO: 3856106 - RNA, 17 nt, Human
uuuuuaaaaaaagaaaa

SEQ ID NO: 3856107 - RNA, 17 nt, Human
uuuuuaaaaaagcuuaa

SEQ ID NO: 3856108 - RNA, 18 nt, Human
uuuuuaaaaaauauuuuc

SEQ ID NO: 3856109 - RNA, 19 nt, Human
uuuuuaaaaaauauuuucu

SEQ ID NO: 3856110 - RNA, 14 nt, Human
uuuuuaaaaagcaa

SEQ ID NO: 3856111 - RNA, 23 nt, Human
uuuuuaaaaaucauaaacugugu

SEQ ID NO: 3856112 - RNA, 20 nt, Human
uuuuuaaaaaugcaaauccu

SEQ ID NO: 3856113 - RNA, 23 nt, Human
uuuuuaaaacacauguuuuuaua

SEQ ID NO: 3856114 - RNA, 19 nt, Human
uuuuuaaaaguuucaaugu

SEQ ID NO: 3856115 - RNA, 14 nt, Human
uuuuuaaaauagaa

SEQ ID NO: 3856116 - RNA, 14 nt, Human
uuuuuaaaauggug

SEQ ID NO: 3856117 - RNA, 15 nt, Human
uuuuuaaacuguaca

SEQ ID NO: 3856118 - RNA, 18 nt, Human
uuuuuaaacuguacagug

SEQ ID NO: 3856119 - RNA, 13 nt, Human
ucucacuugugcc

SEQ ID NO: 3856120 - RNA, 13 nt, Human
ucucacuuguuuc

SEQ ID NO: 3856121 - RNA, 17 nt, Human
ucucacuuuucuccaug

SEQ ID NO: 3856122 - RNA, 15 nt, Human
ucucagaagcacaga

SEQ ID NO: 3856123 - RNA, 16 nt, Human
ucucagaagcacagaa

SEQ ID NO: 3856124 - RNA, 20 nt, Human
ucucagaaggcaaaugacuu

SEQ ID NO: 3856125 - RNA, 22 nt, Human
ucucagaaggcaaaugacuuug

SEQ ID NO: 3856126 - RNA, 13 nt, Human
ucucagaagggag

SEQ ID NO: 3856127 - RNA, 12 nt, Human
ucucagaauccc

SEQ ID NO: 3856128 - RNA, 21 nt, Human
ucucagaaucccuuaacaguu

SEQ ID NO: 3856129 - RNA, 12 nt, Human
ucucagaaucua

SEQ ID NO: 3856130 - RNA, 16 nt, Human
ucucagacugcaugua

SEQ ID NO: 3856131 - RNA, 21 nt, Human
ucucagacuuuggaaaaugca

SEQ ID NO: 3856132 - RNA, 22 nt, Human
ucucagacuuuggaaaaugcau

SEQ ID NO: 3856133 - RNA, 17 nt, Human
ucucagacuuuuguaca

SEQ ID NO: 3856134 - RNA, 19 nt, Human
ucucagagcuacuugggcc

SEQ ID NO: 3856135 - RNA, 16 nt, Human
ucucagauauuuauau

SEQ ID NO: 3856136 - RNA, 14 nt, Human
ucucagauccuugu

SEQ ID NO: 3856137 - RNA, 16 nt, Human
ucucagauccuuguuu

SEQ ID NO: 3856138 - RNA, 18 nt, Human
ucucagauguuaaaauaa

SEQ ID NO: 3856139 - RNA, 17 nt, Human
ucucagauuuuauuaug

SEQ ID NO: 3856140 - RNA, 22 nt, Human
ucucagauuuuauuauguaaau

SEQ ID NO: 3856141 - RNA, 23 nt, Human
ucucagauuuuauuauguaaauc

SEQ ID NO: 3856142 - RNA, 14 nt, Human
ucucagcaagagaa

SEQ ID NO: 3856143 - RNA, 21 nt, Human
ucucagcaaugauuacucuuu

SEQ ID NO: 3856144 - RNA, 18 nt, Human
ucucagcagcgaccaccc

SEQ ID NO: 3856145 - RNA, 11 nt, Human
ucucagccucc

SEQ ID NO: 3856146 - RNA, 20 nt, Human
ucucagccuuacauuuguga

SEQ ID NO: 3856147 - RNA, 20 nt, Human
ucucagcucaucuucacugc

SEQ ID NO: 3856148 - RNA, 17 nt, Human
ucucagcucccccuguc

SEQ ID NO: 3856149 - RNA, 19 nt, Human
ucucagcucccccuguccc

SEQ ID NO: 3856150 - RNA, 13 nt, Human
ucucagcuuugag

SEQ ID NO: 3856151 - RNA, 17 nt, Human
ucucaggacacaggccu

SEQ ID NO: 3856152 - RNA, 18 nt, Human
ucucaggacacaggccug

SEQ ID NO: 3856153 - RNA, 21 nt, Human
ucucaggacacaggccugugu

SEQ ID NO: 3856154 - RNA, 16 nt, Human
ucucaggaccuaggga

SEQ ID NO: 3856155 - RNA, 16 nt, Human
ucucaggagauuucau

SEQ ID NO: 3856156 - RNA, 14 nt, Human
ucucaggagcacag

SEQ ID NO: 3856157 - RNA, 15 nt, Human
ucucaggagcacagg

SEQ ID NO: 3856158 - RNA, 16 nt, Human
ucucaggagcacaggc

SEQ ID NO: 3856159 - RNA, 19 nt, Human
ucucaggagcacaggcagc

SEQ ID NO: 3856160 - RNA, 15 nt, Human
ucucaggagcauggg

SEQ ID NO: 3856161 - RNA, 20 nt, Human
ucucaggaucaagaaagugu

SEQ ID NO: 3856162 - RNA, 13 nt, Human
ucucaggauccaa

SEQ ID NO: 3856163 - RNA, 22 nt, Human
ucucaggauccccucucuuccu

SEQ ID NO: 3856164 - RNA, 10 nt, Human
ucucaggcca

SEQ ID NO: 3856165 - RNA, 21 nt, Human
ucucaggccaccugcccccuu

SEQ ID NO: 3856166 - RNA, 13 nt, Human
ucucaggccagcu

SEQ ID NO: 3856167 - RNA, 17 nt, Human
ucucaggccagcugcuu

SEQ ID NO: 3856168 - RNA, 18 nt, Human
ucucaggccagcugcuug

SEQ ID NO: 3856169 - RNA, 21 nt, Human
ucucaggccagcugcuugggc

SEQ ID NO: 3856170 - RNA, 20 nt, Human
ucucaggccggcagccccag

SEQ ID NO: 3856171 - RNA, 13 nt, Human
ucucaggcugccu

SEQ ID NO: 3856172 - RNA, 16 nt, Human
ucucaggcugccugag

SEQ ID NO: 3856173 - RNA, 16 nt, Human
ucucagggaagcccag

SEQ ID NO: 3856174 - RNA, 17 nt, Human
ucucagggaagcccagc

SEQ ID NO: 3856175 - RNA, 14 nt, Human
ucucagggccaggc

SEQ ID NO: 3856176 - RNA, 17 nt, Human
ucucagggccaggccuc

SEQ ID NO: 3856177 - RNA, 15 nt, Human
ucucagggccugguc

SEQ ID NO: 3856178 - RNA, 11 nt, Human
ucucagggcuc

SEQ ID NO: 3856179 - RNA, 12 nt, Human
ucucagggcucc

SEQ ID NO: 3856180 - RNA, 16 nt, Human
ucucagggcuccugcc

SEQ ID NO: 3856181 - RNA, 17 nt, Human
ucucaggggccagagga

SEQ ID NO: 3856182 - RNA, 20 nt, Human
ucucaggggccagaggaacu

SEQ ID NO: 3856183 - RNA, 18 nt, Human
ucucagggucucugcugc

SEQ ID NO: 3856184 - RNA, 19 nt, Human
ucucagggucucugcugcc

SEQ ID NO: 3856185 - RNA, 17 nt, Human
ucucaguacuuuggagg

SEQ ID NO: 3856186 - RNA, 16 nt, Human
ucucagucaugcauaa

SEQ ID NO: 3856187 - RNA, 15 nt, Human
ucucagucucugagc

SEQ ID NO: 3856188 - RNA, 17 nt, Human
ucucagucucugagcag

SEQ ID NO: 3856189 - RNA, 18 nt, Human
ucucagucucugagcagu

SEQ ID NO: 3856190 - RNA, 21 nt, Human
ucucagugccaacuguggcug

SEQ ID NO: 3856191 - RNA, 16 nt, Human
ucucagugcccuccag

SEQ ID NO: 3856192 - RNA, 22 nt, Human
ucucagugguuaagauuccuaa

SEQ ID NO: 3856193 - RNA, 18 nt, Human
ucucaguguugagccuuu

SEQ ID NO: 3856194 - RNA, 22 nt, Human
ucucaguguugagccuuuuccc

SEQ ID NO: 3856195 - RNA, 13 nt, Human
ucucaguguuggu

SEQ ID NO: 3856196 - RNA, 14 nt, Human
ucucaguguuggua

SEQ ID NO: 3856197 - RNA, 15 nt, Human
ucucaguguuuugga

SEQ ID NO: 3856198 - RNA, 21 nt, Human
ucucaguuaaaaugugaggaa

SEQ ID NO: 3856199 - RNA, 13 nt, Human
ucucaguuucacu

SEQ ID NO: 3856200 - RNA, 19 nt, Human
ucucaguuugugugucuua

SEQ ID NO: 3856201 - RNA, 12 nt, Human
ucucaguuuuuc

SEQ ID NO: 3856202 - RNA, 18 nt, Human
ucucaguuuuucuuaaua

SEQ ID NO: 3856203 - RNA, 13 nt, Human
ucucauaaauuua

SEQ ID NO: 3856204 - RNA, 23 nt, Human
ucucauaauuuauacaggucaua

SEQ ID NO: 3856205 - RNA, 15 nt, Human
ucucauacguccacc

SEQ ID NO: 3856206 - RNA, 21 nt, Human
ucucauacucccccacaguuu

SEQ ID NO: 3856207 - RNA, 18 nt, Human
ucucaucacacacaugga

SEQ ID NO: 3856208 - RNA, 19 nt, Human
ucucaucacuccccuccaa

SEQ ID NO: 3856209 - RNA, 15 nt, Human
ucucaucaguguccu

SEQ ID NO: 3856210 - RNA, 15 nt, Human
ucucaucaugucuau

SEQ ID NO: 3856211 - RNA, 19 nt, Human
ucucaucucagugaagaau

SEQ ID NO: 3856212 - RNA, 20 nt, Human
ucucaucucuuagcuccccu

SEQ ID NO: 3856213 - RNA, 18 nt, Human
ucucaucucuucuuuuaa

SEQ ID NO: 3856214 - RNA, 12 nt, Human
ucucaucuuucu

SEQ ID NO: 3856215 - RNA, 13 nt, Human
ucucaugaaccuc

SEQ ID NO: 3856216 - RNA, 14 nt, Human
ucucaugaaucugc

SEQ ID NO: 3856217 - RNA, 20 nt, Human
ucucaugaggggagaggaga

SEQ ID NO: 3856218 - RNA, 21 nt, Human
ucucaugccccuggcugggac

SEQ ID NO: 3856219 - RNA, 15 nt, Human
ucucaugcuccuuaa

SEQ ID NO: 3856220 - RNA, 13 nt, Human
ucucaugcugccc

SEQ ID NO: 3856221 - RNA, 15 nt, Human
ucucauggagaaguu

SEQ ID NO: 3856222 - RNA, 17 nt, Human
ucucaugugauccuuuu

SEQ ID NO: 3856223 - RNA, 13 nt, Human
ucugccugucccu

SEQ ID NO: 3856224 - RNA, 18 nt, Human
ucugccugucccucucag

SEQ ID NO: 3856225 - RNA, 11 nt, Human
ucugccuguga

SEQ ID NO: 3856226 - RNA, 16 nt, Human
ucugccuguggaacug

SEQ ID NO: 3856227 - RNA, 15 nt, Human
ucugccuguuauaac

SEQ ID NO: 3856228 - RNA, 22 nt, Human
ucugccuguuauaacucugcac

SEQ ID NO: 3856229 - RNA, 16 nt, Human
ucugccuguugcguga

SEQ ID NO: 3856230 - RNA, 16 nt, Human
ucugccuuagaggagc

SEQ ID NO: 3856231 - RNA, 13 nt, Human
ucugccuuccuug

SEQ ID NO: 3856232 - RNA, 16 nt, Human
ucugccuuuauugugu

SEQ ID NO: 3856233 - RNA, 14 nt, Human
ucugccuuugacau

SEQ ID NO: 3856234 - RNA, 14 nt, Human
aagcaccccuucau

SEQ ID NO: 3856235 - RNA, 15 nt, Human
aagcacgaaauguua

SEQ ID NO: 3856236 - RNA, 21 nt, Human
aagcacgugguaaaacacuug

SEQ ID NO: 3856237 - RNA, 23 nt, Human
aagcacuacaccuugccuugcug

SEQ ID NO: 3856238 - RNA, 21 nt, Human
aagcacuccucccugauguac

SEQ ID NO: 3856239 - RNA, 23 nt, Human
aagcacuccucccugauguacag

SEQ ID NO: 3856240 - RNA, 23 nt, Human
aagcacuccugcuuaaucuucaa

SEQ ID NO: 3856241 - RNA, 22 nt, Human
aagcacugacugggaccaggca

SEQ ID NO: 3856242 - RNA, 16 nt, Human
aagcacugacuucuaa

SEQ ID NO: 3856243 - RNA, 20 nt, Human
aagcacugacuucuaaguaa

SEQ ID NO: 3856244 - RNA, 12 nt, Human
aagcacugagca

SEQ ID NO: 3856245 - RNA, 20 nt, Human
aagcagaaaauaaaggaagc

SEQ ID NO: 3856246 - RNA, 17 nt, Human
aagcagaaagugccuuu

SEQ ID NO: 3856247 - RNA, 19 nt, Human
aagcagaaagugccuuuca

SEQ ID NO: 3856248 - RNA, 16 nt, Human
aagcagaaauccaagc

SEQ ID NO: 3856249 - RNA, 22 nt, Human
aagcagaaauccugcaaugaaa

SEQ ID NO: 3856250 - RNA, 11 nt, Human
aagcagaauaa

SEQ ID NO: 3856251 - RNA, 12 nt, Human
aagcagaauaaa

SEQ ID NO: 3856252 - RNA, 14 nt, Human
aagcagaauuggaa

SEQ ID NO: 3856253 - RNA, 16 nt, Human
aagcagaauuggaaaa

SEQ ID NO: 3856254 - RNA, 15 nt, Human
aagcagacagcucca

SEQ ID NO: 3856255 - RNA, 14 nt, Human
aagcagaggaagga

SEQ ID NO: 3856256 - RNA, 14 nt, Human
aagcagaggagggg

SEQ ID NO: 3856257 - RNA, 22 nt, Human
aagcagaggaggggccgcugcc

SEQ ID NO: 3856258 - RNA, 17 nt, Human
aagcagagugcacagcu

SEQ ID NO: 3856259 - RNA, 20 nt, Human
aagcagagugcacagcuguc

SEQ ID NO: 3856260 - RNA, 14 nt, Human
aagcagaguuuuca

SEQ ID NO: 3856261 - RNA, 15 nt, Human
aagcagaguuuucau

SEQ ID NO: 3856262 - RNA, 14 nt, Human
aagcagaugcaaag

SEQ ID NO: 3856263 - RNA, 16 nt, Human
aagcagaugcaaagag

SEQ ID NO: 3856264 - RNA, 18 nt, Human
aagcagaugcaaagaggc

SEQ ID NO: 3856265 - RNA, 19 nt, Human
aagcagaugcaaagaggca

SEQ ID NO: 3856266 - RNA, 21 nt, Human
aagcagaugcaaagaggcaag

SEQ ID NO: 3856267 - RNA, 20 nt, Human
aagcagauggaaugcugugu

SEQ ID NO: 3856268 - RNA, 14 nt, Human
aagcagcaacuauu

SEQ ID NO: 3856269 - RNA, 16 nt, Human
aagcagcacuuauaaa

SEQ ID NO: 3856270 - RNA, 12 nt, Human
aagcagcagccu

SEQ ID NO: 3856271 - RNA, 17 nt, Human
aagcagcauaaagaauu

SEQ ID NO: 3856272 - RNA, 21 nt, Human
aagcagccaagcuccuuggga

SEQ ID NO: 3856273 - RNA, 13 nt, Human
aagcagcccuugg

SEQ ID NO: 3856274 - RNA, 16 nt, Human
aagcagcccuuggcca

SEQ ID NO: 3856275 - RNA, 17 nt, Human
aagcagcccuuggccag

SEQ ID NO: 3856276 - RNA, 22 nt, Human
aagcagccucuccccaggucca

SEQ ID NO: 3856277 - RNA, 19 nt, Human
aagcagcgaccgcccccuc

SEQ ID NO: 3856278 - RNA, 20 nt, Human
aagcagcguuucuaugacac

SEQ ID NO: 3856279 - RNA, 21 nt, Human
aagcagcguuucuaugacaca

SEQ ID NO: 3856280 - RNA, 19 nt, Human
aagcagcucaaaggcacag

SEQ ID NO: 3856281 - RNA, 13 nt, Human
aagcagcucuccc

SEQ ID NO: 3856282 - RNA, 17 nt, Human
aagcagcucuugcuaau

SEQ ID NO: 3856283 - RNA, 18 nt, Human
aagcaggagacgacaggc

SEQ ID NO: 3856284 - RNA, 21 nt, Human
aagcaggaggaggugccaaca

SEQ ID NO: 3856285 - RNA, 22 nt, Human
aagcaggcuacacugacacugg

SEQ ID NO: 3856286 - RNA, 21 nt, Human
aagcaggcuugcccaguacau

SEQ ID NO: 3856287 - RNA, 22 nt, Human
aagcagggaauuucuaucuaaa

SEQ ID NO: 3856288 - RNA, 12 nt, Human
aagcagggagga

SEQ ID NO: 3856289 - RNA, 20 nt, Human
aagcaggggcuacaagaggg

SEQ ID NO: 3856290 - RNA, 14 nt, Human
aagcagguuaaaug

SEQ ID NO: 3856291 - RNA, 21 nt, Human
aagcagguuagagaaaauaga

SEQ ID NO: 3856292 - RNA, 15 nt, Human
aagcagguugauaaa

SEQ ID NO: 3856293 - RNA, 16 nt, Human
aagcagguuucaagga

SEQ ID NO: 3856294 - RNA, 17 nt, Human
aagcagguuucaaggaa

SEQ ID NO: 3856295 - RNA, 15 nt, Human
aagcaguauuuuggu

SEQ ID NO: 3856296 - RNA, 17 nt, Human
aagcagucgugccugug

SEQ ID NO: 3856297 - RNA, 18 nt, Human
aagcagucgugccugugu

SEQ ID NO: 3856298 - RNA, 14 nt, Human
aagcagugcaugcu

SEQ ID NO: 3856299 - RNA, 20 nt, Human
aagcagugcaugcugucccu

SEQ ID NO: 3856300 - RNA, 15 nt, Human
aagcagugccuucca

SEQ ID NO: 3856301 - RNA, 17 nt, Human
aagcagugccuuccaua

SEQ ID NO: 3856302 - RNA, 20 nt, Human
aagcagugccuuccauaauu

SEQ ID NO: 3856303 - RNA, 15 nt, Human
aagcaguugugucag

SEQ ID NO: 3856304 - RNA, 22 nt, Human
aagcauaaaaacauuuuaaaaa

SEQ ID NO: 3856305 - RNA, 22 nt, Human
aagcauaaaagaugaaagagca

SEQ ID NO: 3856306 - RNA, 23 nt, Human
aagcauaaaagaugaaagagcag

SEQ ID NO: 3856307 - RNA, 22 nt, Human
aagcauaaaauucuuaaaauau

SEQ ID NO: 3856308 - RNA, 14 nt, Human
aagcauacuuugua

SEQ ID NO: 3856309 - RNA, 21 nt, Human
aagcauagauaauauuguuug

SEQ ID NO: 3856310 - RNA, 14 nt, Human
aagcauagauguuu

SEQ ID NO: 3856311 - RNA, 15 nt, Human
aagcauauaaaaugg

SEQ ID NO: 3856312 - RNA, 22 nt, Human
aagcauauaaaauggcaacaaa

SEQ ID NO: 3856313 - RNA, 19 nt, Human
aagcauauggguuagaugu

SEQ ID NO: 3856314 - RNA, 17 nt, Human
aagcauauuguuauuau

SEQ ID NO: 3856315 - RNA, 23 nt, Human
aagcauauuguuauuauauaauu

SEQ ID NO: 3856316 - RNA, 18 nt, Human
aagcaucagggggaagaa

SEQ ID NO: 3856317 - RNA, 23 nt, Human
aagcaucagggggaagaagcaga

SEQ ID NO: 3856318 - RNA, 15 nt, Human
aagcaucauuauuua

SEQ ID NO: 3856319 - RNA, 17 nt, Human
aagcaucauuauuuaug

SEQ ID NO: 3856320 - RNA, 19 nt, Human
aagcaucauuauuuaugua

SEQ ID NO: 3856321 - RNA, 23 nt, Human
aagcaucauuauuuauguauugu

SEQ ID NO: 3856322 - RNA, 22 nt, Human
aagcaucauuauuugcagagac

SEQ ID NO: 3856323 - RNA, 13 nt, Human
aagcauccaggca

SEQ ID NO: 3856324 - RNA, 14 nt, Human
aagcauccaugugu

SEQ ID NO: 3856325 - RNA, 21 nt, Human
aagcauccauguguggacuca

SEQ ID NO: 3856326 - RNA, 18 nt, Human
aagcaucggagggaauug

SEQ ID NO: 3856327 - RNA, 15 nt, Human
aagcaucuaaggaca

SEQ ID NO: 3856328 - RNA, 18 nt, Human
aagcaucuaaguuauaag

SEQ ID NO: 3856329 - RNA, 12 nt, Human
aagcaucuccug

SEQ ID NO: 3856330 - RNA, 20 nt, Human
aagcaucuuggggggguggc

SEQ ID NO: 3856331 - RNA, 14 nt, Human
aagcaugaaaugug

SEQ ID NO: 3856332 - RNA, 20 nt, Human
aagcaugaacagugcaccug

SEQ ID NO: 3856333 - RNA, 15 nt, Human
aagcaugaagauaaa

SEQ ID NO: 3856334 - RNA, 18 nt, Human
aagcaugacagaaaauau

SEQ ID NO: 3856335 - RNA, 20 nt, Human
aagcaugacagaaaauaugu

SEQ ID NO: 3856336 - RNA, 23 nt, Human
aagcaugcacaaauucugucucu

SEQ ID NO: 3856337 - RNA, 21 nt, Human
aagcaugcuugugaaaaugug

SEQ ID NO: 3856338 - RNA, 19 nt, Human
aagcauggacauuuagaag

SEQ ID NO: 3856339 - RNA, 23 nt, Human
aagcauggucccacaucccuggg

SEQ ID NO: 3856340 - RNA, 19 nt, Human
aagcauguaacuuauauua

SEQ ID NO: 3856341 - RNA, 15 nt, Human
aagcauguacagugu

SEQ ID NO: 3856342 - RNA, 17 nt, Human
aagcauguacaguguuc

SEQ ID NO: 3856343 - RNA, 21 nt, Human
aagcauguacaguguucuguu

SEQ ID NO: 3856344 - RNA, 16 nt, Human
aagcauguaggagaau

SEQ ID NO: 3856345 - RNA, 17 nt, Human
aagcaugucucaauagu

SEQ ID NO: 3856346 - RNA, 19 nt, Human
aagcauguggcauguucau

SEQ ID NO: 3856347 - RNA, 14 nt, Human
aagcauguuucaug

SEQ ID NO: 3856348 - RNA, 16 nt, Human
aagcauguuucauguu

SEQ ID NO: 3856349 - RNA, 17 nt, Human
aagcauuaacuucucug

SEQ ID NO: 3856350 - RNA, 23 nt, Human
aagcauuacucuuguaagauuuu

SEQ ID NO: 3856351 - RNA, 21 nt, Human
aagcauucagaagaaaaagaa

SEQ ID NO: 3856352 - RNA, 18 nt, Human
aagcauuccuucuuugau

SEQ ID NO: 3856353 - RNA, 21 nt, Human
aagcauuccuucuuugauaau

SEQ ID NO: 3856354 - RNA, 22 nt, Human
aagcauucucauuggaaauuua

SEQ ID NO: 3856355 - RNA, 13 nt, Human
aagcauugccugg

SEQ ID NO: 3856356 - RNA, 21 nt, Human
aagcauugccuggccuuccug

SEQ ID NO: 3856357 - RNA, 18 nt, Human
aagcauuguaaaauaauu

SEQ ID NO: 3856358 - RNA, 14 nt, Human
aagcauuguuugcu

SEQ ID NO: 3856359 - RNA, 22 nt, Human
aagcauuguuugcuuauuguuc

SEQ ID NO: 3856360 - RNA, 23 nt, Human
aagcauuguuugcuuauuguucc

SEQ ID NO: 3856361 - RNA, 21 nt, Human
aagcauuuaaccccccuguac

SEQ ID NO: 3856362 - RNA, 19 nt, Human
aagcauuuaauguagccau

SEQ ID NO: 3856363 - RNA, 23 nt, Human
aagcauuuaauguagccauggga

SEQ ID NO: 3856364 - RNA, 18 nt, Human
aagcauuuacaagugcug

SEQ ID NO: 3856365 - RNA, 12 nt, Human
aagcauuuauaa

SEQ ID NO: 3856366 - RNA, 12 nt, Human
ucuuaauuauua

SEQ ID NO: 3856367 - RNA, 17 nt, Human
ucuuaauuauuauaaaa

SEQ ID NO: 3856368 - RNA, 18 nt, Human
ucuuaauuauuauaaaaa

SEQ ID NO: 3856369 - RNA, 22 nt, Human
ucuuaauuauuauaaaaauauu

SEQ ID NO: 3856370 - RNA, 23 nt, Human
ucuuaauuuaaucuuuuuuaugu

SEQ ID NO: 3856371 - RNA, 17 nt, Human
ucuuaauuucuaucuug

SEQ ID NO: 3856372 - RNA, 12 nt, Human
ucuuaauuugga

SEQ ID NO: 3856373 - RNA, 13 nt, Human
ucuuaauuuggaa

SEQ ID NO: 3856374 - RNA, 16 nt, Human
ucuuaauuuggaaacu

SEQ ID NO: 3856375 - RNA, 19 nt, Human
ucuuaauuuggaaacuaau

SEQ ID NO: 3856376 - RNA, 16 nt, Human
ucuuacacauacaguu

SEQ ID NO: 3856377 - RNA, 17 nt, Human
ucuuacaggcacaaaau

SEQ ID NO: 3856378 - RNA, 15 nt, Human
ucuuacauguuuucu

SEQ ID NO: 3856379 - RNA, 16 nt, Human
ucuuacccaauuuccc

SEQ ID NO: 3856380 - RNA, 21 nt, Human
ucuuacccuucugugcccagc

SEQ ID NO: 3856381 - RNA, 23 nt, Human
ucuuaccuguaugucuccaguau

SEQ ID NO: 3856382 - RNA, 20 nt, Human
ucuuaccuugaacugaaggc

SEQ ID NO: 3856383 - RNA, 15 nt, Human
ucuuacgaauauuuu

SEQ ID NO: 3856384 - RNA, 17 nt, Human
ucuuacuaaaaaguaua

SEQ ID NO: 3856385 - RNA, 16 nt, Human
ucuuacuaaacauuuu

SEQ ID NO: 3856386 - RNA, 14 nt, Human
ucuuacuaauguaa

SEQ ID NO: 3856387 - RNA, 21 nt, Human
ucuuacuaauguaaaaugauu

SEQ ID NO: 3856388 - RNA, 15 nt, Human
ucuuacuauuucaca

SEQ ID NO: 3856389 - RNA, 18 nt, Human
ucuuacuccuccucuuuc

SEQ ID NO: 3856390 - RNA, 13 nt, Human
ucuuacucuuucc

SEQ ID NO: 3856391 - RNA, 15 nt, Human
ucuuacucuuuccua

SEQ ID NO: 3856392 - RNA, 16 nt, Human
ucuuacucuuuccuau

SEQ ID NO: 3856393 - RNA, 23 nt, Human
ucuuacugaagguaaaauugaaa

SEQ ID NO: 3856394 - RNA, 16 nt, Human
ucuuacugauaauuuu

SEQ ID NO: 3856395 - RNA, 13 nt, Human
ucuuacugcaaau

SEQ ID NO: 3856396 - RNA, 22 nt, Human
ucuuacugcuuaauucaaauaa

SEQ ID NO: 3856397 - RNA, 19 nt, Human
ucuuacugucuuuuuucua

SEQ ID NO: 3856398 - RNA, 16 nt, Human
ucuuacuuuguaaauu

SEQ ID NO: 3856399 - RNA, 15 nt, Human
ucuuagaaaagguga

SEQ ID NO: 3856400 - RNA, 12 nt, Human
ucuuagaaauuu

SEQ ID NO: 3856401 - RNA, 21 nt, Human
ucuuagaacaguggaaacuau

SEQ ID NO: 3856402 - RNA, 19 nt, Human
ucuuagaaguggaccagga

SEQ ID NO: 3856403 - RNA, 14 nt, Human
ucuuagacuacauu

SEQ ID NO: 3856404 - RNA, 20 nt, Human
ucuuagacuacauuuagaga

SEQ ID NO: 3856405 - RNA, 15 nt, Human
ucuuagacuucugcu

SEQ ID NO: 3856406 - RNA, 18 nt, Human
ucuuagacuugaaauacu

SEQ ID NO: 3856407 - RNA, 17 nt, Human
ucuuagacuuuuccaau

SEQ ID NO: 3856408 - RNA, 23 nt, Human
ucuuagacuuuuccaauauguga

SEQ ID NO: 3856409 - RNA, 17 nt, Human
ucuuagauaucuuuuua

SEQ ID NO: 3856410 - RNA, 23 nt, Human
ucuuagauaucuuuuuauugaug

SEQ ID NO: 3856411 - RNA, 12 nt, Human
ucuuagauucuc

SEQ ID NO: 3856412 - RNA, 21 nt, Human
ucuuagauucucugugucuaa

SEQ ID NO: 3856413 - RNA, 15 nt, Human
ucuuagccuguggca

SEQ ID NO: 3856414 - RNA, 22 nt, Human
ucuuagccuguggcaguaaaga

SEQ ID NO: 3856415 - RNA, 15 nt, Human
ucuucagggggccag

SEQ ID NO: 3856416 - RNA, 18 nt, Human
ucuucaguugguguguuu

SEQ ID NO: 3856417 - RNA, 21 nt, Human
ucuucaguugguugugucuuu

SEQ ID NO: 3856418 - RNA, 20 nt, Human
ucuucauaacaauuuuagga

SEQ ID NO: 3856419 - RNA, 18 nt, Human
ucuucauaccuacaugua

SEQ ID NO: 3856420 - RNA, 13 nt, Human
ucuucauacuuuu

SEQ ID NO: 3856421 - RNA, 13 nt, Human
ucuucaugaaaug

SEQ ID NO: 3856422 - RNA, 14 nt, Human
ucuucaugcaauga

SEQ ID NO: 3856423 - RNA, 22 nt, Human
ucuucauggaauucacaaagua

SEQ ID NO: 3856424 - RNA, 16 nt, Human
ucuucauguucccacu

SEQ ID NO: 3856425 - RNA, 21 nt, Human
ucuucauuaagcccucuucca

SEQ ID NO: 3856426 - RNA, 17 nt, Human
ucuucauuauucucugc

SEQ ID NO: 3856427 - RNA, 17 nt, Human
ucuucauuucauuguau

SEQ ID NO: 3856428 - RNA, 21 nt, Human
ucuuccaaagcagagagcauu

SEQ ID NO: 3856429 - RNA, 20 nt, Human
ucuuccaaaguaaaauugcu

SEQ ID NO: 3856430 - RNA, 17 nt, Human
ucuuccaaccauuuauc

SEQ ID NO: 3856431 - RNA, 19 nt, Human
ucuuccaaccauuuaucuu

SEQ ID NO: 3856432 - RNA, 22 nt, Human
ucuuccaaccauuuaucuugaa

SEQ ID NO: 3856433 - RNA, 21 nt, Human
ucuuccaagacuccagcccug

SEQ ID NO: 3856434 - RNA, 24 nt, Human
ucuuccaagcaaaggugaagagac

SEQ ID NO: 3856435 - RNA, 23 nt, Human
ucuuccacaaagaaaauuccuau

SEQ ID NO: 3856436 - RNA, 16 nt, Human
ucuuccagaaguguga

SEQ ID NO: 3856437 - RNA, 19 nt, Human
ucuuccaggcccccaaccc

SEQ ID NO: 3856438 - RNA, 14 nt, Human
ucuuccagggggaa

SEQ ID NO: 3856439 - RNA, 22 nt, Human
ucuuccaguuugcuuugcccuu

SEQ ID NO: 3856440 - RNA, 19 nt, Human
ucuuccauaugaccucaug

SEQ ID NO: 3856441 - RNA, 22 nt, Human
ucuuccauauggauccacuggc

SEQ ID NO: 3856442 - RNA, 13 nt, Human
ucuuccaucaugg

SEQ ID NO: 3856443 - RNA, 19 nt, Human
ucuuccaucauguccccaa

SEQ ID NO: 3856444 - RNA, 15 nt, Human
ucuuccaugcugugc

SEQ ID NO: 3856445 - RNA, 17 nt, Human
ucuuccaugcugugcgc

SEQ ID NO: 3856446 - RNA, 13 nt, Human
ucuuccauuugca

SEQ ID NO: 3856447 - RNA, 23 nt, Human
ucuucccagcacuaugcuuuccu

SEQ ID NO: 3856448 - RNA, 21 nt, Human
ucuucccaggguagcccgccu

SEQ ID NO: 3856449 - RNA, 17 nt, Human
ucuucccaugcauucug

SEQ ID NO: 3856450 - RNA, 14 nt, Human
ucuucccauggugc

SEQ ID NO: 3856451 - RNA, 19 nt, Human
ucuucccauucuccauuug

SEQ ID NO: 3856452 - RNA, 20 nt, Human
ucuuccccaacgaaaagcac

SEQ ID NO: 3856453 - RNA, 15 nt, Human
ugaaaaguuuuuguu

SEQ ID NO: 3856454 - RNA, 15 nt, Human
ugaaaauaaagaaug

SEQ ID NO: 3856455 - RNA, 16 nt, Human
ugaaaauaaagaaugg

SEQ ID NO: 3856456 - RNA, 17 nt, Human
ugaaaauaaagaaugga

SEQ ID NO: 3856457 - RNA, 14 nt, Human
ugaaaauaagccau

SEQ ID NO: 3856458 - RNA, 18 nt, Human
ugaaaauaaucucugauu

SEQ ID NO: 3856459 - RNA, 17 nt, Human
ugaaaauaaugcuguuc

SEQ ID NO: 3856460 - RNA, 12 nt, Human
ugaaaauacaac

SEQ ID NO: 3856461 - RNA, 23 nt, Human
ugaaaauaguuuauuuuaaaaca

SEQ ID NO: 3856462 - RNA, 16 nt, Human
ugaaaauauaaccagc

SEQ ID NO: 3856463 - RNA, 17 nt, Human
ugaaaauauaugauggc

SEQ ID NO: 3856464 - RNA, 23 nt, Human
ugaaaauaucugcucaaaacuuu

SEQ ID NO: 3856465 - RNA, 20 nt, Human
ugaaaauaugauguuucaca

SEQ ID NO: 3856466 - RNA, 15 nt, Human
ugaaaauccuaccaa

SEQ ID NO: 3856467 - RNA, 14 nt, Human
ugaaaaucuaauau

SEQ ID NO: 3856468 - RNA, 15 nt, Human
ugaaaaucuaauauu

SEQ ID NO: 3856469 - RNA, 17 nt, Human
ugaaaaucuaauauuaa

SEQ ID NO: 3856470 - RNA, 21 nt, Human
ugaaaaucuaauauuaaaaau

SEQ ID NO: 3856471 - RNA, 20 nt, Human
ugaaaaucuuauaauuuaaa

SEQ ID NO: 3856472 - RNA, 14 nt, Human
ugaaaaucuuggag

SEQ ID NO: 3856473 - RNA, 17 nt, Human
ugaaaaugaguugugaa

SEQ ID NO: 3856474 - RNA, 18 nt, Human
ugaaaaugcaacaacaug

SEQ ID NO: 3856475 - RNA, 20 nt, Human
ugaaaaugcaacaacaugua

SEQ ID NO: 3856476 - RNA, 12 nt, Human
ugaaaaugcugg

SEQ ID NO: 3856477 - RNA, 21 nt, Human
ugaaaaugguauuuucccccu

SEQ ID NO: 3856478 - RNA, 20 nt, Human
ugaaaauguccaggaaagug

SEQ ID NO: 3856479 - RNA, 17 nt, Human
ugaaaauguccuuguga

SEQ ID NO: 3856480 - RNA, 23 nt, Human
ugaaaauguccuugugaugugca

SEQ ID NO: 3856481 - RNA, 14 nt, Human
ugaaaaugucuugu

SEQ ID NO: 3856482 - RNA, 20 nt, Human
ugaaaaugugcuauacugca

SEQ ID NO: 3856483 - RNA, 14 nt, Human
ugaaaauguguguu

SEQ ID NO: 3856484 - RNA, 11 nt, Human
ugaaaauguua

SEQ ID NO: 3856485 - RNA, 16 nt, Human
ugaaaauguuguuaug

SEQ ID NO: 3856486 - RNA, 14 nt, Human
ugaaaauuaacacu

SEQ ID NO: 3856487 - RNA, 18 nt, Human
ugaaaauuaacacugcuu

SEQ ID NO: 3856488 - RNA, 14 nt, Human
ugaaaauuaacaug

SEQ ID NO: 3856489 - RNA, 14 nt, Human
ugaaaauuauuuaa

SEQ ID NO: 3856490 - RNA, 19 nt, Human
ugaaaauuauuuuguucau

SEQ ID NO: 3856491 - RNA, 22 nt, Human
ugaaaauucauaguaagauuga

SEQ ID NO: 3856492 - RNA, 13 nt, Human
ugaaaauugaaaa

SEQ ID NO: 3856493 - RNA, 16 nt, Human
ugaaaauugaaaagua

SEQ ID NO: 3856494 - RNA, 18 nt, Human
ugaaaauugccuuucugu

SEQ ID NO: 3856495 - RNA, 22 nt, Human
ugaaaauuguuuagugauauua

SEQ ID NO: 3856496 - RNA, 13 nt, Human
ugaaaauuugaga

SEQ ID NO: 3856497 - RNA, 12 nt, Human
ugaaaauuuuga

SEQ ID NO: 3856498 - RNA, 14 nt, Human
ugaaacaaagaagg

SEQ ID NO: 3856499 - RNA, 23 nt, Human
ugaaacaaagaguucaagaaaua

SEQ ID NO: 3856500 - RNA, 19 nt, Human
ugaaacaacuuucucuugu

SEQ ID NO: 3856501 - RNA, 17 nt, Human
ugaaacaagaagccaca

SEQ ID NO: 3856502 - RNA, 21 nt, Human
ugaaacaagauaacugagaau

SEQ ID NO: 3856503 - RNA, 23 nt, Human
ugaaacaauacucauaaugugaa

SEQ ID NO: 3856504 - RNA, 19 nt, Human
ugaaacacaccaggcugug

SEQ ID NO: 3856505 - RNA, 15 nt, Human
ugaaacacagcuguu

SEQ ID NO: 3856506 - RNA, 19 nt, Human
ugaaacacgaaacuuguua

SEQ ID NO: 3856507 - RNA, 21 nt, Human
ugaaacacgaaacuuguuauu

SEQ ID NO: 3856508 - RNA, 20 nt, Human
ugaaacacuuugccuccugu

SEQ ID NO: 3856509 - RNA, 23 nt, Human
ugaaacacuuugccuccugugua

SEQ ID NO: 3856510 - RNA, 15 nt, Human
ugaaacacuuuuuug

SEQ ID NO: 3856511 - RNA, 13 nt, Human
ugaaacagaaaca

SEQ ID NO: 3856512 - RNA, 14 nt, Human
ugaaacagauuuca

SEQ ID NO: 3856513 - RNA, 24 nt, Human
ugaaacauguugccaaaauggugg

SEQ ID NO: 3856514 - RNA, 13 nt, Human
ugaaacauguuuc

SEQ ID NO: 3856515 - RNA, 17 nt, Human
ugaaacauugcuuuuaa

SEQ ID NO: 3856516 - RNA, 18 nt, Human
ugaaaccaaauguaacua

SEQ ID NO: 3856517 - RNA, 18 nt, Human
ugaaacccccacacacac

SEQ ID NO: 3856518 - RNA, 20 nt, Human
ugaaaccccuguaggccuca

SEQ ID NO: 3856519 - RNA, 21 nt, Human
ugaaacccuggaccagugguc

SEQ ID NO: 3856520 - RNA, 20 nt, Human
ugaaaccuacacacugucau

SEQ ID NO: 3856521 - RNA, 18 nt, Human
ugaaaccuuauuuuuucc

SEQ ID NO: 3856522 - RNA, 16 nt, Human
ugaaaccuuuuuuaag

SEQ ID NO: 3856523 - RNA, 20 nt, Human
ugaaaccuuuuuuaagauuu

SEQ ID NO: 3856524 - RNA, 17 nt, Human
ugaaaccuuuuuuuauc

SEQ ID NO: 3856525 - RNA, 17 nt, Human
ugaaacggaugauuucu

SEQ ID NO: 3856526 - RNA, 18 nt, Human
ugaaacggaugauuucua

SEQ ID NO: 3856527 - RNA, 14 nt, Human
ugaaacuaaagcaa

SEQ ID NO: 3856528 - RNA, 19 nt, Human
ugaaacuccagaugccaca

SEQ ID NO: 3856529 - RNA, 17 nt, Human
ugaaacugacuugcugu

SEQ ID NO: 3856530 - RNA, 19 nt, Human
ugaaacugcuuguuuccua

SEQ ID NO: 3856531 - RNA, 18 nt, Human
ugaaacuggcacugaauu

SEQ ID NO: 3856532 - RNA, 12 nt, Human
ugaaacuuauuu

SEQ ID NO: 3856533 - RNA, 23 nt, Human
ugaaacuuauuuuuuucugauug

SEQ ID NO: 3856534 - RNA, 14 nt, Human
ugaaacuuucauuc

SEQ ID NO: 3856535 - RNA, 22 nt, Human
ugaaacuuugagaucuaaaaau

SEQ ID NO: 3856536 - RNA, 15 nt, Human
ugaaacuuugggaaa

SEQ ID NO: 3856537 - RNA, 17 nt, Human
ugaaacuuuucuagaau

SEQ ID NO: 3856538 - RNA, 23 nt, Human
ugaaacuuuucuagaauuauuuu

SEQ ID NO: 3856539 - RNA, 12 nt, Human
ugaaacuuuugg

SEQ ID NO: 3856540 - RNA, 15 nt, Human
ugaaagaaaacuuuu

SEQ ID NO: 3856541 - RNA, 18 nt, Human
ugaaagaaaacuuuuaug

SEQ ID NO: 3856542 - RNA, 15 nt, Human
ugaaagaaaauugag

SEQ ID NO: 3856543 - RNA, 22 nt, Human
ugaaagaaaauugaguugcacu

SEQ ID NO: 3856544 - RNA, 20 nt, Human
ugaaagaaacaguuaacuuu

SEQ ID NO: 3856545 - RNA, 12 nt, Human
ugaaagaaauca

SEQ ID NO: 3856546 - RNA, 17 nt, Human
ugaaagaaaucauguua

SEQ ID NO: 3856547 - RNA, 18 nt, Human
ugaaagaauauauuuauu

SEQ ID NO: 3856548 - RNA, 13 nt, Human
ugaaagacaccau

SEQ ID NO: 3856549 - RNA, 19 nt, Human
ugaaagaccuucuccaaau

SEQ ID NO: 3856550 - RNA, 16 nt, Human
ugaaagacuguacaaa

SEQ ID NO: 3856551 - RNA, 22 nt, Human
ugaaagacuguacaaaguagaa

SEQ ID NO: 3856552 - RNA, 16 nt, Human
ugaaagagaaccaguu

SEQ ID NO: 3856553 - RNA, 18 nt, Human
ugaaagagaaccaguuuc

SEQ ID NO: 3856554 - RNA, 18 nt, Human
ugaaagaggaaugaagua

SEQ ID NO: 3856555 - RNA, 18 nt, Human
ugaaagaggcagcuugaa

SEQ ID NO: 3856556 - RNA, 21 nt, Human
ugaaagaggcugaggccugga

SEQ ID NO: 3856557 - RNA, 16 nt, Human
ugaaagaguaaaggaa

SEQ ID NO: 3856558 - RNA, 17 nt, Human
ugaaagaguaaaggaaa

SEQ ID NO: 3856559 - RNA, 16 nt, Human
ugaaagaguuaagaau

SEQ ID NO: 3856560 - RNA, 18 nt, Human
ugaaagaugauuugcaau

SEQ ID NO: 3856561 - RNA, 19 nt, Human
ugaaagauggcugugccuc

SEQ ID NO: 3856562 - RNA, 21 nt, Human
ugaaagauggcugugccucug

SEQ ID NO: 3856563 - RNA, 22 nt, Human
ugaaagauggcugugccucugc

SEQ ID NO: 3856564 - RNA, 22 nt, Human
ugaaagauugugggggaaaaau

SEQ ID NO: 3856565 - RNA, 19 nt, Human
ugaaagcaaaaaugcuaau

SEQ ID NO: 3856566 - RNA, 19 nt, Human
ugaaagcagggacuugaac

SEQ ID NO: 3856567 - RNA, 16 nt, Human
ugaaagccauggagau

SEQ ID NO: 3856568 - RNA, 16 nt, Human
ugaaagccccagaaau

SEQ ID NO: 3856569 - RNA, 15 nt, Human
ugaaagcuacucaua

SEQ ID NO: 3856570 - RNA, 17 nt, Human
ugaaggcaaaauugcaa

SEQ ID NO: 3856571 - RNA, 15 nt, Human
ugaaggccccgccca

SEQ ID NO: 3856572 - RNA, 16 nt, Human
ugaaggccccgcccag

SEQ ID NO: 3856573 - RNA, 17 nt, Human
ugaaggccccgcccagg

SEQ ID NO: 3856574 - RNA, 20 nt, Human
ugaaggccccgcccaggcuu

SEQ ID NO: 3856575 - RNA, 19 nt, Human
ugaaggccgagaagcaaga

SEQ ID NO: 3856576 - RNA, 12 nt, Human
ugaaggccugag

SEQ ID NO: 3856577 - RNA, 14 nt, Human
ugaaggccugaggu

SEQ ID NO: 3856578 - RNA, 19 nt, Human
ugaaggccuuauucuacau

SEQ ID NO: 3856579 - RNA, 18 nt, Human
ugaaggcuaaaaagcaac

SEQ ID NO: 3856580 - RNA, 20 nt, Human
ugaaggcucgagcaugccug

SEQ ID NO: 3856581 - RNA, 16 nt, Human
ugaaggcuggguucug

SEQ ID NO: 3856582 - RNA, 16 nt, Human
ugaaggcuucucucug

SEQ ID NO: 3856583 - RNA, 19 nt, Human
ugaaggcuucucucugugg

SEQ ID NO: 3856584 - RNA, 19 nt, Human
ugaaggcuuucagggccuc

SEQ ID NO: 3856585 - RNA, 17 nt, Human
ugaagggagagccagcu

SEQ ID NO: 3856586 - RNA, 21 nt, Human
ugaagggagguggggaugaga

SEQ ID NO: 3856587 - RNA, 16 nt, Human
ugaagggauaugugaa

SEQ ID NO: 3856588 - RNA, 12 nt, Human
ugaagggccaga

SEQ ID NO: 3856589 - RNA, 14 nt, Human
ugaagggccagagc

SEQ ID NO: 3856590 - RNA, 13 nt, Human
ugaagggcccagg

SEQ ID NO: 3856591 - RNA, 15 nt, Human
ugaagggggcggccu

SEQ ID NO: 3856592 - RNA, 21 nt, Human
ugaaggggguaccuuaagaga

SEQ ID NO: 3856593 - RNA, 21 nt, Human
ugaagguaaaauugaaaggca

SEQ ID NO: 3856594 - RNA, 14 nt, Human
ugaagguaaauaaa

SEQ ID NO: 3856595 - RNA, 20 nt, Human
ugaagguaaauaaaaagaaa

SEQ ID NO: 3856596 - RNA, 19 nt, Human
ugaaggucuugauuuguuu

SEQ ID NO: 3856597 - RNA, 14 nt, Human
ugaaggugucagaa

SEQ ID NO: 3856598 - RNA, 15 nt, Human
ugaaggugucagaau

SEQ ID NO: 3856599 - RNA, 15 nt, Human
ugaagguuaggauuu

SEQ ID NO: 3856600 - RNA, 16 nt, Human
ugaagguuaggauuua

SEQ ID NO: 3856601 - RNA, 14 nt, Human
ugaagguuuacaau

SEQ ID NO: 3856602 - RNA, 13 nt, Human
ugaagguuuuugu

SEQ ID NO: 3856603 - RNA, 18 nt, Human
ugaagguuuuuguaaaga

SEQ ID NO: 3856604 - RNA, 21 nt, Human
ugaagguuuuuguaaagauuu

SEQ ID NO: 3856605 - RNA, 22 nt, Human
ugaaguaaaacaaacaauaccu

SEQ ID NO: 3856606 - RNA, 18 nt, Human
ugaaguaaaauguggcag

SEQ ID NO: 3856607 - RNA, 14 nt, Human
ugaaguaaacuuuu

SEQ ID NO: 3856608 - RNA, 17 nt, Human
ugaaguaacuugucuua

SEQ ID NO: 3856609 - RNA, 19 nt, Human
ugaaguaacuugucuuaaa

SEQ ID NO: 3856610 - RNA, 15 nt, Human
ugaaguaagcaaaga

SEQ ID NO: 3856611 - RNA, 20 nt, Human
ugaaguaauaugcacacauu

SEQ ID NO: 3856612 - RNA, 21 nt, Human
ugaaguaauaugcacacauuu

SEQ ID NO: 3856613 - RNA, 22 nt, Human
ugaaguaauaugcacacauuuu

SEQ ID NO: 3856614 - RNA, 13 nt, Human
ugaaguacauauu

SEQ ID NO: 3856615 - RNA, 23 nt, Human
ugaaguacccguucacauuuuug

SEQ ID NO: 3856616 - RNA, 14 nt, Human
ugaaguaguuugua

SEQ ID NO: 3856617 - RNA, 16 nt, Human
ugaaguauauaauggu

SEQ ID NO: 3856618 - RNA, 20 nt, Human
ugaaguaucuaaaaguguca

SEQ ID NO: 3856619 - RNA, 14 nt, Human
ugaagucacacagu

SEQ ID NO: 3856620 - RNA, 14 nt, Human
ugaagucacugcac

SEQ ID NO: 3856621 - RNA, 11 nt, Human
ugaaguccaag

SEQ ID NO: 3856622 - RNA, 13 nt, Human
ugaaguccggaac

SEQ ID NO: 3856623 - RNA, 21 nt, Human
ugaagucgucuuaacucacca

SEQ ID NO: 3856624 - RNA, 17 nt, Human
ugaagucguugugaggg

SEQ ID NO: 3856625 - RNA, 13 nt, Human
ugaagucugaaau

SEQ ID NO: 3856626 - RNA, 14 nt, Human
ugaagucuuguaua

SEQ ID NO: 3856627 - RNA, 17 nt, Human
ugaagugagcacagccu

SEQ ID NO: 3856628 - RNA, 23 nt, Human
ugaagugagcugagauugcacca

SEQ ID NO: 3856629 - RNA, 16 nt, Human
ugaagugcauccaaag

SEQ ID NO: 3856630 - RNA, 18 nt, Human
ugaagugcauccaaaggu

SEQ ID NO: 3856631 - RNA, 16 nt, Human
ugaagugccuuaaaua

SEQ ID NO: 3856632 - RNA, 16 nt, Human
ugaagugcgugaaugu

SEQ ID NO: 3856633 - RNA, 16 nt, Human
ugaaguguaccugugu

SEQ ID NO: 3856634 - RNA, 17 nt, Human
ugaaguguaccugugua

SEQ ID NO: 3856635 - RNA, 18 nt, Human
ugaaguguauaauauaaa

SEQ ID NO: 3856636 - RNA, 16 nt, Human
ugaaguguguuuccuu

SEQ ID NO: 3856637 - RNA, 23 nt, Human
ugaaguguuaauacuaguuguga

SEQ ID NO: 3856638 - RNA, 10 nt, Human
ugaaguguug

SEQ ID NO: 3856639 - RNA, 15 nt, Human
ugaaguuacuuucuu

SEQ ID NO: 3856640 - RNA, 15 nt, Human
ugaaguuagaauucc

SEQ ID NO: 3856641 - RNA, 19 nt, Human
ugaaguuagguucuuaaaa

SEQ ID NO: 3856642 - RNA, 19 nt, Human
ugaauauuacuccuauuuu

SEQ ID NO: 3856643 - RNA, 16 nt, Human
ugaauauuauaguauu

SEQ ID NO: 3856644 - RNA, 15 nt, Human
ugaauauuauuccuc

SEQ ID NO: 3856645 - RNA, 17 nt, Human
ugaauauugaaguuuca

SEQ ID NO: 3856646 - RNA, 16 nt, Human
ugaauauugccauuau

SEQ ID NO: 3856647 - RNA, 17 nt, Human
ugaauauuuacguuuuu

SEQ ID NO: 3856648 - RNA, 22 nt, Human
ugaauauuuacguuuuuguaaa

SEQ ID NO: 3856649 - RNA, 18 nt, Human
ugaauauuuauaacagca

SEQ ID NO: 3856650 - RNA, 21 nt, Human
ugaauauuuccauauggauuu

SEQ ID NO: 3856651 - RNA, 13 nt, Human
ugaauauuuucaa

SEQ ID NO: 3856652 - RNA, 16 nt, Human
ugaaucaaaagugccu

SEQ ID NO: 3856653 - RNA, 13 nt, Human
ugaaucaauaaua

SEQ ID NO: 3856654 - RNA, 15 nt, Human
ugaaucaauaauaua

SEQ ID NO: 3856655 - RNA, 14 nt, Human
ugaaucacaugaau

SEQ ID NO: 3856656 - RNA, 15 nt, Human
ugaaucaccuagggg

SEQ ID NO: 3856657 - RNA, 16 nt, Human
ugaaucaccuaggggu

SEQ ID NO: 3856658 - RNA, 17 nt, Human
ugaaucagacaguggau

SEQ ID NO: 3856659 - RNA, 21 nt, Human
ugaaucagacccuaccccacc

SEQ ID NO: 3856660 - RNA, 20 nt, Human
ugaaucaguauaaacaaagu

SEQ ID NO: 3856661 - RNA, 22 nt, Human
ugaaucaguuuccaauuauuug

SEQ ID NO: 3856662 - RNA, 13 nt, Human
ugaaucaugagcc

SEQ ID NO: 3856663 - RNA, 14 nt, Human
ugaaucaugagccu

SEQ ID NO: 3856664 - RNA, 18 nt, Human
ugaaucauguaguaucaa

SEQ ID NO: 3856665 - RNA, 19 nt, Human
ugaaucauguaguaucaaa

SEQ ID NO: 3856666 - RNA, 18 nt, Human
ugaaucauuguauguggu

SEQ ID NO: 3856667 - RNA, 17 nt, Human
ugaauccaugcuugggu

SEQ ID NO: 3856668 - RNA, 21 nt, Human
ugaaucccccuugccacccca

SEQ ID NO: 3856669 - RNA, 10 nt, Human
ugaauccuac

SEQ ID NO: 3856670 - RNA, 17 nt, Human
ugaauccucuucuuuau

SEQ ID NO: 3856671 - RNA, 18 nt, Human
ugaauccuuccauuccac

SEQ ID NO: 3856672 - RNA, 23 nt, Human
ugaaucuagcuuauuuugaggcu

SEQ ID NO: 3856673 - RNA, 15 nt, Human
ugaaucuaugccaaa

SEQ ID NO: 3856674 - RNA, 16 nt, Human
ugaaucuauuuaagua

SEQ ID NO: 3856675 - RNA, 13 nt, Human
ugaaucucauaau

SEQ ID NO: 3856676 - RNA, 19 nt, Human
ugaaucugagagaugcugu

SEQ ID NO: 3856677 - RNA, 14 nt, Human
ugaaucuguacaga

SEQ ID NO: 3856678 - RNA, 14 nt, Human
ugaaucuucugaaa

SEQ ID NO: 3856679 - RNA, 13 nt, Human
ugaaucuugucuc

SEQ ID NO: 3856680 - RNA, 24 nt, Human
ugaaucuugucucaaugcucauaa

SEQ ID NO: 3856681 - RNA, 19 nt, Human
ugaaucuuuccaauaaacc

SEQ ID NO: 3856682 - RNA, 11 nt, Human
ugaaugaaaaa

SEQ ID NO: 3856683 - RNA, 16 nt, Human
ugaaugaaaaauuuaa

SEQ ID NO: 3856684 - RNA, 19 nt, Human
ugaaugaaaaauuuaagca

SEQ ID NO: 3856685 - RNA, 22 nt, Human
ugaaugaaaaauuuaagcauug

SEQ ID NO: 3856686 - RNA, 21 nt, Human
ugaaugaaacccccacacaca

SEQ ID NO: 3856687 - RNA, 19 nt, Human
ugaaugaaagauuaaacag

SEQ ID NO: 3856688 - RNA, 20 nt, Human
ugaaugaaagucuugugacu

SEQ ID NO: 3856689 - RNA, 24 nt, Human
ugaaugaagcaaaugucaugcugc

SEQ ID NO: 3856690 - RNA, 15 nt, Human
ugaaugaauggcuaa

SEQ ID NO: 3856691 - RNA, 19 nt, Human
ugaaugaggauuauuauaa

SEQ ID NO: 3856692 - RNA, 17 nt, Human
ugaaugaggucccaggc

SEQ ID NO: 3856693 - RNA, 18 nt, Human
ugaaugaggucccaggca

SEQ ID NO: 3856694 - RNA, 18 nt, Human
ugaaugagucuguugugu

SEQ ID NO: 3856695 - RNA, 18 nt, Human
ugaaugaucucucugaau

SEQ ID NO: 3856696 - RNA, 23 nt, Human
ugaaugaugauccuaggcauuug

SEQ ID NO: 3856697 - RNA, 15 nt, Human
ugaaugauuuuucuu

SEQ ID NO: 3856698 - RNA, 16 nt, Human
ugaaugauuuuucuuu

SEQ ID NO: 3856699 - RNA, 15 nt, Human
ugaaugcaaaccaua

SEQ ID NO: 3856700 - RNA, 19 nt, Human
ugaaugcaaaccauagcac

SEQ ID NO: 3856701 - RNA, 19 nt, Human
ugaaugcacacuagccucu

SEQ ID NO: 3856702 - RNA, 18 nt, Human
ugaaugcaccauggucaa

SEQ ID NO: 3856703 - RNA, 23 nt, Human
ugaaugcagucuguccaggcucg

SEQ ID NO: 3856704 - RNA, 15 nt, Human
ugaaugcauuuuguu

SEQ ID NO: 3856705 - RNA, 15 nt, Human
ugaaugccacugccu

SEQ ID NO: 3856706 - RNA, 23 nt, Human
ugaaugcccacaggcaaaugcau

SEQ ID NO: 3856707 - RNA, 20 nt, Human
ugaaugcccagugagacugu

SEQ ID NO: 3856708 - RNA, 17 nt, Human
ugaaugcccccagcugg

SEQ ID NO: 3856709 - RNA, 18 nt, Human
ugaaugcccccagcuggc

SEQ ID NO: 3856710 - RNA, 19 nt, Human
ugaaugcccccagcuggcc

SEQ ID NO: 3856711 - RNA, 19 nt, Human
ugaaugccuaugguggauc

SEQ ID NO: 3856712 - RNA, 11 nt, Human
ugaaugcugcc

SEQ ID NO: 3856713 - RNA, 12 nt, Human
ugaaugcugcca

SEQ ID NO: 3856714 - RNA, 13 nt, Human
ugaaugcugccac

SEQ ID NO: 3856715 - RNA, 18 nt, Human
ugaaugcugccacaacca

SEQ ID NO: 3856716 - RNA, 18 nt, Human
ugaaugcugccagugugg

SEQ ID NO: 3856717 - RNA, 22 nt, Human
ugaaugcugccaguguggagug

SEQ ID NO: 3856718 - RNA, 15 nt, Human
ugaaugcugggacuc

SEQ ID NO: 3856719 - RNA, 14 nt, Human
ugaaugcuuuuagu

SEQ ID NO: 3856720 - RNA, 12 nt, Human
ugaaugcuuuuu

SEQ ID NO: 3856721 - RNA, 19 nt, Human
ugaauggacuuugcacacu

SEQ ID NO: 3856722 - RNA, 20 nt, Human
ugaauggauuggauuauuua

SEQ ID NO: 3856723 - RNA, 13 nt, Human
ugaguuuuccaug

SEQ ID NO: 3856724 - RNA, 22 nt, Human
ugaguuuugggaaguuaaaggg

SEQ ID NO: 3856725 - RNA, 19 nt, Human
ugaguuuuuauggggcuga

SEQ ID NO: 3856726 - RNA, 13 nt, Human
ugauaaaaacuca

SEQ ID NO: 3856727 - RNA, 18 nt, Human
ugauaaaacaacagcucg

SEQ ID NO: 3856728 - RNA, 16 nt, Human
ugauaaaaccauguag

SEQ ID NO: 3856729 - RNA, 16 nt, Human
ugauaaaagauacauu

SEQ ID NO: 3856730 - RNA, 18 nt, Human
ugauaaaagggcaaaucu

SEQ ID NO: 3856731 - RNA, 12 nt, Human
ugauaaaaucau

SEQ ID NO: 3856732 - RNA, 14 nt, Human
ugauaaacauuuaa

SEQ ID NO: 3856733 - RNA, 14 nt, Human
ugauaaacuuugcu

SEQ ID NO: 3856734 - RNA, 19 nt, Human
ugauaaagauuuuuuaaua

SEQ ID NO: 3856735 - RNA, 20 nt, Human
ugauaaagauuuuuuaauaa

SEQ ID NO: 3856736 - RNA, 13 nt, Human
ugauaaagccuca

SEQ ID NO: 3856737 - RNA, 18 nt, Human
ugauaaaguuucucagau

SEQ ID NO: 3856738 - RNA, 17 nt, Human
ugauaaaucagucaagc

SEQ ID NO: 3856739 - RNA, 20 nt, Human
ugauaaauuugacuguuauu

SEQ ID NO: 3856740 - RNA, 21 nt, Human
ugauaacaauguuuuaacaag

SEQ ID NO: 3856741 - RNA, 15 nt, Human
ugauaacagcuacca

SEQ ID NO: 3856742 - RNA, 18 nt, Human
ugauaacuagauggugcu

SEQ ID NO: 3856743 - RNA, 22 nt, Human
ugauaacuagauggugcugaga

SEQ ID NO: 3856744 - RNA, 19 nt, Human
ugauaacugcaauuuuaau

SEQ ID NO: 3856745 - RNA, 14 nt, Human
ugauaacuuugcuu

SEQ ID NO: 3856746 - RNA, 17 nt, Human
ugauaacuuugcuugca

SEQ ID NO: 3856747 - RNA, 16 nt, Human
ugauaaguaaaugcua

SEQ ID NO: 3856748 - RNA, 17 nt, Human
ugauaaguucauacauu

SEQ ID NO: 3856749 - RNA, 15 nt, Human
ugauaauaaauugaa

SEQ ID NO: 3856750 - RNA, 18 nt, Human
ugauaauaauauuguuuu

SEQ ID NO: 3856751 - RNA, 21 nt, Human
ugauaauauauuguguugacu

SEQ ID NO: 3856752 - RNA, 24 nt, Human
ugauaaucaacugggcugaacacu

SEQ ID NO: 3856753 - RNA, 15 nt, Human
ugauaaugaacagaa

SEQ ID NO: 3856754 - RNA, 18 nt, Human
ugauaaugaacagaacau

SEQ ID NO: 3856755 - RNA, 15 nt, Human
ugauaauguuaaauu

SEQ ID NO: 3856756 - RNA, 21 nt, Human
ugauaauguuaaauuuguaag

SEQ ID NO: 3856757 - RNA, 21 nt, Human
ugauaauguugugguuuguug

SEQ ID NO: 3856758 - RNA, 15 nt, Human
ugauaauuccagugg

SEQ ID NO: 3856759 - RNA, 17 nt, Human
ugauaauuccagugguc

SEQ ID NO: 3856760 - RNA, 16 nt, Human
ugauaauucuuauuuu

SEQ ID NO: 3856761 - RNA, 14 nt, Human
ugauaauugcauuc

SEQ ID NO: 3856762 - RNA, 19 nt, Human
ugauaauugcauucaucuu

SEQ ID NO: 3856763 - RNA, 14 nt, Human
ugauaauuuuaaau

SEQ ID NO: 3856764 - RNA, 13 nt, Human
ugauaauuuuccu

SEQ ID NO: 3856765 - RNA, 14 nt, Human
ugauaauuuuccuu

SEQ ID NO: 3856766 - RNA, 23 nt, Human
ugcaauuagguuuuuccuuauuu

SEQ ID NO: 3856767 - RNA, 16 nt, Human
ugcaauucaaaaguuc

SEQ ID NO: 3856768 - RNA, 13 nt, Human
ugcaauuccccuc

SEQ ID NO: 3856769 - RNA, 14 nt, Human
ugcaauuccccucu

SEQ ID NO: 3856770 - RNA, 16 nt, Human
ugcaauugauuucuuu

SEQ ID NO: 3856771 - RNA, 21 nt, Human
ugcaauugccuuuuuucugua

SEQ ID NO: 3856772 - RNA, 15 nt, Human
ugcaauugcuuagga

SEQ ID NO: 3856773 - RNA, 21 nt, Human
ugcaauuguaggggugugugu

SEQ ID NO: 3856774 - RNA, 14 nt, Human
ugcaauuuauuaaa

SEQ ID NO: 3856775 - RNA, 15 nt, Human
ugcaauuuauuaaaa

SEQ ID NO: 3856776 - RNA, 22 nt, Human
ugcaauuuauuaaaaugauugu

SEQ ID NO: 3856777 - RNA, 12 nt, Human
ugcaauuucaag

SEQ ID NO: 3856778 - RNA, 20 nt, Human
ugcaauuucauaugcuguau

SEQ ID NO: 3856779 - RNA, 21 nt, Human
ugcaauuuguuugugcuucua

SEQ ID NO: 3856780 - RNA, 18 nt, Human
ugcacaaaacccagaccu

SEQ ID NO: 3856781 - RNA, 15 nt, Human
ugcacaaaguggcau

SEQ ID NO: 3856782 - RNA, 20 nt, Human
ugcacaaaguggcauaaaaa

SEQ ID NO: 3856783 - RNA, 21 nt, Human
ugcacaaccaucugucccugc

SEQ ID NO: 3856784 - RNA, 16 nt, Human
ugcacaagaauggauc

SEQ ID NO: 3856785 - RNA, 16 nt, Human
ugcacaagcuccaagc

SEQ ID NO: 3856786 - RNA, 21 nt, Human
aagcuauucccucaaaucuga

SEQ ID NO: 3856787 - RNA, 14 nt, Human
aagcuauuccuuuc

SEQ ID NO: 3856788 - RNA, 21 nt, Human
aagcuauuccuuucccuuccu

SEQ ID NO: 3856789 - RNA, 13 nt, Human
aagcuauuuaaag

SEQ ID NO: 3856790 - RNA, 17 nt, Human
aagcuauuuaucuguag

SEQ ID NO: 3856791 - RNA, 22 nt, Human
aagcuauuuaugggccccuggc

SEQ ID NO: 3856792 - RNA, 14 nt, Human
aagcuauuuuucua

SEQ ID NO: 3856793 - RNA, 22 nt, Human
aagcucaaagguuuggaaggag

SEQ ID NO: 3856794 - RNA, 18 nt, Human
aagcucaaaugaaaugua

SEQ ID NO: 3856795 - RNA, 15 nt, Human
aagcucacaguuccu

SEQ ID NO: 3856796 - RNA, 20 nt, Human
aagcucacaguuccucgccc

SEQ ID NO: 3856797 - RNA, 22 nt, Human
aagcucaccuguugcuuacaau

SEQ ID NO: 3856798 - RNA, 23 nt, Human
aagcucaccuguugcuuacaauu

SEQ ID NO: 3856799 - RNA, 18 nt, Human
aagcucacguccugagaa

SEQ ID NO: 3856800 - RNA, 14 nt, Human
aagcucacuucugg

SEQ ID NO: 3856801 - RNA, 23 nt, Human
aagcucacuucugggcuucaucu

SEQ ID NO: 3856802 - RNA, 13 nt, Human
aagcucagaaucc

SEQ ID NO: 3856803 - RNA, 15 nt, Human
aagcucagaauccaa

SEQ ID NO: 3856804 - RNA, 15 nt, Human
aagcucagauuauuu

SEQ ID NO: 3856805 - RNA, 16 nt, Human
aagcucagauuauuua

SEQ ID NO: 3856806 - RNA, 15 nt, Human
aagcucagccagccc

SEQ ID NO: 3856807 - RNA, 14 nt, Human
aagcucagcccacc

SEQ ID NO: 3856808 - RNA, 15 nt, Human
aagcucagcugcauu

SEQ ID NO: 3856809 - RNA, 17 nt, Human
aagcucaggaccaggca

SEQ ID NO: 3856810 - RNA, 12 nt, Human
aagcucagggcc

SEQ ID NO: 3856811 - RNA, 13 nt, Human
aagcucagggccu

SEQ ID NO: 3856812 - RNA, 19 nt, Human
aagcucagggccuggcuca

SEQ ID NO: 3856813 - RNA, 15 nt, Human
aagcuccacugucac

SEQ ID NO: 3856814 - RNA, 13 nt, Human
aagcuccagguag

SEQ ID NO: 3856815 - RNA, 18 nt, Human
aagcuccaguccugcucu

SEQ ID NO: 3856816 - RNA, 14 nt, Human
aagcuccaucucca

SEQ ID NO: 3856817 - RNA, 16 nt, Human
aagcuccaucuuauuu

SEQ ID NO: 3856818 - RNA, 18 nt, Human
aagcuccaugugccucuu

SEQ ID NO: 3856819 - RNA, 17 nt, Human
aagcucccaagggaugg

SEQ ID NO: 3856820 - RNA, 21 nt, Human
aagcucccaagggauggugcc

SEQ ID NO: 3856821 - RNA, 12 nt, Human
aagcucccaggc

SEQ ID NO: 3856822 - RNA, 23 nt, Human
aagcucccaggcauuccccagga

SEQ ID NO: 3856823 - RNA, 14 nt, Human
aagcucccaggccg

SEQ ID NO: 3856824 - RNA, 23 nt, Human
aagcucccccagcaaagccccca

SEQ ID NO: 3856825 - RNA, 15 nt, Human
aagcucccugcccca

SEQ ID NO: 3856826 - RNA, 16 nt, Human
aagcuccuagcagaga

SEQ ID NO: 3856827 - RNA, 18 nt, Human
aagcuccuagcagagaga

SEQ ID NO: 3856828 - RNA, 17 nt, Human
aagcuccuaucuguuuu

SEQ ID NO: 3856829 - RNA, 13 nt, Human
aagcuccuccucc

SEQ ID NO: 3856830 - RNA, 16 nt, Human
aagcuccuccucccug

SEQ ID NO: 3856831 - RNA, 18 nt, Human
aagcuccuccucccugca

SEQ ID NO: 3856832 - RNA, 19 nt, Human
aagcuccucuccccagccc

SEQ ID NO: 3856833 - RNA, 23 nt, Human
aagcuccugguauggguuucucc

SEQ ID NO: 3856834 - RNA, 22 nt, Human
aagcucgauguggucacagcug

SEQ ID NO: 3856835 - RNA, 16 nt, Human
aagcucuagugggaag

SEQ ID NO: 3856836 - RNA, 15 nt, Human
aagcucuauuaagau

SEQ ID NO: 3856837 - RNA, 22 nt, Human
aagcucucugcaucuacuccca

SEQ ID NO: 3856838 - RNA, 11 nt, Human
aagcucugagc

SEQ ID NO: 3856839 - RNA, 15 nt, Human
aagcucugagcuguc

SEQ ID NO: 3856840 - RNA, 13 nt, Human
aagcucugaggga

SEQ ID NO: 3856841 - RNA, 13 nt, Human
aagcucuggcuga

SEQ ID NO: 3856842 - RNA, 17 nt, Human
aagcucuugaagacacu

SEQ ID NO: 3856843 - RNA, 12 nt, Human
aagcugaaauuu

SEQ ID NO: 3856844 - RNA, 20 nt, Human
aagcugaaauuuuagaaaua

SEQ ID NO: 3856845 - RNA, 22 nt, Human
aagcugaaauuuuagaaauauu

SEQ ID NO: 3856846 - RNA, 22 nt, Human
aagcugaaguuucacuccggag

SEQ ID NO: 3856847 - RNA, 17 nt, Human
aagcugacauugccaaa

SEQ ID NO: 3856848 - RNA, 17 nt, Human
aagcugacgaacuucca

SEQ ID NO: 3856849 - RNA, 15 nt, Human
aagcugacuuggcug

SEQ ID NO: 3856850 - RNA, 16 nt, Human
aagcugacuuggcugg

SEQ ID NO: 3856851 - RNA, 19 nt, Human
aagcugagaacuccugacu

SEQ ID NO: 3856852 - RNA, 15 nt, Human
aagcugagccugcag

SEQ ID NO: 3856853 - RNA, 13 nt, Human
aagcugaggugcc

SEQ ID NO: 3856854 - RNA, 22 nt, Human
aagcugauuacugucaauaaac

SEQ ID NO: 3856855 - RNA, 20 nt, Human
aagcugcaaaucagccaugu

SEQ ID NO: 3856856 - RNA, 19 nt, Human
aagcugcaaaucugauggc

SEQ ID NO: 3856857 - RNA, 22 nt, Human
aagcugcacccucaggcaggug

SEQ ID NO: 3856858 - RNA, 17 nt, Human
aagcugcagagauuucu

SEQ ID NO: 3856859 - RNA, 18 nt, Human
aagcugcagcuuccuguc

SEQ ID NO: 3856860 - RNA, 13 nt, Human
aagcugcagcuug

SEQ ID NO: 3856861 - RNA, 22 nt, Human
aagcugccagccgagauagcca

SEQ ID NO: 3856862 - RNA, 18 nt, Human
aagcugcccacuguuucu

SEQ ID NO: 3856863 - RNA, 21 nt, Human
aagcugccgaaccaaaagaau

SEQ ID NO: 3856864 - RNA, 17 nt, Human
aagcugccugcuuuuca

SEQ ID NO: 3856865 - RNA, 20 nt, Human
aagcugccugcuuuucacug

SEQ ID NO: 3856866 - RNA, 15 nt, Human
aagcugccugguaua

SEQ ID NO: 3856867 - RNA, 20 nt, Human
aagcugccugguauauccaa

SEQ ID NO: 3856868 - RNA, 16 nt, Human
aagcugccuguaguua

SEQ ID NO: 3856869 - RNA, 15 nt, Human
aagcugcuaaaucuc

SEQ ID NO: 3856870 - RNA, 22 nt, Human
aagcugcuaaaucuccuauuuu

SEQ ID NO: 3856871 - RNA, 16 nt, Human
aagcugcucugagcca

SEQ ID NO: 3856872 - RNA, 23 nt, Human
aagcuggaggacuagaaccugga

SEQ ID NO: 3856873 - RNA, 22 nt, Human
aagcuggccucuaccacaaggg

SEQ ID NO: 3856874 - RNA, 11 nt, Human
aagcugggcag

SEQ ID NO: 3856875 - RNA, 17 nt, Human
aagcugggccccagccc

SEQ ID NO: 3856876 - RNA, 19 nt, Human
aagcugggccccagcccac

SEQ ID NO: 3856877 - RNA, 13 nt, Human
aagcuggggagga

SEQ ID NO: 3856878 - RNA, 21 nt, Human
aagcuggucccacucagucca

SEQ ID NO: 3856879 - RNA, 22 nt, Human
aagcuguaguagcccuuucugu

SEQ ID NO: 3856880 - RNA, 14 nt, Human
aagcuguauuuuga

SEQ ID NO: 3856881 - RNA, 22 nt, Human
aagcugucccucacuguugaau

SEQ ID NO: 3856882 - RNA, 16 nt, Human
aagcugugaacaggcu

SEQ ID NO: 3856883 - RNA, 14 nt, Human
aagcugugccaccc

SEQ ID NO: 3856884 - RNA, 14 nt, Human
uggcucccucacuc

SEQ ID NO: 3856885 - RNA, 21 nt, Human
uggcucccuccuccaggccug

SEQ ID NO: 3856886 - RNA, 14 nt, Human
uggcucccucuugg

SEQ ID NO: 3856887 - RNA, 16 nt, Human
uggcuccgcugugugg

SEQ ID NO: 3856888 - RNA, 15 nt, Human
uggcuccggccucug

SEQ ID NO: 3856889 - RNA, 22 nt, Human
uggcuccucaaacaguagguug

SEQ ID NO: 3856890 - RNA, 14 nt, Human
uggcuccucccagc

SEQ ID NO: 3856891 - RNA, 14 nt, Human
uggcuccucccggu

SEQ ID NO: 3856892 - RNA, 18 nt, Human
uggcuccucccggugccc

SEQ ID NO: 3856893 - RNA, 23 nt, Human
uggcuccucuguggugucugccu

SEQ ID NO: 3856894 - RNA, 15 nt, Human
uggcuccugcccacu

SEQ ID NO: 3856895 - RNA, 17 nt, Human
uggcuccuugugccaga

SEQ ID NO: 3856896 - RNA, 19 nt, Human
uggcucgaaucucugugcc

SEQ ID NO: 3856897 - RNA, 21 nt, Human
uggcucgaaucucugugccuu

SEQ ID NO: 3856898 - RNA, 15 nt, Human
uggcucgccaggcca

SEQ ID NO: 3856899 - RNA, 14 nt, Human
uggcucuacacaua

SEQ ID NO: 3856900 - RNA, 15 nt, Human
uggcucuacacauau

SEQ ID NO: 3856901 - RNA, 19 nt, Human
uggcucucauugacuuccu

SEQ ID NO: 3856902 - RNA, 13 nt, Human
uggcucuccuggc

SEQ ID NO: 3856903 - RNA, 13 nt, Human
uggcucucuccag

SEQ ID NO: 3856904 - RNA, 20 nt, Human
uggcucugaggugccugucc

SEQ ID NO: 3856905 - RNA, 17 nt, Human
uggcucugccaguccug

SEQ ID NO: 3856906 - RNA, 15 nt, Human
uggcucuucugccca

SEQ ID NO: 3856907 - RNA, 21 nt, Human
uggcucuugauaccccccucu

SEQ ID NO: 3856908 - RNA, 23 nt, Human
uggcucuugauaccccccucugu

SEQ ID NO: 3856909 - RNA, 16 nt, Human
uggcucuuugggcugg

SEQ ID NO: 3856910 - RNA, 15 nt, Human
uggcugaaaaaggcc

SEQ ID NO: 3856911 - RNA, 22 nt, Human
uggcugaaaggaagcugugcgu

SEQ ID NO: 3856912 - RNA, 16 nt, Human
uggcugaaauucuccu

SEQ ID NO: 3856913 - RNA, 18 nt, Human
uggcugaaauucuccugg

SEQ ID NO: 3856914 - RNA, 22 nt, Human
uggcugaaauucuccuggaggu

SEQ ID NO: 3856915 - RNA, 16 nt, Human
uggcugaacccugugc

SEQ ID NO: 3856916 - RNA, 20 nt, Human
uggcugaacccugugcuggu

SEQ ID NO: 3856917 - RNA, 21 nt, Human
uggcugaauagcuucuccaaa

SEQ ID NO: 3856918 - RNA, 15 nt, Human
uggcugacccagucc

SEQ ID NO: 3856919 - RNA, 20 nt, Human
uggcugacccagucccuggg

SEQ ID NO: 3856920 - RNA, 22 nt, Human
uggcugaccccaaagagccugg

SEQ ID NO: 3856921 - RNA, 23 nt, Human
uggcugacuaaauuuggggacag

SEQ ID NO: 3856922 - RNA, 20 nt, Human
uggcugacuuacaucaugug

SEQ ID NO: 3856923 - RNA, 16 nt, Human
uggcugacuuugcucu

SEQ ID NO: 3856924 - RNA, 19 nt, Human
uggcugagauaugaacaua

SEQ ID NO: 3856925 - RNA, 15 nt, Human
uggcugagggcaguu

SEQ ID NO: 3856926 - RNA, 22 nt, Human
uggcugagggcaguucgcagcc

SEQ ID NO: 3856927 - RNA, 17 nt, Human
uggcugagguuccucug

SEQ ID NO: 3856928 - RNA, 22 nt, Human
uggcugagguuccucugccugc

SEQ ID NO: 3856929 - RNA, 24 nt, Human
uggcugagguuccucugccugccc

SEQ ID NO: 3856930 - RNA, 19 nt, Human
uggcugaguagcucugccu

SEQ ID NO: 3856931 - RNA, 19 nt, Human
uggcugauaaaagauacau

SEQ ID NO: 3856932 - RNA, 18 nt, Human
uggcugcagccugcgcca

SEQ ID NO: 3856933 - RNA, 14 nt, Human
uggcugcagggagu

SEQ ID NO: 3856934 - RNA, 19 nt, Human
uggcugcaguccgugugga

SEQ ID NO: 3856935 - RNA, 19 nt, Human
uggcugcauaaauguggua

SEQ ID NO: 3856936 - RNA, 18 nt, Human
uggcugccaaugggagcu

SEQ ID NO: 3856937 - RNA, 21 nt, Human
uggcugcccagaccccucugg

SEQ ID NO: 3856938 - RNA, 23 nt, Human
uggcugcccagaccccucuggcc

SEQ ID NO: 3856939 - RNA, 22 nt, Human
uggcugcccaucauguggcccc

SEQ ID NO: 3856940 - RNA, 14 nt, Human
uggcugccuccacu

SEQ ID NO: 3856941 - RNA, 22 nt, Human
uggcugcggggcgggcacaccu

SEQ ID NO: 3856942 - RNA, 13 nt, Human
uggcugcuaacaa

SEQ ID NO: 3856943 - RNA, 14 nt, Human
uggcugcugaaggc

SEQ ID NO: 3856944 - RNA, 16 nt, Human
uggcugcugcccccac

SEQ ID NO: 3856945 - RNA, 16 nt, Human
uggcugcugugggaaa

SEQ ID NO: 3856946 - RNA, 11 nt, Human
uggcugcuuca

SEQ ID NO: 3856947 - RNA, 20 nt, Human
uggcauccagagucccugcc

SEQ ID NO: 3856948 - RNA, 21 nt, Human
uggcauccagagucccugccu

SEQ ID NO: 3856949 - RNA, 15 nt, Human
uggcaucccaguggc

SEQ ID NO: 3856950 - RNA, 13 nt, Human
uggcaucccuggg

SEQ ID NO: 3856951 - RNA, 13 nt, Human
uggcauccuguga

SEQ ID NO: 3856952 - RNA, 12 nt, Human
uggcaucucugu

SEQ ID NO: 3856953 - RNA, 18 nt, Human
uggcaucugacacaaaaa

SEQ ID NO: 3856954 - RNA, 16 nt, Human
uggcaucuuacaucug

SEQ ID NO: 3856955 - RNA, 23 nt, Human
uggcaucuucgucuucacucuua

SEQ ID NO: 3856956 - RNA, 16 nt, Human
uggcaucuuugccuug

SEQ ID NO: 3856957 - RNA, 16 nt, Human
uggcaugauccaagca

SEQ ID NO: 3856958 - RNA, 13 nt, Human
uggcaugcauccc

SEQ ID NO: 3856959 - RNA, 20 nt, Human
uggcauggaaauuuaaagca

SEQ ID NO: 3856960 - RNA, 16 nt, Human
uggcauggauuucugu

SEQ ID NO: 3856961 - RNA, 14 nt, Human
uggcauggcaccug

SEQ ID NO: 3856962 - RNA, 14 nt, Human
uggcauggccacca

SEQ ID NO: 3856963 - RNA, 15 nt, Human
uggcauggcuccagu

SEQ ID NO: 3856964 - RNA, 12 nt, Human
uggcaugggaau

SEQ ID NO: 3856965 - RNA, 16 nt, Human
uggcaugggggccuca

SEQ ID NO: 3856966 - RNA, 20 nt, Human
uggcaugggggccucagggc

SEQ ID NO: 3856967 - RNA, 19 nt, Human
uggcaugguaguauacaaa

SEQ ID NO: 3856968 - RNA, 21 nt, Human
uggcauggugguugggaccca

SEQ ID NO: 3856969 - RNA, 22 nt, Human
uggcaugguuuugugccaucug

SEQ ID NO: 3856970 - RNA, 23 nt, Human
uggcaugguuuugugccaucugu

SEQ ID NO: 3856971 - RNA, 22 nt, Human
uggcaugugcugugaccauuua

SEQ ID NO: 3856972 - RNA, 20 nt, Human
uggcauguuagcccuuccuc

SEQ ID NO: 3856973 - RNA, 22 nt, Human
uggcauguuuugugcauuugua

SEQ ID NO: 3856974 - RNA, 17 nt, Human
uggcauuagaauuauuu

SEQ ID NO: 3856975 - RNA, 13 nt, Human
uggcauuaugucc

SEQ ID NO: 3856976 - RNA, 19 nt, Human
uggcauugucccugugccu

SEQ ID NO: 3856977 - RNA, 15 nt, Human
uggcauuucccuacu

SEQ ID NO: 3856978 - RNA, 17 nt, Human
uggcauuugcaauaaaa

SEQ ID NO: 3856979 - RNA, 18 nt, Human
uggccaaaagcaguaaau

SEQ ID NO: 3856980 - RNA, 16 nt, Human
uggccaaacaaguguu

SEQ ID NO: 3856981 - RNA, 23 nt, Human
uggccaagcagggaggaagaagc

SEQ ID NO: 3856982 - RNA, 19 nt, Human
uggccaagcugaggugccc

SEQ ID NO: 3856983 - RNA, 21 nt, Human
uggccaagcugaggugcccag

SEQ ID NO: 3856984 - RNA, 22 nt, Human
uggccaagcugaggugcccagg

SEQ ID NO: 3856985 - RNA, 18 nt, Human
uggccaaggagcugcuau

SEQ ID NO: 3856986 - RNA, 16 nt, Human
uggccaaguucuuagu

SEQ ID NO: 3856987 - RNA, 14 nt, Human
uggccacaaauucu

SEQ ID NO: 3856988 - RNA, 19 nt, Human
uggccacacugugacacac

SEQ ID NO: 3856989 - RNA, 13 nt, Human
uggccacagccag

SEQ ID NO: 3856990 - RNA, 16 nt, Human
uggccacauggcggag

SEQ ID NO: 3856991 - RNA, 22 nt, Human
uggccacauuuaauaucuucag

SEQ ID NO: 3856992 - RNA, 13 nt, Human
uggccaccacccc

SEQ ID NO: 3856993 - RNA, 15 nt, Human
uggccaccacccccc

SEQ ID NO: 3856994 - RNA, 23 nt, Human
uggccaccaccccccacucugug

SEQ ID NO: 3856995 - RNA, 14 nt, Human
uggccaccaggcug

SEQ ID NO: 3856996 - RNA, 16 nt, Human
uggccaccaggcuggc

SEQ ID NO: 3856997 - RNA, 15 nt, Human
uggccaccucucucc

SEQ ID NO: 3856998 - RNA, 17 nt, Human
uggccaccugagguggg

SEQ ID NO: 3856999 - RNA, 21 nt, Human
uggccaccugaggugggccca

SEQ ID NO: 3857000 - RNA, 16 nt, Human
uggccaccuuuucagc

SEQ ID NO: 3857001 - RNA, 14 nt, Human
uggccacgcagcca

SEQ ID NO: 3857002 - RNA, 16 nt, Human
uggccacgcagccagg

SEQ ID NO: 3857003 - RNA, 18 nt, Human
uggccacugcacagagcu

SEQ ID NO: 3857004 - RNA, 20 nt, Human
uggccacugcucccuaagcc

SEQ ID NO: 3857005 - RNA, 17 nt, Human
uggccacuucuguccau

SEQ ID NO: 3857006 - RNA, 13 nt, Human
uggccagacacag

SEQ ID NO: 3857007 - RNA, 14 nt, Human
uggccagaccagag

SEQ ID NO: 3857008 - RNA, 16 nt, Human
uggccagaccagagcu

SEQ ID NO: 3857009 - RNA, 23 nt, Human
uggccagagagccuggugcugcu

SEQ ID NO: 3857010 - RNA, 14 nt, Human
uggccagagcuggg

SEQ ID NO: 3857011 - RNA, 17 nt, Human
uggccagagcugggagg

SEQ ID NO: 3857012 - RNA, 15 nt, Human
uggccagaugcacca

SEQ ID NO: 3857013 - RNA, 20 nt, Human
uggccagaugcaccagcccu

SEQ ID NO: 3857014 - RNA, 21 nt, Human
uggccagaugcaccagcccuu

SEQ ID NO: 3857015 - RNA, 20 nt, Human
uggccagcagcaccugcccu

SEQ ID NO: 3857016 - RNA, 14 nt, Human
uggccagcagcuug

SEQ ID NO: 3857017 - RNA, 16 nt, Human
uggccagccccacagc

SEQ ID NO: 3857018 - RNA, 18 nt, Human
uggccagccccacagccc

SEQ ID NO: 3857019 - RNA, 23 nt, Human
uggccagccccacagcccacguc

SEQ ID NO: 3857020 - RNA, 21 nt, Human
uggccagccccuuagacagag

SEQ ID NO: 3857021 - RNA, 11 nt, Human
uggccagcccg

SEQ ID NO: 3857022 - RNA, 16 nt, Human
uggccagcccggcugg

SEQ ID NO: 3857023 - RNA, 15 nt, Human
uggccagccuggggc

SEQ ID NO: 3857024 - RNA, 20 nt, Human
uggccagccuggggccuggc

SEQ ID NO: 3857025 - RNA, 21 nt, Human
uggccagcuggaggcaggggc

SEQ ID NO: 3857026 - RNA, 21 nt, Human
uggccaggaagcuuuggugag

SEQ ID NO: 3857027 - RNA, 22 nt, Human
uggccaggagcaggcacgggug

SEQ ID NO: 3857028 - RNA, 16 nt, Human
uggccaggaggugcca

SEQ ID NO: 3857029 - RNA, 23 nt, Human
uggccaggcagaucugugcccca

SEQ ID NO: 3857030 - RNA, 15 nt, Human
uggccaggccgggaa

SEQ ID NO: 3857031 - RNA, 19 nt, Human
uggccaggccucuuggcag

SEQ ID NO: 3857032 - RNA, 12 nt, Human
uggccaggguga

SEQ ID NO: 3857033 - RNA, 15 nt, Human
uggccagguggccac

SEQ ID NO: 3857034 - RNA, 17 nt, Human
uggccagguggccacuc

SEQ ID NO: 3857035 - RNA, 15 nt, Human
uggccaguccaggcu

SEQ ID NO: 3857036 - RNA, 18 nt, Human
uggccagugcccugaucc

SEQ ID NO: 3857037 - RNA, 18 nt, Human
uggccaguguuuaaaacu

SEQ ID NO: 3857038 - RNA, 19 nt, Human
uggccaguguuuaaaacuu

SEQ ID NO: 3857039 - RNA, 22 nt, Human
uggccauauuuaccucagccug

SEQ ID NO: 3857040 - RNA, 24 nt, Human
uggccauauuuaccucagccuggg

SEQ ID NO: 3857041 - RNA, 14 nt, Human
uggccaucauuucu

SEQ ID NO: 3857042 - RNA, 13 nt, Human
uggccaucuccac

SEQ ID NO: 3857043 - RNA, 14 nt, Human
uggccaucucugga

SEQ ID NO: 3857044 - RNA, 17 nt, Human
uggccaucucuggaugc

SEQ ID NO: 3857045 - RNA, 15 nt, Human
uggccaucugcuccu

SEQ ID NO: 3857046 - RNA, 18 nt, Human
uggccaucugcuccugga

SEQ ID NO: 3857047 - RNA, 22 nt, Human
uggccaugaagaggaugcugug

SEQ ID NO: 3857048 - RNA, 20 nt, Human
uggccaugacccugccucuc

SEQ ID NO: 3857049 - RNA, 17 nt, Human
uggccaugaugacaacu

SEQ ID NO: 3857050 - RNA, 20 nt, Human
uggccaugccucagcccuga

SEQ ID NO: 3857051 - RNA, 16 nt, Human
uggccaugcuccucuu

SEQ ID NO: 3857052 - RNA, 22 nt, Human
uggccaugcuccucuuccccag

SEQ ID NO: 3857053 - RNA, 17 nt, Human
uggccauggagaaagcu

SEQ ID NO: 3857054 - RNA, 22 nt, Human
uggccauggagaaagcugacuu

SEQ ID NO: 3857055 - RNA, 18 nt, Human
uggccaugguacccccuu

SEQ ID NO: 3857056 - RNA, 14 nt, Human
uggccauuugcuuu

SEQ ID NO: 3857057 - RNA, 15 nt, Human
uggccauuugcuuuu

SEQ ID NO: 3857058 - RNA, 16 nt, Human
uggcccaaggcuggca

SEQ ID NO: 3857059 - RNA, 18 nt, Human
uggcccaaggcuggcagg

SEQ ID NO: 3857060 - RNA, 13 nt, Human
uggcccagcccug

SEQ ID NO: 3857061 - RNA, 17 nt, Human
uggcccagcccugcugg

SEQ ID NO: 3857062 - RNA, 13 nt, Human
uggcccagccggc

SEQ ID NO: 3857063 - RNA, 17 nt, Human
uggcccagccggccucu

SEQ ID NO: 3857064 - RNA, 18 nt, Human
uggcccagccggccucuc

SEQ ID NO: 3857065 - RNA, 17 nt, Human
uggcccagcggccccuc

SEQ ID NO: 3857066 - RNA, 14 nt, Human
uggcccagcucccc

SEQ ID NO: 3857067 - RNA, 17 nt, Human
uggcccaggaccaucau

SEQ ID NO: 3857068 - RNA, 21 nt, Human
uggcccaggaguuuggccaga

SEQ ID NO: 3857069 - RNA, 22 nt, Human
uggcccaggaguuuggccagaa

SEQ ID NO: 3857070 - RNA, 18 nt, Human
uggcccagggcccagagc

SEQ ID NO: 3857071 - RNA, 21 nt, Human
uggcccagggcccagagccca

SEQ ID NO: 3857072 - RNA, 22 nt, Human
uggcccagggcccagagcccag

SEQ ID NO: 3857073 - RNA, 23 nt, Human
uggcccagggugagguggcaugg

SEQ ID NO: 3857074 - RNA, 16 nt, Human
uggcccaggguggcca

SEQ ID NO: 3857075 - RNA, 19 nt, Human
uggcccaguccucucccaa

SEQ ID NO: 3857076 - RNA, 23 nt, Human
uggcccauagaaacaugacacug

SEQ ID NO: 3857077 - RNA, 12 nt, Human
uggcccaucagg

SEQ ID NO: 3857078 - RNA, 12 nt, Human
uggcccaucagu

SEQ ID NO: 3857079 - RNA, 20 nt, Human
uggcccauccccccucacca

SEQ ID NO: 3857080 - RNA, 21 nt, Human
uggcccauccccccucaccag

SEQ ID NO: 3857081 - RNA, 17 nt, Human
uggcccauguauggcca

SEQ ID NO: 3857082 - RNA, 23 nt, Human
uggcccauucuacuugcucugga

SEQ ID NO: 3857083 - RNA, 18 nt, Human
uggccccacaccagcccc

SEQ ID NO: 3857084 - RNA, 22 nt, Human
uggccccacccucguggacacc

SEQ ID NO: 3857085 - RNA, 16 nt, Human
uggccccacccugggc

SEQ ID NO: 3857086 - RNA, 16 nt, Human
uggccccaccuggccc

SEQ ID NO: 3857087 - RNA, 12 nt, Human
uggccccagcac

SEQ ID NO: 3857088 - RNA, 14 nt, Human
uggccccagcacag

SEQ ID NO: 3857089 - RNA, 21 nt, Human
uggccccagcccugcugggga

SEQ ID NO: 3857090 - RNA, 13 nt, Human
uggccccagccug

SEQ ID NO: 3857091 - RNA, 16 nt, Human
uggccccagccuggcc

SEQ ID NO: 3857092 - RNA, 18 nt, Human
uggccccagggcacccug

SEQ ID NO: 3857093 - RNA, 21 nt, Human
uggccccaugucucucagaau

SEQ ID NO: 3857094 - RNA, 13 nt, Human
uggcccccacugg

SEQ ID NO: 3857095 - RNA, 14 nt, Human
uggcccccacuggc

SEQ ID NO: 3857096 - RNA, 13 nt, Human
ugguuagaaaagu

SEQ ID NO: 3857097 - RNA, 13 nt, Human
ugguuagaaaugc

SEQ ID NO: 3857098 - RNA, 15 nt, Human
ugguuagcucagccc

SEQ ID NO: 3857099 - RNA, 21 nt, Human
ugguuagcucagccccagccc

SEQ ID NO: 3857100 - RNA, 23 nt, Human
ugguuagcucagccccagcccag

SEQ ID NO: 3857101 - RNA, 21 nt, Human
ugguuaguagagguacacuug

SEQ ID NO: 3857102 - RNA, 20 nt, Human
ugguuauaaaagugauuguu

SEQ ID NO: 3857103 - RNA, 17 nt, Human
ugguuauaacuuaauga

SEQ ID NO: 3857104 - RNA, 18 nt, Human
ugguuauacaaguucuug

SEQ ID NO: 3857105 - RNA, 12 nt, Human
ugguuauacaug

SEQ ID NO: 3857106 - RNA, 14 nt, Human
ugguuauagugcaa

SEQ ID NO: 3857107 - RNA, 22 nt, Human
ugguuauagugcaauauauuuu

SEQ ID NO: 3857108 - RNA, 19 nt, Human
ugguuaugaaagaauauau

SEQ ID NO: 3857109 - RNA, 20 nt, Human
ugguuaugaaagaauauauu

SEQ ID NO: 3857110 - RNA, 12 nt, Human
ugguuaugaacu

SEQ ID NO: 3857111 - RNA, 17 nt, Human
ugguuaugaauacuuug

SEQ ID NO: 3857112 - RNA, 21 nt, Human
ugguucaaauguguuuugguc

SEQ ID NO: 3857113 - RNA, 21 nt, Human
ugguucacucuuggagccugc

SEQ ID NO: 3857114 - RNA, 16 nt, Human
ugguucauaaaugaau

SEQ ID NO: 3857115 - RNA, 18 nt, Human
ugguucaucaguguuaaa

SEQ ID NO: 3857116 - RNA, 17 nt, Human
ugguucauuuucagauu

SEQ ID NO: 3857117 - RNA, 13 nt, Human
ugguuccaagccc

SEQ ID NO: 3857118 - RNA, 16 nt, Human
ugguuccaagcccugg

SEQ ID NO: 3857119 - RNA, 20 nt, Human
ugguuccaagucuuugcuau

SEQ ID NO: 3857120 - RNA, 18 nt, Human
ugguuccccuguucacuc

SEQ ID NO: 3857121 - RNA, 20 nt, Human
ugguucccguuucuccaccu

SEQ ID NO: 3857122 - RNA, 14 nt, Human
ugguucccuuccua

SEQ ID NO: 3857123 - RNA, 21 nt, Human
ugguucccuuugcuccacccc

SEQ ID NO: 3857124 - RNA, 23 nt, Human
ugguucccuuugcuccaccccac

SEQ ID NO: 3857125 - RNA, 20 nt, Human
ugguuccggaauccuguccu

SEQ ID NO: 3857126 - RNA, 18 nt, Human
ugguuccuggggcaucca

SEQ ID NO: 3857127 - RNA, 17 nt, Human
ugguucuaaggaccuga

SEQ ID NO: 3857128 - RNA, 15 nt, Human
ugguucuaauagaac

SEQ ID NO: 3857129 - RNA, 18 nt, Human
ugguucugagauggcucc

SEQ ID NO: 3857130 - RNA, 20 nt, Human
ugguucugaugaugugccug

SEQ ID NO: 3857131 - RNA, 13 nt, Human
ugguucugugaac

SEQ ID NO: 3857132 - RNA, 21 nt, Human
aaggagcugcuauagccuggg

SEQ ID NO: 3857133 - RNA, 11 nt, Human
aaggaggaaaa

SEQ ID NO: 3857134 - RNA, 16 nt, Human
aaggaggaaggagccu

SEQ ID NO: 3857135 - RNA, 15 nt, Human
aaggaggacccagga

SEQ ID NO: 3857136 - RNA, 18 nt, Human
aaggaggacccaggacag

SEQ ID NO: 3857137 - RNA, 21 nt, Human
aaggaggacccaggacaggau

SEQ ID NO: 3857138 - RNA, 16 nt, Human
aaggaggcaugccucu

SEQ ID NO: 3857139 - RNA, 18 nt, Human
aaggaggcuaugcucagg

SEQ ID NO: 3857140 - RNA, 17 nt, Human
aaggaggcuccaggcag

SEQ ID NO: 3857141 - RNA, 18 nt, Human
aaggaggcuccaggcagc

SEQ ID NO: 3857142 - RNA, 14 nt, Human
aaggaggcuggcag

SEQ ID NO: 3857143 - RNA, 17 nt, Human
aaggagggaaggauuua

SEQ ID NO: 3857144 - RNA, 17 nt, Human
aaggaggggaaaaaaau

SEQ ID NO: 3857145 - RNA, 15 nt, Human
aaggaggggaagcug

SEQ ID NO: 3857146 - RNA, 15 nt, Human
aaggaguaagaaccu

SEQ ID NO: 3857147 - RNA, 20 nt, Human
aaggagucagacauuuuaag

SEQ ID NO: 3857148 - RNA, 19 nt, Human
aaggagugagaucauuuuc

SEQ ID NO: 3857149 - RNA, 12 nt, Human
aaggauaaagaa

SEQ ID NO: 3857150 - RNA, 20 nt, Human
aaggauaaaucauaaaguca

SEQ ID NO: 3857151 - RNA, 13 nt, Human
aaggauacaaaag

SEQ ID NO: 3857152 - RNA, 14 nt, Human
aaggauacauaaug

SEQ ID NO: 3857153 - RNA, 20 nt, Human
aaggauagaugcuggcccag

SEQ ID NO: 3857154 - RNA, 22 nt, Human
aaggauaggccuucauuaacaa

SEQ ID NO: 3857155 - RNA, 15 nt, Human
aaggauaguaagcau

SEQ ID NO: 3857156 - RNA, 20 nt, Human
aaggauagugcgauguuuca

SEQ ID NO: 3857157 - RNA, 19 nt, Human
aaggauauuuaagaaaaua

SEQ ID NO: 3857158 - RNA, 17 nt, Human
aaggauccggaaagaag

SEQ ID NO: 3857159 - RNA, 13 nt, Human
aaggauccugagc

SEQ ID NO: 3857160 - RNA, 14 nt, Human
aaggauccugagcc

SEQ ID NO: 3857161 - RNA, 22 nt, Human
aaggauccugagccagauuuca

SEQ ID NO: 3857162 - RNA, 20 nt, Human
aaggaucucucaggagcaca

SEQ ID NO: 3857163 - RNA, 23 nt, Human
aaggaucuguuuuuaaaaaucau

SEQ ID NO: 3857164 - RNA, 14 nt, Human
aaggaucuucaucu

SEQ ID NO: 3857165 - RNA, 23 nt, Human
aaggaucuuucacccacagaaag

SEQ ID NO: 3857166 - RNA, 20 nt, Human
aaggaucuuuguggccaagg

SEQ ID NO: 3857167 - RNA, 23 nt, Human
aaggaugaaugaggucccaggca

SEQ ID NO: 3857168 - RNA, 18 nt, Human
aaggaugcacagaguugu

SEQ ID NO: 3857169 - RNA, 22 nt, Human
aaggaugcacagaguuguuaca

SEQ ID NO: 3857170 - RNA, 22 nt, Human
aaggaugccaagaaguuuaagg

SEQ ID NO: 3857171 - RNA, 15 nt, Human
aaggaugcuuguaca

SEQ ID NO: 3857172 - RNA, 17 nt, Human
aaggaugcuuguacaua

SEQ ID NO: 3857173 - RNA, 15 nt, Human
aaggauguucuagca

SEQ ID NO: 3857174 - RNA, 15 nt, Human
aaggauguugguguu

SEQ ID NO: 3857175 - RNA, 22 nt, Human
aaggauucugcuggccucugcg

SEQ ID NO: 3857176 - RNA, 13 nt, Human
aaggauugaaaau

SEQ ID NO: 3857177 - RNA, 14 nt, Human
aaggauugaaaauu

SEQ ID NO: 3857178 - RNA, 14 nt, Human
aaggauuguaaaaa

SEQ ID NO: 3857179 - RNA, 21 nt, Human
aaggauuguaaaaaaaaaugc

SEQ ID NO: 3857180 - RNA, 12 nt, Human
aaggauuuuaug

SEQ ID NO: 3857181 - RNA, 13 nt, Human
aaggauuuuaugc

SEQ ID NO: 3857182 - RNA, 21 nt, Human
aaggauuuuaugcuuuaaaca

SEQ ID NO: 3857183 - RNA, 14 nt, Human
aaggauuuugcagu

SEQ ID NO: 3857184 - RNA, 15 nt, Human
aaggauuuugcaguu

SEQ ID NO: 3857185 - RNA, 21 nt, Human
aaggcaaaaauaguuuggaua

SEQ ID NO: 3857186 - RNA, 21 nt, Human
aaggcaaaggguccagaagga

SEQ ID NO: 3857187 - RNA, 15 nt, Human
aaggcaaaugacuuu

SEQ ID NO: 3857188 - RNA, 16 nt, Human
aaggcaaaugacuuug

SEQ ID NO: 3857189 - RNA, 22 nt, Human
aaggcaacaaaagaagcccggc

SEQ ID NO: 3857190 - RNA, 19 nt, Human
aaggcaagaggggguggag

SEQ ID NO: 3857191 - RNA, 16 nt, Human
aaggcaaggcugucaa

SEQ ID NO: 3857192 - RNA, 17 nt, Human
aaggcaaggcugucaau

SEQ ID NO: 3857193 - RNA, 21 nt, Human
aaggcaaguuaagagaaacuu

SEQ ID NO: 3857194 - RNA, 16 nt, Human
aaggcacaugucaccu

SEQ ID NO: 3857195 - RNA, 19 nt, Human
aaggcacccacaaauaaau

SEQ ID NO: 3857196 - RNA, 19 nt, Human
aaggcacccaucugucugc

SEQ ID NO: 3857197 - RNA, 16 nt, Human
aaggcacucuagauuc

SEQ ID NO: 3857198 - RNA, 19 nt, Human
aaggcacucuagauuccau

SEQ ID NO: 3857199 - RNA, 21 nt, Human
aaggcacucuguuauuuagac

SEQ ID NO: 3857200 - RNA, 17 nt, Human
aaggcagaaagcaaaau

SEQ ID NO: 3857201 - RNA, 15 nt, Human
aaggcagaggccugg

SEQ ID NO: 3857202 - RNA, 13 nt, Human
aaggcagcaggcg

SEQ ID NO: 3857203 - RNA, 18 nt, Human
aaggcagcuguugucucu

SEQ ID NO: 3857204 - RNA, 21 nt, Human
aaggcagcuguugucucuucu

SEQ ID NO: 3857205 - RNA, 19 nt, Human
aaggcaggaauguguggca

SEQ ID NO: 3857206 - RNA, 22 nt, Human
aaggcaggcagggcucuccugg

SEQ ID NO: 3857207 - RNA, 19 nt, Human
aaggcagggagggccuggg

SEQ ID NO: 3857208 - RNA, 22 nt, Human
aaggcagggagggccugggccc

SEQ ID NO: 3857209 - RNA, 15 nt, Human
aaggcaguuuucuaa

SEQ ID NO: 3857210 - RNA, 20 nt, Human
aaggcauaucagucucugag

SEQ ID NO: 3857211 - RNA, 23 nt, Human
aaggcaugccuggacaaacccuu

SEQ ID NO: 3857212 - RNA, 15 nt, Human
aaggcaugugugaaa

SEQ ID NO: 3857213 - RNA, 18 nt, Human
aaggcaugugugaaacau

SEQ ID NO: 3857214 - RNA, 15 nt, Human
aaggcauuucccacc

SEQ ID NO: 3857215 - RNA, 13 nt, Human
aaggcauuuuauu

SEQ ID NO: 3857216 - RNA, 17 nt, Human
aaggccaaacugcugga

SEQ ID NO: 3857217 - RNA, 18 nt, Human
aaggccaaaggaagcaca

SEQ ID NO: 3857218 - RNA, 19 nt, Human
aaggccaagaggcuguucc

SEQ ID NO: 3857219 - RNA, 20 nt, Human
aaggccaccucuuccuggcc

SEQ ID NO: 3857220 - RNA, 18 nt, Human
aaggccagaccugcagac

SEQ ID NO: 3857221 - RNA, 19 nt, Human
aaggccagcaagguggagu

SEQ ID NO: 3857222 - RNA, 14 nt, Human
aaggccauaaaaca

SEQ ID NO: 3857223 - RNA, 22 nt, Human
aaggccauggagagcuggagcc

SEQ ID NO: 3857224 - RNA, 15 nt, Human
aaggcccacaggagg

SEQ ID NO: 3857225 - RNA, 14 nt, Human
aaggccccagagac

SEQ ID NO: 3857226 - RNA, 15 nt, Human
aaggccccagagacu

SEQ ID NO: 3857227 - RNA, 14 nt, Human
aaggcccccuacgc

SEQ ID NO: 3857228 - RNA, 22 nt, Human
aaggcccccucucaggagccau

SEQ ID NO: 3857229 - RNA, 14 nt, Human
aaggcccccugccu

SEQ ID NO: 3857230 - RNA, 15 nt, Human
aaggcccccugccug

SEQ ID NO: 3857231 - RNA, 14 nt, Human
aaggccccgcccag

SEQ ID NO: 3857232 - RNA, 20 nt, Human
aaggcccgagcagcugagca

SEQ ID NO: 3857233 - RNA, 22 nt, Human
aaggcccuaucuguuuacagug

SEQ ID NO: 3857234 - RNA, 15 nt, Human
aaggcccugcugccc

SEQ ID NO: 3857235 - RNA, 16 nt, Human
aaggccgaagcucugg

SEQ ID NO: 3857236 - RNA, 18 nt, Human
aaggccgaagcucuggcu

SEQ ID NO: 3857237 - RNA, 22 nt, Human
aaggccgcuguucacccacagg

SEQ ID NO: 3857238 - RNA, 22 nt, Human
aaggccuaauucuaugccuguc

SEQ ID NO: 3857239 - RNA, 18 nt, Human
aaggccuaggauucuaaa

SEQ ID NO: 3857240 - RNA, 16 nt, Human
aaggccucccacagug

SEQ ID NO: 3857241 - RNA, 18 nt, Human
aaggccucgcaggaagac

SEQ ID NO: 3857242 - RNA, 13 nt, Human
aaggccucugucc

SEQ ID NO: 3857243 - RNA, 16 nt, Human
aaggccucuuccuugc

SEQ ID NO: 3857244 - RNA, 23 nt, Human
aaggccucuuggagaccuuaccc

SEQ ID NO: 3857245 - RNA, 13 nt, Human
aaggccugaauca

SEQ ID NO: 3857246 - RNA, 14 nt, Human
aaggccugcacaca

SEQ ID NO: 3857247 - RNA, 17 nt, Human
aaggccuggcccacagc

SEQ ID NO: 3857248 - RNA, 12 nt, Human
aaggccugggug

SEQ ID NO: 3857249 - RNA, 21 nt, Human
aaggccuuauucuacauuuca

SEQ ID NO: 3857250 - RNA, 18 nt, Human
aaggccuucaacccgaga

SEQ ID NO: 3857251 - RNA, 20 nt, Human
aaggccuucauggccccagc

SEQ ID NO: 3857252 - RNA, 15 nt, Human
aaggccuucuccucc

SEQ ID NO: 3857253 - RNA, 15 nt, Human
aaggccuuuaaaauu

SEQ ID NO: 3857254 - RNA, 14 nt, Human
aaggccuuucugug

SEQ ID NO: 3857255 - RNA, 23 nt, Human
aaggcgaucccaucuugauaaga

SEQ ID NO: 3857256 - RNA, 23 nt, Human
aaggcgcuaacuugcuuaaaugu

SEQ ID NO: 3857257 - RNA, 17 nt, Human
aaggcgcugagacugug

SEQ ID NO: 3857258 - RNA, 21 nt, Human
aaggcgguggacuugaacuuu

SEQ ID NO: 3857259 - RNA, 22 nt, Human
aaggcguagcaucauccugcag

SEQ ID NO: 3857260 - RNA, 15 nt, Human
aaggcuaccuuugua

SEQ ID NO: 3857261 - RNA, 15 nt, Human
aaggcuacucaccuu

SEQ ID NO: 3857262 - RNA, 16 nt, Human
aaggcucagucucagg

SEQ ID NO: 3857263 - RNA, 15 nt, Human
aaggcuccaagaccu

SEQ ID NO: 3857264 - RNA, 16 nt, Human
aaggcuccaggagcag

SEQ ID NO: 3857265 - RNA, 18 nt, Human
aaggcuccaggagcagcc

SEQ ID NO: 3857266 - RNA, 22 nt, Human
aaggcuccaggagcagccacau

SEQ ID NO: 3857267 - RNA, 16 nt, Human
aaggcuccauauauau

SEQ ID NO: 3857268 - RNA, 20 nt, Human
aaggcucgagcaugccugga

SEQ ID NO: 3857269 - RNA, 15 nt, Human
aaggcucgauuuugu

SEQ ID NO: 3857270 - RNA, 20 nt, Human
aaggcucuaugagucuagau

SEQ ID NO: 3857271 - RNA, 12 nt, Human
aaggcucugaga

SEQ ID NO: 3857272 - RNA, 13 nt, Human
aaggcucugagag

SEQ ID NO: 3857273 - RNA, 14 nt, Human
aaggcucugagagu

SEQ ID NO: 3857274 - RNA, 20 nt, Human
aaggcucugagagucuagau

SEQ ID NO: 3857275 - RNA, 23 nt, Human
aaggcucuguuccacauauauuu

SEQ ID NO: 3857276 - RNA, 17 nt, Human
aaggcucuucuccccag

SEQ ID NO: 3857277 - RNA, 19 nt, Human
aaggcucuucuccccagag

SEQ ID NO: 3857278 - RNA, 15 nt, Human
aaggcugaccaagag

SEQ ID NO: 3857279 - RNA, 20 nt, Human
aaggcugaggaaaggccagc

SEQ ID NO: 3857280 - RNA, 18 nt, Human
aaggcuggagugcagugg

SEQ ID NO: 3857281 - RNA, 17 nt, Human
uguaaucucucugcagc

SEQ ID NO: 3857282 - RNA, 19 nt, Human
uguaaucucucugcagcug

SEQ ID NO: 3857283 - RNA, 21 nt, Human
uguaaucucucugcagcugcc

SEQ ID NO: 3857284 - RNA, 11 nt, Human
uguaaugaaaa

SEQ ID NO: 3857285 - RNA, 17 nt, Human
uguaaugaaacaccuuc

SEQ ID NO: 3857286 - RNA, 19 nt, Human
uguaaugaaccgcugaaua

SEQ ID NO: 3857287 - RNA, 15 nt, Human
uguaaugaaguaaag

SEQ ID NO: 3857288 - RNA, 15 nt, Human
uguaaugaauaccuu

SEQ ID NO: 3857289 - RNA, 12 nt, Human
uguaaugacagg

SEQ ID NO: 3857290 - RNA, 14 nt, Human
uguaaugcugcacu

SEQ ID NO: 3857291 - RNA, 19 nt, Human
uguaaugguacugacuuug

SEQ ID NO: 3857292 - RNA, 22 nt, Human
uguaaugucccuuucagagaca

SEQ ID NO: 3857293 - RNA, 15 nt, Human
uguaaugucuugagc

SEQ ID NO: 3857294 - RNA, 19 nt, Human
uguaaugucuugagcucua

SEQ ID NO: 3857295 - RNA, 18 nt, Human
uguaaugugugguggccu

SEQ ID NO: 3857296 - RNA, 20 nt, Human
uguaaugugugguggccuca

SEQ ID NO: 3857297 - RNA, 14 nt, Human
uguaauguuaauau

SEQ ID NO: 3857298 - RNA, 13 nt, Human
uguaauguuacug

SEQ ID NO: 3857299 - RNA, 13 nt, Human
uguaauguuuucu

SEQ ID NO: 3857300 - RNA, 18 nt, Human
uguaauguuuucuuugca

SEQ ID NO: 3857301 - RNA, 19 nt, Human
uguaauuaaaagcaaauca

SEQ ID NO: 3857302 - RNA, 17 nt, Human
uguaauuaaauuauggu

SEQ ID NO: 3857303 - RNA, 17 nt, Human
uguaauuaaguacuaug

SEQ ID NO: 3857304 - RNA, 13 nt, Human
uguaauucagugu

SEQ ID NO: 3857305 - RNA, 13 nt, Human
uguaauucuaaau

SEQ ID NO: 3857306 - RNA, 19 nt, Human
uguaauugacgguuuuuua

SEQ ID NO: 3857307 - RNA, 13 nt, Human
uguaauugauugu

SEQ ID NO: 3857308 - RNA, 15 nt, Human
uguaauugcuuacau

SEQ ID NO: 3857309 - RNA, 17 nt, Human
uguaauugcuuacauuu

SEQ ID NO: 3857310 - RNA, 18 nt, Human
uguaauuguaauuuugaa

SEQ ID NO: 3857311 - RNA, 20 nt, Human
uguaauuguguggauucuuu

SEQ ID NO: 3857312 - RNA, 19 nt, Human
uguaauuguuguuuguaug

SEQ ID NO: 3857313 - RNA, 15 nt, Human
uguaauuguuugucu

SEQ ID NO: 3857314 - RNA, 17 nt, Human
uguaauuuaaaauugug

SEQ ID NO: 3857315 - RNA, 21 nt, Human
uguaauuuaaacaggcccagc

SEQ ID NO: 3857316 - RNA, 19 nt, Human
uguaauuugaugagguauu

SEQ ID NO: 3857317 - RNA, 17 nt, Human
uguaauuuuauuuuaaa

SEQ ID NO: 3857318 - RNA, 20 nt, Human
uguaauuuuauuuuaaaauu

SEQ ID NO: 3857319 - RNA, 15 nt, Human
uguaauuuucuugau

SEQ ID NO: 3857320 - RNA, 15 nt, Human
uguaauuuuguguaa

SEQ ID NO: 3857321 - RNA, 22 nt, Human
uguacaaaaaaaucuuccaauu

SEQ ID NO: 3857322 - RNA, 13 nt, Human
uguacaaaauuaa

SEQ ID NO: 3857323 - RNA, 19 nt, Human
uguacaaaauuaagcaaau

SEQ ID NO: 3857324 - RNA, 24 nt, Human
uguacaaaauuaagcaaauguuaa

SEQ ID NO: 3857325 - RNA, 14 nt, Human
uguacaaaggggaa

SEQ ID NO: 3857326 - RNA, 22 nt, Human
uguacaaaggggaaagaacaua

SEQ ID NO: 3857327 - RNA, 14 nt, Human
uguacaaaguauua

SEQ ID NO: 3857328 - RNA, 17 nt, Human
uguacaaaguauuaagc

SEQ ID NO: 3857329 - RNA, 20 nt, Human
uguacaaaguauuaagcaua

SEQ ID NO: 3857330 - RNA, 19 nt, Human
uguacaaauaaagucccag

SEQ ID NO: 3857331 - RNA, 18 nt, Human
uguacaaauauaagaaua

SEQ ID NO: 3857332 - RNA, 17 nt, Human
uguacaaccugugauca

SEQ ID NO: 3857333 - RNA, 18 nt, Human
uguacaaugacuuuauug

SEQ ID NO: 3857334 - RNA, 18 nt, Human
uguacaauguacacacug

SEQ ID NO: 3857335 - RNA, 16 nt, Human
uguacaauuaaaaacc

SEQ ID NO: 3857336 - RNA, 22 nt, Human
uguacaauugaacuuaaauaaa

SEQ ID NO: 3857337 - RNA, 23 nt, Human
uguacaauugaacuuaaauaaau

SEQ ID NO: 3857338 - RNA, 21 nt, Human
uguacacaacucacuccuuuu

SEQ ID NO: 3857339 - RNA, 14 nt, Human
uguacacugaauau

SEQ ID NO: 3857340 - RNA, 16 nt, Human
uguacacugaauauuu

SEQ ID NO: 3857341 - RNA, 17 nt, Human
uguacacugacuugaga

SEQ ID NO: 3857342 - RNA, 12 nt, Human
uguacacuuuuu

SEQ ID NO: 3857343 - RNA, 21 nt, Human
uguacagaaaagggcggcuuc

SEQ ID NO: 3857344 - RNA, 15 nt, Human
uguacagaauauuuc

SEQ ID NO: 3857345 - RNA, 20 nt, Human
uguacagacguaugcuuauu

SEQ ID NO: 3857346 - RNA, 21 nt, Human
uguacagagaacuaacacuau

SEQ ID NO: 3857347 - RNA, 18 nt, Human
uguacagagcccacgccc

SEQ ID NO: 3857348 - RNA, 21 nt, Human
uguacagagccguaaaaacug

SEQ ID NO: 3857349 - RNA, 19 nt, Human
uguacagagugcuuuucug

SEQ ID NO: 3857350 - RNA, 12 nt, Human
uguacagcccag

SEQ ID NO: 3857351 - RNA, 16 nt, Human
uguacaggaacugcau

SEQ ID NO: 3857352 - RNA, 18 nt, Human
uguacaguauguucaaag

SEQ ID NO: 3857353 - RNA, 13 nt, Human
uguacagucuguc

SEQ ID NO: 3857354 - RNA, 14 nt, Human
uguacagucuguca

SEQ ID NO: 3857355 - RNA, 18 nt, Human
uguacagucugucaugaa

SEQ ID NO: 3857356 - RNA, 23 nt, Human
uguacagucugucaugaacaugu

SEQ ID NO: 3857357 - RNA, 21 nt, Human
uguacagucuuguauuaaguu

SEQ ID NO: 3857358 - RNA, 15 nt, Human
uguacagugucuuuu

SEQ ID NO: 3857359 - RNA, 17 nt, Human
uguacaguguguaaagu

SEQ ID NO: 3857360 - RNA, 14 nt, Human
uguacaguguuacc

SEQ ID NO: 3857361 - RNA, 23 nt, Human
uguccaucugcccgccugcccac

SEQ ID NO: 3857362 - RNA, 13 nt, Human
uguccaugugugu

SEQ ID NO: 3857363 - RNA, 19 nt, Human
uguccauugacauguacag

SEQ ID NO: 3857364 - RNA, 20 nt, Human
uguccauugacauguacaga

SEQ ID NO: 3857365 - RNA, 22 nt, Human
uguccauugacauguacagaga

SEQ ID NO: 3857366 - RNA, 20 nt, Human
uguccauuuauccacaggaa

SEQ ID NO: 3857367 - RNA, 14 nt, Human
uguccauuuuuaca

SEQ ID NO: 3857368 - RNA, 12 nt, Human
ugucccaagugc

SEQ ID NO: 3857369 - RNA, 15 nt, Human
ugucccaagugccaa

SEQ ID NO: 3857370 - RNA, 20 nt, Human
ugucccacagcuuggggcca

SEQ ID NO: 3857371 - RNA, 23 nt, Human
ugucccacccccacccccagcuc

SEQ ID NO: 3857372 - RNA, 13 nt, Human
ugucccaccucuu

SEQ ID NO: 3857373 - RNA, 23 nt, Human
ugucccaccucuucucuuccugu

SEQ ID NO: 3857374 - RNA, 14 nt, Human
ugucccagaagaug

SEQ ID NO: 3857375 - RNA, 17 nt, Human
ugucccaggcagggaga

SEQ ID NO: 3857376 - RNA, 17 nt, Human
ugucccagguccucacu

SEQ ID NO: 3857377 - RNA, 19 nt, Human
ugucccaucuggucauuug

SEQ ID NO: 3857378 - RNA, 14 nt, Human
ugucccaugaccca

SEQ ID NO: 3857379 - RNA, 16 nt, Human
ugucccaugacccacc

SEQ ID NO: 3857380 - RNA, 22 nt, Human
ugucccaugugagcugcugcca

SEQ ID NO: 3857381 - RNA, 19 nt, Human
uguccccaaauccgaaccu

SEQ ID NO: 3857382 - RNA, 15 nt, Human
uguccccacacuccu

SEQ ID NO: 3857383 - RNA, 11 nt, Human
uguccccacca

SEQ ID NO: 3857384 - RNA, 17 nt, Human
uguccccaccaucugcu

SEQ ID NO: 3857385 - RNA, 21 nt, Human
uguccccaccaucugcugucu

SEQ ID NO: 3857386 - RNA, 22 nt, Human
uguccccacccuccacucagcu

SEQ ID NO: 3857387 - RNA, 22 nt, Human
uguccccaccgcagacaggacc

SEQ ID NO: 3857388 - RNA, 15 nt, Human
uguccccagcccacu

SEQ ID NO: 3857389 - RNA, 19 nt, Human
uguccccaguuugcagaaa

SEQ ID NO: 3857390 - RNA, 13 nt, Human
ugucccccaacuu

SEQ ID NO: 3857391 - RNA, 15 nt, Human
ugucccccaacuuca

SEQ ID NO: 3857392 - RNA, 14 nt, Human
ugucccccaacuug

SEQ ID NO: 3857393 - RNA, 16 nt, Human
ugucccccaacuugag

SEQ ID NO: 3857394 - RNA, 15 nt, Human
ugucccccagcucug

SEQ ID NO: 3857395 - RNA, 14 nt, Human
ugucccccugagau

SEQ ID NO: 3857396 - RNA, 23 nt, Human
ugucccccugagaucagaguccu

SEQ ID NO: 3857397 - RNA, 17 nt, Human
uguccccgacccuugcc

SEQ ID NO: 3857398 - RNA, 19 nt, Human
uguccccgcacugggcuug

SEQ ID NO: 3857399 - RNA, 13 nt, Human
uguccccuauccu

SEQ ID NO: 3857400 - RNA, 13 nt, Human
uguccccucagcu

SEQ ID NO: 3857401 - RNA, 13 nt, Human
uguccccucccag

SEQ ID NO: 3857402 - RNA, 21 nt, Human
uguccccuccucacucccuuc

SEQ ID NO: 3857403 - RNA, 14 nt, Human
uguccccucuugac

SEQ ID NO: 3857404 - RNA, 14 nt, Human
uguccccuucucuc

SEQ ID NO: 3857405 - RNA, 20 nt, Human
uguccccuucucucaucucu

SEQ ID NO: 3857406 - RNA, 20 nt, Human
ugucccgggguccuguggca

SEQ ID NO: 3857407 - RNA, 19 nt, Human
ugucccuacaccccucccc

SEQ ID NO: 3857408 - RNA, 13 nt, Human
ugucccuaggugu

SEQ ID NO: 3857409 - RNA, 12 nt, Human
ugucccucccac

SEQ ID NO: 3857410 - RNA, 22 nt, Human
ugucccuccuggugucacccca

SEQ ID NO: 3857411 - RNA, 15 nt, Human
ugucccucucaggca

SEQ ID NO: 3857412 - RNA, 15 nt, Human
ugucccucugcccca

SEQ ID NO: 3857413 - RNA, 16 nt, Human
ugucccucugccccau

SEQ ID NO: 3857414 - RNA, 14 nt, Human
ugucccucuucacu

SEQ ID NO: 3857415 - RNA, 16 nt, Human
ugucccucuucacucc

SEQ ID NO: 3857416 - RNA, 15 nt, Human
ugucccugaaaccua

SEQ ID NO: 3857417 - RNA, 14 nt, Human
ugucccugcacuug

SEQ ID NO: 3857418 - RNA, 22 nt, Human
ugucccuggccaucucugaacu

SEQ ID NO: 3857419 - RNA, 15 nt, Human
ugucccuggcuuccu

SEQ ID NO: 3857420 - RNA, 17 nt, Human
ugucccuggcuuccuua

SEQ ID NO: 3857421 - RNA, 15 nt, Human
ugucccugggccagg

SEQ ID NO: 3857422 - RNA, 20 nt, Human
ugucccuucugucccucaca

SEQ ID NO: 3857423 - RNA, 18 nt, Human
ugucccuugccccccugg

SEQ ID NO: 3857424 - RNA, 22 nt, Human
ugucccuugccucaaugccagu

SEQ ID NO: 3857425 - RNA, 15 nt, Human
ugucccuuucagaga

SEQ ID NO: 3857426 - RNA, 17 nt, Human
ugucccuuuuccuuuuu

SEQ ID NO: 3857427 - RNA, 13 nt, Human
uguccgagaacua

SEQ ID NO: 3857428 - RNA, 15 nt, Human
uguccgcccucuucc

SEQ ID NO: 3857429 - RNA, 22 nt, Human
uguccgcugggugguacccucu

SEQ ID NO: 3857430 - RNA, 22 nt, Human
uguccuaaaacaccugguagga

SEQ ID NO: 3857431 - RNA, 16 nt, Human
uguccuaaggaaccuu

SEQ ID NO: 3857432 - RNA, 15 nt, Human
uguccuaaggacaca

SEQ ID NO: 3857433 - RNA, 22 nt, Human
uguccuaaugcuugcugcugau

SEQ ID NO: 3857434 - RNA, 14 nt, Human
uguccuacagaaaa

SEQ ID NO: 3857435 - RNA, 22 nt, Human
uguccuagcacagauggccagc

SEQ ID NO: 3857436 - RNA, 13 nt, Human
uguccuaugaaug

SEQ ID NO: 3857437 - RNA, 21 nt, Human
uguccuaugaaugcuuugcau

SEQ ID NO: 3857438 - RNA, 13 nt, Human
uguccuaugugug

SEQ ID NO: 3857439 - RNA, 14 nt, Human
uguccucaccacau

SEQ ID NO: 3857440 - RNA, 22 nt, Human
uguccucacggugccuuuuuuc

SEQ ID NO: 3857441 - RNA, 14 nt, Human
uguccucacugcuc

SEQ ID NO: 3857442 - RNA, 15 nt, Human
uguccucagcauuuc

SEQ ID NO: 3857443 - RNA, 14 nt, Human
uguccucagccagu

SEQ ID NO: 3857444 - RNA, 13 nt, Human
uguccucagcccc

SEQ ID NO: 3857445 - RNA, 16 nt, Human
uguccucagccuugcc

SEQ ID NO: 3857446 - RNA, 17 nt, Human
uguccucagccuugcca

SEQ ID NO: 3857447 - RNA, 14 nt, Human
uguccucagggagc

SEQ ID NO: 3857448 - RNA, 23 nt, Human
uguccucagggagcagggaaggc

SEQ ID NO: 3857449 - RNA, 14 nt, Human
uguccucagguggc

SEQ ID NO: 3857450 - RNA, 16 nt, Human
uguccucauuucucca

SEQ ID NO: 3857451 - RNA, 18 nt, Human
uguccucauuucuccaga

SEQ ID NO: 3857452 - RNA, 23 nt, Human
uguccuccaacaccaagcacagc

SEQ ID NO: 3857453 - RNA, 17 nt, Human
uguccuccaagccagcg

SEQ ID NO: 3857454 - RNA, 19 nt, Human
uguccuccagaagccucug

SEQ ID NO: 3857455 - RNA, 20 nt, Human
uguccuccagaagccucugg

SEQ ID NO: 3857456 - RNA, 21 nt, Human
uguccuccagaagccucuggc

SEQ ID NO: 3857457 - RNA, 13 nt, Human
uguccucccaucc

SEQ ID NO: 3857458 - RNA, 23 nt, Human
uguccucccgagcuccucuucca

SEQ ID NO: 3857459 - RNA, 21 nt, Human
uguccuccgccuuaccaggag

SEQ ID NO: 3857460 - RNA, 14 nt, Human
uguccuccugcugc

SEQ ID NO: 3857461 - RNA, 17 nt, Human
uguccuccugcugccag

SEQ ID NO: 3857462 - RNA, 18 nt, Human
uguccuccugcugccagu

SEQ ID NO: 3857463 - RNA, 20 nt, Human
uguccucuccccuccagccu

SEQ ID NO: 3857464 - RNA, 19 nt, Human
uguccucuucugcaucuug

SEQ ID NO: 3857465 - RNA, 23 nt, Human
uguccucuucugcaucuugggga

SEQ ID NO: 3857466 - RNA, 23 nt, Human
uguccucuugcucaaaaaucugu

SEQ ID NO: 3857467 - RNA, 19 nt, Human
uguccucuuucagaaaaca

SEQ ID NO: 3857468 - RNA, 21 nt, Human
uguccucuuucagaaaacaga

SEQ ID NO: 3857469 - RNA, 20 nt, Human
uguccucuuuuguuguuucu

SEQ ID NO: 3857470 - RNA, 12 nt, Human
uguccugaaggc

SEQ ID NO: 3857471 - RNA, 15 nt, Human
uguccugaaggccug

SEQ ID NO: 3857472 - RNA, 12 nt, Human
uguccugaccac

SEQ ID NO: 3857473 - RNA, 20 nt, Human
uguccugaccacccuccccu

SEQ ID NO: 3857474 - RNA, 21 nt, Human
uguccugaccacccuccccuc

SEQ ID NO: 3857475 - RNA, 22 nt, Human
uguccugaccacccuccccucu

SEQ ID NO: 3857476 - RNA, 21 nt, Human
uguccugacuucaggggcugc

SEQ ID NO: 3857477 - RNA, 17 nt, Human
uguccugagccccaggg

SEQ ID NO: 3857478 - RNA, 21 nt, Human
ugugcuaccuggguccuuuuc

SEQ ID NO: 3857479 - RNA, 17 nt, Human
ugugcuacugauuguuu

SEQ ID NO: 3857480 - RNA, 20 nt, Human
ugugcuagaaauuuucaaga

SEQ ID NO: 3857481 - RNA, 19 nt, Human
ugugcuaguaauuggaaag

SEQ ID NO: 3857482 - RNA, 15 nt, Human
ugugcuaugaauuuu

SEQ ID NO: 3857483 - RNA, 16 nt, Human
ugugcuauuaauauuu

SEQ ID NO: 3857484 - RNA, 15 nt, Human
ugugcucagcccuga

SEQ ID NO: 3857485 - RNA, 18 nt, Human
ugugcucaggacucagaa

SEQ ID NO: 3857486 - RNA, 19 nt, Human
ugugcucuccaagcccagu

SEQ ID NO: 3857487 - RNA, 14 nt, Human
ugugcucugcuuca

SEQ ID NO: 3857488 - RNA, 15 nt, Human
ugugcucuggacagg

SEQ ID NO: 3857489 - RNA, 19 nt, Human
ugugcugaauucugcaaug

SEQ ID NO: 3857490 - RNA, 17 nt, Human
ugugcugcccugaagaa

SEQ ID NO: 3857491 - RNA, 18 nt, Human
ugugcugcccugaagaau

SEQ ID NO: 3857492 - RNA, 18 nt, Human
ugccacauuagaacuucu

SEQ ID NO: 3857493 - RNA, 16 nt, Human
ugccacauuuucuuaa

SEQ ID NO: 3857494 - RNA, 16 nt, Human
ugccaccaccucugug

SEQ ID NO: 3857495 - RNA, 22 nt, Human
ugccaccaccucuguggcauug

SEQ ID NO: 3857496 - RNA, 18 nt, Human
ugccaccacuauaaaaug

SEQ ID NO: 3857497 - RNA, 22 nt, Human
ugccaccagagaccguccucac

SEQ ID NO: 3857498 - RNA, 22 nt, Human
ugccaccaggagaaccacuaca

SEQ ID NO: 3857499 - RNA, 17 nt, Human
ugccaccaggccaccuc

SEQ ID NO: 3857500 - RNA, 17 nt, Human
ugccacccaccagggcg

SEQ ID NO: 3857501 - RNA, 21 nt, Human
ugccacccaccucccugccuc

SEQ ID NO: 3857502 - RNA, 21 nt, Human
ugccacccagccccagccagg

SEQ ID NO: 3857503 - RNA, 13 nt, Human
ugccacccaggau

SEQ ID NO: 3857504 - RNA, 14 nt, Human
ugccaccccacccu

SEQ ID NO: 3857505 - RNA, 19 nt, Human
ugccaccccacccucccug

SEQ ID NO: 3857506 - RNA, 22 nt, Human
ugccaccccacccucccuggag

SEQ ID NO: 3857507 - RNA, 19 nt, Human
ugccacccccgcuggagga

SEQ ID NO: 3857508 - RNA, 23 nt, Human
ugccacccccgcuggaggaugug

SEQ ID NO: 3857509 - RNA, 13 nt, Human
ugccacccuaccu

SEQ ID NO: 3857510 - RNA, 14 nt, Human
ugccacccuagcca

SEQ ID NO: 3857511 - RNA, 16 nt, Human
ugccacccucaugcug

SEQ ID NO: 3857512 - RNA, 17 nt, Human
ugccacccucaugcugu

SEQ ID NO: 3857513 - RNA, 15 nt, Human
ugccaccucccccca

SEQ ID NO: 3857514 - RNA, 17 nt, Human
ugccaccuccccuaucc

SEQ ID NO: 3857515 - RNA, 22 nt, Human
ugccaccuccccuauccaccca

SEQ ID NO: 3857516 - RNA, 22 nt, Human
ugccaccuccccuugccagcug

SEQ ID NO: 3857517 - RNA, 14 nt, Human
ugccaccucugcag

SEQ ID NO: 3857518 - RNA, 14 nt, Human
ugccaccuggaccc

SEQ ID NO: 3857519 - RNA, 12 nt, Human
ugccaccugucu

SEQ ID NO: 3857520 - RNA, 13 nt, Human
ugccaccugucug

SEQ ID NO: 3857521 - RNA, 15 nt, Human
ugccaccugucuguc

SEQ ID NO: 3857522 - RNA, 16 nt, Human
ugccaccugucugucu

SEQ ID NO: 3857523 - RNA, 15 nt, Human
ugccacgaauuucug

SEQ ID NO: 3857524 - RNA, 16 nt, Human
ugccacguuccacagu

SEQ ID NO: 3857525 - RNA, 19 nt, Human
ugccacuaaacuacauugu

SEQ ID NO: 3857526 - RNA, 15 nt, Human
ugccacucacacagc

SEQ ID NO: 3857527 - RNA, 18 nt, Human
ugccacucacacagccag

SEQ ID NO: 3857528 - RNA, 20 nt, Human
ugccacucacacagccaggu

SEQ ID NO: 3857529 - RNA, 13 nt, Human
ugccacucacuag

SEQ ID NO: 3857530 - RNA, 15 nt, Human
ugccacucacuaggc

SEQ ID NO: 3857531 - RNA, 19 nt, Human
ugccacucacuaggccccc

SEQ ID NO: 3857532 - RNA, 17 nt, Human
ugccacuccucccuccg

SEQ ID NO: 3857533 - RNA, 13 nt, Human
ugccacugcacuc

SEQ ID NO: 3857534 - RNA, 16 nt, Human
ugccacugcacuccag

SEQ ID NO: 3857535 - RNA, 20 nt, Human
ugccacugcccgagcuggug

SEQ ID NO: 3857536 - RNA, 22 nt, Human
ugccacugcccgagcuggugca

SEQ ID NO: 3857537 - RNA, 18 nt, Human
ugccacugccucuuccuc

SEQ ID NO: 3857538 - RNA, 20 nt, Human
ugccacugccucuuccuccc

SEQ ID NO: 3857539 - RNA, 22 nt, Human
ugccacugccuucgcuucuugc

SEQ ID NO: 3857540 - RNA, 12 nt, Human
ugccacuguugu

SEQ ID NO: 3857541 - RNA, 23 nt, Human
ugccacuuaauguauguuaccaa

SEQ ID NO: 3857542 - RNA, 22 nt, Human
ugccacuugaacaaaaucuguu

SEQ ID NO: 3857543 - RNA, 20 nt, Human
ugccacuuuacccaccuaga

SEQ ID NO: 3857544 - RNA, 19 nt, Human
ugccacuuugcaaaggagc

SEQ ID NO: 3857545 - RNA, 21 nt, Human
ugccacuuugcacauuuugau

SEQ ID NO: 3857546 - RNA, 14 nt, Human
ugccagagauccaa

SEQ ID NO: 3857547 - RNA, 12 nt, Human
ugccagagccug

SEQ ID NO: 3857548 - RNA, 20 nt, Human
ugccagagccuggggcucua

SEQ ID NO: 3857549 - RNA, 22 nt, Human
ugccagaggcugaugucaagca

SEQ ID NO: 3857550 - RNA, 21 nt, Human
ugccagaggugggcagguggu

SEQ ID NO: 3857551 - RNA, 12 nt, Human
ugccagaugcug

SEQ ID NO: 3857552 - RNA, 16 nt, Human
ugccagaugcugaugu

SEQ ID NO: 3857553 - RNA, 15 nt, Human
ugccagaugcugcag

SEQ ID NO: 3857554 - RNA, 16 nt, Human
ugccagcaaagcccca

SEQ ID NO: 3857555 - RNA, 12 nt, Human
ugccagcaacug

SEQ ID NO: 3857556 - RNA, 14 nt, Human
ugccagcaacugaa

SEQ ID NO: 3857557 - RNA, 17 nt, Human
ugccagcagcagcaggu

SEQ ID NO: 3857558 - RNA, 21 nt, Human
ugccagccaagcucugcaguc

SEQ ID NO: 3857559 - RNA, 11 nt, Human
ugccagccaca

SEQ ID NO: 3857560 - RNA, 17 nt, Human
ugccagccacugugaua

SEQ ID NO: 3857561 - RNA, 12 nt, Human
ugccagccagca

SEQ ID NO: 3857562 - RNA, 22 nt, Human
ugccagccagcagccagcucuc

SEQ ID NO: 3857563 - RNA, 18 nt, Human
ugccagccccacacagcu

SEQ ID NO: 3857564 - RNA, 21 nt, Human
ugccagcccccuaaaagcacu

SEQ ID NO: 3857565 - RNA, 17 nt, Human
ugccagccgagauagcc

SEQ ID NO: 3857566 - RNA, 20 nt, Human
ugccagccgugaugcucagg

SEQ ID NO: 3857567 - RNA, 12 nt, Human
ugccagccuggc

SEQ ID NO: 3857568 - RNA, 15 nt, Human
ugccagccuggcuuc

SEQ ID NO: 3857569 - RNA, 20 nt, Human
ugccagccuggcuucuggag

SEQ ID NO: 3857570 - RNA, 21 nt, Human
ugccagccuggcuucuggagc

SEQ ID NO: 3857571 - RNA, 22 nt, Human
ugccagcucuuccuagcuggag

SEQ ID NO: 3857572 - RNA, 18 nt, Human
ugccagcugacaucuuga

SEQ ID NO: 3857573 - RNA, 15 nt, Human
ugccagcugcacuga

SEQ ID NO: 3857574 - RNA, 17 nt, Human
ugccagcugcugagccg

SEQ ID NO: 3857575 - RNA, 20 nt, Human
ugccagcugcugagccgcag

SEQ ID NO: 3857576 - RNA, 18 nt, Human
ugccagcuggccuuugua

SEQ ID NO: 3857577 - RNA, 18 nt, Human
ugccagcuuaucucaggg

SEQ ID NO: 3857578 - RNA, 22 nt, Human
ugccaggaaaggagaguacuuu

SEQ ID NO: 3857579 - RNA, 22 nt, Human
ugccaggaaccuguccuaagga

SEQ ID NO: 3857580 - RNA, 18 nt, Human
ugccaggaagccagcagg

SEQ ID NO: 3857581 - RNA, 20 nt, Human
ugccaggaagccagcaggcu

SEQ ID NO: 3857582 - RNA, 20 nt, Human
ugccaggacaugcaauaaaa

SEQ ID NO: 3857583 - RNA, 12 nt, Human
ugccaggacucc

SEQ ID NO: 3857584 - RNA, 17 nt, Human
ugccaggaggacccagg

SEQ ID NO: 3857585 - RNA, 20 nt, Human
ugccaggaggacccagggcu

SEQ ID NO: 3857586 - RNA, 13 nt, Human
ugccaggagggac

SEQ ID NO: 3857587 - RNA, 22 nt, Human
ugccaggagggacaaaggagcc

SEQ ID NO: 3857588 - RNA, 23 nt, Human
ugccaggagggacaaaggagccu

SEQ ID NO: 3857589 - RNA, 20 nt, Human
ugccaggaucaagcaugaaa

SEQ ID NO: 3857590 - RNA, 16 nt, Human
ugccaggcacaggcag

SEQ ID NO: 3857591 - RNA, 20 nt, Human
ugccaggcacaggcagggca

SEQ ID NO: 3857592 - RNA, 10 nt, Human
ugccaggcau

SEQ ID NO: 3857593 - RNA, 14 nt, Human
ugccaggcauggug

SEQ ID NO: 3857594 - RNA, 15 nt, Human
ugccaggccagccuc

SEQ ID NO: 3857595 - RNA, 19 nt, Human
ugccaggcccccaccacac

SEQ ID NO: 3857596 - RNA, 17 nt, Human
ugccaggcuaauuuuuu

SEQ ID NO: 3857597 - RNA, 11 nt, Human
ugccagggagc

SEQ ID NO: 3857598 - RNA, 22 nt, Human
ugccagggcaaugaugaaugag

SEQ ID NO: 3857599 - RNA, 12 nt, Human
ugccagggcagg

SEQ ID NO: 3857600 - RNA, 18 nt, Human
ugccagggccccucuccc

SEQ ID NO: 3857601 - RNA, 16 nt, Human
ugccagguccuugccc

SEQ ID NO: 3857602 - RNA, 14 nt, Human
ugccaggugagaaa

SEQ ID NO: 3857603 - RNA, 17 nt, Human
ugccaggugagaaacug

SEQ ID NO: 3857604 - RNA, 19 nt, Human
ugccagguucuauuuggaa

SEQ ID NO: 3857605 - RNA, 14 nt, Human
ugccagguuuucug

SEQ ID NO: 3857606 - RNA, 18 nt, Human
ugccagguuuucugggug

SEQ ID NO: 3857607 - RNA, 14 nt, Human
ugccaguaaaaaaa

SEQ ID NO: 3857608 - RNA, 24 nt, Human
ugccaguaacacaggccacccugu

SEQ ID NO: 3857609 - RNA, 21 nt, Human
ugccaguaacgcgucuuccug

SEQ ID NO: 3857610 - RNA, 20 nt, Human
ugccaguaccagccccaccc

SEQ ID NO: 3857611 - RNA, 22 nt, Human
ugccaguaggcucaacuaggga

SEQ ID NO: 3857612 - RNA, 19 nt, Human
ugccagucccccugcccca

SEQ ID NO: 3857613 - RNA, 16 nt, Human
ugccaguccuagcugc

SEQ ID NO: 3857614 - RNA, 16 nt, Human
ugccagucgcgcugcc

SEQ ID NO: 3857615 - RNA, 17 nt, Human
ugccagucgcgcugccu

SEQ ID NO: 3857616 - RNA, 18 nt, Human
ugccagucgcgcugccug

SEQ ID NO: 3857617 - RNA, 21 nt, Human
ugccagucgcgcugccugugu

SEQ ID NO: 3857618 - RNA, 22 nt, Human
ugccagucgcgcugccugugug

SEQ ID NO: 3857619 - RNA, 16 nt, Human
ugccagugacacuucc

SEQ ID NO: 3857620 - RNA, 20 nt, Human
ugccagugacagacaggcuc

SEQ ID NO: 3857621 - RNA, 22 nt, Human
ugccagugacagacaggcucuu

SEQ ID NO: 3857622 - RNA, 15 nt, Human
ugccagugccugggu

SEQ ID NO: 3857623 - RNA, 16 nt, Human
ugccagugccugggug

SEQ ID NO: 3857624 - RNA, 13 nt, Human
ugccagugccuua

SEQ ID NO: 3857625 - RNA, 20 nt, Human
ugccagugccuuaccuccug

SEQ ID NO: 3857626 - RNA, 21 nt, Human
ugccagugccuuaccuccugc

SEQ ID NO: 3857627 - RNA, 23 nt, Human
ugccaguguccugagccccaggg

SEQ ID NO: 3857628 - RNA, 13 nt, Human
ugccagugucuuu

SEQ ID NO: 3857629 - RNA, 14 nt, Human
ugccagugucuuuc

SEQ ID NO: 3857630 - RNA, 17 nt, Human
ugccaguuacuugcuuu

SEQ ID NO: 3857631 - RNA, 17 nt, Human
ugccaguuauggcuaua

SEQ ID NO: 3857632 - RNA, 15 nt, Human
ugccaguuguccucc

SEQ ID NO: 3857633 - RNA, 22 nt, Human
ugccauacaucaguuauucauu

SEQ ID NO: 3857634 - RNA, 18 nt, Human
ugccauacuuugucugaa

SEQ ID NO: 3857635 - RNA, 13 nt, Human
ugccauagaguuu

SEQ ID NO: 3857636 - RNA, 20 nt, Human
ugccauagaguuuaacacaa

SEQ ID NO: 3857637 - RNA, 24 nt, Human
ugccauagucaaagagaguuuuua

SEQ ID NO: 3857638 - RNA, 17 nt, Human
ugccauagucuuaacug

SEQ ID NO: 3857639 - RNA, 14 nt, Human
ugccauauuaaauu

SEQ ID NO: 3857640 - RNA, 16 nt, Human
ugccauauuaaauuuu

SEQ ID NO: 3857641 - RNA, 19 nt, Human
ugcccucguggccagcccg

SEQ ID NO: 3857642 - RNA, 21 nt, Human
ugcccucguggccagcccggc

SEQ ID NO: 3857643 - RNA, 14 nt, Human
ugcccucucaggcc

SEQ ID NO: 3857644 - RNA, 14 nt, Human
ugcccucuccuggg

SEQ ID NO: 3857645 - RNA, 17 nt, Human
ugcccucuccugggcag

SEQ ID NO: 3857646 - RNA, 20 nt, Human
ugcccucuccugggcagcug

SEQ ID NO: 3857647 - RNA, 15 nt, Human
ugcccucuccuuccu

SEQ ID NO: 3857648 - RNA, 16 nt, Human
ugcccucuccuuccuu

SEQ ID NO: 3857649 - RNA, 20 nt, Human
ugcccucugcauccucugga

SEQ ID NO: 3857650 - RNA, 16 nt, Human
ugcccucugggcucug

SEQ ID NO: 3857651 - RNA, 18 nt, Human
ugcccucugggcucugag

SEQ ID NO: 3857652 - RNA, 17 nt, Human
ugcccugaccucccagc

SEQ ID NO: 3857653 - RNA, 20 nt, Human
ugcccugagaagcugcucca

SEQ ID NO: 3857654 - RNA, 22 nt, Human
ugcccugagccagggucuccag

SEQ ID NO: 3857655 - RNA, 23 nt, Human
ugcccugaguggaucuccaagga

SEQ ID NO: 3857656 - RNA, 15 nt, Human
ugcccugaucccaga

SEQ ID NO: 3857657 - RNA, 22 nt, Human
ugcccugcacgucaugggaggg

SEQ ID NO: 3857658 - RNA, 14 nt, Human
ugcccugccaccug

SEQ ID NO: 3857659 - RNA, 19 nt, Human
ugcccugccaccugucugu

SEQ ID NO: 3857660 - RNA, 22 nt, Human
ugcccugccaccugucugucug

SEQ ID NO: 3857661 - RNA, 15 nt, Human
ugcccugcccugcca

SEQ ID NO: 3857662 - RNA, 14 nt, Human
ugcccugcugcccu

SEQ ID NO: 3857663 - RNA, 17 nt, Human
ugcccugcugcccuccc

SEQ ID NO: 3857664 - RNA, 13 nt, Human
ugcccugcuguuu

SEQ ID NO: 3857665 - RNA, 19 nt, Human
ugcccuggaggaaccgaaa

SEQ ID NO: 3857666 - RNA, 12 nt, Human
ugcccuggcccu

SEQ ID NO: 3857667 - RNA, 12 nt, Human
ugcccuggcucc

SEQ ID NO: 3857668 - RNA, 14 nt, Human
ugcccuggcuccag

SEQ ID NO: 3857669 - RNA, 21 nt, Human
ugcccuggcuccagugaaacu

SEQ ID NO: 3857670 - RNA, 17 nt, Human
ugcccuggcugcugccc

SEQ ID NO: 3857671 - RNA, 18 nt, Human
ugcccuggcugcugcccc

SEQ ID NO: 3857672 - RNA, 16 nt, Human
ugcccugggaugucca

SEQ ID NO: 3857673 - RNA, 23 nt, Human
ugcccuggggcugaucucaggga

SEQ ID NO: 3857674 - RNA, 12 nt, Human
ugcccuggugcu

SEQ ID NO: 3857675 - RNA, 16 nt, Human
ugcccuggugcugcca

SEQ ID NO: 3857676 - RNA, 13 nt, Human
ugcccugguggag

SEQ ID NO: 3857677 - RNA, 17 nt, Human
ugcccugguuuccugcc

SEQ ID NO: 3857678 - RNA, 18 nt, Human
ugcccugguuuccugccc

SEQ ID NO: 3857679 - RNA, 20 nt, Human
ugcccugguuuccugcccug

SEQ ID NO: 3857680 - RNA, 16 nt, Human
ugcccugucaggaggc

SEQ ID NO: 3857681 - RNA, 19 nt, Human
ugcccugucaggaggcaga

SEQ ID NO: 3857682 - RNA, 23 nt, Human
ugcccugugaguacuacaguccu

SEQ ID NO: 3857683 - RNA, 13 nt, Human
ugcccugugggac

SEQ ID NO: 3857684 - RNA, 22 nt, Human
ugcccugugggaccccaggccc

SEQ ID NO: 3857685 - RNA, 23 nt, Human
ugcccugugggaccccaggccca

SEQ ID NO: 3857686 - RNA, 15 nt, Human
ugcccugugggcccc

SEQ ID NO: 3857687 - RNA, 19 nt, Human
ugcccuguuaaaagaugaa

SEQ ID NO: 3857688 - RNA, 20 nt, Human
ugcccuuacacuuacuguug

SEQ ID NO: 3857689 - RNA, 18 nt, Human
ugcccuuaccugccagga

SEQ ID NO: 3857690 - RNA, 23 nt, Human
ugcccuucagcauccucaguucc

SEQ ID NO: 3857691 - RNA, 13 nt, Human
ugcccuucccugu

SEQ ID NO: 3857692 - RNA, 18 nt, Human
ugcccuucccugucccuc

SEQ ID NO: 3857693 - RNA, 16 nt, Human
ugcccuuccucaguuu

SEQ ID NO: 3857694 - RNA, 13 nt, Human
ugcccuucuuucu

SEQ ID NO: 3857695 - RNA, 21 nt, Human
ugcccuucuuucuacccugcu

SEQ ID NO: 3857696 - RNA, 18 nt, Human
ugcccuugcccugaccuc

SEQ ID NO: 3857697 - RNA, 19 nt, Human
ugcccuugcccugaccucc

SEQ ID NO: 3857698 - RNA, 17 nt, Human
ugcccuuggaggccagc

SEQ ID NO: 3857699 - RNA, 16 nt, Human
ugcccuugucccacuc

SEQ ID NO: 3857700 - RNA, 14 nt, Human
ugcccuugucugag

SEQ ID NO: 3857701 - RNA, 24 nt, Human
ugcccuuguuuggggcaggaguag

SEQ ID NO: 3857702 - RNA, 15 nt, Human
ugccgaaacuggaag

SEQ ID NO: 3857703 - RNA, 15 nt, Human
ugccgaccagagccc

SEQ ID NO: 3857704 - RNA, 22 nt, Human
ugccgaccagagccccacacgg

SEQ ID NO: 3857705 - RNA, 15 nt, Human
ugccgaccgaggcug

SEQ ID NO: 3857706 - RNA, 15 nt, Human
ugccgaccucguccu

SEQ ID NO: 3857707 - RNA, 17 nt, Human
ugccgaccucguccucc

SEQ ID NO: 3857708 - RNA, 14 nt, Human
ugccgacuccuggg

SEQ ID NO: 3857709 - RNA, 15 nt, Human
ugccgacuccugggu

SEQ ID NO: 3857710 - RNA, 20 nt, Human
ugccgagcaaccguggcccu

SEQ ID NO: 3857711 - RNA, 16 nt, Human
ugccgagcccuugccc

SEQ ID NO: 3857712 - RNA, 20 nt, Human
ugccgcaagucugcagcccg

SEQ ID NO: 3857713 - RNA, 17 nt, Human
ugccgcaauacaggaac

SEQ ID NO: 3857714 - RNA, 22 nt, Human
ugccgcaauggccaugugggga

SEQ ID NO: 3857715 - RNA, 13 nt, Human
ugccgcagagcug

SEQ ID NO: 3857716 - RNA, 14 nt, Human
ugccgcagagcugg

SEQ ID NO: 3857717 - RNA, 20 nt, Human
ugccgcagcccugcagaggg

SEQ ID NO: 3857718 - RNA, 16 nt, Human
ugccgcaucucacagc

SEQ ID NO: 3857719 - RNA, 19 nt, Human
ugccgcccccuccugaacc

SEQ ID NO: 3857720 - RNA, 20 nt, Human
ugccgcccgagguggcugcc

SEQ ID NO: 3857721 - RNA, 23 nt, Human
ugccgcccgagguggcugccugg

SEQ ID NO: 3857722 - RNA, 16 nt, Human
ugccgccgccucgccc

SEQ ID NO: 3857723 - RNA, 24 nt, Human
ugccgccuccccacggccgcucca

SEQ ID NO: 3857724 - RNA, 15 nt, Human
ugccgcuaccucccu

SEQ ID NO: 3857725 - RNA, 16 nt, Human
ugccgcuaccucccuc

SEQ ID NO: 3857726 - RNA, 17 nt, Human
ugccgcuaccucccucc

SEQ ID NO: 3857727 - RNA, 14 nt, Human
ugccggagaggaag

SEQ ID NO: 3857728 - RNA, 16 nt, Human
ugccggauacaaacug

SEQ ID NO: 3857729 - RNA, 18 nt, Human
ugccgggugcagcaucug

SEQ ID NO: 3857730 - RNA, 19 nt, Human
ugccggguucuagucuccu

SEQ ID NO: 3857731 - RNA, 18 nt, Human
ugccggguuuuauauuuu

SEQ ID NO: 3857732 - RNA, 21 nt, Human
ugccggucuugacagcucagu

SEQ ID NO: 3857733 - RNA, 13 nt, Human
ugccgucaccacc

SEQ ID NO: 3857734 - RNA, 15 nt, Human
ugccgucaccaccac

SEQ ID NO: 3857735 - RNA, 17 nt, Human
ugccgucuaccugaggg

SEQ ID NO: 3857736 - RNA, 22 nt, Human
ugccguggcaccaggcgcugcc

SEQ ID NO: 3857737 - RNA, 19 nt, Human
ugccgugugagugugacag

SEQ ID NO: 3857738 - RNA, 21 nt, Human
ugccgugugagugugacaggg

SEQ ID NO: 3857739 - RNA, 20 nt, Human
ugccguugccaagaacugaa

SEQ ID NO: 3857740 - RNA, 18 nt, Human
ugccuaaauccacucugc

SEQ ID NO: 3857741 - RNA, 19 nt, Human
ugccuaaauccauuuggaa

SEQ ID NO: 3857742 - RNA, 20 nt, Human
ugccuaaauuuaaugcugcc

SEQ ID NO: 3857743 - RNA, 15 nt, Human
ugccuaacaccagcg

SEQ ID NO: 3857744 - RNA, 19 nt, Human
ugccuaagcauugccuggc

SEQ ID NO: 3857745 - RNA, 22 nt, Human
ugccuaagcauugccuggccuu

SEQ ID NO: 3857746 - RNA, 13 nt, Human
ugccuaagcccuc

SEQ ID NO: 3857747 - RNA, 15 nt, Human
ugccuaaggacuucu

SEQ ID NO: 3857748 - RNA, 20 nt, Human
ugccuaaggacuucuuuaau

SEQ ID NO: 3857749 - RNA, 21 nt, Human
ugccuaaggacuucuuuaauu

SEQ ID NO: 3857750 - RNA, 13 nt, Human
ugccuaaguauua

SEQ ID NO: 3857751 - RNA, 19 nt, Human
ugccuaaguauuaaaacau

SEQ ID NO: 3857752 - RNA, 15 nt, Human
ugccuaaguggcugc

SEQ ID NO: 3857753 - RNA, 21 nt, Human
ugccuaauacauuaaagcagu

SEQ ID NO: 3857754 - RNA, 22 nt, Human
ugccuacagaacuucagaaaga

SEQ ID NO: 3857755 - RNA, 17 nt, Human
ugccuaccaauauuuaa

SEQ ID NO: 3857756 - RNA, 18 nt, Human
ugccuagaaacaacacug

SEQ ID NO: 3857757 - RNA, 18 nt, Human
ugccuagcaagcuggccu

SEQ ID NO: 3857758 - RNA, 22 nt, Human
ugccuaggauucacaccccacc

SEQ ID NO: 3857759 - RNA, 16 nt, Human
ugccuaggccugggca

SEQ ID NO: 3857760 - RNA, 18 nt, Human
ugccuaggcugaccuuga

SEQ ID NO: 3857761 - RNA, 18 nt, Human
ugccuagggccuggucca

SEQ ID NO: 3857762 - RNA, 15 nt, Human
ugccuaguauugaca

SEQ ID NO: 3857763 - RNA, 21 nt, Human
ugccuaguauugacaaaaugu

SEQ ID NO: 3857764 - RNA, 22 nt, Human
ugccuaguauugacaaaauguu

SEQ ID NO: 3857765 - RNA, 16 nt, Human
ugccuauaagccaaaa

SEQ ID NO: 3857766 - RNA, 21 nt, Human
ugccuauaagccaaaauuaag

SEQ ID NO: 3857767 - RNA, 20 nt, Human
ugccuaucaccucuuaugca

SEQ ID NO: 3857768 - RNA, 18 nt, Human
ugccuauugcuagagcuc

SEQ ID NO: 3857769 - RNA, 20 nt, Human
ugccuauugcuagagcuccu

SEQ ID NO: 3857770 - RNA, 21 nt, Human
ugccucaaauaaaaagugcuu

SEQ ID NO: 3857771 - RNA, 17 nt, Human
ugccucaagaggaauga

SEQ ID NO: 3857772 - RNA, 15 nt, Human
ugccucaaugccagu

SEQ ID NO: 3857773 - RNA, 14 nt, Human
ugccucacagcugg

SEQ ID NO: 3857774 - RNA, 14 nt, Human
ugccucacuucagg

SEQ ID NO: 3857775 - RNA, 18 nt, Human
ugccucagaaaacaagga

SEQ ID NO: 3857776 - RNA, 14 nt, Human
ugccucagagacca

SEQ ID NO: 3857777 - RNA, 16 nt, Human
ugccucagagaccagg

SEQ ID NO: 3857778 - RNA, 19 nt, Human
ugccucagagaccagggcu

SEQ ID NO: 3857779 - RNA, 13 nt, Human
ugccucagccucc

SEQ ID NO: 3857780 - RNA, 17 nt, Human
ugccucagccucccgag

SEQ ID NO: 3857781 - RNA, 15 nt, Human
ugccucagcuucccc

SEQ ID NO: 3857782 - RNA, 18 nt, Human
ugccucaggccucugugc

SEQ ID NO: 3857783 - RNA, 18 nt, Human
ugccucaguaaaaugaac

SEQ ID NO: 3857784 - RNA, 22 nt, Human
ugccucauuuagagaggaaaag

SEQ ID NO: 3857785 - RNA, 22 nt, Human
ugccuccaagaggaaccucuga

SEQ ID NO: 3857786 - RNA, 12 nt, Human
ugccuccaccac

SEQ ID NO: 3857787 - RNA, 15 nt, Human
ugccuccaccaccac

SEQ ID NO: 3857788 - RNA, 16 nt, Human
ugccuccaccaccacu

SEQ ID NO: 3857789 - RNA, 20 nt, Human
ugccuccaccaccacuggcc

SEQ ID NO: 3857790 - RNA, 15 nt, Human
ugcuaauuaaaaagu

SEQ ID NO: 3857791 - RNA, 15 nt, Human
ugcuaauucuuugca

SEQ ID NO: 3857792 - RNA, 20 nt, Human
ugcuaauugcuguugaaagc

SEQ ID NO: 3857793 - RNA, 16 nt, Human
ugcuaauuuaaagaga

SEQ ID NO: 3857794 - RNA, 18 nt, Human
ugcuaauuuauccugaaa

SEQ ID NO: 3857795 - RNA, 22 nt, Human
ugcuaauuuucucaaaagcauu

SEQ ID NO: 3857796 - RNA, 16 nt, Human
ugcuaauuuugaaaaa

SEQ ID NO: 3857797 - RNA, 16 nt, Human
ugcuacaaaaacacag

SEQ ID NO: 3857798 - RNA, 12 nt, Human
ugcuacaaagaa

SEQ ID NO: 3857799 - RNA, 17 nt, Human
ugcuacaaagaagacau

SEQ ID NO: 3857800 - RNA, 23 nt, Human
ugcuacaaagaagacauguuuua

SEQ ID NO: 3857801 - RNA, 14 nt, Human
ugcuacaauuuuaa

SEQ ID NO: 3857802 - RNA, 22 nt, Human
ugcuacaccuauuaucccagcu

SEQ ID NO: 3857803 - RNA, 20 nt, Human
ugcuacagaugauagaggau

SEQ ID NO: 3857804 - RNA, 24 nt, Human
ugcuacaugacgacaaagcugcua

SEQ ID NO: 3857805 - RNA, 16 nt, Human
ugcuaccaccagcugu

SEQ ID NO: 3857806 - RNA, 21 nt, Human
ugcuaccaccagcugugucca

SEQ ID NO: 3857807 - RNA, 21 nt, Human
ugcuaccacggccuccuuucc

SEQ ID NO: 3857808 - RNA, 22 nt, Human
ugcuaccaguauuuagaagcca

SEQ ID NO: 3857809 - RNA, 13 nt, Human
ugcuaccucaguc

SEQ ID NO: 3857810 - RNA, 16 nt, Human
ugcuaccucagucagu

SEQ ID NO: 3857811 - RNA, 18 nt, Human
ugcuaccucccuugccuu

SEQ ID NO: 3857812 - RNA, 23 nt, Human
ugcuaccuggguccuuuucagaa

SEQ ID NO: 3857813 - RNA, 17 nt, Human
ugcuaccuuucaaagcu

SEQ ID NO: 3857814 - RNA, 18 nt, Human
ugcuaccuuucaaagcuu

SEQ ID NO: 3857815 - RNA, 20 nt, Human
ugcuacgccugcauguaaac

SEQ ID NO: 3857816 - RNA, 16 nt, Human
ugcuacucuguuccuu

SEQ ID NO: 3857817 - RNA, 15 nt, Human
ugcuacugccaaccu

SEQ ID NO: 3857818 - RNA, 22 nt, Human
ugcuacuguacauaaacaauga

SEQ ID NO: 3857819 - RNA, 13 nt, Human
ugcuacuguugua

SEQ ID NO: 3857820 - RNA, 22 nt, Human
ugcuacuuaauuccuuucucau

SEQ ID NO: 3857821 - RNA, 15 nt, Human
ugcuacuuccugccu

SEQ ID NO: 3857822 - RNA, 13 nt, Human
ugcuagaaaaauu

SEQ ID NO: 3857823 - RNA, 15 nt, Human
ugcuagaacaugguu

SEQ ID NO: 3857824 - RNA, 10 nt, Human
ugcuagaacu

SEQ ID NO: 3857825 - RNA, 13 nt, Human
ugcuagaacuccc

SEQ ID NO: 3857826 - RNA, 20 nt, Human
ugcuagaacucccuuucaac

SEQ ID NO: 3857827 - RNA, 11 nt, Human
ugcuagaacuu

SEQ ID NO: 3857828 - RNA, 16 nt, Human
ugcuagaacuuuuuua

SEQ ID NO: 3857829 - RNA, 17 nt, Human
ugcuagaacuuuuuuaa

SEQ ID NO: 3857830 - RNA, 21 nt, Human
ugcuagaacuuuuuuaaauaa

SEQ ID NO: 3857831 - RNA, 22 nt, Human
ugcuagaacuuuuuuaaauaaa

SEQ ID NO: 3857832 - RNA, 14 nt, Human
ugcuagaagaaaac

SEQ ID NO: 3857833 - RNA, 13 nt, Human
ugcuagagcuccu

SEQ ID NO: 3857834 - RNA, 14 nt, Human
ugcuagauaaaagc

SEQ ID NO: 3857835 - RNA, 23 nt, Human
ugcuagaugagaauucagcugcc

SEQ ID NO: 3857836 - RNA, 19 nt, Human
ugcuagaugugcaaaugca

SEQ ID NO: 3857837 - RNA, 20 nt, Human
ugcuagaugugcaaaugcaa

SEQ ID NO: 3857838 - RNA, 12 nt, Human
ugcuagcacaug

SEQ ID NO: 3857839 - RNA, 18 nt, Human
ugcuagcgcguugccugu

SEQ ID NO: 3857840 - RNA, 19 nt, Human
ugcuagcgcguugccuguc

SEQ ID NO: 3857841 - RNA, 13 nt, Human
ugcuagcuagcuc

SEQ ID NO: 3857842 - RNA, 18 nt, Human
ugcuagcuaugugaccuu

SEQ ID NO: 3857843 - RNA, 16 nt, Human
ugcuagcucugagcca

SEQ ID NO: 3857844 - RNA, 19 nt, Human
ugcuaggaacacuccuuca

SEQ ID NO: 3857845 - RNA, 18 nt, Human
ugcuaggccagagcccac

SEQ ID NO: 3857846 - RNA, 18 nt, Human
ugcuaggcgagugccagg

SEQ ID NO: 3857847 - RNA, 21 nt, Human
ugcuaggcgagugccaggacu

SEQ ID NO: 3857848 - RNA, 22 nt, Human
ugcuaggcgagugccaggacuc

SEQ ID NO: 3857849 - RNA, 21 nt, Human
ugcuaggguuaggagguccuu

SEQ ID NO: 3857850 - RNA, 21 nt, Human
ugcuaggugggccagccccuc

SEQ ID NO: 3857851 - RNA, 23 nt, Human
ugcuaggugggccagccccuccc

SEQ ID NO: 3857852 - RNA, 12 nt, Human
ugcuagguucua

SEQ ID NO: 3857853 - RNA, 14 nt, Human
ugcuaguaauugga

SEQ ID NO: 3857854 - RNA, 15 nt, Human
ugcuaguauuugaau

SEQ ID NO: 3857855 - RNA, 17 nt, Human
ugcuaguauuugaauua

SEQ ID NO: 3857856 - RNA, 22 nt, Human
ugcuaguauuugaauuaaaacu

SEQ ID NO: 3857857 - RNA, 21 nt, Human
ugcuauaacuauguugauaaa

SEQ ID NO: 3857858 - RNA, 18 nt, Human
ugcuauaaucuguuuuua

SEQ ID NO: 3857859 - RNA, 19 nt, Human
ugcuauaggcuggagaagc

SEQ ID NO: 3857860 - RNA, 20 nt, Human
ugcuauaggcuggagaagcu

SEQ ID NO: 3857861 - RNA, 14 nt, Human
ugcuauaguauuug

SEQ ID NO: 3857862 - RNA, 21 nt, Human
ugcuauaguauuugauucaaa

SEQ ID NO: 3857863 - RNA, 15 nt, Human
ugcuauauauauaaa

SEQ ID NO: 3857864 - RNA, 16 nt, Human
ugcuauauugcccagg

SEQ ID NO: 3857865 - RNA, 20 nt, Human
ugcuaucaaaauaaauugaa

SEQ ID NO: 3857866 - RNA, 21 nt, Human
ugcuaucaaaauaaauugaaa

SEQ ID NO: 3857867 - RNA, 15 nt, Human
ugcuaucaguuuuau

SEQ ID NO: 3857868 - RNA, 18 nt, Human
ugcuaucaguuuuauagc

SEQ ID NO: 3857869 - RNA, 20 nt, Human
ugcuauccugccaaaaucau

SEQ ID NO: 3857870 - RNA, 19 nt, Human
ugcuaucucccccagcccc

SEQ ID NO: 3857871 - RNA, 20 nt, Human
ugcuaucucugugugcacaa

SEQ ID NO: 3857872 - RNA, 21 nt, Human
ugcuaucucugugugcacaaa

SEQ ID NO: 3857873 - RNA, 22 nt, Human
ugcuaugauguuaguuuuccuu

SEQ ID NO: 3857874 - RNA, 19 nt, Human
ugcuauggggagaaaagac

SEQ ID NO: 3857875 - RNA, 22 nt, Human
ugcuauggggagaaaagacaug

SEQ ID NO: 3857876 - RNA, 13 nt, Human
ugcuauuaaagug

SEQ ID NO: 3857877 - RNA, 12 nt, Human
ugcuauuaauau

SEQ ID NO: 3857878 - RNA, 16 nt, Human
ugcuauuaauauuugu

SEQ ID NO: 3857879 - RNA, 19 nt, Human
ugcuauuacgaaguucaag

SEQ ID NO: 3857880 - RNA, 11 nt, Human
ugcuauucugu

SEQ ID NO: 3857881 - RNA, 16 nt, Human
ugcuauucugucccua

SEQ ID NO: 3857882 - RNA, 17 nt, Human
ugcuauucugucccuag

SEQ ID NO: 3857883 - RNA, 16 nt, Human
ugcuauugacaaguca

SEQ ID NO: 3857884 - RNA, 15 nt, Human
ugcuauuguaaauau

SEQ ID NO: 3857885 - RNA, 17 nt, Human
ugcuauuguaaauaugu

SEQ ID NO: 3857886 - RNA, 20 nt, Human
ugcuauuuauuuuuacaaga

SEQ ID NO: 3857887 - RNA, 14 nt, Human
ugcuauuucuauau

SEQ ID NO: 3857888 - RNA, 17 nt, Human
ugcuauuuuacugucuu

SEQ ID NO: 3857889 - RNA, 19 nt, Human
ugcuauuuuuguuuuuaga

SEQ ID NO: 3857890 - RNA, 19 nt, Human
ugcucaaaauuugaagaau

SEQ ID NO: 3857891 - RNA, 16 nt, Human
ugcucaacuugcaaaa

SEQ ID NO: 3857892 - RNA, 20 nt, Human
ugcucaacuugcaaaaucag

SEQ ID NO: 3857893 - RNA, 14 nt, Human
ugcucaagaaacaa

SEQ ID NO: 3857894 - RNA, 22 nt, Human
ugcucaagaagacauggagacu

SEQ ID NO: 3857895 - RNA, 21 nt, Human
ugcucaauaaaugauucuuag

SEQ ID NO: 3857896 - RNA, 17 nt, Human
ugcucacaacuuagugu

SEQ ID NO: 3857897 - RNA, 14 nt, Human
ugcucacagcugua

SEQ ID NO: 3857898 - RNA, 14 nt, Human
ugcucacccagugc

SEQ ID NO: 3857899 - RNA, 23 nt, Human
ugcucaccgcccaucaggguucu

SEQ ID NO: 3857900 - RNA, 22 nt, Human
ugcucaccuggggugugggagg

SEQ ID NO: 3857901 - RNA, 17 nt, Human
ugcucacgucaaaugca

SEQ ID NO: 3857902 - RNA, 13 nt, Human
ugcucacuaccuc

SEQ ID NO: 3857903 - RNA, 15 nt, Human
ugcucacuuuaaacc

SEQ ID NO: 3857904 - RNA, 16 nt, Human
ugcucagaacuugcug

SEQ ID NO: 3857905 - RNA, 22 nt, Human
ugcucagaacuugcugcugucu

SEQ ID NO: 3857906 - RNA, 14 nt, Human
ugcucagaccagcu

SEQ ID NO: 3857907 - RNA, 16 nt, Human
ugcucagaccagcucu

SEQ ID NO: 3857908 - RNA, 17 nt, Human
ugcucagaccagcucuu

SEQ ID NO: 3857909 - RNA, 20 nt, Human
ugcucagagaccugaagugu

SEQ ID NO: 3857910 - RNA, 12 nt, Human
ugcucagcagcu

SEQ ID NO: 3857911 - RNA, 15 nt, Human
ugcucagcagugaga

SEQ ID NO: 3857912 - RNA, 13 nt, Human
ugcucagcccuga

SEQ ID NO: 3857913 - RNA, 19 nt, Human
ugcucagcccugaggacag

SEQ ID NO: 3857914 - RNA, 18 nt, Human
ugcucagcucugggccau

SEQ ID NO: 3857915 - RNA, 16 nt, Human
ugcucagcugucaagg

SEQ ID NO: 3857916 - RNA, 20 nt, Human
ugcucagcugucaaggcuca

SEQ ID NO: 3857917 - RNA, 20 nt, Human
ugcucagcuucuccugugug

SEQ ID NO: 3857918 - RNA, 20 nt, Human
ugcucaggagaccuggagga

SEQ ID NO: 3857919 - RNA, 14 nt, Human
ugcucaggagcccu

SEQ ID NO: 3857920 - RNA, 15 nt, Human
ugcucaggagcccug

SEQ ID NO: 3857921 - RNA, 18 nt, Human
ugcucaggcugcagcugg

SEQ ID NO: 3857922 - RNA, 18 nt, Human
ugcucaggggcccuggag

SEQ ID NO: 3857923 - RNA, 19 nt, Human
ugcucaggggcguguggcu

SEQ ID NO: 3857924 - RNA, 18 nt, Human
ugcucagguacagagaag

SEQ ID NO: 3857925 - RNA, 22 nt, Human
ugcucagguacagagaaggaau

SEQ ID NO: 3857926 - RNA, 17 nt, Human
ugcucaggugcuggggc

SEQ ID NO: 3857927 - RNA, 17 nt, Human
ugcucaguaauuugagg

SEQ ID NO: 3857928 - RNA, 19 nt, Human
ugcucagugucuggcugca

SEQ ID NO: 3857929 - RNA, 17 nt, Human
ugcucaguucagaauca

SEQ ID NO: 3857930 - RNA, 13 nt, Human
ugcucaguugcua

SEQ ID NO: 3857931 - RNA, 13 nt, Human
ugcucaguuguag

SEQ ID NO: 3857932 - RNA, 18 nt, Human
ugcucaguuguagaaugu

SEQ ID NO: 3857933 - RNA, 22 nt, Human
ugcucaguuguagaauguauug

SEQ ID NO: 3857934 - RNA, 19 nt, Human
ugcucauacuacauugagu

SEQ ID NO: 3857935 - RNA, 22 nt, Human
ugcucaucauuccuugagaaaa

SEQ ID NO: 3857936 - RNA, 19 nt, Human
ugcucaucauucucugucu

SEQ ID NO: 3857937 - RNA, 21 nt, Human
ugcucaucauucucugucuca

SEQ ID NO: 3857938 - RNA, 17 nt, Human
ugcucauccacucuacu

SEQ ID NO: 3857939 - RNA, 12 nt, Human
ugccuuuguaac

SEQ ID NO: 3857940 - RNA, 13 nt, Human
ugccuuuuauagc

SEQ ID NO: 3857941 - RNA, 19 nt, Human
ugccuuuugcaaccaggaa

SEQ ID NO: 3857942 - RNA, 21 nt, Human
ugccuuuugcaccccucccau

SEQ ID NO: 3857943 - RNA, 15 nt, Human
ugccuuuugcagaag

SEQ ID NO: 3857944 - RNA, 17 nt, Human
ugccuuuugcagaagag

SEQ ID NO: 3857945 - RNA, 22 nt, Human
ugccuuuugcagaagagggugu

SEQ ID NO: 3857946 - RNA, 21 nt, Human
ugccuuuuuauuuauauguac

SEQ ID NO: 3857947 - RNA, 13 nt, Human
ugccuuuuucauu

SEQ ID NO: 3857948 - RNA, 15 nt, Human
ugccuuuuucauuau

SEQ ID NO: 3857949 - RNA, 21 nt, Human
ugccuuuuucauuauuuuauu

SEQ ID NO: 3857950 - RNA, 20 nt, Human
ugccuuuuucauuuuccaau

SEQ ID NO: 3857951 - RNA, 19 nt, Human
ugcgaaaggaugaaaguga

SEQ ID NO: 3857952 - RNA, 18 nt, Human
ugcgaaggggcccugguc

SEQ ID NO: 3857953 - RNA, 21 nt, Human
ugcgaauggacuuuggaagca

SEQ ID NO: 3857954 - RNA, 22 nt, Human
ugcgaauggacuuuggaagcag

SEQ ID NO: 3857955 - RNA, 14 nt, Human
ugcgaccccaucug

SEQ ID NO: 3857956 - RNA, 15 nt, Human
ugcgacccugggggc

SEQ ID NO: 3857957 - RNA, 19 nt, Human
ugcgacccugggggcacag

SEQ ID NO: 3857958 - RNA, 15 nt, Human
ugcgacggagagaaa

SEQ ID NO: 3857959 - RNA, 12 nt, Human
ugcgagagaugu

SEQ ID NO: 3857960 - RNA, 17 nt, Human
ugcgagagauguguguu

SEQ ID NO: 3857961 - RNA, 21 nt, Human
ugcgagcgcuaucuucacaua

SEQ ID NO: 3857962 - RNA, 14 nt, Human
ugcgaguauguguu

SEQ ID NO: 3857963 - RNA, 22 nt, Human
ugcgaguauguguuugugugug

SEQ ID NO: 3857964 - RNA, 19 nt, Human
ugcgagugugugcaugugu

SEQ ID NO: 3857965 - RNA, 13 nt, Human
ugcgauagagucu

SEQ ID NO: 3857966 - RNA, 21 nt, Human
ugcgaucauggcucacugcag

SEQ ID NO: 3857967 - RNA, 23 nt, Human
ugcgaucauggcucacugcagcc

SEQ ID NO: 3857968 - RNA, 20 nt, Human
ugcgaucuggguucacugca

SEQ ID NO: 3857969 - RNA, 16 nt, Human
ugcgcaaaaugcagcu

SEQ ID NO: 3857970 - RNA, 16 nt, Human
ugcgcagccccaucug

SEQ ID NO: 3857971 - RNA, 23 nt, Human
ugcgcaggcuggcccugcccugg

SEQ ID NO: 3857972 - RNA, 14 nt, Human
ugcgcagugccuug

SEQ ID NO: 3857973 - RNA, 15 nt, Human
ugcgcaucuugccuc

SEQ ID NO: 3857974 - RNA, 20 nt, Human
ugcgcaucuugccuccaggu

SEQ ID NO: 3857975 - RNA, 23 nt, Human
ugcgcauucucauggagaaguua

SEQ ID NO: 3857976 - RNA, 17 nt, Human
ugcgccauugcacucca

SEQ ID NO: 3857977 - RNA, 18 nt, Human
ugcgccauugcacuccag

SEQ ID NO: 3857978 - RNA, 21 nt, Human
ugcgccauugcacuccagccu

SEQ ID NO: 3857979 - RNA, 23 nt, Human
ugcgcccagggcugggaggaagg

SEQ ID NO: 3857980 - RNA, 17 nt, Human
ugcgcccaguccuucca

SEQ ID NO: 3857981 - RNA, 14 nt, Human
ugcgcccugggcuc

SEQ ID NO: 3857982 - RNA, 22 nt, Human
ugcgccuacaggagugagcacu

SEQ ID NO: 3857983 - RNA, 23 nt, Human
ugcgcgugcacguggagagcugg

SEQ ID NO: 3857984 - RNA, 13 nt, Human
ugcgcucagggcc

SEQ ID NO: 3857985 - RNA, 21 nt, Human
ugcgcucagggccaugcugag

SEQ ID NO: 3857986 - RNA, 22 nt, Human
ugcgcucagggccaugcugagg

SEQ ID NO: 3857987 - RNA, 13 nt, Human
ugcgcuccuggcc

SEQ ID NO: 3857988 - RNA, 18 nt, Human
ugcgcuccuggcccagcc

SEQ ID NO: 3857989 - RNA, 23 nt, Human
ugcgcugacaaccaccgcucccc

SEQ ID NO: 3857990 - RNA, 17 nt, Human
ugcgcugggcacuuccc

SEQ ID NO: 3857991 - RNA, 18 nt, Human
ugcgcugggcacuucccu

SEQ ID NO: 3857992 - RNA, 17 nt, Human
ugcgcuuuugcugguca

SEQ ID NO: 3857993 - RNA, 23 nt, Human
ugcggaaagguauuugggaaacu

SEQ ID NO: 3857994 - RNA, 17 nt, Human
ugcggacagccacggcc

SEQ ID NO: 3857995 - RNA, 23 nt, Human
ugcggacagccacggccaggcca

SEQ ID NO: 3857996 - RNA, 22 nt, Human
ugcggaccacccucacuggcuc

SEQ ID NO: 3857997 - RNA, 14 nt, Human
ugcggaccccagcu

SEQ ID NO: 3857998 - RNA, 15 nt, Human
ugcggagaacaaaug

SEQ ID NO: 3857999 - RNA, 21 nt, Human
ugcggaggaaggaggacccag

SEQ ID NO: 3858000 - RNA, 22 nt, Human
ugcggaggaaggaggacccagg

SEQ ID NO: 3858001 - RNA, 23 nt, Human
ugcggagucauuuuguguugaag

SEQ ID NO: 3858002 - RNA, 20 nt, Human
ugcggagugaagaggggcag

SEQ ID NO: 3858003 - RNA, 21 nt, Human
ugcggagugaagaggggcagc

SEQ ID NO: 3858004 - RNA, 17 nt, Human
ugcggaucucagcuuug

SEQ ID NO: 3858005 - RNA, 15 nt, Human
ugcggcaaaaggaaa

SEQ ID NO: 3858006 - RNA, 21 nt, Human
ugcggcccagcccggcuccca

SEQ ID NO: 3858007 - RNA, 16 nt, Human
ugcggccccucccccg

SEQ ID NO: 3858008 - RNA, 18 nt, Human
ugcggccccucccccguc

SEQ ID NO: 3858009 - RNA, 18 nt, Human
ugcggccgcauucccuga

SEQ ID NO: 3858010 - RNA, 19 nt, Human
ugcggccuuuggcuucacg

SEQ ID NO: 3858011 - RNA, 15 nt, Human
ugcggccuuuucaug

SEQ ID NO: 3858012 - RNA, 17 nt, Human
ugcggcggucccagcuc

SEQ ID NO: 3858013 - RNA, 18 nt, Human
ugcggcggucccagcucc

SEQ ID NO: 3858014 - RNA, 14 nt, Human
ugcggcuggccaug

SEQ ID NO: 3858015 - RNA, 21 nt, Human
ugcggcugugcagccuguccu

SEQ ID NO: 3858016 - RNA, 12 nt, Human
ugcggcugugug

SEQ ID NO: 3858017 - RNA, 13 nt, Human
ugcggcugugugu

SEQ ID NO: 3858018 - RNA, 14 nt, Human
ugcggcugugugug

SEQ ID NO: 3858019 - RNA, 16 nt, Human
ugcgggcacaauaaau

SEQ ID NO: 3858020 - RNA, 18 nt, Human
ugcggggcgggcacaccu

SEQ ID NO: 3858021 - RNA, 15 nt, Human
ugcggggugggggca

SEQ ID NO: 3858022 - RNA, 17 nt, Human
ugcgggucacaggaggg

SEQ ID NO: 3858023 - RNA, 21 nt, Human
ugcgggugaacaaagcagcca

SEQ ID NO: 3858024 - RNA, 23 nt, Human
ugcgggugaacaaagcagccacg

SEQ ID NO: 3858025 - RNA, 16 nt, Human
ugcgguagccagcaca

SEQ ID NO: 3858026 - RNA, 17 nt, Human
ugcgguagccagcacac

SEQ ID NO: 3858027 - RNA, 14 nt, Human
ugcgguccacccag

SEQ ID NO: 3858028 - RNA, 14 nt, Human
ugcggucuagggaa

SEQ ID NO: 3858029 - RNA, 15 nt, Human
ugcguacguuuccug

SEQ ID NO: 3858030 - RNA, 23 nt, Human
ugcguccccccccaaccuuuccc

SEQ ID NO: 3858031 - RNA, 14 nt, Human
ugcgugaaacacac

SEQ ID NO: 3858032 - RNA, 20 nt, Human
ugcgugaauguauguaaugu

SEQ ID NO: 3858033 - RNA, 14 nt, Human
ugcgugacaauaaa

SEQ ID NO: 3858034 - RNA, 22 nt, Human
ugcgugacaauaaaacauuaau

SEQ ID NO: 3858035 - RNA, 22 nt, Human
ugcgugacacucuccuugcagu

SEQ ID NO: 3858036 - RNA, 15 nt, Human
ugcgugccgugugag

SEQ ID NO: 3858037 - RNA, 20 nt, Human
ugcguggaaugcccuucacu

SEQ ID NO: 3858038 - RNA, 18 nt, Human
ugcguggacucugcacau

SEQ ID NO: 3858039 - RNA, 14 nt, Human
ugcgugggugugug

SEQ ID NO: 3858040 - RNA, 13 nt, Human
ugcgugucguggg

SEQ ID NO: 3858041 - RNA, 12 nt, Human
ugcguguguaga

SEQ ID NO: 3858042 - RNA, 21 nt, Human
ugcguguguagaguuaagaag

SEQ ID NO: 3858043 - RNA, 19 nt, Human
ugcguuagaaugaggagga

SEQ ID NO: 3858044 - RNA, 13 nt, Human
ugcguuggucucu

SEQ ID NO: 3858045 - RNA, 23 nt, Human
ugcuaaaaaugagcuugauuaaa

SEQ ID NO: 3858046 - RNA, 12 nt, Human
ugcuaaaaaugu

SEQ ID NO: 3858047 - RNA, 13 nt, Human
ugcuaaaccuuag

SEQ ID NO: 3858048 - RNA, 18 nt, Human
ugcuaaacguguauguuu

SEQ ID NO: 3858049 - RNA, 23 nt, Human
ugcuaaacguguauguuuuucag

SEQ ID NO: 3858050 - RNA, 21 nt, Human
ugcuaaagaaaaagucaucca

SEQ ID NO: 3858051 - RNA, 22 nt, Human
ugcuaaagaaaaagucauccaa

SEQ ID NO: 3858052 - RNA, 14 nt, Human
uggaaggcagacag

SEQ ID NO: 3858053 - RNA, 23 nt, Human
uggaaggcagacagcaggcagcg

SEQ ID NO: 3858054 - RNA, 14 nt, Human
uggaaggcagagaa

SEQ ID NO: 3858055 - RNA, 15 nt, Human
uggaaggcagagaaa

SEQ ID NO: 3858056 - RNA, 20 nt, Human
uggaaggcagagaaaucuaa

SEQ ID NO: 3858057 - RNA, 14 nt, Human
uggaaggcauggcg

SEQ ID NO: 3858058 - RNA, 15 nt, Human
uggaaggcccagcac

SEQ ID NO: 3858059 - RNA, 15 nt, Human
uggaagggacuagga

SEQ ID NO: 3858060 - RNA, 17 nt, Human
uggaaggguuuguggcu

SEQ ID NO: 3858061 - RNA, 17 nt, Human
uggaagguauuuaauag

SEQ ID NO: 3858062 - RNA, 18 nt, Human
uggaagugaaaacuuugu

SEQ ID NO: 3858063 - RNA, 19 nt, Human
uggaagugaaaacuuugua

SEQ ID NO: 3858064 - RNA, 17 nt, Human
uggaagugacuuuggcu

SEQ ID NO: 3858065 - RNA, 17 nt, Human
uggaagugcaucuacuu

SEQ ID NO: 3858066 - RNA, 16 nt, Human
uggaaguguauuuauu

SEQ ID NO: 3858067 - RNA, 22 nt, Human
uggaaguguauuuauuuuacag

SEQ ID NO: 3858068 - RNA, 20 nt, Human
uggaaguguguguggcagca

SEQ ID NO: 3858069 - RNA, 23 nt, Human
uggaaguucauaccuaaguacug

SEQ ID NO: 3858070 - RNA, 11 nt, Human
uggaaguugca

SEQ ID NO: 3858071 - RNA, 18 nt, Human
uggaaguugcauggcauc

SEQ ID NO: 3858072 - RNA, 15 nt, Human
uggaauaaaaggcuu

SEQ ID NO: 3858073 - RNA, 21 nt, Human
uggaauaaaauauuuuuuuca

SEQ ID NO: 3858074 - RNA, 14 nt, Human
uggaauaagacaga

SEQ ID NO: 3858075 - RNA, 15 nt, Human
uggaauaaguucaaa

SEQ ID NO: 3858076 - RNA, 22 nt, Human
uggaauaauccuaaacauauga

SEQ ID NO: 3858077 - RNA, 14 nt, Human
uggaauacaguguu

SEQ ID NO: 3858078 - RNA, 15 nt, Human
uggaauacaguguua

SEQ ID NO: 3858079 - RNA, 14 nt, Human
uggaauacaugaaa

SEQ ID NO: 3858080 - RNA, 15 nt, Human
uggaauacaugaaau

SEQ ID NO: 3858081 - RNA, 20 nt, Human
uggaauacuaaaaaucauga

SEQ ID NO: 3858082 - RNA, 14 nt, Human
uggaauaggaauaa

SEQ ID NO: 3858083 - RNA, 13 nt, Human
uggaauaguuuuu

SEQ ID NO: 3858084 - RNA, 14 nt, Human
uggaauauaaggaa

SEQ ID NO: 3858085 - RNA, 14 nt, Human
uggaauauaauugu

SEQ ID NO: 3858086 - RNA, 22 nt, Human
uggaauauaauuguuuuaucug

SEQ ID NO: 3858087 - RNA, 14 nt, Human
uggaauaucuacuu

SEQ ID NO: 3858088 - RNA, 16 nt, Human
uggaauaucuccguca

SEQ ID NO: 3858089 - RNA, 22 nt, Human
uggaauaucugcuguaugucaa

SEQ ID NO: 3858090 - RNA, 22 nt, Human
uggaaucacuguuuagaacaca

SEQ ID NO: 3858091 - RNA, 21 nt, Human
uggaaucagauuuuaacagcu

SEQ ID NO: 3858092 - RNA, 22 nt, Human
uggaaucaggaauauuuuccaa

SEQ ID NO: 3858093 - RNA, 18 nt, Human
uggaaucauuguccagag

SEQ ID NO: 3858094 - RNA, 17 nt, Human
uggaaucuagaagaaau

SEQ ID NO: 3858095 - RNA, 18 nt, Human
uggaaucuagaagaaaug

SEQ ID NO: 3858096 - RNA, 18 nt, Human
uggaaucuggagaccagg

SEQ ID NO: 3858097 - RNA, 22 nt, Human
uggaaucuucucuuugacaauu

SEQ ID NO: 3858098 - RNA, 18 nt, Human
uggaaugacaugugucaa

SEQ ID NO: 3858099 - RNA, 13 nt, Human
uggaaugaggguu

SEQ ID NO: 3858100 - RNA, 20 nt, Human
uggaaugcuucuucucaggc

SEQ ID NO: 3858101 - RNA, 13 nt, Human
uggaaugcuugaa

SEQ ID NO: 3858102 - RNA, 22 nt, Human
uggaaugcuugaaaaaugugca

SEQ ID NO: 3858103 - RNA, 17 nt, Human
uggaaugggcagcucau

SEQ ID NO: 3858104 - RNA, 16 nt, Human
uggaauguuggauaag

SEQ ID NO: 3858105 - RNA, 14 nt, Human
uggaauuaaaacaa

SEQ ID NO: 3858106 - RNA, 15 nt, Human
uggaauuaaaacaau

SEQ ID NO: 3858107 - RNA, 16 nt, Human
uggaauuaaaacaaug

SEQ ID NO: 3858108 - RNA, 23 nt, Human
uggaauuagaacccuugcacagc

SEQ ID NO: 3858109 - RNA, 15 nt, Human
uggaauuauuuuaaa

SEQ ID NO: 3858110 - RNA, 19 nt, Human
uggaauuauuuuaaaagau

SEQ ID NO: 3858111 - RNA, 13 nt, Human
uggaauucuuccu

SEQ ID NO: 3858112 - RNA, 20 nt, Human
uggaauugauuugcauugaa

SEQ ID NO: 3858113 - RNA, 23 nt, Human
uggaauugauuugcauugaacac

SEQ ID NO: 3858114 - RNA, 23 nt, Human
uggaauugcuuaccaaaggauag

SEQ ID NO: 3858115 - RNA, 22 nt, Human
uggaauuguggcuauccugauu

SEQ ID NO: 3858116 - RNA, 17 nt, Human
uggaauuuauauacaac

SEQ ID NO: 3858117 - RNA, 13 nt, Human
uggaauuucuugu

SEQ ID NO: 3858118 - RNA, 22 nt, Human
uggaauuugcaagucauggcug

SEQ ID NO: 3858119 - RNA, 17 nt, Human
uggaauuuguaaccuca

SEQ ID NO: 3858120 - RNA, 18 nt, Human
uggaauuuguaaccucag

SEQ ID NO: 3858121 - RNA, 19 nt, Human
uggaauuuguaaccucagc

SEQ ID NO: 3858122 - RNA, 13 nt, Human
uggaauuuguuca

SEQ ID NO: 3858123 - RNA, 15 nt, Human
uggaauuuguucaag

SEQ ID NO: 3858124 - RNA, 14 nt, Human
uggaauuuuuuauu

SEQ ID NO: 3858125 - RNA, 16 nt, Human
uggaauuuuuuauucu

SEQ ID NO: 3858126 - RNA, 21 nt, Human
uggaauuuuuuauucuuguga

SEQ ID NO: 3858127 - RNA, 18 nt, Human
uggaauuuuuuuguacga

SEQ ID NO: 3858128 - RNA, 17 nt, Human
uggacaaaauggaauac

SEQ ID NO: 3858129 - RNA, 13 nt, Human
uggacaaagcguu

SEQ ID NO: 3858130 - RNA, 23 nt, Human
uggacaaaucacauauuuuaaaa

SEQ ID NO: 3858131 - RNA, 15 nt, Human
uggacaaaugugaag

SEQ ID NO: 3858132 - RNA, 19 nt, Human
uggacaaaugugaagaugc

SEQ ID NO: 3858133 - RNA, 13 nt, Human
uggacaagaaagu

SEQ ID NO: 3858134 - RNA, 17 nt, Human
uggacaagccaacuugu

SEQ ID NO: 3858135 - RNA, 17 nt, Human
uggacaagcuucugaga

SEQ ID NO: 3858136 - RNA, 18 nt, Human
uggacaauacccccaggc

SEQ ID NO: 3858137 - RNA, 16 nt, Human
uggacacacacagacu

SEQ ID NO: 3858138 - RNA, 15 nt, Human
uggacacacacagcu

SEQ ID NO: 3858139 - RNA, 15 nt, Human
uggacacagcucuuc

SEQ ID NO: 3858140 - RNA, 16 nt, Human
uggacacagcucuucu

SEQ ID NO: 3858141 - RNA, 18 nt, Human
uggacacagcucuucucc

SEQ ID NO: 3858142 - RNA, 22 nt, Human
uggacacagcucuucuccaggc

SEQ ID NO: 3858143 - RNA, 15 nt, Human
uggacacaggccugc

SEQ ID NO: 3858144 - RNA, 20 nt, Human
uggacaccaggagucccugg

SEQ ID NO: 3858145 - RNA, 14 nt, Human
uggacaccugcccu

SEQ ID NO: 3858146 - RNA, 17 nt, Human
uggacaccugcccugcc

SEQ ID NO: 3858147 - RNA, 22 nt, Human
uggacacgcucaguggggcaga

SEQ ID NO: 3858148 - RNA, 19 nt, Human
uggacacuacacccagcaa

SEQ ID NO: 3858149 - RNA, 18 nt, Human
uggacacuccagggacac

SEQ ID NO: 3858150 - RNA, 22 nt, Human
uggacacuccagggacacacag

SEQ ID NO: 3858151 - RNA, 19 nt, Human
uggacacuccagugccagc

SEQ ID NO: 3858152 - RNA, 14 nt, Human
uggacacuguacaa

SEQ ID NO: 3858153 - RNA, 13 nt, Human
uggacacuuaauu

SEQ ID NO: 3858154 - RNA, 21 nt, Human
uggacacuuugaaauguguuu

SEQ ID NO: 3858155 - RNA, 22 nt, Human
uggacacuuugaaauguguuuc

SEQ ID NO: 3858156 - RNA, 14 nt, Human
uggacacuuuucac

SEQ ID NO: 3858157 - RNA, 16 nt, Human
uggacagaagcagcuc

SEQ ID NO: 3858158 - RNA, 16 nt, Human
uggacagacagaggau

SEQ ID NO: 3858159 - RNA, 22 nt, Human
uggacagacagaggaugagcuc

SEQ ID NO: 3858160 - RNA, 13 nt, Human
uggacagagggga

SEQ ID NO: 3858161 - RNA, 20 nt, Human
uggacagaggggacucuggg

SEQ ID NO: 3858162 - RNA, 17 nt, Human
uggacagcaaaaccauu

SEQ ID NO: 3858163 - RNA, 18 nt, Human
uggacagcaaaaccauug

SEQ ID NO: 3858164 - RNA, 22 nt, Human
uggacagcaaaaccauugcuuc

SEQ ID NO: 3858165 - RNA, 13 nt, Human
uggacagcugugc

SEQ ID NO: 3858166 - RNA, 16 nt, Human
uggacagcugugccuc

SEQ ID NO: 3858167 - RNA, 18 nt, Human
uggacagcugugccucgc

SEQ ID NO: 3858168 - RNA, 19 nt, Human
uggacagcugugccucgcu

SEQ ID NO: 3858169 - RNA, 18 nt, Human
uggacaggauguguuugc

SEQ ID NO: 3858170 - RNA, 12 nt, Human
uggacaggcaug

SEQ ID NO: 3858171 - RNA, 23 nt, Human
uggacaggcauguucucugagga

SEQ ID NO: 3858172 - RNA, 14 nt, Human
uggacaggcucugc

SEQ ID NO: 3858173 - RNA, 14 nt, Human
uggacaggcuggcu

SEQ ID NO: 3858174 - RNA, 13 nt, Human
uggacaggucugg

SEQ ID NO: 3858175 - RNA, 16 nt, Human
uggacaguccugggag

SEQ ID NO: 3858176 - RNA, 21 nt, Human
uggacaguucacacccugcaa

SEQ ID NO: 3858177 - RNA, 18 nt, Human
uggacaugaagauucuuu

SEQ ID NO: 3858178 - RNA, 21 nt, Human
uggacaugaagauucuuuccc

SEQ ID NO: 3858179 - RNA, 22 nt, Human
uggacaugaagauucuuuccca

SEQ ID NO: 3858180 - RNA, 17 nt, Human
uggacauggccccugug

SEQ ID NO: 3858181 - RNA, 20 nt, Human
uggacauuaagcaucacaaa

SEQ ID NO: 3858182 - RNA, 15 nt, Human
uggacauugucugcg

SEQ ID NO: 3858183 - RNA, 14 nt, Human
uggacauuuaccuu

SEQ ID NO: 3858184 - RNA, 19 nt, Human
uggacauuuagaagaaaga

SEQ ID NO: 3858185 - RNA, 19 nt, Human
uggacauuugccuugcugg

SEQ ID NO: 3858186 - RNA, 11 nt, Human
uggacauuuua

SEQ ID NO: 3858187 - RNA, 13 nt, Human
uggacauuuuaug

SEQ ID NO: 3858188 - RNA, 14 nt, Human
uggaccaaagcuga

SEQ ID NO: 3858189 - RNA, 21 nt, Human
uggaccaacccuguuuccuga

SEQ ID NO: 3858190 - RNA, 20 nt, Human
uggaccaauagggcugagcu

SEQ ID NO: 3858191 - RNA, 21 nt, Human
uggaccaauuauugauauaua

SEQ ID NO: 3858192 - RNA, 12 nt, Human
uggaccacugca

SEQ ID NO: 3858193 - RNA, 14 nt, Human
uggaccacuguuuc

SEQ ID NO: 3858194 - RNA, 19 nt, Human
uggaccacuguuucuugcu

SEQ ID NO: 3858195 - RNA, 23 nt, Human
uggaccacuguuucuugcuugua

SEQ ID NO: 3858196 - RNA, 13 nt, Human
uggaccaggacag

SEQ ID NO: 3858197 - RNA, 19 nt, Human
uggaccaggacaggaccag

SEQ ID NO: 3858198 - RNA, 13 nt, Human
uggaccagugguc

SEQ ID NO: 3858199 - RNA, 14 nt, Human
uggacccaaggaaa

SEQ ID NO: 3858200 - RNA, 17 nt, Human
uggacccagccaggccc

SEQ ID NO: 3858201 - RNA, 16 nt, Human
uggacccagggaacag

SEQ ID NO: 3858202 - RNA, 14 nt, Human
uggaccccagcugg

SEQ ID NO: 3858203 - RNA, 20 nt, Human
uggaccccaucugugaauaa

SEQ ID NO: 3858204 - RNA, 21 nt, Human
uggaccccaucugugaauaag

SEQ ID NO: 3858205 - RNA, 13 nt, Human
uggacccccagcu

SEQ ID NO: 3858206 - RNA, 14 nt, Human
uggacccccagcuu

SEQ ID NO: 3858207 - RNA, 15 nt, Human
uggaccccccuuuca

SEQ ID NO: 3858208 - RNA, 13 nt, Human
uggaccccugcau

SEQ ID NO: 3858209 - RNA, 16 nt, Human
uggaccccugcauugg

SEQ ID NO: 3858210 - RNA, 22 nt, Human
uggacccguucaugggggaggg

SEQ ID NO: 3858211 - RNA, 17 nt, Human
uggacccugaaaugugu

SEQ ID NO: 3858212 - RNA, 18 nt, Human
uggacccugaccagcucc

SEQ ID NO: 3858213 - RNA, 21 nt, Human
uggacccugaggcccagaggg

SEQ ID NO: 3858214 - RNA, 13 nt, Human
uggacccuguugc

SEQ ID NO: 3858215 - RNA, 15 nt, Human
uggacccuguugcua

SEQ ID NO: 3858216 - RNA, 18 nt, Human
uggaccuaaauggccuca

SEQ ID NO: 3858217 - RNA, 17 nt, Human
uggaccucgugcuuuaa

SEQ ID NO: 3858218 - RNA, 17 nt, Human
uggaccucugacagcag

SEQ ID NO: 3858219 - RNA, 19 nt, Human
uggaccucugacagcagca

SEQ ID NO: 3858220 - RNA, 17 nt, Human
uggaccucugcucugag

SEQ ID NO: 3858221 - RNA, 20 nt, Human
uggaccugccuccugccugc

SEQ ID NO: 3858222 - RNA, 15 nt, Human
uggaccugccugcau

SEQ ID NO: 3858223 - RNA, 17 nt, Human
uggaccuuaggccuucc

SEQ ID NO: 3858224 - RNA, 15 nt, Human
uggacgcacacagcu

SEQ ID NO: 3858225 - RNA, 18 nt, Human
uggacggcaggcucacug

SEQ ID NO: 3858226 - RNA, 20 nt, Human
uggacggcaggcucacugcc

SEQ ID NO: 3858227 - RNA, 23 nt, Human
uggacggcaggcucacugccagg

SEQ ID NO: 3858228 - RNA, 14 nt, Human
uggacggugcucca

SEQ ID NO: 3858229 - RNA, 18 nt, Human
uggacggugcuccaggca

SEQ ID NO: 3858230 - RNA, 19 nt, Human
uggacggugcuccaggcag

SEQ ID NO: 3858231 - RNA, 20 nt, Human
uggacggugcuccaggcagg

SEQ ID NO: 3858232 - RNA, 19 nt, Human
uggacguguuaugacucca

SEQ ID NO: 3858233 - RNA, 22 nt, Human
uggacuaaaugccuaguuuuua

SEQ ID NO: 3858234 - RNA, 19 nt, Human
uggacuaacuugucuuugg

SEQ ID NO: 3858235 - RNA, 24 nt, Human
uggacuacccacguucucacaccc

SEQ ID NO: 3858236 - RNA, 23 nt, Human
uggacuaucugucugguggcccc

SEQ ID NO: 3858237 - RNA, 18 nt, Human
uggacucaccucccccau

SEQ ID NO: 3858238 - RNA, 20 nt, Human
uggacucaccucccccaucu

SEQ ID NO: 3858239 - RNA, 18 nt, Human
uggacucagaaacuccau

SEQ ID NO: 3858240 - RNA, 12 nt, Human
uggacucagaga

SEQ ID NO: 3858241 - RNA, 18 nt, Human
uggacucaggaugcccag

SEQ ID NO: 3858242 - RNA, 21 nt, Human
uggacuccagacucucuguga

SEQ ID NO: 3858243 - RNA, 15 nt, Human
uggacuccagaucug

SEQ ID NO: 3858244 - RNA, 16 nt, Human
uggacucgccuguaau

SEQ ID NO: 3858245 - RNA, 16 nt, Human
uggacucuaaagacca

SEQ ID NO: 3858246 - RNA, 14 nt, Human
uggacucuaaaguc

SEQ ID NO: 3858247 - RNA, 15 nt, Human
uggacucucagucuc

SEQ ID NO: 3858248 - RNA, 15 nt, Human
uggacucuccccucu

SEQ ID NO: 3858249 - RNA, 21 nt, Human
uggacucuccccucuuaugua

SEQ ID NO: 3858250 - RNA, 21 nt, Human
uggacucugaaauaucccggg

SEQ ID NO: 3858251 - RNA, 13 nt, Human
uggacucugcauc

SEQ ID NO: 3858252 - RNA, 18 nt, Human
uggacucugcaucccagc

SEQ ID NO: 3858253 - RNA, 15 nt, Human
uggacucugcccuca

SEQ ID NO: 3858254 - RNA, 21 nt, Human
uggacucuucaaaaacuguuu

SEQ ID NO: 3858255 - RNA, 17 nt, Human
uggacugaccuggucca

SEQ ID NO: 3858256 - RNA, 15 nt, Human
uggacugaggccuga

SEQ ID NO: 3858257 - RNA, 16 nt, Human
uggacugaggccugag

SEQ ID NO: 3858258 - RNA, 19 nt, Human
uggacugagggggccugga

SEQ ID NO: 3858259 - RNA, 22 nt, Human
uggacugagggggccuggaugc

SEQ ID NO: 3858260 - RNA, 17 nt, Human
uggacugagugggaagc

SEQ ID NO: 3858261 - RNA, 19 nt, Human
uggacugcagaagcaaggg

SEQ ID NO: 3858262 - RNA, 22 nt, Human
uggacugcuaccuuucaaagcu

SEQ ID NO: 3858263 - RNA, 14 nt, Human
uggacuggaagggg

SEQ ID NO: 3858264 - RNA, 17 nt, Human
uggacuggaggccccug

SEQ ID NO: 3858265 - RNA, 13 nt, Human
uggacuggcuaga

SEQ ID NO: 3858266 - RNA, 19 nt, Human
uggacuggcuagaguccuc

SEQ ID NO: 3858267 - RNA, 13 nt, Human
uggacugggaggu

SEQ ID NO: 3858268 - RNA, 17 nt, Human
uggacugguggccccug

SEQ ID NO: 3858269 - RNA, 17 nt, Human
uggacugguugguuuug

SEQ ID NO: 3858270 - RNA, 15 nt, Human
uggacugucauagaa

SEQ ID NO: 3858271 - RNA, 15 nt, Human
uggacugugaugcca

SEQ ID NO: 3858272 - RNA, 17 nt, Human
uggacuguggugacuuu

SEQ ID NO: 3858273 - RNA, 15 nt, Human
uggacuuagaaagca

SEQ ID NO: 3858274 - RNA, 16 nt, Human
uggacuuagaaagcag

SEQ ID NO: 3858275 - RNA, 18 nt, Human
uggacuuauuucuucaaa

SEQ ID NO: 3858276 - RNA, 18 nt, Human
uggacuucuaccugcccu

SEQ ID NO: 3858277 - RNA, 14 nt, Human
uggacuugccucug

SEQ ID NO: 3858278 - RNA, 15 nt, Human
uggacuuguauauuu

SEQ ID NO: 3858279 - RNA, 15 nt, Human
uggacuuguccucag

SEQ ID NO: 3858280 - RNA, 12 nt, Human
uggacuuucaaa

SEQ ID NO: 3858281 - RNA, 16 nt, Human
uggacuuuccaccccc

SEQ ID NO: 3858282 - RNA, 19 nt, Human
uggacuuuccacccccucc

SEQ ID NO: 3858283 - RNA, 20 nt, Human
uggacuuuccacccccuccc

SEQ ID NO: 3858284 - RNA, 19 nt, Human
uggacuuuccugcaacuca

SEQ ID NO: 3858285 - RNA, 20 nt, Human
uggacuuucucuaauaauaa

SEQ ID NO: 3858286 - RNA, 22 nt, Human
uggacuuucucuaauaauaaau

SEQ ID NO: 3858287 - RNA, 11 nt, Human
uggacuuuguu

SEQ ID NO: 3858288 - RNA, 12 nt, Human
uggacuuuguua

SEQ ID NO: 3858289 - RNA, 15 nt, Human
uggacuuuguuacac

SEQ ID NO: 3858290 - RNA, 22 nt, Human
uggacuuuguuacacuguuauu

SEQ ID NO: 3858291 - RNA, 22 nt, Human
uggacuuuguuaguuucuccaa

SEQ ID NO: 3858292 - RNA, 14 nt, Human
uggacuuuguucac

SEQ ID NO: 3858293 - RNA, 17 nt, Human
uggagaaaaauaucugu

SEQ ID NO: 3858294 - RNA, 14 nt, Human
uggagaaaauggac

SEQ ID NO: 3858295 - RNA, 22 nt, Human
uggagaaaauggguuuauucac

SEQ ID NO: 3858296 - RNA, 14 nt, Human
uggagaaacccugu

SEQ ID NO: 3858297 - RNA, 22 nt, Human
uggagaaacuguagucucagga

SEQ ID NO: 3858298 - RNA, 17 nt, Human
uggagaaagcacugacc

SEQ ID NO: 3858299 - RNA, 18 nt, Human
uggagaaagcacugaccu

SEQ ID NO: 3858300 - RNA, 13 nt, Human
uggagaaagcuga

SEQ ID NO: 3858301 - RNA, 13 nt, Human
uggagaaagggcc

SEQ ID NO: 3858302 - RNA, 22 nt, Human
uggagaaagggcccugggccug

SEQ ID NO: 3858303 - RNA, 11 nt, Human
uggagaaauua

SEQ ID NO: 3858304 - RNA, 14 nt, Human
uggagaaccaccua

SEQ ID NO: 3858305 - RNA, 16 nt, Human
uggagaagaacugaaa

SEQ ID NO: 3858306 - RNA, 20 nt, Human
uggagaagagagaggaaagg

SEQ ID NO: 3858307 - RNA, 19 nt, Human
uggagaagagaggagagga

SEQ ID NO: 3858308 - RNA, 11 nt, Human
uggagaagcca

SEQ ID NO: 3858309 - RNA, 14 nt, Human
uggagaagccauug

SEQ ID NO: 3858310 - RNA, 17 nt, Human
uggagaagccauugucu

SEQ ID NO: 3858311 - RNA, 18 nt, Human
uggagaagccauugucuu

SEQ ID NO: 3858312 - RNA, 22 nt, Human
uggagaagcggcuggcagccca

SEQ ID NO: 3858313 - RNA, 16 nt, Human
uggagaagcucaccca

SEQ ID NO: 3858314 - RNA, 19 nt, Human
uggagaagcucccaggaac

SEQ ID NO: 3858315 - RNA, 15 nt, Human
uggagaagucucagc

SEQ ID NO: 3858316 - RNA, 17 nt, Human
uggagaagucucagcua

SEQ ID NO: 3858317 - RNA, 16 nt, Human
uggagaauaauucuuu

SEQ ID NO: 3858318 - RNA, 17 nt, Human
uggagaaucacaggcug

SEQ ID NO: 3858319 - RNA, 23 nt, Human
uggagaaucacaggcugggcugg

SEQ ID NO: 3858320 - RNA, 20 nt, Human
uggagaaucucaacaugucu

SEQ ID NO: 3858321 - RNA, 15 nt, Human
uggagaauguggaga

SEQ ID NO: 3858322 - RNA, 18 nt, Human
uggagaauugcugaaggg

SEQ ID NO: 3858323 - RNA, 13 nt, Human
uggagacagcccc

SEQ ID NO: 3858324 - RNA, 17 nt, Human
uggagacagccccagag

SEQ ID NO: 3858325 - RNA, 22 nt, Human
uggagacagccccagagcaggg

SEQ ID NO: 3858326 - RNA, 15 nt, Human
uggagacauuccugg

SEQ ID NO: 3858327 - RNA, 13 nt, Human
uggagaccaccag

SEQ ID NO: 3858328 - RNA, 18 nt, Human
uggagaccagggagccuu

SEQ ID NO: 3858329 - RNA, 22 nt, Human
uggagacccaccccaccugcag

SEQ ID NO: 3858330 - RNA, 24 nt, Human
uggagacguggaaccucugucuca

SEQ ID NO: 3858331 - RNA, 22 nt, Human
uggagacguuuauaaacagaaa

SEQ ID NO: 3858332 - RNA, 19 nt, Human
uggagacuccuaggcagga

SEQ ID NO: 3858333 - RNA, 19 nt, Human
uggagacuccugcccuguu

SEQ ID NO: 3858334 - RNA, 22 nt, Human
uggagacugcuccugagccccc

SEQ ID NO: 3858335 - RNA, 14 nt, Human
uggagacugucuca

SEQ ID NO: 3858336 - RNA, 20 nt, Human
uggagacugugugugcccuc

SEQ ID NO: 3858337 - RNA, 18 nt, Human
uggagacuuucuuuaaau

SEQ ID NO: 3858338 - RNA, 13 nt, Human
uggagagaaauau

SEQ ID NO: 3858339 - RNA, 12 nt, Human
uggagagaaggc

SEQ ID NO: 3858340 - RNA, 19 nt, Human
uggagagagcagacuggcg

SEQ ID NO: 3858341 - RNA, 14 nt, Human
uggagagcaacaca

SEQ ID NO: 3858342 - RNA, 13 nt, Human
uggagagcccugg

SEQ ID NO: 3858343 - RNA, 15 nt, Human
uggagagcccuggga

SEQ ID NO: 3858344 - RNA, 20 nt, Human
uggagagcccugggaccgcu

SEQ ID NO: 3858345 - RNA, 15 nt, Human
uggagagcuaggagc

SEQ ID NO: 3858346 - RNA, 22 nt, Human
uggagagcuaggagcaaagccu

SEQ ID NO: 3858347 - RNA, 13 nt, Human
uggagagcuggag

SEQ ID NO: 3858348 - RNA, 15 nt, Human
uggagagcuggagcc

SEQ ID NO: 3858349 - RNA, 17 nt, Human
uggagagcuggagccug

SEQ ID NO: 3858350 - RNA, 14 nt, Human
uggagagcuggugc

SEQ ID NO: 3858351 - RNA, 16 nt, Human
uggagagcuggugccc

SEQ ID NO: 3858352 - RNA, 15 nt, Human
uggcaacagaagcag

SEQ ID NO: 3858353 - RNA, 15 nt, Human
uggcaacagaucugg

SEQ ID NO: 3858354 - RNA, 16 nt, Human
uggcaacagaucugga

SEQ ID NO: 3858355 - RNA, 21 nt, Human
uggcaacaguuagcuggagcu

SEQ ID NO: 3858356 - RNA, 14 nt, Human
uggcaaccugcuuc

SEQ ID NO: 3858357 - RNA, 17 nt, Human
uggcaagaguguggagg

SEQ ID NO: 3858358 - RNA, 16 nt, Human
uggcaagccccugccc

SEQ ID NO: 3858359 - RNA, 11 nt, Human
uggcaaggaaa

SEQ ID NO: 3858360 - RNA, 19 nt, Human
uggcaaggacuuuguacau

SEQ ID NO: 3858361 - RNA, 20 nt, Human
uggcaaggcagcccugucug

SEQ ID NO: 3858362 - RNA, 22 nt, Human
uggcaaguuuugauaugaguau

SEQ ID NO: 3858363 - RNA, 20 nt, Human
uggcaauagugggcccuccg

SEQ ID NO: 3858364 - RNA, 16 nt, Human
uggcaauaguguguuc

SEQ ID NO: 3858365 - RNA, 17 nt, Human
uggcaauaguguguucu

SEQ ID NO: 3858366 - RNA, 15 nt, Human
uggcaauauuccuua

SEQ ID NO: 3858367 - RNA, 19 nt, Human
uggcaaugacucaaagucu

SEQ ID NO: 3858368 - RNA, 19 nt, Human
uggcaaugccacagcccug

SEQ ID NO: 3858369 - RNA, 19 nt, Human
uggcaaugccaucaucucc

SEQ ID NO: 3858370 - RNA, 20 nt, Human
uggcaauggaugaacugaaa

SEQ ID NO: 3858371 - RNA, 16 nt, Human
uggcaaugguaguuuc

SEQ ID NO: 3858372 - RNA, 13 nt, Human
uggcaauuccaau

SEQ ID NO: 3858373 - RNA, 14 nt, Human
uggcaauugucuau

SEQ ID NO: 3858374 - RNA, 16 nt, Human
uggcaauugucuauuu

SEQ ID NO: 3858375 - RNA, 18 nt, Human
uggcaauugucuauuuau

SEQ ID NO: 3858376 - RNA, 14 nt, Human
uggcaauuuugugg

SEQ ID NO: 3858377 - RNA, 23 nt, Human
uggcacagagguagucucacugc

SEQ ID NO: 3858378 - RNA, 18 nt, Human
uggcacagcccaaagaag

SEQ ID NO: 3858379 - RNA, 14 nt, Human
uggcacagccugca

SEQ ID NO: 3858380 - RNA, 16 nt, Human
uggcacagggcaugaa

SEQ ID NO: 3858381 - RNA, 18 nt, Human
uggcacagugucugggcu

SEQ ID NO: 3858382 - RNA, 20 nt, Human
uggcacagugucugggcuga

SEQ ID NO: 3858383 - RNA, 22 nt, Human
uggcacaguuuucugagaaaga

SEQ ID NO: 3858384 - RNA, 18 nt, Human
uggcacaucagaaaggaa

SEQ ID NO: 3858385 - RNA, 20 nt, Human
uggcacaucagcacgauuuc

SEQ ID NO: 3858386 - RNA, 21 nt, Human
uggcacaucagcacgauuucu

SEQ ID NO: 3858387 - RNA, 23 nt, Human
uggcacaucagcacgauuucugu

SEQ ID NO: 3858388 - RNA, 21 nt, Human
uggcaccacugcacuccagcc

SEQ ID NO: 3858389 - RNA, 20 nt, Human
uggcaccagacacccaggac

SEQ ID NO: 3858390 - RNA, 23 nt, Human
uggcaccagacacccaggacuua

SEQ ID NO: 3858391 - RNA, 14 nt, Human
uggcaccagaggcu

SEQ ID NO: 3858392 - RNA, 13 nt, Human
uggcaccagcgaa

SEQ ID NO: 3858393 - RNA, 16 nt, Human
uggcaccgccucccca

SEQ ID NO: 3858394 - RNA, 15 nt, Human
uggcaccgccuucuc

SEQ ID NO: 3858395 - RNA, 16 nt, Human
uggcaccgccuucucu

SEQ ID NO: 3858396 - RNA, 12 nt, Human
uggcaccuccua

SEQ ID NO: 3858397 - RNA, 20 nt, Human
uggcaccugucgcccagugc

SEQ ID NO: 3858398 - RNA, 14 nt, Human
uggcaccugucugc

SEQ ID NO: 3858399 - RNA, 18 nt, Human
uggcaccugucugcucca

SEQ ID NO: 3858400 - RNA, 21 nt, Human
uggcaccuucccccuccccca

SEQ ID NO: 3858401 - RNA, 20 nt, Human
uggcacgguggcucaggccu

SEQ ID NO: 3858402 - RNA, 16 nt, Human
uggcacgucaucuagu

SEQ ID NO: 3858403 - RNA, 18 nt, Human
uggcacucacagaccugg

SEQ ID NO: 3858404 - RNA, 21 nt, Human
uggcacucccuccagcacaaa

SEQ ID NO: 3858405 - RNA, 13 nt, Human
uggcacugagccc

SEQ ID NO: 3858406 - RNA, 18 nt, Human
uggcacugcuuccaguga

SEQ ID NO: 3858407 - RNA, 19 nt, Human
uggcacugcuuccagugag

SEQ ID NO: 3858408 - RNA, 18 nt, Human
uggcacuggaccccagca

SEQ ID NO: 3858409 - RNA, 15 nt, Human
uggcacuggaugcag

SEQ ID NO: 3858410 - RNA, 18 nt, Human
uggcacuggaugcagaaa

SEQ ID NO: 3858411 - RNA, 21 nt, Human
uggcacuggcaaacagggccu

SEQ ID NO: 3858412 - RNA, 17 nt, Human
uggcacuugcaucugug

SEQ ID NO: 3858413 - RNA, 15 nt, Human
uggcacuugccuggg

SEQ ID NO: 3858414 - RNA, 14 nt, Human
uggcagaacugagc

SEQ ID NO: 3858415 - RNA, 20 nt, Human
uggcagaacugagcuccucu

SEQ ID NO: 3858416 - RNA, 13 nt, Human
uggcagaagacac

SEQ ID NO: 3858417 - RNA, 14 nt, Human
uggcagaagacacc

SEQ ID NO: 3858418 - RNA, 16 nt, Human
uggcagaaguguuuca

SEQ ID NO: 3858419 - RNA, 20 nt, Human
uggcagaauaaucuuugggu

SEQ ID NO: 3858420 - RNA, 15 nt, Human
uggcagacuguguaa

SEQ ID NO: 3858421 - RNA, 12 nt, Human
uggcagagagag

SEQ ID NO: 3858422 - RNA, 18 nt, Human
uggcagagagagagaaag

SEQ ID NO: 3858423 - RNA, 21 nt, Human
uggcagaguugaagacagagc

SEQ ID NO: 3858424 - RNA, 15 nt, Human
uggcagaguuguaaa

SEQ ID NO: 3858425 - RNA, 16 nt, Human
uggcagaguuguaaau

SEQ ID NO: 3858426 - RNA, 23 nt, Human
uggcagaguuguaaauauauaaa

SEQ ID NO: 3858427 - RNA, 20 nt, Human
uggcagauaaucagccucuu

SEQ ID NO: 3858428 - RNA, 17 nt, Human
uggcagaugcagcucuu

SEQ ID NO: 3858429 - RNA, 13 nt, Human
uggcagauuuuac

SEQ ID NO: 3858430 - RNA, 16 nt, Human
uggcagauuuuacaaa

SEQ ID NO: 3858431 - RNA, 22 nt, Human
uggcagauuuuacaaaagaugu

SEQ ID NO: 3858432 - RNA, 13 nt, Human
uggcagcaacaau

SEQ ID NO: 3858433 - RNA, 20 nt, Human
uggcagcaacggcacagcua

SEQ ID NO: 3858434 - RNA, 20 nt, Human
uggcagcaccgccucuuccc

SEQ ID NO: 3858435 - RNA, 18 nt, Human
uggcagcaccugucuccu

SEQ ID NO: 3858436 - RNA, 20 nt, Human
uggcagcagaaaacuugugu

SEQ ID NO: 3858437 - RNA, 11 nt, Human
uggcagcagau

SEQ ID NO: 3858438 - RNA, 14 nt, Human
uggcagcaggcagc

SEQ ID NO: 3858439 - RNA, 19 nt, Human
uggcagcaggccuguugcu

SEQ ID NO: 3858440 - RNA, 14 nt, Human
uggcagcauaaagg

SEQ ID NO: 3858441 - RNA, 21 nt, Human
uggcagccacacuucucagga

SEQ ID NO: 3858442 - RNA, 16 nt, Human
uggcagcccagccagc

SEQ ID NO: 3858443 - RNA, 12 nt, Human
uggcagccccug

SEQ ID NO: 3858444 - RNA, 20 nt, Human
uggcagcccgcaucagcugc

SEQ ID NO: 3858445 - RNA, 14 nt, Human
uggcagcccuguag

SEQ ID NO: 3858446 - RNA, 14 nt, Human
uggcagccgagcuc

SEQ ID NO: 3858447 - RNA, 16 nt, Human
uggcagccgugccuuc

SEQ ID NO: 3858448 - RNA, 20 nt, Human
uggcagccgugccuucagcu

SEQ ID NO: 3858449 - RNA, 23 nt, Human
uggcagccgugccuucagcucua

SEQ ID NO: 3858450 - RNA, 21 nt, Human
uggcagccucccauccagggc

SEQ ID NO: 3858451 - RNA, 22 nt, Human
uggcagccucccauccagggcc

SEQ ID NO: 3858452 - RNA, 15 nt, Human
uggcagccucuucaa

SEQ ID NO: 3858453 - RNA, 22 nt, Human
uggcagcucaccucucccuugg

SEQ ID NO: 3858454 - RNA, 23 nt, Human
uggcagcucaccucucccuugga

SEQ ID NO: 3858455 - RNA, 13 nt, Human
uggcagcucagag

SEQ ID NO: 3858456 - RNA, 12 nt, Human
uggcagcucucc

SEQ ID NO: 3858457 - RNA, 13 nt, Human
uggcagcucucca

SEQ ID NO: 3858458 - RNA, 17 nt, Human
uggcagcucuccaguca

SEQ ID NO: 3858459 - RNA, 11 nt, Human
uggcagcucug

SEQ ID NO: 3858460 - RNA, 22 nt, Human
uggcagcucuggacagccccac

SEQ ID NO: 3858461 - RNA, 21 nt, Human
uggcaggacacugcagaacag

SEQ ID NO: 3858462 - RNA, 19 nt, Human
uggcaggaguuggaagugu

SEQ ID NO: 3858463 - RNA, 18 nt, Human
uggcaggauggccuggcc

SEQ ID NO: 3858464 - RNA, 20 nt, Human
uggcaggauggccuggccag

SEQ ID NO: 3858465 - RNA, 23 nt, Human
uggcaggcagaggcccaggcugc

SEQ ID NO: 3858466 - RNA, 23 nt, Human
uggcaggcagcgccaagcaaccu

SEQ ID NO: 3858467 - RNA, 19 nt, Human
uggcagggaggucaggccc

SEQ ID NO: 3858468 - RNA, 16 nt, Human
uggcagggcacagggc

SEQ ID NO: 3858469 - RNA, 18 nt, Human
uggcagggcacagggccu

SEQ ID NO: 3858470 - RNA, 14 nt, Human
uggcagggccuagc

SEQ ID NO: 3858471 - RNA, 12 nt, Human
uggcagggcuca

SEQ ID NO: 3858472 - RNA, 14 nt, Human
uggcagggcucagg

SEQ ID NO: 3858473 - RNA, 15 nt, Human
uggcagggcucagga

SEQ ID NO: 3858474 - RNA, 21 nt, Human
uggcagggcuggccccagggc

SEQ ID NO: 3858475 - RNA, 13 nt, Human
uggcagggggcug

SEQ ID NO: 3858476 - RNA, 16 nt, Human
uggcagggggcugcug

SEQ ID NO: 3858477 - RNA, 17 nt, Human
uggcagggggcugcugc

SEQ ID NO: 3858478 - RNA, 19 nt, Human
uggcagggggcugcugcug

SEQ ID NO: 3858479 - RNA, 16 nt, Human
uggcagggugggaugg

SEQ ID NO: 3858480 - RNA, 17 nt, Human
uggcagggugggaugga

SEQ ID NO: 3858481 - RNA, 20 nt, Human
uggcagguaggaauauuaua

SEQ ID NO: 3858482 - RNA, 17 nt, Human
uggcagguccuccccuc

SEQ ID NO: 3858483 - RNA, 22 nt, Human
uggcaggugauguccuguaaac

SEQ ID NO: 3858484 - RNA, 15 nt, Human
uggcaggugcagccc

SEQ ID NO: 3858485 - RNA, 22 nt, Human
uggcagguggaggugucaggcu

SEQ ID NO: 3858486 - RNA, 14 nt, Human
uggcaguaaagaga

SEQ ID NO: 3858487 - RNA, 17 nt, Human
uggcaguaaagagaaac

SEQ ID NO: 3858488 - RNA, 18 nt, Human
uggcaguccuggaagcca

SEQ ID NO: 3858489 - RNA, 16 nt, Human
uggcagucugaauuuu

SEQ ID NO: 3858490 - RNA, 17 nt, Human
uggcagugagugagccu

SEQ ID NO: 3858491 - RNA, 12 nt, Human
uggcaguggagg

SEQ ID NO: 3858492 - RNA, 23 nt, Human
uggcagugggaaaaauguaggag

SEQ ID NO: 3858493 - RNA, 16 nt, Human
uggcagugggagcugc

SEQ ID NO: 3858494 - RNA, 20 nt, Human
uggcagugggagcugccugu

SEQ ID NO: 3858495 - RNA, 21 nt, Human
uggcauaacauaaaucuguga

SEQ ID NO: 3858496 - RNA, 15 nt, Human
uggcauagcucuggg

SEQ ID NO: 3858497 - RNA, 16 nt, Human
uggcauagcucugggg

SEQ ID NO: 3858498 - RNA, 18 nt, Human
uggcaucacagggcagag

SEQ ID NO: 3858499 - RNA, 23 nt, Human
uggcaucaccuuaggcagggaag

SEQ ID NO: 3858500 - RNA, 18 nt, Human
uggcaucagcuggcguca

SEQ ID NO: 3858501 - RNA, 18 nt, Human
uggcaucaucucagcuca

SEQ ID NO: 3858502 - RNA, 15 nt, Human
uucuagggaaaugaa

SEQ ID NO: 3858503 - RNA, 23 nt, Human
uucuagggcugggaaacacuccu

SEQ ID NO: 3858504 - RNA, 23 nt, Human
uucuagguggcaaggcugugcuc

SEQ ID NO: 3858505 - RNA, 20 nt, Human
uucuagguuucaaagaugcu

SEQ ID NO: 3858506 - RNA, 19 nt, Human
uucuaguacacuuuuauga

SEQ ID NO: 3858507 - RNA, 21 nt, Human
uucuagucuccuuugcacuga

SEQ ID NO: 3858508 - RNA, 22 nt, Human
uucuagucuccuuugcacugag

SEQ ID NO: 3858509 - RNA, 23 nt, Human
uucuagucuccuuugcacugagg

SEQ ID NO: 3858510 - RNA, 18 nt, Human
uucuaguggucuuuguaa

SEQ ID NO: 3858511 - RNA, 21 nt, Human
uucuaguggucuuuguaagag

SEQ ID NO: 3858512 - RNA, 22 nt, Human
uucuaguggucuuuguaagagu

SEQ ID NO: 3858513 - RNA, 15 nt, Human
uucuaguguagaauu

SEQ ID NO: 3858514 - RNA, 17 nt, Human
uucuaguuauuuauucu

SEQ ID NO: 3858515 - RNA, 15 nt, Human
uucuaguucugccag

SEQ ID NO: 3858516 - RNA, 22 nt, Human
uucuaguuucccacaauauaaa

SEQ ID NO: 3858517 - RNA, 23 nt, Human
uucuauaaggccauaaaacaggu

SEQ ID NO: 3858518 - RNA, 18 nt, Human
uuguuaauaucacucauu

SEQ ID NO: 3858519 - RNA, 22 nt, Human
uuguuaaucucuguuauguacu

SEQ ID NO: 3858520 - RNA, 21 nt, Human
uuguuaauuuagaaaacuuua

SEQ ID NO: 3858521 - RNA, 17 nt, Human
uuguuaauuucaguccu

SEQ ID NO: 3858522 - RNA, 13 nt, Human
uuguuaauuugga

SEQ ID NO: 3858523 - RNA, 18 nt, Human
uuguuacccaugaaaaac

SEQ ID NO: 3858524 - RNA, 21 nt, Human
uuguuaccuccaacagaacua

SEQ ID NO: 3858525 - RNA, 23 nt, Human
uuguuaccuccaacagaacuaaa

SEQ ID NO: 3858526 - RNA, 22 nt, Human
uuguuacucugguucuuuguuu

SEQ ID NO: 3858527 - RNA, 9 nt, Human
uuguuacug

SEQ ID NO: 3858528 - RNA, 13 nt, Human
uuguuacuguucu

SEQ ID NO: 3858529 - RNA, 15 nt, Human
uuguuacuguucuug

SEQ ID NO: 3858530 - RNA, 16 nt, Human
uuguuacuguucuugc

SEQ ID NO: 3858531 - RNA, 19 nt, Human
uuguuacuguucuugcugc

SEQ ID NO: 3858532 - RNA, 23 nt, Human
uuguuacuguucuugcugcuaga

SEQ ID NO: 3858533 - RNA, 15 nt, Human
uuguuacuucucuaa

SEQ ID NO: 3858534 - RNA, 22 nt, Human
uuguuagaaaacaaaauuuuau

SEQ ID NO: 3858535 - RNA, 16 nt, Human
uuguuagauagcugca

SEQ ID NO: 3858536 - RNA, 21 nt, Human
uuguuaggccaaagacaaaua

SEQ ID NO: 3858537 - RNA, 22 nt, Human
uuguuaggccaaagacaaauag

SEQ ID NO: 3858538 - RNA, 13 nt, Human
uuguuauauaauc

SEQ ID NO: 3858539 - RNA, 15 nt, Human
uuguuauauaauuua

SEQ ID NO: 3858540 - RNA, 12 nt, Human
uuguuaugcuau

SEQ ID NO: 3858541 - RNA, 13 nt, Human
uuguuauuaaaug

SEQ ID NO: 3858542 - RNA, 14 nt, Human
uuguuauuaaaugu

SEQ ID NO: 3858543 - RNA, 15 nt, Human
uuguuauuaaaugua

SEQ ID NO: 3858544 - RNA, 22 nt, Human
uuguuauuuugcaaccucgcug

SEQ ID NO: 3858545 - RNA, 14 nt, Human
uuguucaaacaaua

SEQ ID NO: 3858546 - RNA, 15 nt, Human
uuguucaccuuugua

SEQ ID NO: 3858547 - RNA, 21 nt, Human
uuguucacugaaggugauuca

SEQ ID NO: 3858548 - RNA, 16 nt, Human
uuguucagcaugcaau

SEQ ID NO: 3858549 - RNA, 16 nt, Human
uuguucaucauccaga

SEQ ID NO: 3858550 - RNA, 14 nt, Human
uuguucauguuugg

SEQ ID NO: 3858551 - RNA, 19 nt, Human
uuguucauuuugagcugaa

SEQ ID NO: 3858552 - RNA, 21 nt, Human
uuguuccaaauacuaaugaaa

SEQ ID NO: 3858553 - RNA, 16 nt, Human
uuguuccaagacauug

SEQ ID NO: 3858554 - RNA, 22 nt, Human
uuguuccaagacauugucaaua

SEQ ID NO: 3858555 - RNA, 21 nt, Human
uuguuccacaaguuaaauaaa

SEQ ID NO: 3858556 - RNA, 12 nt, Human
uuguuccagaga

SEQ ID NO: 3858557 - RNA, 11 nt, Human
uuguucccagu

SEQ ID NO: 3858558 - RNA, 21 nt, Human
uuguucccauccucuucuuuu

SEQ ID NO: 3858559 - RNA, 18 nt, Human
uuguuccccacuggagca

SEQ ID NO: 3858560 - RNA, 19 nt, Human
uuguuccccaucaucugug

SEQ ID NO: 3858561 - RNA, 14 nt, Human
uuguuccccuccuc

SEQ ID NO: 3858562 - RNA, 16 nt, Human
uuguuccccuccucca

SEQ ID NO: 3858563 - RNA, 18 nt, Human
uuguuccccuccuccacu

SEQ ID NO: 3858564 - RNA, 20 nt, Human
uuguuccccuccuccacucu

SEQ ID NO: 3858565 - RNA, 23 nt, Human
uuguucccuauuuuucucuccug

SEQ ID NO: 3858566 - RNA, 20 nt, Human
uuguuccuaaguucuuagau

SEQ ID NO: 3858567 - RNA, 21 nt, Human
uuguucucugggagaaaauca

SEQ ID NO: 3858568 - RNA, 14 nt, Human
uuguucucugucca

SEQ ID NO: 3858569 - RNA, 23 nt, Human
uuguucugugguuuuccccuccc

SEQ ID NO: 3858570 - RNA, 15 nt, Human
uuguucuguuaacug

SEQ ID NO: 3858571 - RNA, 22 nt, Human
uuguucuucagagaucauggaa

SEQ ID NO: 3858572 - RNA, 19 nt, Human
uuguucuuggcaauaaauu

SEQ ID NO: 3858573 - RNA, 15 nt, Human
uuguugaaagaaagu

SEQ ID NO: 3858574 - RNA, 12 nt, Human
uuguugaaauuu

SEQ ID NO: 3858575 - RNA, 16 nt, Human
uuguugacaaaauuuu

SEQ ID NO: 3858576 - RNA, 21 nt, Human
uuguugacaguucugaagaau

SEQ ID NO: 3858577 - RNA, 17 nt, Human
uuguugacuuauuuucu

SEQ ID NO: 3858578 - RNA, 22 nt, Human
uuguugagcaugacagccugca

SEQ ID NO: 3858579 - RNA, 19 nt, Human
uuguugaggguauguuuua

SEQ ID NO: 3858580 - RNA, 22 nt, Human
uuguugagguggucugaauguu

SEQ ID NO: 3858581 - RNA, 23 nt, Human
uuguugaugggcacuugagaacu

SEQ ID NO: 3858582 - RNA, 18 nt, Human
uuguugcaagaugugaau

SEQ ID NO: 3858583 - RNA, 19 nt, Human
uuguugcaaguacugcugu

SEQ ID NO: 3858584 - RNA, 17 nt, Human
uuguugcacugaaguuu

SEQ ID NO: 3858585 - RNA, 16 nt, Human
uuguugcguuccuuuc

SEQ ID NO: 3858586 - RNA, 20 nt, Human
uuguugcuggcuuguuguaa

SEQ ID NO: 3858587 - RNA, 13 nt, Human
uuguuggaaugaa

SEQ ID NO: 3858588 - RNA, 15 nt, Human
uuguuggagccugca

SEQ ID NO: 3858589 - RNA, 15 nt, Human
uuguuggaucuucaa

SEQ ID NO: 3858590 - RNA, 12 nt, Human
uuguuggccucc

SEQ ID NO: 3858591 - RNA, 21 nt, Human
uuguuggccuccggccucccc

SEQ ID NO: 3858592 - RNA, 18 nt, Human
uuguuggcguaggcuaca

SEQ ID NO: 3858593 - RNA, 15 nt, Human
uuguuggugcacagc

SEQ ID NO: 3858594 - RNA, 20 nt, Human
uuguugguugguuuucuucu

SEQ ID NO: 3858595 - RNA, 20 nt, Human
uuguugguuuuuaaagauuu

SEQ ID NO: 3858596 - RNA, 13 nt, Human
uuguuguaaaaag

SEQ ID NO: 3858597 - RNA, 17 nt, Human
uuguuguaaaaagaaaa

SEQ ID NO: 3858598 - RNA, 21 nt, Human
uuguuguaaaacaaaauuuga

SEQ ID NO: 3858599 - RNA, 14 nt, Human
uuguuguacuuaaa

SEQ ID NO: 3858600 - RNA, 18 nt, Human
uuguuguagagaaaacau

SEQ ID NO: 3858601 - RNA, 23 nt, Human
uuguuguagauugauuguauugu

SEQ ID NO: 3858602 - RNA, 20 nt, Human
uuguuguauaauuucgagau

SEQ ID NO: 3858603 - RNA, 14 nt, Human
uuguuguccuuuuc

SEQ ID NO: 3858604 - RNA, 14 nt, Human
uuguugugugccuc

SEQ ID NO: 3858605 - RNA, 20 nt, Human
uuguuguuauuuuuugagaa

SEQ ID NO: 3858606 - RNA, 13 nt, Human
uuguuguucuguu

SEQ ID NO: 3858607 - RNA, 21 nt, Human
uuguuguucuguuaacugaau

SEQ ID NO: 3858608 - RNA, 15 nt, Human
uuguuuaaaaaguaa

SEQ ID NO: 3858609 - RNA, 23 nt, Human
uuguuuaaugguaguuuuacagu

SEQ ID NO: 3858610 - RNA, 22 nt, Human
uuguuuaauuuuuauuucuucc

SEQ ID NO: 3858611 - RNA, 21 nt, Human
uuguuuacagcacuacucugu

SEQ ID NO: 3858612 - RNA, 17 nt, Human
uuguuuacaugcuuauu

SEQ ID NO: 3858613 - RNA, 22 nt, Human
uuguuuacaugcuuauuccaug

SEQ ID NO: 3858614 - RNA, 21 nt, Human
uuguuuagaaagaauauucau

SEQ ID NO: 3858615 - RNA, 13 nt, Human
uuguuuagagaau

SEQ ID NO: 3858616 - RNA, 18 nt, Human
uuguuuauaauaaaaaua

SEQ ID NO: 3858617 - RNA, 13 nt, Human
uuguuuaucagca

SEQ ID NO: 3858618 - RNA, 15 nt, Human
uuguuuauuagauga

SEQ ID NO: 3858619 - RNA, 24 nt, Human
uuguuuauuagaugaauuauccua

SEQ ID NO: 3858620 - RNA, 19 nt, Human
uuguuuauuaguuuugcau

SEQ ID NO: 3858621 - RNA, 20 nt, Human
uuguuuauucuuuuuaaagu

SEQ ID NO: 3858622 - RNA, 13 nt, Human
uuguuuauugagu

SEQ ID NO: 3858623 - RNA, 19 nt, Human
uuguuuauugaguuuguag

SEQ ID NO: 3858624 - RNA, 20 nt, Human
uuguuucaagaaccuggaaa

SEQ ID NO: 3858625 - RNA, 21 nt, Human
uuguuucaaugagguguccaa

SEQ ID NO: 3858626 - RNA, 23 nt, Human
uuguuucaaugagguguccaacu

SEQ ID NO: 3858627 - RNA, 20 nt, Human
uuguuucagggcuguggccu

SEQ ID NO: 3858628 - RNA, 18 nt, Human
uuguuucgcucuuugaga

SEQ ID NO: 3858629 - RNA, 19 nt, Human
uuguuucgcucuuugagaa

SEQ ID NO: 3858630 - RNA, 22 nt, Human
uuguuucuagacuauaaauguu

SEQ ID NO: 3858631 - RNA, 23 nt, Human
uuguuucucaaaucuuggcaaua

SEQ ID NO: 3858632 - RNA, 17 nt, Human
uuguuucucccccuggg

SEQ ID NO: 3858633 - RNA, 12 nt, Human
uuguuucuuaaa

SEQ ID NO: 3858634 - RNA, 15 nt, Human
uuguuucuuaaauaa

SEQ ID NO: 3858635 - RNA, 19 nt, Human
uuguuucuuccaaagcaca

SEQ ID NO: 3858636 - RNA, 18 nt, Human
uuguuucuuguuuauuga

SEQ ID NO: 3858637 - RNA, 16 nt, Human
uuguagccuuuugacu

SEQ ID NO: 3858638 - RNA, 12 nt, Human
uuguagcuccuc

SEQ ID NO: 3858639 - RNA, 19 nt, Human
uuuacagugaagaaagccu

SEQ ID NO: 3858640 - RNA, 14 nt, Human
uuuacauaacugcc

SEQ ID NO: 3858641 - RNA, 16 nt, Human
uuuacauaacugccuu

SEQ ID NO: 3858642 - RNA, 23 nt, Human
uuuacauaacugccuugaaccug

SEQ ID NO: 3858643 - RNA, 14 nt, Human
uuuacauacuuuau

SEQ ID NO: 3858644 - RNA, 23 nt, Human
uuuacauagucugaagugaagua

SEQ ID NO: 3858645 - RNA, 19 nt, Human
uuuacauauaaaauguaau

SEQ ID NO: 3858646 - RNA, 18 nt, Human
uuuacaugcuuauuccau

SEQ ID NO: 3858647 - RNA, 17 nt, Human
uuuacauggcuggagcu

SEQ ID NO: 3858648 - RNA, 17 nt, Human
uuuacauuuuauggugc

SEQ ID NO: 3858649 - RNA, 23 nt, Human
uuuacauuuuauggugccuagua

SEQ ID NO: 3858650 - RNA, 13 nt, Human
uuuacauuuuuau

SEQ ID NO: 3858651 - RNA, 12 nt, Human
uuuaccaaguuu

SEQ ID NO: 3858652 - RNA, 13 nt, Human
uuuaccacuugug

SEQ ID NO: 3858653 - RNA, 13 nt, Human
uuuaccaucugaa

SEQ ID NO: 3858654 - RNA, 21 nt, Human
uuuaccaugcucaaugaaaag

SEQ ID NO: 3858655 - RNA, 16 nt, Human
uuuaccauuuguaaua

SEQ ID NO: 3858656 - RNA, 19 nt, Human
uuuaccauuuguaauaaag

SEQ ID NO: 3858657 - RNA, 20 nt, Human
uuuaccauuuguaauaaagu

SEQ ID NO: 3858658 - RNA, 23 nt, Human
uuuaccauuuguaauaaaguaua

SEQ ID NO: 3858659 - RNA, 18 nt, Human
uuuacccaaaaacuaaau

SEQ ID NO: 3858660 - RNA, 19 nt, Human
uuuacccacacacagauaa

SEQ ID NO: 3858661 - RNA, 18 nt, Human
uuuacccauauccccucu

SEQ ID NO: 3858662 - RNA, 15 nt, Human
uuuacccaugaagau

SEQ ID NO: 3858663 - RNA, 16 nt, Human
uuuacccuaaugucuu

SEQ ID NO: 3858664 - RNA, 18 nt, Human
uuuacccuauaucuauaa

SEQ ID NO: 3858665 - RNA, 14 nt, Human
uuuacccuggcccc

SEQ ID NO: 3858666 - RNA, 19 nt, Human
uuuacccuggccccucucc

SEQ ID NO: 3858667 - RNA, 20 nt, Human
uuuacccuucuuuucugacu

SEQ ID NO: 3858668 - RNA, 18 nt, Human
uuuaccguuucuucccug

SEQ ID NO: 3858669 - RNA, 15 nt, Human
uuuaccuaagauuac

SEQ ID NO: 3858670 - RNA, 18 nt, Human
uuuaccuaccacaguguc

SEQ ID NO: 3858671 - RNA, 13 nt, Human
uuuaccuagaaga

SEQ ID NO: 3858672 - RNA, 15 nt, Human
uuuaccucagccugg

SEQ ID NO: 3858673 - RNA, 15 nt, Human
uuuaccugucacauu

SEQ ID NO: 3858674 - RNA, 21 nt, Human
uuuaccugucacauugcauuc

SEQ ID NO: 3858675 - RNA, 16 nt, Human
uuuaccugugaaauag

SEQ ID NO: 3858676 - RNA, 21 nt, Human
uuuaccugugcguuacuaauu

SEQ ID NO: 3858677 - RNA, 16 nt, Human
uuuaccuuuuaauuaa

SEQ ID NO: 3858678 - RNA, 13 nt, Human
uuuacguagugua

SEQ ID NO: 3858679 - RNA, 18 nt, Human
uuuacgucugggagaaau

SEQ ID NO: 3858680 - RNA, 13 nt, Human
uuuacuaaacaua

SEQ ID NO: 3858681 - RNA, 14 nt, Human
uuuacuaaacauau

SEQ ID NO: 3858682 - RNA, 15 nt, Human
uuuacuaaagaaaga

SEQ ID NO: 3858683 - RNA, 22 nt, Human
uuuacuaaagaaagauuacuua

SEQ ID NO: 3858684 - RNA, 23 nt, Human
uuuacuaagaugacauugcuaag

SEQ ID NO: 3858685 - RNA, 20 nt, Human
uuuacuaagccacaagaaau

SEQ ID NO: 3858686 - RNA, 19 nt, Human
uuuacuacaauauguacau

SEQ ID NO: 3858687 - RNA, 21 nt, Human
uuuacuacagcuaugaagaaa

SEQ ID NO: 3858688 - RNA, 23 nt, Human
uuuacuacuguggaaaaauauuu

SEQ ID NO: 3858689 - RNA, 22 nt, Human
uuuacuacuucucucuguauuu

SEQ ID NO: 3858690 - RNA, 20 nt, Human
uuuacuagaacacagaaagc

SEQ ID NO: 3858691 - RNA, 13 nt, Human
uuuacuauauaua

SEQ ID NO: 3858692 - RNA, 17 nt, Human
uuuacucaacccucuca

SEQ ID NO: 3858693 - RNA, 21 nt, Human
uuuacucaacccucucaggug

SEQ ID NO: 3858694 - RNA, 13 nt, Human
uuuacucauuauc

SEQ ID NO: 3858695 - RNA, 14 nt, Human
uuuacucauugaaa

SEQ ID NO: 3858696 - RNA, 16 nt, Human
uuuacucauugaaaug

SEQ ID NO: 3858697 - RNA, 22 nt, Human
uuuacucauugaaaugucacgu

SEQ ID NO: 3858698 - RNA, 17 nt, Human
uuuacuccguaacagau

SEQ ID NO: 3858699 - RNA, 17 nt, Human
uuuacuccucacacuua

SEQ ID NO: 3858700 - RNA, 22 nt, Human
uuuacucuaugccccaaauaua

SEQ ID NO: 3858701 - RNA, 14 nt, Human
uuuacugaagccuu

SEQ ID NO: 3858702 - RNA, 21 nt, Human
uuuacugagcuucucugugaa

SEQ ID NO: 3858703 - RNA, 16 nt, Human
uuuacugcagcuuugu

SEQ ID NO: 3858704 - RNA, 22 nt, Human
uuuacugccaaagggaaauauc

SEQ ID NO: 3858705 - RNA, 12 nt, Human
uuuacugcuuuu

SEQ ID NO: 3858706 - RNA, 12 nt, Human
uuuacuguguuu

SEQ ID NO: 3858707 - RNA, 15 nt, Human
uuuagccaaacccuu

SEQ ID NO: 3858708 - RNA, 15 nt, Human
uuuagccuaguucau

SEQ ID NO: 3858709 - RNA, 14 nt, Human
uuuagccuguccug

SEQ ID NO: 3858710 - RNA, 13 nt, Human
uuuagccuguguc

SEQ ID NO: 3858711 - RNA, 16 nt, Human
uuuagccuucucuguu

SEQ ID NO: 3858712 - RNA, 21 nt, Human
uuuagcugaugaacuuauucu

SEQ ID NO: 3858713 - RNA, 22 nt, Human
uuuagcuggaaaaguauguuag

SEQ ID NO: 3858714 - RNA, 16 nt, Human
uuuagcuguguuauua

SEQ ID NO: 3858715 - RNA, 17 nt, Human
uuuagcuguguuauuau

SEQ ID NO: 3858716 - RNA, 22 nt, Human
uuuaggaaaaucacuuugucua

SEQ ID NO: 3858717 - RNA, 18 nt, Human
uuuaggaaaugaaugugu

SEQ ID NO: 3858718 - RNA, 17 nt, Human
uuuaggaacuucagaga

SEQ ID NO: 3858719 - RNA, 23 nt, Human
uuuaggagcuaaggcucuaugag

SEQ ID NO: 3858720 - RNA, 17 nt, Human
uuuaggauaaaauaaug

SEQ ID NO: 3858721 - RNA, 18 nt, Human
uuuaggcugguggcccag

SEQ ID NO: 3858722 - RNA, 23 nt, Human
uuuagggacucaauuucucccca

SEQ ID NO: 3858723 - RNA, 21 nt, Human
uuuagggagagucauauuuug

SEQ ID NO: 3858724 - RNA, 15 nt, Human
uuuagggcagcuugc

SEQ ID NO: 3858725 - RNA, 16 nt, Human
uuuagggccaggcagg

SEQ ID NO: 3858726 - RNA, 20 nt, Human
uuuaggguacuaaauuuaaa

SEQ ID NO: 3858727 - RNA, 22 nt, Human
uuuaggucaagaagaagaugga

SEQ ID NO: 3858728 - RNA, 18 nt, Human
uuuagguucuaaaguucu

SEQ ID NO: 3858729 - RNA, 22 nt, Human
uuuagguuuuuguuuguuuccu

SEQ ID NO: 3858730 - RNA, 13 nt, Human
uuuaguaaaccaa

SEQ ID NO: 3858731 - RNA, 16 nt, Human
uuuaguaaauguuauc

SEQ ID NO: 3858732 - RNA, 17 nt, Human
uuuaguaaauguuaucu

SEQ ID NO: 3858733 - RNA, 14 nt, Human
uuuaguaaucugua

SEQ ID NO: 3858734 - RNA, 15 nt, Human
uuuaguagagacagg

SEQ ID NO: 3858735 - RNA, 20 nt, Human
uuuaguauauuuauauaauu

SEQ ID NO: 3858736 - RNA, 15 nt, Human
uuuaguauuaucaaa

SEQ ID NO: 3858737 - RNA, 21 nt, Human
uuuaguauucauucugcauug

SEQ ID NO: 3858738 - RNA, 17 nt, Human
uuuagucuugucucaga

SEQ ID NO: 3858739 - RNA, 23 nt, Human
uuuagucuugucucagauuuuau

SEQ ID NO: 3858740 - RNA, 13 nt, Human
uuuaguggaaaau

SEQ ID NO: 3858741 - RNA, 20 nt, Human
uuuaguggacccugaaaugu

SEQ ID NO: 3858742 - RNA, 21 nt, Human
uuuaguggacccugaaaugug

SEQ ID NO: 3858743 - RNA, 13 nt, Human
uuuaguggcuuca

SEQ ID NO: 3858744 - RNA, 17 nt, Human
uuuaguguaaaaaugag

SEQ ID NO: 3858745 - RNA, 16 nt, Human
uuuaguuacagcugug

SEQ ID NO: 3858746 - RNA, 14 nt, Human
uuuaguuauaaagg

SEQ ID NO: 3858747 - RNA, 13 nt, Human
uuuaguuccugug

SEQ ID NO: 3858748 - RNA, 19 nt, Human
uuuaguuccugugcacagc

SEQ ID NO: 3858749 - RNA, 14 nt, Human
uuuaguugaauuuu

SEQ ID NO: 3858750 - RNA, 18 nt, Human
uuuaguugcaacuuugua

SEQ ID NO: 3858751 - RNA, 14 nt, Human
uuuaguuuacucaa

SEQ ID NO: 3858752 - RNA, 22 nt, Human
uuuaguuucuguucuguggaaa

SEQ ID NO: 3858753 - RNA, 19 nt, Human
uuuaguuuuauuuucuaaa

SEQ ID NO: 3858754 - RNA, 12 nt, Human
uuuaguuuuucu

SEQ ID NO: 3858755 - RNA, 15 nt, Human
uuuaguuuuuguucu

SEQ ID NO: 3858756 - RNA, 21 nt, Human
uuuauaaaaaaaaugaaaugu

SEQ ID NO: 3858757 - RNA, 14 nt, Human
uuuauaaaaagaua

SEQ ID NO: 3858758 - RNA, 22 nt, Human
uuuauaaaaauaaauagaaaag

SEQ ID NO: 3858759 - RNA, 23 nt, Human
uuuauaaaaauaaauagaaaagu

SEQ ID NO: 3858760 - RNA, 13 nt, Human
uuuauaaaacuuc

SEQ ID NO: 3858761 - RNA, 16 nt, Human
uuuauaaaauuagaaa

SEQ ID NO: 3858762 - RNA, 22 nt, Human
uuuauaaaauuagaaagcaacu

SEQ ID NO: 3858763 - RNA, 16 nt, Human
uuuauaaacagaaaug

SEQ ID NO: 3858764 - RNA, 23 nt, Human
uuuauaaacagaaauggaaagca

SEQ ID NO: 3858765 - RNA, 18 nt, Human
uuuauaaacagacaauau

SEQ ID NO: 3858766 - RNA, 22 nt, Human
uuuauaaacagacaauauguga

SEQ ID NO: 3858767 - RNA, 24 nt, Human
uuuauaaaguacccaucuaguacu

SEQ ID NO: 3858768 - RNA, 20 nt, Human
uuuauaaagugcuuguguaa

SEQ ID NO: 3858769 - RNA, 13 nt, Human
uuuauaaaugcua

SEQ ID NO: 3858770 - RNA, 13 nt, Human
uuuauaaauuaaa

SEQ ID NO: 3858771 - RNA, 18 nt, Human
uuuauaaauuaaauauau

SEQ ID NO: 3858772 - RNA, 16 nt, Human
uuuauaacucaucaua

SEQ ID NO: 3858773 - RNA, 17 nt, Human
uuuauaagaaaaacuuu

SEQ ID NO: 3858774 - RNA, 15 nt, Human
uuuauaagaaagccu

SEQ ID NO: 3858775 - RNA, 16 nt, Human
uuuauaagcaaauuuc

SEQ ID NO: 3858776 - RNA, 17 nt, Human
uuuauaagcaaauuuca

SEQ ID NO: 3858777 - RNA, 20 nt, Human
uuuauaagcaucauuauuua

SEQ ID NO: 3858778 - RNA, 21 nt, Human
uuuauaagcaucauuauuuau

SEQ ID NO: 3858779 - RNA, 22 nt, Human
uuuauaagcaucauuauuuaug

SEQ ID NO: 3858780 - RNA, 23 nt, Human
uuuauaagcaucauuauuuaugu

SEQ ID NO: 3858781 - RNA, 17 nt, Human
uuuauaaggacuuccug

SEQ ID NO: 3858782 - RNA, 17 nt, Human
uuuauaagucauuguau

SEQ ID NO: 3858783 - RNA, 14 nt, Human
uuucuuauugcgcu

SEQ ID NO: 3858784 - RNA, 17 nt, Human
uuucuuauugcgcugcu

SEQ ID NO: 3858785 - RNA, 18 nt, Human
uuucuuauuuaacuuaac

SEQ ID NO: 3858786 - RNA, 11 nt, Human
uuucuucaaaa

SEQ ID NO: 3858787 - RNA, 18 nt, Human
uuucuucaacaucaaugu

SEQ ID NO: 3858788 - RNA, 13 nt, Human
uuucuucacuuuu

SEQ ID NO: 3858789 - RNA, 12 nt, Human
uuucuucaugag

SEQ ID NO: 3858790 - RNA, 19 nt, Human
uuucuucaugcaaugacau

SEQ ID NO: 3858791 - RNA, 18 nt, Human
uuucuucccuguauuuuc

SEQ ID NO: 3858792 - RNA, 22 nt, Human
uuucuuccuaccaagucaaacu

SEQ ID NO: 3858793 - RNA, 11 nt, Human
uuucuuccucu

SEQ ID NO: 3858794 - RNA, 16 nt, Human
uuucuuccucugcuga

SEQ ID NO: 3858795 - RNA, 12 nt, Human
uuucuuccuggc

SEQ ID NO: 3858796 - RNA, 13 nt, Human
uuucuucuacuuu

SEQ ID NO: 3858797 - RNA, 12 nt, Human
uuucuucuaugu

SEQ ID NO: 3858798 - RNA, 23 nt, Human
uuucuucuguauuuuuuuuucua

SEQ ID NO: 3858799 - RNA, 22 nt, Human
uuucuugacucuuguuuucagu

SEQ ID NO: 3858800 - RNA, 19 nt, Human
uuucuugauaauuuuccuu

SEQ ID NO: 3858801 - RNA, 16 nt, Human
uuucuugcagaucaaa

SEQ ID NO: 3858802 - RNA, 23 nt, Human
uuucuugccaaugaggucugaaa

SEQ ID NO: 3858803 - RNA, 11 nt, Human
uuucuugcugg

SEQ ID NO: 3858804 - RNA, 21 nt, Human
uuucuugcugguugucauuuu

SEQ ID NO: 3858805 - RNA, 16 nt, Human
uuucuugcuuguaccu

SEQ ID NO: 3858806 - RNA, 19 nt, Human
uuucuuggcaaaagccuug

SEQ ID NO: 3858807 - RNA, 19 nt, Human
uuucuuggcccccuuccca

SEQ ID NO: 3858808 - RNA, 17 nt, Human
uuucuugguucauaaau

SEQ ID NO: 3858809 - RNA, 18 nt, Human
uuucuugguucauaaaug

SEQ ID NO: 3858810 - RNA, 19 nt, Human
uuucuugugcacuggcacc

SEQ ID NO: 3858811 - RNA, 20 nt, Human
uuucuugugcacuggcacca

SEQ ID NO: 3858812 - RNA, 13 nt, Human
uuucuuguuucuc

SEQ ID NO: 3858813 - RNA, 15 nt, Human
uuucuuuaaaagaau

SEQ ID NO: 3858814 - RNA, 12 nt, Human
uuucuuuaacug

SEQ ID NO: 3858815 - RNA, 13 nt, Human
uuucuuuaacugc

SEQ ID NO: 3858816 - RNA, 16 nt, Human
uuucuuuaagaaagua

SEQ ID NO: 3858817 - RNA, 13 nt, Human
uuucuuuaaugcu

SEQ ID NO: 3858818 - RNA, 15 nt, Human
uuucuuuacaaaaca

SEQ ID NO: 3858819 - RNA, 18 nt, Human
uuucuuuagagaacugaa

SEQ ID NO: 3858820 - RNA, 21 nt, Human
uuucuuuagagcauugccauu

SEQ ID NO: 3858821 - RNA, 21 nt, Human
uuucuuuaguuuuugugaagu

SEQ ID NO: 3858822 - RNA, 18 nt, Human
uuucuuuauauuuaucca

SEQ ID NO: 3858823 - RNA, 13 nt, Human
uuucuuucaacuu

SEQ ID NO: 3858824 - RNA, 16 nt, Human
uuucuuucacaaaaaa

SEQ ID NO: 3858825 - RNA, 13 nt, Human
uuucuuucuuaga

SEQ ID NO: 3858826 - RNA, 15 nt, Human
uuucuuucuuagaaa

SEQ ID NO: 3858827 - RNA, 13 nt, Human
uuucuuugaauaa

SEQ ID NO: 3858828 - RNA, 16 nt, Human
uuucuuugaauuuuca

SEQ ID NO: 3858829 - RNA, 12 nt, Human
uuucuuugauca

SEQ ID NO: 3858830 - RNA, 14 nt, Human
uuucuuugcaaagu

SEQ ID NO: 3858831 - RNA, 21 nt, Human
uuucuuugccuguucaguuac

SEQ ID NO: 3858832 - RNA, 19 nt, Human
uuucuuugggaauauuuga

SEQ ID NO: 3858833 - RNA, 23 nt, Human
uuucuuugggaauauuugaaucu

SEQ ID NO: 3858834 - RNA, 13 nt, Human
uuucuuuguggcu

SEQ ID NO: 3858835 - RNA, 15 nt, Human
uuucuuuguguagcu

SEQ ID NO: 3858836 - RNA, 18 nt, Human
uuucuuuguuucuuucuu

SEQ ID NO: 3858837 - RNA, 9 nt, Human
uuucuuuuc

SEQ ID NO: 3858838 - RNA, 21 nt, Human
uuucuuuucccccauuaauca

SEQ ID NO: 3858839 - RNA, 16 nt, Human
uuucuuuucucuggua

SEQ ID NO: 3858840 - RNA, 15 nt, Human
uuucuuuucuuuuua

SEQ ID NO: 3858841 - RNA, 16 nt, Human
uuucuuuuguaaaugu

SEQ ID NO: 3858842 - RNA, 14 nt, Human
uuucuuuuguaaua

SEQ ID NO: 3858843 - RNA, 15 nt, Human
uuucuuuuuaaagcu

SEQ ID NO: 3858844 - RNA, 20 nt, Human
uuucuuuuuaaguaaugugg

SEQ ID NO: 3858845 - RNA, 16 nt, Human
uuucuuuuugaaucuu

SEQ ID NO: 3858846 - RNA, 17 nt, Human
uuucuuuuugaaucuuu

SEQ ID NO: 3858847 - RNA, 19 nt, Human
uuucuuuuugaaucuuuaa

SEQ ID NO: 3858848 - RNA, 16 nt, Human
uuucuuuuuuaaauua

SEQ ID NO: 3858849 - RNA, 18 nt, Human
uuucuuuuuuuuuaaguu

SEQ ID NO: 3858850 - RNA, 14 nt, Human
uuugaaaaaagcuc

SEQ ID NO: 3858851 - RNA, 15 nt, Human
uuugaaaaaagcuca

SEQ ID NO: 3858852 - RNA, 16 nt, Human
uuugaaaaauuccuau

SEQ ID NO: 3858853 - RNA, 14 nt, Human
uuugaaaacagaaa

SEQ ID NO: 3858854 - RNA, 15 nt, Human
uuugaaaacauauaa

SEQ ID NO: 3858855 - RNA, 17 nt, Human
uuugaaaacauguuuau

SEQ ID NO: 3858856 - RNA, 19 nt, Human
uuugaaaacauguuuauuu

SEQ ID NO: 3858857 - RNA, 20 nt, Human
uuugaaaaccaacaccauca

SEQ ID NO: 3858858 - RNA, 22 nt, Human
uuugaaaaccaacaccaucaca

SEQ ID NO: 3858859 - RNA, 22 nt, Human
uuugaaaacucuguguuuggaa

SEQ ID NO: 3858860 - RNA, 19 nt, Human
uuugaaaacuucagaagca

SEQ ID NO: 3858861 - RNA, 23 nt, Human
uuugaaaagcuucuuaauuaauu

SEQ ID NO: 3858862 - RNA, 12 nt, Human
uuugaaaaguaa

SEQ ID NO: 3858863 - RNA, 14 nt, Human
uuugaaaaguaaua

SEQ ID NO: 3858864 - RNA, 15 nt, Human
uuugaaacaaagaag

SEQ ID NO: 3858865 - RNA, 19 nt, Human
uuugaaacacuuugcauaa

SEQ ID NO: 3858866 - RNA, 15 nt, Human
uuugaaacauugcuu

SEQ ID NO: 3858867 - RNA, 23 nt, Human
uuugaaacauugcuuuuaaaacu

SEQ ID NO: 3858868 - RNA, 21 nt, Human
uuugaaaggagaugucuugga

SEQ ID NO: 3858869 - RNA, 16 nt, Human
uuugaaagucuguccu

SEQ ID NO: 3858870 - RNA, 14 nt, Human
uuugaaauaauaaa

SEQ ID NO: 3858871 - RNA, 13 nt, Human
uuugaaauaccuc

SEQ ID NO: 3858872 - RNA, 20 nt, Human
uuugaaauagucugugugaa

SEQ ID NO: 3858873 - RNA, 14 nt, Human
uuugaaauauugac

SEQ ID NO: 3858874 - RNA, 20 nt, Human
uuugaaaugaggucuguuua

SEQ ID NO: 3858875 - RNA, 17 nt, Human
uuugaaauuauguaaau

SEQ ID NO: 3858876 - RNA, 22 nt, Human
uuugaaauuaugugacauuuua

SEQ ID NO: 3858877 - RNA, 11 nt, Human
uuugaaauucu

SEQ ID NO: 3858878 - RNA, 14 nt, Human
uuugaaauucugaa

SEQ ID NO: 3858879 - RNA, 15 nt, Human
uuugaaauucugaau

SEQ ID NO: 3858880 - RNA, 22 nt, Human
uuugaacaacuaggcuucagca

SEQ ID NO: 3858881 - RNA, 19 nt, Human
uuugaacacgaaagaaaug

SEQ ID NO: 3858882 - RNA, 21 nt, Human
uuugaacacgaaagaaaugua

SEQ ID NO: 3858883 - RNA, 16 nt, Human
uuugaaccaaaacauu

SEQ ID NO: 3858884 - RNA, 18 nt, Human
uuugaaccugaugaaaau

SEQ ID NO: 3858885 - RNA, 20 nt, Human
uuugaaccugaugaaaauaa

SEQ ID NO: 3858886 - RNA, 22 nt, Human
uuugaacuaagaaacuuuugua

SEQ ID NO: 3858887 - RNA, 15 nt, Human
uuugaacuaauaaaa

SEQ ID NO: 3858888 - RNA, 17 nt, Human
uuugaacucuucucauu

SEQ ID NO: 3858889 - RNA, 22 nt, Human
uuugaacucuucucauuacuug

SEQ ID NO: 3858890 - RNA, 19 nt, Human
uuugaacuggcaauugucu

SEQ ID NO: 3858891 - RNA, 14 nt, Human
uuugaacuuuuuau

SEQ ID NO: 3858892 - RNA, 18 nt, Human
uuugaagaacaugugaga

SEQ ID NO: 3858893 - RNA, 18 nt, Human
uuugaagagugaaauacc

SEQ ID NO: 3858894 - RNA, 18 nt, Human
uuugaagcaguuguguca

SEQ ID NO: 3858895 - RNA, 22 nt, Human
uuugaagccugcccuugucuga

SEQ ID NO: 3858896 - RNA, 18 nt, Human
uuugaagcuaauuauuuu

SEQ ID NO: 3858897 - RNA, 19 nt, Human
uuugaagcuaauuauuuua

SEQ ID NO: 3858898 - RNA, 16 nt, Human
uuugaagcuacugugu

SEQ ID NO: 3858899 - RNA, 18 nt, Human
uuugaagcugaaaauaua

SEQ ID NO: 3858900 - RNA, 23 nt, Human
uuugaaguaguuuguauaacuuc

SEQ ID NO: 3858901 - RNA, 22 nt, Human
uuugaagucauaccaaugaaaa

SEQ ID NO: 3858902 - RNA, 13 nt, Human
uuugaagucuugu

SEQ ID NO: 3858903 - RNA, 15 nt, Human
uuugaagucuuguau

SEQ ID NO: 3858904 - RNA, 16 nt, Human
uuugaagugcuguuua

SEQ ID NO: 3858905 - RNA, 13 nt, Human
uuugaaguguaau

SEQ ID NO: 3858906 - RNA, 18 nt, Human
uuugaaguguaggcagac

SEQ ID NO: 3858907 - RNA, 20 nt, Human
uuugaaguguaggcagacac

SEQ ID NO: 3858908 - RNA, 17 nt, Human
uuugaaguuuacauuuu

SEQ ID NO: 3858909 - RNA, 14 nt, Human
uuugaauaaagaau

SEQ ID NO: 3858910 - RNA, 13 nt, Human
uuugaauaaaugu

SEQ ID NO: 3858911 - RNA, 15 nt, Human
uuugaauaaauguca

SEQ ID NO: 3858912 - RNA, 15 nt, Human
uuugacaacaaauua

SEQ ID NO: 3858913 - RNA, 20 nt, Human
uuugacaacguuucagcgac

SEQ ID NO: 3858914 - RNA, 14 nt, Human
uuugacaaggggca

SEQ ID NO: 3858915 - RNA, 20 nt, Human
uuugacaccucuuuuuucgu

SEQ ID NO: 3858916 - RNA, 15 nt, Human
uuugacacuauaucu

SEQ ID NO: 3858917 - RNA, 18 nt, Human
uuugacacucugcagacu

SEQ ID NO: 3858918 - RNA, 13 nt, Human
uuugacacugaaa

SEQ ID NO: 3858919 - RNA, 15 nt, Human
uuugacacugcucua

SEQ ID NO: 3858920 - RNA, 20 nt, Human
uuugacagaauauguuucaa

SEQ ID NO: 3858921 - RNA, 18 nt, Human
uuugacagcgcacagcug

SEQ ID NO: 3858922 - RNA, 18 nt, Human
uuugacaguuauuuugau

SEQ ID NO: 3858923 - RNA, 16 nt, Human
uuugacauggaaauga

SEQ ID NO: 3858924 - RNA, 17 nt, Human
uuugacauuguauguau

SEQ ID NO: 3858925 - RNA, 18 nt, Human
uuugaccucacagugacc

SEQ ID NO: 3858926 - RNA, 18 nt, Human
uuugaccucugcagcaau

SEQ ID NO: 3858927 - RNA, 21 nt, Human
uuugaccucugcagcaauaaa

SEQ ID NO: 3858928 - RNA, 18 nt, Human
uuugaccuucauuucaug

SEQ ID NO: 3858929 - RNA, 19 nt, Human
uuugacgccaucccagccc

SEQ ID NO: 3858930 - RNA, 20 nt, Human
uuugacgccaucccagcccc

SEQ ID NO: 3858931 - RNA, 14 nt, Human
uuugacggaugauu

SEQ ID NO: 3858932 - RNA, 16 nt, Human
uuugacuaauuuuaca

SEQ ID NO: 3858933 - RNA, 19 nt, Human
uuugacuagaugauggaug

SEQ ID NO: 3858934 - RNA, 18 nt, Human
uuugacucuugcaaucca

SEQ ID NO: 3858935 - RNA, 19 nt, Human
uuugacugaagaugcagcu

SEQ ID NO: 3858936 - RNA, 19 nt, Human
uuugacuguuuuuacccau

SEQ ID NO: 3858937 - RNA, 16 nt, Human
uuugacuuaaugugau

SEQ ID NO: 3858938 - RNA, 22 nt, Human
uuugacuuucuucugaauauuu

SEQ ID NO: 3858939 - RNA, 22 nt, Human
uuugacuuuuuuuguaugugug

SEQ ID NO: 3858940 - RNA, 21 nt, Human
uuugagaaacaacaauuucua

SEQ ID NO: 3858941 - RNA, 13 nt, Human
uuugagaaaugca

SEQ ID NO: 3858942 - RNA, 23 nt, Human
uuugagaaauuuuuuuuuccagu

SEQ ID NO: 3858943 - RNA, 20 nt, Human
uuugagacagagucuuccuc

SEQ ID NO: 3858944 - RNA, 19 nt, Human
uuugagaccagccugggca

SEQ ID NO: 3858945 - RNA, 22 nt, Human
uuugagagagagucuuacucug

SEQ ID NO: 3858946 - RNA, 14 nt, Human
uuugagaguucuaa

SEQ ID NO: 3858947 - RNA, 16 nt, Human
uuugagaucuaaaaau

SEQ ID NO: 3858948 - RNA, 19 nt, Human
uuugagcucccacuucugc

SEQ ID NO: 3858949 - RNA, 17 nt, Human
uuugagcugccuucccu

SEQ ID NO: 3858950 - RNA, 22 nt, Human
uuugaggagcagcuucaguugu

SEQ ID NO: 3858951 - RNA, 16 nt, Human
uuugaggauuaguuua

SEQ ID NO: 3858952 - RNA, 20 nt, Human
uuugagggacugccucugcc

SEQ ID NO: 3858953 - RNA, 20 nt, Human
uuugaggucaaguaagaaga

SEQ ID NO: 3858954 - RNA, 22 nt, Human
uuugagucuuuuuuuuuuaagu

SEQ ID NO: 3858955 - RNA, 16 nt, Human
uuugagugauuauuug

SEQ ID NO: 3858956 - RNA, 13 nt, Human
uuugagugccuua

SEQ ID NO: 3858957 - RNA, 13 nt, Human
uuugagugcucug

SEQ ID NO: 3858958 - RNA, 16 nt, Human
uuugaguggaugaugu

SEQ ID NO: 3858959 - RNA, 20 nt, Human
uuugaguggaugauguuucg

SEQ ID NO: 3858960 - RNA, 14 nt, Human
uuugaguguuuuaa

SEQ ID NO: 3858961 - RNA, 19 nt, Human
uuugaguuauuuuaauuau

SEQ ID NO: 3858962 - RNA, 12 nt, Human
uuugaguucuac

SEQ ID NO: 3858963 - RNA, 21 nt, Human
uuugauaaaguaguaaaaauu

SEQ ID NO: 3858964 - RNA, 19 nt, Human
uuugauaaaguuucucaga

SEQ ID NO: 3858965 - RNA, 23 nt, Human
uuugauaacagggauugauuuua

SEQ ID NO: 3858966 - RNA, 14 nt, Human
uuugauaacuguuu

SEQ ID NO: 3858967 - RNA, 20 nt, Human
uuugauaacuguuuauaugu

SEQ ID NO: 3858968 - RNA, 22 nt, Human
uuugauaacuguuuauaugugu

SEQ ID NO: 3858969 - RNA, 14 nt, Human
uuugauaaugauaa

SEQ ID NO: 3858970 - RNA, 14 nt, Human
uuugauacauaaua

SEQ ID NO: 3858971 - RNA, 15 nt, Human
uuugauacauaauaa

SEQ ID NO: 3858972 - RNA, 14 nt, Human
uuugauacauuuuu

SEQ ID NO: 3858973 - RNA, 21 nt, Human
uuugauacuaagcauugaaug

SEQ ID NO: 3858974 - RNA, 17 nt, Human
uuugauacuuauauuuu

SEQ ID NO: 3858975 - RNA, 14 nt, Human
uuugauauaugaaa

SEQ ID NO: 3858976 - RNA, 17 nt, Human
uuugauauccaaagcug

SEQ ID NO: 3858977 - RNA, 18 nt, Human
uuugauaugaguauacaa

SEQ ID NO: 3858978 - RNA, 18 nt, Human
uuugauauggguaguauu

SEQ ID NO: 3858979 - RNA, 14 nt, Human
uuugauaugugaac

SEQ ID NO: 3858980 - RNA, 15 nt, Human
uuugauaugugaaca

SEQ ID NO: 3858981 - RNA, 14 nt, Human
uuugauccaagcug

SEQ ID NO: 3858982 - RNA, 15 nt, Human
uuugauccaagcugg

SEQ ID NO: 3858983 - RNA, 16 nt, Human
uuugaucucacauuuu

SEQ ID NO: 3858984 - RNA, 22 nt, Human
uuugaucuuccucugcuaaauu

SEQ ID NO: 3858985 - RNA, 18 nt, Human
uuugaugcuucuuugaaa

SEQ ID NO: 3858986 - RNA, 20 nt, Human
uuugaugucagcaguugcug

SEQ ID NO: 3858987 - RNA, 15 nt, Human
uuugauguuaacaca

SEQ ID NO: 3858988 - RNA, 17 nt, Human
uuugauguuaacacauu

SEQ ID NO: 3858989 - RNA, 15 nt, Human
uuugauguuccuucc

SEQ ID NO: 3858990 - RNA, 21 nt, Human
uuugauguucuuucacccuuu

SEQ ID NO: 3858991 - RNA, 22 nt, Human
uuugauguucuuucacccuuuu

SEQ ID NO: 3858992 - RNA, 14 nt, Human
uuugauuaacaaau

SEQ ID NO: 3858993 - RNA, 17 nt, Human
uuugauuauuugcaugu

SEQ ID NO: 3858994 - RNA, 20 nt, Human
uuugauuauuugcauguuau

SEQ ID NO: 3858995 - RNA, 22 nt, Human
uuugauucacauguuuucaaau

SEQ ID NO: 3858996 - RNA, 15 nt, Human
uuugauucagacagc

SEQ ID NO: 3858997 - RNA, 18 nt, Human
uuugauucagacagcugc

SEQ ID NO: 3858998 - RNA, 22 nt, Human
uuugauucagacagcugccugg

SEQ ID NO: 3858999 - RNA, 17 nt, Human
uuugauugggaugaaug

SEQ ID NO: 3859000 - RNA, 14 nt, Human
uuugauuuaauguu

SEQ ID NO: 3859001 - RNA, 13 nt, Human
uuugauuuacaua

SEQ ID NO: 3859002 - RNA, 17 nt, Human
uuugauuuagauugagu

SEQ ID NO: 3859003 - RNA, 13 nt, Human
uuugauuuauuaa

SEQ ID NO: 3859004 - RNA, 16 nt, Human
uuugauuuauuaacuu

SEQ ID NO: 3859005 - RNA, 21 nt, Human
uuugauuuauuaacuuaauaa

SEQ ID NO: 3859006 - RNA, 16 nt, Human
uuugcaaaguacugua

SEQ ID NO: 3859007 - RNA, 15 nt, Human
uuugcaaccaggaac

SEQ ID NO: 3859008 - RNA, 23 nt, Human
uuugcaaccaggaacagcaaaug

SEQ ID NO: 3859009 - RNA, 17 nt, Human
uuugcaacuuaauacuc

SEQ ID NO: 3859010 - RNA, 12 nt, Human
uuugcaaggaag

SEQ ID NO: 3859011 - RNA, 14 nt, Human
uuugcaaggaagcc

SEQ ID NO: 3859012 - RNA, 24 nt, Human
uuugcaaggugcauuuuuacuauu

SEQ ID NO: 3859013 - RNA, 15 nt, Human
uuugcaagugaaggu

SEQ ID NO: 3859014 - RNA, 18 nt, Human
uuugcaauaaaaaugaua

SEQ ID NO: 3859015 - RNA, 17 nt, Human
uuugcaauaacagcugc

SEQ ID NO: 3859016 - RNA, 15 nt, Human
uuugcaauaaugcag

SEQ ID NO: 3859017 - RNA, 16 nt, Human
uuugcaauaaugcagu

SEQ ID NO: 3859018 - RNA, 12 nt, Human
uuugcaccccuc

SEQ ID NO: 3859019 - RNA, 16 nt, Human
uuugcaccugcucucu

SEQ ID NO: 3859020 - RNA, 21 nt, Human
uuugcaccuuucuaguugaaa

SEQ ID NO: 3859021 - RNA, 14 nt, Human
uuugcacuaaauca

SEQ ID NO: 3859022 - RNA, 19 nt, Human
uuugcacuaaaucagagac

SEQ ID NO: 3859023 - RNA, 19 nt, Human
uuugcacucaaaucuuaag

SEQ ID NO: 3859024 - RNA, 21 nt, Human
uuugcacucaaaucuuaagaa

SEQ ID NO: 3859025 - RNA, 23 nt, Human
uuugcacucuuguuucucccgug

SEQ ID NO: 3859026 - RNA, 16 nt, Human
uuugcacugagggcca

SEQ ID NO: 3859027 - RNA, 20 nt, Human
uuugcacuggaguucuaugc

SEQ ID NO: 3859028 - RNA, 22 nt, Human
uuugcacuuuuucuuaaucauu

SEQ ID NO: 3859029 - RNA, 21 nt, Human
uuugcagcagugagucucuuc

SEQ ID NO: 3859030 - RNA, 12 nt, Human
uuuguggaauaa

SEQ ID NO: 3859031 - RNA, 20 nt, Human
uuuguggcagaaguguuuca

SEQ ID NO: 3859032 - RNA, 20 nt, Human
uuuguggccaaggagcugcu

SEQ ID NO: 3859033 - RNA, 12 nt, Human
uuuguggccuca

SEQ ID NO: 3859034 - RNA, 14 nt, Human
uuuguggccucaga

SEQ ID NO: 3859035 - RNA, 15 nt, Human
uuuguggccucagaa

SEQ ID NO: 3859036 - RNA, 14 nt, Human
uuugugggaauuua

SEQ ID NO: 3859037 - RNA, 20 nt, Human
uuuguggggcuuggcgugga

SEQ ID NO: 3859038 - RNA, 16 nt, Human
uuuguggugauauaga

SEQ ID NO: 3859039 - RNA, 13 nt, Human
uuuguggugauuu

SEQ ID NO: 3859040 - RNA, 16 nt, Human
uuugugguuuggaaua

SEQ ID NO: 3859041 - RNA, 17 nt, Human
uuuguguaauaaagugu

SEQ ID NO: 3859042 - RNA, 16 nt, Human
uuuguguaaugaaaau

SEQ ID NO: 3859043 - RNA, 11 nt, Human
uuuguguccuc

SEQ ID NO: 3859044 - RNA, 15 nt, Human
uuugugugaaauaau

SEQ ID NO: 3859045 - RNA, 13 nt, Human
uuugugugauuga

SEQ ID NO: 3859046 - RNA, 18 nt, Human
uuugugugcuaaacgugu

SEQ ID NO: 3859047 - RNA, 13 nt, Human
uuugugugucuua

SEQ ID NO: 3859048 - RNA, 15 nt, Human
uuuguguguguguca

SEQ ID NO: 3859049 - RNA, 18 nt, Human
uuuguguguuacaaugua

SEQ ID NO: 3859050 - RNA, 23 nt, Human
uuuguguguucacuaaacucuga

SEQ ID NO: 3859051 - RNA, 17 nt, Human
uuuguguguugucuuga

SEQ ID NO: 3859052 - RNA, 20 nt, Human
uuuguguuguuggaaaaagu

SEQ ID NO: 3859053 - RNA, 21 nt, Human
uuuguguuguuggaaaaaguc

SEQ ID NO: 3859054 - RNA, 15 nt, Human
uuuguguuuauucuu

SEQ ID NO: 3859055 - RNA, 13 nt, Human
uuuguuaaauaau

SEQ ID NO: 3859056 - RNA, 14 nt, Human
uuuguuaaauauuu

SEQ ID NO: 3859057 - RNA, 18 nt, Human
uuuguuaaauauuuacau

SEQ ID NO: 3859058 - RNA, 12 nt, Human
uuuguuaauuua

SEQ ID NO: 3859059 - RNA, 18 nt, Human
uuuguuaccuuaaaacua

SEQ ID NO: 3859060 - RNA, 21 nt, Human
uuuguuacucucuuccacaug

SEQ ID NO: 3859061 - RNA, 15 nt, Human
uuuguuacuguucuu

SEQ ID NO: 3859062 - RNA, 19 nt, Human
uuuguuacuguucuugcug

SEQ ID NO: 3859063 - RNA, 17 nt, Human
uuuguuaggauuuucac

SEQ ID NO: 3859064 - RNA, 21 nt, Human
uuuguuaguuccuguaugaaa

SEQ ID NO: 3859065 - RNA, 17 nt, Human
uuuguuauaccauuucc

SEQ ID NO: 3859066 - RNA, 17 nt, Human
uuuguuauuuguacagu

SEQ ID NO: 3859067 - RNA, 18 nt, Human
uuuguuauuuguacaguu

SEQ ID NO: 3859068 - RNA, 23 nt, Human
uuuguucaaguuuuggguauguu

SEQ ID NO: 3859069 - RNA, 19 nt, Human
uuuguucacugaaggugau

SEQ ID NO: 3859070 - RNA, 14 nt, Human
uuuguucauauuaa

SEQ ID NO: 3859071 - RNA, 18 nt, Human
uuuguuccagaaucugua

SEQ ID NO: 3859072 - RNA, 14 nt, Human
uuuguucccauccu

SEQ ID NO: 3859073 - RNA, 23 nt, Human
uuuguucccauccucuucuuuua

SEQ ID NO: 3859074 - RNA, 16 nt, Human
uuuguuccccuccucc

SEQ ID NO: 3859075 - RNA, 13 nt, Human
uuuguucccggcu

SEQ ID NO: 3859076 - RNA, 20 nt, Human
uuuguucgcauggucacaca

SEQ ID NO: 3859077 - RNA, 12 nt, Human
uuuguucucugu

SEQ ID NO: 3859078 - RNA, 15 nt, Human
uuuguucuuacacau

SEQ ID NO: 3859079 - RNA, 15 nt, Human
uuuguucuucaagaa

SEQ ID NO: 3859080 - RNA, 15 nt, Human
uuuguucuucuuaaa

SEQ ID NO: 3859081 - RNA, 15 nt, Human
uuuguugaaauuaug

SEQ ID NO: 3859082 - RNA, 15 nt, Human
uuuguugaacuguua

SEQ ID NO: 3859083 - RNA, 17 nt, Human
uuuguugacauucugaa

SEQ ID NO: 3859084 - RNA, 23 nt, Human
uuuguugagcugguaacaucguu

SEQ ID NO: 3859085 - RNA, 21 nt, Human
uuuguugcacugaaguuugau

SEQ ID NO: 3859086 - RNA, 22 nt, Human
uuuguugcacugaaguuugaua

SEQ ID NO: 3859087 - RNA, 19 nt, Human
uuuguugccagauuucaga

SEQ ID NO: 3859088 - RNA, 20 nt, Human
uuuguugccagauuucagaa

SEQ ID NO: 3859089 - RNA, 22 nt, Human
uuuguugcguuccuuucuuuuc

SEQ ID NO: 3859090 - RNA, 18 nt, Human
uuuguuguacuuaaaugg

SEQ ID NO: 3859091 - RNA, 13 nt, Human
uuuguugugugcc

SEQ ID NO: 3859092 - RNA, 22 nt, Human
uuuguuuaauuuuuauuucuuc

SEQ ID NO: 3859093 - RNA, 17 nt, Human
uuuguuuauuaaauagu

SEQ ID NO: 3859094 - RNA, 18 nt, Human
uuuguuuauuagaugaau

SEQ ID NO: 3859095 - RNA, 13 nt, Human
uuuguuucauauu

SEQ ID NO: 3859096 - RNA, 15 nt, Human
uuuguuuccuuuguu

SEQ ID NO: 3859097 - RNA, 18 nt, Human
uuuguuucucccccuggg

SEQ ID NO: 3859098 - RNA, 16 nt, Human
uuuguuucugaaaggg

SEQ ID NO: 3859099 - RNA, 17 nt, Human
uuuguuucuuucucuga

SEQ ID NO: 3859100 - RNA, 13 nt, Human
uuuguuugaacug

SEQ ID NO: 3859101 - RNA, 14 nt, Human
uuuguuugaacuga

SEQ ID NO: 3859102 - RNA, 18 nt, Human
uuuguuugaacugauaaa

SEQ ID NO: 3859103 - RNA, 21 nt, Human
uuuguuuggauguaauuuagg

SEQ ID NO: 3859104 - RNA, 16 nt, Human
uuuguuugguauugua

SEQ ID NO: 3859105 - RNA, 22 nt, Human
uuuguuugguuauagugcaaua

SEQ ID NO: 3859106 - RNA, 12 nt, Human
uuuguuugucug

SEQ ID NO: 3859107 - RNA, 13 nt, Human
uuuguuugugcau

SEQ ID NO: 3859108 - RNA, 16 nt, Human
uuuguuuguucuuguu

SEQ ID NO: 3859109 - RNA, 18 nt, Human
uuuguuuuacaaugucau

SEQ ID NO: 3859110 - RNA, 14 nt, Human
uuuguuuugugucu

SEQ ID NO: 3859111 - RNA, 15 nt, Human
uuuguuuugugucuc

SEQ ID NO: 3859112 - RNA, 14 nt, Human
uuuguuuuguugca

SEQ ID NO: 3859113 - RNA, 19 nt, Human
uuuguuuuuaaacuguaca

SEQ ID NO: 3859114 - RNA, 23 nt, Human
uuuguuuuuaaacuguacagugu

SEQ ID NO: 3859115 - RNA, 14 nt, Human
uuuguuuuucauuc

SEQ ID NO: 3859116 - RNA, 16 nt, Human
uuuucauauugugcca

SEQ ID NO: 3859117 - RNA, 15 nt, Human
uuuucauauuuuaau

SEQ ID NO: 3859118 - RNA, 16 nt, Human
uuuucauauuuuaauu

SEQ ID NO: 3859119 - RNA, 22 nt, Human
uuuucauauuuuaauuucaagc

SEQ ID NO: 3859120 - RNA, 20 nt, Human
uuuucauccauaacugaaca

SEQ ID NO: 3859121 - RNA, 14 nt, Human
uuuucaucugggaa

SEQ ID NO: 3859122 - RNA, 14 nt, Human
uuuucaucuucagu

SEQ ID NO: 3859123 - RNA, 19 nt, Human
uuuucaucuucaguugucu

SEQ ID NO: 3859124 - RNA, 17 nt, Human
uuuucaugcaaacucuu

SEQ ID NO: 3859125 - RNA, 14 nt, Human
uuuucaugugugau

SEQ ID NO: 3859126 - RNA, 20 nt, Human
uuuucauguuuuaacaaaaa

SEQ ID NO: 3859127 - RNA, 14 nt, Human
uuuucauuaaauaa

SEQ ID NO: 3859128 - RNA, 16 nt, Human
uuuucauuacaaugga

SEQ ID NO: 3859129 - RNA, 21 nt, Human
uuuucauuagcaaaaaaaguu

SEQ ID NO: 3859130 - RNA, 21 nt, Human
uuuucauuauuuuauuaugaa

SEQ ID NO: 3859131 - RNA, 14 nt, Human
uuuucauucucauu

SEQ ID NO: 3859132 - RNA, 13 nt, Human
uuuucauuguaaa

SEQ ID NO: 3859133 - RNA, 15 nt, Human
uuuucauuuuccaau

SEQ ID NO: 3859134 - RNA, 15 nt, Human
uuuuccaaaaaaaua

SEQ ID NO: 3859135 - RNA, 13 nt, Human
uuuuccaaaacaa

SEQ ID NO: 3859136 - RNA, 13 nt, Human
uuuuccaaacuga

SEQ ID NO: 3859137 - RNA, 19 nt, Human
uuuuccaaagagugauagu

SEQ ID NO: 3859138 - RNA, 14 nt, Human
uuuuccaacuacua

SEQ ID NO: 3859139 - RNA, 15 nt, Human
uuuuccaaugucugc

SEQ ID NO: 3859140 - RNA, 15 nt, Human
uuuuccacccuggaa

SEQ ID NO: 3859141 - RNA, 18 nt, Human
uuuuccacuccauugucg

SEQ ID NO: 3859142 - RNA, 13 nt, Human
uuuuccacuuugu

SEQ ID NO: 3859143 - RNA, 20 nt, Human
uuuuccagcuggaugagaau

SEQ ID NO: 3859144 - RNA, 12 nt, Human
uuuuccaggcug

SEQ ID NO: 3859145 - RNA, 19 nt, Human
uuuuccaggcuucugcugg

SEQ ID NO: 3859146 - RNA, 20 nt, Human
uuuuccaggcuucugcuggg

SEQ ID NO: 3859147 - RNA, 23 nt, Human
uuuuccaguaaugagcuuaagaa

SEQ ID NO: 3859148 - RNA, 17 nt, Human
uuuuccaguauuuuagu

SEQ ID NO: 3859149 - RNA, 15 nt, Human
uuuuccagucucuug

SEQ ID NO: 3859150 - RNA, 16 nt, Human
uuuuccaucauaauuc

SEQ ID NO: 3859151 - RNA, 18 nt, Human
uuuuccaugaaaaugcaa

SEQ ID NO: 3859152 - RNA, 19 nt, Human
uuuuccaugaguccccugu

SEQ ID NO: 3859153 - RNA, 15 nt, Human
uuuuccauuuuauaa

SEQ ID NO: 3859154 - RNA, 13 nt, Human
uuuucccaaagcc

SEQ ID NO: 3859155 - RNA, 14 nt, Human
uuuucccaauaaau

SEQ ID NO: 3859156 - RNA, 13 nt, Human
uuuucccacugca

SEQ ID NO: 3859157 - RNA, 22 nt, Human
uuuucccacugcacccccuccu

SEQ ID NO: 3859158 - RNA, 23 nt, Human
uuuucccagacuacuauuuucuu

SEQ ID NO: 3859159 - RNA, 20 nt, Human
uuuucccagauacuucccau

SEQ ID NO: 3859160 - RNA, 15 nt, Human
uuuucccaggaaaga

SEQ ID NO: 3859161 - RNA, 22 nt, Human
uuuucccauuuaucuaaauaug

SEQ ID NO: 3859162 - RNA, 16 nt, Human
uuuuccccccuagaaa

SEQ ID NO: 3859163 - RNA, 19 nt, Human
uuuucccccuuuucugcau

SEQ ID NO: 3859164 - RNA, 23 nt, Human
uuuuccccggucccuugagaccu

SEQ ID NO: 3859165 - RNA, 15 nt, Human
uuuuccccuuucugu

SEQ ID NO: 3859166 - RNA, 18 nt, Human
uuuucccuauuagagaag

SEQ ID NO: 3859167 - RNA, 16 nt, Human
uuuucccucagaaaau

SEQ ID NO: 3859168 - RNA, 17 nt, Human
uuuuccuaaagagagua

SEQ ID NO: 3859169 - RNA, 14 nt, Human
uuuuccuaaaugca

SEQ ID NO: 3859170 - RNA, 20 nt, Human
uuuuccuaauaaaguucugu

SEQ ID NO: 3859171 - RNA, 17 nt, Human
uuuuccuacaggcaguc

SEQ ID NO: 3859172 - RNA, 11 nt, Human
uuuuccuauau

SEQ ID NO: 3859173 - RNA, 19 nt, Human
uuuuccuaugcuauugaca

SEQ ID NO: 3859174 - RNA, 13 nt, Human
uuuuccuauuugu

SEQ ID NO: 3859175 - RNA, 18 nt, Human
uuuuccuauuuucagccc

SEQ ID NO: 3859176 - RNA, 14 nt, Human
uuuuccucuuguga

SEQ ID NO: 3859177 - RNA, 16 nt, Human
uuuuccucuugugauu

SEQ ID NO: 3859178 - RNA, 14 nt, Human
uuuuccugaaaacc

SEQ ID NO: 3859179 - RNA, 12 nt, Human
uuuuccugcuuc

SEQ ID NO: 3859180 - RNA, 12 nt, Human
uuuuccuuacau

SEQ ID NO: 3859181 - RNA, 14 nt, Human
uuuuccuuacauaa

SEQ ID NO: 3859182 - RNA, 15 nt, Human
uuuuccuuacauaaa

SEQ ID NO: 3859183 - RNA, 21 nt, Human
uuuuccuuccaaugucuggag

SEQ ID NO: 3859184 - RNA, 16 nt, Human
uuuuccuuguccccac

SEQ ID NO: 3859185 - RNA, 13 nt, Human
uuuuccuuugugg

SEQ ID NO: 3859186 - RNA, 19 nt, Human
uuuucgaagcucagcccac

SEQ ID NO: 3859187 - RNA, 19 nt, Human
uuuucguaugaaaaugagu

SEQ ID NO: 3859188 - RNA, 16 nt, Human
uuuucguuaacauuga

SEQ ID NO: 3859189 - RNA, 12 nt, Human
uuuucguuuguu

SEQ ID NO: 3859190 - RNA, 20 nt, Human
uuuucuaaacguaagcacug

SEQ ID NO: 3859191 - RNA, 21 nt, Human
uuuucuaaacguaagcacugu

SEQ ID NO: 3859192 - RNA, 22 nt, Human
uuuucuaaacguaagcacuguu

SEQ ID NO: 3859193 - RNA, 20 nt, Human
uuuucuaaaggaguuuaugu

SEQ ID NO: 3859194 - RNA, 14 nt, Human
uuuucuaaccuuga

SEQ ID NO: 3859195 - RNA, 21 nt, Human
uuuucuaagcaauuucuugcu

SEQ ID NO: 3859196 - RNA, 13 nt, Human
uuuucuacaaaua

SEQ ID NO: 3859197 - RNA, 18 nt, Human
uuuucuacagugguuuua

SEQ ID NO: 3859198 - RNA, 17 nt, Human
uuuucuacccuagccau

SEQ ID NO: 3859199 - RNA, 15 nt, Human
uuuucuacuguuuua

SEQ ID NO: 3859200 - RNA, 13 nt, Human
uuuucuagacuuu

SEQ ID NO: 3859201 - RNA, 15 nt, Human
uuuucuagauacaau

SEQ ID NO: 3859202 - RNA, 18 nt, Human
uuuucuagauacaauaaa

SEQ ID NO: 3859203 - RNA, 22 nt, Human
uuuucuagccuauuuaccugca

SEQ ID NO: 3859204 - RNA, 20 nt, Human
uuuucuaguguaucaaaaug

SEQ ID NO: 3859205 - RNA, 16 nt, Human
uuuucuaguuugcuca

SEQ ID NO: 3859206 - RNA, 11 nt, Human
uuuucuauuaa

SEQ ID NO: 3859207 - RNA, 12 nt, Human
uuuucuauuaaa

SEQ ID NO: 3859208 - RNA, 15 nt, Human
uuuucuauuaaaaga

SEQ ID NO: 3859209 - RNA, 20 nt, Human
uuuucuauuaaaagacucau

SEQ ID NO: 3859210 - RNA, 19 nt, Human
uuuucuauuauuuuuauaa

SEQ ID NO: 3859211 - RNA, 19 nt, Human
uuuucucacagaagaugaa

SEQ ID NO: 3859212 - RNA, 17 nt, Human
uuuucuccacuuuguug

SEQ ID NO: 3859213 - RNA, 21 nt, Human
uuuucuccucacuguauccag

SEQ ID NO: 3859214 - RNA, 11 nt, Human
uuuucuccuga

SEQ ID NO: 3859215 - RNA, 17 nt, Human
uuuucucugaacacauu

SEQ ID NO: 3859216 - RNA, 20 nt, Human
uuuucucugcauuuaaaaaa

SEQ ID NO: 3859217 - RNA, 14 nt, Human
uuuucucugguaau

SEQ ID NO: 3859218 - RNA, 21 nt, Human
uuuucucugguaauauugacu

SEQ ID NO: 3859219 - RNA, 14 nt, Human
uuuucucuguacuu

SEQ ID NO: 3859220 - RNA, 15 nt, Human
uuuucucuuucucuc

SEQ ID NO: 3859221 - RNA, 15 nt, Human
uuuucugaaacuaau

SEQ ID NO: 3859222 - RNA, 17 nt, Human
uuuucugaauaacauuu

SEQ ID NO: 3859223 - RNA, 12 nt, Human
uuuucugagccc

SEQ ID NO: 3859224 - RNA, 18 nt, Human
uuuucugauauguuugua

SEQ ID NO: 3859225 - RNA, 19 nt, Human
uuuucugauccaguuuugu

SEQ ID NO: 3859226 - RNA, 17 nt, Human
uuuucugauuagcuuug

SEQ ID NO: 3859227 - RNA, 23 nt, Human
uuuucugauuguaacguugcugu

SEQ ID NO: 3859228 - RNA, 13 nt, Human
uuuucugcacuga

SEQ ID NO: 3859229 - RNA, 15 nt, Human
uuuucugcccuggcu

SEQ ID NO: 3859230 - RNA, 16 nt, Human
uuuucugcccuggcug

SEQ ID NO: 3859231 - RNA, 12 nt, Human
uuuucugcuuua

SEQ ID NO: 3859232 - RNA, 15 nt, Human
uuuucugcuuuagac

SEQ ID NO: 3859233 - RNA, 19 nt, Human
uuuucugcuuuagacuuga

SEQ ID NO: 3859234 - RNA, 16 nt, Human
uuuucugcuuuugaaa

SEQ ID NO: 3859235 - RNA, 21 nt, Human
uuuucuggaauacaugaaaua

SEQ ID NO: 3859236 - RNA, 23 nt, Human
uuuucuggggaaagacacugccu

SEQ ID NO: 3859237 - RNA, 16 nt, Human
uuuucugguagauaga

SEQ ID NO: 3859238 - RNA, 17 nt, Human
uuuucugguucuaacau

SEQ ID NO: 3859239 - RNA, 14 nt, Human
uuuucuguaauuca

SEQ ID NO: 3859240 - RNA, 21 nt, Human
uuuucuguaccaguuaauuuu

SEQ ID NO: 3859241 - RNA, 11 nt, Human
uuuucuguacu

SEQ ID NO: 3859242 - RNA, 12 nt, Human
uuuucuguauuu

SEQ ID NO: 3859243 - RNA, 17 nt, Human
uuuucugucucugccuc

SEQ ID NO: 3859244 - RNA, 22 nt, Human
uuuucuguguaaccauuuuaua

SEQ ID NO: 3859245 - RNA, 11 nt, Human
uuuucugugug

SEQ ID NO: 3859246 - RNA, 12 nt, Human
uuuucugugugu

SEQ ID NO: 3859247 - RNA, 18 nt, Human
uuuucuguguguuccugg

SEQ ID NO: 3859248 - RNA, 23 nt, Human
uuuucuguugaaguuuacaauca

SEQ ID NO: 3859249 - RNA, 14 nt, Human
uuuucuguuucugu

SEQ ID NO: 3859250 - RNA, 13 nt, Human
uuuucuuaaagug

SEQ ID NO: 3859251 - RNA, 16 nt, Human
uuuucuuaaagugcca

SEQ ID NO: 3859252 - RNA, 18 nt, Human
uuuucuuaaagugccagu

SEQ ID NO: 3859253 - RNA, 21 nt, Human
uuuucuucaacaucaauguuc

SEQ ID NO: 3859254 - RNA, 17 nt, Human
uuuucuucacucaaauu

SEQ ID NO: 3859255 - RNA, 16 nt, Human
uuuucuucaugcaaug

SEQ ID NO: 3859256 - RNA, 11 nt, Human
uuuucuuccuu

SEQ ID NO: 3859257 - RNA, 14 nt, Human
uuuucuucuucccu

SEQ ID NO: 3859258 - RNA, 15 nt, Human
uuuucuucuucccuc

SEQ ID NO: 3859259 - RNA, 17 nt, Human
uuuucuugcaugaggcu

SEQ ID NO: 3859260 - RNA, 21 nt, Human
uuuucuugccaaugaggucug

SEQ ID NO: 3859261 - RNA, 19 nt, Human
uuuucuugccucugucccc

SEQ ID NO: 3859262 - RNA, 20 nt, Human
uuuucuugcuuaccuugacu

SEQ ID NO: 3859263 - RNA, 19 nt, Human
uuuucuuggcaaaagccuu

SEQ ID NO: 3859264 - RNA, 21 nt, Human
uuuucuuggcaaaagccuugu

SEQ ID NO: 3859265 - RNA, 24 nt, Human
uuuucuuggcaaaagccuugugua

SEQ ID NO: 3859266 - RNA, 18 nt, Human
uuuucuuguuuaucagca

SEQ ID NO: 3859267 - RNA, 12 nt, Human
uuuucuuuaaaa

SEQ ID NO: 3859268 - RNA, 16 nt, Human
uuuucuuuaaaagaau

SEQ ID NO: 3859269 - RNA, 14 nt, Human
uuuucuuuaacugc

SEQ ID NO: 3859270 - RNA, 18 nt, Human
uuuucuuuaacugccgua

SEQ ID NO: 3859271 - RNA, 16 nt, Human
uuuucuuuaaugcuuu

SEQ ID NO: 3859272 - RNA, 19 nt, Human
uuuucuuuagagaacugaa

SEQ ID NO: 3859273 - RNA, 11 nt, Human
uuuucuuucuc

SEQ ID NO: 3859274 - RNA, 14 nt, Human
uuuucuuugaaauu

SEQ ID NO: 3859275 - RNA, 15 nt, Human
uuuucuuugaauaaa

SEQ ID NO: 3859276 - RNA, 20 nt, Human
uuuucuuugaauaaauguca

SEQ ID NO: 3859277 - RNA, 17 nt, Human
uuuucuuugaaugcuuu

SEQ ID NO: 3859278 - RNA, 15 nt, Human
uuuucuuugcaaagu

SEQ ID NO: 3859279 - RNA, 20 nt, Human
uuuucuuuguaucauucauc

SEQ ID NO: 3859280 - RNA, 16 nt, Human
uuuucuuuguguagcu

SEQ ID NO: 3859281 - RNA, 13 nt, Human
uuuucuuuuaaga

SEQ ID NO: 3859282 - RNA, 14 nt, Human
uuuucuuuuguuac

SEQ ID NO: 3859283 - RNA, 20 nt, Human
uuuucuuuuguuuuuugaag

SEQ ID NO: 3859284 - RNA, 15 nt, Human
uuuucuuuuuacaua

SEQ ID NO: 3859285 - RNA, 16 nt, Human
uuuugaaaaaagcuca

SEQ ID NO: 3859286 - RNA, 23 nt, Human
uuuugaaaagcuauuagccagga

SEQ ID NO: 3859287 - RNA, 21 nt, Human
uuuugaaaagcuucuuaauua

SEQ ID NO: 3859288 - RNA, 15 nt, Human
uuuugaaacugcauu

SEQ ID NO: 3859289 - RNA, 12 nt, Human
uuuugaaagaau

SEQ ID NO: 3859290 - RNA, 22 nt, Human
uuuugaaauauuaaacccugga

SEQ ID NO: 3859291 - RNA, 17 nt, Human
uuuugaaaugaaauuua

SEQ ID NO: 3859292 - RNA, 22 nt, Human
uuuugaaaugaaauuuaaacau

SEQ ID NO: 3859293 - RNA, 13 nt, Human
uuuugaaauguca

SEQ ID NO: 3859294 - RNA, 17 nt, Human
uucagaucagugcuuga

SEQ ID NO: 3859295 - RNA, 16 nt, Human
uucagaucauggcauc

SEQ ID NO: 3859296 - RNA, 14 nt, Human
uucagauccuaccc

SEQ ID NO: 3859297 - RNA, 18 nt, Human
uucagaugccacuucuaa

SEQ ID NO: 3859298 - RNA, 14 nt, Human
uucagaugcuuuag

SEQ ID NO: 3859299 - RNA, 14 nt, Human
uucagauguaaugu

SEQ ID NO: 3859300 - RNA, 23 nt, Human
uucagaugucuucugccuguuau

SEQ ID NO: 3859301 - RNA, 15 nt, Human
uucagaugugaacca

SEQ ID NO: 3859302 - RNA, 16 nt, Human
uucagauguggagcca

SEQ ID NO: 3859303 - RNA, 21 nt, Human
uucagauucaggcauuuuccc

SEQ ID NO: 3859304 - RNA, 19 nt, Human
uucagauuggacauaacug

SEQ ID NO: 3859305 - RNA, 20 nt, Human
uucagauuguggaauguugg

SEQ ID NO: 3859306 - RNA, 15 nt, Human
uucagauuucucuuu

SEQ ID NO: 3859307 - RNA, 17 nt, Human
uucagauuucucuuuga

SEQ ID NO: 3859308 - RNA, 19 nt, Human
uucagauuucucuuugaaa

SEQ ID NO: 3859309 - RNA, 18 nt, Human
uucagauuugcacaaaaa

SEQ ID NO: 3859310 - RNA, 16 nt, Human
uucagauuugccuuau

SEQ ID NO: 3859311 - RNA, 12 nt, Human
uucagauuuggc

SEQ ID NO: 3859312 - RNA, 20 nt, Human
uucagauuuuaaaaagucuu

SEQ ID NO: 3859313 - RNA, 22 nt, Human
uucagauuuugauaacuguuua

SEQ ID NO: 3859314 - RNA, 17 nt, Human
uucagcaaaaauauuuu

SEQ ID NO: 3859315 - RNA, 19 nt, Human
uucagcaaaaauauuuuau

SEQ ID NO: 3859316 - RNA, 13 nt, Human
uucagcaaaccau

SEQ ID NO: 3859317 - RNA, 18 nt, Human
uucagcaagacuucucuu

SEQ ID NO: 3859318 - RNA, 17 nt, Human
uucagcaagagagaacc

SEQ ID NO: 3859319 - RNA, 19 nt, Human
uucagcaaguuagaacuag

SEQ ID NO: 3859320 - RNA, 17 nt, Human
uucagcaccaagcaugu

SEQ ID NO: 3859321 - RNA, 16 nt, Human
uucagcaccacccuag

SEQ ID NO: 3859322 - RNA, 21 nt, Human
uucagcacuagccaaaccuca

SEQ ID NO: 3859323 - RNA, 13 nt, Human
uucagcacuuguc

SEQ ID NO: 3859324 - RNA, 13 nt, Human
uucagcaggcagc

SEQ ID NO: 3859325 - RNA, 23 nt, Human
uucagcauccgcaggugcugguc

SEQ ID NO: 3859326 - RNA, 16 nt, Human
uucagcauucccuccc

SEQ ID NO: 3859327 - RNA, 17 nt, Human
uucagcauucccuccca

SEQ ID NO: 3859328 - RNA, 14 nt, Human
uucagccaagaauu

SEQ ID NO: 3859329 - RNA, 16 nt, Human
uucagccacuaagaac

SEQ ID NO: 3859330 - RNA, 13 nt, Human
uucagccaggagc

SEQ ID NO: 3859331 - RNA, 21 nt, Human
uucagccaucaacaagaguug

SEQ ID NO: 3859332 - RNA, 19 nt, Human
uucagccccuccucugcca

SEQ ID NO: 3859333 - RNA, 23 nt, Human
uucagcccuaaaucuagacucaa

SEQ ID NO: 3859334 - RNA, 16 nt, Human
uucagcccucaccccu

SEQ ID NO: 3859335 - RNA, 15 nt, Human
uucagcccucagaau

SEQ ID NO: 3859336 - RNA, 20 nt, Human
uucagccuagccgaccucag

SEQ ID NO: 3859337 - RNA, 22 nt, Human
uucagccuagccgaccucagcc

SEQ ID NO: 3859338 - RNA, 15 nt, Human
uucagccucuuucug

SEQ ID NO: 3859339 - RNA, 12 nt, Human
uucagccuuaau

SEQ ID NO: 3859340 - RNA, 13 nt, Human
uucagccuucuuu

SEQ ID NO: 3859341 - RNA, 20 nt, Human
uucagccuucuuuuucugga

SEQ ID NO: 3859342 - RNA, 21 nt, Human
uucagccuucuuuuucuggac

SEQ ID NO: 3859343 - RNA, 17 nt, Human
uucagcgguuuauauaa

SEQ ID NO: 3859344 - RNA, 13 nt, Human
uucagcuaaggga

SEQ ID NO: 3859345 - RNA, 20 nt, Human
uucagcuaagggaagacauu

SEQ ID NO: 3859346 - RNA, 21 nt, Human
uucagcuaagggaagacauuu

SEQ ID NO: 3859347 - RNA, 19 nt, Human
uucagcuagcuuuuaggaa

SEQ ID NO: 3859348 - RNA, 20 nt, Human
uucagcuagcuuuuaggaaa

SEQ ID NO: 3859349 - RNA, 18 nt, Human
uucagcucacacaugaga

SEQ ID NO: 3859350 - RNA, 20 nt, Human
uucagcucacgcuucacagu

SEQ ID NO: 3859351 - RNA, 14 nt, Human
uucagcucacugca

SEQ ID NO: 3859352 - RNA, 23 nt, Human
uucagcugagguuugcacuuccu

SEQ ID NO: 3859353 - RNA, 12 nt, Human
uucagcugcccc

SEQ ID NO: 3859354 - RNA, 18 nt, Human
uucagcuguccucccucc

SEQ ID NO: 3859355 - RNA, 21 nt, Human
uucagcuguccucccuccacc

SEQ ID NO: 3859356 - RNA, 20 nt, Human
uucagcugugaacauggacu

SEQ ID NO: 3859357 - RNA, 16 nt, Human
uucagcuuaaaauaaa

SEQ ID NO: 3859358 - RNA, 16 nt, Human
uucagcuucugcuggg

SEQ ID NO: 3859359 - RNA, 20 nt, Human
uucagcuucugcugggcugg

SEQ ID NO: 3859360 - RNA, 22 nt, Human
uucagcuucugcugggcugggg

SEQ ID NO: 3859361 - RNA, 16 nt, Human
uucaggaaaaggccug

SEQ ID NO: 3859362 - RNA, 17 nt, Human
uucaggaaaaggccugg

SEQ ID NO: 3859363 - RNA, 18 nt, Human
uucaggaaaauugaaugc

SEQ ID NO: 3859364 - RNA, 19 nt, Human
uucaggaaagcagcaguuu

SEQ ID NO: 3859365 - RNA, 17 nt, Human
uucaggaaccuggacca

SEQ ID NO: 3859366 - RNA, 23 nt, Human
uucaggaaccuggaccaaagcug

SEQ ID NO: 3859367 - RNA, 13 nt, Human
uucaggaagcuca

SEQ ID NO: 3859368 - RNA, 20 nt, Human
uucaggagagaguugaaccu

SEQ ID NO: 3859369 - RNA, 21 nt, Human
uucaggagagaguugaaccua

SEQ ID NO: 3859370 - RNA, 22 nt, Human
uucaggagcagccucagaacaa

SEQ ID NO: 3859371 - RNA, 17 nt, Human
uucaggagucccaagga

SEQ ID NO: 3859372 - RNA, 16 nt, Human
uucaggauacaugugc

SEQ ID NO: 3859373 - RNA, 21 nt, Human
uucaggauacucugucagaug

SEQ ID NO: 3859374 - RNA, 12 nt, Human
uucaggaucuau

SEQ ID NO: 3859375 - RNA, 17 nt, Human
uucaggcaauucuccug

SEQ ID NO: 3859376 - RNA, 22 nt, Human
uucaggcuccccagaucauguu

SEQ ID NO: 3859377 - RNA, 15 nt, Human
uucaggcucuucucc

SEQ ID NO: 3859378 - RNA, 16 nt, Human
uucaggcugcuuggga

SEQ ID NO: 3859379 - RNA, 18 nt, Human
uucagggaagauaaguug

SEQ ID NO: 3859380 - RNA, 21 nt, Human
uucagggaagauaaguuggaa

SEQ ID NO: 3859381 - RNA, 18 nt, Human
uucagggaauuucaggaa

SEQ ID NO: 3859382 - RNA, 18 nt, Human
uucagggcagauuuuagu

SEQ ID NO: 3859383 - RNA, 16 nt, Human
uucaggggacucagcc

SEQ ID NO: 3859384 - RNA, 21 nt, Human
uucaggggagucccgucagga

SEQ ID NO: 3859385 - RNA, 16 nt, Human
uucaggguccugagau

SEQ ID NO: 3859386 - RNA, 14 nt, Human
uucaggguuggccc

SEQ ID NO: 3859387 - RNA, 19 nt, Human
uucaggguuggccccugcc

SEQ ID NO: 3859388 - RNA, 22 nt, Human
uucagguaaagggcaaauaaug

SEQ ID NO: 3859389 - RNA, 15 nt, Human
uucagguaacaggca

SEQ ID NO: 3859390 - RNA, 17 nt, Human
uucagguaacaggcaga

SEQ ID NO: 3859391 - RNA, 14 nt, Human
uucagguagaggug

SEQ ID NO: 3859392 - RNA, 14 nt, Human
uucaggugaaaaug

SEQ ID NO: 3859393 - RNA, 15 nt, Human
uucaggugaaaaugu

SEQ ID NO: 3859394 - RNA, 21 nt, Human
uucaggugacaugugaaaccu

SEQ ID NO: 3859395 - RNA, 20 nt, Human
uucagguuaucgaaauaaca

SEQ ID NO: 3859396 - RNA, 24 nt, Human
uucagguuaucgaaauaacaaugu

SEQ ID NO: 3859397 - RNA, 15 nt, Human
uucagguuguuggug

SEQ ID NO: 3859398 - RNA, 15 nt, Human
uucaguaaaaaacaa

SEQ ID NO: 3859399 - RNA, 19 nt, Human
uucaguaaacauaaagcca

SEQ ID NO: 3859400 - RNA, 21 nt, Human
uucaguaacccccacuggacu

SEQ ID NO: 3859401 - RNA, 14 nt, Human
uucaguaagccgug

SEQ ID NO: 3859402 - RNA, 16 nt, Human
uucaguaauguuauuu

SEQ ID NO: 3859403 - RNA, 16 nt, Human
uucaguaccuggagga

SEQ ID NO: 3859404 - RNA, 17 nt, Human
uucaguaccuggaggag

SEQ ID NO: 3859405 - RNA, 20 nt, Human
uucaguacuucagcaagaga

SEQ ID NO: 3859406 - RNA, 22 nt, Human
uucaguacuucagcaagagaga

SEQ ID NO: 3859407 - RNA, 20 nt, Human
uucaguauaauuuaacuuca

SEQ ID NO: 3859408 - RNA, 20 nt, Human
uucaguauuauguaguuguu

SEQ ID NO: 3859409 - RNA, 20 nt, Human
uucagucagaaaacuuuaaa

SEQ ID NO: 3859410 - RNA, 17 nt, Human
uucaguccaauaggugu

SEQ ID NO: 3859411 - RNA, 17 nt, Human
uucagucccuuccccau

SEQ ID NO: 3859412 - RNA, 12 nt, Human
uucaguccugcu

SEQ ID NO: 3859413 - RNA, 16 nt, Human
uucaguccuguaguuu

SEQ ID NO: 3859414 - RNA, 21 nt, Human
uucagucucuauaccaauaaa

SEQ ID NO: 3859415 - RNA, 22 nt, Human
uucagucucuauaccaauaaag

SEQ ID NO: 3859416 - RNA, 23 nt, Human
uucagucucuauaccaauaaagu

SEQ ID NO: 3859417 - RNA, 13 nt, Human
uucagucuuucau

SEQ ID NO: 3859418 - RNA, 14 nt, Human
uucagucuuuuccu

SEQ ID NO: 3859419 - RNA, 20 nt, Human
uucagugagggucuucuuac

SEQ ID NO: 3859420 - RNA, 12 nt, Human
uuccacuggacu

SEQ ID NO: 3859421 - RNA, 20 nt, Human
uuccacugucaagaaagagc

SEQ ID NO: 3859422 - RNA, 20 nt, Human
uuccacuuauagccucuguc

SEQ ID NO: 3859423 - RNA, 20 nt, Human
uuccacuucuuccuuucucu

SEQ ID NO: 3859424 - RNA, 23 nt, Human
uuccacuuuguucuuuaggagau

SEQ ID NO: 3859425 - RNA, 20 nt, Human
uuccacuuuuuuuuguaugu

SEQ ID NO: 3859426 - RNA, 17 nt, Human
uuccagaaaaccccagc

SEQ ID NO: 3859427 - RNA, 18 nt, Human
uuccagaaaaccccagca

SEQ ID NO: 3859428 - RNA, 14 nt, Human
uuccagaaaggaua

SEQ ID NO: 3859429 - RNA, 16 nt, Human
uuccagaagaagagaa

SEQ ID NO: 3859430 - RNA, 20 nt, Human
uuccagaagaagagaagcug

SEQ ID NO: 3859431 - RNA, 21 nt, Human
uuccagaagaagagaagcugc

SEQ ID NO: 3859432 - RNA, 20 nt, Human
uuccagaagugugacuggcu

SEQ ID NO: 3859433 - RNA, 21 nt, Human
uuccagaagugugauugggaa

SEQ ID NO: 3859434 - RNA, 15 nt, Human
uuccagaaucccaag

SEQ ID NO: 3859435 - RNA, 15 nt, Human
uuccagaaugcugua

SEQ ID NO: 3859436 - RNA, 17 nt, Human
uuccagaccugaagaau

SEQ ID NO: 3859437 - RNA, 17 nt, Human
uuccagagaguccucug

SEQ ID NO: 3859438 - RNA, 19 nt, Human
uuccagagaguggcuccuc

SEQ ID NO: 3859439 - RNA, 20 nt, Human
uuccagagaguggcuccucc

SEQ ID NO: 3859440 - RNA, 21 nt, Human
uuccagagaguggcuccuccc

SEQ ID NO: 3859441 - RNA, 10 nt, Human
uuccagagca

SEQ ID NO: 3859442 - RNA, 21 nt, Human
uuccagagcauuccagucagg

SEQ ID NO: 3859443 - RNA, 19 nt, Human
uuccagaggcuauuauuuu

SEQ ID NO: 3859444 - RNA, 23 nt, Human
uuccagauaaccagcuguaacac

SEQ ID NO: 3859445 - RNA, 22 nt, Human
uuccagaucccaggccccugga

SEQ ID NO: 3859446 - RNA, 15 nt, Human
uuccagauccucucu

SEQ ID NO: 3859447 - RNA, 18 nt, Human
uuccagauccucucuggg

SEQ ID NO: 3859448 - RNA, 21 nt, Human
uuccagaugcugguuuuuccc

SEQ ID NO: 3859449 - RNA, 14 nt, Human
uuccagaugugaug

SEQ ID NO: 3859450 - RNA, 22 nt, Human
uuccagcaauucuccugccuca

SEQ ID NO: 3859451 - RNA, 24 nt, Human
uuccagcaugagguaucuaaggau

SEQ ID NO: 3859452 - RNA, 17 nt, Human
uuccagcauucccaggu

SEQ ID NO: 3859453 - RNA, 20 nt, Human
uuccagcauuuagcuggcca

SEQ ID NO: 3859454 - RNA, 16 nt, Human
uuccagccagggcugc

SEQ ID NO: 3859455 - RNA, 12 nt, Human
uuccagccauca

SEQ ID NO: 3859456 - RNA, 16 nt, Human
uuccagccccucuggu

SEQ ID NO: 3859457 - RNA, 16 nt, Human
uuccagccugccacuc

SEQ ID NO: 3859458 - RNA, 19 nt, Human
uuccagcucuaauaaaaca

SEQ ID NO: 3859459 - RNA, 11 nt, Human
uuccagcugcu

SEQ ID NO: 3859460 - RNA, 13 nt, Human
uuccagcugcugu

SEQ ID NO: 3859461 - RNA, 11 nt, Human
uuccaggcucc

SEQ ID NO: 3859462 - RNA, 19 nt, Human
uuccaggcugcauagaagg

SEQ ID NO: 3859463 - RNA, 15 nt, Human
uuccaggcuucugcu

SEQ ID NO: 3859464 - RNA, 17 nt, Human
uuccaggcuucugcugg

SEQ ID NO: 3859465 - RNA, 18 nt, Human
uuccaggggaaccugcca

SEQ ID NO: 3859466 - RNA, 17 nt, Human
uuccagguaucuccagg

SEQ ID NO: 3859467 - RNA, 17 nt, Human
uuccagguguuuauagu

SEQ ID NO: 3859468 - RNA, 23 nt, Human
uuccagguucugguuagcucagc

SEQ ID NO: 3859469 - RNA, 16 nt, Human
uuccaguaaugagcuu

SEQ ID NO: 3859470 - RNA, 19 nt, Human
uuccaguacaccuuucagc

SEQ ID NO: 3859471 - RNA, 17 nt, Human
uuccaguaccuuuguca

SEQ ID NO: 3859472 - RNA, 19 nt, Human
uuccaguaccuuugucaca

SEQ ID NO: 3859473 - RNA, 17 nt, Human
uuccaguauaaccagcu

SEQ ID NO: 3859474 - RNA, 11 nt, Human
uuccaguauuu

SEQ ID NO: 3859475 - RNA, 14 nt, Human
uuccaguauuuuag

SEQ ID NO: 3859476 - RNA, 15 nt, Human
uuccaguccaaucuc

SEQ ID NO: 3859477 - RNA, 22 nt, Human
uuccagucgggggaacugaggc

SEQ ID NO: 3859478 - RNA, 19 nt, Human
uuccagucucaaaaauaca

SEQ ID NO: 3859479 - RNA, 22 nt, Human
uuccagucuccaccaggaaccu

SEQ ID NO: 3859480 - RNA, 22 nt, Human
uuccagugaggcucugcccuug

SEQ ID NO: 3859481 - RNA, 21 nt, Human
uuccagugcaacacugaagcu

SEQ ID NO: 3859482 - RNA, 17 nt, Human
uuccaguucuucgacug

SEQ ID NO: 3859483 - RNA, 20 nt, Human
uuccaguuuguuuauuacuu

SEQ ID NO: 3859484 - RNA, 14 nt, Human
uuccauaauuauga

SEQ ID NO: 3859485 - RNA, 16 nt, Human
uuccauaauuaugaca

SEQ ID NO: 3859486 - RNA, 13 nt, Human
uuccauagcaaca

SEQ ID NO: 3859487 - RNA, 14 nt, Human
uuccauaguauauu

SEQ ID NO: 3859488 - RNA, 17 nt, Human
uuccauaguuaaagaag

SEQ ID NO: 3859489 - RNA, 13 nt, Human
uuccauaguuuug

SEQ ID NO: 3859490 - RNA, 22 nt, Human
uuccauaguuuugaugacuggc

SEQ ID NO: 3859491 - RNA, 21 nt, Human
uuccauaucuugcgaauccaa

SEQ ID NO: 3859492 - RNA, 14 nt, Human
uuccauaugcuguu

SEQ ID NO: 3859493 - RNA, 21 nt, Human
uuccauauggauccacuggcu

SEQ ID NO: 3859494 - RNA, 19 nt, Human
uuccaucagguuccauccc

SEQ ID NO: 3859495 - RNA, 20 nt, Human
uuccaucauaauucuaaucu

SEQ ID NO: 3859496 - RNA, 23 nt, Human
uuccauccauaaauccaguucua

SEQ ID NO: 3859497 - RNA, 18 nt, Human
uuccauccauggccagca

SEQ ID NO: 3859498 - RNA, 18 nt, Human
uuccaucccaaccagugc

SEQ ID NO: 3859499 - RNA, 20 nt, Human
uuccaucccaaccagugcca

SEQ ID NO: 3859500 - RNA, 14 nt, Human
uuccaucugauucc

SEQ ID NO: 3859501 - RNA, 15 nt, Human
uuccaugaaaaugca

SEQ ID NO: 3859502 - RNA, 16 nt, Human
uuccaugaaggcagag

SEQ ID NO: 3859503 - RNA, 16 nt, Human
uuccaugacaucaaga

SEQ ID NO: 3859504 - RNA, 18 nt, Human
uuccaugagaacagcagg

SEQ ID NO: 3859505 - RNA, 21 nt, Human
uuccaugaguuaucaugaauu

SEQ ID NO: 3859506 - RNA, 18 nt, Human
uuccaugaugcugggauu

SEQ ID NO: 3859507 - RNA, 23 nt, Human
uuccaugccugaggguggagacu

SEQ ID NO: 3859508 - RNA, 14 nt, Human
uuccauggacuuug

SEQ ID NO: 3859509 - RNA, 17 nt, Human
uuccauggcaggaaggc

SEQ ID NO: 3859510 - RNA, 16 nt, Human
uuccauggcccucauu

SEQ ID NO: 3859511 - RNA, 12 nt, Human
uuccauggccuc

SEQ ID NO: 3859512 - RNA, 12 nt, Human
uuccaugggaau

SEQ ID NO: 3859513 - RNA, 22 nt, Human
uuccaugggaccacaacuauuu

SEQ ID NO: 3859514 - RNA, 21 nt, Human
uuccauggugugaucgucuga

SEQ ID NO: 3859515 - RNA, 15 nt, Human
uuccaugucaagauu

SEQ ID NO: 3859516 - RNA, 17 nt, Human
uuccaugucaagauuca

SEQ ID NO: 3859517 - RNA, 17 nt, Human
uuccaugucgccucugc

SEQ ID NO: 3859518 - RNA, 21 nt, Human
uuccaugucgccucugcauuc

SEQ ID NO: 3859519 - RNA, 15 nt, Human
uuccaugucggccuc

SEQ ID NO: 3859520 - RNA, 16 nt, Human
uuccaugucggccucu

SEQ ID NO: 3859521 - RNA, 15 nt, Human
uuccaugugcccagu

SEQ ID NO: 3859522 - RNA, 13 nt, Human
uuccauuaaacga

SEQ ID NO: 3859523 - RNA, 23 nt, Human
uuccauuacaaguauuuuuaauu

SEQ ID NO: 3859524 - RNA, 15 nt, Human
uuccauuaugauucu

SEQ ID NO: 3859525 - RNA, 18 nt, Human
uuccauuguuuggagaca

SEQ ID NO: 3859526 - RNA, 21 nt, Human
uuccauuucucucuccagucu

SEQ ID NO: 3859527 - RNA, 18 nt, Human
uuccauuuuaauuuuaaa

SEQ ID NO: 3859528 - RNA, 16 nt, Human
uucccaaaggacucca

SEQ ID NO: 3859529 - RNA, 17 nt, Human
uucccaaaggacuccac

SEQ ID NO: 3859530 - RNA, 20 nt, Human
uucccaaaggacuccaccca

SEQ ID NO: 3859531 - RNA, 23 nt, Human
uucccaaaggcauuauaaaaaga

SEQ ID NO: 3859532 - RNA, 12 nt, Human
uucccaaauuuc

SEQ ID NO: 3859533 - RNA, 15 nt, Human
uucccaacuugccuu

SEQ ID NO: 3859534 - RNA, 23 nt, Human
uucccaacuugccuuugaagagu

SEQ ID NO: 3859535 - RNA, 22 nt, Human
uucccaagagcaucaugccucu

SEQ ID NO: 3859536 - RNA, 14 nt, Human
uucccaagcucugc

SEQ ID NO: 3859537 - RNA, 18 nt, Human
uucccaagcucugcuccu

SEQ ID NO: 3859538 - RNA, 23 nt, Human
uucccaagugagucucucugggc

SEQ ID NO: 3859539 - RNA, 20 nt, Human
uucccaauagcaacguagcu

SEQ ID NO: 3859540 - RNA, 15 nt, Human
uucccaaucagcacu

SEQ ID NO: 3859541 - RNA, 21 nt, Human
uucccaaugguguuuuucuug

SEQ ID NO: 3859542 - RNA, 16 nt, Human
uucccacaccuccaca

SEQ ID NO: 3859543 - RNA, 17 nt, Human
uucccacaccuccacag

SEQ ID NO: 3859544 - RNA, 21 nt, Human
uucccacaccuccacaguuca

SEQ ID NO: 3859545 - RNA, 16 nt, Human
uucccacauuugucuu

SEQ ID NO: 3859546 - RNA, 21 nt, Human
uucccacccaauucaaaacau

SEQ ID NO: 3859547 - RNA, 20 nt, Human
uucccaccccaaccugcucu

SEQ ID NO: 3859548 - RNA, 12 nt, Human
uucccaccucuc

SEQ ID NO: 3859549 - RNA, 15 nt, Human
uucccacucaccccg

SEQ ID NO: 3859550 - RNA, 21 nt, Human
uucccacuccaagcccagccc

SEQ ID NO: 3859551 - RNA, 20 nt, Human
uucccacucugucgagccug

SEQ ID NO: 3859552 - RNA, 14 nt, Human
uucccacucuucuc

SEQ ID NO: 3859553 - RNA, 11 nt, Human
uucccacugca

SEQ ID NO: 3859554 - RNA, 18 nt, Human
uucccacugcacccccuc

SEQ ID NO: 3859555 - RNA, 23 nt, Human
uucccacugcacccccuccugcu

SEQ ID NO: 3859556 - RNA, 24 nt, Human
uucccacugcacccccuccugcug

SEQ ID NO: 3859557 - RNA, 18 nt, Human
uucccacuuucccacccc

SEQ ID NO: 3859558 - RNA, 12 nt, Human
uucccagaauca

SEQ ID NO: 3859559 - RNA, 15 nt, Human
uucccagaaucaaag

SEQ ID NO: 3859560 - RNA, 19 nt, Human
uucccagagacaggaaaau

SEQ ID NO: 3859561 - RNA, 11 nt, Human
uucccagaggg

SEQ ID NO: 3859562 - RNA, 14 nt, Human
uucccagcacauga

SEQ ID NO: 3859563 - RNA, 23 nt, Human
uucccagcagggccacucccggc

SEQ ID NO: 3859564 - RNA, 14 nt, Human
uucccagcucuccc

SEQ ID NO: 3859565 - RNA, 11 nt, Human
uucccaggacc

SEQ ID NO: 3859566 - RNA, 12 nt, Human
uucccaggaccc

SEQ ID NO: 3859567 - RNA, 22 nt, Human
uucccaggcaaauaaaauuccc

SEQ ID NO: 3859568 - RNA, 22 nt, Human
uucccaggcccacugugccuca

SEQ ID NO: 3859569 - RNA, 13 nt, Human
uucccagggaagu

SEQ ID NO: 3859570 - RNA, 19 nt, Human
uucccaggguagcccgccu

SEQ ID NO: 3859571 - RNA, 20 nt, Human
uucccaggguagcccgccug

SEQ ID NO: 3859572 - RNA, 16 nt, Human
uucccaggugcuacac

SEQ ID NO: 3859573 - RNA, 20 nt, Human
uucccagucuucugacaaac

SEQ ID NO: 3859574 - RNA, 16 nt, Human
uucccaguggcugcug

SEQ ID NO: 3859575 - RNA, 18 nt, Human
uucccaguggcugcugcc

SEQ ID NO: 3859576 - RNA, 19 nt, Human
uucccaguggcugcugccc

SEQ ID NO: 3859577 - RNA, 18 nt, Human
uucccauaauuuucuuca

SEQ ID NO: 3859578 - RNA, 13 nt, Human
uucccauccccag

SEQ ID NO: 3859579 - RNA, 17 nt, Human
uucccauccccagcgau

SEQ ID NO: 3859580 - RNA, 13 nt, Human
uucccauccuacc

SEQ ID NO: 3859581 - RNA, 19 nt, Human
uucccauccucuucuuuua

SEQ ID NO: 3859582 - RNA, 12 nt, Human
uucccaucugca

SEQ ID NO: 3859583 - RNA, 14 nt, Human
uucccaucugcacc

SEQ ID NO: 3859584 - RNA, 18 nt, Human
uucccaugacccaggcug

SEQ ID NO: 3859585 - RNA, 22 nt, Human
uucccaugauuucauguacugc

SEQ ID NO: 3859586 - RNA, 18 nt, Human
uucccauugaaaauguaa

SEQ ID NO: 3859587 - RNA, 20 nt, Human
uucccauugcaucaccucug

SEQ ID NO: 3859588 - RNA, 17 nt, Human
uucccauuguggcuccu

SEQ ID NO: 3859589 - RNA, 15 nt, Human
uucccauuuaucuaa

SEQ ID NO: 3859590 - RNA, 17 nt, Human
uucccauuuguaauuug

SEQ ID NO: 3859591 - RNA, 17 nt, Human
uucccauuuugcaaaau

SEQ ID NO: 3859592 - RNA, 13 nt, Human
uucccauuuugga

SEQ ID NO: 3859593 - RNA, 15 nt, Human
uuccccaacagugug

SEQ ID NO: 3859594 - RNA, 16 nt, Human
uuccccaacaguguga

SEQ ID NO: 3859595 - RNA, 20 nt, Human
uuccccaacagugugaaguu

SEQ ID NO: 3859596 - RNA, 16 nt, Human
uuccccaacgaaaagc

SEQ ID NO: 3859597 - RNA, 17 nt, Human
uuccccacugacagccu

SEQ ID NO: 3859598 - RNA, 13 nt, Human
uuccccacuggag

SEQ ID NO: 3859599 - RNA, 14 nt, Human
uuccccacuggagc

SEQ ID NO: 3859600 - RNA, 22 nt, Human
uuccccacuugagaauuacccu

SEQ ID NO: 3859601 - RNA, 18 nt, Human
uuccccagacgccuggcu

SEQ ID NO: 3859602 - RNA, 12 nt, Human
uuccccagagaa

SEQ ID NO: 3859603 - RNA, 22 nt, Human
uuccccagcagggucuuuucau

SEQ ID NO: 3859604 - RNA, 20 nt, Human
uuccccagcaucacucccca

SEQ ID NO: 3859605 - RNA, 12 nt, Human
uuccccagccca

SEQ ID NO: 3859606 - RNA, 16 nt, Human
uuccccaggaggccag

SEQ ID NO: 3859607 - RNA, 18 nt, Human
uuccccaggaggccagcc

SEQ ID NO: 3859608 - RNA, 19 nt, Human
uuccccaggaggccagccu

SEQ ID NO: 3859609 - RNA, 18 nt, Human
uuccccaggggaaaauga

SEQ ID NO: 3859610 - RNA, 19 nt, Human
uuccccaucucaggccaga

SEQ ID NO: 3859611 - RNA, 15 nt, Human
uuccccaucuggguc

SEQ ID NO: 3859612 - RNA, 17 nt, Human
uuccccaucuucuaaac

SEQ ID NO: 3859613 - RNA, 16 nt, Human
uuccccauugccuccu

SEQ ID NO: 3859614 - RNA, 14 nt, Human
uucccccaaagugg

SEQ ID NO: 3859615 - RNA, 18 nt, Human
uucccccaaccucagacu

SEQ ID NO: 3859616 - RNA, 12 nt, Human
uucccccaccac

SEQ ID NO: 3859617 - RNA, 23 nt, Human
uucccccaccaccaaaacugcuc

SEQ ID NO: 3859618 - RNA, 18 nt, Human
uucccccaccgguccagc

SEQ ID NO: 3859619 - RNA, 14 nt, Human
uucccccacuaccg

SEQ ID NO: 3859620 - RNA, 15 nt, Human
uucccccacugauca

SEQ ID NO: 3859621 - RNA, 15 nt, Human
uucccccagcccugu

SEQ ID NO: 3859622 - RNA, 18 nt, Human
uucccccauagccacccc

SEQ ID NO: 3859623 - RNA, 21 nt, Human
uuccccccauguuguaaugcu

SEQ ID NO: 3859624 - RNA, 12 nt, Human
uucccccuaaac

SEQ ID NO: 3859625 - RNA, 14 nt, Human
uucccccuuucuuc

SEQ ID NO: 3859626 - RNA, 22 nt, Human
uuccccgagggaugaugccaca

SEQ ID NO: 3859627 - RNA, 22 nt, Human
uuccccuaguaagugccuucca

SEQ ID NO: 3859628 - RNA, 22 nt, Human
uuccccucagaaaaaaauucau

SEQ ID NO: 3859629 - RNA, 13 nt, Human
uuccccucccugg

SEQ ID NO: 3859630 - RNA, 14 nt, Human
uuccccucccuggg

SEQ ID NO: 3859631 - RNA, 17 nt, Human
uuccccuccuaccccuc

SEQ ID NO: 3859632 - RNA, 18 nt, Human
uuccccuccuucucccuu

SEQ ID NO: 3859633 - RNA, 13 nt, Human
uuccccucucccu

SEQ ID NO: 3859634 - RNA, 12 nt, Human
uuccccucugcu

SEQ ID NO: 3859635 - RNA, 15 nt, Human
uuccccucugcugcu

SEQ ID NO: 3859636 - RNA, 19 nt, Human
uuccccucuucccuucaac

SEQ ID NO: 3859637 - RNA, 18 nt, Human
uuccccuguuuauucaua

SEQ ID NO: 3859638 - RNA, 15 nt, Human
uuccccuuccuucuu

SEQ ID NO: 3859639 - RNA, 17 nt, Human
uuccccuuccuuuuaag

SEQ ID NO: 3859640 - RNA, 13 nt, Human
uuccccuugcccu

SEQ ID NO: 3859641 - RNA, 14 nt, Human
uuccccuugcccuu

SEQ ID NO: 3859642 - RNA, 21 nt, Human
uuccccuugcccuugcccuga

SEQ ID NO: 3859643 - RNA, 17 nt, Human
uuccccuuuccccacuc

SEQ ID NO: 3859644 - RNA, 21 nt, Human
uucccgagcaaagucuaaagu

SEQ ID NO: 3859645 - RNA, 23 nt, Human
uucccgagcaaagucuaaaguuu

SEQ ID NO: 3859646 - RNA, 21 nt, Human
uucccgccagagggcuuguga

SEQ ID NO: 3859647 - RNA, 22 nt, Human
uucccgcggguuccgcaggcag

SEQ ID NO: 3859648 - RNA, 14 nt, Human
uucccgcucagccc

SEQ ID NO: 3859649 - RNA, 18 nt, Human
uucccgcucagcccuccc

SEQ ID NO: 3859650 - RNA, 20 nt, Human
uucccggucccgaguacagu

SEQ ID NO: 3859651 - RNA, 20 nt, Human
uucccgucccauauccugcc

SEQ ID NO: 3859652 - RNA, 15 nt, Human
uucccguuucuccac

SEQ ID NO: 3859653 - RNA, 17 nt, Human
uucccguuucuccaccu

SEQ ID NO: 3859654 - RNA, 19 nt, Human
uucccuaaaauacauuuaa

SEQ ID NO: 3859655 - RNA, 22 nt, Human
uucccuaaaauacauuuaaaac

SEQ ID NO: 3859656 - RNA, 14 nt, Human
uucccuacauuaaa

SEQ ID NO: 3859657 - RNA, 14 nt, Human
uucccuacccucua

SEQ ID NO: 3859658 - RNA, 17 nt, Human
uucccuacccucuagag

SEQ ID NO: 3859659 - RNA, 20 nt, Human
uucccuacccucuagagaaa

SEQ ID NO: 3859660 - RNA, 13 nt, Human
uucccuaccucag

SEQ ID NO: 3859661 - RNA, 15 nt, Human
uucccuaccucaggc

SEQ ID NO: 3859662 - RNA, 16 nt, Human
uucccuacuuccugug

SEQ ID NO: 3859663 - RNA, 15 nt, Human
uucccuauccaauca

SEQ ID NO: 3859664 - RNA, 13 nt, Human
uucccuaucuuuu

SEQ ID NO: 3859665 - RNA, 12 nt, Human
uucccucacccc

SEQ ID NO: 3859666 - RNA, 21 nt, Human
uucccucaccuuggcaccaga

SEQ ID NO: 3859667 - RNA, 21 nt, Human
uucccucacucgucuccccca

SEQ ID NO: 3859668 - RNA, 11 nt, Human
uucccuccucc

SEQ ID NO: 3859669 - RNA, 22 nt, Human
uucccuccucccaugucacugc

SEQ ID NO: 3859670 - RNA, 15 nt, Human
uucccuccugcuacu

SEQ ID NO: 3859671 - RNA, 12 nt, Human
uucccuccuugg

SEQ ID NO: 3859672 - RNA, 13 nt, Human
uucccuccuuggu

SEQ ID NO: 3859673 - RNA, 14 nt, Human
uucccucucucacu

SEQ ID NO: 3859674 - RNA, 14 nt, Human
uucccucucucuga

SEQ ID NO: 3859675 - RNA, 22 nt, Human
uucccucugagaauuccaagga

SEQ ID NO: 3859676 - RNA, 13 nt, Human
uucccucugcuca

SEQ ID NO: 3859677 - RNA, 15 nt, Human
uucccucugcucagc

SEQ ID NO: 3859678 - RNA, 17 nt, Human
uucccucugcucagcca

SEQ ID NO: 3859679 - RNA, 15 nt, Human
uucccucugcuccug

SEQ ID NO: 3859680 - RNA, 13 nt, Human
uucccucuuuucu

SEQ ID NO: 3859681 - RNA, 15 nt, Human
uucccucuuuucuua

SEQ ID NO: 3859682 - RNA, 19 nt, Human
uucccucuuuucuuacucc

SEQ ID NO: 3859683 - RNA, 20 nt, Human
uucccugaaaacccagagag

SEQ ID NO: 3859684 - RNA, 21 nt, Human
uucccugaaacacgaaacuug

SEQ ID NO: 3859685 - RNA, 10 nt, Human
uucccugcaa

SEQ ID NO: 3859686 - RNA, 12 nt, Human
uucccugcacua

SEQ ID NO: 3859687 - RNA, 20 nt, Human
uucccuggaaaccuuccacc

SEQ ID NO: 3859688 - RNA, 22 nt, Human
uucccuggaaaccuuccaccca

SEQ ID NO: 3859689 - RNA, 12 nt, Human
uucccuggccuu

SEQ ID NO: 3859690 - RNA, 20 nt, Human
uucccuggggaaaacuugca

SEQ ID NO: 3859691 - RNA, 21 nt, Human
uucccuggguuagacugccag

SEQ ID NO: 3859692 - RNA, 20 nt, Human
uucccugucucuugaaaaau

SEQ ID NO: 3859693 - RNA, 17 nt, Human
uucccuguucuuccucc

SEQ ID NO: 3859694 - RNA, 22 nt, Human
uucccuuaagggguaucaugua

SEQ ID NO: 3859695 - RNA, 13 nt, Human
uucccuuccacug

SEQ ID NO: 3859696 - RNA, 14 nt, Human
uucccuuccuccau

SEQ ID NO: 3859697 - RNA, 22 nt, Human
uucccuucuccaucucucuggc

SEQ ID NO: 3859698 - RNA, 17 nt, Human
uucccuucuccuuccaa

SEQ ID NO: 3859699 - RNA, 18 nt, Human
uucccuugaugaagaagu

SEQ ID NO: 3859700 - RNA, 15 nt, Human
uucccuuggccucag

SEQ ID NO: 3859701 - RNA, 16 nt, Human
uucccuuguagcuccu

SEQ ID NO: 3859702 - RNA, 16 nt, Human
uucccuuugcuccacc

SEQ ID NO: 3859703 - RNA, 15 nt, Human
uucccuuugugcaca

SEQ ID NO: 3859704 - RNA, 21 nt, Human
uucccuuuuacauacugcugu

SEQ ID NO: 3859705 - RNA, 14 nt, Human
uucccuuuucuguu

SEQ ID NO: 3859706 - RNA, 21 nt, Human
uuccgaaaaauccucuuccuc

SEQ ID NO: 3859707 - RNA, 20 nt, Human
uuccgacaaccgaugcucca

SEQ ID NO: 3859708 - RNA, 22 nt, Human
uuccgacaaccgaugcuccagc

SEQ ID NO: 3859709 - RNA, 17 nt, Human
uuccgacccucugggaa

SEQ ID NO: 3859710 - RNA, 18 nt, Human
uuccgacccucugggaac

SEQ ID NO: 3859711 - RNA, 21 nt, Human
uuccgcacuucagaauuccau

SEQ ID NO: 3859712 - RNA, 17 nt, Human
uuccgcaggcagacuac

SEQ ID NO: 3859713 - RNA, 16 nt, Human
uuccgccccugccugc

SEQ ID NO: 3859714 - RNA, 17 nt, Human
uuccgccccuucccuuc

SEQ ID NO: 3859715 - RNA, 19 nt, Human
uuccgcuuggagcagaggg

SEQ ID NO: 3859716 - RNA, 22 nt, Human
uuccggcauggacaauggaccg

SEQ ID NO: 3859717 - RNA, 17 nt, Human
uuccgguagggaggcag

SEQ ID NO: 3859718 - RNA, 20 nt, Human
uuccguagguagauguguaa

SEQ ID NO: 3859719 - RNA, 18 nt, Human
uuccgugacgucacugga

SEQ ID NO: 3859720 - RNA, 13 nt, Human
uucgcuccugugu

SEQ ID NO: 3859721 - RNA, 14 nt, Human
uucgcucuuugaga

SEQ ID NO: 3859722 - RNA, 22 nt, Human
uucgcuucuugccucugugcug

SEQ ID NO: 3859723 - RNA, 17 nt, Human
uucgcuuggcuccaugc

SEQ ID NO: 3859724 - RNA, 23 nt, Human
uucggaaagaagaaggugggagg

SEQ ID NO: 3859725 - RNA, 20 nt, Human
uucggaagggguuccucaaa

SEQ ID NO: 3859726 - RNA, 19 nt, Human
uucggacaguuuauuuguu

SEQ ID NO: 3859727 - RNA, 12 nt, Human
uucggcauuuga

SEQ ID NO: 3859728 - RNA, 17 nt, Human
uucggccccauguaucu

SEQ ID NO: 3859729 - RNA, 19 nt, Human
uucggccuccauccugagg

SEQ ID NO: 3859730 - RNA, 16 nt, Human
uucggcucuggguggg

SEQ ID NO: 3859731 - RNA, 13 nt, Human
uucggcugucuca

SEQ ID NO: 3859732 - RNA, 22 nt, Human
uucgggaagagaggaguucaau

SEQ ID NO: 3859733 - RNA, 12 nt, Human
uucgggcugugc

SEQ ID NO: 3859734 - RNA, 13 nt, Human
uucgggcugugcc

SEQ ID NO: 3859735 - RNA, 21 nt, Human
uucgggugugcaaugucugag

SEQ ID NO: 3859736 - RNA, 22 nt, Human
uucgguggcuagucaagcuccu

SEQ ID NO: 3859737 - RNA, 20 nt, Human
uucgguuuuuuuccuguuuc

SEQ ID NO: 3859738 - RNA, 14 nt, Human
uucguacaguucuu

SEQ ID NO: 3859739 - RNA, 15 nt, Human
uucguacaguucuuc

SEQ ID NO: 3859740 - RNA, 15 nt, Human
uucguagcaugaguu

SEQ ID NO: 3859741 - RNA, 15 nt, Human
uucguaugaaaauga

SEQ ID NO: 3859742 - RNA, 17 nt, Human
uucguccacagcuuccu

SEQ ID NO: 3859743 - RNA, 19 nt, Human
uucgucuguuuauaaacau

SEQ ID NO: 3859744 - RNA, 13 nt, Human
uucgucuucuaau

SEQ ID NO: 3859745 - RNA, 16 nt, Human
uucgucuucuaauuuc

SEQ ID NO: 3859746 - RNA, 21 nt, Human
uucgugaaguauacuguauuu

SEQ ID NO: 3859747 - RNA, 20 nt, Human
uucgugagccccaucuucac

SEQ ID NO: 3859748 - RNA, 16 nt, Human
uucguuagaccgcucu

SEQ ID NO: 3859749 - RNA, 13 nt, Human
uucguuaucuaau

SEQ ID NO: 3859750 - RNA, 17 nt, Human
uucguucgcagagcuuu

SEQ ID NO: 3859751 - RNA, 14 nt, Human
uucguucucugcca

SEQ ID NO: 3859752 - RNA, 15 nt, Human
uucguucuuguucug

SEQ ID NO: 3859753 - RNA, 14 nt, Human
uucguucuuuuuaa

SEQ ID NO: 3859754 - RNA, 20 nt, Human
uucguuguguuuuuuaagau

SEQ ID NO: 3859755 - RNA, 12 nt, Human
uucguuuugguu

SEQ ID NO: 3859756 - RNA, 14 nt, Human
uucuaaaaaaagaa

SEQ ID NO: 3859757 - RNA, 15 nt, Human
uucuaaaaagucaga

SEQ ID NO: 3859758 - RNA, 18 nt, Human
uucuaaaacuaaauagca

SEQ ID NO: 3859759 - RNA, 22 nt, Human
uucuaaaacuaaauagcaugua

SEQ ID NO: 3859760 - RNA, 19 nt, Human
uucuaaaacuguacuuuga

SEQ ID NO: 3859761 - RNA, 15 nt, Human
uucuaaaagguguga

SEQ ID NO: 3859762 - RNA, 19 nt, Human
uucuaaaauauaaucaacc

SEQ ID NO: 3859763 - RNA, 20 nt, Human
uucuaaaaucuuauaguucu

SEQ ID NO: 3859764 - RNA, 15 nt, Human
uucuaaaaugauugu

SEQ ID NO: 3859765 - RNA, 19 nt, Human
uucuaaacccaauccaaau

SEQ ID NO: 3859766 - RNA, 21 nt, Human
uucuaaacguaagcacuguuu

SEQ ID NO: 3859767 - RNA, 18 nt, Human
uucuaaacuggagacugu

SEQ ID NO: 3859768 - RNA, 14 nt, Human
uucuaaagauucua

SEQ ID NO: 3859769 - RNA, 15 nt, Human
uucuaaagcucugac

SEQ ID NO: 3859770 - RNA, 23 nt, Human
uucuaaaggaguuuauguuccau

SEQ ID NO: 3859771 - RNA, 17 nt, Human
uucuaaaggcuaccuuu

SEQ ID NO: 3859772 - RNA, 13 nt, Human
uucuaaaggucca

SEQ ID NO: 3859773 - RNA, 13 nt, Human
uucuaaaguucua

SEQ ID NO: 3859774 - RNA, 20 nt, Human
uucuaacaaaaaaauauauu

SEQ ID NO: 3859775 - RNA, 18 nt, Human
uucuaaccuugaaugcug

SEQ ID NO: 3859776 - RNA, 20 nt, Human
uucuaaccuugaaugcugcc

SEQ ID NO: 3859777 - RNA, 22 nt, Human
uucuaaccuugaaugcugccag

SEQ ID NO: 3859778 - RNA, 23 nt, Human
uucuaaccuugaaugcugccagu

SEQ ID NO: 3859779 - RNA, 16 nt, Human
uucuaacucugaugua

SEQ ID NO: 3859780 - RNA, 23 nt, Human
uucuaacucugauguaaaugaag

SEQ ID NO: 3859781 - RNA, 16 nt, Human
uucuaagaaaagccua

SEQ ID NO: 3859782 - RNA, 18 nt, Human
uucuaagaaaucaaguaa

SEQ ID NO: 3859783 - RNA, 23 nt, Human
uucuaagaagugaaaaucuacac

SEQ ID NO: 3859784 - RNA, 13 nt, Human
uucuaagacucaa

SEQ ID NO: 3859785 - RNA, 21 nt, Human
uucuaagacuuacucuaagau

SEQ ID NO: 3859786 - RNA, 15 nt, Human
uucuaagauucuaau

SEQ ID NO: 3859787 - RNA, 13 nt, Human
uucuaagauucug

SEQ ID NO: 3859788 - RNA, 12 nt, Human
uucuaaggcucu

SEQ ID NO: 3859789 - RNA, 20 nt, Human
uucuaaguaaaaccacagca

SEQ ID NO: 3859790 - RNA, 21 nt, Human
uucuaaguaaaaccacagcag

SEQ ID NO: 3859791 - RNA, 24 nt, Human
uucuaaguaaaaccacagcaguug

SEQ ID NO: 3859792 - RNA, 15 nt, Human
uucuaaguaaauaca

SEQ ID NO: 3859793 - RNA, 17 nt, Human
uucuaaguaaauacaau

SEQ ID NO: 3859794 - RNA, 12 nt, Human
uucuaagucuuu

SEQ ID NO: 3859795 - RNA, 17 nt, Human
uucuaagucuuuccauu

SEQ ID NO: 3859796 - RNA, 20 nt, Human
uucuaagugaaauuucuagc

SEQ ID NO: 3859797 - RNA, 20 nt, Human
uucuaaguugaguauauuau

SEQ ID NO: 3859798 - RNA, 14 nt, Human
uucuaaguuucuaa

SEQ ID NO: 3859799 - RNA, 13 nt, Human
uucuaauaaauua

SEQ ID NO: 3859800 - RNA, 17 nt, Human
uucuaauaagcuaguug

SEQ ID NO: 3859801 - RNA, 19 nt, Human
uucuaauaagcuaguugaa

SEQ ID NO: 3859802 - RNA, 16 nt, Human
uucuaauaauuucuaa

SEQ ID NO: 3859803 - RNA, 18 nt, Human
uucuaauaauuucuaaug

SEQ ID NO: 3859804 - RNA, 14 nt, Human
uucuaauagaacuc

SEQ ID NO: 3859805 - RNA, 18 nt, Human
uucuaauagaacucaguu

SEQ ID NO: 3859806 - RNA, 14 nt, Human
uucuaauaguuuua

SEQ ID NO: 3859807 - RNA, 13 nt, Human
uucuaauaucauu

SEQ ID NO: 3859808 - RNA, 21 nt, Human
uucuaauauuuauugcuuuau

SEQ ID NO: 3859809 - RNA, 13 nt, Human
uucuaaucaaaag

SEQ ID NO: 3859810 - RNA, 14 nt, Human
uucuaaucugcuau

SEQ ID NO: 3859811 - RNA, 23 nt, Human
uucuaaugaggagagaaaauaua

SEQ ID NO: 3859812 - RNA, 16 nt, Human
uucuaaugcugauaug

SEQ ID NO: 3859813 - RNA, 17 nt, Human
uucuaauggaaugguuu

SEQ ID NO: 3859814 - RNA, 17 nt, Human
uucuaaugucuucauuu

SEQ ID NO: 3859815 - RNA, 20 nt, Human
uucuaauuggcuuuacuauu

SEQ ID NO: 3859816 - RNA, 21 nt, Human
uucuacaaagcacuagagaau

SEQ ID NO: 3859817 - RNA, 15 nt, Human
uucuacaaugugaac

SEQ ID NO: 3859818 - RNA, 19 nt, Human
uucuacaaugugaacuuua

SEQ ID NO: 3859819 - RNA, 19 nt, Human
uucuacagcaaauuuauaa

SEQ ID NO: 3859820 - RNA, 15 nt, Human
uucuacagugguuuu

SEQ ID NO: 3859821 - RNA, 22 nt, Human
uucuacauaaguaauucaagaa

SEQ ID NO: 3859822 - RNA, 14 nt, Human
uucuacauuucacc

SEQ ID NO: 3859823 - RNA, 22 nt, Human
uucuacauuucaccuacuuugu

SEQ ID NO: 3859824 - RNA, 15 nt, Human
uucuaccauuucaga

SEQ ID NO: 3859825 - RNA, 18 nt, Human
uucuacccaacggcccug

SEQ ID NO: 3859826 - RNA, 14 nt, Human
uucuacccuagcca

SEQ ID NO: 3859827 - RNA, 18 nt, Human
uucuacccuagccauucc

SEQ ID NO: 3859828 - RNA, 20 nt, Human
uucuacccuagccauuccug

SEQ ID NO: 3859829 - RNA, 18 nt, Human
uucuaccggagagagaau

SEQ ID NO: 3859830 - RNA, 20 nt, Human
uucuaccggcuuugccaugu

SEQ ID NO: 3859831 - RNA, 23 nt, Human
uucuaccuauaacacucuaggau

SEQ ID NO: 3859832 - RNA, 12 nt, Human
uucuaccuccca

SEQ ID NO: 3859833 - RNA, 13 nt, Human
uucuaccugcccu

SEQ ID NO: 3859834 - RNA, 22 nt, Human
uucuacggaucaucaacaagau

SEQ ID NO: 3859835 - RNA, 13 nt, Human
uucuacuauuuau

SEQ ID NO: 3859836 - RNA, 18 nt, Human
uucuacucauauauaucu

SEQ ID NO: 3859837 - RNA, 17 nt, Human
uucuacucuuaaguuuc

SEQ ID NO: 3859838 - RNA, 13 nt, Human
uucuacugcucuc

SEQ ID NO: 3859839 - RNA, 17 nt, Human
uucuacugucaaaugau

SEQ ID NO: 3859840 - RNA, 16 nt, Human
uucuacuugcucugga

SEQ ID NO: 3859841 - RNA, 19 nt, Human
uucuacuuugauaugacug

SEQ ID NO: 3859842 - RNA, 15 nt, Human
uucuacuuuuaaaga

SEQ ID NO: 3859843 - RNA, 21 nt, Human
uucuagaaacaaacaucuaau

SEQ ID NO: 3859844 - RNA, 22 nt, Human
uucuagaaagagaaacaguugg

SEQ ID NO: 3859845 - RNA, 18 nt, Human
uucuagaaguuucccuuc

SEQ ID NO: 3859846 - RNA, 18 nt, Human
uucuagaauuauuuuuca

SEQ ID NO: 3859847 - RNA, 15 nt, Human
uucuagaauuuauca

SEQ ID NO: 3859848 - RNA, 20 nt, Human
uucuagacauggagguucua

SEQ ID NO: 3859849 - RNA, 15 nt, Human
uucuagacuuucugu

SEQ ID NO: 3859850 - RNA, 12 nt, Human
uucuagagaaga

SEQ ID NO: 3859851 - RNA, 21 nt, Human
uucuagagagggaauucucuu

SEQ ID NO: 3859852 - RNA, 22 nt, Human
uucuagaugauuaaauaagauu

SEQ ID NO: 3859853 - RNA, 16 nt, Human
uucuagcacuggccug

SEQ ID NO: 3859854 - RNA, 19 nt, Human
uucuagcaugaagacagag

SEQ ID NO: 3859855 - RNA, 21 nt, Human
uucuagcauggcauauuuuuc

SEQ ID NO: 3859856 - RNA, 18 nt, Human
uucuagcccauggacuuc

SEQ ID NO: 3859857 - RNA, 18 nt, Human
uucuagcuagaaauauga

SEQ ID NO: 3859858 - RNA, 19 nt, Human
uucuagcuagaaauaugau

SEQ ID NO: 3859859 - RNA, 21 nt, Human
uucuagcuguugagcuguuuu

SEQ ID NO: 3859860 - RNA, 22 nt, Human
uucuagcuuaucuacuuccaaa

SEQ ID NO: 3859861 - RNA, 11 nt, Human
uucuaggaaaa

SEQ ID NO: 3859862 - RNA, 23 nt, Human
uucuaggaagaauuuuaaaaaug

SEQ ID NO: 3859863 - RNA, 13 nt, Human
uucuaggacugaa

SEQ ID NO: 3859864 - RNA, 14 nt, Human
uucuaggacugaau

SEQ ID NO: 3859865 - RNA, 23 nt, Human
uucuaggacugaauuaugaaacu

SEQ ID NO: 3859866 - RNA, 20 nt, Human
uucuaggcaucucuguacuu

SEQ ID NO: 3859867 - RNA, 13 nt, Human
uucuaggccuggg

SEQ ID NO: 3859868 - RNA, 22 nt, Human
uucuaggcuacaauuuucuccc

SEQ ID NO: 3859869 - RNA, 23 nt, Human
uucuaggcuacaauuuucuccca

SEQ ID NO: 3859870 - RNA, 19 nt, Human
uucuggugaggccuugcuc

SEQ ID NO: 3859871 - RNA, 12 nt, Human
uucuggugugaa

SEQ ID NO: 3859872 - RNA, 17 nt, Human
uucugguguguuaacau

SEQ ID NO: 3859873 - RNA, 23 nt, Human
uucugguguuggacaagcuucug

SEQ ID NO: 3859874 - RNA, 22 nt, Human
uucugguuagcucagccccagc

SEQ ID NO: 3859875 - RNA, 15 nt, Human
uucugguuccagggu

SEQ ID NO: 3859876 - RNA, 12 nt, Human
uucugguucuaa

SEQ ID NO: 3859877 - RNA, 19 nt, Human
uucugguuguuuuuaaaca

SEQ ID NO: 3859878 - RNA, 11 nt, Human
uucuguaaaau

SEQ ID NO: 3859879 - RNA, 22 nt, Human
uucuguaaacucugcauccaga

SEQ ID NO: 3859880 - RNA, 14 nt, Human
uucuguaaauacca

SEQ ID NO: 3859881 - RNA, 23 nt, Human
uucuguaaauaccauugacacau

SEQ ID NO: 3859882 - RNA, 16 nt, Human
aaggcuggcugggcau

SEQ ID NO: 3859883 - RNA, 14 nt, Human
aaggcuggggcuau

SEQ ID NO: 3859884 - RNA, 22 nt, Human
aaggcugggggaagaagcucuc

SEQ ID NO: 3859885 - RNA, 16 nt, Human
aaggcuguauucagca

SEQ ID NO: 3859886 - RNA, 18 nt, Human
aaggcugucucagauaaa

SEQ ID NO: 3859887 - RNA, 16 nt, Human
aaggcugugcucccug

SEQ ID NO: 3859888 - RNA, 18 nt, Human
aaggcuuauauucaacca

SEQ ID NO: 3859889 - RNA, 16 nt, Human
aaggcuucucucucac

SEQ ID NO: 3859890 - RNA, 18 nt, Human
aaggcuucucucuguggg

SEQ ID NO: 3859891 - RNA, 19 nt, Human
aaggcuugggauuugcugu

SEQ ID NO: 3859892 - RNA, 16 nt, Human
aaggcuuuauauuuuu

SEQ ID NO: 3859893 - RNA, 16 nt, Human
aaggcuuucagggccu

SEQ ID NO: 3859894 - RNA, 21 nt, Human
aaggcuuugcccugcugcccu

SEQ ID NO: 3859895 - RNA, 12 nt, Human
aagggaaaaaua

SEQ ID NO: 3859896 - RNA, 15 nt, Human
aagggaaaaauauau

SEQ ID NO: 3859897 - RNA, 14 nt, Human
aagggaaacaguca

SEQ ID NO: 3859898 - RNA, 18 nt, Human
aagggaaacagucauuug

SEQ ID NO: 3859899 - RNA, 16 nt, Human
aagggaaacugccagc

SEQ ID NO: 3859900 - RNA, 15 nt, Human
aagggaaaguuuuuu

SEQ ID NO: 3859901 - RNA, 14 nt, Human
aagggaacagaaag

SEQ ID NO: 3859902 - RNA, 15 nt, Human
aagggaagacauuuc

SEQ ID NO: 3859903 - RNA, 17 nt, Human
aagggaaguugugccuu

SEQ ID NO: 3859904 - RNA, 14 nt, Human
aagggaaugcauua

SEQ ID NO: 3859905 - RNA, 16 nt, Human
aagggacauguuuuga

SEQ ID NO: 3859906 - RNA, 13 nt, Human
aagggaccaaggc

SEQ ID NO: 3859907 - RNA, 18 nt, Human
aagggacgcuacccggga

SEQ ID NO: 3859908 - RNA, 17 nt, Human
aagggacugagaaauuu

SEQ ID NO: 3859909 - RNA, 21 nt, Human
aagggacugagagaugcagaa

SEQ ID NO: 3859910 - RNA, 17 nt, Human
aagggacugauguuugu

SEQ ID NO: 3859911 - RNA, 17 nt, Human
aagggagagaccucauc

SEQ ID NO: 3859912 - RNA, 24 nt, Human
aagggagcacuggguugacuuuca

SEQ ID NO: 3859913 - RNA, 16 nt, Human
aagggagcagagaagg

SEQ ID NO: 3859914 - RNA, 11 nt, Human
aagggagccaa

SEQ ID NO: 3859915 - RNA, 12 nt, Human
aagggagccaag

SEQ ID NO: 3859916 - RNA, 11 nt, Human
aagggaggagg

SEQ ID NO: 3859917 - RNA, 16 nt, Human
aagggaggcugcugcu

SEQ ID NO: 3859918 - RNA, 16 nt, Human
aagggagggcucugag

SEQ ID NO: 3859919 - RNA, 15 nt, Human
aagggagucugccag

SEQ ID NO: 3859920 - RNA, 16 nt, Human
aagggagucugccagg

SEQ ID NO: 3859921 - RNA, 15 nt, Human
aagggauaugugaaa

SEQ ID NO: 3859922 - RNA, 13 nt, Human
aagggauccugcc

SEQ ID NO: 3859923 - RNA, 16 nt, Human
aagggauccugccugc

SEQ ID NO: 3859924 - RNA, 24 nt, Human
aagggauggaggucacacugguag

SEQ ID NO: 3859925 - RNA, 16 nt, Human
aagggauguauuugua

SEQ ID NO: 3859926 - RNA, 17 nt, Human
aagggauuacccaagca

SEQ ID NO: 3859927 - RNA, 18 nt, Human
aagggauuacccaagcaa

SEQ ID NO: 3859928 - RNA, 19 nt, Human
aagggauuacccaagcaaa

SEQ ID NO: 3859929 - RNA, 23 nt, Human
aagggauuuaguaacaucauuuu

SEQ ID NO: 3859930 - RNA, 16 nt, Human
aagggauuucuuaggg

SEQ ID NO: 3859931 - RNA, 20 nt, Human
aagggauuuuagucacacgu

SEQ ID NO: 3859932 - RNA, 22 nt, Human
aagggauuuuagucacacgugg

SEQ ID NO: 3859933 - RNA, 15 nt, Human
aagggauuuucagcc

SEQ ID NO: 3859934 - RNA, 18 nt, Human
aagggcaaaauucccagg

SEQ ID NO: 3859935 - RNA, 20 nt, Human
aagggcaacagaucaguaaa

SEQ ID NO: 3859936 - RNA, 22 nt, Human
aagggcaacagaucaguaaaga

SEQ ID NO: 3859937 - RNA, 16 nt, Human
aagggcacauagaaag

SEQ ID NO: 3859938 - RNA, 19 nt, Human
aagggcagaacacuaaccu

SEQ ID NO: 3859939 - RNA, 13 nt, Human
aagggcagaguua

SEQ ID NO: 3859940 - RNA, 19 nt, Human
aagggcagaguuacuugau

SEQ ID NO: 3859941 - RNA, 14 nt, Human
aagggcagggacag

SEQ ID NO: 3859942 - RNA, 15 nt, Human
aagggcaguggaggu

SEQ ID NO: 3859943 - RNA, 14 nt, Human
aagggcauaaagua

SEQ ID NO: 3859944 - RNA, 15 nt, Human
aagggcauaaaguaa

SEQ ID NO: 3859945 - RNA, 21 nt, Human
aagggcauaaaguaaauacau

SEQ ID NO: 3859946 - RNA, 21 nt, Human
aagggcaugagcauuggauac

SEQ ID NO: 3859947 - RNA, 15 nt, Human
aagggcaugccuugu

SEQ ID NO: 3859948 - RNA, 11 nt, Human
aagggccagag

SEQ ID NO: 3859949 - RNA, 14 nt, Human
aagggccagagcca

SEQ ID NO: 3859950 - RNA, 13 nt, Human
aagggccaggaga

SEQ ID NO: 3859951 - RNA, 22 nt, Human
aagggccaguccugccuggcca

SEQ ID NO: 3859952 - RNA, 18 nt, Human
aagggccagucugggcug

SEQ ID NO: 3859953 - RNA, 16 nt, Human
aagggcccagauucua

SEQ ID NO: 3859954 - RNA, 14 nt, Human
aagggcccccacau

SEQ ID NO: 3859955 - RNA, 17 nt, Human
aagggccuggccugagc

SEQ ID NO: 3859956 - RNA, 17 nt, Human
aagggcuagaaccugga

SEQ ID NO: 3859957 - RNA, 19 nt, Human
aagggcuagaaccuggaga

SEQ ID NO: 3859958 - RNA, 17 nt, Human
aagggcugaccugccuc

SEQ ID NO: 3859959 - RNA, 13 nt, Human
aagggcugcauga

SEQ ID NO: 3859960 - RNA, 15 nt, Human
aagggcugcaugaug

SEQ ID NO: 3859961 - RNA, 19 nt, Human
aagggcugccggggcagcc

SEQ ID NO: 3859962 - RNA, 21 nt, Human
aagggcuuacacguggaggaa

SEQ ID NO: 3859963 - RNA, 14 nt, Human
aagggcuuacuauu

SEQ ID NO: 3859964 - RNA, 15 nt, Human
aagggcuuacuauuu

SEQ ID NO: 3859965 - RNA, 19 nt, Human
aagggcuucugcacccucc

SEQ ID NO: 3859966 - RNA, 23 nt, Human
aagggcuucugcacccuccaccc

SEQ ID NO: 3859967 - RNA, 17 nt, Human
aaggggaauugaggaca

SEQ ID NO: 3859968 - RNA, 20 nt, Human
aaggggacaaguagccaccu

SEQ ID NO: 3859969 - RNA, 16 nt, Human
aaggggacaggccuca

SEQ ID NO: 3859970 - RNA, 16 nt, Human
aaggggacccccgccc

SEQ ID NO: 3859971 - RNA, 18 nt, Human
aaggggagagccugcugg

SEQ ID NO: 3859972 - RNA, 16 nt, Human
aaggggagcccacugu

SEQ ID NO: 3859973 - RNA, 13 nt, Human
aaggggaggaggg

SEQ ID NO: 3859974 - RNA, 18 nt, Human
aaggggaucauaaaguua

SEQ ID NO: 3859975 - RNA, 14 nt, Human
aaggggauuuuuau

SEQ ID NO: 3859976 - RNA, 14 nt, Human
aaggggcaaauuuu

SEQ ID NO: 3859977 - RNA, 20 nt, Human
aaggggcagucuggaggggc

SEQ ID NO: 3859978 - RNA, 13 nt, Human
aaggggccauccu

SEQ ID NO: 3859979 - RNA, 23 nt, Human
aaggggccauuuggcauaccuuu

SEQ ID NO: 3859980 - RNA, 22 nt, Human
aaggggcccaaauucuuucagu

SEQ ID NO: 3859981 - RNA, 14 nt, Human
aaggggcccugguc

SEQ ID NO: 3859982 - RNA, 21 nt, Human
aaggggcccugguccuuccag

SEQ ID NO: 3859983 - RNA, 15 nt, Human
aaggggcccuuggag

SEQ ID NO: 3859984 - RNA, 16 nt, Human
aaggggcccuuggagc

SEQ ID NO: 3859985 - RNA, 21 nt, Human
aaggggcccuuggagcgugga

SEQ ID NO: 3859986 - RNA, 13 nt, Human
aaggggccugagc

SEQ ID NO: 3859987 - RNA, 20 nt, Human
aaggggcggugcccacaccg

SEQ ID NO: 3859988 - RNA, 22 nt, Human
aagggggcggccuaugacuugg

SEQ ID NO: 3859989 - RNA, 12 nt, Human
aagggggcuggg

SEQ ID NO: 3859990 - RNA, 23 nt, Human
aagggggcugggacaugggaaag

SEQ ID NO: 3859991 - RNA, 15 nt, Human
aaggggggagcuggg

SEQ ID NO: 3859992 - RNA, 15 nt, Human
aaggggguagggaaa

SEQ ID NO: 3859993 - RNA, 12 nt, Human
aaggggguccca

SEQ ID NO: 3859994 - RNA, 17 nt, Human
aaggggguggugucucc

SEQ ID NO: 3859995 - RNA, 17 nt, Human
aaggggugccugggaac

SEQ ID NO: 3859996 - RNA, 13 nt, Human
aaggggugugcau

SEQ ID NO: 3859997 - RNA, 19 nt, Human
aagggguuccucaaauuuu

SEQ ID NO: 3859998 - RNA, 16 nt, Human
aagggguuggauugca

SEQ ID NO: 3859999 - RNA, 20 nt, Human
aagggguuugccauuugaua

SEQ ID NO: 3860000 - RNA, 16 nt, Human
aaggguaaacaauaua

SEQ ID NO: 3860001 - RNA, 19 nt, Human
aaggguaucaggugcugcc

SEQ ID NO: 3860002 - RNA, 22 nt, Human
aagggucagaggaccuguauuu

SEQ ID NO: 3860003 - RNA, 16 nt, Human
aagggucauagaaagg

SEQ ID NO: 3860004 - RNA, 17 nt, Human
aagggucauagaaaggg

SEQ ID NO: 3860005 - RNA, 19 nt, Human
aaggguccuucccucuccc

SEQ ID NO: 3860006 - RNA, 22 nt, Human
aagggucuagggagagacccuu

SEQ ID NO: 3860007 - RNA, 16 nt, Human
aagggucuugggaaau

SEQ ID NO: 3860008 - RNA, 21 nt, Human
aagggugaugggaaagcauug

SEQ ID NO: 3860009 - RNA, 16 nt, Human
aagggugcugcuuccc

SEQ ID NO: 3860010 - RNA, 17 nt, Human
aagggugggugcucaga

SEQ ID NO: 3860011 - RNA, 19 nt, Human
aagggugggugcucagaau

SEQ ID NO: 3860012 - RNA, 17 nt, Human
aagguaaaacaaaucag

SEQ ID NO: 3860013 - RNA, 14 nt, Human
aagguaaaaugcca

SEQ ID NO: 3860014 - RNA, 15 nt, Human
aagguaaaauucuaa

SEQ ID NO: 3860015 - RNA, 16 nt, Human
aagguaaaauucuaaa

SEQ ID NO: 3860016 - RNA, 19 nt, Human
aagguaaauaaaaagaaag

SEQ ID NO: 3860017 - RNA, 22 nt, Human
aagguacuguaugaucaaaugu

SEQ ID NO: 3860018 - RNA, 13 nt, Human
aagguacuucaaa

SEQ ID NO: 3860019 - RNA, 18 nt, Human
aagguacuuucauauuuu

SEQ ID NO: 3860020 - RNA, 19 nt, Human
aagguagaaugaccuugua

SEQ ID NO: 3860021 - RNA, 18 nt, Human
aagguagcauucuuugga

SEQ ID NO: 3860022 - RNA, 18 nt, Human
aagguagcuuaccugaca

SEQ ID NO: 3860023 - RNA, 22 nt, Human
aagguaguuuuuaccuaccaca

SEQ ID NO: 3860024 - RNA, 22 nt, Human
aagguauaucauucuaaagaua

SEQ ID NO: 3860025 - RNA, 16 nt, Human
aagguauuauacaugu

SEQ ID NO: 3860026 - RNA, 15 nt, Human
aaggucaccucacuc

SEQ ID NO: 3860027 - RNA, 18 nt, Human
aaggucaccucacucagc

SEQ ID NO: 3860028 - RNA, 22 nt, Human
aaggucaccucacucagcacca

SEQ ID NO: 3860029 - RNA, 15 nt, Human
aaggucacuguuucc

SEQ ID NO: 3860030 - RNA, 14 nt, Human
aaggucucucuuug

SEQ ID NO: 3860031 - RNA, 12 nt, Human
aaggucugcuuu

SEQ ID NO: 3860032 - RNA, 16 nt, Human
aaggucuggccucagg

SEQ ID NO: 3860033 - RNA, 21 nt, Human
uucuguaauauuuacaaugua

SEQ ID NO: 3860034 - RNA, 23 nt, Human
uucuguaauuauaucuaaaauau

SEQ ID NO: 3860035 - RNA, 11 nt, Human
uucuguaauuc

SEQ ID NO: 3860036 - RNA, 22 nt, Human
uucuguacauagccuauauuua

SEQ ID NO: 3860037 - RNA, 22 nt, Human
uucuguacaugcauugagcucu

SEQ ID NO: 3860038 - RNA, 20 nt, Human
uucuguacugauuuuuguaa

SEQ ID NO: 3860039 - RNA, 15 nt, Human
uucuguacuuccuga

SEQ ID NO: 3860040 - RNA, 17 nt, Human
uucuguacuuccugagu

SEQ ID NO: 3860041 - RNA, 18 nt, Human
uucuguacuuuuuggcau

SEQ ID NO: 3860042 - RNA, 19 nt, Human
uucuguacuuuuuggcaua

SEQ ID NO: 3860043 - RNA, 20 nt, Human
uucuguagaaaugguuguau

SEQ ID NO: 3860044 - RNA, 22 nt, Human
uucuguagaaaugguuguauua

SEQ ID NO: 3860045 - RNA, 16 nt, Human
uucuguagguuaaaaa

SEQ ID NO: 3860046 - RNA, 14 nt, Human
uucuguagucauuu

SEQ ID NO: 3860047 - RNA, 11 nt, Human
uucuguauaaa

SEQ ID NO: 3860048 - RNA, 23 nt, Human
uucuguauagacaggagaagaaa

SEQ ID NO: 3860049 - RNA, 19 nt, Human
uucuguauauaaaugggaa

SEQ ID NO: 3860050 - RNA, 21 nt, Human
uucuguauauaaaugggaaca

SEQ ID NO: 3860051 - RNA, 17 nt, Human
uucuguaucuacuuuaa

SEQ ID NO: 3860052 - RNA, 13 nt, Human
uucuguauuugaa

SEQ ID NO: 3860053 - RNA, 17 nt, Human
uucuguauuugaaagug

SEQ ID NO: 3860054 - RNA, 22 nt, Human
uucuguauuuuuuuuucuaaga

SEQ ID NO: 3860055 - RNA, 22 nt, Human
uucugucaaagucagaacaaau

SEQ ID NO: 3860056 - RNA, 23 nt, Human
uucugucaaagucagaacaaauu

SEQ ID NO: 3860057 - RNA, 24 nt, Human
uucugucagaugagaacaaagcug

SEQ ID NO: 3860058 - RNA, 22 nt, Human
uucugucaucuaccuuuucucu

SEQ ID NO: 3860059 - RNA, 16 nt, Human
uucuguccccucuucc

SEQ ID NO: 3860060 - RNA, 14 nt, Human
uucugucccuucug

SEQ ID NO: 3860061 - RNA, 17 nt, Human
uucuguccgagcuuuga

SEQ ID NO: 3860062 - RNA, 21 nt, Human
uucuguccgagcuuugaaaau

SEQ ID NO: 3860063 - RNA, 19 nt, Human
uucuguccuacucuguguc

SEQ ID NO: 3860064 - RNA, 18 nt, Human
uucuguccuggugucacu

SEQ ID NO: 3860065 - RNA, 13 nt, Human
uucugucuccagc

SEQ ID NO: 3860066 - RNA, 13 nt, Human
uucugucucugcc

SEQ ID NO: 3860067 - RNA, 19 nt, Human
uucugucucugccucccuc

SEQ ID NO: 3860068 - RNA, 21 nt, Human
uucugucucugccucccucac

SEQ ID NO: 3860069 - RNA, 17 nt, Human
uucugucuucacaacag

SEQ ID NO: 3860070 - RNA, 21 nt, Human
uucugucuucauccccucaga

SEQ ID NO: 3860071 - RNA, 17 nt, Human
uucugucuucuacagau

SEQ ID NO: 3860072 - RNA, 14 nt, Human
uucugucuuuagau

SEQ ID NO: 3860073 - RNA, 17 nt, Human
uucugugaucauuuauu

SEQ ID NO: 3860074 - RNA, 14 nt, Human
uucugugcaccugg

SEQ ID NO: 3860075 - RNA, 13 nt, Human
uucugugcagcca

SEQ ID NO: 3860076 - RNA, 16 nt, Human
uucugugcccuacuca

SEQ ID NO: 3860077 - RNA, 17 nt, Human
uucuguggaaaguguaa

SEQ ID NO: 3860078 - RNA, 18 nt, Human
uucuguggaaaguguaaa

SEQ ID NO: 3860079 - RNA, 23 nt, Human
uucuguggaaaguguaaagcauu

SEQ ID NO: 3860080 - RNA, 22 nt, Human
uucuguggaugccgauuucugu

SEQ ID NO: 3860081 - RNA, 16 nt, Human
uucuguggggccccuc

SEQ ID NO: 3860082 - RNA, 21 nt, Human
uucugugguuccucugcucac

SEQ ID NO: 3860083 - RNA, 20 nt, Human
uucugugguuuuccccuccc

SEQ ID NO: 3860084 - RNA, 17 nt, Human
uucuguguaaccauuuu

SEQ ID NO: 3860085 - RNA, 17 nt, Human
uucuguguauuuaauug

SEQ ID NO: 3860086 - RNA, 20 nt, Human
uucuguguauuuaauuguaa

SEQ ID NO: 3860087 - RNA, 22 nt, Human
uucugugucuuucacagcuccu

SEQ ID NO: 3860088 - RNA, 13 nt, Human
uucugugugaaga

SEQ ID NO: 3860089 - RNA, 18 nt, Human
uucugugugucaguuuuc

SEQ ID NO: 3860090 - RNA, 14 nt, Human
uucuguguguuccu

SEQ ID NO: 3860091 - RNA, 17 nt, Human
uucuguguuuacagaga

SEQ ID NO: 3860092 - RNA, 17 nt, Human
uucuguuaaaaucuauu

SEQ ID NO: 3860093 - RNA, 13 nt, Human
uucuguuaaaaug

SEQ ID NO: 3860094 - RNA, 13 nt, Human
uucuguuacaaaa

SEQ ID NO: 3860095 - RNA, 14 nt, Human
uucuguuacaaaau

SEQ ID NO: 3860096 - RNA, 19 nt, Human
uucuguuauauccccugcu

SEQ ID NO: 3860097 - RNA, 17 nt, Human
uucuguucauuuguuau

SEQ ID NO: 3860098 - RNA, 13 nt, Human
uucuguuccaaau

SEQ ID NO: 3860099 - RNA, 23 nt, Human
uucuguuccucucuuuuccuguu

SEQ ID NO: 3860100 - RNA, 13 nt, Human
uucuguucuaguu

SEQ ID NO: 3860101 - RNA, 11 nt, Human
uucuguucuuu

SEQ ID NO: 3860102 - RNA, 22 nt, Human
uucuguuggauuccaugcuaag

SEQ ID NO: 3860103 - RNA, 12 nt, Human
uucuguuuaacu

SEQ ID NO: 3860104 - RNA, 19 nt, Human
uucuguuuacaucaguuuu

SEQ ID NO: 3860105 - RNA, 15 nt, Human
uucuguuuccuuuuu

SEQ ID NO: 3860106 - RNA, 20 nt, Human
uucuguuucuauucucuccu

SEQ ID NO: 3860107 - RNA, 12 nt, Human
uucuguuucuca

SEQ ID NO: 3860108 - RNA, 11 nt, Human
uucuguuucuu

SEQ ID NO: 3860109 - RNA, 12 nt, Human
uucuguuucuuc

SEQ ID NO: 3860110 - RNA, 14 nt, Human
uucuguuugauucu

SEQ ID NO: 3860111 - RNA, 12 nt, Human
uucuguuuguua

SEQ ID NO: 3860112 - RNA, 17 nt, Human
uucuguuuuauaauuuu

SEQ ID NO: 3860113 - RNA, 12 nt, Human
uucuguuuucaa

SEQ ID NO: 3860114 - RNA, 13 nt, Human
uucuguuuucaau

SEQ ID NO: 3860115 - RNA, 16 nt, Human
uucuguuuugccugaa

SEQ ID NO: 3860116 - RNA, 21 nt, Human
uucuguuuugccugaaguugg

SEQ ID NO: 3860117 - RNA, 12 nt, Human
uucuguuuuguu

SEQ ID NO: 3860118 - RNA, 23 nt, Human
uucuguuuuguuuggcaaggaaa

SEQ ID NO: 3860119 - RNA, 13 nt, Human
uucuuaaaaagua

SEQ ID NO: 3860120 - RNA, 14 nt, Human
uucuuaaaaaguua

SEQ ID NO: 3860121 - RNA, 16 nt, Human
uucuuaaacacuugca

SEQ ID NO: 3860122 - RNA, 19 nt, Human
uucuuaaauaagaaacuuu

SEQ ID NO: 3860123 - RNA, 15 nt, Human
uucuuaaauaauaaa

SEQ ID NO: 3860124 - RNA, 16 nt, Human
uucuuaaauaaugcuu

SEQ ID NO: 3860125 - RNA, 14 nt, Human
uucuuaaauaucuu

SEQ ID NO: 3860126 - RNA, 13 nt, Human
uucuuaacaaccu

SEQ ID NO: 3860127 - RNA, 22 nt, Human
uucuuaaccagaucauugugaa

SEQ ID NO: 3860128 - RNA, 16 nt, Human
uucuuaacuucuugcu

SEQ ID NO: 3860129 - RNA, 21 nt, Human
uucuuaagacgugauuuugcu

SEQ ID NO: 3860130 - RNA, 16 nt, Human
uucuuaauuaauuuga

SEQ ID NO: 3860131 - RNA, 22 nt, Human
uucuuaauuaauuugauuaaca

SEQ ID NO: 3860132 - RNA, 18 nt, Human
uucuuaauuauuauaaaa

SEQ ID NO: 3860133 - RNA, 19 nt, Human
uucuuaauuauuauaaaaa

SEQ ID NO: 3860134 - RNA, 13 nt, Human
uucuuaauucuua

SEQ ID NO: 3860135 - RNA, 20 nt, Human
uucuuaauuuggaaacuaau

SEQ ID NO: 3860136 - RNA, 14 nt, Human
uucuuacaaaccau

SEQ ID NO: 3860137 - RNA, 12 nt, Human
uucuuacacaua

SEQ ID NO: 3860138 - RNA, 22 nt, Human
uucuuacacgacuaaguugaau

SEQ ID NO: 3860139 - RNA, 13 nt, Human
uucuuacagacug

SEQ ID NO: 3860140 - RNA, 16 nt, Human
uucuuacauaauuuuu

SEQ ID NO: 3860141 - RNA, 16 nt, Human
uucuuacgcaaugcuu

SEQ ID NO: 3860142 - RNA, 20 nt, Human
uucuuacuaaaaaguauaaa

SEQ ID NO: 3860143 - RNA, 16 nt, Human
uucuuacuccuccucu

SEQ ID NO: 3860144 - RNA, 19 nt, Human
uucuuacuccuccucuuuc

SEQ ID NO: 3860145 - RNA, 12 nt, Human
uucuuagaaauu

SEQ ID NO: 3860146 - RNA, 22 nt, Human
uucuuagaacaguggaaacuau

SEQ ID NO: 3860147 - RNA, 18 nt, Human
uucuuagacuuuuccaau

SEQ ID NO: 3860148 - RNA, 18 nt, Human
uucuuagauaucuuuuua

SEQ ID NO: 3860149 - RNA, 17 nt, Human
uucuuagccuguggcag

SEQ ID NO: 3860150 - RNA, 23 nt, Human
uucuuagcucaaugagcauguuu

SEQ ID NO: 3860151 - RNA, 19 nt, Human
uucuuagcuuuuuaauugu

SEQ ID NO: 3860152 - RNA, 20 nt, Human
uucuuagcuuuuuaauuguu

SEQ ID NO: 3860153 - RNA, 15 nt, Human
uucuuaguagauuuu

SEQ ID NO: 3860154 - RNA, 13 nt, Human
uucuuagugucac

SEQ ID NO: 3860155 - RNA, 13 nt, Human
uucuuaguucuca

SEQ ID NO: 3860156 - RNA, 14 nt, Human
uucuuaguugcugu

SEQ ID NO: 3860157 - RNA, 20 nt, Human
uucuuauacagauaaaacau

SEQ ID NO: 3860158 - RNA, 22 nt, Human
uucuuauaggaaagcuugagua

SEQ ID NO: 3860159 - RNA, 16 nt, Human
uucuuauauaugugaa

SEQ ID NO: 3860160 - RNA, 13 nt, Human
uugacaacaucug

SEQ ID NO: 3860161 - RNA, 16 nt, Human
uugacaacugugacug

SEQ ID NO: 3860162 - RNA, 15 nt, Human
uugacaagcuggcuu

SEQ ID NO: 3860163 - RNA, 22 nt, Human
uugacaagucauuuuaacuuua

SEQ ID NO: 3860164 - RNA, 19 nt, Human
uugacaauaaaauauuauu

SEQ ID NO: 3860165 - RNA, 14 nt, Human
uugacacaagugga

SEQ ID NO: 3860166 - RNA, 17 nt, Human
uugacacaaguggaccu

SEQ ID NO: 3860167 - RNA, 16 nt, Human
uugacacaauuggaau

SEQ ID NO: 3860168 - RNA, 11 nt, Human
uugacacauag

SEQ ID NO: 3860169 - RNA, 18 nt, Human
uugacacauccgccuuuu

SEQ ID NO: 3860170 - RNA, 21 nt, Human
uugacacauccgccuuuugua

SEQ ID NO: 3860171 - RNA, 12 nt, Human
uugacaccugcu

SEQ ID NO: 3860172 - RNA, 17 nt, Human
uugacacucugcagacu

SEQ ID NO: 3860173 - RNA, 15 nt, Human
uugacacugaaauaa

SEQ ID NO: 3860174 - RNA, 22 nt, Human
uugacacugaacuuaauaacug

SEQ ID NO: 3860175 - RNA, 16 nt, Human
uugacacugcucuaac

SEQ ID NO: 3860176 - RNA, 23 nt, Human
uugacacugcucuaacagcccuc

SEQ ID NO: 3860177 - RNA, 15 nt, Human
uugacagaacacugu

SEQ ID NO: 3860178 - RNA, 17 nt, Human
uugacagaauauguuuc

SEQ ID NO: 3860179 - RNA, 23 nt, Human
uugacagagagagauacucuggg

SEQ ID NO: 3860180 - RNA, 19 nt, Human
uugacagagccugccccag

SEQ ID NO: 3860181 - RNA, 17 nt, Human
uugacagaucaagcugu

SEQ ID NO: 3860182 - RNA, 18 nt, Human
uugacagaucaagcugug

SEQ ID NO: 3860183 - RNA, 12 nt, Human
uugacaggaggu

SEQ ID NO: 3860184 - RNA, 16 nt, Human
uugacaguaacuuggu

SEQ ID NO: 3860185 - RNA, 17 nt, Human
uugacaguucugaagaa

SEQ ID NO: 3860186 - RNA, 20 nt, Human
uugacauaacacuauaaagg

SEQ ID NO: 3860187 - RNA, 17 nt, Human
uugacauauuuaauguu

SEQ ID NO: 3860188 - RNA, 16 nt, Human
uugacaucagccagcu

SEQ ID NO: 3860189 - RNA, 13 nt, Human
uugacauguacag

SEQ ID NO: 3860190 - RNA, 14 nt, Human
uugacauugaaauc

SEQ ID NO: 3860191 - RNA, 14 nt, Human
uugacauugcguuu

SEQ ID NO: 3860192 - RNA, 13 nt, Human
uugacauuuaauu

SEQ ID NO: 3860193 - RNA, 16 nt, Human
uugaccaagcaggaag

SEQ ID NO: 3860194 - RNA, 11 nt, Human
uugaccaggcc

SEQ ID NO: 3860195 - RNA, 20 nt, Human
uugaccgcgacuaauuucaa

SEQ ID NO: 3860196 - RNA, 20 nt, Human
uugaccgugaggccagagac

SEQ ID NO: 3860197 - RNA, 22 nt, Human
uugaccucacagugacccuucc

SEQ ID NO: 3860198 - RNA, 21 nt, Human
uugaccuccucccuguuauuu

SEQ ID NO: 3860199 - RNA, 19 nt, Human
uugaccugaggcccuucuc

SEQ ID NO: 3860200 - RNA, 22 nt, Human
uugaccugaggcccuucucucc

SEQ ID NO: 3860201 - RNA, 20 nt, Human
uugacggaugauuggauuau

SEQ ID NO: 3860202 - RNA, 20 nt, Human
uugacuaacucaaauacaca

SEQ ID NO: 3860203 - RNA, 23 nt, Human
uugacuaacucaaauacacauuu

SEQ ID NO: 3860204 - RNA, 15 nt, Human
uugacuaauuuuaca

SEQ ID NO: 3860205 - RNA, 22 nt, Human
uugacuagaaaauuuaaaacau

SEQ ID NO: 3860206 - RNA, 19 nt, Human
uugacuagggauucaggcu

SEQ ID NO: 3860207 - RNA, 12 nt, Human
uugacuauuuuu

SEQ ID NO: 3860208 - RNA, 15 nt, Human
uugacucaggauuua

SEQ ID NO: 3860209 - RNA, 19 nt, Human
uugacucuggcaaagcuuu

SEQ ID NO: 3860210 - RNA, 13 nt, Human
uugacucugggga

SEQ ID NO: 3860211 - RNA, 19 nt, Human
uugacuggcugugugaccu

SEQ ID NO: 3860212 - RNA, 17 nt, Human
uugacuggguuucucug

SEQ ID NO: 3860213 - RNA, 12 nt, Human
uugacuguuuuu

SEQ ID NO: 3860214 - RNA, 19 nt, Human
uugacuguuuuuacccaua

SEQ ID NO: 3860215 - RNA, 14 nt, Human
uuuuguauguuaaa

SEQ ID NO: 3860216 - RNA, 23 nt, Human
uuuugucaaugcaguugucucug

SEQ ID NO: 3860217 - RNA, 16 nt, Human
uuuugucauauaagau

SEQ ID NO: 3860218 - RNA, 20 nt, Human
uuuugucccccaacuugaga

SEQ ID NO: 3860219 - RNA, 22 nt, Human
uuuugucgaauuuuuauuauuu

SEQ ID NO: 3860220 - RNA, 15 nt, Human
uuuugucuacacacc

SEQ ID NO: 3860221 - RNA, 12 nt, Human
uuuugucuugaa

SEQ ID NO: 3860222 - RNA, 13 nt, Human
uuuugucuugugu

SEQ ID NO: 3860223 - RNA, 17 nt, Human
uuuugucuuuaaauaga

SEQ ID NO: 3860224 - RNA, 14 nt, Human
uuuugucuuuuaug

SEQ ID NO: 3860225 - RNA, 18 nt, Human
uuuugugaaaaugucaaa

SEQ ID NO: 3860226 - RNA, 12 nt, Human
uuuugugaaauu

SEQ ID NO: 3860227 - RNA, 20 nt, Human
uuuugugaaauuuuucauau

SEQ ID NO: 3860228 - RNA, 14 nt, Human
uuuugugaagacug

SEQ ID NO: 3860229 - RNA, 14 nt, Human
uuuugugaagcaaa

SEQ ID NO: 3860230 - RNA, 14 nt, Human
uuuugugaauuagg

SEQ ID NO: 3860231 - RNA, 18 nt, Human
agcuuguaugcaauggau

SEQ ID NO: 3860232 - RNA, 19 nt, Human
agcuugugcacaauucugu

SEQ ID NO: 3860233 - RNA, 14 nt, Human
agcuuguggagccc

SEQ ID NO: 3860234 - RNA, 18 nt, Human
agcuuguggagccccaca

SEQ ID NO: 3860235 - RNA, 17 nt, Human
agcuuguugacucagcu

SEQ ID NO: 3860236 - RNA, 19 nt, Human
agcuuguuuacaugcuuau

SEQ ID NO: 3860237 - RNA, 19 nt, Human
agcuuguuuuggacuuugu

SEQ ID NO: 3860238 - RNA, 12 nt, Human
agcuuuaaauua

SEQ ID NO: 3860239 - RNA, 22 nt, Human
agcuuuaaccauuaaaacugaa

SEQ ID NO: 3860240 - RNA, 18 nt, Human
agcuuuaacuuaaauagu

SEQ ID NO: 3860241 - RNA, 19 nt, Human
agcuuuacaugcaauuuau

SEQ ID NO: 3860242 - RNA, 13 nt, Human
agcuuuacccuca

SEQ ID NO: 3860243 - RNA, 18 nt, Human
agcuuuacccucaggcau

SEQ ID NO: 3860244 - RNA, 21 nt, Human
agcuuuacuggggcuggggaa

SEQ ID NO: 3860245 - RNA, 17 nt, Human
agcuuuagacccugggu

SEQ ID NO: 3860246 - RNA, 22 nt, Human
agcuuuagacccugggugggcu

SEQ ID NO: 3860247 - RNA, 17 nt, Human
agcuuuauauauggaca

SEQ ID NO: 3860248 - RNA, 23 nt, Human
agcuuuaucaaagggugaaaauu

SEQ ID NO: 3860249 - RNA, 14 nt, Human
agcuuuaugauuuu

SEQ ID NO: 3860250 - RNA, 14 nt, Human
agcuuuauguaaua

SEQ ID NO: 3860251 - RNA, 18 nt, Human
agcuuuauguucauuugu

SEQ ID NO: 3860252 - RNA, 23 nt, Human
agcuuuauguucauuuguuuguu

SEQ ID NO: 3860253 - RNA, 15 nt, Human
agcuuucaaagcauu

SEQ ID NO: 3860254 - RNA, 17 nt, Human
agcuuucaagugccuuu

SEQ ID NO: 3860255 - RNA, 17 nt, Human
agcuuuccauguugcug

SEQ ID NO: 3860256 - RNA, 13 nt, Human
agcuuuccugccc

SEQ ID NO: 3860257 - RNA, 14 nt, Human
agcuuuccugcccc

SEQ ID NO: 3860258 - RNA, 22 nt, Human
agcuuuccugccccaggccuga

SEQ ID NO: 3860259 - RNA, 23 nt, Human
agcuuuccuguugaaugacaaag

SEQ ID NO: 3860260 - RNA, 13 nt, Human
agcuuucuccccg

SEQ ID NO: 3860261 - RNA, 13 nt, Human
agcuuucucugcu

SEQ ID NO: 3860262 - RNA, 19 nt, Human
agcuuucucugcuucagcu

SEQ ID NO: 3860263 - RNA, 17 nt, Human
agcuuucugaacagcug

SEQ ID NO: 3860264 - RNA, 20 nt, Human
agcuuucugaccuucagcuc

SEQ ID NO: 3860265 - RNA, 22 nt, Human
agcuuucuguccuuuuggcacu

SEQ ID NO: 3860266 - RNA, 22 nt, Human
agcuuucuuuuuaaagcuuuug

SEQ ID NO: 3860267 - RNA, 18 nt, Human
agcuuugaaaauucagug

SEQ ID NO: 3860268 - RNA, 19 nt, Human
agcuuugaaaauucagugg

SEQ ID NO: 3860269 - RNA, 21 nt, Human
agcuuugacucaggagccugu

SEQ ID NO: 3860270 - RNA, 22 nt, Human
agcuuugagguggaagagggcu

SEQ ID NO: 3860271 - RNA, 21 nt, Human
agcuuugcaaacccauuaagg

SEQ ID NO: 3860272 - RNA, 18 nt, Human
agcuuugcauguuccacu

SEQ ID NO: 3860273 - RNA, 22 nt, Human
agcuuugcauguuccacuaacc

SEQ ID NO: 3860274 - RNA, 19 nt, Human
agcuuugccagcugcugcu

SEQ ID NO: 3860275 - RNA, 22 nt, Human
agcuuugcccaacaccagcccc

SEQ ID NO: 3860276 - RNA, 13 nt, Human
agcuuugcucaua

SEQ ID NO: 3860277 - RNA, 19 nt, Human
agcuuugcucauauuuccc

SEQ ID NO: 3860278 - RNA, 21 nt, Human
agcuuugcucauauuucccau

SEQ ID NO: 3860279 - RNA, 13 nt, Human
agcuuugcugcug

SEQ ID NO: 3860280 - RNA, 20 nt, Human
agcuuugcuucucucucuaa

SEQ ID NO: 3860281 - RNA, 12 nt, Human
agcuuuggacac

SEQ ID NO: 3860282 - RNA, 14 nt, Human
agcuuuggacacac

SEQ ID NO: 3860283 - RNA, 19 nt, Human
agcuuuggacccaaggaaa

SEQ ID NO: 3860284 - RNA, 14 nt, Human
agcuuuggacgcac

SEQ ID NO: 3860285 - RNA, 19 nt, Human
agcuuuggacgcacacagc

SEQ ID NO: 3860286 - RNA, 20 nt, Human
agcuuuggcuaugagggccu

SEQ ID NO: 3860287 - RNA, 16 nt, Human
agcuuuguccccugcu

SEQ ID NO: 3860288 - RNA, 17 nt, Human
agcuuuguccccugcuu

SEQ ID NO: 3860289 - RNA, 20 nt, Human
agcuuuguccccugcuucag

SEQ ID NO: 3860290 - RNA, 19 nt, Human
agcuuugucguauuuggca

SEQ ID NO: 3860291 - RNA, 21 nt, Human
agcuuugugacuguauauaaa

SEQ ID NO: 3860292 - RNA, 12 nt, Human
agcuuuguguuu

SEQ ID NO: 3860293 - RNA, 19 nt, Human
agcuuuguuucaaccaagu

SEQ ID NO: 3860294 - RNA, 13 nt, Human
agcuuuguuuguu

SEQ ID NO: 3860295 - RNA, 21 nt, Human
agcuuuguuuguugucagcug

SEQ ID NO: 3860296 - RNA, 12 nt, Human
agcuuuuaaaaa

SEQ ID NO: 3860297 - RNA, 16 nt, Human
agcuuuuaaaagauuu

SEQ ID NO: 3860298 - RNA, 18 nt, Human
agcuuuuaguacccaccu

SEQ ID NO: 3860299 - RNA, 15 nt, Human
agcuuuuaugugaaa

SEQ ID NO: 3860300 - RNA, 15 nt, Human
agcuuuuauuguaua

SEQ ID NO: 3860301 - RNA, 20 nt, Human
agcuuuucaaacaagaaugu

SEQ ID NO: 3860302 - RNA, 14 nt, Human
agcuuuucaccuuu

SEQ ID NO: 3860303 - RNA, 14 nt, Human
agcuuuucauugcu

SEQ ID NO: 3860304 - RNA, 13 nt, Human
agcuuuucccuuc

SEQ ID NO: 3860305 - RNA, 16 nt, Human
agcuuuucccuucuuu

SEQ ID NO: 3860306 - RNA, 18 nt, Human
agcuuuugaauaaaaacu

SEQ ID NO: 3860307 - RNA, 12 nt, Human
agcuuuugcaua

SEQ ID NO: 3860308 - RNA, 15 nt, Human
agcuuuuuaaaacau

SEQ ID NO: 3860309 - RNA, 15 nt, Human
agcuuuuuaauuguu

SEQ ID NO: 3860310 - RNA, 19 nt, Human
agcuuuuuucucugauaca

SEQ ID NO: 3860311 - RNA, 14 nt, Human
agcuuuuuucuuua

SEQ ID NO: 3860312 - RNA, 22 nt, Human
agcuuuuuuuuuuuaauuuugu

SEQ ID NO: 3860313 - RNA, 13 nt, Human
aggaaaaaaacuu

SEQ ID NO: 3860314 - RNA, 21 nt, Human
aggaaaaaaacuuuuauaaau

SEQ ID NO: 3860315 - RNA, 13 nt, Human
aggaaaaaaagac

SEQ ID NO: 3860316 - RNA, 23 nt, Human
aggaaaaaauguuggauuuauaa

SEQ ID NO: 3860317 - RNA, 17 nt, Human
aggaaaaacacaagcaa

SEQ ID NO: 3860318 - RNA, 19 nt, Human
aggaaaaacacaagcaaaa

SEQ ID NO: 3860319 - RNA, 13 nt, Human
aggaaaaacaggu

SEQ ID NO: 3860320 - RNA, 13 nt, Human
aggaaaaacugau

SEQ ID NO: 3860321 - RNA, 16 nt, Human
aggaaaaagaacuucc

SEQ ID NO: 3860322 - RNA, 12 nt, Human
aggaaaaagcuc

SEQ ID NO: 3860323 - RNA, 12 nt, Human
aggaaaaaggac

SEQ ID NO: 3860324 - RNA, 14 nt, Human
aggaaaaaggacag

SEQ ID NO: 3860325 - RNA, 17 nt, Human
aggaaaaauaugugaag

SEQ ID NO: 3860326 - RNA, 14 nt, Human
aggaaaaaugugua

SEQ ID NO: 3860327 - RNA, 19 nt, Human
aggaaaaccaagccguggc

SEQ ID NO: 3860328 - RNA, 22 nt, Human
aggaaaaccaagccguggcuuc

SEQ ID NO: 3860329 - RNA, 16 nt, Human
aggaaaaccugaagac

SEQ ID NO: 3860330 - RNA, 20 nt, Human
aggaaaacugcauggagacg

SEQ ID NO: 3860331 - RNA, 14 nt, Human
aggaaaagaaaaaa

SEQ ID NO: 3860332 - RNA, 12 nt, Human
aggaaaagaaau

SEQ ID NO: 3860333 - RNA, 14 nt, Human
aggaaaagccucug

SEQ ID NO: 3860334 - RNA, 16 nt, Human
aggaaaagcugcugac

SEQ ID NO: 3860335 - RNA, 13 nt, Human
aggaaaaggccug

SEQ ID NO: 3860336 - RNA, 15 nt, Human
aggaaaaggccuggg

SEQ ID NO: 3860337 - RNA, 16 nt, Human
aggaaaaggccugggg

SEQ ID NO: 3860338 - RNA, 17 nt, Human
aggaaaaggccuggggu

SEQ ID NO: 3860339 - RNA, 18 nt, Human
aggaaaaggccuggggug

SEQ ID NO: 3860340 - RNA, 21 nt, Human
aggaaaaggugauauccauuc

SEQ ID NO: 3860341 - RNA, 16 nt, Human
aggaaaaguacauuua

SEQ ID NO: 3860342 - RNA, 18 nt, Human
aggaagguuuucuccacu

SEQ ID NO: 3860343 - RNA, 15 nt, Human
aggaaguagaaacaa

SEQ ID NO: 3860344 - RNA, 16 nt, Human
aggaaguagcacaggc

SEQ ID NO: 3860345 - RNA, 18 nt, Human
aggaagucuaggagcugg

SEQ ID NO: 3860346 - RNA, 17 nt, Human
aggaagugaaaauaggu

SEQ ID NO: 3860347 - RNA, 15 nt, Human
aggaagugcccccuc

SEQ ID NO: 3860348 - RNA, 17 nt, Human
aggaaguguaacagcug

SEQ ID NO: 3860349 - RNA, 21 nt, Human
aggaaguguugaagggaggug

SEQ ID NO: 3860350 - RNA, 22 nt, Human
aggaaguugacuuauaguacau

SEQ ID NO: 3860351 - RNA, 23 nt, Human
aggaaguugacuuauaguacaug

SEQ ID NO: 3860352 - RNA, 16 nt, Human
aggaaguuuucuguag

SEQ ID NO: 3860353 - RNA, 13 nt, Human
aggaauaaauaaa

SEQ ID NO: 3860354 - RNA, 15 nt, Human
aggaauacaauauau

SEQ ID NO: 3860355 - RNA, 17 nt, Human
aggaauauaugugugcc

SEQ ID NO: 3860356 - RNA, 17 nt, Human
aggaauauuauauuugg

SEQ ID NO: 3860357 - RNA, 22 nt, Human
aggaauauuauauuuggaugca

SEQ ID NO: 3860358 - RNA, 15 nt, Human
aggaaucaacagggc

SEQ ID NO: 3860359 - RNA, 17 nt, Human
aggaaucaacagggcag

SEQ ID NO: 3860360 - RNA, 19 nt, Human
aggaaucaagagcugcccu

SEQ ID NO: 3860361 - RNA, 21 nt, Human
aggaaucaagagcugcccucc

SEQ ID NO: 3860362 - RNA, 19 nt, Human
aggaaucacguuagaggaa

SEQ ID NO: 3860363 - RNA, 18 nt, Human
aggaaucacucuugugga

SEQ ID NO: 3860364 - RNA, 13 nt, Human
aggaauccuggca

SEQ ID NO: 3860365 - RNA, 15 nt, Human
aggaauccuggcagc

SEQ ID NO: 3860366 - RNA, 13 nt, Human
aggaaucuuuaag

SEQ ID NO: 3860367 - RNA, 16 nt, Human
aggaaucuuuaagcag

SEQ ID NO: 3860368 - RNA, 23 nt, Human
aggaaugaaauccugcuucagug

SEQ ID NO: 3860369 - RNA, 15 nt, Human
aggaaugcaaagaug

SEQ ID NO: 3860370 - RNA, 24 nt, Human
aggaaugccuccucccugggcaga

SEQ ID NO: 3860371 - RNA, 16 nt, Human
aggaaugccuguguga

SEQ ID NO: 3860372 - RNA, 22 nt, Human
aggaaugcuaacaguucacuug

SEQ ID NO: 3860373 - RNA, 12 nt, Human
aggaaugcuccc

SEQ ID NO: 3860374 - RNA, 14 nt, Human
aggaaugcuccccc

SEQ ID NO: 3860375 - RNA, 22 nt, Human
aggaaugcucccccauccuccc

SEQ ID NO: 3860376 - RNA, 15 nt, Human
aggaaugcuggacug

SEQ ID NO: 3860377 - RNA, 16 nt, Human
aggaaugcuggacugg

SEQ ID NO: 3860378 - RNA, 21 nt, Human
aggaaugggggccucuucaaa

SEQ ID NO: 3860379 - RNA, 18 nt, Human
aggaauguagcugguuuc

SEQ ID NO: 3860380 - RNA, 17 nt, Human
aggaauuaaguuaucuu

SEQ ID NO: 3860381 - RNA, 22 nt, Human
aggaauucccagcccaaagcug

SEQ ID NO: 3860382 - RNA, 20 nt, Human
aggaauuccccaaagaaugu

SEQ ID NO: 3860383 - RNA, 17 nt, Human
aggaauucuguauagau

SEQ ID NO: 3860384 - RNA, 22 nt, Human
aggaauuucaccuguaaaccug

SEQ ID NO: 3860385 - RNA, 17 nt, Human
aggaauuucccaggacc

SEQ ID NO: 3860386 - RNA, 20 nt, Human
aggaauuucccaggacccug

SEQ ID NO: 3860387 - RNA, 13 nt, Human
aggaauuucuuaa

SEQ ID NO: 3860388 - RNA, 19 nt, Human
aggaauuucuuaacuucuu

SEQ ID NO: 3860389 - RNA, 14 nt, Human
aggaauuuuaaaaa

SEQ ID NO: 3860390 - RNA, 22 nt, Human
aggaauuuuauuuuuuucugaa

SEQ ID NO: 3860391 - RNA, 19 nt, Human
aggaauuuucuccaauuuu

SEQ ID NO: 3860392 - RNA, 12 nt, Human
aggacaaaacuu

SEQ ID NO: 3860393 - RNA, 20 nt, Human
aggacaaagugccaaagaaa

SEQ ID NO: 3860394 - RNA, 18 nt, Human
aggacaaauugagacagu

SEQ ID NO: 3860395 - RNA, 17 nt, Human
aggacaacgaggaagcc

SEQ ID NO: 3860396 - RNA, 16 nt, Human
aggacaauacuggggu

SEQ ID NO: 3860397 - RNA, 23 nt, Human
aggacaaucaguccccucccauc

SEQ ID NO: 3860398 - RNA, 16 nt, Human
aggacaauuucaaaaa

SEQ ID NO: 3860399 - RNA, 13 nt, Human
aggacacaggccu

SEQ ID NO: 3860400 - RNA, 16 nt, Human
aggacacaggccugug

SEQ ID NO: 3860401 - RNA, 11 nt, Human
aggacacaugu

SEQ ID NO: 3860402 - RNA, 13 nt, Human
aggacacaugucc

SEQ ID NO: 3860403 - RNA, 17 nt, Human
aggacaccacacccagc

SEQ ID NO: 3860404 - RNA, 18 nt, Human
aggacaccacacccagcc

SEQ ID NO: 3860405 - RNA, 19 nt, Human
aggacacuaaccacgcugg

SEQ ID NO: 3860406 - RNA, 17 nt, Human
aggacacugauaugggu

SEQ ID NO: 3860407 - RNA, 17 nt, Human
aggacacugcagaacag

SEQ ID NO: 3860408 - RNA, 14 nt, Human
aggacacuuccgua

SEQ ID NO: 3860409 - RNA, 17 nt, Human
aggacagaaggcuccug

SEQ ID NO: 3860410 - RNA, 19 nt, Human
aggacagaaggcuccugcc

SEQ ID NO: 3860411 - RNA, 19 nt, Human
aggacagauccagggacug

SEQ ID NO: 3860412 - RNA, 16 nt, Human
aggacagaugccuccu

SEQ ID NO: 3860413 - RNA, 20 nt, Human
aggacagaugccuccuuccu

SEQ ID NO: 3860414 - RNA, 23 nt, Human
aggacagcccuucuuuccacaga

SEQ ID NO: 3860415 - RNA, 12 nt, Human
aggacaggcccg

SEQ ID NO: 3860416 - RNA, 20 nt, Human
aggacaggcugcggccccuc

SEQ ID NO: 3860417 - RNA, 22 nt, Human
aggacagggaggugaccccagg

SEQ ID NO: 3860418 - RNA, 16 nt, Human
aggacagugcuucagc

SEQ ID NO: 3860419 - RNA, 17 nt, Human
aggacagugcuucagcc

SEQ ID NO: 3860420 - RNA, 21 nt, Human
aggacagugcuucagccugag

SEQ ID NO: 3860421 - RNA, 22 nt, Human
aggacagugcuucagccugagg

SEQ ID NO: 3860422 - RNA, 15 nt, Human
aggacauaauggggu

SEQ ID NO: 3860423 - RNA, 24 nt, Human
aggacauaaugggguccuggccau

SEQ ID NO: 3860424 - RNA, 13 nt, Human
aggacaucagcaa

SEQ ID NO: 3860425 - RNA, 15 nt, Human
aggacaucagcaaac

SEQ ID NO: 3860426 - RNA, 22 nt, Human
aggacaucagcaaacaggauca

SEQ ID NO: 3860427 - RNA, 21 nt, Human
aggacaugauggagcgcaccu

SEQ ID NO: 3860428 - RNA, 21 nt, Human
aggacaugcaauaaaauuuaa

SEQ ID NO: 3860429 - RNA, 16 nt, Human
aggacauguuuuuguu

SEQ ID NO: 3860430 - RNA, 23 nt, Human
aggacauguuuuuguuuucuuug

SEQ ID NO: 3860431 - RNA, 16 nt, Human
aggacauuaugugugc

SEQ ID NO: 3860432 - RNA, 17 nt, Human
aggacauuaugugugca

SEQ ID NO: 3860433 - RNA, 15 nt, Human
aggacauugcggaca

SEQ ID NO: 3860434 - RNA, 18 nt, Human
aggacauugcggacagcc

SEQ ID NO: 3860435 - RNA, 19 nt, Human
aggacauugcggacagcca

SEQ ID NO: 3860436 - RNA, 15 nt, Human
aggacauuucccagg

SEQ ID NO: 3860437 - RNA, 19 nt, Human
aggaccaacaagggcagug

SEQ ID NO: 3860438 - RNA, 14 nt, Human
aggaccacaggcuc

SEQ ID NO: 3860439 - RNA, 20 nt, Human
aggaccacaggcucaggcag

SEQ ID NO: 3860440 - RNA, 15 nt, Human
aggaccacucagccc

SEQ ID NO: 3860441 - RNA, 12 nt, Human
aggaccagaagc

SEQ ID NO: 3860442 - RNA, 16 nt, Human
aggaccagaagcuccc

SEQ ID NO: 3860443 - RNA, 22 nt, Human
aggaccagaagcucccccagca

SEQ ID NO: 3860444 - RNA, 13 nt, Human
aggaccagcccac

SEQ ID NO: 3860445 - RNA, 15 nt, Human
aggaccagcucagga

SEQ ID NO: 3860446 - RNA, 23 nt, Human
aggaccagcucaggacagaugcc

SEQ ID NO: 3860447 - RNA, 14 nt, Human
aggaccagcugggg

SEQ ID NO: 3860448 - RNA, 15 nt, Human
aggaccagcuggggc

SEQ ID NO: 3860449 - RNA, 19 nt, Human
aggaccagcuggggcgugg

SEQ ID NO: 3860450 - RNA, 17 nt, Human
aggaccaggacucccuc

SEQ ID NO: 3860451 - RNA, 18 nt, Human
aggaccaggacucccucc

SEQ ID NO: 3860452 - RNA, 13 nt, Human
aggaccagggccu

SEQ ID NO: 3860453 - RNA, 15 nt, Human
aggaccagggccuuu

SEQ ID NO: 3860454 - RNA, 20 nt, Human
aggaccagggccuuuucugg

SEQ ID NO: 3860455 - RNA, 19 nt, Human
aggaccagucaaccugggc

SEQ ID NO: 3860456 - RNA, 20 nt, Human
aggaccagucaaccugggca

SEQ ID NO: 3860457 - RNA, 17 nt, Human
aggaccagucccagagc

SEQ ID NO: 3860458 - RNA, 14 nt, Human
aggacccagaccca

SEQ ID NO: 3860459 - RNA, 15 nt, Human
aggacccagaggaag

SEQ ID NO: 3860460 - RNA, 14 nt, Human
aggacccaggaaag

SEQ ID NO: 3860461 - RNA, 13 nt, Human
aggacccagggcu

SEQ ID NO: 3860462 - RNA, 14 nt, Human
aggacccagggcuc

SEQ ID NO: 3860463 - RNA, 13 nt, Human
aggacccccuucc

SEQ ID NO: 3860464 - RNA, 15 nt, Human
aggaccccucaccuu

SEQ ID NO: 3860465 - RNA, 20 nt, Human
aggaccccugcaguuccccu

SEQ ID NO: 3860466 - RNA, 18 nt, Human
aggacccggaggggccug

SEQ ID NO: 3860467 - RNA, 22 nt, Human
aggacccggaggggccuggcag

SEQ ID NO: 3860468 - RNA, 16 nt, Human
aggacccucgcuggcc

SEQ ID NO: 3860469 - RNA, 18 nt, Human
aggacccucgcuggcccc

SEQ ID NO: 3860470 - RNA, 13 nt, Human
aggacccugccag

SEQ ID NO: 3860471 - RNA, 16 nt, Human
aggacccugccaggca

SEQ ID NO: 3860472 - RNA, 17 nt, Human
aggacccuggacccagc

SEQ ID NO: 3860473 - RNA, 20 nt, Human
aggacccuucccuugagccc

SEQ ID NO: 3860474 - RNA, 22 nt, Human
aggacccuucccuugagcccuc

SEQ ID NO: 3860475 - RNA, 16 nt, Human
aggaccuauguuugcu

SEQ ID NO: 3860476 - RNA, 14 nt, Human
aggaccucagguga

SEQ ID NO: 3860477 - RNA, 16 nt, Human
aggaccucccuuccga

SEQ ID NO: 3860478 - RNA, 20 nt, Human
aggaccucugaaacccugga

SEQ ID NO: 3860479 - RNA, 11 nt, Human
aggaccucugg

SEQ ID NO: 3860480 - RNA, 12 nt, Human
aggaccucuggg

SEQ ID NO: 3860481 - RNA, 17 nt, Human
aggaccugaaauuccaa

SEQ ID NO: 3860482 - RNA, 18 nt, Human
aggaccugaaauuccaaa

SEQ ID NO: 3860483 - RNA, 19 nt, Human
aggaccugagccugccgag

SEQ ID NO: 3860484 - RNA, 13 nt, Human
aggaccugccugu

SEQ ID NO: 3860485 - RNA, 13 nt, Human
aggaccuggcugc

SEQ ID NO: 3860486 - RNA, 16 nt, Human
aggaccuggcugccau

SEQ ID NO: 3860487 - RNA, 18 nt, Human
aggagccugugaacccag

SEQ ID NO: 3860488 - RNA, 19 nt, Human
aggagccugugaacccagg

SEQ ID NO: 3860489 - RNA, 21 nt, Human
aggagccugugaacccaggac

SEQ ID NO: 3860490 - RNA, 13 nt, Human
aggagccugugac

SEQ ID NO: 3860491 - RNA, 15 nt, Human
aggagcgagcauguc

SEQ ID NO: 3860492 - RNA, 14 nt, Human
aggagcgcucccuu

SEQ ID NO: 3860493 - RNA, 22 nt, Human
aggagcgcucccuugaccugcu

SEQ ID NO: 3860494 - RNA, 16 nt, Human
aggagcgggaccugug

SEQ ID NO: 3860495 - RNA, 18 nt, Human
aggagcgggaccuguggc

SEQ ID NO: 3860496 - RNA, 14 nt, Human
aggagcuaaggcuc

SEQ ID NO: 3860497 - RNA, 16 nt, Human
aggagcuaaggcucua

SEQ ID NO: 3860498 - RNA, 12 nt, Human
aggagcuaccug

SEQ ID NO: 3860499 - RNA, 18 nt, Human
aggagcuaccugugugga

SEQ ID NO: 3860500 - RNA, 22 nt, Human
aggagcuaccuguguggacagg

SEQ ID NO: 3860501 - RNA, 22 nt, Human
aggagcuccaguguccugagcu

SEQ ID NO: 3860502 - RNA, 21 nt, Human
aggagcuccccuccccaacug

SEQ ID NO: 3860503 - RNA, 21 nt, Human
aggagcucuucaggccucccu

SEQ ID NO: 3860504 - RNA, 22 nt, Human
aggagcugacucacaccugaac

SEQ ID NO: 3860505 - RNA, 18 nt, Human
aggagcugagaauagaag

SEQ ID NO: 3860506 - RNA, 22 nt, Human
aggagcugagaauagaaggaaa

SEQ ID NO: 3860507 - RNA, 12 nt, Human
aggagcugccug

SEQ ID NO: 3860508 - RNA, 15 nt, Human
aggagcugccuggac

SEQ ID NO: 3860509 - RNA, 21 nt, Human
aggagcugccuuggcucagac

SEQ ID NO: 3860510 - RNA, 23 nt, Human
aggagcugccuuggcucagacau

SEQ ID NO: 3860511 - RNA, 21 nt, Human
aggagcugcuauagccugggg

SEQ ID NO: 3860512 - RNA, 14 nt, Human
aggagcugcuggcu

SEQ ID NO: 3860513 - RNA, 17 nt, Human
aggagcugggaggaaaa

SEQ ID NO: 3860514 - RNA, 20 nt, Human
aggagcugucaccaaggaaa

SEQ ID NO: 3860515 - RNA, 21 nt, Human
aggagcugucaccaaggaaac

SEQ ID NO: 3860516 - RNA, 18 nt, Human
aggagcuuaccucccacc

SEQ ID NO: 3860517 - RNA, 11 nt, Human
aggagcuuccu

SEQ ID NO: 3860518 - RNA, 13 nt, Human
aggagcuucucug

SEQ ID NO: 3860519 - RNA, 20 nt, Human
aggagcuucuuguuuccuug

SEQ ID NO: 3860520 - RNA, 19 nt, Human
aggagcuuugacucaggag

SEQ ID NO: 3860521 - RNA, 17 nt, Human
aggaggaaaucccuuca

SEQ ID NO: 3860522 - RNA, 18 nt, Human
aggaggaauacugaacau

SEQ ID NO: 3860523 - RNA, 23 nt, Human
aggaggaaucaugucaggccugu

SEQ ID NO: 3860524 - RNA, 22 nt, Human
aggaggaaugcuggacuggagg

SEQ ID NO: 3860525 - RNA, 22 nt, Human
aggaggacaauucaugaacuuc

SEQ ID NO: 3860526 - RNA, 15 nt, Human
aggaggacccaggac

SEQ ID NO: 3860527 - RNA, 17 nt, Human
aggaggacccaggacag

SEQ ID NO: 3860528 - RNA, 18 nt, Human
aggaggacccagggcucu

SEQ ID NO: 3860529 - RNA, 16 nt, Human
aggaggagagggaaaa

SEQ ID NO: 3860530 - RNA, 20 nt, Human
aggaggagccuguccugccu

SEQ ID NO: 3860531 - RNA, 21 nt, Human
aggaggagccuguccugccug

SEQ ID NO: 3860532 - RNA, 12 nt, Human
aggaggaggagg

SEQ ID NO: 3860533 - RNA, 18 nt, Human
aggaggaggugccaacag

SEQ ID NO: 3860534 - RNA, 22 nt, Human
aggaggaugggcucgcccacca

SEQ ID NO: 3860535 - RNA, 22 nt, Human
aggaggcagaaagcagaggcug

SEQ ID NO: 3860536 - RNA, 14 nt, Human
aggaggcagagaag

SEQ ID NO: 3860537 - RNA, 20 nt, Human
aggaggcaggcauggcccug

SEQ ID NO: 3860538 - RNA, 11 nt, Human
aggaggccacc

SEQ ID NO: 3860539 - RNA, 13 nt, Human
aggaggccaccuc

SEQ ID NO: 3860540 - RNA, 23 nt, Human
aggaggccaccucuccaagggcu

SEQ ID NO: 3860541 - RNA, 22 nt, Human
aggaggccaggccggcgagccc

SEQ ID NO: 3860542 - RNA, 17 nt, Human
aggaggccuccaucuca

SEQ ID NO: 3860543 - RNA, 21 nt, Human
aggaggccuugggcucugcug

SEQ ID NO: 3860544 - RNA, 20 nt, Human
aggaggcuaugcucaggggc

SEQ ID NO: 3860545 - RNA, 16 nt, Human
aggaggcuccagaggg

SEQ ID NO: 3860546 - RNA, 19 nt, Human
aggaggcuccagagggcac

SEQ ID NO: 3860547 - RNA, 17 nt, Human
aggaggcugaggcagaa

SEQ ID NO: 3860548 - RNA, 17 nt, Human
aggaggcugaggcagga

SEQ ID NO: 3860549 - RNA, 13 nt, Human
aggaggcugaggu

SEQ ID NO: 3860550 - RNA, 18 nt, Human
aggaggcuggaggaaggg

SEQ ID NO: 3860551 - RNA, 13 nt, Human
aggaggcuggcug

SEQ ID NO: 3860552 - RNA, 18 nt, Human
aggagggacaaaggagcc

SEQ ID NO: 3860553 - RNA, 22 nt, Human
aggagggacaaaggagccugug

SEQ ID NO: 3860554 - RNA, 23 nt, Human
aggagggacaaaggagccuguga

SEQ ID NO: 3860555 - RNA, 19 nt, Human
aggagggacugucgcugcu

SEQ ID NO: 3860556 - RNA, 12 nt, Human
aggagggagagg

SEQ ID NO: 3860557 - RNA, 21 nt, Human
aggagggagcaucagugcccu

SEQ ID NO: 3860558 - RNA, 15 nt, Human
aggagggagggggcu

SEQ ID NO: 3860559 - RNA, 15 nt, Human
aggagggaggugcuu

SEQ ID NO: 3860560 - RNA, 14 nt, Human
aggagggcagcaga

SEQ ID NO: 3860561 - RNA, 22 nt, Human
aggagggcauccauaccagcuc

SEQ ID NO: 3860562 - RNA, 17 nt, Human
aggagggcguucuuagg

SEQ ID NO: 3860563 - RNA, 20 nt, Human
aggaggggaacacugcccuc

SEQ ID NO: 3860564 - RNA, 16 nt, Human
aggaggggaagaggcc

SEQ ID NO: 3860565 - RNA, 17 nt, Human
aggagggggccgggcgc

SEQ ID NO: 3860566 - RNA, 17 nt, Human
aggaggggggagggaag

SEQ ID NO: 3860567 - RNA, 14 nt, Human
aggagggucaggaa

SEQ ID NO: 3860568 - RNA, 17 nt, Human
aggagggucaggaagga

SEQ ID NO: 3860569 - RNA, 15 nt, Human
aggagggugggaagg

SEQ ID NO: 3860570 - RNA, 14 nt, Human
aggaggugccugga

SEQ ID NO: 3860571 - RNA, 20 nt, Human
aggagguggaggcugcagug

SEQ ID NO: 3860572 - RNA, 18 nt, Human
aggagguggcagcccugu

SEQ ID NO: 3860573 - RNA, 20 nt, Human
aggagguggcagcccuguag

SEQ ID NO: 3860574 - RNA, 23 nt, Human
aggaggugucucaggcugccuga

SEQ ID NO: 3860575 - RNA, 19 nt, Human
aggagguuggagggaaagc

SEQ ID NO: 3860576 - RNA, 23 nt, Human
aggagguuuggggucugccacca

SEQ ID NO: 3860577 - RNA, 19 nt, Human
aggaguaacaauacaaaug

SEQ ID NO: 3860578 - RNA, 18 nt, Human
aggaguacaggugaagca

SEQ ID NO: 3860579 - RNA, 15 nt, Human
aggaguagcugagcu

SEQ ID NO: 3860580 - RNA, 18 nt, Human
aggaguaugcagggagcu

SEQ ID NO: 3860581 - RNA, 15 nt, Human
aggagucacugagac

SEQ ID NO: 3860582 - RNA, 14 nt, Human
aggagucagagaga

SEQ ID NO: 3860583 - RNA, 20 nt, Human
aggaguccacuuuguuucgu

SEQ ID NO: 3860584 - RNA, 16 nt, Human
aggagucugagguccu

SEQ ID NO: 3860585 - RNA, 18 nt, Human
aggagucugagguccuga

SEQ ID NO: 3860586 - RNA, 20 nt, Human
aggagucugagguccugagc

SEQ ID NO: 3860587 - RNA, 24 nt, Human
aggagucugcacaugcagcugcac

SEQ ID NO: 3860588 - RNA, 21 nt, Human
aggagugaaacaucauagaaa

SEQ ID NO: 3860589 - RNA, 14 nt, Human
aggagugagaucau

SEQ ID NO: 3860590 - RNA, 13 nt, Human
aggagugagcacu

SEQ ID NO: 3860591 - RNA, 21 nt, Human
aggagugccguguguugcaug

SEQ ID NO: 3860592 - RNA, 20 nt, Human
aggagugcguggcccaccag

SEQ ID NO: 3860593 - RNA, 22 nt, Human
aggagugcguggcccaccaggc

SEQ ID NO: 3860594 - RNA, 15 nt, Human
aggagugggugggga

SEQ ID NO: 3860595 - RNA, 18 nt, Human
aggaguggugcagacaga

SEQ ID NO: 3860596 - RNA, 13 nt, Human
aggagugugugug

SEQ ID NO: 3860597 - RNA, 22 nt, Human
aggaguucaagaccagccuggc

SEQ ID NO: 3860598 - RNA, 13 nt, Human
aggaguucaauga

SEQ ID NO: 3860599 - RNA, 15 nt, Human
aggaguucaaugauc

SEQ ID NO: 3860600 - RNA, 16 nt, Human
aggaguucaaugaucu

SEQ ID NO: 3860601 - RNA, 19 nt, Human
aggaguucaaugaucuagg

SEQ ID NO: 3860602 - RNA, 19 nt, Human
aggaguuccuaaccagccu

SEQ ID NO: 3860603 - RNA, 16 nt, Human
aggaguucgagaccag

SEQ ID NO: 3860604 - RNA, 23 nt, Human
aggaguucgaguuacagccuggg

SEQ ID NO: 3860605 - RNA, 14 nt, Human
aggaguucugcuca

SEQ ID NO: 3860606 - RNA, 21 nt, Human
aggaguuuaagaccagccugg

SEQ ID NO: 3860607 - RNA, 14 nt, Human
aggaguuuauguuc

SEQ ID NO: 3860608 - RNA, 23 nt, Human
aggaguuuauguuccauuaaacg

SEQ ID NO: 3860609 - RNA, 20 nt, Human
aggaguuuccuaaaaguuca

SEQ ID NO: 3860610 - RNA, 19 nt, Human
aggaguuugagaccagccu

SEQ ID NO: 3860611 - RNA, 14 nt, Human
aggaguuuggagga

SEQ ID NO: 3860612 - RNA, 21 nt, Human
aggauaaaaagccagggcugg

SEQ ID NO: 3860613 - RNA, 21 nt, Human
aggauacaaaagcaugugaga

SEQ ID NO: 3860614 - RNA, 14 nt, Human
aggauacaugugcc

SEQ ID NO: 3860615 - RNA, 20 nt, Human
aggauacgacaguacacugu

SEQ ID NO: 3860616 - RNA, 15 nt, Human
aggauacugccuccc

SEQ ID NO: 3860617 - RNA, 18 nt, Human
aggauacugccuccccca

SEQ ID NO: 3860618 - RNA, 16 nt, Human
aggauacuuauuuaaa

SEQ ID NO: 3860619 - RNA, 23 nt, Human
aggauagaaguauaccugauuuu

SEQ ID NO: 3860620 - RNA, 14 nt, Human
aggauagaugcugg

SEQ ID NO: 3860621 - RNA, 15 nt, Human
aggauagaugcuggc

SEQ ID NO: 3860622 - RNA, 20 nt, Human
aggauagaugcuggcccagg

SEQ ID NO: 3860623 - RNA, 17 nt, Human
aggauagcuaacuguaa

SEQ ID NO: 3860624 - RNA, 20 nt, Human
aggauagcuaacuguaaauc

SEQ ID NO: 3860625 - RNA, 14 nt, Human
aggauaguauuuuu

SEQ ID NO: 3860626 - RNA, 14 nt, Human
aggauauauuuuca

SEQ ID NO: 3860627 - RNA, 17 nt, Human
aggauauccuuaucaga

SEQ ID NO: 3860628 - RNA, 22 nt, Human
aggauauccuuaucagagcuaa

SEQ ID NO: 3860629 - RNA, 21 nt, Human
aggauaucggcauuuguuucu

SEQ ID NO: 3860630 - RNA, 14 nt, Human
aggauauuuaagaa

SEQ ID NO: 3860631 - RNA, 16 nt, Human
aggauauuuaagaaaa

SEQ ID NO: 3860632 - RNA, 18 nt, Human
aggaucacagugcugaga

SEQ ID NO: 3860633 - RNA, 14 nt, Human
aggaucacuggagc

SEQ ID NO: 3860634 - RNA, 15 nt, Human
aggaucacuggagcc

SEQ ID NO: 3860635 - RNA, 16 nt, Human
aggaucacuggagccc

SEQ ID NO: 3860636 - RNA, 18 nt, Human
aggaucacuggagcccag

SEQ ID NO: 3860637 - RNA, 19 nt, Human
aggaucacuggagcccagg

SEQ ID NO: 3860638 - RNA, 16 nt, Human
aggaucagauugcaug

SEQ ID NO: 3860639 - RNA, 15 nt, Human
aggaucaguuaacua

SEQ ID NO: 3860640 - RNA, 17 nt, Human
aggaucaguuaacuauu

SEQ ID NO: 3860641 - RNA, 23 nt, Human
aggaucaguuaacuauugcauuu

SEQ ID NO: 3860642 - RNA, 22 nt, Human
aggaucaguuuuuuguuuuaca

SEQ ID NO: 3860643 - RNA, 13 nt, Human
aggaucaucugaa

SEQ ID NO: 3860644 - RNA, 20 nt, Human
aggaucauuuguuggaauga

SEQ ID NO: 3860645 - RNA, 19 nt, Human
aggaucccaugagcuccuu

SEQ ID NO: 3860646 - RNA, 15 nt, Human
aggaucccucucugg

SEQ ID NO: 3860647 - RNA, 19 nt, Human
aggaucccucucuggauug

SEQ ID NO: 3860648 - RNA, 16 nt, Human
aggauccggaaagaag

SEQ ID NO: 3860649 - RNA, 15 nt, Human
aggauccugagccag

SEQ ID NO: 3860650 - RNA, 17 nt, Human
aggauccugagccagau

SEQ ID NO: 3860651 - RNA, 21 nt, Human
aggauccugagccagauuuca

SEQ ID NO: 3860652 - RNA, 14 nt, Human
aggaucuaaggcug

SEQ ID NO: 3860653 - RNA, 20 nt, Human
aggaucuauuuuuggagguu

SEQ ID NO: 3860654 - RNA, 17 nt, Human
aggaucucaccaggcag

SEQ ID NO: 3860655 - RNA, 23 nt, Human
aggaucucaccaggcagccucug

SEQ ID NO: 3860656 - RNA, 20 nt, Human
aggaucucucaggagcacag

SEQ ID NO: 3860657 - RNA, 12 nt, Human
aggaucucuuga

SEQ ID NO: 3860658 - RNA, 13 nt, Human
aggaucuuugugg

SEQ ID NO: 3860659 - RNA, 16 nt, Human
aggaucuuuguggcca

SEQ ID NO: 3860660 - RNA, 18 nt, Human
aggaugaagggcccgaga

SEQ ID NO: 3860661 - RNA, 13 nt, Human
aggaugagagccc

SEQ ID NO: 3860662 - RNA, 14 nt, Human
aggaugagagccca

SEQ ID NO: 3860663 - RNA, 19 nt, Human
aggaugagagcccagaggu

SEQ ID NO: 3860664 - RNA, 20 nt, Human
aggaugagagcccagaggua

SEQ ID NO: 3860665 - RNA, 23 nt, Human
aggaugagagcccagagguaaca

SEQ ID NO: 3860666 - RNA, 18 nt, Human
aggaugauaaguuccuuu

SEQ ID NO: 3860667 - RNA, 16 nt, Human
aggaugauuuuggccu

SEQ ID NO: 3860668 - RNA, 18 nt, Human
aggaugcagagucagcag

SEQ ID NO: 3860669 - RNA, 14 nt, Human
aggaugcccaaaga

SEQ ID NO: 3860670 - RNA, 13 nt, Human
aggaugcccaggg

SEQ ID NO: 3860671 - RNA, 23 nt, Human
aggaugcuaacaucuaaaaauag

SEQ ID NO: 3860672 - RNA, 18 nt, Human
aggaugcuguguugucaa

SEQ ID NO: 3860673 - RNA, 23 nt, Human
aggaugcuuguacauaaugcgug

SEQ ID NO: 3860674 - RNA, 14 nt, Human
aggaugcuuugguu

SEQ ID NO: 3860675 - RNA, 14 nt, Human
aggauggaacacgg

SEQ ID NO: 3860676 - RNA, 14 nt, Human
aggauggagagagg

SEQ ID NO: 3860677 - RNA, 15 nt, Human
aggauggagagaggg

SEQ ID NO: 3860678 - RNA, 17 nt, Human
aggauggagccagcucu

SEQ ID NO: 3860679 - RNA, 12 nt, Human
aggauggagggg

SEQ ID NO: 3860680 - RNA, 16 nt, Human
aggauggccuggccag

SEQ ID NO: 3860681 - RNA, 23 nt, Human
aggauggccuggccagggccugg

SEQ ID NO: 3860682 - RNA, 13 nt, Human
aggauggcgcagg

SEQ ID NO: 3860683 - RNA, 17 nt, Human
aggaugggaaggaggga

SEQ ID NO: 3860684 - RNA, 11 nt, Human
aggaugggcuc

SEQ ID NO: 3860685 - RNA, 21 nt, Human
aggaugguaauucuuauucuu

SEQ ID NO: 3860686 - RNA, 18 nt, Human
aggauguagcuuuucacc

SEQ ID NO: 3860687 - RNA, 20 nt, Human
aggauguaucgggaagauuu

SEQ ID NO: 3860688 - RNA, 16 nt, Human
aggaugucacagggcc

SEQ ID NO: 3860689 - RNA, 14 nt, Human
aggaugugaauugu

SEQ ID NO: 3860690 - RNA, 21 nt, Human
aggaugugggggaagaccugg

SEQ ID NO: 3860691 - RNA, 19 nt, Human
aggauguguuugcuuucug

SEQ ID NO: 3860692 - RNA, 22 nt, Human
aggauguucuagcauggcugcc

SEQ ID NO: 3860693 - RNA, 16 nt, Human
aggauguucugggaca

SEQ ID NO: 3860694 - RNA, 14 nt, Human
aggauuaaauaaug

SEQ ID NO: 3860695 - RNA, 20 nt, Human
aggauuaaauaauguaaaua

SEQ ID NO: 3860696 - RNA, 18 nt, Human
aggauuauugauaguacu

SEQ ID NO: 3860697 - RNA, 21 nt, Human
aggauucacaccccaccugcg

SEQ ID NO: 3860698 - RNA, 14 nt, Human
aggauucagccgga

SEQ ID NO: 3860699 - RNA, 12 nt, Human
aggauucuaaaa

SEQ ID NO: 3860700 - RNA, 15 nt, Human
aggauucuaugaggc

SEQ ID NO: 3860701 - RNA, 20 nt, Human
aggauucugcuggccucugc

SEQ ID NO: 3860702 - RNA, 21 nt, Human
aggauugaaaauguccaggaa

SEQ ID NO: 3860703 - RNA, 17 nt, Human
aggauugcgagagaugu

SEQ ID NO: 3860704 - RNA, 20 nt, Human
aggauugcgagagaugugug

SEQ ID NO: 3860705 - RNA, 15 nt, Human
aggauugcuacuguc

SEQ ID NO: 3860706 - RNA, 18 nt, Human
aggauugcuacuguccua

SEQ ID NO: 3860707 - RNA, 21 nt, Human
aggauugcuugagcccaggag

SEQ ID NO: 3860708 - RNA, 12 nt, Human
aggauuggggaa

SEQ ID NO: 3860709 - RNA, 16 nt, Human
aggauugugauauuuu

SEQ ID NO: 3860710 - RNA, 16 nt, Human
aggauuuaaaaacugg

SEQ ID NO: 3860711 - RNA, 16 nt, Human
aggauuuaacagucau

SEQ ID NO: 3860712 - RNA, 13 nt, Human
aggauuuagaagu

SEQ ID NO: 3860713 - RNA, 12 nt, Human
aggauuucaagc

SEQ ID NO: 3860714 - RNA, 16 nt, Human
aggauuugcugggaga

SEQ ID NO: 3860715 - RNA, 13 nt, Human
aggauuuuauacc

SEQ ID NO: 3860716 - RNA, 17 nt, Human
aggauuuuuuucugagc

SEQ ID NO: 3860717 - RNA, 15 nt, Human
aggcaaaaaaggaug

SEQ ID NO: 3860718 - RNA, 23 nt, Human
aggcaaaaggcaguggggcuggg

SEQ ID NO: 3860719 - RNA, 13 nt, Human
aggcaaaauugca

SEQ ID NO: 3860720 - RNA, 20 nt, Human
aggcaaaauugcaaaucuug

SEQ ID NO: 3860721 - RNA, 18 nt, Human
aggcaaauccgaaaucag

SEQ ID NO: 3860722 - RNA, 15 nt, Human
aggcaaaugcccaag

SEQ ID NO: 3860723 - RNA, 13 nt, Human
aggcaaaugugua

SEQ ID NO: 3860724 - RNA, 14 nt, Human
aggcaaauguguac

SEQ ID NO: 3860725 - RNA, 16 nt, Human
aggcaacugaggcaga

SEQ ID NO: 3860726 - RNA, 22 nt, Human
aggcaacuucaguccugggaga

SEQ ID NO: 3860727 - RNA, 24 nt, Human
aggcaagagggguggagacugcuu

SEQ ID NO: 3860728 - RNA, 16 nt, Human
aggcaagauugauguu

SEQ ID NO: 3860729 - RNA, 18 nt, Human
aggcaagcaagcucucuu

SEQ ID NO: 3860730 - RNA, 12 nt, Human
aggcaagcccug

SEQ ID NO: 3860731 - RNA, 15 nt, Human
aggcaagcugaaauu

SEQ ID NO: 3860732 - RNA, 16 nt, Human
aggcaagcugaaauuu

SEQ ID NO: 3860733 - RNA, 13 nt, Human
aggcaaggcaggu

SEQ ID NO: 3860734 - RNA, 19 nt, Human
aggcaaggcaggugccucc

SEQ ID NO: 3860735 - RNA, 17 nt, Human
aggcaagguuauaugca

SEQ ID NO: 3860736 - RNA, 13 nt, Human
aggcaagugaaga

SEQ ID NO: 3860737 - RNA, 17 nt, Human
aggcaagugaagaaaag

SEQ ID NO: 3860738 - RNA, 18 nt, Human
aggcaaguuaagagaaac

SEQ ID NO: 3860739 - RNA, 14 nt, Human
aggcaauaaaaauc

SEQ ID NO: 3860740 - RNA, 14 nt, Human
aggcaaucacauag

SEQ ID NO: 3860741 - RNA, 15 nt, Human
aggcaauccuaccuu

SEQ ID NO: 3860742 - RNA, 12 nt, Human
aggcaauuagac

SEQ ID NO: 3860743 - RNA, 19 nt, Human
aggcaauucuccugccuuu

SEQ ID NO: 3860744 - RNA, 17 nt, Human
aggcacacaaggggccc

SEQ ID NO: 3860745 - RNA, 23 nt, Human
aggcacacaccaccacgccuggc

SEQ ID NO: 3860746 - RNA, 23 nt, Human
aggcacacacugugcuuucuauu

SEQ ID NO: 3860747 - RNA, 18 nt, Human
aggcacacagcugcagag

SEQ ID NO: 3860748 - RNA, 12 nt, Human
aggcacaggcag

SEQ ID NO: 3860749 - RNA, 16 nt, Human
aggcacaggcagggca

SEQ ID NO: 3860750 - RNA, 17 nt, Human
aggcacaggcagggcag

SEQ ID NO: 3860751 - RNA, 18 nt, Human
aggcacaggcagggcagg

SEQ ID NO: 3860752 - RNA, 13 nt, Human
aggcacauggagg

SEQ ID NO: 3860753 - RNA, 16 nt, Human
aggcacaugucagcaa

SEQ ID NO: 3860754 - RNA, 13 nt, Human
aggcaccagaaga

SEQ ID NO: 3860755 - RNA, 12 nt, Human
aggcaccauuca

SEQ ID NO: 3860756 - RNA, 17 nt, Human
aggcaccauucaggaac

SEQ ID NO: 3860757 - RNA, 12 nt, Human
aggcacccaucc

SEQ ID NO: 3860758 - RNA, 17 nt, Human
aggcacccccuggagag

SEQ ID NO: 3860759 - RNA, 13 nt, Human
aggcacccuucca

SEQ ID NO: 3860760 - RNA, 17 nt, Human
aggcaccgcugaugggg

SEQ ID NO: 3860761 - RNA, 23 nt, Human
aggcaccuacacucaccugcacu

SEQ ID NO: 3860762 - RNA, 22 nt, Human
aggcaccuaccaccacgcccgg

SEQ ID NO: 3860763 - RNA, 18 nt, Human
aggcaccucaagaagaag

SEQ ID NO: 3860764 - RNA, 14 nt, Human
aggcaccugcaggu

SEQ ID NO: 3860765 - RNA, 18 nt, Human
aggcaccugcagguuggg

SEQ ID NO: 3860766 - RNA, 21 nt, Human
aggcaccugcagguugggcca

SEQ ID NO: 3860767 - RNA, 16 nt, Human
aggcaccuuuuacugu

SEQ ID NO: 3860768 - RNA, 17 nt, Human
aggcaccuuuuacugug

SEQ ID NO: 3860769 - RNA, 18 nt, Human
aggcacgaacccaccugc

SEQ ID NO: 3860770 - RNA, 17 nt, Human
aggcacggguggucccc

SEQ ID NO: 3860771 - RNA, 14 nt, Human
aggcacucuagauu

SEQ ID NO: 3860772 - RNA, 14 nt, Human
aggcacucuuaaau

SEQ ID NO: 3860773 - RNA, 23 nt, Human
aggcacugagauaccagcgagga

SEQ ID NO: 3860774 - RNA, 13 nt, Human
aggcacugcccug

SEQ ID NO: 3860775 - RNA, 15 nt, Human
aggcacugcccuggu

SEQ ID NO: 3860776 - RNA, 18 nt, Human
aggguccuuuaguaccug

SEQ ID NO: 3860777 - RNA, 20 nt, Human
aggguccuuuaguaccugaa

SEQ ID NO: 3860778 - RNA, 14 nt, Human
agggucgaaagcuc

SEQ ID NO: 3860779 - RNA, 16 nt, Human
agggucgaaagcucua

SEQ ID NO: 3860780 - RNA, 22 nt, Human
agggucgaaagcucuagaaucu

SEQ ID NO: 3860781 - RNA, 22 nt, Human
agggucggaacccaagcuuaga

SEQ ID NO: 3860782 - RNA, 23 nt, Human
agggucggggaggaaauaccaaa

SEQ ID NO: 3860783 - RNA, 15 nt, Human
agggucggugccuuc

SEQ ID NO: 3860784 - RNA, 15 nt, Human
agggucuagggagag

SEQ ID NO: 3860785 - RNA, 15 nt, Human
agggucuauggggag

SEQ ID NO: 3860786 - RNA, 23 nt, Human
agggucucacuauguugcccagg

SEQ ID NO: 3860787 - RNA, 17 nt, Human
agggucucagggugucc

SEQ ID NO: 3860788 - RNA, 22 nt, Human
agggucucuagugcugugaaaa

SEQ ID NO: 3860789 - RNA, 17 nt, Human
agggucucucccucagg

SEQ ID NO: 3860790 - RNA, 13 nt, Human
agggucugcucuu

SEQ ID NO: 3860791 - RNA, 23 nt, Human
agggucugcucuuucucugccag

SEQ ID NO: 3860792 - RNA, 14 nt, Human
agggucuggagaag

SEQ ID NO: 3860793 - RNA, 21 nt, Human
agggucugggaaaugagcagg

SEQ ID NO: 3860794 - RNA, 22 nt, Human
agggucugggggcacaagacug

SEQ ID NO: 3860795 - RNA, 22 nt, Human
agggucuguagguugcacacuu

SEQ ID NO: 3860796 - RNA, 13 nt, Human
agggucuguguga

SEQ ID NO: 3860797 - RNA, 16 nt, Human
agggucuugggaaaua

SEQ ID NO: 3860798 - RNA, 17 nt, Human
agggugacagcuuccuu

SEQ ID NO: 3860799 - RNA, 21 nt, Human
agggugaguccuccagaacuc

SEQ ID NO: 3860800 - RNA, 19 nt, Human
agggugaguuggcuuaccu

SEQ ID NO: 3860801 - RNA, 22 nt, Human
agggugaguuggcuuaccuggc

SEQ ID NO: 3860802 - RNA, 15 nt, Human
agggugaugccaggu

SEQ ID NO: 3860803 - RNA, 19 nt, Human
agggugaugccagguucua

SEQ ID NO: 3860804 - RNA, 21 nt, Human
agggugaugccagguucuauu

SEQ ID NO: 3860805 - RNA, 21 nt, Human
agggugaugggaaagcauugu

SEQ ID NO: 3860806 - RNA, 23 nt, Human
agggugauuuuaugaucaguguu

SEQ ID NO: 3860807 - RNA, 15 nt, Human
agggugcagccacac

SEQ ID NO: 3860808 - RNA, 17 nt, Human
agggugcgucugggagg

SEQ ID NO: 3860809 - RNA, 14 nt, Human
agggugcugacugg

SEQ ID NO: 3860810 - RNA, 22 nt, Human
agggugcugccccaugaagcca

SEQ ID NO: 3860811 - RNA, 21 nt, Human
agggugcugcuucccucugcc

SEQ ID NO: 3860812 - RNA, 16 nt, Human
aggguggacuuagaaa

SEQ ID NO: 3860813 - RNA, 20 nt, Human
aggguggacuuagaaagcag

SEQ ID NO: 3860814 - RNA, 23 nt, Human
aggguggacuuagaaagcagggg

SEQ ID NO: 3860815 - RNA, 11 nt, Human
aggguggcagc

SEQ ID NO: 3860816 - RNA, 14 nt, Human
aggguggcagguga

SEQ ID NO: 3860817 - RNA, 21 nt, Human
aggguggcaucccaguggccu

SEQ ID NO: 3860818 - RNA, 18 nt, Human
aggguggcccuugcaguu

SEQ ID NO: 3860819 - RNA, 12 nt, Human
agggugggaagg

SEQ ID NO: 3860820 - RNA, 16 nt, Human
agggugggagagccca

SEQ ID NO: 3860821 - RNA, 17 nt, Human
agggugggggagggagg

SEQ ID NO: 3860822 - RNA, 17 nt, Human
agggugggggccaccug

SEQ ID NO: 3860823 - RNA, 21 nt, Human
agggugggggccaccugccug

SEQ ID NO: 3860824 - RNA, 23 nt, Human
aggguggucucuucuuggggccc

SEQ ID NO: 3860825 - RNA, 17 nt, Human
aggguggugaccucugc

SEQ ID NO: 3860826 - RNA, 19 nt, Human
aggguggugaccucugccu

SEQ ID NO: 3860827 - RNA, 21 nt, Human
aggguggugaccucugccuga

SEQ ID NO: 3860828 - RNA, 19 nt, Human
agggugucugcgucgucac

SEQ ID NO: 3860829 - RNA, 20 nt, Human
aggguguguuugaaaucauc

SEQ ID NO: 3860830 - RNA, 14 nt, Human
aggguguuuaugua

SEQ ID NO: 3860831 - RNA, 15 nt, Human
aggguuaaggccuga

SEQ ID NO: 3860832 - RNA, 20 nt, Human
aggguuacagagaccuaugu

SEQ ID NO: 3860833 - RNA, 15 nt, Human
aggguuauauuuuac

SEQ ID NO: 3860834 - RNA, 14 nt, Human
aggguucaaaaugu

SEQ ID NO: 3860835 - RNA, 18 nt, Human
aggguucaaaaugucugu

SEQ ID NO: 3860836 - RNA, 21 nt, Human
aggguuccuguagaccuaggg

SEQ ID NO: 3860837 - RNA, 20 nt, Human
aggguucugccucuccaggc

SEQ ID NO: 3860838 - RNA, 16 nt, Human
aggguugaccccagag

SEQ ID NO: 3860839 - RNA, 21 nt, Human
aggguugaguuacuuccuauc

SEQ ID NO: 3860840 - RNA, 17 nt, Human
aggguugcuggagccug

SEQ ID NO: 3860841 - RNA, 18 nt, Human
aggguuggccccugcccg

SEQ ID NO: 3860842 - RNA, 15 nt, Human
aggguugggcuggug

SEQ ID NO: 3860843 - RNA, 15 nt, Human
aggguuuaucuuuug

SEQ ID NO: 3860844 - RNA, 17 nt, Human
aggguuucagagagccu

SEQ ID NO: 3860845 - RNA, 11 nt, Human
aggguuucuga

SEQ ID NO: 3860846 - RNA, 17 nt, Human
aggguuucugagcugcu

SEQ ID NO: 3860847 - RNA, 18 nt, Human
aggguuucugagcugcuc

SEQ ID NO: 3860848 - RNA, 14 nt, Human
aggguuuguggcug

SEQ ID NO: 3860849 - RNA, 15 nt, Human
aggguuuuaacuuug

SEQ ID NO: 3860850 - RNA, 19 nt, Human
aggguuuuccacccuggaa

SEQ ID NO: 3860851 - RNA, 22 nt, Human
agguaaaaugccaugaugccuc

SEQ ID NO: 3860852 - RNA, 19 nt, Human
agguaaaauugaaaggcau

SEQ ID NO: 3860853 - RNA, 14 nt, Human
agguaaacuccugu

SEQ ID NO: 3860854 - RNA, 15 nt, Human
agguaaacuccuguc

SEQ ID NO: 3860855 - RNA, 12 nt, Human
agguaaagauau

SEQ ID NO: 3860856 - RNA, 18 nt, Human
agguaaagggcaaauaau

SEQ ID NO: 3860857 - RNA, 23 nt, Human
agguaacaagaugagaacagaua

SEQ ID NO: 3860858 - RNA, 23 nt, Human
agguaacacuagggccuuggaaa

SEQ ID NO: 3860859 - RNA, 17 nt, Human
agguaacagaacagcuu

SEQ ID NO: 3860860 - RNA, 19 nt, Human
agguaacagaacagcuuca

SEQ ID NO: 3860861 - RNA, 13 nt, Human
agguaacaggcag

SEQ ID NO: 3860862 - RNA, 14 nt, Human
agguaacaggcaga

SEQ ID NO: 3860863 - RNA, 15 nt, Human
agguaagaaguuuua

SEQ ID NO: 3860864 - RNA, 19 nt, Human
agguaagcaggaggaggug

SEQ ID NO: 3860865 - RNA, 17 nt, Human
agguaaggaauaccugu

SEQ ID NO: 3860866 - RNA, 19 nt, Human
agguaaucgaccugccucg

SEQ ID NO: 3860867 - RNA, 21 nt, Human
agguaaugaccaugaaagacu

SEQ ID NO: 3860868 - RNA, 14 nt, Human
agguaaugagggac

SEQ ID NO: 3860869 - RNA, 14 nt, Human
agguaauuuuuacc

SEQ ID NO: 3860870 - RNA, 17 nt, Human
agguaauuuuuuucacc

SEQ ID NO: 3860871 - RNA, 17 nt, Human
agguacaaccuguucug

SEQ ID NO: 3860872 - RNA, 12 nt, Human
agguacacucuu

SEQ ID NO: 3860873 - RNA, 18 nt, Human
agguacaggguuuuuacc

SEQ ID NO: 3860874 - RNA, 23 nt, Human
agguacccaauagcugcccauuu

SEQ ID NO: 3860875 - RNA, 17 nt, Human
agguaccccagcucugc

SEQ ID NO: 3860876 - RNA, 20 nt, Human
agguaccccagcucugcuug

SEQ ID NO: 3860877 - RNA, 14 nt, Human
agguacccugggug

SEQ ID NO: 3860878 - RNA, 19 nt, Human
agguaccuuucacauagag

SEQ ID NO: 3860879 - RNA, 17 nt, Human
agguacgcacagacagg

SEQ ID NO: 3860880 - RNA, 14 nt, Human
agguacuagaaugc

SEQ ID NO: 3860881 - RNA, 17 nt, Human
agguacuagaaugcuua

SEQ ID NO: 3860882 - RNA, 15 nt, Human
agguacuauauuugc

SEQ ID NO: 3860883 - RNA, 14 nt, Human
agguacucuccugg

SEQ ID NO: 3860884 - RNA, 22 nt, Human
agguacugagagugaacaaauu

SEQ ID NO: 3860885 - RNA, 19 nt, Human
agguacuguaugaucaaau

SEQ ID NO: 3860886 - RNA, 23 nt, Human
agguacuguaugaucaaauguuu

SEQ ID NO: 3860887 - RNA, 16 nt, Human
agguacuuugucuaag

SEQ ID NO: 3860888 - RNA, 23 nt, Human
agguacuuugucuaagaaacauu

SEQ ID NO: 3860889 - RNA, 20 nt, Human
agguacuuuuugugaagacg

SEQ ID NO: 3860890 - RNA, 13 nt, Human
agguagaaaaagg

SEQ ID NO: 3860891 - RNA, 17 nt, Human
agguagaaauaucugaa

SEQ ID NO: 3860892 - RNA, 17 nt, Human
agguagaacgccaggga

SEQ ID NO: 3860893 - RNA, 21 nt, Human
agguagaauguaaagcuuguc

SEQ ID NO: 3860894 - RNA, 20 nt, Human
agguagaccugucuccuggc

SEQ ID NO: 3860895 - RNA, 17 nt, Human
agguagaguuugaagga

SEQ ID NO: 3860896 - RNA, 20 nt, Human
agguagcauucuuuggaguu

SEQ ID NO: 3860897 - RNA, 17 nt, Human
agguagcccccucuucc

SEQ ID NO: 3860898 - RNA, 16 nt, Human
agguagcccuggccag

SEQ ID NO: 3860899 - RNA, 19 nt, Human
agguagcccuggccagagg

SEQ ID NO: 3860900 - RNA, 20 nt, Human
agguagcccuggccagaggc

SEQ ID NO: 3860901 - RNA, 21 nt, Human
agguagcccuggccagaggcu

SEQ ID NO: 3860902 - RNA, 15 nt, Human
agguagccugcuggu

SEQ ID NO: 3860903 - RNA, 15 nt, Human
agguaggguuuaauc

SEQ ID NO: 3860904 - RNA, 19 nt, Human
agguauaauugugugauau

SEQ ID NO: 3860905 - RNA, 15 nt, Human
agguauaauuuuaug

SEQ ID NO: 3860906 - RNA, 13 nt, Human
agguauaccucac

SEQ ID NO: 3860907 - RNA, 20 nt, Human
agguauaucauucuaaagau

SEQ ID NO: 3860908 - RNA, 14 nt, Human
agguaucuccagga

SEQ ID NO: 3860909 - RNA, 22 nt, Human
agguaugaccuucuaggaagcu

SEQ ID NO: 3860910 - RNA, 23 nt, Human
agguauggcucugcaccccucug

SEQ ID NO: 3860911 - RNA, 22 nt, Human
agguauuccuuuuguguacagu

SEQ ID NO: 3860912 - RNA, 20 nt, Human
agguauucguuaucuaauag

SEQ ID NO: 3860913 - RNA, 20 nt, Human
agguauuuaaaguauuuucu

SEQ ID NO: 3860914 - RNA, 23 nt, Human
agguauuugggaaacuugucacu

SEQ ID NO: 3860915 - RNA, 19 nt, Human
agguauuuuguuucuuuua

SEQ ID NO: 3860916 - RNA, 13 nt, Human
aggucaacagaau

SEQ ID NO: 3860917 - RNA, 14 nt, Human
aggucaacagaaug

SEQ ID NO: 3860918 - RNA, 15 nt, Human
aggucaacagaauga

SEQ ID NO: 3860919 - RNA, 16 nt, Human
agguucacuaaagcag

SEQ ID NO: 3860920 - RNA, 15 nt, Human
agguucagccaaggu

SEQ ID NO: 3860921 - RNA, 21 nt, Human
agguucaugccaccauggcca

SEQ ID NO: 3860922 - RNA, 12 nt, Human
agguuccacaga

SEQ ID NO: 3860923 - RNA, 18 nt, Human
agguuccacagaggacac

SEQ ID NO: 3860924 - RNA, 14 nt, Human
agguuccacagagu

SEQ ID NO: 3860925 - RNA, 16 nt, Human
agguuccauccuuuac

SEQ ID NO: 3860926 - RNA, 14 nt, Human
agguucccaagcuc

SEQ ID NO: 3860927 - RNA, 16 nt, Human
agguucccaagcucag

SEQ ID NO: 3860928 - RNA, 16 nt, Human
agguucccagagauga

SEQ ID NO: 3860929 - RNA, 14 nt, Human
agguuccccuguca

SEQ ID NO: 3860930 - RNA, 22 nt, Human
agguucccuuugacgccauccc

SEQ ID NO: 3860931 - RNA, 23 nt, Human
agguucccuuugacgccauccca

SEQ ID NO: 3860932 - RNA, 21 nt, Human
agguuccgcuuggagcagagg

SEQ ID NO: 3860933 - RNA, 23 nt, Human
agguuccgcuuggagcagagggg

SEQ ID NO: 3860934 - RNA, 14 nt, Human
agguuccucugccu

SEQ ID NO: 3860935 - RNA, 15 nt, Human
agguuccucugccug

SEQ ID NO: 3860936 - RNA, 17 nt, Human
agguuccucugccugcc

SEQ ID NO: 3860937 - RNA, 19 nt, Human
agguuccucugccugcccc

SEQ ID NO: 3860938 - RNA, 20 nt, Human
agguuccucugccugccccg

SEQ ID NO: 3860939 - RNA, 13 nt, Human
agguucuaaaguu

SEQ ID NO: 3860940 - RNA, 15 nt, Human
agguucuaaaguucu

SEQ ID NO: 3860941 - RNA, 17 nt, Human
agguucuagguuucaaa

SEQ ID NO: 3860942 - RNA, 17 nt, Human
agguucuauuuggaauu

SEQ ID NO: 3860943 - RNA, 21 nt, Human
agguucuccaacaucacagcc

SEQ ID NO: 3860944 - RNA, 19 nt, Human
agguucuccguuagcuccu

SEQ ID NO: 3860945 - RNA, 21 nt, Human
agguucuccguuagcuccugu

SEQ ID NO: 3860946 - RNA, 18 nt, Human
agguucugggugcaggag

SEQ ID NO: 3860947 - RNA, 17 nt, Human
agguucuggugugaacu

SEQ ID NO: 3860948 - RNA, 19 nt, Human
agguucugguuagcucagc

SEQ ID NO: 3860949 - RNA, 21 nt, Human
agguucugguuagcucagccc

SEQ ID NO: 3860950 - RNA, 22 nt, Human
agguucuguuuauggccacauu

SEQ ID NO: 3860951 - RNA, 14 nt, Human
agguucuuacugcu

SEQ ID NO: 3860952 - RNA, 19 nt, Human
agguucuucaucccuuucc

SEQ ID NO: 3860953 - RNA, 23 nt, Human
agguucuucccuuuuacauacug

SEQ ID NO: 3860954 - RNA, 23 nt, Human
agguucuucuuccugaagcugag

SEQ ID NO: 3860955 - RNA, 13 nt, Human
agguucuuugugu

SEQ ID NO: 3860956 - RNA, 23 nt, Human
agguugaagaccuaaccagggcc

SEQ ID NO: 3860957 - RNA, 12 nt, Human
agguugaagagg

SEQ ID NO: 3860958 - RNA, 13 nt, Human
agguugaagccaa

SEQ ID NO: 3860959 - RNA, 14 nt, Human
agguugauaacuuu

SEQ ID NO: 3860960 - RNA, 17 nt, Human
agguugauaacuuugcu

SEQ ID NO: 3860961 - RNA, 19 nt, Human
agguugauaacuuugcuug

SEQ ID NO: 3860962 - RNA, 16 nt, Human
agguugaucagaucug

SEQ ID NO: 3860963 - RNA, 12 nt, Human
agguugcacacu

SEQ ID NO: 3860964 - RNA, 19 nt, Human
agguugcacacuuugguac

SEQ ID NO: 3860965 - RNA, 18 nt, Human
agguugcagugagcagag

SEQ ID NO: 3860966 - RNA, 24 nt, Human
agguugcugguugcugugugguuu

SEQ ID NO: 3860967 - RNA, 17 nt, Human
agguuggaagagaauca

SEQ ID NO: 3860968 - RNA, 18 nt, Human
agguuggaagagaaucac

SEQ ID NO: 3860969 - RNA, 16 nt, Human
agguuggagcccaggg

SEQ ID NO: 3860970 - RNA, 15 nt, Human
agguuggauggaugg

SEQ ID NO: 3860971 - RNA, 20 nt, Human
agguuggcaaaaaggcagga

SEQ ID NO: 3860972 - RNA, 14 nt, Human
agguuggugggggc

SEQ ID NO: 3860973 - RNA, 22 nt, Human
agguugguuuaaugcaauagaa

SEQ ID NO: 3860974 - RNA, 17 nt, Human
agguuguagugagccca

SEQ ID NO: 3860975 - RNA, 16 nt, Human
agguugucugaaguca

SEQ ID NO: 3860976 - RNA, 12 nt, Human
agguugucugug

SEQ ID NO: 3860977 - RNA, 16 nt, Human
agguuguuagaaaaau

SEQ ID NO: 3860978 - RNA, 17 nt, Human
agguuuaaacuucucug

SEQ ID NO: 3860979 - RNA, 13 nt, Human
agguuuaaagagu

SEQ ID NO: 3860980 - RNA, 15 nt, Human
agguuuaaagagucu

SEQ ID NO: 3860981 - RNA, 14 nt, Human
agguuuaacauaaa

SEQ ID NO: 3860982 - RNA, 15 nt, Human
agguuuaacauuugc

SEQ ID NO: 3860983 - RNA, 16 nt, Human
agguuuaacauuugcc

SEQ ID NO: 3860984 - RNA, 15 nt, Human
agguuuaacucagau

SEQ ID NO: 3860985 - RNA, 19 nt, Human
agguuuaacucagaucacu

SEQ ID NO: 3860986 - RNA, 23 nt, Human
agguuuaacucagaucacuacug

SEQ ID NO: 3860987 - RNA, 14 nt, Human
agguuuaagcuguu

SEQ ID NO: 3860988 - RNA, 17 nt, Human
agguuuacaauuuacaa

SEQ ID NO: 3860989 - RNA, 14 nt, Human
agguuuaugacagu

SEQ ID NO: 3860990 - RNA, 16 nt, Human
agguuuaugacaguaa

SEQ ID NO: 3860991 - RNA, 19 nt, Human
agguuuauuguuaauacaa

SEQ ID NO: 3860992 - RNA, 14 nt, Human
agguuucuauuuuc

SEQ ID NO: 3860993 - RNA, 16 nt, Human
agguuucucaaagaaa

SEQ ID NO: 3860994 - RNA, 14 nt, Human
agguuucugaaaau

SEQ ID NO: 3860995 - RNA, 23 nt, Human
agguuucugaaaauuaacacugc

SEQ ID NO: 3860996 - RNA, 18 nt, Human
agguuucuggucucuagg

SEQ ID NO: 3860997 - RNA, 12 nt, Human
agguuugaaucu

SEQ ID NO: 3860998 - RNA, 23 nt, Human
agguuuggacaaaauggaauacu

SEQ ID NO: 3860999 - RNA, 22 nt, Human
agguuugguguguggagaugca

SEQ ID NO: 3861000 - RNA, 23 nt, Human
agguuuguuuagaagaagugugu

SEQ ID NO: 3861001 - RNA, 17 nt, Human
agguuuguuuugugaau

SEQ ID NO: 3861002 - RNA, 20 nt, Human
agguuuguuuugugaauuuu

SEQ ID NO: 3861003 - RNA, 18 nt, Human
agguuuuaaaagccuugg

SEQ ID NO: 3861004 - RNA, 19 nt, Human
agguuuuaaguuguuugca

SEQ ID NO: 3861005 - RNA, 16 nt, Human
agguuuuaauuuagua

SEQ ID NO: 3861006 - RNA, 17 nt, Human
agguuuuaauuuaguaa

SEQ ID NO: 3861007 - RNA, 13 nt, Human
agguuuuacagau

SEQ ID NO: 3861008 - RNA, 14 nt, Human
agguuuuacagauu

SEQ ID NO: 3861009 - RNA, 14 nt, Human
agguuuuagguucu

SEQ ID NO: 3861010 - RNA, 13 nt, Human
agguuuuguaaag

SEQ ID NO: 3861011 - RNA, 21 nt, Human
agguuuuguuuuuuuucagcc

SEQ ID NO: 3861012 - RNA, 23 nt, Human
agguuuuuaaacacuaaaauaua

SEQ ID NO: 3861013 - RNA, 20 nt, Human
agguuuuuauuaguaccaua

SEQ ID NO: 3861014 - RNA, 14 nt, Human
agguuuuucaauua

SEQ ID NO: 3861015 - RNA, 17 nt, Human
agguuuuucaauuaaac

SEQ ID NO: 3861016 - RNA, 18 nt, Human
agguuuuucaauuaaacg

SEQ ID NO: 3861017 - RNA, 12 nt, Human
agguuuuuccuu

SEQ ID NO: 3861018 - RNA, 20 nt, Human
agguuuuuggaauuaugucu

SEQ ID NO: 3861019 - RNA, 13 nt, Human
agguuuuuguaaa

SEQ ID NO: 3861020 - RNA, 16 nt, Human
agguuuuuguaaagau

SEQ ID NO: 3861021 - RNA, 17 nt, Human
agguuuuuguaaagauu

SEQ ID NO: 3861022 - RNA, 16 nt, Human
agguuuuuuuccuucu

SEQ ID NO: 3861023 - RNA, 16 nt, Human
agguuuuuuuucaguu

SEQ ID NO: 3861024 - RNA, 16 nt, Human
aguaaaaacaaagaaa

SEQ ID NO: 3861025 - RNA, 14 nt, Human
aguaaaaaggcuaa

SEQ ID NO: 3861026 - RNA, 17 nt, Human
aguaaaaauaaaauacu

SEQ ID NO: 3861027 - RNA, 15 nt, Human
aguaaaacacagagg

SEQ ID NO: 3861028 - RNA, 16 nt, Human
aguaaaaccacagcag

SEQ ID NO: 3861029 - RNA, 17 nt, Human
aguaaaaccacagcagu

SEQ ID NO: 3861030 - RNA, 19 nt, Human
aguaaaaccacagcaguug

SEQ ID NO: 3861031 - RNA, 13 nt, Human
aguaaaagacauu

SEQ ID NO: 3861032 - RNA, 17 nt, Human
aguaaaauaauaauuuu

SEQ ID NO: 3861033 - RNA, 17 nt, Human
aguaaaauacucuuuuu

SEQ ID NO: 3861034 - RNA, 16 nt, Human
aguaaaauguggcagg

SEQ ID NO: 3861035 - RNA, 16 nt, Human
aguaaaauuauacugu

SEQ ID NO: 3861036 - RNA, 17 nt, Human
aguaaaauugccauauu

SEQ ID NO: 3861037 - RNA, 22 nt, Human
aguaaaauugccauauugcaca

SEQ ID NO: 3861038 - RNA, 13 nt, Human
aguaaaauuuauu

SEQ ID NO: 3861039 - RNA, 12 nt, Human
aguaaacacugu

SEQ ID NO: 3861040 - RNA, 23 nt, Human
aguaaacgggaacaugcccccug

SEQ ID NO: 3861041 - RNA, 14 nt, Human
aguaaacuauuuau

SEQ ID NO: 3861042 - RNA, 14 nt, Human
aguaaacuuuuugu

SEQ ID NO: 3861043 - RNA, 13 nt, Human
aguaaagaaauga

SEQ ID NO: 3861044 - RNA, 22 nt, Human
aguaaagaacguggucagagua

SEQ ID NO: 3861045 - RNA, 12 nt, Human
aguaaagaacug

SEQ ID NO: 3861046 - RNA, 23 nt, Human
aguaaagaacugcacaugaagaa

SEQ ID NO: 3861047 - RNA, 15 nt, Human
aguaaagagaaacuu

SEQ ID NO: 3861048 - RNA, 20 nt, Human
aguaaagccauuaaaugaau

SEQ ID NO: 3861049 - RNA, 21 nt, Human
aguaaagccauuaaaugaaua

SEQ ID NO: 3861050 - RNA, 17 nt, Human
aguaaagccguuguuua

SEQ ID NO: 3861051 - RNA, 14 nt, Human
aguaaagcuaaaau

SEQ ID NO: 3861052 - RNA, 17 nt, Human
aguaaagcuaaaaugau

SEQ ID NO: 3861053 - RNA, 16 nt, Human
aguaaaggcaaacuua

SEQ ID NO: 3861054 - RNA, 19 nt, Human
aguaaagugauaauuucug

SEQ ID NO: 3861055 - RNA, 21 nt, Human
aguaaaguguaacauaugcaa

SEQ ID NO: 3861056 - RNA, 16 nt, Human
aguaaaucucuucugu

SEQ ID NO: 3861057 - RNA, 18 nt, Human
aguaaaugggggugcauu

SEQ ID NO: 3861058 - RNA, 10 nt, Human
aguaaauguu

SEQ ID NO: 3861059 - RNA, 18 nt, Human
aguaacaagagugauucu

SEQ ID NO: 3861060 - RNA, 21 nt, Human
aguaacaagagugauucuugc

SEQ ID NO: 3861061 - RNA, 17 nt, Human
aguaacacuaauauauu

SEQ ID NO: 3861062 - RNA, 15 nt, Human
aguaacauaauaaau

SEQ ID NO: 3861063 - RNA, 17 nt, Human
aguaacauuugcuguuu

SEQ ID NO: 3861064 - RNA, 18 nt, Human
aguaucuccucgcaagcu

SEQ ID NO: 3861065 - RNA, 16 nt, Human
aguaucucuucagucu

SEQ ID NO: 3861066 - RNA, 14 nt, Human
aguaucugggaacu

SEQ ID NO: 3861067 - RNA, 15 nt, Human
aguaucuguaucucu

SEQ ID NO: 3861068 - RNA, 12 nt, Human
aguaucuuuuga

SEQ ID NO: 3861069 - RNA, 13 nt, Human
aguaugaaaauaa

SEQ ID NO: 3861070 - RNA, 14 nt, Human
aguaugaaauuaua

SEQ ID NO: 3861071 - RNA, 16 nt, Human
aguaugaaucuaugcc

SEQ ID NO: 3861072 - RNA, 17 nt, Human
aguaugaaucuaugcca

SEQ ID NO: 3861073 - RNA, 23 nt, Human
aguaugaauuugagcaggucuca

SEQ ID NO: 3861074 - RNA, 18 nt, Human
aguaugacgcugauacau

SEQ ID NO: 3861075 - RNA, 16 nt, Human
aguaugaggcauuugu

SEQ ID NO: 3861076 - RNA, 17 nt, Human
aguaugaggcauuuguu

SEQ ID NO: 3861077 - RNA, 16 nt, Human
aguaugcauuauuaaa

SEQ ID NO: 3861078 - RNA, 19 nt, Human
aguaugcauuauuaaauug

SEQ ID NO: 3861079 - RNA, 20 nt, Human
aguaugggacuggccucugc

SEQ ID NO: 3861080 - RNA, 14 nt, Human
aguaugguacauuu

SEQ ID NO: 3861081 - RNA, 16 nt, Human
aguaugguggcugggu

SEQ ID NO: 3861082 - RNA, 15 nt, Human
aguauguauauuaaa

SEQ ID NO: 3861083 - RNA, 19 nt, Human
aguauguggaagugugggu

SEQ ID NO: 3861084 - RNA, 21 nt, Human
aguauguuuuacacuguacca

SEQ ID NO: 3861085 - RNA, 20 nt, Human
aguauguuuuagcauguguu

SEQ ID NO: 3861086 - RNA, 13 nt, Human
aguauuaaaacau

SEQ ID NO: 3861087 - RNA, 19 nt, Human
aguauuaaaacauuggauu

SEQ ID NO: 3861088 - RNA, 15 nt, Human
aguauuaaaauguau

SEQ ID NO: 3861089 - RNA, 18 nt, Human
aguauuaaaauguaugca

SEQ ID NO: 3861090 - RNA, 18 nt, Human
aguauuaauacuaaaaua

SEQ ID NO: 3861091 - RNA, 21 nt, Human
aguauuaauaucugaggauga

SEQ ID NO: 3861092 - RNA, 16 nt, Human
aguauuaauucucuuu

SEQ ID NO: 3861093 - RNA, 21 nt, Human
aguauuacuaaauugaccuuu

SEQ ID NO: 3861094 - RNA, 18 nt, Human
aguauuauaaauuauguu

SEQ ID NO: 3861095 - RNA, 12 nt, Human
aguauuauaugu

SEQ ID NO: 3861096 - RNA, 13 nt, Human
aguauuauuuucc

SEQ ID NO: 3861097 - RNA, 20 nt, Human
aguauuccagaccugaagaa

SEQ ID NO: 3861098 - RNA, 19 nt, Human
aguauuccauugugugagu

SEQ ID NO: 3861099 - RNA, 23 nt, Human
aguauucucggauaguugcuauu

SEQ ID NO: 3861100 - RNA, 12 nt, Human
aguauucugccu

SEQ ID NO: 3861101 - RNA, 23 nt, Human
aguauucugccuuugcagaaaca

SEQ ID NO: 3861102 - RNA, 12 nt, Human
aguauucuucuc

SEQ ID NO: 3861103 - RNA, 12 nt, Human
aguauucuuuuu

SEQ ID NO: 3861104 - RNA, 14 nt, Human
aguauucuuuuucu

SEQ ID NO: 3861105 - RNA, 15 nt, Human
aguauugaagcauuu

SEQ ID NO: 3861106 - RNA, 20 nt, Human
aguauugaagcauuuuauaa

SEQ ID NO: 3861107 - RNA, 12 nt, Human
aguauugacaaa

SEQ ID NO: 3861108 - RNA, 14 nt, Human
aguauugacaaaau

SEQ ID NO: 3861109 - RNA, 20 nt, Human
aguauugacaaaauguuauu

SEQ ID NO: 3861110 - RNA, 21 nt, Human
aguauugacaaaauguuauuu

SEQ ID NO: 3861111 - RNA, 20 nt, Human
aguauugcaucuguauaagu

SEQ ID NO: 3861112 - RNA, 20 nt, Human
aguauuguacaaaguauuaa

SEQ ID NO: 3861113 - RNA, 15 nt, Human
aguauuguccagguc

SEQ ID NO: 3861114 - RNA, 16 nt, Human
aguauuguccaggucu

SEQ ID NO: 3861115 - RNA, 21 nt, Human
aguauuguuguccuuuucaua

SEQ ID NO: 3861116 - RNA, 22 nt, Human
aguauuguuuaaaauguaauuu

SEQ ID NO: 3861117 - RNA, 12 nt, Human
aguauuuaacua

SEQ ID NO: 3861118 - RNA, 17 nt, Human
aguauuuaacuucugag

SEQ ID NO: 3861119 - RNA, 14 nt, Human
aguauuuaagccua

SEQ ID NO: 3861120 - RNA, 19 nt, Human
aguauuuaagccuaaagau

SEQ ID NO: 3861121 - RNA, 20 nt, Human
aguauuuaagccuaaagauu

SEQ ID NO: 3861122 - RNA, 15 nt, Human
aguauuuaauuagug

SEQ ID NO: 3861123 - RNA, 21 nt, Human
aguauuuaauuagugcuaagu

SEQ ID NO: 3861124 - RNA, 16 nt, Human
aguauuuauaauagca

SEQ ID NO: 3861125 - RNA, 13 nt, Human
aguauuuauauau

SEQ ID NO: 3861126 - RNA, 14 nt, Human
aguauuuauauauu

SEQ ID NO: 3861127 - RNA, 16 nt, Human
aguauuuauauauuua

SEQ ID NO: 3861128 - RNA, 20 nt, Human
aguauuuauauauuuauaac

SEQ ID NO: 3861129 - RNA, 23 nt, Human
aguauuuauauauuuauaacuca

SEQ ID NO: 3861130 - RNA, 15 nt, Human
aguauuuauuuaaug

SEQ ID NO: 3861131 - RNA, 20 nt, Human
aguauuuauuuaauguuaug

SEQ ID NO: 3861132 - RNA, 15 nt, Human
aguauuuauuuaugu

SEQ ID NO: 3861133 - RNA, 20 nt, Human
aguauuuauuuauguacuuu

SEQ ID NO: 3861134 - RNA, 16 nt, Human
aguauuuauuuuguaa

SEQ ID NO: 3861135 - RNA, 21 nt, Human
aguauuuauuuuguaauuaug

SEQ ID NO: 3861136 - RNA, 19 nt, Human
aguauuucagaugcuuuag

SEQ ID NO: 3861137 - RNA, 17 nt, Human
aguauuucaguguaguu

SEQ ID NO: 3861138 - RNA, 16 nt, Human
aguauuucaugcuggg

SEQ ID NO: 3861139 - RNA, 13 nt, Human
aguauuucauugc

SEQ ID NO: 3861140 - RNA, 19 nt, Human
aguauuucauugccugugu

SEQ ID NO: 3861141 - RNA, 21 nt, Human
aguauuucauugccuguguau

SEQ ID NO: 3861142 - RNA, 22 nt, Human
aguauuuccacuuguucucagg

SEQ ID NO: 3861143 - RNA, 12 nt, Human
aguauuugaaaa

SEQ ID NO: 3861144 - RNA, 13 nt, Human
aguauuugaaaac

SEQ ID NO: 3861145 - RNA, 23 nt, Human
aguauuugaaacugaauguuuau

SEQ ID NO: 3861146 - RNA, 16 nt, Human
aguauuugaauuaaaa

SEQ ID NO: 3861147 - RNA, 17 nt, Human
aguauuugaauuaaaac

SEQ ID NO: 3861148 - RNA, 20 nt, Human
aguauuugaauuaaaacuuc

SEQ ID NO: 3861149 - RNA, 23 nt, Human
aguauuugauucaaaauauuuaa

SEQ ID NO: 3861150 - RNA, 18 nt, Human
aguauuuguuaauuuaga

SEQ ID NO: 3861151 - RNA, 16 nt, Human
aguauuuuaaaauagc

SEQ ID NO: 3861152 - RNA, 18 nt, Human
aguauuuugaaguuuaca

SEQ ID NO: 3861153 - RNA, 20 nt, Human
aguauuuugaaguuuacauu

SEQ ID NO: 3861154 - RNA, 22 nt, Human
aguauuuugaaguuuacauuuu

SEQ ID NO: 3861155 - RNA, 23 nt, Human
aguauuuugaaguuuacauuuuu

SEQ ID NO: 3861156 - RNA, 14 nt, Human
aguauuuuguuuca

SEQ ID NO: 3861157 - RNA, 18 nt, Human
aguauuuuugacagaaua

SEQ ID NO: 3861158 - RNA, 19 nt, Human
aguauuuuugcugcuucug

SEQ ID NO: 3861159 - RNA, 18 nt, Human
aguauuuuuuacauuuua

SEQ ID NO: 3861160 - RNA, 22 nt, Human
aguauuuuuuacauuuuacaca

SEQ ID NO: 3861161 - RNA, 19 nt, Human
aguauuuuuucaaguugua

SEQ ID NO: 3861162 - RNA, 20 nt, Human
aguauuuuuuguauaauugg

SEQ ID NO: 3861163 - RNA, 15 nt, Human
agucaaaaggugccu

SEQ ID NO: 3861164 - RNA, 16 nt, Human
agucaaaaggugccug

SEQ ID NO: 3861165 - RNA, 21 nt, Human
agucaaaauauuuuuaaaaga

SEQ ID NO: 3861166 - RNA, 22 nt, Human
agucaaacacuugugacuuuug

SEQ ID NO: 3861167 - RNA, 18 nt, Human
agucaaacauuucaaagu

SEQ ID NO: 3861168 - RNA, 13 nt, Human
agucaaagacauu

SEQ ID NO: 3861169 - RNA, 16 nt, Human
agucaaagagaguuuu

SEQ ID NO: 3861170 - RNA, 23 nt, Human
agucaaagagaguuuuuaauaga

SEQ ID NO: 3861171 - RNA, 12 nt, Human
agucaaaguaaa

SEQ ID NO: 3861172 - RNA, 23 nt, Human
agucaaauguaauguggcuucug

SEQ ID NO: 3861173 - RNA, 14 nt, Human
agucaaauuaauaa

SEQ ID NO: 3861174 - RNA, 13 nt, Human
agucaaauugugu

SEQ ID NO: 3861175 - RNA, 16 nt, Human
agucaacaaacuauuu

SEQ ID NO: 3861176 - RNA, 14 nt, Human
agucaacaguaaac

SEQ ID NO: 3861177 - RNA, 15 nt, Human
agucaacaguaaacc

SEQ ID NO: 3861178 - RNA, 16 nt, Human
agucaacaguaaacca

SEQ ID NO: 3861179 - RNA, 17 nt, Human
agucaacaguaaaccac

SEQ ID NO: 3861180 - RNA, 20 nt, Human
agucaacaguaaaccacuga

SEQ ID NO: 3861181 - RNA, 15 nt, Human
agucaaccugccuga

SEQ ID NO: 3861182 - RNA, 21 nt, Human
agucaacuacacaaagcaggc

SEQ ID NO: 3861183 - RNA, 19 nt, Human
agucaagacgaacauguag

SEQ ID NO: 3861184 - RNA, 14 nt, Human
agucaagcuccucc

SEQ ID NO: 3861185 - RNA, 15 nt, Human
agucaagcuccuccu

SEQ ID NO: 3861186 - RNA, 22 nt, Human
agucaagcuccuccucccugca

SEQ ID NO: 3861187 - RNA, 16 nt, Human
agucaaggaguggcuu

SEQ ID NO: 3861188 - RNA, 13 nt, Human
agucaaggccugc

SEQ ID NO: 3861189 - RNA, 24 nt, Human
agucaaucaagucuguuuacugca

SEQ ID NO: 3861190 - RNA, 16 nt, Human
agucaaucauuucuca

SEQ ID NO: 3861191 - RNA, 22 nt, Human
agucaaucauuucucacugugu

SEQ ID NO: 3861192 - RNA, 18 nt, Human
agucaauccccucauuca

SEQ ID NO: 3861193 - RNA, 17 nt, Human
agucaauuacucuauaa

SEQ ID NO: 3861194 - RNA, 13 nt, Human
agucacaauguuc

SEQ ID NO: 3861195 - RNA, 23 nt, Human
agucacacagugagucgaggaca

SEQ ID NO: 3861196 - RNA, 16 nt, Human
agucacacgggggcag

SEQ ID NO: 3861197 - RNA, 16 nt, Human
agucacacugcuagca

SEQ ID NO: 3861198 - RNA, 13 nt, Human
agucacagggcag

SEQ ID NO: 3861199 - RNA, 14 nt, Human
agucacagggcagu

SEQ ID NO: 3861200 - RNA, 15 nt, Human
agucacaucacagga

SEQ ID NO: 3861201 - RNA, 14 nt, Human
agucacaucucuuc

SEQ ID NO: 3861202 - RNA, 23 nt, Human
agucacauggccuaugcacauau

SEQ ID NO: 3861203 - RNA, 20 nt, Human
agucacauuccaagccucau

SEQ ID NO: 3861204 - RNA, 18 nt, Human
agucacauuccugaacag

SEQ ID NO: 3861205 - RNA, 20 nt, Human
agucaccaaauagugugaaa

SEQ ID NO: 3861206 - RNA, 14 nt, Human
agucaccaagccca

SEQ ID NO: 3861207 - RNA, 15 nt, Human
agucaccaagcccag

SEQ ID NO: 3861208 - RNA, 18 nt, Human
agucaccacuccauuccc

SEQ ID NO: 3861209 - RNA, 13 nt, Human
aguuuggguaaaa

SEQ ID NO: 3861210 - RNA, 20 nt, Human
aguuuggguaaaauacuuuu

SEQ ID NO: 3861211 - RNA, 15 nt, Human
aguuugguauuugcg

SEQ ID NO: 3861212 - RNA, 16 nt, Human
aguuuggucuggacug

SEQ ID NO: 3861213 - RNA, 21 nt, Human
aguuugguuguguaagagaau

SEQ ID NO: 3861214 - RNA, 15 nt, Human
aguuuguaaauguua

SEQ ID NO: 3861215 - RNA, 22 nt, Human
aguuuguaaauguuauuucugc

SEQ ID NO: 3861216 - RNA, 19 nt, Human
aguuuguagguaaaaugua

SEQ ID NO: 3861217 - RNA, 23 nt, Human
aguuuguauuuuaauuaugggaa

SEQ ID NO: 3861218 - RNA, 16 nt, Human
aguuuguccauuugua

SEQ ID NO: 3861219 - RNA, 16 nt, Human
aguuuguccuguagag

SEQ ID NO: 3861220 - RNA, 14 nt, Human
aguuugucuauuuu

SEQ ID NO: 3861221 - RNA, 15 nt, Human
aguuugucuauuuua

SEQ ID NO: 3861222 - RNA, 21 nt, Human
aguuugucuauuuuaaaauaa

SEQ ID NO: 3861223 - RNA, 13 nt, Human
aguuugugagaaa

SEQ ID NO: 3861224 - RNA, 14 nt, Human
aguuugugagaaac

SEQ ID NO: 3861225 - RNA, 14 nt, Human
aguuugugugucuu

SEQ ID NO: 3861226 - RNA, 15 nt, Human
aguuugugugucuua

SEQ ID NO: 3861227 - RNA, 21 nt, Human
aguuuguguguugucucuuga

SEQ ID NO: 3861228 - RNA, 20 nt, Human
aguuuguguguugucuugaa

SEQ ID NO: 3861229 - RNA, 20 nt, Human
aguuuguuuaaugugaacuu

SEQ ID NO: 3861230 - RNA, 21 nt, Human
aguuuguuuauuacuuauuug

SEQ ID NO: 3861231 - RNA, 17 nt, Human
aguuuguuucuuugaau

SEQ ID NO: 3861232 - RNA, 22 nt, Human
aguuuuaaaaaaauaaaacauu

SEQ ID NO: 3861233 - RNA, 16 nt, Human
aguuuuaccagaugau

SEQ ID NO: 3861234 - RNA, 20 nt, Human
aguuuuacuuuuaaacugug

SEQ ID NO: 3861235 - RNA, 19 nt, Human
aguuuuaggguacaugugc

SEQ ID NO: 3861236 - RNA, 14 nt, Human
aguuuuaguuuucu

SEQ ID NO: 3861237 - RNA, 19 nt, Human
aguuuuauagccuggacug

SEQ ID NO: 3861238 - RNA, 13 nt, Human
aguuuuauauauu

SEQ ID NO: 3861239 - RNA, 19 nt, Human
aguuuuaucacauguaugu

SEQ ID NO: 3861240 - RNA, 21 nt, Human
aguuuuaucacauguauguuu

SEQ ID NO: 3861241 - RNA, 13 nt, Human
aguuuuaucauuu

SEQ ID NO: 3861242 - RNA, 20 nt, Human
aguuuuaucauuuucaaaau

SEQ ID NO: 3861243 - RNA, 15 nt, Human
aguuuuaugcucuuu

SEQ ID NO: 3861244 - RNA, 14 nt, Human
aguuuuauuuauau

SEQ ID NO: 3861245 - RNA, 15 nt, Human
aguuuuauuuauauu

SEQ ID NO: 3861246 - RNA, 16 nt, Human
aguuuuauuuuauguu

SEQ ID NO: 3861247 - RNA, 20 nt, Human
aguuuuauuuucuaaaguac

SEQ ID NO: 3861248 - RNA, 22 nt, Human
aguuuucaagucaaauuaauaa

SEQ ID NO: 3861249 - RNA, 17 nt, Human
aguuuucaccucgaauu

SEQ ID NO: 3861250 - RNA, 19 nt, Human
aguuuucagaaaaagaaau

SEQ ID NO: 3861251 - RNA, 20 nt, Human
aguuuucauccauaacugaa

SEQ ID NO: 3861252 - RNA, 21 nt, Human
aguuuucauccauaacugaac

SEQ ID NO: 3861253 - RNA, 12 nt, Human
aguuuuccauga

SEQ ID NO: 3861254 - RNA, 20 nt, Human
aguuuuccauggcaggaagg

SEQ ID NO: 3861255 - RNA, 16 nt, Human
aguuuuccuaaaugua

SEQ ID NO: 3861256 - RNA, 17 nt, Human
aguuuuccuaaauguau

SEQ ID NO: 3861257 - RNA, 17 nt, Human
aguuuucuccucccagg

SEQ ID NO: 3861258 - RNA, 17 nt, Human
aguuuucuccuuuuacu

SEQ ID NO: 3861259 - RNA, 12 nt, Human
aguuuucucuua

SEQ ID NO: 3861260 - RNA, 12 nt, Human
aguuuucugaga

SEQ ID NO: 3861261 - RNA, 18 nt, Human
aguuuucuggcuggagcc

SEQ ID NO: 3861262 - RNA, 14 nt, Human
aguuuucuucugug

SEQ ID NO: 3861263 - RNA, 15 nt, Human
aguuuucuuguugcu

SEQ ID NO: 3861264 - RNA, 18 nt, Human
aguuuucuuuccuccuuu

SEQ ID NO: 3861265 - RNA, 17 nt, Human
aguuuucuuuuaauuuu

SEQ ID NO: 3861266 - RNA, 15 nt, Human
aguuuugaaaagcua

SEQ ID NO: 3861267 - RNA, 17 nt, Human
aguuuugaaaagcuauu

SEQ ID NO: 3861268 - RNA, 18 nt, Human
aguuuugaauguuaagaa

SEQ ID NO: 3861269 - RNA, 23 nt, Human
aguuuugacaucagccagcugcc

SEQ ID NO: 3861270 - RNA, 12 nt, Human
aguuuugagaac

SEQ ID NO: 3861271 - RNA, 19 nt, Human
aguuuugaugacuggcauu

SEQ ID NO: 3861272 - RNA, 15 nt, Human
aguuuuggaugcagu

SEQ ID NO: 3861273 - RNA, 18 nt, Human
aguuuuggaugcagugcu

SEQ ID NO: 3861274 - RNA, 19 nt, Human
aguuuuggaugcagugcuc

SEQ ID NO: 3861275 - RNA, 14 nt, Human
aguuuuguauucau

SEQ ID NO: 3861276 - RNA, 12 nt, Human
aguuuugucuug

SEQ ID NO: 3861277 - RNA, 14 nt, Human
aguuuugucuugaa

SEQ ID NO: 3861278 - RNA, 12 nt, Human
aguuuugugaaa

SEQ ID NO: 3861279 - RNA, 13 nt, Human
aguuuugugaaau

SEQ ID NO: 3861280 - RNA, 14 nt, Human
aguuuugugaaauu

SEQ ID NO: 3861281 - RNA, 16 nt, Human
aguuuugugaaauuuu

SEQ ID NO: 3861282 - RNA, 19 nt, Human
aguuuugugaaauuuuuca

SEQ ID NO: 3861283 - RNA, 20 nt, Human
aguuuugugaaauuuuucau

SEQ ID NO: 3861284 - RNA, 12 nt, Human
aguuuuguguuu

SEQ ID NO: 3861285 - RNA, 21 nt, Human
aguuuuguguuuguuguagau

SEQ ID NO: 3861286 - RNA, 18 nt, Human
aguuuuguuuuaaaauua

SEQ ID NO: 3861287 - RNA, 17 nt, Human
aguuuuuaaaauaucuu

SEQ ID NO: 3861288 - RNA, 19 nt, Human
aguuuuuaagguuauuuau

SEQ ID NO: 3861289 - RNA, 18 nt, Human
aguuuuuacagcuguguu

SEQ ID NO: 3861290 - RNA, 23 nt, Human
aguuuuuaccuaccacagugucu

SEQ ID NO: 3861291 - RNA, 15 nt, Human
aguuuuuacugaaca

SEQ ID NO: 3861292 - RNA, 16 nt, Human
aguuuuuacuuucugu

SEQ ID NO: 3861293 - RNA, 21 nt, Human
aguuuuuaguaaucuguacau

SEQ ID NO: 3861294 - RNA, 17 nt, Human
aguuuuuauauguugua

SEQ ID NO: 3861295 - RNA, 13 nt, Human
aguuuuucuguca

SEQ ID NO: 3861296 - RNA, 23 nt, Human
aguuuuucuguuuuguuuggcaa

SEQ ID NO: 3861297 - RNA, 13 nt, Human
aguuuuugauagu

SEQ ID NO: 3861298 - RNA, 12 nt, Human
aguuuuuguuug

SEQ ID NO: 3861299 - RNA, 20 nt, Human
aguuuuuucaucuucaguug

SEQ ID NO: 3861300 - RNA, 23 nt, Human
aguuuuuucaucuucaguugucu

SEQ ID NO: 3861301 - RNA, 20 nt, Human
aguuuuuucuuccuuuucac

SEQ ID NO: 3861302 - RNA, 23 nt, Human
aguuuuuucuuccuuuucacugc

SEQ ID NO: 3861303 - RNA, 23 nt, Human
aguuuuuugaaauuaugugacau

SEQ ID NO: 3861304 - RNA, 16 nt, Human
aguuuuuuguuuuaca

SEQ ID NO: 3861305 - RNA, 19 nt, Human
aguuuuuuuccuucaagaa

SEQ ID NO: 3861306 - RNA, 18 nt, Human
auaaaaaaaagaaaaaag

SEQ ID NO: 3861307 - RNA, 17 nt, Human
auaaaaaaaagaaauga

SEQ ID NO: 3861308 - RNA, 14 nt, Human
auaaaaaaaauagu

SEQ ID NO: 3861309 - RNA, 15 nt, Human
auaaaaaaaauaguu

SEQ ID NO: 3861310 - RNA, 18 nt, Human
auaaaaaaaaugaaaugu

SEQ ID NO: 3861311 - RNA, 16 nt, Human
auaaaaaagaucccaa

SEQ ID NO: 3861312 - RNA, 16 nt, Human
auaaaaaagucucuau

SEQ ID NO: 3861313 - RNA, 20 nt, Human
auaaaaaauaauaauacaag

SEQ ID NO: 3861314 - RNA, 14 nt, Human
auaaaaaauaugua

SEQ ID NO: 3861315 - RNA, 20 nt, Human
auaaaaaauauguauuuacc

SEQ ID NO: 3861316 - RNA, 16 nt, Human
auaaaaaaucaugcca

SEQ ID NO: 3861317 - RNA, 13 nt, Human
auaaaaaaugaaa

SEQ ID NO: 3861318 - RNA, 12 nt, Human
auaaaaaaugga

SEQ ID NO: 3861319 - RNA, 18 nt, Human
auaaaaaauggugccuga

SEQ ID NO: 3861320 - RNA, 16 nt, Human
auaaaaaauuaugaca

SEQ ID NO: 3861321 - RNA, 13 nt, Human
auaaaaaauuuug

SEQ ID NO: 3861322 - RNA, 19 nt, Human
auaaaaaauuuuguaauuu

SEQ ID NO: 3861323 - RNA, 12 nt, Human
auaaaaacuaaa

SEQ ID NO: 3861324 - RNA, 18 nt, Human
auaaaaacuaaauuguaa

SEQ ID NO: 3861325 - RNA, 20 nt, Human
auaaaaagacauucuuccaa

SEQ ID NO: 3861326 - RNA, 18 nt, Human
auaaaaagaucacuuucu

SEQ ID NO: 3861327 - RNA, 12 nt, Human
auaaaaagcaaa

SEQ ID NO: 3861328 - RNA, 16 nt, Human
auaaaaagcaaaacaa

SEQ ID NO: 3861329 - RNA, 18 nt, Human
auaaaaagccagggcugg

SEQ ID NO: 3861330 - RNA, 17 nt, Human
auaaaaagcuuccauga

SEQ ID NO: 3861331 - RNA, 21 nt, Human
auaaaaagcuuccaugauucu

SEQ ID NO: 3861332 - RNA, 12 nt, Human
auaaaaaggcac

SEQ ID NO: 3861333 - RNA, 12 nt, Human
auaaaaaggugu

SEQ ID NO: 3861334 - RNA, 18 nt, Human
auaaaaaguuaaaaaguu

SEQ ID NO: 3861335 - RNA, 19 nt, Human
auaaaaauaaaaaagaucc

SEQ ID NO: 3861336 - RNA, 15 nt, Human
auaaaaauaaauaga

SEQ ID NO: 3861337 - RNA, 22 nt, Human
auaaaaauaaauuugguucuaa

SEQ ID NO: 3861338 - RNA, 14 nt, Human
auaaaaauacugac

SEQ ID NO: 3861339 - RNA, 22 nt, Human
auaaaaauauuguguugugaau

SEQ ID NO: 3861340 - RNA, 19 nt, Human
auaaaaaucauggcaacau

SEQ ID NO: 3861341 - RNA, 12 nt, Human
auaaaaaugaca

SEQ ID NO: 3861342 - RNA, 12 nt, Human
auaaaaauguuu

SEQ ID NO: 3861343 - RNA, 18 nt, Human
auaaaaauuacuguguua

SEQ ID NO: 3861344 - RNA, 18 nt, Human
auaaaaauucuagauuac

SEQ ID NO: 3861345 - RNA, 19 nt, Human
auaaaacagaguaaucuug

SEQ ID NO: 3861346 - RNA, 21 nt, Human
auaaaacagaguaaucuuguu

SEQ ID NO: 3861347 - RNA, 22 nt, Human
auaaaacauuaagaaaaucaua

SEQ ID NO: 3861348 - RNA, 11 nt, Human
auaaaacauuu

SEQ ID NO: 3861349 - RNA, 13 nt, Human
auaaaacauuuua

SEQ ID NO: 3861350 - RNA, 19 nt, Human
auaaaacauuuuaaaugga

SEQ ID NO: 3861351 - RNA, 20 nt, Human
auaaaacauuuucacacaau

SEQ ID NO: 3861352 - RNA, 13 nt, Human
auaaaaccuuuca

SEQ ID NO: 3861353 - RNA, 14 nt, Human
auaaaaccuuucaa

SEQ ID NO: 3861354 - RNA, 15 nt, Human
auaaaaccuuucaaa

SEQ ID NO: 3861355 - RNA, 14 nt, Human
auaaccacugcuuc

SEQ ID NO: 3861356 - RNA, 22 nt, Human
auaaccacuuaaaaaaugucca

SEQ ID NO: 3861357 - RNA, 14 nt, Human
auaaccagacacaa

SEQ ID NO: 3861358 - RNA, 20 nt, Human
auaaccaugugaaaaggcaa

SEQ ID NO: 3861359 - RNA, 14 nt, Human
auaaccuaauuaau

SEQ ID NO: 3861360 - RNA, 13 nt, Human
auaaccuauauga

SEQ ID NO: 3861361 - RNA, 18 nt, Human
auaaccuauaugauuuau

SEQ ID NO: 3861362 - RNA, 23 nt, Human
auaaccuauuuugaaaaauuccu

SEQ ID NO: 3861363 - RNA, 22 nt, Human
auaacgauaaaagacagugaaa

SEQ ID NO: 3861364 - RNA, 16 nt, Human
auaacgugauacauuu

SEQ ID NO: 3861365 - RNA, 18 nt, Human
auaacguguucaauauuu

SEQ ID NO: 3861366 - RNA, 17 nt, Human
auaacguuuaagccaaa

SEQ ID NO: 3861367 - RNA, 14 nt, Human
auaacuaaauuuga

SEQ ID NO: 3861368 - RNA, 18 nt, Human
auaacuaaauuugauacu

SEQ ID NO: 3861369 - RNA, 15 nt, Human
auaacuaacaugucc

SEQ ID NO: 3861370 - RNA, 20 nt, Human
auaacuacuccggagacagg

SEQ ID NO: 3861371 - RNA, 19 nt, Human
auaacuagauggugcugag

SEQ ID NO: 3861372 - RNA, 15 nt, Human
auaacuauucaguug

SEQ ID NO: 3861373 - RNA, 17 nt, Human
auaacucaucauaaaau

SEQ ID NO: 3861374 - RNA, 18 nt, Human
auaacucaucauaaaaua

SEQ ID NO: 3861375 - RNA, 19 nt, Human
auaacucaucauaaaauaa

SEQ ID NO: 3861376 - RNA, 15 nt, Human
auaacuccucauugu

SEQ ID NO: 3861377 - RNA, 20 nt, Human
auaacuccuucuuguaguag

SEQ ID NO: 3861378 - RNA, 11 nt, Human
auaacucugca

SEQ ID NO: 3861379 - RNA, 12 nt, Human
auaacucuuugg

SEQ ID NO: 3861380 - RNA, 14 nt, Human
auaacugaaaauua

SEQ ID NO: 3861381 - RNA, 12 nt, Human
auaacugacaaa

SEQ ID NO: 3861382 - RNA, 12 nt, Human
auaacugagaau

SEQ ID NO: 3861383 - RNA, 12 nt, Human
auaacugaggag

SEQ ID NO: 3861384 - RNA, 18 nt, Human
auaacugccuuaaaacuu

SEQ ID NO: 3861385 - RNA, 12 nt, Human
auaacuggaaac

SEQ ID NO: 3861386 - RNA, 21 nt, Human
auaacuggaacacucuauaac

SEQ ID NO: 3861387 - RNA, 19 nt, Human
auaacuggaggaauuuucu

SEQ ID NO: 3861388 - RNA, 19 nt, Human
auaacuguaauuauuugaa

SEQ ID NO: 3861389 - RNA, 15 nt, Human
auaacuguauuugaa

SEQ ID NO: 3861390 - RNA, 12 nt, Human
auaacugugaag

SEQ ID NO: 3861391 - RNA, 16 nt, Human
auaacuguuuauaugu

SEQ ID NO: 3861392 - RNA, 20 nt, Human
auaacuguuuauauguguug

SEQ ID NO: 3861393 - RNA, 19 nt, Human
auaacuuaaaaauguaaau

SEQ ID NO: 3861394 - RNA, 12 nt, Human
auaacuuaaaau

SEQ ID NO: 3861395 - RNA, 18 nt, Human
auaacuuaaugaaaacaa

SEQ ID NO: 3861396 - RNA, 19 nt, Human
auaacuuaaugaaaacaau

SEQ ID NO: 3861397 - RNA, 15 nt, Human
auaacuuauauugua

SEQ ID NO: 3861398 - RNA, 19 nt, Human
auaacuucuuaaaaguugu

SEQ ID NO: 3861399 - RNA, 20 nt, Human
auaacuugaugcaugugguu

SEQ ID NO: 3861400 - RNA, 22 nt, Human
auaacuuuaacuucuguuuuac

SEQ ID NO: 3861401 - RNA, 12 nt, Human
auaacuuugcuu

SEQ ID NO: 3861402 - RNA, 14 nt, Human
auaagaaaaacuuu

SEQ ID NO: 3861403 - RNA, 21 nt, Human
auaagaaaagauguagauuua

SEQ ID NO: 3861404 - RNA, 21 nt, Human
auaagaaaauauauucuuuca

SEQ ID NO: 3861405 - RNA, 21 nt, Human
auaagaaacuuuuuuauuuaa

SEQ ID NO: 3861406 - RNA, 13 nt, Human
auaagaaagacau

SEQ ID NO: 3861407 - RNA, 14 nt, Human
auaagaaagacauc

SEQ ID NO: 3861408 - RNA, 11 nt, Human
auaagaaagcc

SEQ ID NO: 3861409 - RNA, 15 nt, Human
auaagaaaguuucac

SEQ ID NO: 3861410 - RNA, 21 nt, Human
auaagaaauaaugcuacaauu

SEQ ID NO: 3861411 - RNA, 22 nt, Human
auaagaacaauagguaaagcua

SEQ ID NO: 3861412 - RNA, 23 nt, Human
auaagaaccuuuugagugccuua

SEQ ID NO: 3861413 - RNA, 23 nt, Human
auaagaagaaguucauguccaaa

SEQ ID NO: 3861414 - RNA, 14 nt, Human
auaagaagcaaaua

SEQ ID NO: 3861415 - RNA, 18 nt, Human
auaagaauaaaauguuga

SEQ ID NO: 3861416 - RNA, 17 nt, Human
auaagaauuauuuugau

SEQ ID NO: 3861417 - RNA, 14 nt, Human
auaagaauuugcau

SEQ ID NO: 3861418 - RNA, 17 nt, Human
auaagaauuugcauacu

SEQ ID NO: 3861419 - RNA, 21 nt, Human
auaagacaaugacauacgcuu

SEQ ID NO: 3861420 - RNA, 21 nt, Human
auaagacggauuuauuuuucc

SEQ ID NO: 3861421 - RNA, 17 nt, Human
auaagacuuagauugug

SEQ ID NO: 3861422 - RNA, 20 nt, Human
auaagagagaacaacuacug

SEQ ID NO: 3861423 - RNA, 14 nt, Human
auaagagcaugaaa

SEQ ID NO: 3861424 - RNA, 21 nt, Human
auaagaggcugauaauuccag

SEQ ID NO: 3861425 - RNA, 17 nt, Human
auaagagggcacacacu

SEQ ID NO: 3861426 - RNA, 17 nt, Human
auaagauaaaugugcug

SEQ ID NO: 3861427 - RNA, 14 nt, Human
auaagaugacugug

SEQ ID NO: 3861428 - RNA, 11 nt, Human
auaagauucua

SEQ ID NO: 3861429 - RNA, 12 nt, Human
auaagauucuaa

SEQ ID NO: 3861430 - RNA, 17 nt, Human
auaagauucuaacgguc

SEQ ID NO: 3861431 - RNA, 10 nt, Human
auaagcaaaa

SEQ ID NO: 3861432 - RNA, 14 nt, Human
auaagcaaaauccu

SEQ ID NO: 3861433 - RNA, 21 nt, Human
auaagcaaaauccugacuauu

SEQ ID NO: 3861434 - RNA, 12 nt, Human
auaagcaacaau

SEQ ID NO: 3861435 - RNA, 23 nt, Human
auaagcaagaaggcaaaaauagu

SEQ ID NO: 3861436 - RNA, 12 nt, Human
auaagcaagaga

SEQ ID NO: 3861437 - RNA, 14 nt, Human
auaagcaagagaga

SEQ ID NO: 3861438 - RNA, 16 nt, Human
auaagcaagagagaug

SEQ ID NO: 3861439 - RNA, 17 nt, Human
auaagcaaucaagguua

SEQ ID NO: 3861440 - RNA, 13 nt, Human
auaagcacuguaa

SEQ ID NO: 3861441 - RNA, 17 nt, Human
auaagcacuguaaacuu

SEQ ID NO: 3861442 - RNA, 18 nt, Human
auaagcacugugcuaaua

SEQ ID NO: 3861443 - RNA, 22 nt, Human
auaagcagguggaucuauuuca

SEQ ID NO: 3861444 - RNA, 14 nt, Human
auaagcaucauuau

SEQ ID NO: 3861445 - RNA, 15 nt, Human
auaagcaucauuauu

SEQ ID NO: 3861446 - RNA, 19 nt, Human
auaagcaucauuauuuaug

SEQ ID NO: 3861447 - RNA, 15 nt, Human
auaagcauugaaauu

SEQ ID NO: 3861448 - RNA, 22 nt, Human
auaagccaaaaaaugcuugcuu

SEQ ID NO: 3861449 - RNA, 22 nt, Human
auaagccaauuuuucugcacug

SEQ ID NO: 3861450 - RNA, 18 nt, Human
auaagcggcguaaguuua

SEQ ID NO: 3861451 - RNA, 16 nt, Human
auaagcuaaagaggcu

SEQ ID NO: 3861452 - RNA, 21 nt, Human
auaagcuaacaccagacagac

SEQ ID NO: 3861453 - RNA, 19 nt, Human
auaagcuacuagcaaaaua

SEQ ID NO: 3861454 - RNA, 22 nt, Human
auaagcuacuagcaaaauaaaa

SEQ ID NO: 3861455 - RNA, 17 nt, Human
auaagcuaguugaauac

SEQ ID NO: 3861456 - RNA, 20 nt, Human
auaagcuaguugaauacuug

SEQ ID NO: 3861457 - RNA, 15 nt, Human
auaagcuauuugaug

SEQ ID NO: 3861458 - RNA, 16 nt, Human
auaagcuauuugaugu

SEQ ID NO: 3861459 - RNA, 23 nt, Human
auaagcuauuugauguaauacuu

SEQ ID NO: 3861460 - RNA, 18 nt, Human
auaagcuuaugcuuaaau

SEQ ID NO: 3861461 - RNA, 13 nt, Human
auaagcuuccagg

SEQ ID NO: 3861462 - RNA, 23 nt, Human
auaagcuuccaggcugcauagaa

SEQ ID NO: 3861463 - RNA, 10 nt, Human
auaaggaauu

SEQ ID NO: 3861464 - RNA, 17 nt, Human
auaaggaauuauagacc

SEQ ID NO: 3861465 - RNA, 10 nt, Human
auaaggacug

SEQ ID NO: 3861466 - RNA, 11 nt, Human
auaaggacugc

SEQ ID NO: 3861467 - RNA, 15 nt, Human
auaaggacugcaugg

SEQ ID NO: 3861468 - RNA, 14 nt, Human
auaaggaucagaac

SEQ ID NO: 3861469 - RNA, 16 nt, Human
auaaggccuuaauaug

SEQ ID NO: 3861470 - RNA, 11 nt, Human
auaaggcuuca

SEQ ID NO: 3861471 - RNA, 13 nt, Human
auaagggaaaaau

SEQ ID NO: 3861472 - RNA, 22 nt, Human
auaagggaaguaguuaucaugu

SEQ ID NO: 3861473 - RNA, 23 nt, Human
auaagggaaguaguuaucauguu

SEQ ID NO: 3861474 - RNA, 13 nt, Human
auaagggcagagu

SEQ ID NO: 3861475 - RNA, 21 nt, Human
auaaggggucaaaauuugcug

SEQ ID NO: 3861476 - RNA, 17 nt, Human
auaagggguuugccauu

SEQ ID NO: 3861477 - RNA, 21 nt, Human
auaagguaccuuucacauaga

SEQ ID NO: 3861478 - RNA, 20 nt, Human
auaaggugcucucuuucugu

SEQ ID NO: 3861479 - RNA, 13 nt, Human
auaagguguauug

SEQ ID NO: 3861480 - RNA, 14 nt, Human
auaagguguauugc

SEQ ID NO: 3861481 - RNA, 20 nt, Human
auaagguguuuucuguguaa

SEQ ID NO: 3861482 - RNA, 22 nt, Human
auaagguguuuucuguguaacc

SEQ ID NO: 3861483 - RNA, 19 nt, Human
auaagguuucguuucugua

SEQ ID NO: 3861484 - RNA, 23 nt, Human
auaagguuucguuucuguauaca

SEQ ID NO: 3861485 - RNA, 15 nt, Human
auaaguaaaugcuag

SEQ ID NO: 3861486 - RNA, 13 nt, Human
auaaguaaguuug

SEQ ID NO: 3861487 - RNA, 18 nt, Human
auaaguacuguguacaga

SEQ ID NO: 3861488 - RNA, 19 nt, Human
auaaguauuucaaauugga

SEQ ID NO: 3861489 - RNA, 22 nt, Human
auaaguccucuagugaauguag

SEQ ID NO: 3861490 - RNA, 21 nt, Human
auaaguccuugcaagaaucag

SEQ ID NO: 3861491 - RNA, 22 nt, Human
auaagugaaauggauacuacau

SEQ ID NO: 3861492 - RNA, 12 nt, Human
auaagugcccuc

SEQ ID NO: 3861493 - RNA, 14 nt, Human
auaagugcuguaua

SEQ ID NO: 3861494 - RNA, 15 nt, Human
auaagugcuguauaa

SEQ ID NO: 3861495 - RNA, 18 nt, Human
auaaguggaggcacuuua

SEQ ID NO: 3861496 - RNA, 19 nt, Human
auaaguggaggcacuuuag

SEQ ID NO: 3861497 - RNA, 21 nt, Human
auaaguguauuuugaaauugu

SEQ ID NO: 3861498 - RNA, 14 nt, Human
auaaguguauuuuu

SEQ ID NO: 3861499 - RNA, 20 nt, Human
auaagugugugguagaaaca

SEQ ID NO: 3861500 - RNA, 19 nt, Human
auaaguguguguuuuucau

SEQ ID NO: 3861501 - RNA, 12 nt, Human
auauugucagau

SEQ ID NO: 3861502 - RNA, 15 nt, Human
auauugucagauauu

SEQ ID NO: 3861503 - RNA, 14 nt, Human
auauugugauucug

SEQ ID NO: 3861504 - RNA, 19 nt, Human
auauugugauucugccuuu

SEQ ID NO: 3861505 - RNA, 12 nt, Human
auauugugccaa

SEQ ID NO: 3861506 - RNA, 19 nt, Human
auauugugccaauauguau

SEQ ID NO: 3861507 - RNA, 18 nt, Human
auauuguguugugaaugu

SEQ ID NO: 3861508 - RNA, 17 nt, Human
auauuguuaaucucugu

SEQ ID NO: 3861509 - RNA, 20 nt, Human
auauuguuauuauauaauua

SEQ ID NO: 3861510 - RNA, 15 nt, Human
auauuguugacaacu

SEQ ID NO: 3861511 - RNA, 16 nt, Human
auauuguuguauaauu

SEQ ID NO: 3861512 - RNA, 14 nt, Human
auauuguuucugca

SEQ ID NO: 3861513 - RNA, 18 nt, Human
auauuguuucuuuaucac

SEQ ID NO: 3861514 - RNA, 19 nt, Human
auauuguuugguaaauguu

SEQ ID NO: 3861515 - RNA, 21 nt, Human
auauuguuugguaaauguuuc

SEQ ID NO: 3861516 - RNA, 13 nt, Human
auauuguuuucag

SEQ ID NO: 3861517 - RNA, 20 nt, Human
auauuguuuucaguguacau

SEQ ID NO: 3861518 - RNA, 17 nt, Human
auauuguuuuucuuucu

SEQ ID NO: 3861519 - RNA, 13 nt, Human
auauuuaaaaaua

SEQ ID NO: 3861520 - RNA, 12 nt, Human
auauuuaaacag

SEQ ID NO: 3861521 - RNA, 12 nt, Human
auauuuaaacuc

SEQ ID NO: 3861522 - RNA, 14 nt, Human
auauuuaaagggaa

SEQ ID NO: 3861523 - RNA, 19 nt, Human
auauuuaacucucuuuaug

SEQ ID NO: 3861524 - RNA, 22 nt, Human
auauuuaagaaaauacaauaaa

SEQ ID NO: 3861525 - RNA, 23 nt, Human
auauuuaagaaaauacaauaaac

SEQ ID NO: 3861526 - RNA, 14 nt, Human
auauuuaaggagau

SEQ ID NO: 3861527 - RNA, 15 nt, Human
auauuuaaguauuca

SEQ ID NO: 3861528 - RNA, 23 nt, Human
auauuuaaugcauuaaaccuguc

SEQ ID NO: 3861529 - RNA, 21 nt, Human
auauuuaauguugaacaaaau

SEQ ID NO: 3861530 - RNA, 14 nt, Human
auauuuaauguuuu

SEQ ID NO: 3861531 - RNA, 21 nt, Human
auauuuaauguuuuaaaugua

SEQ ID NO: 3861532 - RNA, 22 nt, Human
auauuuaauguuuuaaauguac

SEQ ID NO: 3861533 - RNA, 13 nt, Human
auauuuacaaaug

SEQ ID NO: 3861534 - RNA, 16 nt, Human
auauuuacaauguauu

SEQ ID NO: 3861535 - RNA, 16 nt, Human
auauuuacauaugaaa

SEQ ID NO: 3861536 - RNA, 21 nt, Human
auauuuacaugaauugcauuu

SEQ ID NO: 3861537 - RNA, 15 nt, Human
auauuuaccucagcc

SEQ ID NO: 3861538 - RNA, 14 nt, Human
auauuuacucuaua

SEQ ID NO: 3861539 - RNA, 19 nt, Human
auauuuacuucuuauacau

SEQ ID NO: 3861540 - RNA, 15 nt, Human
auauuuagcaaauaa

SEQ ID NO: 3861541 - RNA, 14 nt, Human
auauuuagcuccaa

SEQ ID NO: 3861542 - RNA, 18 nt, Human
auauuuaguguucauaaa

SEQ ID NO: 3861543 - RNA, 22 nt, Human
auauuuaguuauaguuucagau

SEQ ID NO: 3861544 - RNA, 14 nt, Human
auauuuauaaaacu

SEQ ID NO: 3861545 - RNA, 17 nt, Human
auauuuauaaaugagca

SEQ ID NO: 3861546 - RNA, 16 nt, Human
auauuuauaacagcau

SEQ ID NO: 3861547 - RNA, 13 nt, Human
auauuuauaacuc

SEQ ID NO: 3861548 - RNA, 17 nt, Human
auauuuauaacucauca

SEQ ID NO: 3861549 - RNA, 20 nt, Human
auauuuauaacucaucauaa

SEQ ID NO: 3861550 - RNA, 15 nt, Human
auauuuauauauuua

SEQ ID NO: 3861551 - RNA, 15 nt, Human
auauuuauccaaaau

SEQ ID NO: 3861552 - RNA, 20 nt, Human
auauuuauccaaaaugugua

SEQ ID NO: 3861553 - RNA, 19 nt, Human
auauuuauggggggagaac

SEQ ID NO: 3861554 - RNA, 22 nt, Human
auauuuauuaaauaaaaucaau

SEQ ID NO: 3861555 - RNA, 15 nt, Human
auauuuauuaaauuu

SEQ ID NO: 3861556 - RNA, 23 nt, Human
auauuuauuauuuucaccuguuu

SEQ ID NO: 3861557 - RNA, 19 nt, Human
auauuuauucauuauuugu

SEQ ID NO: 3861558 - RNA, 16 nt, Human
auauuuauugacucuu

SEQ ID NO: 3861559 - RNA, 18 nt, Human
auauuuauugacucuuga

SEQ ID NO: 3861560 - RNA, 12 nt, Human
auauuuauugcu

SEQ ID NO: 3861561 - RNA, 18 nt, Human
auauuuauugcuuuauaa

SEQ ID NO: 3861562 - RNA, 16 nt, Human
auauuuauuuaaagca

SEQ ID NO: 3861563 - RNA, 14 nt, Human
auauuuauuuuaau

SEQ ID NO: 3861564 - RNA, 18 nt, Human
auauuuauuuuaauaaug

SEQ ID NO: 3861565 - RNA, 18 nt, Human
auauuuauuuuuuuaagc

SEQ ID NO: 3861566 - RNA, 13 nt, Human
auauuucaagaca

SEQ ID NO: 3861567 - RNA, 23 nt, Human
auauuucagauaaucacaauaca

SEQ ID NO: 3861568 - RNA, 22 nt, Human
auauuuccaggcugcauuugua

SEQ ID NO: 3861569 - RNA, 23 nt, Human
auauuuccaggcugcauuuguau

SEQ ID NO: 3861570 - RNA, 18 nt, Human
auauuuccauauggauuu

SEQ ID NO: 3861571 - RNA, 22 nt, Human
auauuucccaugauuucaugua

SEQ ID NO: 3861572 - RNA, 22 nt, Human
auauuucccuaaaauacauuua

SEQ ID NO: 3861573 - RNA, 21 nt, Human
auauuucccuccccuggggac

SEQ ID NO: 3861574 - RNA, 21 nt, Human
auauuuccuauaccauuuccg

SEQ ID NO: 3861575 - RNA, 22 nt, Human
auauuuccuauaccauuuccgu

SEQ ID NO: 3861576 - RNA, 15 nt, Human
auauuuccuuuaugu

SEQ ID NO: 3861577 - RNA, 21 nt, Human
auauuuccuuuaugugaauuu

SEQ ID NO: 3861578 - RNA, 14 nt, Human
auauuucuauugaa

SEQ ID NO: 3861579 - RNA, 21 nt, Human
auauuucuauuuuauuaugaa

SEQ ID NO: 3861580 - RNA, 14 nt, Human
auauuugaaauauu

SEQ ID NO: 3861581 - RNA, 23 nt, Human
auauuugaaauauugacuuuuua

SEQ ID NO: 3861582 - RNA, 11 nt, Human
auauuugaauc

SEQ ID NO: 3861583 - RNA, 13 nt, Human
auauuugaaucuu

SEQ ID NO: 3861584 - RNA, 16 nt, Human
auauuugaaucuuguc

SEQ ID NO: 3861585 - RNA, 21 nt, Human
auauuugaauguaugcuucau

SEQ ID NO: 3861586 - RNA, 15 nt, Human
auauuugacuauucu

SEQ ID NO: 3861587 - RNA, 22 nt, Human
auauuugacuugcaugaagaga

SEQ ID NO: 3861588 - RNA, 17 nt, Human
auauuugaggaguguua

SEQ ID NO: 3861589 - RNA, 16 nt, Human
auauuugauuuauuaa

SEQ ID NO: 3861590 - RNA, 17 nt, Human
auauuugcaaaguguau

SEQ ID NO: 3861591 - RNA, 20 nt, Human
auauuuggaugcagaguuca

SEQ ID NO: 3861592 - RNA, 19 nt, Human
auauuugguuuuccuguau

SEQ ID NO: 3861593 - RNA, 20 nt, Human
auauuuguaaauuuauguga

SEQ ID NO: 3861594 - RNA, 13 nt, Human
auauuuguacaaa

SEQ ID NO: 3861595 - RNA, 14 nt, Human
auauuuguacaaaa

SEQ ID NO: 3861596 - RNA, 18 nt, Human
auauuuguacuguuuaau

SEQ ID NO: 3861597 - RNA, 22 nt, Human
auauuuguacuguuuaauguuc

SEQ ID NO: 3861598 - RNA, 17 nt, Human
auauuuguacuuucugu

SEQ ID NO: 3861599 - RNA, 19 nt, Human
auauuuguacuuucuguua

SEQ ID NO: 3861600 - RNA, 13 nt, Human
auauuuguaggag

SEQ ID NO: 3861601 - RNA, 18 nt, Human
auauuuguauaguugcuu

SEQ ID NO: 3861602 - RNA, 13 nt, Human
auauuuguaugau

SEQ ID NO: 3861603 - RNA, 17 nt, Human
auauuuguauuuauucu

SEQ ID NO: 3861604 - RNA, 21 nt, Human
auauuugucaugcugggauuu

SEQ ID NO: 3861605 - RNA, 20 nt, Human
auauuugucgauauuuccau

SEQ ID NO: 3861606 - RNA, 18 nt, Human
auauuugugacaaaaaau

SEQ ID NO: 3861607 - RNA, 18 nt, Human
auauuugugcauuuucua

SEQ ID NO: 3861608 - RNA, 17 nt, Human
auauuuguguauuuaac

SEQ ID NO: 3861609 - RNA, 22 nt, Human
auauuugugugcuaaacgugua

SEQ ID NO: 3861610 - RNA, 17 nt, Human
auauuuguguguucacu

SEQ ID NO: 3861611 - RNA, 16 nt, Human
auauuuguuuauggua

SEQ ID NO: 3861612 - RNA, 16 nt, Human
auauuuuaaaaugaga

SEQ ID NO: 3861613 - RNA, 13 nt, Human
auauuuuaaaauu

SEQ ID NO: 3861614 - RNA, 17 nt, Human
auauuuuaaaauuuguu

SEQ ID NO: 3861615 - RNA, 14 nt, Human
auauuuuaaagaau

SEQ ID NO: 3861616 - RNA, 20 nt, Human
auauuuuaaagaauuguguc

SEQ ID NO: 3861617 - RNA, 12 nt, Human
auauuuuaacuu

SEQ ID NO: 3861618 - RNA, 15 nt, Human
auauuuuaagcauua

SEQ ID NO: 3861619 - RNA, 21 nt, Human
auauuuuaagcauuacucuug

SEQ ID NO: 3861620 - RNA, 16 nt, Human
auauuuuaauuucaag

SEQ ID NO: 3861621 - RNA, 15 nt, Human
auauuuuacauaaau

SEQ ID NO: 3861622 - RNA, 23 nt, Human
auauuuuacauucuuggaaaguc

SEQ ID NO: 3861623 - RNA, 23 nt, Human
auauuuuaccucuuauugcaaaa

SEQ ID NO: 3861624 - RNA, 22 nt, Human
auauuuuauauaaaguauucuu

SEQ ID NO: 3861625 - RNA, 17 nt, Human
auauuuuaugauccagc

SEQ ID NO: 3861626 - RNA, 15 nt, Human
auauuuuaugugaga

SEQ ID NO: 3861627 - RNA, 15 nt, Human
auauuuuauuacugu

SEQ ID NO: 3861628 - RNA, 15 nt, Human
auauuuuauuauaua

SEQ ID NO: 3861629 - RNA, 15 nt, Human
auauuuuauuucaau

SEQ ID NO: 3861630 - RNA, 18 nt, Human
auauuuucauuaaaagcu

SEQ ID NO: 3861631 - RNA, 18 nt, Human
auauuuuccaugaaaaug

SEQ ID NO: 3861632 - RNA, 13 nt, Human
auauuuuccuccu

SEQ ID NO: 3861633 - RNA, 11 nt, Human
auauuuuccug

SEQ ID NO: 3861634 - RNA, 16 nt, Human
auauuuucguaugaaa

SEQ ID NO: 3861635 - RNA, 14 nt, Human
auauuuucuauuuu

SEQ ID NO: 3861636 - RNA, 12 nt, Human
auauuuucucua

SEQ ID NO: 3861637 - RNA, 13 nt, Human
auauuuucucugu

SEQ ID NO: 3861638 - RNA, 14 nt, Human
auauuuucugugug

SEQ ID NO: 3861639 - RNA, 20 nt, Human
auauuuucuguguguuccug

SEQ ID NO: 3861640 - RNA, 21 nt, Human
auauuuucuguguguuccugg

SEQ ID NO: 3861641 - RNA, 12 nt, Human
auauuuucuguu

SEQ ID NO: 3861642 - RNA, 12 nt, Human
auauuuugaauc

SEQ ID NO: 3861643 - RNA, 13 nt, Human
auauuuugaauca

SEQ ID NO: 3861644 - RNA, 23 nt, Human
auauuuugauaauaaauugaaau

SEQ ID NO: 3861645 - RNA, 12 nt, Human
auauuuugaucu

SEQ ID NO: 3861646 - RNA, 14 nt, Human
aucacuuuuuucca

SEQ ID NO: 3861647 - RNA, 16 nt, Human
aucagaaacacccuca

SEQ ID NO: 3861648 - RNA, 14 nt, Human
aucagaaagaggca

SEQ ID NO: 3861649 - RNA, 20 nt, Human
aucagaaaggaaaaacaaac

SEQ ID NO: 3861650 - RNA, 22 nt, Human
aucagaaaggaaaaacaaacuc

SEQ ID NO: 3861651 - RNA, 21 nt, Human
aucagaaagggagggcucuga

SEQ ID NO: 3861652 - RNA, 22 nt, Human
aucagaaagggagggcucugag

SEQ ID NO: 3861653 - RNA, 14 nt, Human
aucagaaaguaauu

SEQ ID NO: 3861654 - RNA, 14 nt, Human
aucagaaauuuuua

SEQ ID NO: 3861655 - RNA, 17 nt, Human
aucagaagauaacuuga

SEQ ID NO: 3861656 - RNA, 12 nt, Human
aucagaaggaga

SEQ ID NO: 3861657 - RNA, 18 nt, Human
aucagaagucaucuugcu

SEQ ID NO: 3861658 - RNA, 20 nt, Human
aucagaauaaccuucaaaua

SEQ ID NO: 3861659 - RNA, 19 nt, Human
aucagaauagccacauuug

SEQ ID NO: 3861660 - RNA, 22 nt, Human
aucagaauagccacauuuggaa

SEQ ID NO: 3861661 - RNA, 11 nt, Human
aucagaauucu

SEQ ID NO: 3861662 - RNA, 17 nt, Human
aucagaauugaaacacu

SEQ ID NO: 3861663 - RNA, 13 nt, Human
aucagacagaucu

SEQ ID NO: 3861664 - RNA, 20 nt, Human
aucagacaguggaugagaca

SEQ ID NO: 3861665 - RNA, 14 nt, Human
aucagacccuaccc

SEQ ID NO: 3861666 - RNA, 15 nt, Human
aucagacccuacccc

SEQ ID NO: 3861667 - RNA, 16 nt, Human
aucagacccuacccca

SEQ ID NO: 3861668 - RNA, 16 nt, Human
aucagacuaagccagc

SEQ ID NO: 3861669 - RNA, 17 nt, Human
aucagacuaagccagca

SEQ ID NO: 3861670 - RNA, 19 nt, Human
aucagacuaugaaguuuuu

SEQ ID NO: 3861671 - RNA, 15 nt, Human
aucagagcaggaccu

SEQ ID NO: 3861672 - RNA, 16 nt, Human
aucagagcaggaccuc

SEQ ID NO: 3861673 - RNA, 13 nt, Human
aucagagcuccuc

SEQ ID NO: 3861674 - RNA, 21 nt, Human
aucagagcuccucuguccugc

SEQ ID NO: 3861675 - RNA, 14 nt, Human
aucagaggccuaua

SEQ ID NO: 3861676 - RNA, 16 nt, Human
aucagagugacaucca

SEQ ID NO: 3861677 - RNA, 15 nt, Human
aucagauaagacaua

SEQ ID NO: 3861678 - RNA, 14 nt, Human
aucagauacaucac

SEQ ID NO: 3861679 - RNA, 15 nt, Human
aucagauacaucacu

SEQ ID NO: 3861680 - RNA, 23 nt, Human
aucagaugaacucuuagaaauga

SEQ ID NO: 3861681 - RNA, 14 nt, Human
aucagauggaaaua

SEQ ID NO: 3861682 - RNA, 15 nt, Human
aucagauguugaauu

SEQ ID NO: 3861683 - RNA, 16 nt, Human
aucagauguugaauuc

SEQ ID NO: 3861684 - RNA, 19 nt, Human
aucagauguugaauucuuu

SEQ ID NO: 3861685 - RNA, 21 nt, Human
aucagauguuuuggucaagua

SEQ ID NO: 3861686 - RNA, 14 nt, Human
aucagauugcuuuu

SEQ ID NO: 3861687 - RNA, 17 nt, Human
aucagauuuuaacagcu

SEQ ID NO: 3861688 - RNA, 12 nt, Human
aucagcaaaaaa

SEQ ID NO: 3861689 - RNA, 13 nt, Human
aucagcaaagaau

SEQ ID NO: 3861690 - RNA, 13 nt, Human
aucagcacgauuu

SEQ ID NO: 3861691 - RNA, 17 nt, Human
aucagcacgauuucugu

SEQ ID NO: 3861692 - RNA, 13 nt, Human
aucagcacugaaa

SEQ ID NO: 3861693 - RNA, 12 nt, Human
aucagccaauua

SEQ ID NO: 3861694 - RNA, 16 nt, Human
aucagccaauuauguu

SEQ ID NO: 3861695 - RNA, 12 nt, Human
aucagccagcug

SEQ ID NO: 3861696 - RNA, 20 nt, Human
aucagcccaaucccugaucc

SEQ ID NO: 3861697 - RNA, 17 nt, Human
aucagccccacccuggc

SEQ ID NO: 3861698 - RNA, 19 nt, Human
aucagccccacccuggccu

SEQ ID NO: 3861699 - RNA, 16 nt, Human
aucagccuacaggccu

SEQ ID NO: 3861700 - RNA, 13 nt, Human
aucagccucuuaa

SEQ ID NO: 3861701 - RNA, 18 nt, Human
aucagccugagucuccug

SEQ ID NO: 3861702 - RNA, 22 nt, Human
aucagccugagucuccugugcc

SEQ ID NO: 3861703 - RNA, 17 nt, Human
aucagccugcuccagcu

SEQ ID NO: 3861704 - RNA, 11 nt, Human
aucagccuggg

SEQ ID NO: 3861705 - RNA, 20 nt, Human
aucagccugggcaaugugau

SEQ ID NO: 3861706 - RNA, 23 nt, Human
aucagcggccccuugacucuggg

SEQ ID NO: 3861707 - RNA, 12 nt, Human
aucagcguggcc

SEQ ID NO: 3861708 - RNA, 13 nt, Human
aucagcguggccu

SEQ ID NO: 3861709 - RNA, 21 nt, Human
aucagcuacuuaagagaaaug

SEQ ID NO: 3861710 - RNA, 14 nt, Human
aucagcuauuuacu

SEQ ID NO: 3861711 - RNA, 15 nt, Human
aucagcuauuuacug

SEQ ID NO: 3861712 - RNA, 18 nt, Human
aucagcugagccuucuga

SEQ ID NO: 3861713 - RNA, 22 nt, Human
aucagcugcugaaacaacaaau

SEQ ID NO: 3861714 - RNA, 20 nt, Human
aucaggaaauauauaugugu

SEQ ID NO: 3861715 - RNA, 21 nt, Human
aucaggaaauauauaugugug

SEQ ID NO: 3861716 - RNA, 16 nt, Human
aucaggacccagagga

SEQ ID NO: 3861717 - RNA, 20 nt, Human
aucaggacccagaggaaggg

SEQ ID NO: 3861718 - RNA, 14 nt, Human
aucaggacccugga

SEQ ID NO: 3861719 - RNA, 18 nt, Human
aucaggaugaacccagga

SEQ ID NO: 3861720 - RNA, 19 nt, Human
aucaggauuuccucuugaa

SEQ ID NO: 3861721 - RNA, 14 nt, Human
aucaggcacagguc

SEQ ID NO: 3861722 - RNA, 14 nt, Human
aucaggccaggccc

SEQ ID NO: 3861723 - RNA, 18 nt, Human
aucaggccaggcccucug

SEQ ID NO: 3861724 - RNA, 22 nt, Human
aucaggccaggcccucugccca

SEQ ID NO: 3861725 - RNA, 19 nt, Human
aucaggccuaaucucauac

SEQ ID NO: 3861726 - RNA, 13 nt, Human
aucaggcucccag

SEQ ID NO: 3861727 - RNA, 14 nt, Human
aucaggcuuucuuu

SEQ ID NO: 3861728 - RNA, 18 nt, Human
aucagggaggucauuuug

SEQ ID NO: 3861729 - RNA, 21 nt, Human
aucagggcaaucccaacacau

SEQ ID NO: 3861730 - RNA, 13 nt, Human
aucagggccuggg

SEQ ID NO: 3861731 - RNA, 20 nt, Human
aucagggccuggggccugag

SEQ ID NO: 3861732 - RNA, 24 nt, Human
aucagggccuggggccugagagaa

SEQ ID NO: 3861733 - RNA, 14 nt, Human
aucagggggaagaa

SEQ ID NO: 3861734 - RNA, 16 nt, Human
aucagguccucagaga

SEQ ID NO: 3861735 - RNA, 14 nt, Human
aucaggugcugcca

SEQ ID NO: 3861736 - RNA, 15 nt, Human
aucaggugcugccau

SEQ ID NO: 3861737 - RNA, 13 nt, Human
aucagguggggag

SEQ ID NO: 3861738 - RNA, 15 nt, Human
aucagguuccauccc

SEQ ID NO: 3861739 - RNA, 14 nt, Human
aucagguuuuuccc

SEQ ID NO: 3861740 - RNA, 13 nt, Human
aucaguaaaauua

SEQ ID NO: 3861741 - RNA, 17 nt, Human
aucaguaaaauuauacu

SEQ ID NO: 3861742 - RNA, 14 nt, Human
aucaguaaacacug

SEQ ID NO: 3861743 - RNA, 19 nt, Human
aucaguaaacacuguguau

SEQ ID NO: 3861744 - RNA, 18 nt, Human
aucaguaaauaacuggaa

SEQ ID NO: 3861745 - RNA, 22 nt, Human
aucaguaacccccuuaaauuua

SEQ ID NO: 3861746 - RNA, 23 nt, Human
aucaguaacccccuuaaauuuaa

SEQ ID NO: 3861747 - RNA, 18 nt, Human
aucaguagccagcaucug

SEQ ID NO: 3861748 - RNA, 18 nt, Human
aucaguaggcuaauguca

SEQ ID NO: 3861749 - RNA, 23 nt, Human
aucaguaguucacauacaaauca

SEQ ID NO: 3861750 - RNA, 16 nt, Human
aucaguauaaacaaag

SEQ ID NO: 3861751 - RNA, 14 nt, Human
aucaguauaauucu

SEQ ID NO: 3861752 - RNA, 22 nt, Human
aucaguauaauucuguacugau

SEQ ID NO: 3861753 - RNA, 23 nt, Human
aucaguauuaauacuaaaauaug

SEQ ID NO: 3861754 - RNA, 13 nt, Human
aucagucaauauu

SEQ ID NO: 3861755 - RNA, 22 nt, Human
aucaguccuagaauguuucauu

SEQ ID NO: 3861756 - RNA, 21 nt, Human
aucaguccucuuucaaaggua

SEQ ID NO: 3861757 - RNA, 14 nt, Human
aucaguccuuugau

SEQ ID NO: 3861758 - RNA, 19 nt, Human
aucagucuauccacagaga

SEQ ID NO: 3861759 - RNA, 18 nt, Human
aucagucucugagggcuu

SEQ ID NO: 3861760 - RNA, 19 nt, Human
aucagucugauucccaagc

SEQ ID NO: 3861761 - RNA, 15 nt, Human
aucagugcccuccag

SEQ ID NO: 3861762 - RNA, 15 nt, Human
aucagugcucccuca

SEQ ID NO: 3861763 - RNA, 13 nt, Human
aucaguggagcca

SEQ ID NO: 3861764 - RNA, 17 nt, Human
aucaguggauuucccau

SEQ ID NO: 3861765 - RNA, 20 nt, Human
aucagugggcaggauaaacu

SEQ ID NO: 3861766 - RNA, 21 nt, Human
aucagugggcaggauaaacug

SEQ ID NO: 3861767 - RNA, 19 nt, Human
aucagugguuauuuaggga

SEQ ID NO: 3861768 - RNA, 17 nt, Human
aucaguguccucuugcu

SEQ ID NO: 3861769 - RNA, 14 nt, Human
aucagugucucaca

SEQ ID NO: 3861770 - RNA, 16 nt, Human
aucagugucuuuccac

SEQ ID NO: 3861771 - RNA, 18 nt, Human
aucaguuaagaaauuuca

SEQ ID NO: 3861772 - RNA, 23 nt, Human
aucaguuacccacucggucccag

SEQ ID NO: 3861773 - RNA, 19 nt, Human
aucaguuacucagcccugg

SEQ ID NO: 3861774 - RNA, 15 nt, Human
aucaguuagagcuga

SEQ ID NO: 3861775 - RNA, 16 nt, Human
aucaguuauucauucu

SEQ ID NO: 3861776 - RNA, 19 nt, Human
aucaguucauuagaaauau

SEQ ID NO: 3861777 - RNA, 19 nt, Human
aucaguugcgcguucugaa

SEQ ID NO: 3861778 - RNA, 16 nt, Human
aucaguuuaaaagcac

SEQ ID NO: 3861779 - RNA, 22 nt, Human
aucaguuuaaaagcacgacagu

SEQ ID NO: 3861780 - RNA, 21 nt, Human
aucaguuuuuucaccuggaag

SEQ ID NO: 3861781 - RNA, 15 nt, Human
aucauaaaacuugau

SEQ ID NO: 3861782 - RNA, 12 nt, Human
aucauaaaauaa

SEQ ID NO: 3861783 - RNA, 13 nt, Human
aucauaaaauaaa

SEQ ID NO: 3861784 - RNA, 13 nt, Human
aucauaaggcuuc

SEQ ID NO: 3861785 - RNA, 14 nt, Human
aucauaaguauuug

SEQ ID NO: 3861786 - RNA, 17 nt, Human
aucauaaguauuuggaa

SEQ ID NO: 3861787 - RNA, 19 nt, Human
aucauaaguauuuggaauu

SEQ ID NO: 3861788 - RNA, 13 nt, Human
aucauaauuacca

SEQ ID NO: 3861789 - RNA, 17 nt, Human
aucauacuccuaugcuu

SEQ ID NO: 3861790 - RNA, 15 nt, Human
aucauagaaauguaa

SEQ ID NO: 3861791 - RNA, 18 nt, Human
aucauagauuucugauuu

SEQ ID NO: 3861792 - RNA, 20 nt, Human
auccucauauggcccagugu

SEQ ID NO: 3861793 - RNA, 23 nt, Human
auccuccaacuucauuugaugcu

SEQ ID NO: 3861794 - RNA, 17 nt, Human
auccuccacuuguucag

SEQ ID NO: 3861795 - RNA, 23 nt, Human
auccuccagcuucugguacucuc

SEQ ID NO: 3861796 - RNA, 13 nt, Human
auccuccagggcu

SEQ ID NO: 3861797 - RNA, 11 nt, Human
auccuccaggu

SEQ ID NO: 3861798 - RNA, 22 nt, Human
auccuccaggugcacaagcucc

SEQ ID NO: 3861799 - RNA, 13 nt, Human
auccuccagguuu

SEQ ID NO: 3861800 - RNA, 14 nt, Human
auccuccagguuuu

SEQ ID NO: 3861801 - RNA, 16 nt, Human
auccuccagguuuuuc

SEQ ID NO: 3861802 - RNA, 21 nt, Human
auccuccagguuuuucaauua

SEQ ID NO: 3861803 - RNA, 20 nt, Human
auccucccaccucagccucc

SEQ ID NO: 3861804 - RNA, 20 nt, Human
auccucccacuucagccucc

SEQ ID NO: 3861805 - RNA, 13 nt, Human
auccuccccuucc

SEQ ID NO: 3861806 - RNA, 19 nt, Human
auccuccccuucccugcaa

SEQ ID NO: 3861807 - RNA, 11 nt, Human
auccucccugu

SEQ ID NO: 3861808 - RNA, 16 nt, Human
auccucccuguaacuu

SEQ ID NO: 3861809 - RNA, 15 nt, Human
auccucccuuccucc

SEQ ID NO: 3861810 - RNA, 20 nt, Human
auccuccuaccuccaaagcu

SEQ ID NO: 3861811 - RNA, 11 nt, Human
auccuccucag

SEQ ID NO: 3861812 - RNA, 14 nt, Human
auccuccucagauc

SEQ ID NO: 3861813 - RNA, 18 nt, Human
auccuccuccuuccuagu

SEQ ID NO: 3861814 - RNA, 16 nt, Human
auccuccuggaaccuu

SEQ ID NO: 3861815 - RNA, 22 nt, Human
auccuccuggaaccuugcuguc

SEQ ID NO: 3861816 - RNA, 14 nt, Human
auccucgcucccgg

SEQ ID NO: 3861817 - RNA, 16 nt, Human
auccucgcucccggga

SEQ ID NO: 3861818 - RNA, 21 nt, Human
auccucuccacagcugccucu

SEQ ID NO: 3861819 - RNA, 20 nt, Human
auccucucuggggcuguguu

SEQ ID NO: 3861820 - RNA, 15 nt, Human
auccucucuuccucu

SEQ ID NO: 3861821 - RNA, 20 nt, Human
auccucucuuccucuucccc

SEQ ID NO: 3861822 - RNA, 19 nt, Human
auccucugguucuucauuu

SEQ ID NO: 3861823 - RNA, 13 nt, Human
auccucuucuuuu

SEQ ID NO: 3861824 - RNA, 13 nt, Human
auccucuuuagag

SEQ ID NO: 3861825 - RNA, 16 nt, Human
auccucuuuagaguua

SEQ ID NO: 3861826 - RNA, 19 nt, Human
auccucuuuagaguuagac

SEQ ID NO: 3861827 - RNA, 20 nt, Human
auccucuuuagaguuagacu

SEQ ID NO: 3861828 - RNA, 22 nt, Human
auccucuuuagaguuagacugu

SEQ ID NO: 3861829 - RNA, 18 nt, Human
auccugaaauagaggcua

SEQ ID NO: 3861830 - RNA, 23 nt, Human
auccugacaagauuauaauauuu

SEQ ID NO: 3861831 - RNA, 17 nt, Human
auccugacucugccccc

SEQ ID NO: 3861832 - RNA, 18 nt, Human
auccugacucugcccccu

SEQ ID NO: 3861833 - RNA, 19 nt, Human
auccugacucugcccccug

SEQ ID NO: 3861834 - RNA, 11 nt, Human
auccugagcca

SEQ ID NO: 3861835 - RNA, 12 nt, Human
auccugagccau

SEQ ID NO: 3861836 - RNA, 12 nt, Human
auccugagcccc

SEQ ID NO: 3861837 - RNA, 23 nt, Human
auccugagccccgcccucuuccu

SEQ ID NO: 3861838 - RNA, 13 nt, Human
auccugaggcuga

SEQ ID NO: 3861839 - RNA, 19 nt, Human
auccugagguguaccagga

SEQ ID NO: 3861840 - RNA, 19 nt, Human
auccugcacugacucugga

SEQ ID NO: 3861841 - RNA, 16 nt, Human
auccugcauuguuagc

SEQ ID NO: 3861842 - RNA, 16 nt, Human
auccugccacccugua

SEQ ID NO: 3861843 - RNA, 18 nt, Human
auccugccacccuguagc

SEQ ID NO: 3861844 - RNA, 17 nt, Human
auccugccagccccaca

SEQ ID NO: 3861845 - RNA, 21 nt, Human
auccugcccaguguuguuugu

SEQ ID NO: 3861846 - RNA, 22 nt, Human
auccugcccaguguuguuugua

SEQ ID NO: 3861847 - RNA, 20 nt, Human
auccugcccccugaaacuua

SEQ ID NO: 3861848 - RNA, 19 nt, Human
auccugccuuagagccagg

SEQ ID NO: 3861849 - RNA, 17 nt, Human
auccugccuucauggaa

SEQ ID NO: 3861850 - RNA, 16 nt, Human
auccugcggguggggc

SEQ ID NO: 3861851 - RNA, 14 nt, Human
auccugcugcugug

SEQ ID NO: 3861852 - RNA, 14 nt, Human
auccugcuguucua

SEQ ID NO: 3861853 - RNA, 14 nt, Human
auccugcuucagug

SEQ ID NO: 3861854 - RNA, 21 nt, Human
auccuggaacaauauuuuaug

SEQ ID NO: 3861855 - RNA, 23 nt, Human
auccuggacugagggggccugga

SEQ ID NO: 3861856 - RNA, 15 nt, Human
auccuggaggcccag

SEQ ID NO: 3861857 - RNA, 16 nt, Human
auccuggaggcccagu

SEQ ID NO: 3861858 - RNA, 15 nt, Human
auccuggaguucugg

SEQ ID NO: 3861859 - RNA, 13 nt, Human
auccuggcagccc

SEQ ID NO: 3861860 - RNA, 24 nt, Human
auccuggcagcccagagacuuugu

SEQ ID NO: 3861861 - RNA, 14 nt, Human
auccuggcccauca

SEQ ID NO: 3861862 - RNA, 14 nt, Human
auccuggcccucug

SEQ ID NO: 3861863 - RNA, 18 nt, Human
auccuggcucuguggcuu

SEQ ID NO: 3861864 - RNA, 23 nt, Human
auccuggcuggagaauguggaga

SEQ ID NO: 3861865 - RNA, 16 nt, Human
auccuggcuuugccca

SEQ ID NO: 3861866 - RNA, 21 nt, Human
auccugggggccuggguuggg

SEQ ID NO: 3861867 - RNA, 23 nt, Human
auccuggguggucugcaggcagg

SEQ ID NO: 3861868 - RNA, 22 nt, Human
auccugguugguguugcagaag

SEQ ID NO: 3861869 - RNA, 14 nt, Human
auccugguuucaua

SEQ ID NO: 3861870 - RNA, 23 nt, Human
auccugguuucauaacuuccugu

SEQ ID NO: 3861871 - RNA, 14 nt, Human
auccuguauaagca

SEQ ID NO: 3861872 - RNA, 17 nt, Human
auccuguauaagcacug

SEQ ID NO: 3861873 - RNA, 23 nt, Human
auccuguauaagcacugaaaaac

SEQ ID NO: 3861874 - RNA, 20 nt, Human
auccuguauucagacagaug

SEQ ID NO: 3861875 - RNA, 16 nt, Human
auccuguauucuucaa

SEQ ID NO: 3861876 - RNA, 17 nt, Human
auccugucaucugagaa

SEQ ID NO: 3861877 - RNA, 17 nt, Human
auccuguccucagcuuc

SEQ ID NO: 3861878 - RNA, 23 nt, Human
auccugucuuuaaggaaaaaaag

SEQ ID NO: 3861879 - RNA, 15 nt, Human
auccugucuuucuga

SEQ ID NO: 3861880 - RNA, 16 nt, Human
auccugugaaguaagg

SEQ ID NO: 3861881 - RNA, 14 nt, Human
auccuguguggaga

SEQ ID NO: 3861882 - RNA, 23 nt, Human
auccuguguggagagggaaugug

SEQ ID NO: 3861883 - RNA, 15 nt, Human
auccugugugguuua

SEQ ID NO: 3861884 - RNA, 21 nt, Human
auccugugugguuuaguguaa

SEQ ID NO: 3861885 - RNA, 18 nt, Human
auccuguguuucuaggga

SEQ ID NO: 3861886 - RNA, 17 nt, Human
auccuguugaaaagcca

SEQ ID NO: 3861887 - RNA, 18 nt, Human
auccuguugaaaagccau

SEQ ID NO: 3861888 - RNA, 20 nt, Human
auccuuaaaucuuaauguuc

SEQ ID NO: 3861889 - RNA, 13 nt, Human
auccuuaacagau

SEQ ID NO: 3861890 - RNA, 18 nt, Human
auccuuagagguccucug

SEQ ID NO: 3861891 - RNA, 21 nt, Human
auccuuagagguccucuggag

SEQ ID NO: 3861892 - RNA, 21 nt, Human
auccuuaucuaguguuugauu

SEQ ID NO: 3861893 - RNA, 16 nt, Human
auccuuaugccacccc

SEQ ID NO: 3861894 - RNA, 22 nt, Human
auccuucaucuggauuccagag

SEQ ID NO: 3861895 - RNA, 18 nt, Human
auccuuccaaaaauuauu

SEQ ID NO: 3861896 - RNA, 19 nt, Human
auccuuccaaaaauuauua

SEQ ID NO: 3861897 - RNA, 14 nt, Human
auccuuccaaagaa

SEQ ID NO: 3861898 - RNA, 15 nt, Human
auccuuccauuccac

SEQ ID NO: 3861899 - RNA, 18 nt, Human
auccuucccaaguaagag

SEQ ID NO: 3861900 - RNA, 22 nt, Human
auccuucccugucugccagggc

SEQ ID NO: 3861901 - RNA, 20 nt, Human
auccuuccuauaacuugaug

SEQ ID NO: 3861902 - RNA, 19 nt, Human
auccuucgugaacaucccc

SEQ ID NO: 3861903 - RNA, 12 nt, Human
auccuucuaauc

SEQ ID NO: 3861904 - RNA, 19 nt, Human
auccuucuaaucugcuaug

SEQ ID NO: 3861905 - RNA, 12 nt, Human
auccuucuaguu

SEQ ID NO: 3861906 - RNA, 13 nt, Human
auccuucuaguuu

SEQ ID NO: 3861907 - RNA, 22 nt, Human
auccuucuaguuucccacaaua

SEQ ID NO: 3861908 - RNA, 11 nt, Human
auccuucugcc

SEQ ID NO: 3861909 - RNA, 16 nt, Human
auccuugagucaaaaa

SEQ ID NO: 3861910 - RNA, 14 nt, Human
auccuugauaauau

SEQ ID NO: 3861911 - RNA, 16 nt, Human
auccuuggcaccaaag

SEQ ID NO: 3861912 - RNA, 19 nt, Human
auccuuggucuuuguaucu

SEQ ID NO: 3861913 - RNA, 22 nt, Human
auccuuguauaaaaaaaauagu

SEQ ID NO: 3861914 - RNA, 17 nt, Human
auccuuuaaauccuucc

SEQ ID NO: 3861915 - RNA, 19 nt, Human
auccuuuaggguucugccu

SEQ ID NO: 3861916 - RNA, 20 nt, Human
auccuuucacuucuuucccu

SEQ ID NO: 3861917 - RNA, 16 nt, Human
auccuuugcagggcag

SEQ ID NO: 3861918 - RNA, 17 nt, Human
auccuuugcagggcagc

SEQ ID NO: 3861919 - RNA, 21 nt, Human
auccuuuguuuucugacuaau

SEQ ID NO: 3861920 - RNA, 23 nt, Human
auccuuuguuuucugacuaauua

SEQ ID NO: 3861921 - RNA, 15 nt, Human
auccuuuuucuuuau

SEQ ID NO: 3861922 - RNA, 14 nt, Human
aucgaaaaaauaau

SEQ ID NO: 3861923 - RNA, 12 nt, Human
aucgaaaauuca

SEQ ID NO: 3861924 - RNA, 16 nt, Human
aucgaaaauucauuuc

SEQ ID NO: 3861925 - RNA, 13 nt, Human
aucgaaauaacaa

SEQ ID NO: 3861926 - RNA, 17 nt, Human
aucgaaauaacaauguu

SEQ ID NO: 3861927 - RNA, 17 nt, Human
aucgagaccauccuggc

SEQ ID NO: 3861928 - RNA, 19 nt, Human
aucgagaccauccuggcua

SEQ ID NO: 3861929 - RNA, 15 nt, Human
aucgaggaaccagag

SEQ ID NO: 3861930 - RNA, 13 nt, Human
aucgauggccuug

SEQ ID NO: 3861931 - RNA, 15 nt, Human
aucgauguuauguaa

SEQ ID NO: 3861932 - RNA, 16 nt, Human
aucgauguuuuauuau

SEQ ID NO: 3861933 - RNA, 20 nt, Human
aucgauuuuuaaaaauuaaa

SEQ ID NO: 3861934 - RNA, 20 nt, Human
aucgcaccacuguguauuua

SEQ ID NO: 3861935 - RNA, 18 nt, Human
aucgcaccauucugacuc

SEQ ID NO: 3861936 - RNA, 14 nt, Human
aucgccagcaaaac

SEQ ID NO: 3861937 - RNA, 21 nt, Human
augcuauugacaauaaaauau

SEQ ID NO: 3861938 - RNA, 14 nt, Human
augcuauuucuaua

SEQ ID NO: 3861939 - RNA, 22 nt, Human
augcuauuucuauauuuucauu

SEQ ID NO: 3861940 - RNA, 23 nt, Human
augcuauuucuauauuuucauuc

SEQ ID NO: 3861941 - RNA, 12 nt, Human
augcuauuucug

SEQ ID NO: 3861942 - RNA, 11 nt, Human
augcuauuuuu

SEQ ID NO: 3861943 - RNA, 22 nt, Human
augcuauuuuuguuuuuagaau

SEQ ID NO: 3861944 - RNA, 14 nt, Human
augcucaaagaaau

SEQ ID NO: 3861945 - RNA, 16 nt, Human
augcucacgcucccaa

SEQ ID NO: 3861946 - RNA, 22 nt, Human
augcucaggggcccuggagcag

SEQ ID NO: 3861947 - RNA, 22 nt, Human
augcucagguacagagaaggaa

SEQ ID NO: 3861948 - RNA, 18 nt, Human
augcucaggugcuggggc

SEQ ID NO: 3861949 - RNA, 14 nt, Human
augcucaguugcua

SEQ ID NO: 3861950 - RNA, 13 nt, Human
augcucaucugcu

SEQ ID NO: 3861951 - RNA, 15 nt, Human
augcuccaagauucu

SEQ ID NO: 3861952 - RNA, 17 nt, Human
augcuccaagauucuag

SEQ ID NO: 3861953 - RNA, 12 nt, Human
augcuccagcca

SEQ ID NO: 3861954 - RNA, 20 nt, Human
augcuccagccaaccccugu

SEQ ID NO: 3861955 - RNA, 24 nt, Human
augcuccagucaacaaacuauuuc

SEQ ID NO: 3861956 - RNA, 21 nt, Human
augcuccccacagcgucccug

SEQ ID NO: 3861957 - RNA, 23 nt, Human
augcuccccacagcgucccuggc

SEQ ID NO: 3861958 - RNA, 15 nt, Human
augcucccccauccu

SEQ ID NO: 3861959 - RNA, 18 nt, Human
augcucccccauccuccc

SEQ ID NO: 3861960 - RNA, 20 nt, Human
augcucccccauccuccccu

SEQ ID NO: 3861961 - RNA, 17 nt, Human
augcuccccugugccag

SEQ ID NO: 3861962 - RNA, 17 nt, Human
augcucccuccccugcc

SEQ ID NO: 3861963 - RNA, 18 nt, Human
augcucccuccccugccc

SEQ ID NO: 3861964 - RNA, 20 nt, Human
augcucccuccccugcccug

SEQ ID NO: 3861965 - RNA, 19 nt, Human
augcuccucuuccccagac

SEQ ID NO: 3861966 - RNA, 23 nt, Human
augcuccucuuccccagacgccu

SEQ ID NO: 3861967 - RNA, 15 nt, Human
augcuccuugggccc

SEQ ID NO: 3861968 - RNA, 16 nt, Human
augcuccuugggcccu

SEQ ID NO: 3861969 - RNA, 16 nt, Human
augcucuagugccuuc

SEQ ID NO: 3861970 - RNA, 14 nt, Human
augcucuccuuucc

SEQ ID NO: 3861971 - RNA, 17 nt, Human
augcucucucaaauugu

SEQ ID NO: 3861972 - RNA, 19 nt, Human
augcucucugcagccagcc

SEQ ID NO: 3861973 - RNA, 17 nt, Human
augcucugcaaaaggag

SEQ ID NO: 3861974 - RNA, 23 nt, Human
augcucuuaauugccaccucuaa

SEQ ID NO: 3861975 - RNA, 22 nt, Human
augcucuuucccacccagccug

SEQ ID NO: 3861976 - RNA, 19 nt, Human
augcucuuuuuuacucauu

SEQ ID NO: 3861977 - RNA, 14 nt, Human
augcugaaaauugc

SEQ ID NO: 3861978 - RNA, 15 nt, Human
augcugaaacaggag

SEQ ID NO: 3861979 - RNA, 16 nt, Human
augcugaaacaggaga

SEQ ID NO: 3861980 - RNA, 18 nt, Human
augcugaaacaggagaga

SEQ ID NO: 3861981 - RNA, 19 nt, Human
augcugaagccaaagccaa

SEQ ID NO: 3861982 - RNA, 12 nt, Human
augcugaaggga

SEQ ID NO: 3861983 - RNA, 23 nt, Human
augcugaauauacagcaggugcu

SEQ ID NO: 3861984 - RNA, 22 nt, Human
augcugacauucaccugcccca

SEQ ID NO: 3861985 - RNA, 13 nt, Human
augcugacccaug

SEQ ID NO: 3861986 - RNA, 16 nt, Human
augcugacccaugggc

SEQ ID NO: 3861987 - RNA, 21 nt, Human
augcugacuguacuccuccca

SEQ ID NO: 3861988 - RNA, 17 nt, Human
augcugacuucacuuau

SEQ ID NO: 3861989 - RNA, 14 nt, Human
augcugagauucuu

SEQ ID NO: 3861990 - RNA, 23 nt, Human
augcugaggguguuucuuccugc

SEQ ID NO: 3861991 - RNA, 20 nt, Human
augcugaguuugugcuggug

SEQ ID NO: 3861992 - RNA, 19 nt, Human
augcugaucaucgccagag

SEQ ID NO: 3861993 - RNA, 22 nt, Human
augcugaucaucgccagaggug

SEQ ID NO: 3861994 - RNA, 22 nt, Human
augcugauguucaguguaauuu

SEQ ID NO: 3861995 - RNA, 18 nt, Human
augcugcaacaaaaugua

SEQ ID NO: 3861996 - RNA, 20 nt, Human
augcugcaacaaaauguaga

SEQ ID NO: 3861997 - RNA, 23 nt, Human
augcugcaaguuaugaaauauuu

SEQ ID NO: 3861998 - RNA, 20 nt, Human
augcugcagauuugggcugg

SEQ ID NO: 3861999 - RNA, 19 nt, Human
augcugcaggacuugagaa

SEQ ID NO: 3862000 - RNA, 13 nt, Human
augcugccaauau

SEQ ID NO: 3862001 - RNA, 12 nt, Human
augcugccagug

SEQ ID NO: 3862002 - RNA, 15 nt, Human
augcugcccaugcca

SEQ ID NO: 3862003 - RNA, 22 nt, Human
augcugcccaugccaccgcuuc

SEQ ID NO: 3862004 - RNA, 11 nt, Human
augcugccccu

SEQ ID NO: 3862005 - RNA, 12 nt, Human
augcugccccuc

SEQ ID NO: 3862006 - RNA, 11 nt, Human
augcugcccug

SEQ ID NO: 3862007 - RNA, 12 nt, Human
augcugcccugu

SEQ ID NO: 3862008 - RNA, 13 nt, Human
augcugcccugug

SEQ ID NO: 3862009 - RNA, 16 nt, Human
augcugcccugugagu

SEQ ID NO: 3862010 - RNA, 17 nt, Human
augcugccuaggcugac

SEQ ID NO: 3862011 - RNA, 13 nt, Human
augcugccugagu

SEQ ID NO: 3862012 - RNA, 11 nt, Human
augcugccugc

SEQ ID NO: 3862013 - RNA, 13 nt, Human
augcugccugccu

SEQ ID NO: 3862014 - RNA, 17 nt, Human
augcugccugccugucu

SEQ ID NO: 3862015 - RNA, 18 nt, Human
augcugccugccugucug

SEQ ID NO: 3862016 - RNA, 23 nt, Human
augcugccuuauucagggaagga

SEQ ID NO: 3862017 - RNA, 19 nt, Human
augcugcgcccuuccccag

SEQ ID NO: 3862018 - RNA, 20 nt, Human
augcugcuggggaagacagu

SEQ ID NO: 3862019 - RNA, 16 nt, Human
augcugcuuuuauauc

SEQ ID NO: 3862020 - RNA, 19 nt, Human
augcugcuuuuauaucugu

SEQ ID NO: 3862021 - RNA, 21 nt, Human
augcugcuuuuauaucuguau

SEQ ID NO: 3862022 - RNA, 18 nt, Human
augcuggacaggucuggg

SEQ ID NO: 3862023 - RNA, 14 nt, Human
augcuggagaagag

SEQ ID NO: 3862024 - RNA, 17 nt, Human
augcuggagaagagagg

SEQ ID NO: 3862025 - RNA, 23 nt, Human
augcuggagaagagaggagagga

SEQ ID NO: 3862026 - RNA, 22 nt, Human
augcuggagccuguguaacagc

SEQ ID NO: 3862027 - RNA, 23 nt, Human
augcuggagccuguguaacagcu

SEQ ID NO: 3862028 - RNA, 14 nt, Human
augcuggagcggcu

SEQ ID NO: 3862029 - RNA, 21 nt, Human
augcuggcauagagcagcacu

SEQ ID NO: 3862030 - RNA, 15 nt, Human
augcuggccagccug

SEQ ID NO: 3862031 - RNA, 12 nt, Human
augcuggcccag

SEQ ID NO: 3862032 - RNA, 13 nt, Human
augcuggcccagg

SEQ ID NO: 3862033 - RNA, 18 nt, Human
augcuggcccagggccca

SEQ ID NO: 3862034 - RNA, 22 nt, Human
augcuggcccagggcccagagc

SEQ ID NO: 3862035 - RNA, 17 nt, Human
augcuggccuuugcucu

SEQ ID NO: 3862036 - RNA, 22 nt, Human
augcuggcuauagaugucuuuu

SEQ ID NO: 3862037 - RNA, 19 nt, Human
augcuggcucccagggcca

SEQ ID NO: 3862038 - RNA, 23 nt, Human
augcugggaagacgccugagcuc

SEQ ID NO: 3862039 - RNA, 15 nt, Human
augcugggcugggug

SEQ ID NO: 3862040 - RNA, 21 nt, Human
augcuggguccauaucacaca

SEQ ID NO: 3862041 - RNA, 23 nt, Human
augcuggguuggugcacagugau

SEQ ID NO: 3862042 - RNA, 14 nt, Human
augcuggugagcca

SEQ ID NO: 3862043 - RNA, 16 nt, Human
augcuguaaaagcaag

SEQ ID NO: 3862044 - RNA, 15 nt, Human
augcuguacauacuu

SEQ ID NO: 3862045 - RNA, 18 nt, Human
augcuguacauacuuuuu

SEQ ID NO: 3862046 - RNA, 16 nt, Human
augcuguacaucuauu

SEQ ID NO: 3862047 - RNA, 22 nt, Human
augcuguacaucuauuuuggau

SEQ ID NO: 3862048 - RNA, 19 nt, Human
augcuguauauccuuucua

SEQ ID NO: 3862049 - RNA, 14 nt, Human
augcuguauauguu

SEQ ID NO: 3862050 - RNA, 19 nt, Human
augcuguauuuuaaaagaa

SEQ ID NO: 3862051 - RNA, 23 nt, Human
augcuguauuuuaaaagaaugau

SEQ ID NO: 3862052 - RNA, 20 nt, Human
augcugucaacuaugauaug

SEQ ID NO: 3862053 - RNA, 23 nt, Human
augcugucuacacuaagagagaa

SEQ ID NO: 3862054 - RNA, 18 nt, Human
augcugucuuucuugcuc

SEQ ID NO: 3862055 - RNA, 21 nt, Human
augcugucuuucuugcucccu

SEQ ID NO: 3862056 - RNA, 21 nt, Human
augcugugagucuuugguucu

SEQ ID NO: 3862057 - RNA, 22 nt, Human
augcugugagucuuugguucua

SEQ ID NO: 3862058 - RNA, 13 nt, Human
augcugugccccu

SEQ ID NO: 3862059 - RNA, 18 nt, Human
augcugugcgcccagggc

SEQ ID NO: 3862060 - RNA, 18 nt, Human
augcugugcuaaauauca

SEQ ID NO: 3862061 - RNA, 18 nt, Human
augcuguugccucaucua

SEQ ID NO: 3862062 - RNA, 14 nt, Human
augcuguuucagag

SEQ ID NO: 3862063 - RNA, 18 nt, Human
augcuuaaagaauucaaa

SEQ ID NO: 3862064 - RNA, 15 nt, Human
augcuuaauuucuaa

SEQ ID NO: 3862065 - RNA, 15 nt, Human
augcuuacaaaaaag

SEQ ID NO: 3862066 - RNA, 23 nt, Human
augcuuacgugauccucucaccu

SEQ ID NO: 3862067 - RNA, 20 nt, Human
augcuuagagggauuucuuu

SEQ ID NO: 3862068 - RNA, 14 nt, Human
augcuuaguaaugc

SEQ ID NO: 3862069 - RNA, 21 nt, Human
augcuuagucccucaugcaaa

SEQ ID NO: 3862070 - RNA, 20 nt, Human
augcuuauauuguucacuuc

SEQ ID NO: 3862071 - RNA, 15 nt, Human
augcuuaugacaaug

SEQ ID NO: 3862072 - RNA, 14 nt, Human
augcuuauuuuaaa

SEQ ID NO: 3862073 - RNA, 21 nt, Human
augcuuauuuuaaaauuuuau

SEQ ID NO: 3862074 - RNA, 13 nt, Human
augcuucauacag

SEQ ID NO: 3862075 - RNA, 16 nt, Human
augcuucauacaggga

SEQ ID NO: 3862076 - RNA, 19 nt, Human
augcuucauaugaggagga

SEQ ID NO: 3862077 - RNA, 15 nt, Human
augcuucaugaaaau

SEQ ID NO: 3862078 - RNA, 21 nt, Human
augcuucauucaauauugaca

SEQ ID NO: 3862079 - RNA, 13 nt, Human
augcuuccagaaa

SEQ ID NO: 3862080 - RNA, 16 nt, Human
augcuucccuuuccug

SEQ ID NO: 3862081 - RNA, 18 nt, Human
augggaaaguauucucuu

SEQ ID NO: 3862082 - RNA, 17 nt, Human
augggaacaauugaagu

SEQ ID NO: 3862083 - RNA, 11 nt, Human
augggaacauu

SEQ ID NO: 3862084 - RNA, 14 nt, Human
augggaacauuuau

SEQ ID NO: 3862085 - RNA, 20 nt, Human
augggaagacgaggcccucg

SEQ ID NO: 3862086 - RNA, 18 nt, Human
augggaaggugggcgggc

SEQ ID NO: 3862087 - RNA, 18 nt, Human
augggaaucaagauuuaa

SEQ ID NO: 3862088 - RNA, 13 nt, Human
augggaaugaagc

SEQ ID NO: 3862089 - RNA, 16 nt, Human
augggaaugaagcuug

SEQ ID NO: 3862090 - RNA, 21 nt, Human
augggaaugaagcuuguguau

SEQ ID NO: 3862091 - RNA, 18 nt, Human
augggaaugaggugggag

SEQ ID NO: 3862092 - RNA, 14 nt, Human
augggaauugugug

SEQ ID NO: 3862093 - RNA, 15 nt, Human
augggaauuguguga

SEQ ID NO: 3862094 - RNA, 22 nt, Human
augggacaaaguuccaaaaugc

SEQ ID NO: 3862095 - RNA, 15 nt, Human
augggacagggagga

SEQ ID NO: 3862096 - RNA, 21 nt, Human
augggacauuugcucauggaa

SEQ ID NO: 3862097 - RNA, 12 nt, Human
augggaccacaa

SEQ ID NO: 3862098 - RNA, 15 nt, Human
augggaccuauaacu

SEQ ID NO: 3862099 - RNA, 13 nt, Human
augggacuucuuu

SEQ ID NO: 3862100 - RNA, 19 nt, Human
augggacuucuuuucacau

SEQ ID NO: 3862101 - RNA, 20 nt, Human
augggacuucuuuucacauu

SEQ ID NO: 3862102 - RNA, 17 nt, Human
augggagacccuugaca

SEQ ID NO: 3862103 - RNA, 15 nt, Human
augggagagaagaga

SEQ ID NO: 3862104 - RNA, 23 nt, Human
augggagaguagauggugaaauu

SEQ ID NO: 3862105 - RNA, 19 nt, Human
augggagagugucaaccag

SEQ ID NO: 3862106 - RNA, 13 nt, Human
augggagccccag

SEQ ID NO: 3862107 - RNA, 14 nt, Human
augggagcuccucu

SEQ ID NO: 3862108 - RNA, 21 nt, Human
augggaggccuuucccuaagc

SEQ ID NO: 3862109 - RNA, 20 nt, Human
augggagggggcuugaagcc

SEQ ID NO: 3862110 - RNA, 15 nt, Human
augggauaaaugcca

SEQ ID NO: 3862111 - RNA, 20 nt, Human
augggauaaaugccaucaau

SEQ ID NO: 3862112 - RNA, 17 nt, Human
augggauacaaccuccc

SEQ ID NO: 3862113 - RNA, 18 nt, Human
augggcaacccccagccu

SEQ ID NO: 3862114 - RNA, 18 nt, Human
augggcacaaagggccca

SEQ ID NO: 3862115 - RNA, 14 nt, Human
augggcacugcugg

SEQ ID NO: 3862116 - RNA, 20 nt, Human
augggcagucauuuugcaga

SEQ ID NO: 3862117 - RNA, 15 nt, Human
augggcaguuucagu

SEQ ID NO: 3862118 - RNA, 16 nt, Human
augggcaucuuuugua

SEQ ID NO: 3862119 - RNA, 20 nt, Human
augggcaucuuuuguauuaa

SEQ ID NO: 3862120 - RNA, 23 nt, Human
augggcauggggugggccucugg

SEQ ID NO: 3862121 - RNA, 16 nt, Human
augggcauugacaaau

SEQ ID NO: 3862122 - RNA, 12 nt, Human
augggccaccgc

SEQ ID NO: 3862123 - RNA, 18 nt, Human
augggccaccgccuugcc

SEQ ID NO: 3862124 - RNA, 16 nt, Human
augggccacugaaauc

SEQ ID NO: 3862125 - RNA, 19 nt, Human
augggccacugaaaucugu

SEQ ID NO: 3862126 - RNA, 12 nt, Human
augggccagccc

SEQ ID NO: 3862127 - RNA, 20 nt, Human
augggccagccccuccaucu

SEQ ID NO: 3862128 - RNA, 13 nt, Human
augggccuggcau

SEQ ID NO: 3862129 - RNA, 18 nt, Human
augggcguacgcuggugc

SEQ ID NO: 3862130 - RNA, 17 nt, Human
augggcuaaugaagauc

SEQ ID NO: 3862131 - RNA, 20 nt, Human
augggcuggguucuacccag

SEQ ID NO: 3862132 - RNA, 15 nt, Human
augggcuucacugua

SEQ ID NO: 3862133 - RNA, 19 nt, Human
augggcuucacuguauaaa

SEQ ID NO: 3862134 - RNA, 18 nt, Human
augggcuuguuuucuugc

SEQ ID NO: 3862135 - RNA, 22 nt, Human
augggcuuuuggggagccagaa

SEQ ID NO: 3862136 - RNA, 15 nt, Human
auggggagaaaagac

SEQ ID NO: 3862137 - RNA, 20 nt, Human
auggggagaucggggccaga

SEQ ID NO: 3862138 - RNA, 13 nt, Human
auggggaggacaa

SEQ ID NO: 3862139 - RNA, 17 nt, Human
auggggauaaaaugacu

SEQ ID NO: 3862140 - RNA, 16 nt, Human
auggggaucacagaga

SEQ ID NO: 3862141 - RNA, 13 nt, Human
auggggccacagc

SEQ ID NO: 3862142 - RNA, 19 nt, Human
auggggccagauccagccu

SEQ ID NO: 3862143 - RNA, 21 nt, Human
auggggccagauccagccugg

SEQ ID NO: 3862144 - RNA, 17 nt, Human
auggggcucccgcccgu

SEQ ID NO: 3862145 - RNA, 16 nt, Human
augggggaaagcacag

SEQ ID NO: 3862146 - RNA, 21 nt, Human
augggggaacucagauccagg

SEQ ID NO: 3862147 - RNA, 16 nt, Human
augggggaugcuucau

SEQ ID NO: 3862148 - RNA, 15 nt, Human
augggggcaagaaga

SEQ ID NO: 3862149 - RNA, 17 nt, Human
augggggcacugaggac

SEQ ID NO: 3862150 - RNA, 16 nt, Human
augggggcagggcugu

SEQ ID NO: 3862151 - RNA, 16 nt, Human
augggggccucagggc

SEQ ID NO: 3862152 - RNA, 22 nt, Human
auggggggagcacccugagggc

SEQ ID NO: 3862153 - RNA, 14 nt, Human
auggggguaaaguu

SEQ ID NO: 3862154 - RNA, 18 nt, Human
auggggguagcagcugga

SEQ ID NO: 3862155 - RNA, 14 nt, Human
auggggguuucacc

SEQ ID NO: 3862156 - RNA, 12 nt, Human
auggguagggua

SEQ ID NO: 3862157 - RNA, 13 nt, Human
augggucacagga

SEQ ID NO: 3862158 - RNA, 13 nt, Human
augggucagagcu

SEQ ID NO: 3862159 - RNA, 17 nt, Human
augggucgcccaugaga

SEQ ID NO: 3862160 - RNA, 18 nt, Human
augggugaaggcuggcau

SEQ ID NO: 3862161 - RNA, 15 nt, Human
augggugauauccug

SEQ ID NO: 3862162 - RNA, 15 nt, Human
augggugcuuggagg

SEQ ID NO: 3862163 - RNA, 21 nt, Human
augggugcuuggaggaaggaa

SEQ ID NO: 3862164 - RNA, 19 nt, Human
auggguguguguuugugug

SEQ ID NO: 3862165 - RNA, 22 nt, Human
auggguuagggaaaacauucca

SEQ ID NO: 3862166 - RNA, 16 nt, Human
auggguuuuaugagau

SEQ ID NO: 3862167 - RNA, 22 nt, Human
auggguuuuaugagauggauca

SEQ ID NO: 3862168 - RNA, 19 nt, Human
auggguuuuguagguacuu

SEQ ID NO: 3862169 - RNA, 16 nt, Human
augguaaaaaauuuau

SEQ ID NO: 3862170 - RNA, 18 nt, Human
augguaaaaaauuuauaa

SEQ ID NO: 3862171 - RNA, 15 nt, Human
augguaaaauugcau

SEQ ID NO: 3862172 - RNA, 17 nt, Human
augguaaaauugcaugg

SEQ ID NO: 3862173 - RNA, 14 nt, Human
augguaacugcuuu

SEQ ID NO: 3862174 - RNA, 15 nt, Human
augguaacugcuuuc

SEQ ID NO: 3862175 - RNA, 23 nt, Human
augguaacugcuuucuguuccaa

SEQ ID NO: 3862176 - RNA, 13 nt, Human
augguaagagaaa

SEQ ID NO: 3862177 - RNA, 20 nt, Human
augguaauaagcacuguaaa

SEQ ID NO: 3862178 - RNA, 14 nt, Human
augguacaaccuuu

SEQ ID NO: 3862179 - RNA, 18 nt, Human
augguacaugucuuccau

SEQ ID NO: 3862180 - RNA, 16 nt, Human
augguacauuuuucaa

SEQ ID NO: 3862181 - RNA, 15 nt, Human
augguaccagauaaa

SEQ ID NO: 3862182 - RNA, 13 nt, Human
augguagaaaaau

SEQ ID NO: 3862183 - RNA, 20 nt, Human
augguagccaguugaauuua

SEQ ID NO: 3862184 - RNA, 22 nt, Human
augguagucuaaccaaaugcau

SEQ ID NO: 3862185 - RNA, 19 nt, Human
augguaguuucugugguug

SEQ ID NO: 3862186 - RNA, 22 nt, Human
augguaguuuuacaguguuucu

SEQ ID NO: 3862187 - RNA, 19 nt, Human
augguauaaugguugacug

SEQ ID NO: 3862188 - RNA, 12 nt, Human
augguauauaua

SEQ ID NO: 3862189 - RNA, 14 nt, Human
augguauauauaca

SEQ ID NO: 3862190 - RNA, 14 nt, Human
augguaugagcuga

SEQ ID NO: 3862191 - RNA, 15 nt, Human
augguauuugagaca

SEQ ID NO: 3862192 - RNA, 22 nt, Human
auggucacuuaaaaugugcagu

SEQ ID NO: 3862193 - RNA, 16 nt, Human
auggucagacacaaac

SEQ ID NO: 3862194 - RNA, 15 nt, Human
auggucauauuuaaa

SEQ ID NO: 3862195 - RNA, 22 nt, Human
auggucaucuuggagggaccaa

SEQ ID NO: 3862196 - RNA, 13 nt, Human
augguccaggaga

SEQ ID NO: 3862197 - RNA, 17 nt, Human
auggucccacaucccug

SEQ ID NO: 3862198 - RNA, 23 nt, Human
auggucccacaucccugggccug

SEQ ID NO: 3862199 - RNA, 17 nt, Human
auggucccauccaggca

SEQ ID NO: 3862200 - RNA, 19 nt, Human
auggucccauccaggcagu

SEQ ID NO: 3862201 - RNA, 16 nt, Human
auggucccaucugcag

SEQ ID NO: 3862202 - RNA, 14 nt, Human
augguccuggggcu

SEQ ID NO: 3862203 - RNA, 17 nt, Human
augguccuggggcucug

SEQ ID NO: 3862204 - RNA, 19 nt, Human
augguccuggggcucugug

SEQ ID NO: 3862205 - RNA, 20 nt, Human
augguccuggggcucugugc

SEQ ID NO: 3862206 - RNA, 15 nt, Human
auggucggaaaacau

SEQ ID NO: 3862207 - RNA, 16 nt, Human
auggucugcccucugc

SEQ ID NO: 3862208 - RNA, 17 nt, Human
auggucuucagccucuu

SEQ ID NO: 3862209 - RNA, 21 nt, Human
auggugaaaccccaucucuac

SEQ ID NO: 3862210 - RNA, 16 nt, Human
auggugaacugucauu

SEQ ID NO: 3862211 - RNA, 20 nt, Human
auggugaggcuuaacaaugu

SEQ ID NO: 3862212 - RNA, 20 nt, Human
auggugagggauacccaucc

SEQ ID NO: 3862213 - RNA, 14 nt, Human
auggugaugaaaug

SEQ ID NO: 3862214 - RNA, 14 nt, Human
auggugauuuuaaa

SEQ ID NO: 3862215 - RNA, 13 nt, Human
auggugcaaugac

SEQ ID NO: 3862216 - RNA, 17 nt, Human
auggugcaaugaccuuu

SEQ ID NO: 3862217 - RNA, 20 nt, Human
auggugcaguugacagcagg

SEQ ID NO: 3862218 - RNA, 19 nt, Human
auggugcauuacgugggca

SEQ ID NO: 3862219 - RNA, 15 nt, Human
auggugcauuguaua

SEQ ID NO: 3862220 - RNA, 18 nt, Human
auggugcauuguauagau

SEQ ID NO: 3862221 - RNA, 14 nt, Human
auggugccccagga

SEQ ID NO: 3862222 - RNA, 16 nt, Human
auggugccccaggacc

SEQ ID NO: 3862223 - RNA, 19 nt, Human
auggugccccaggaccagc

SEQ ID NO: 3862224 - RNA, 22 nt, Human
auggugccccaggaccagcuca

SEQ ID NO: 3862225 - RNA, 9 nt, Human
auggugccu

SEQ ID NO: 3862226 - RNA, 20 nt, Human
auggugccuaguauugacaa

SEQ ID NO: 3862227 - RNA, 16 nt, Human
auucaaaauauuuaaa

SEQ ID NO: 3862228 - RNA, 22 nt, Human
auucaaaauauuuaaaaauguc

SEQ ID NO: 3862229 - RNA, 16 nt, Human
auucaaaaugauguau

SEQ ID NO: 3862230 - RNA, 22 nt, Human
auucaaaauugacauugcuuua

SEQ ID NO: 3862231 - RNA, 14 nt, Human
auucaaacagucuc

SEQ ID NO: 3862232 - RNA, 15 nt, Human
auucaaacagucuca

SEQ ID NO: 3862233 - RNA, 16 nt, Human
auucaaacagucucag

SEQ ID NO: 3862234 - RNA, 22 nt, Human
auucaaacagucucaggaaauc

SEQ ID NO: 3862235 - RNA, 18 nt, Human
auucaaacugaaaagcug

SEQ ID NO: 3862236 - RNA, 16 nt, Human
auucaaagaaauaucu

SEQ ID NO: 3862237 - RNA, 13 nt, Human
auucaaagagaaa

SEQ ID NO: 3862238 - RNA, 13 nt, Human
auucaaagguucu

SEQ ID NO: 3862239 - RNA, 14 nt, Human
auucaaagguucua

SEQ ID NO: 3862240 - RNA, 16 nt, Human
auucaaagguucuagg

SEQ ID NO: 3862241 - RNA, 21 nt, Human
auucaaagguucuagguuuca

SEQ ID NO: 3862242 - RNA, 21 nt, Human
auucaaaucguuuauuucaca

SEQ ID NO: 3862243 - RNA, 14 nt, Human
auucaaauggguga

SEQ ID NO: 3862244 - RNA, 16 nt, Human
auucaaauguauuaca

SEQ ID NO: 3862245 - RNA, 13 nt, Human
auucaaauuuuau

SEQ ID NO: 3862246 - RNA, 12 nt, Human
auucaacaaaca

SEQ ID NO: 3862247 - RNA, 21 nt, Human
auucaacagcaagugugaaua

SEQ ID NO: 3862248 - RNA, 22 nt, Human
auucaacagcaagugugaauac

SEQ ID NO: 3862249 - RNA, 14 nt, Human
auucaaccauggac

SEQ ID NO: 3862250 - RNA, 17 nt, Human
auucaaccauggacuuu

SEQ ID NO: 3862251 - RNA, 18 nt, Human
auucaaccauggacuuua

SEQ ID NO: 3862252 - RNA, 20 nt, Human
auucaaccauggacuuuaua

SEQ ID NO: 3862253 - RNA, 15 nt, Human
auucaacccuggaga

SEQ ID NO: 3862254 - RNA, 14 nt, Human
auucaacuaaaaaa

SEQ ID NO: 3862255 - RNA, 19 nt, Human
auucaagaaaaguaagccc

SEQ ID NO: 3862256 - RNA, 12 nt, Human
auucaagaacau

SEQ ID NO: 3862257 - RNA, 21 nt, Human
auucaagaaugccaguagaaa

SEQ ID NO: 3862258 - RNA, 13 nt, Human
auucaagauuccc

SEQ ID NO: 3862259 - RNA, 21 nt, Human
auucaaggcauuucuaucaca

SEQ ID NO: 3862260 - RNA, 20 nt, Human
auucaagguaaaauucuaaa

SEQ ID NO: 3862261 - RNA, 21 nt, Human
auucaagucuaugaugcuguu

SEQ ID NO: 3862262 - RNA, 20 nt, Human
auucaaguguaaaauauuuu

SEQ ID NO: 3862263 - RNA, 14 nt, Human
auucaaguuauugu

SEQ ID NO: 3862264 - RNA, 15 nt, Human
auucaaguuauugua

SEQ ID NO: 3862265 - RNA, 12 nt, Human
auucaauaaagu

SEQ ID NO: 3862266 - RNA, 13 nt, Human
auucaauaagcau

SEQ ID NO: 3862267 - RNA, 22 nt, Human
auucaauacaaacaaucucuua

SEQ ID NO: 3862268 - RNA, 17 nt, Human
auucaauauugacauuu

SEQ ID NO: 3862269 - RNA, 22 nt, Human
auucaauguuuaugcaaggaag

SEQ ID NO: 3862270 - RNA, 23 nt, Human
auucaauguuuaugcaaggaagg

SEQ ID NO: 3862271 - RNA, 17 nt, Human
auucaauuaaagaaaua

SEQ ID NO: 3862272 - RNA, 16 nt, Human
auucaauucaaagcug

SEQ ID NO: 3862273 - RNA, 13 nt, Human
auucaauuguaaa

SEQ ID NO: 3862274 - RNA, 18 nt, Human
auucaauuguaaauugaa

SEQ ID NO: 3862275 - RNA, 16 nt, Human
auucaauuugaugugg

SEQ ID NO: 3862276 - RNA, 22 nt, Human
auucaauuuucuuuaaccaguc

SEQ ID NO: 3862277 - RNA, 12 nt, Human
auucacaaaaau

SEQ ID NO: 3862278 - RNA, 17 nt, Human
auucacaaacuuuuaua

SEQ ID NO: 3862279 - RNA, 21 nt, Human
auucacaaguuaagauucuug

SEQ ID NO: 3862280 - RNA, 16 nt, Human
auucacaauaaaagcu

SEQ ID NO: 3862281 - RNA, 17 nt, Human
auucacaccccaccugc

SEQ ID NO: 3862282 - RNA, 16 nt, Human
auucacacuugaacca

SEQ ID NO: 3862283 - RNA, 21 nt, Human
auucacagugcucuuuucucc

SEQ ID NO: 3862284 - RNA, 16 nt, Human
auucacaucucauuuu

SEQ ID NO: 3862285 - RNA, 16 nt, Human
auucacauguuuucaa

SEQ ID NO: 3862286 - RNA, 17 nt, Human
auucacauguuuucaaa

SEQ ID NO: 3862287 - RNA, 16 nt, Human
auucaccaaaauuauc

SEQ ID NO: 3862288 - RNA, 15 nt, Human
auucaccauguaaaa

SEQ ID NO: 3862289 - RNA, 14 nt, Human
auucacccagacag

SEQ ID NO: 3862290 - RNA, 16 nt, Human
auucacccccuuuccu

SEQ ID NO: 3862291 - RNA, 16 nt, Human
auucaccuaagagauu

SEQ ID NO: 3862292 - RNA, 22 nt, Human
auucaccuaagagauucugauu

SEQ ID NO: 3862293 - RNA, 18 nt, Human
auucaccuccuaaaacaa

SEQ ID NO: 3862294 - RNA, 13 nt, Human
auucaccuguaaa

SEQ ID NO: 3862295 - RNA, 15 nt, Human
auucaccuguaaaac

SEQ ID NO: 3862296 - RNA, 17 nt, Human
auucaccuguaaaacuu

SEQ ID NO: 3862297 - RNA, 20 nt, Human
auucacuauuggcugggagu

SEQ ID NO: 3862298 - RNA, 21 nt, Human
auucacucccacacccaagaa

SEQ ID NO: 3862299 - RNA, 15 nt, Human
auucacucuuccaga

SEQ ID NO: 3862300 - RNA, 20 nt, Human
auucacugcccccagcucuu

SEQ ID NO: 3862301 - RNA, 13 nt, Human
auucacuggcccc

SEQ ID NO: 3862302 - RNA, 16 nt, Human
auucacuuauauguuc

SEQ ID NO: 3862303 - RNA, 17 nt, Human
auucacuucacugugcu

SEQ ID NO: 3862304 - RNA, 20 nt, Human
auucagaaaauguucuguuu

SEQ ID NO: 3862305 - RNA, 20 nt, Human
auucagaaaugacuuuuuga

SEQ ID NO: 3862306 - RNA, 14 nt, Human
auucagaaauugga

SEQ ID NO: 3862307 - RNA, 15 nt, Human
auucagacaaaaugg

SEQ ID NO: 3862308 - RNA, 23 nt, Human
auucagacaaaauggauacauaa

SEQ ID NO: 3862309 - RNA, 13 nt, Human
auucagacaagca

SEQ ID NO: 3862310 - RNA, 17 nt, Human
auucagacagcugccug

SEQ ID NO: 3862311 - RNA, 13 nt, Human
auucagacaggca

SEQ ID NO: 3862312 - RNA, 20 nt, Human
auucagagaaaggcaaggga

SEQ ID NO: 3862313 - RNA, 12 nt, Human
auucagauguau

SEQ ID NO: 3862314 - RNA, 14 nt, Human
auucagauguaugu

SEQ ID NO: 3862315 - RNA, 14 nt, Human
auucagcaaaccau

SEQ ID NO: 3862316 - RNA, 14 nt, Human
auucagcacugauu

SEQ ID NO: 3862317 - RNA, 19 nt, Human
auucagcacugauuucaca

SEQ ID NO: 3862318 - RNA, 20 nt, Human
auucagcacugauuucacaa

SEQ ID NO: 3862319 - RNA, 21 nt, Human
auucagcacugauuucacaac

SEQ ID NO: 3862320 - RNA, 19 nt, Human
auucagcagcaaauuuuca

SEQ ID NO: 3862321 - RNA, 20 nt, Human
auucagcagcaaauuuucag

SEQ ID NO: 3862322 - RNA, 14 nt, Human
auucagccuggcuu

SEQ ID NO: 3862323 - RNA, 14 nt, Human
auucagcucugcaa

SEQ ID NO: 3862324 - RNA, 17 nt, Human
auucagcugagguucau

SEQ ID NO: 3862325 - RNA, 21 nt, Human
auucaggaaaaggccuggggu

SEQ ID NO: 3862326 - RNA, 22 nt, Human
auucaggaagcagcuuucccca

SEQ ID NO: 3862327 - RNA, 19 nt, Human
auucaggaagcucagggcc

SEQ ID NO: 3862328 - RNA, 22 nt, Human
auucaggaagcucagggccugg

SEQ ID NO: 3862329 - RNA, 21 nt, Human
auucaggaauguguggccugc

SEQ ID NO: 3862330 - RNA, 22 nt, Human
auucaggacuuaacggcuccag

SEQ ID NO: 3862331 - RNA, 22 nt, Human
auucaggcuacugcuucaaucu

SEQ ID NO: 3862332 - RNA, 11 nt, Human
auucaggcugc

SEQ ID NO: 3862333 - RNA, 16 nt, Human
auucaggcugcuuggg

SEQ ID NO: 3862334 - RNA, 12 nt, Human
auucaggggcug

SEQ ID NO: 3862335 - RNA, 19 nt, Human
auucaggggcugacacuuc

SEQ ID NO: 3862336 - RNA, 13 nt, Human
auucagguauguu

SEQ ID NO: 3862337 - RNA, 18 nt, Human
auucagguauguugccuu

SEQ ID NO: 3862338 - RNA, 20 nt, Human
auucagguauguugccuuua

SEQ ID NO: 3862339 - RNA, 18 nt, Human
auucaggugaaaauguuc

SEQ ID NO: 3862340 - RNA, 18 nt, Human
auucaggugcagaggaag

SEQ ID NO: 3862341 - RNA, 23 nt, Human
auucagguuuuuccuuuuuuugu

SEQ ID NO: 3862342 - RNA, 19 nt, Human
auucaguaauaacucuacc

SEQ ID NO: 3862343 - RNA, 22 nt, Human
auucagugcuguggccugggca

SEQ ID NO: 3862344 - RNA, 17 nt, Human
auucagugcuucuuaaa

SEQ ID NO: 3862345 - RNA, 19 nt, Human
auucaguggcgagaaauaa

SEQ ID NO: 3862346 - RNA, 19 nt, Human
auucaguguuaaaugugau

SEQ ID NO: 3862347 - RNA, 16 nt, Human
auucaguucccagaau

SEQ ID NO: 3862348 - RNA, 19 nt, Human
auucaguucccagaaucaa

SEQ ID NO: 3862349 - RNA, 13 nt, Human
auucaguuucuaa

SEQ ID NO: 3862350 - RNA, 15 nt, Human
auucaguuuucauuu

SEQ ID NO: 3862351 - RNA, 15 nt, Human
auucauaaaaacugc

SEQ ID NO: 3862352 - RNA, 16 nt, Human
auucauaaaaacugcu

SEQ ID NO: 3862353 - RNA, 12 nt, Human
auucauaaaucu

SEQ ID NO: 3862354 - RNA, 13 nt, Human
auucauacuuaaa

SEQ ID NO: 3862355 - RNA, 20 nt, Human
auucauacuuaaaaauuuau

SEQ ID NO: 3862356 - RNA, 16 nt, Human
auucauaguaacuucu

SEQ ID NO: 3862357 - RNA, 17 nt, Human
auucauaguaacuucuu

SEQ ID NO: 3862358 - RNA, 19 nt, Human
auucauaguaacuucuuau

SEQ ID NO: 3862359 - RNA, 14 nt, Human
auucauaugcauau

SEQ ID NO: 3862360 - RNA, 18 nt, Human
auucauauuacaauauuu

SEQ ID NO: 3862361 - RNA, 14 nt, Human
auucauauucuuuu

SEQ ID NO: 3862362 - RNA, 17 nt, Human
auucauauugaauauaa

SEQ ID NO: 3862363 - RNA, 14 nt, Human
auucauauuuacuu

SEQ ID NO: 3862364 - RNA, 15 nt, Human
auucauauuuguacu

SEQ ID NO: 3862365 - RNA, 22 nt, Human
auucauauuuguacuuucuguu

SEQ ID NO: 3862366 - RNA, 16 nt, Human
auucauauuuucuuuc

SEQ ID NO: 3862367 - RNA, 19 nt, Human
auucauccaaguuaaaugu

SEQ ID NO: 3862368 - RNA, 20 nt, Human
auucauccaaguuaaaugua

SEQ ID NO: 3862369 - RNA, 16 nt, Human
auucaucccaacuguc

SEQ ID NO: 3862370 - RNA, 17 nt, Human
auucaucccaacugucu

SEQ ID NO: 3862371 - RNA, 22 nt, Human
auucaucucucuuuaauauaaa

SEQ ID NO: 3862372 - RNA, 17 nt, Human
auugaacacaaacugua

SEQ ID NO: 3862373 - RNA, 20 nt, Human
auugaacacaaacuguaaau

SEQ ID NO: 3862374 - RNA, 14 nt, Human
auugaacagcaaag

SEQ ID NO: 3862375 - RNA, 15 nt, Human
auugaacccaggagg

SEQ ID NO: 3862376 - RNA, 23 nt, Human
auugaaccuuugugcccuaucac

SEQ ID NO: 3862377 - RNA, 19 nt, Human
auugaacuuaaauaaaugu

SEQ ID NO: 3862378 - RNA, 22 nt, Human
auugaacuuacuguagccucag

SEQ ID NO: 3862379 - RNA, 17 nt, Human
auugaacuuuuguacug

SEQ ID NO: 3862380 - RNA, 18 nt, Human
auugaacuuuuguacuga

SEQ ID NO: 3862381 - RNA, 13 nt, Human
auugaagaagaau

SEQ ID NO: 3862382 - RNA, 14 nt, Human
auugaagacaauuu

SEQ ID NO: 3862383 - RNA, 19 nt, Human
auugaagacaauuugauac

SEQ ID NO: 3862384 - RNA, 19 nt, Human
auugaagagagauauaucu

SEQ ID NO: 3862385 - RNA, 18 nt, Human
auugaagccgacucuggc

SEQ ID NO: 3862386 - RNA, 22 nt, Human
auugaagcucgugacaagugcc

SEQ ID NO: 3862387 - RNA, 12 nt, Human
auugaaggaaag

SEQ ID NO: 3862388 - RNA, 19 nt, Human
auugaaggaagccaaauuu

SEQ ID NO: 3862389 - RNA, 15 nt, Human
auugaaggcuuaaac

SEQ ID NO: 3862390 - RNA, 13 nt, Human
auugaagguuuuu

SEQ ID NO: 3862391 - RNA, 14 nt, Human
auugaaguaaaaug

SEQ ID NO: 3862392 - RNA, 15 nt, Human
auugaaguaaacuuu

SEQ ID NO: 3862393 - RNA, 15 nt, Human
auugaaguaaugaau

SEQ ID NO: 3862394 - RNA, 13 nt, Human
auugaaguuucaa

SEQ ID NO: 3862395 - RNA, 14 nt, Human
auugaauaauggua

SEQ ID NO: 3862396 - RNA, 13 nt, Human
auugaaucaguau

SEQ ID NO: 3862397 - RNA, 14 nt, Human
auugaaucauguag

SEQ ID NO: 3862398 - RNA, 16 nt, Human
auugaaucuauuuaag

SEQ ID NO: 3862399 - RNA, 18 nt, Human
auugaaucuauuuaagua

SEQ ID NO: 3862400 - RNA, 14 nt, Human
auugaaucugauug

SEQ ID NO: 3862401 - RNA, 23 nt, Human
auugaaucugauuggacauuuuc

SEQ ID NO: 3862402 - RNA, 22 nt, Human
auugaaugauauauaaauauau

SEQ ID NO: 3862403 - RNA, 22 nt, Human
auugaauggcuauguuuuuaau

SEQ ID NO: 3862404 - RNA, 18 nt, Human
auugaauucauuucacug

SEQ ID NO: 3862405 - RNA, 23 nt, Human
auugaauucuugguugaggaaac

SEQ ID NO: 3862406 - RNA, 14 nt, Human
auugaauuuaacaa

SEQ ID NO: 3862407 - RNA, 20 nt, Human
auugaauuuuuauuuuugaa

SEQ ID NO: 3862408 - RNA, 13 nt, Human
auugacaaacucu

SEQ ID NO: 3862409 - RNA, 15 nt, Human
auugacaagaacuga

SEQ ID NO: 3862410 - RNA, 13 nt, Human
auugacaauaaaa

SEQ ID NO: 3862411 - RNA, 18 nt, Human
auugacaauaaaauauua

SEQ ID NO: 3862412 - RNA, 20 nt, Human
auugacaauaauuucagguu

SEQ ID NO: 3862413 - RNA, 12 nt, Human
auugacacagaa

SEQ ID NO: 3862414 - RNA, 16 nt, Human
auugacacugaacuua

SEQ ID NO: 3862415 - RNA, 18 nt, Human
auugacacugaacuuaau

SEQ ID NO: 3862416 - RNA, 19 nt, Human
auugacacuuaaaaauggu

SEQ ID NO: 3862417 - RNA, 16 nt, Human
auugacagauugaauu

SEQ ID NO: 3862418 - RNA, 14 nt, Human
auugacagcuuugc

SEQ ID NO: 3862419 - RNA, 23 nt, Human
auugacaguaacuugguuauaca

SEQ ID NO: 3862420 - RNA, 14 nt, Human
auugaccaagaacu

SEQ ID NO: 3862421 - RNA, 15 nt, Human
auugaccaucugcuu

SEQ ID NO: 3862422 - RNA, 21 nt, Human
auugaccgacagcuuuccagu

SEQ ID NO: 3862423 - RNA, 20 nt, Human
auugaccgcgacuaauuuca

SEQ ID NO: 3862424 - RNA, 22 nt, Human
auugaccuauuuccagaaauac

SEQ ID NO: 3862425 - RNA, 17 nt, Human
auugaccugcuccgcug

SEQ ID NO: 3862426 - RNA, 20 nt, Human
auugacgauuccuucucuga

SEQ ID NO: 3862427 - RNA, 21 nt, Human
auugacgguuuuuuauuauug

SEQ ID NO: 3862428 - RNA, 23 nt, Human
auugacgucuagcuaugcuguau

SEQ ID NO: 3862429 - RNA, 23 nt, Human
auugacuaacucaaauacacauu

SEQ ID NO: 3862430 - RNA, 18 nt, Human
auugacuaucaaacugaa

SEQ ID NO: 3862431 - RNA, 13 nt, Human
auugacucugggu

SEQ ID NO: 3862432 - RNA, 14 nt, Human
auugacucuggguc

SEQ ID NO: 3862433 - RNA, 15 nt, Human
auugacucugggucc

SEQ ID NO: 3862434 - RNA, 13 nt, Human
auugacucuugag

SEQ ID NO: 3862435 - RNA, 22 nt, Human
auugacucuugaguuguuuuug

SEQ ID NO: 3862436 - RNA, 22 nt, Human
auugacugguuuacaggcccug

SEQ ID NO: 3862437 - RNA, 14 nt, Human
auugacuucaauga

SEQ ID NO: 3862438 - RNA, 18 nt, Human
auugacuucaaugauagu

SEQ ID NO: 3862439 - RNA, 22 nt, Human
auugacuuuccccaccagaugc

SEQ ID NO: 3862440 - RNA, 18 nt, Human
auugacuuuuauaaagca

SEQ ID NO: 3862441 - RNA, 18 nt, Human
auugacuuuuuauggcac

SEQ ID NO: 3862442 - RNA, 17 nt, Human
auugagaaagagcacuu

SEQ ID NO: 3862443 - RNA, 18 nt, Human
auugagaacugcauaugu

SEQ ID NO: 3862444 - RNA, 22 nt, Human
auugagaacugcauauguuucg

SEQ ID NO: 3862445 - RNA, 21 nt, Human
auugagaagaaaaacucaauu

SEQ ID NO: 3862446 - RNA, 13 nt, Human
auugagaaggaga

SEQ ID NO: 3862447 - RNA, 14 nt, Human
auugagaaggagag

SEQ ID NO: 3862448 - RNA, 15 nt, Human
auugagaaggagaga

SEQ ID NO: 3862449 - RNA, 14 nt, Human
auugagaaguucau

SEQ ID NO: 3862450 - RNA, 20 nt, Human
auugagaccgugaagauacu

SEQ ID NO: 3862451 - RNA, 19 nt, Human
auugagaccuacaggcuga

SEQ ID NO: 3862452 - RNA, 11 nt, Human
auugagagaau

SEQ ID NO: 3862453 - RNA, 20 nt, Human
auugagagagauguguaauu

SEQ ID NO: 3862454 - RNA, 20 nt, Human
auugagaguuuugucuugaa

SEQ ID NO: 3862455 - RNA, 16 nt, Human
auugagauacuuuuuc

SEQ ID NO: 3862456 - RNA, 19 nt, Human
auugagauuaugaugaaaa

SEQ ID NO: 3862457 - RNA, 15 nt, Human
auugagccuaaaaau

SEQ ID NO: 3862458 - RNA, 17 nt, Human
auugagccuaaaaauaa

SEQ ID NO: 3862459 - RNA, 15 nt, Human
auugagcugauauaa

SEQ ID NO: 3862460 - RNA, 15 nt, Human
auugaggaaaaauau

SEQ ID NO: 3862461 - RNA, 21 nt, Human
auugaggccugcccucaggga

SEQ ID NO: 3862462 - RNA, 22 nt, Human
auugaggcuuuguguuguaauu

SEQ ID NO: 3862463 - RNA, 22 nt, Human
auugaggggauuaauaugaaaa

SEQ ID NO: 3862464 - RNA, 23 nt, Human
auugagguguauggagagaaaac

SEQ ID NO: 3862465 - RNA, 17 nt, Human
auugaguaagauuuacc

SEQ ID NO: 3862466 - RNA, 19 nt, Human
auugaguaaugguguagaa

SEQ ID NO: 3862467 - RNA, 14 nt, Human
auugaguauuguuu

SEQ ID NO: 3862468 - RNA, 19 nt, Human
auugaguucuuccuguaau

SEQ ID NO: 3862469 - RNA, 20 nt, Human
auugaguucuuccuguaauc

SEQ ID NO: 3862470 - RNA, 13 nt, Human
auugaguuggaau

SEQ ID NO: 3862471 - RNA, 16 nt, Human
auugaguuuguaggua

SEQ ID NO: 3862472 - RNA, 19 nt, Human
auugauaaccuugaaaaaa

SEQ ID NO: 3862473 - RNA, 23 nt, Human
auugauaagagggcacacacugu

SEQ ID NO: 3862474 - RNA, 13 nt, Human
auugauaauaaac

SEQ ID NO: 3862475 - RNA, 15 nt, Human
auugauacucuuucu

SEQ ID NO: 3862476 - RNA, 18 nt, Human
auugauauaaauaaaaca

SEQ ID NO: 3862477 - RNA, 20 nt, Human
auugauaucuccaugaugau

SEQ ID NO: 3862478 - RNA, 14 nt, Human
auugauaugaaaaa

SEQ ID NO: 3862479 - RNA, 17 nt, Human
auugauaugcuuauaca

SEQ ID NO: 3862480 - RNA, 14 nt, Human
auugauauugugaa

SEQ ID NO: 3862481 - RNA, 19 nt, Human
auugauauugugaacauuu

SEQ ID NO: 3862482 - RNA, 15 nt, Human
auugaucaaauucau

SEQ ID NO: 3862483 - RNA, 18 nt, Human
auugaucauuuucccccc

SEQ ID NO: 3862484 - RNA, 17 nt, Human
auugauccagaaagaaa

SEQ ID NO: 3862485 - RNA, 19 nt, Human
auugauccagaaagaaaac

SEQ ID NO: 3862486 - RNA, 19 nt, Human
auugaucggagccuccucu

SEQ ID NO: 3862487 - RNA, 23 nt, Human
auugaucggagccuccucucuca

SEQ ID NO: 3862488 - RNA, 14 nt, Human
auugaugcaaauaa

SEQ ID NO: 3862489 - RNA, 13 nt, Human
auugaugugcaaa

SEQ ID NO: 3862490 - RNA, 16 nt, Human
auugaugugcaaaaau

SEQ ID NO: 3862491 - RNA, 20 nt, Human
auugaugugcaaaaauuuuu

SEQ ID NO: 3862492 - RNA, 13 nt, Human
auugauguugaug

SEQ ID NO: 3862493 - RNA, 20 nt, Human
auugauuauuacuggcaaaa

SEQ ID NO: 3862494 - RNA, 14 nt, Human
auugauugggaaaa

SEQ ID NO: 3862495 - RNA, 19 nt, Human
auugauugggaaaacauuu

SEQ ID NO: 3862496 - RNA, 21 nt, Human
auugauugggaaaacauuugc

SEQ ID NO: 3862497 - RNA, 21 nt, Human
auugauuuccguuaaaauacc

SEQ ID NO: 3862498 - RNA, 15 nt, Human
auugauuuccugugu

SEQ ID NO: 3862499 - RNA, 20 nt, Human
auugauuucugccuuccuug

SEQ ID NO: 3862500 - RNA, 13 nt, Human
auugauuugcauu

SEQ ID NO: 3862501 - RNA, 15 nt, Human
auugauuugcauuga

SEQ ID NO: 3862502 - RNA, 12 nt, Human
auugauuuuugg

SEQ ID NO: 3862503 - RNA, 21 nt, Human
auugcaacaaaauacauucuu

SEQ ID NO: 3862504 - RNA, 15 nt, Human
auugcaacaggcugg

SEQ ID NO: 3862505 - RNA, 16 nt, Human
auugcaacaggcuggg

SEQ ID NO: 3862506 - RNA, 17 nt, Human
auugcaacaggcugggc

SEQ ID NO: 3862507 - RNA, 23 nt, Human
auugcaagaagcuuuauuucuag

SEQ ID NO: 3862508 - RNA, 16 nt, Human
auugcaauaaaguaua

SEQ ID NO: 3862509 - RNA, 13 nt, Human
auugcaauuaaac

SEQ ID NO: 3862510 - RNA, 18 nt, Human
auugcacaaaauauaaag

SEQ ID NO: 3862511 - RNA, 11 nt, Human
auugcacaaua

SEQ ID NO: 3862512 - RNA, 16 nt, Human
auugcacaugucuuaa

SEQ ID NO: 3862513 - RNA, 21 nt, Human
auugcacaugucuuaaugaag

SEQ ID NO: 3862514 - RNA, 13 nt, Human
auugcacauuguu

SEQ ID NO: 3862515 - RNA, 21 nt, Human
auugcacauuguuguuuuuuu

SEQ ID NO: 3862516 - RNA, 12 nt, Human
auugcaccacug

SEQ ID NO: 3862517 - RNA, 16 nt, Human
auuuucucucagguga

SEQ ID NO: 3862518 - RNA, 17 nt, Human
auuuucucugauacuuu

SEQ ID NO: 3862519 - RNA, 18 nt, Human
auuuucucugauacuuuu

SEQ ID NO: 3862520 - RNA, 14 nt, Human
auuuucucuguacu

SEQ ID NO: 3862521 - RNA, 18 nt, Human
auuuucucuguguuuguu

SEQ ID NO: 3862522 - RNA, 21 nt, Human
auuuucugaaacuaaugaaag

SEQ ID NO: 3862523 - RNA, 22 nt, Human
auuuucugaaacuaaugaaagc

SEQ ID NO: 3862524 - RNA, 12 nt, Human
auuuucugcaag

SEQ ID NO: 3862525 - RNA, 20 nt, Human
auuuucuggguucugggugg

SEQ ID NO: 3862526 - RNA, 15 nt, Human
auuuucugguucuaa

SEQ ID NO: 3862527 - RNA, 19 nt, Human
auuuucugguucuaacauu

SEQ ID NO: 3862528 - RNA, 12 nt, Human
auuuucugucag

SEQ ID NO: 3862529 - RNA, 18 nt, Human
auuuucugucagaugaga

SEQ ID NO: 3862530 - RNA, 18 nt, Human
auuuucugugccugaaua

SEQ ID NO: 3862531 - RNA, 20 nt, Human
auuuucugugccugaauauu

SEQ ID NO: 3862532 - RNA, 21 nt, Human
auuuucugugccugaauauuu

SEQ ID NO: 3862533 - RNA, 19 nt, Human
auuuucugugggcaggccu

SEQ ID NO: 3862534 - RNA, 15 nt, Human
auuuucuguguguuc

SEQ ID NO: 3862535 - RNA, 11 nt, Human
auuuucuguug

SEQ ID NO: 3862536 - RNA, 21 nt, Human
auuuucuuacccaauuuccca

SEQ ID NO: 3862537 - RNA, 21 nt, Human
auuuucuuauugcgcugcuac

SEQ ID NO: 3862538 - RNA, 18 nt, Human
auuuucuucaccucugcu

SEQ ID NO: 3862539 - RNA, 14 nt, Human
auuuucuucaugca

SEQ ID NO: 3862540 - RNA, 14 nt, Human
auuuucuucuaagu

SEQ ID NO: 3862541 - RNA, 20 nt, Human
auuuucuucuaagugaaauu

SEQ ID NO: 3862542 - RNA, 18 nt, Human
auuuucuucucugugaga

SEQ ID NO: 3862543 - RNA, 13 nt, Human
auuuucuuuaaaa

SEQ ID NO: 3862544 - RNA, 16 nt, Human
auuuugaaaacuacau

SEQ ID NO: 3862545 - RNA, 17 nt, Human
auuuugaaaagauguac

SEQ ID NO: 3862546 - RNA, 20 nt, Human
auuuugaaaagcuucuuaau

SEQ ID NO: 3862547 - RNA, 14 nt, Human
auuuugaaaaguaa

SEQ ID NO: 3862548 - RNA, 23 nt, Human
auuuugaagcuaauuauuuuaau

SEQ ID NO: 3862549 - RNA, 20 nt, Human
auuuugaagugagaaaauga

SEQ ID NO: 3862550 - RNA, 22 nt, Human
auuuugaagugcuguuuauuaa

SEQ ID NO: 3862551 - RNA, 18 nt, Human
auuuugaaguuuacauuu

SEQ ID NO: 3862552 - RNA, 12 nt, Human
auuuugaaucaa

SEQ ID NO: 3862553 - RNA, 17 nt, Human
auuuugaaucaauaaua

SEQ ID NO: 3862554 - RNA, 16 nt, Human
auuuugacacugaaau

SEQ ID NO: 3862555 - RNA, 19 nt, Human
auuuugagauguaaaaaga

SEQ ID NO: 3862556 - RNA, 14 nt, Human
auuuugaggcuuuc

SEQ ID NO: 3862557 - RNA, 18 nt, Human
auuuugaguaaagcuccu

SEQ ID NO: 3862558 - RNA, 14 nt, Human
auuuugaguugcca

SEQ ID NO: 3862559 - RNA, 17 nt, Human
auuuugauaauaaauug

SEQ ID NO: 3862560 - RNA, 20 nt, Human
auuuugaucucacauuuuua

SEQ ID NO: 3862561 - RNA, 14 nt, Human
auuuugaugaacaa

SEQ ID NO: 3862562 - RNA, 16 nt, Human
auuuugaugcagcauu

SEQ ID NO: 3862563 - RNA, 21 nt, Human
auuuugaugcagcauuugaua

SEQ ID NO: 3862564 - RNA, 23 nt, Human
auuuugaugcagcauuugauaau

SEQ ID NO: 3862565 - RNA, 18 nt, Human
auuuugaugugacaauaa

SEQ ID NO: 3862566 - RNA, 19 nt, Human
auuuugaugugacaauaau

SEQ ID NO: 3862567 - RNA, 14 nt, Human
auuuugcaaaauuu

SEQ ID NO: 3862568 - RNA, 13 nt, Human
auuuugcaaagau

SEQ ID NO: 3862569 - RNA, 19 nt, Human
auuuugcaaauauaaacau

SEQ ID NO: 3862570 - RNA, 18 nt, Human
auuuugcacccacugaaa

SEQ ID NO: 3862571 - RNA, 22 nt, Human
auuuugcagaggcuaugggaag

SEQ ID NO: 3862572 - RNA, 12 nt, Human
auuuugcagcag

SEQ ID NO: 3862573 - RNA, 20 nt, Human
auuuugccaagggcauaaau

SEQ ID NO: 3862574 - RNA, 15 nt, Human
auuuugcccuugaca

SEQ ID NO: 3862575 - RNA, 18 nt, Human
auuuugccucuuuucucu

SEQ ID NO: 3862576 - RNA, 17 nt, Human
auuuugcgucagagaaa

SEQ ID NO: 3862577 - RNA, 19 nt, Human
auuuugcuaucaacaauaa

SEQ ID NO: 3862578 - RNA, 23 nt, Human
auuuugcuauuguaaauauguuu

SEQ ID NO: 3862579 - RNA, 21 nt, Human
auuuugcugucccuuuuccuu

SEQ ID NO: 3862580 - RNA, 14 nt, Human
auuuuggaaaauaa

SEQ ID NO: 3862581 - RNA, 19 nt, Human
auuuuggaaaguuuuugua

SEQ ID NO: 3862582 - RNA, 21 nt, Human
auuuuggagaaauuauuuaau

SEQ ID NO: 3862583 - RNA, 19 nt, Human
auuuuggagagauaggaag

SEQ ID NO: 3862584 - RNA, 20 nt, Human
auuuuggagaguuuccugaa

SEQ ID NO: 3862585 - RNA, 21 nt, Human
auuuuggagaguuuccugaaa

SEQ ID NO: 3862586 - RNA, 21 nt, Human
auuuuggagauuauaauaaau

SEQ ID NO: 3862587 - RNA, 17 nt, Human
auuuuggauuuugcaag

SEQ ID NO: 3862588 - RNA, 21 nt, Human
auuuuggccaugaaagcaugg

SEQ ID NO: 3862589 - RNA, 21 nt, Human
auuuuggcgaaucucaaaauu

SEQ ID NO: 3862590 - RNA, 16 nt, Human
auuuugggaaucuuuu

SEQ ID NO: 3862591 - RNA, 22 nt, Human
auuuugggguacccacugcucu

SEQ ID NO: 3862592 - RNA, 19 nt, Human
auuuuggguuuugggucuu

SEQ ID NO: 3862593 - RNA, 21 nt, Human
auuuugguaagagacagaaug

SEQ ID NO: 3862594 - RNA, 21 nt, Human
auuuugguauuacacuguauu

SEQ ID NO: 3862595 - RNA, 17 nt, Human
auuuuggugucuuucuc

SEQ ID NO: 3862596 - RNA, 17 nt, Human
auuuugguucuucucaa

SEQ ID NO: 3862597 - RNA, 19 nt, Human
auuuugguuguauucuuug

SEQ ID NO: 3862598 - RNA, 16 nt, Human
auuuugguuuuguucc

SEQ ID NO: 3862599 - RNA, 17 nt, Human
auuuugguuuuguuccc

SEQ ID NO: 3862600 - RNA, 12 nt, Human
auuuuguaaaau

SEQ ID NO: 3862601 - RNA, 14 nt, Human
auuuuguaaaaugu

SEQ ID NO: 3862602 - RNA, 17 nt, Human
auuuuguaaacucaaaa

SEQ ID NO: 3862603 - RNA, 23 nt, Human
auuuuguaaauaauaaaauagua

SEQ ID NO: 3862604 - RNA, 12 nt, Human
auuuuguaagaa

SEQ ID NO: 3862605 - RNA, 16 nt, Human
auuuuguaagaaggca

SEQ ID NO: 3862606 - RNA, 20 nt, Human
auuuuguaauuuucuugaug

SEQ ID NO: 3862607 - RNA, 20 nt, Human
auuuuguacaaauuuguuau

SEQ ID NO: 3862608 - RNA, 13 nt, Human
auuuuguaucugc

SEQ ID NO: 3862609 - RNA, 14 nt, Human
auuuuguaucugca

SEQ ID NO: 3862610 - RNA, 14 nt, Human
auuuuguaugaaau

SEQ ID NO: 3862611 - RNA, 23 nt, Human
auuuuguaugcaagcaguuucaa

SEQ ID NO: 3862612 - RNA, 16 nt, Human
auuuuguauuauugcu

SEQ ID NO: 3862613 - RNA, 15 nt, Human
auuuuguauuguggu

SEQ ID NO: 3862614 - RNA, 16 nt, Human
auuuuguauuuuccaa

SEQ ID NO: 3862615 - RNA, 20 nt, Human
auuuuguauuuuccaagugu

SEQ ID NO: 3862616 - RNA, 14 nt, Human
auuuugucgaauuu

SEQ ID NO: 3862617 - RNA, 21 nt, Human
auuuugugaaacagacuugua

SEQ ID NO: 3862618 - RNA, 21 nt, Human
auuuugugaagacugggaagu

SEQ ID NO: 3862619 - RNA, 17 nt, Human
auuuugugacauuccuu

SEQ ID NO: 3862620 - RNA, 23 nt, Human
auuuugugaguuuguuucuuuga

SEQ ID NO: 3862621 - RNA, 20 nt, Human
auuuugugcucauuuaaguu

SEQ ID NO: 3862622 - RNA, 23 nt, Human
auuuuguggaggcagugucauuu

SEQ ID NO: 3862623 - RNA, 13 nt, Human
auuuuguguaaaa

SEQ ID NO: 3862624 - RNA, 14 nt, Human
auuuuguguaaaaa

SEQ ID NO: 3862625 - RNA, 20 nt, Human
auuuuguguaagaaauacag

SEQ ID NO: 3862626 - RNA, 21 nt, Human
auuuuguguccuccaggagcu

SEQ ID NO: 3862627 - RNA, 15 nt, Human
auuuugugugaccaa

SEQ ID NO: 3862628 - RNA, 17 nt, Human
auuuuguguugaagagc

SEQ ID NO: 3862629 - RNA, 17 nt, Human
auuuuguguuuaggaac

SEQ ID NO: 3862630 - RNA, 17 nt, Human
auuuuguguuuauucuu

SEQ ID NO: 3862631 - RNA, 19 nt, Human
auuuuguguuuauucuuga

SEQ ID NO: 3862632 - RNA, 14 nt, Human
auuuuguucauaca

SEQ ID NO: 3862633 - RNA, 15 nt, Human
auuuuguucauacau

SEQ ID NO: 3862634 - RNA, 14 nt, Human
auuuuguucuuaca

SEQ ID NO: 3862635 - RNA, 17 nt, Human
auuuuguucuuacacau

SEQ ID NO: 3862636 - RNA, 23 nt, Human
auuuuguugcuguuuugauuugu

SEQ ID NO: 3862637 - RNA, 20 nt, Human
auuuuguugcuuuugugaac

SEQ ID NO: 3862638 - RNA, 11 nt, Human
auuuuguuuac

SEQ ID NO: 3862639 - RNA, 14 nt, Human
auuuuguuucugua

SEQ ID NO: 3862640 - RNA, 20 nt, Human
auuuuguuucuuuuaaagca

SEQ ID NO: 3862641 - RNA, 20 nt, Human
auuuuguuugguauuguauu

SEQ ID NO: 3862642 - RNA, 21 nt, Human
auuuuguuugguauuguauuu

SEQ ID NO: 3862643 - RNA, 22 nt, Human
auuuuguuuugcuuuuucugac

SEQ ID NO: 3862644 - RNA, 23 nt, Human
auuuuguuuugcuuuuucugacu

SEQ ID NO: 3862645 - RNA, 24 nt, Human
auuuuguuuugcuuuuucugacuc

SEQ ID NO: 3862646 - RNA, 14 nt, Human
auuuuguuuuuaaa

SEQ ID NO: 3862647 - RNA, 15 nt, Human
auuuuuaaaaaauau

SEQ ID NO: 3862648 - RNA, 23 nt, Human
auuuuuaaaaaauauuuucucug

SEQ ID NO: 3862649 - RNA, 22 nt, Human
auuuuuaaaaaaugaaauccuu

SEQ ID NO: 3862650 - RNA, 13 nt, Human
auuuuuaaaagcc

SEQ ID NO: 3862651 - RNA, 22 nt, Human
auuuuuaaaaugcaacaugugu

SEQ ID NO: 3862652 - RNA, 16 nt, Human
auuuuuaaaauguaca

SEQ ID NO: 3862653 - RNA, 14 nt, Human
auuuuuaaacaagu

SEQ ID NO: 3862654 - RNA, 21 nt, Human
auuuuuaaacagguggugaga

SEQ ID NO: 3862655 - RNA, 12 nt, Human
auuuuuaaagau

SEQ ID NO: 3862656 - RNA, 13 nt, Human
auuuuuaaagauc

SEQ ID NO: 3862657 - RNA, 17 nt, Human
auuuuuaaaguauauau

SEQ ID NO: 3862658 - RNA, 11 nt, Human
auuuuuaaaug

SEQ ID NO: 3862659 - RNA, 19 nt, Human
auuuuuaaaugcaguuaca

SEQ ID NO: 3862660 - RNA, 13 nt, Human
auuuuuaaaugug

SEQ ID NO: 3862661 - RNA, 17 nt, Human
caaaagcgcuuuuccuu

SEQ ID NO: 3862662 - RNA, 22 nt, Human
caaaagcgcuuuuccuuggcau

SEQ ID NO: 3862663 - RNA, 19 nt, Human
caaaagcuagacagauccc

SEQ ID NO: 3862664 - RNA, 16 nt, Human
caaaagcugaacacau

SEQ ID NO: 3862665 - RNA, 20 nt, Human
caaaagcugaacacauuucu

SEQ ID NO: 3862666 - RNA, 15 nt, Human
caaaagcugggcagg

SEQ ID NO: 3862667 - RNA, 19 nt, Human
caaaagcugggcagguugg

SEQ ID NO: 3862668 - RNA, 13 nt, Human
caaaagcuuuuua

SEQ ID NO: 3862669 - RNA, 12 nt, Human
caaaaggaaaaa

SEQ ID NO: 3862670 - RNA, 14 nt, Human
caaaaggaaaaagc

SEQ ID NO: 3862671 - RNA, 16 nt, Human
caaaaggaaaaagcuc

SEQ ID NO: 3862672 - RNA, 11 nt, Human
caaaaggaaag

SEQ ID NO: 3862673 - RNA, 20 nt, Human
caaaaggaaagcuguguuua

SEQ ID NO: 3862674 - RNA, 13 nt, Human
caaaaggaagucu

SEQ ID NO: 3862675 - RNA, 22 nt, Human
caaaaggagagacucccaugaa

SEQ ID NO: 3862676 - RNA, 21 nt, Human
caaaaggauaaugaauacuuu

SEQ ID NO: 3862677 - RNA, 19 nt, Human
caaaaggaucuuuguggcc

SEQ ID NO: 3862678 - RNA, 20 nt, Human
caaaaggaucuuuguggcca

SEQ ID NO: 3862679 - RNA, 21 nt, Human
caaaaggcaguggggcugggg

SEQ ID NO: 3862680 - RNA, 16 nt, Human
caaaaggccucuugua

SEQ ID NO: 3862681 - RNA, 22 nt, Human
caaaaggccucuuguaaagacu

SEQ ID NO: 3862682 - RNA, 23 nt, Human
caaaaggccucuuguaaagacug

SEQ ID NO: 3862683 - RNA, 15 nt, Human
caaaagggacaugaa

SEQ ID NO: 3862684 - RNA, 16 nt, Human
caaaagggucagagga

SEQ ID NO: 3862685 - RNA, 23 nt, Human
caaaagggucagaggaccuguau

SEQ ID NO: 3862686 - RNA, 22 nt, Human
caaaaggguuuaaacugauuca

SEQ ID NO: 3862687 - RNA, 15 nt, Human
caaaaggugccugug

SEQ ID NO: 3862688 - RNA, 23 nt, Human
caaaaggugccugugaggcaggg

SEQ ID NO: 3862689 - RNA, 20 nt, Human
caaaagguuaauaaaguaau

SEQ ID NO: 3862690 - RNA, 15 nt, Human
caaaagguuuauucc

SEQ ID NO: 3862691 - RNA, 14 nt, Human
caaaaguaaugccu

SEQ ID NO: 3862692 - RNA, 15 nt, Human
caaaaguagaacuuu

SEQ ID NO: 3862693 - RNA, 17 nt, Human
caaaaguaucgggggcu

SEQ ID NO: 3862694 - RNA, 13 nt, Human
caaaaguauuuuc

SEQ ID NO: 3862695 - RNA, 20 nt, Human
caaaaguauuuuccuguaaa

SEQ ID NO: 3862696 - RNA, 16 nt, Human
caaaagucugucuuuc

SEQ ID NO: 3862697 - RNA, 19 nt, Human
caaaagucugucuuuccug

SEQ ID NO: 3862698 - RNA, 21 nt, Human
caaaagugccucaagaggaau

SEQ ID NO: 3862699 - RNA, 14 nt, Human
caaaaguggccucu

SEQ ID NO: 3862700 - RNA, 18 nt, Human
caaaaguggccucuuugu

SEQ ID NO: 3862701 - RNA, 12 nt, Human
caaaaguuauua

SEQ ID NO: 3862702 - RNA, 17 nt, Human
caaaaguuuuccugaga

SEQ ID NO: 3862703 - RNA, 23 nt, Human
caaaauaaaaagugacacagcag

SEQ ID NO: 3862704 - RNA, 17 nt, Human
caaaauaaaaaugaggu

SEQ ID NO: 3862705 - RNA, 12 nt, Human
caaaauaaaaca

SEQ ID NO: 3862706 - RNA, 13 nt, Human
caaaauaaaacau

SEQ ID NO: 3862707 - RNA, 12 nt, Human
caaaauaaaacu

SEQ ID NO: 3862708 - RNA, 16 nt, Human
caaaauaaaacuuuuu

SEQ ID NO: 3862709 - RNA, 11 nt, Human
caaaauaaauu

SEQ ID NO: 3862710 - RNA, 14 nt, Human
caaaauaauaaaaa

SEQ ID NO: 3862711 - RNA, 20 nt, Human
caaaauaaugucuuguuaau

SEQ ID NO: 3862712 - RNA, 14 nt, Human
caaaauaauucuaa

SEQ ID NO: 3862713 - RNA, 19 nt, Human
caaaauacaugaugauuuc

SEQ ID NO: 3862714 - RNA, 22 nt, Human
caaaauacaugaugauuucaga

SEQ ID NO: 3862715 - RNA, 11 nt, Human
caaaauacauu

SEQ ID NO: 3862716 - RNA, 23 nt, Human
caaaauacauucuuuuugcucua

SEQ ID NO: 3862717 - RNA, 20 nt, Human
caaaauacuugucuguuuua

SEQ ID NO: 3862718 - RNA, 17 nt, Human
caaaauagaaaaguuau

SEQ ID NO: 3862719 - RNA, 12 nt, Human
caaaauagaaag

SEQ ID NO: 3862720 - RNA, 21 nt, Human
caaaauagaaaguugcaaggc

SEQ ID NO: 3862721 - RNA, 16 nt, Human
caaaauagcauuuguu

SEQ ID NO: 3862722 - RNA, 21 nt, Human
caaaauaggguauauuuuccu

SEQ ID NO: 3862723 - RNA, 14 nt, Human
caaaauauacaaaa

SEQ ID NO: 3862724 - RNA, 22 nt, Human
caaaauauauuuuguuuacaaa

SEQ ID NO: 3862725 - RNA, 14 nt, Human
caaaauauguucuu

SEQ ID NO: 3862726 - RNA, 21 nt, Human
caaaauauuuaaaaaugucuu

SEQ ID NO: 3862727 - RNA, 15 nt, Human
caaaauauuucccau

SEQ ID NO: 3862728 - RNA, 16 nt, Human
caaaauauuuguacau

SEQ ID NO: 3862729 - RNA, 17 nt, Human
caaaaucaagcaagccu

SEQ ID NO: 3862730 - RNA, 16 nt, Human
caaaaucaguuuuccu

SEQ ID NO: 3862731 - RNA, 19 nt, Human
caaaaucauuuuauauguc

SEQ ID NO: 3862732 - RNA, 23 nt, Human
caaaaucauuuuauaugucaaag

SEQ ID NO: 3862733 - RNA, 16 nt, Human
caaaauccaaaaagaa

SEQ ID NO: 3862734 - RNA, 21 nt, Human
caaaaucgaugcagugcuucc

SEQ ID NO: 3862735 - RNA, 19 nt, Human
caaaaucucccauuuugga

SEQ ID NO: 3862736 - RNA, 16 nt, Human
caaaaucucuccacuu

SEQ ID NO: 3862737 - RNA, 21 nt, Human
caaaaucuguagagcagggca

SEQ ID NO: 3862738 - RNA, 13 nt, Human
caaaaucugucca

SEQ ID NO: 3862739 - RNA, 21 nt, Human
caaaaucuguccaaaggaggc

SEQ ID NO: 3862740 - RNA, 16 nt, Human
caaaaugacaucuuuu

SEQ ID NO: 3862741 - RNA, 22 nt, Human
caaaaugacaucuuuuuaaagc

SEQ ID NO: 3862742 - RNA, 22 nt, Human
caaaaugaggaauguauauguu

SEQ ID NO: 3862743 - RNA, 18 nt, Human
caaaaugcucuagugccu

SEQ ID NO: 3862744 - RNA, 22 nt, Human
caaaaugcucuuauuucaucau

SEQ ID NO: 3862745 - RNA, 18 nt, Human
caaaauggaauucauucu

SEQ ID NO: 3862746 - RNA, 15 nt, Human
caaaauggauaaaau

SEQ ID NO: 3862747 - RNA, 23 nt, Human
caaaauggauaaaaucugauaug

SEQ ID NO: 3862748 - RNA, 17 nt, Human
caaaauggauacauaaa

SEQ ID NO: 3862749 - RNA, 15 nt, Human
caaaaugggacuugu

SEQ ID NO: 3862750 - RNA, 14 nt, Human
caaaauguaacugu

SEQ ID NO: 3862751 - RNA, 15 nt, Human
caaaauguaacuguu

SEQ ID NO: 3862752 - RNA, 19 nt, Human
caaaauguaacuguuacca

SEQ ID NO: 3862753 - RNA, 15 nt, Human
caaaauguaggguua

SEQ ID NO: 3862754 - RNA, 12 nt, Human
caaaauguauau

SEQ ID NO: 3862755 - RNA, 15 nt, Human
caaaauguauauauu

SEQ ID NO: 3862756 - RNA, 17 nt, Human
caaaauguauauauuua

SEQ ID NO: 3862757 - RNA, 16 nt, Human
caaaauguaugucugg

SEQ ID NO: 3862758 - RNA, 13 nt, Human
caaaaugucugua

SEQ ID NO: 3862759 - RNA, 16 nt, Human
caaaauguguauuucu

SEQ ID NO: 3862760 - RNA, 16 nt, Human
caaaauuaagcaaaug

SEQ ID NO: 3862761 - RNA, 19 nt, Human
caaaauuaagguguuugaa

SEQ ID NO: 3862762 - RNA, 22 nt, Human
caaaauuacagacugucugaaa

SEQ ID NO: 3862763 - RNA, 20 nt, Human
caaaauuaccaaaaaucuug

SEQ ID NO: 3862764 - RNA, 23 nt, Human
caaaauuagauccuaagaugugu

SEQ ID NO: 3862765 - RNA, 21 nt, Human
caaaauuagccaguaauccug

SEQ ID NO: 3862766 - RNA, 21 nt, Human
caaaauuauagaaguuuagau

SEQ ID NO: 3862767 - RNA, 15 nt, Human
caaaauuauuucaga

SEQ ID NO: 3862768 - RNA, 13 nt, Human
caaaauugacauu

SEQ ID NO: 3862769 - RNA, 16 nt, Human
caaaauugcaaaucuu

SEQ ID NO: 3862770 - RNA, 22 nt, Human
caaaauugcaaaucuugaaauu

SEQ ID NO: 3862771 - RNA, 20 nt, Human
caaaauuguuuugagcuuuc

SEQ ID NO: 3862772 - RNA, 17 nt, Human
caaaauuuaguuuuugu

SEQ ID NO: 3862773 - RNA, 20 nt, Human
caaaauuuaguuuuuguucu

SEQ ID NO: 3862774 - RNA, 17 nt, Human
caaaauuuccaguaccu

SEQ ID NO: 3862775 - RNA, 19 nt, Human
caaaauuuccaguaccuuu

SEQ ID NO: 3862776 - RNA, 20 nt, Human
caaaauuuccaguaccuuug

SEQ ID NO: 3862777 - RNA, 14 nt, Human
caaaauuucuauua

SEQ ID NO: 3862778 - RNA, 14 nt, Human
caaaauuugacuaa

SEQ ID NO: 3862779 - RNA, 13 nt, Human
caaaauuuguuug

SEQ ID NO: 3862780 - RNA, 12 nt, Human
caaaauuuuaaa

SEQ ID NO: 3862781 - RNA, 23 nt, Human
caaaauuuuauaagcaaauuuca

SEQ ID NO: 3862782 - RNA, 13 nt, Human
caaaauuuuauuc

SEQ ID NO: 3862783 - RNA, 23 nt, Human
caaaauuuuucaaccccacccug

SEQ ID NO: 3862784 - RNA, 16 nt, Human
caaaauuuuuucucua

SEQ ID NO: 3862785 - RNA, 16 nt, Human
caaaauuuuuuuaauc

SEQ ID NO: 3862786 - RNA, 21 nt, Human
caaacaaaaagguucucaggu

SEQ ID NO: 3862787 - RNA, 21 nt, Human
caaacaaaagcugaacacauu

SEQ ID NO: 3862788 - RNA, 15 nt, Human
caaacaaaauuucua

SEQ ID NO: 3862789 - RNA, 18 nt, Human
caaacaaaauuucuauua

SEQ ID NO: 3862790 - RNA, 15 nt, Human
caaacaaauaugcaa

SEQ ID NO: 3862791 - RNA, 17 nt, Human
caaacaagaaugucccu

SEQ ID NO: 3862792 - RNA, 13 nt, Human
caaacaauaccug

SEQ ID NO: 3862793 - RNA, 19 nt, Human
caaacaaugacaaagcaga

SEQ ID NO: 3862794 - RNA, 17 nt, Human
caaacaauggaaacuga

SEQ ID NO: 3862795 - RNA, 20 nt, Human
caaacaauggaaacugaaug

SEQ ID NO: 3862796 - RNA, 21 nt, Human
caaacaauggaaacugaaugc

SEQ ID NO: 3862797 - RNA, 14 nt, Human
caaacacaaaugca

SEQ ID NO: 3862798 - RNA, 15 nt, Human
caaacacacagaagg

SEQ ID NO: 3862799 - RNA, 21 nt, Human
caaacacaguuacacuugugc

SEQ ID NO: 3862800 - RNA, 14 nt, Human
caaacacauuguua

SEQ ID NO: 3862801 - RNA, 17 nt, Human
caaacacauuguuauuu

SEQ ID NO: 3862802 - RNA, 15 nt, Human
caaacaccucccagg

SEQ ID NO: 3862803 - RNA, 14 nt, Human
caaacaccugcuga

SEQ ID NO: 3862804 - RNA, 14 nt, Human
caaacaccuuccag

SEQ ID NO: 3862805 - RNA, 21 nt, Human
caaacaccuuccagcuccugu

SEQ ID NO: 3862806 - RNA, 11 nt, Human
caaaguggaac

SEQ ID NO: 3862807 - RNA, 15 nt, Human
caaaguggaacgaaa

SEQ ID NO: 3862808 - RNA, 14 nt, Human
caaaguggaaggaa

SEQ ID NO: 3862809 - RNA, 17 nt, Human
caaaguggaaggaaaga

SEQ ID NO: 3862810 - RNA, 22 nt, Human
caaagugguagguacuuuuugu

SEQ ID NO: 3862811 - RNA, 16 nt, Human
caaaguggugagaggc

SEQ ID NO: 3862812 - RNA, 19 nt, Human
caaaguggugagaggcauc

SEQ ID NO: 3862813 - RNA, 17 nt, Human
caaaguguguauuaaaa

SEQ ID NO: 3862814 - RNA, 18 nt, Human
caaaguguuuucucugaa

SEQ ID NO: 3862815 - RNA, 17 nt, Human
caaaguuagagaacuaa

SEQ ID NO: 3862816 - RNA, 24 nt, Human
caaaguuagagaacuaaacuaguu

SEQ ID NO: 3862817 - RNA, 18 nt, Human
caaaguugccuaaaucca

SEQ ID NO: 3862818 - RNA, 17 nt, Human
caaaguuggggcaggcu

SEQ ID NO: 3862819 - RNA, 13 nt, Human
caaaguuuaauaa

SEQ ID NO: 3862820 - RNA, 14 nt, Human
caaaguuuugaaaa

SEQ ID NO: 3862821 - RNA, 17 nt, Human
caaaguuuugaaaagcu

SEQ ID NO: 3862822 - RNA, 18 nt, Human
caaaguuuugaaaagcua

SEQ ID NO: 3862823 - RNA, 21 nt, Human
caaaguuuugaaaagcuauua

SEQ ID NO: 3862824 - RNA, 19 nt, Human
caaauaaaaacuaaauugu

SEQ ID NO: 3862825 - RNA, 21 nt, Human
caaauaaaaacuaaauuguaa

SEQ ID NO: 3862826 - RNA, 17 nt, Human
caaauaaaaagugcuuu

SEQ ID NO: 3862827 - RNA, 11 nt, Human
caaauaaacac

SEQ ID NO: 3862828 - RNA, 13 nt, Human
caaauaaacacug

SEQ ID NO: 3862829 - RNA, 17 nt, Human
caaauaaagucccaggu

SEQ ID NO: 3862830 - RNA, 14 nt, Human
caaauaacaacuuu

SEQ ID NO: 3862831 - RNA, 17 nt, Human
caaauaacuucaguccu

SEQ ID NO: 3862832 - RNA, 14 nt, Human
caaauaagaaauaa

SEQ ID NO: 3862833 - RNA, 16 nt, Human
caaauaaguauuuaua

SEQ ID NO: 3862834 - RNA, 17 nt, Human
caaauaaguauuuauaa

SEQ ID NO: 3862835 - RNA, 18 nt, Human
caaauaauaccuuagaag

SEQ ID NO: 3862836 - RNA, 19 nt, Human
caaauaauaccuuagaagg

SEQ ID NO: 3862837 - RNA, 22 nt, Human
caaauaauauguuuccuucccu

SEQ ID NO: 3862838 - RNA, 20 nt, Human
caaauaaugucucugugaga

SEQ ID NO: 3862839 - RNA, 16 nt, Human
caaauaauuuuagugu

SEQ ID NO: 3862840 - RNA, 13 nt, Human
caaauacacauuu

SEQ ID NO: 3862841 - RNA, 14 nt, Human
caaauacacauuug

SEQ ID NO: 3862842 - RNA, 16 nt, Human
caaauacacauuugcu

SEQ ID NO: 3862843 - RNA, 17 nt, Human
caaauacacauuugcua

SEQ ID NO: 3862844 - RNA, 13 nt, Human
caaauacauuuua

SEQ ID NO: 3862845 - RNA, 20 nt, Human
caaauacgugggcauucaaa

SEQ ID NO: 3862846 - RNA, 21 nt, Human
caaauacgugggcauucaaau

SEQ ID NO: 3862847 - RNA, 15 nt, Human
caaauacuaaaaaga

SEQ ID NO: 3862848 - RNA, 17 nt, Human
caaauacucauguguau

SEQ ID NO: 3862849 - RNA, 14 nt, Human
caaauacucuuagg

SEQ ID NO: 3862850 - RNA, 15 nt, Human
caaauacuuauucau

SEQ ID NO: 3862851 - RNA, 17 nt, Human
caaauacuuauucauug

SEQ ID NO: 3862852 - RNA, 20 nt, Human
caaauacuuuaauguauaaa

SEQ ID NO: 3862853 - RNA, 13 nt, Human
caaauagaaaaca

SEQ ID NO: 3862854 - RNA, 17 nt, Human
caaauagaaaacaggaa

SEQ ID NO: 3862855 - RNA, 15 nt, Human
caaauagcacuugac

SEQ ID NO: 3862856 - RNA, 15 nt, Human
caaauagcauaaguu

SEQ ID NO: 3862857 - RNA, 18 nt, Human
caaauaggaugcuuggga

SEQ ID NO: 3862858 - RNA, 17 nt, Human
caaauaggcuauuaaaa

SEQ ID NO: 3862859 - RNA, 23 nt, Human
caaauaggcuauuaaaaaagucu

SEQ ID NO: 3862860 - RNA, 23 nt, Human
caaauaguaggcaagauggcaca

SEQ ID NO: 3862861 - RNA, 15 nt, Human
caaauagugcucgcu

SEQ ID NO: 3862862 - RNA, 12 nt, Human
caaauaguguga

SEQ ID NO: 3862863 - RNA, 15 nt, Human
caaauagugugaaau

SEQ ID NO: 3862864 - RNA, 19 nt, Human
caaauaguugcauagcagu

SEQ ID NO: 3862865 - RNA, 18 nt, Human
caaauauaagaauaaaau

SEQ ID NO: 3862866 - RNA, 15 nt, Human
caaauauaagauuuu

SEQ ID NO: 3862867 - RNA, 18 nt, Human
caaauauaagauuuucug

SEQ ID NO: 3862868 - RNA, 15 nt, Human
caaauauauucucuu

SEQ ID NO: 3862869 - RNA, 11 nt, Human
caaauauauug

SEQ ID NO: 3862870 - RNA, 14 nt, Human
caaauauauuguua

SEQ ID NO: 3862871 - RNA, 12 nt, Human
caaauaugcaaa

SEQ ID NO: 3862872 - RNA, 16 nt, Human
caaauaugcaaagcac

SEQ ID NO: 3862873 - RNA, 17 nt, Human
caaauaugcaaagcacu

SEQ ID NO: 3862874 - RNA, 23 nt, Human
caaauauuagaugugauuuaaua

SEQ ID NO: 3862875 - RNA, 16 nt, Human
caaauauugguguugu

SEQ ID NO: 3862876 - RNA, 23 nt, Human
caaauauuguugacaacugugac

SEQ ID NO: 3862877 - RNA, 13 nt, Human
caaauauuuggag

SEQ ID NO: 3862878 - RNA, 13 nt, Human
caaaucaaagcag

SEQ ID NO: 3862879 - RNA, 14 nt, Human
caaaucaaagcaga

SEQ ID NO: 3862880 - RNA, 19 nt, Human
caaaucaacagaagcauuu

SEQ ID NO: 3862881 - RNA, 21 nt, Human
caaaucaacagaagcauuugu

SEQ ID NO: 3862882 - RNA, 20 nt, Human
caaaucaaucuguaaaacua

SEQ ID NO: 3862883 - RNA, 16 nt, Human
caaaucaauucuaguc

SEQ ID NO: 3862884 - RNA, 19 nt, Human
caaaucacauauuuuaaaa

SEQ ID NO: 3862885 - RNA, 14 nt, Human
caaaucaccacaaa

SEQ ID NO: 3862886 - RNA, 15 nt, Human
caaaucaccacaaac

SEQ ID NO: 3862887 - RNA, 13 nt, Human
caaaucagccaug

SEQ ID NO: 3862888 - RNA, 16 nt, Human
caaaucaggcuuuugu

SEQ ID NO: 3862889 - RNA, 22 nt, Human
caaaucaguuacuaagaagaaa

SEQ ID NO: 3862890 - RNA, 14 nt, Human
caaauccaggaccc

SEQ ID NO: 3862891 - RNA, 21 nt, Human
caaauccaggacccugccagg

SEQ ID NO: 3862892 - RNA, 15 nt, Human
caaauccgaaaucag

SEQ ID NO: 3862893 - RNA, 16 nt, Human
caaauccgaaccuccu

SEQ ID NO: 3862894 - RNA, 16 nt, Human
caaauccgcucucuuc

SEQ ID NO: 3862895 - RNA, 13 nt, Human
caaauccuaugug

SEQ ID NO: 3862896 - RNA, 18 nt, Human
caaauccuaugugauuuu

SEQ ID NO: 3862897 - RNA, 23 nt, Human
caaauccuaugugauuuuaacuc

SEQ ID NO: 3862898 - RNA, 13 nt, Human
caaauccucucca

SEQ ID NO: 3862899 - RNA, 18 nt, Human
caaauccugcauuuagau

SEQ ID NO: 3862900 - RNA, 14 nt, Human
caaaucgaaugaaa

SEQ ID NO: 3862901 - RNA, 19 nt, Human
caaaucguccagcgaccuu

SEQ ID NO: 3862902 - RNA, 23 nt, Human
caaaucuaagggaaaaagccuug

SEQ ID NO: 3862903 - RNA, 20 nt, Human
caaaucuauucagacaagca

SEQ ID NO: 3862904 - RNA, 13 nt, Human
caaaucugucugc

SEQ ID NO: 3862905 - RNA, 14 nt, Human
caaaucugucugcu

SEQ ID NO: 3862906 - RNA, 17 nt, Human
caaaucuguguauauua

SEQ ID NO: 3862907 - RNA, 13 nt, Human
caaaucuuccugg

SEQ ID NO: 3862908 - RNA, 21 nt, Human
caaaucuuggcaauauuccuu

SEQ ID NO: 3862909 - RNA, 22 nt, Human
caaaucuuggcaauauuccuua

SEQ ID NO: 3862910 - RNA, 19 nt, Human
caaaugaaauauauuuaaa

SEQ ID NO: 3862911 - RNA, 20 nt, Human
caaaugaaauauauuuaaaa

SEQ ID NO: 3862912 - RNA, 18 nt, Human
caaaugaauaaugccuuu

SEQ ID NO: 3862913 - RNA, 19 nt, Human
caaaugaaugaccuuguug

SEQ ID NO: 3862914 - RNA, 10 nt, Human
caaaugaauu

SEQ ID NO: 3862915 - RNA, 10 nt, Human
caaaugacau

SEQ ID NO: 3862916 - RNA, 19 nt, Human
caaaugacaugcacugacc

SEQ ID NO: 3862917 - RNA, 20 nt, Human
caaaugacaugcacugaccc

SEQ ID NO: 3862918 - RNA, 16 nt, Human
caaaugacuuuauuau

SEQ ID NO: 3862919 - RNA, 17 nt, Human
caaaugacuuuauuauu

SEQ ID NO: 3862920 - RNA, 17 nt, Human
caaaugagacagcaguc

SEQ ID NO: 3862921 - RNA, 12 nt, Human
caaaugagccau

SEQ ID NO: 3862922 - RNA, 21 nt, Human
caaaugagcucugaaaucuuc

SEQ ID NO: 3862923 - RNA, 18 nt, Human
caaaugaguaacauuugc

SEQ ID NO: 3862924 - RNA, 19 nt, Human
caaaugaguaacauuugcu

SEQ ID NO: 3862925 - RNA, 14 nt, Human
caaaugauugcuuu

SEQ ID NO: 3862926 - RNA, 15 nt, Human
caaaugauugcuuuu

SEQ ID NO: 3862927 - RNA, 20 nt, Human
caaaugcagggauugcugcc

SEQ ID NO: 3862928 - RNA, 16 nt, Human
caaaugcaguauauuu

SEQ ID NO: 3862929 - RNA, 16 nt, Human
caaaugcaucuuugau

SEQ ID NO: 3862930 - RNA, 17 nt, Human
caaaugcaucuuugaug

SEQ ID NO: 3862931 - RNA, 21 nt, Human
caaaugcaucuuugauguguu

SEQ ID NO: 3862932 - RNA, 17 nt, Human
caaaugcaugaacaagu

SEQ ID NO: 3862933 - RNA, 18 nt, Human
caaaugcccaagggaaag

SEQ ID NO: 3862934 - RNA, 21 nt, Human
caaaugcuaaugucaaacuug

SEQ ID NO: 3862935 - RNA, 13 nt, Human
caaaugcuauuaa

SEQ ID NO: 3862936 - RNA, 19 nt, Human
caaaugcugcgcccuuccc

SEQ ID NO: 3862937 - RNA, 14 nt, Human
caaauggaaacaga

SEQ ID NO: 3862938 - RNA, 20 nt, Human
caaauggaaacagaggacca

SEQ ID NO: 3862939 - RNA, 21 nt, Human
caaauggaaacagaggaccag

SEQ ID NO: 3862940 - RNA, 13 nt, Human
caaauggaaagga

SEQ ID NO: 3862941 - RNA, 22 nt, Human
caaauggaaaguaacucauuug

SEQ ID NO: 3862942 - RNA, 21 nt, Human
caaauggaaaugggcagagca

SEQ ID NO: 3862943 - RNA, 19 nt, Human
caaauggaagacacauuga

SEQ ID NO: 3862944 - RNA, 19 nt, Human
caaauggagaagcugcagg

SEQ ID NO: 3862945 - RNA, 18 nt, Human
caaauggaguuggaguuc

SEQ ID NO: 3862946 - RNA, 22 nt, Human
caaauggcgucuggaaguccaa

SEQ ID NO: 3862947 - RNA, 21 nt, Human
caaaugggcgccccccccucc

SEQ ID NO: 3862948 - RNA, 17 nt, Human
caaauggggccagaucc

SEQ ID NO: 3862949 - RNA, 19 nt, Human
caaauggggccagauccag

SEQ ID NO: 3862950 - RNA, 13 nt, Human
caaaugguaggca

SEQ ID NO: 3862951 - RNA, 15 nt, Human
caaaugguaggcauu

SEQ ID NO: 3862952 - RNA, 17 nt, Human
cacaaagacccuggcuu

SEQ ID NO: 3862953 - RNA, 20 nt, Human
cacaaagacccuggcuuuca

SEQ ID NO: 3862954 - RNA, 12 nt, Human
cacaaagagagu

SEQ ID NO: 3862955 - RNA, 22 nt, Human
cacaaagagaguuaaucaacug

SEQ ID NO: 3862956 - RNA, 22 nt, Human
cacaaagaugggugaaggcugg

SEQ ID NO: 3862957 - RNA, 12 nt, Human
cacaaagcccaa

SEQ ID NO: 3862958 - RNA, 20 nt, Human
cacaaagccuuaucaagugu

SEQ ID NO: 3862959 - RNA, 17 nt, Human
cacaaaggccaaacugc

SEQ ID NO: 3862960 - RNA, 21 nt, Human
cacaaaggccaaacugcugga

SEQ ID NO: 3862961 - RNA, 16 nt, Human
cacaaagggcccagau

SEQ ID NO: 3862962 - RNA, 22 nt, Human
cacaaaggggaucauaaaguua

SEQ ID NO: 3862963 - RNA, 10 nt, Human
cacaaauaaa

SEQ ID NO: 3862964 - RNA, 12 nt, Human
cacaaauaaaau

SEQ ID NO: 3862965 - RNA, 13 nt, Human
cacaaauaacaag

SEQ ID NO: 3862966 - RNA, 13 nt, Human
cacaaauauuaaa

SEQ ID NO: 3862967 - RNA, 20 nt, Human
cacaaauauuaaaaagucuu

SEQ ID NO: 3862968 - RNA, 14 nt, Human
cacaaauauuauuu

SEQ ID NO: 3862969 - RNA, 23 nt, Human
cacaaauauuuauuuucuuucug

SEQ ID NO: 3862970 - RNA, 15 nt, Human
cacaaaugcucaaag

SEQ ID NO: 3862971 - RNA, 13 nt, Human
cacaaauuaguua

SEQ ID NO: 3862972 - RNA, 15 nt, Human
cacaaauuaucuuaa

SEQ ID NO: 3862973 - RNA, 11 nt, Human
cacaacaaaaa

SEQ ID NO: 3862974 - RNA, 15 nt, Human
cacaacauuugcaga

SEQ ID NO: 3862975 - RNA, 16 nt, Human
cacaaccagccaggca

SEQ ID NO: 3862976 - RNA, 23 nt, Human
cacaaccaucugucccugccuca

SEQ ID NO: 3862977 - RNA, 14 nt, Human
cacaacgugcauug

SEQ ID NO: 3862978 - RNA, 13 nt, Human
cacaacuauauug

SEQ ID NO: 3862979 - RNA, 19 nt, Human
cacaacuauuuuuccaaaa

SEQ ID NO: 3862980 - RNA, 17 nt, Human
cacaacugacacaggaa

SEQ ID NO: 3862981 - RNA, 23 nt, Human
cacaacugcaauaacuucugacc

SEQ ID NO: 3862982 - RNA, 22 nt, Human
cacaacugugugauuaaaaggu

SEQ ID NO: 3862983 - RNA, 20 nt, Human
cacaacuuguuuuugguuuu

SEQ ID NO: 3862984 - RNA, 21 nt, Human
cacaagaaaugaaagcaggga

SEQ ID NO: 3862985 - RNA, 20 nt, Human
cacaagagcccagcagggcc

SEQ ID NO: 3862986 - RNA, 16 nt, Human
cacaagagcccaggcc

SEQ ID NO: 3862987 - RNA, 17 nt, Human
cacaagagcccaggccu

SEQ ID NO: 3862988 - RNA, 18 nt, Human
cacaagagcccaggccuc

SEQ ID NO: 3862989 - RNA, 14 nt, Human
cacaagauucccag

SEQ ID NO: 3862990 - RNA, 12 nt, Human
cacaagccaggg

SEQ ID NO: 3862991 - RNA, 15 nt, Human
cacaagccucugccc

SEQ ID NO: 3862992 - RNA, 12 nt, Human
cacaagccugag

SEQ ID NO: 3862993 - RNA, 15 nt, Human
cacaagccugaggga

SEQ ID NO: 3862994 - RNA, 14 nt, Human
cacaagcuccaagc

SEQ ID NO: 3862995 - RNA, 18 nt, Human
cacaagcuccaagcuccc

SEQ ID NO: 3862996 - RNA, 23 nt, Human
cacaagcugcacccucaggcagg

SEQ ID NO: 3862997 - RNA, 22 nt, Human
cacaagcugccucccuguccac

SEQ ID NO: 3862998 - RNA, 12 nt, Human
cacaagcuggaa

SEQ ID NO: 3862999 - RNA, 14 nt, Human
cacaagcuggaagc

SEQ ID NO: 3863000 - RNA, 15 nt, Human
cacaagcuggaagca

SEQ ID NO: 3863001 - RNA, 17 nt, Human
cacaaggaaauaaaauu

SEQ ID NO: 3863002 - RNA, 15 nt, Human
cacaaggaagaaauu

SEQ ID NO: 3863003 - RNA, 18 nt, Human
cacaaggauagaugcugg

SEQ ID NO: 3863004 - RNA, 21 nt, Human
cacaaggauagaugcuggccc

SEQ ID NO: 3863005 - RNA, 16 nt, Human
cacaaggauugaaaau

SEQ ID NO: 3863006 - RNA, 18 nt, Human
cacaaggcagcaaggccc

SEQ ID NO: 3863007 - RNA, 14 nt, Human
cacaaggcugacca

SEQ ID NO: 3863008 - RNA, 12 nt, Human
cacaagggcucu

SEQ ID NO: 3863009 - RNA, 17 nt, Human
cacaaggggcccuugga

SEQ ID NO: 3863010 - RNA, 17 nt, Human
cacaaggugcaaaucaa

SEQ ID NO: 3863011 - RNA, 20 nt, Human
cacaaggugcaaaucaaugc

SEQ ID NO: 3863012 - RNA, 23 nt, Human
cacaaguaagagacucagccugc

SEQ ID NO: 3863013 - RNA, 13 nt, Human
cacaagucuucca

SEQ ID NO: 3863014 - RNA, 14 nt, Human
cacaagucuuccag

SEQ ID NO: 3863015 - RNA, 22 nt, Human
cacaagugccacugcccgagcu

SEQ ID NO: 3863016 - RNA, 19 nt, Human
cacaagugccgcaaauugu

SEQ ID NO: 3863017 - RNA, 21 nt, Human
cacaagugccgcaaauuguac

SEQ ID NO: 3863018 - RNA, 19 nt, Human
cacaagugcucaucuguug

SEQ ID NO: 3863019 - RNA, 17 nt, Human
cacaaguguaaugaaua

SEQ ID NO: 3863020 - RNA, 17 nt, Human
cacaaguuaagauucuu

SEQ ID NO: 3863021 - RNA, 19 nt, Human
cacaaguuaagauucuugg

SEQ ID NO: 3863022 - RNA, 18 nt, Human
cacaauaaaaauguuuaa

SEQ ID NO: 3863023 - RNA, 19 nt, Human
cacaauaaauguauucaaa

SEQ ID NO: 3863024 - RNA, 13 nt, Human
cacaauacaauaa

SEQ ID NO: 3863025 - RNA, 19 nt, Human
cacaauacagauaacauua

SEQ ID NO: 3863026 - RNA, 12 nt, Human
cacaauaugaau

SEQ ID NO: 3863027 - RNA, 15 nt, Human
cacaauauugaacuu

SEQ ID NO: 3863028 - RNA, 15 nt, Human
cacaaucccuuucua

SEQ ID NO: 3863029 - RNA, 19 nt, Human
cacaaucucggcucacugc

SEQ ID NO: 3863030 - RNA, 20 nt, Human
cacaaucuuaaggggcagcu

SEQ ID NO: 3863031 - RNA, 14 nt, Human
cacaaugucuuggu

SEQ ID NO: 3863032 - RNA, 22 nt, Human
cacaauugaauuaguuuuuucu

SEQ ID NO: 3863033 - RNA, 15 nt, Human
cacacaaaaaaagac

SEQ ID NO: 3863034 - RNA, 19 nt, Human
cacacaaaaaaagaccugu

SEQ ID NO: 3863035 - RNA, 23 nt, Human
cacacaaaagggaacccagcucu

SEQ ID NO: 3863036 - RNA, 15 nt, Human
cacacaaacaaggcc

SEQ ID NO: 3863037 - RNA, 17 nt, Human
cacacaaagagaguuaa

SEQ ID NO: 3863038 - RNA, 13 nt, Human
cacacaaagguau

SEQ ID NO: 3863039 - RNA, 15 nt, Human
cacacaacagccaac

SEQ ID NO: 3863040 - RNA, 16 nt, Human
cacacaagaagaaggg

SEQ ID NO: 3863041 - RNA, 17 nt, Human
cacacacaaaaaaagac

SEQ ID NO: 3863042 - RNA, 19 nt, Human
cacacacaaaagggaaccc

SEQ ID NO: 3863043 - RNA, 15 nt, Human
cacacacaaaauaaa

SEQ ID NO: 3863044 - RNA, 13 nt, Human
cacacacaaagag

SEQ ID NO: 3863045 - RNA, 14 nt, Human
cacacacaaagaga

SEQ ID NO: 3863046 - RNA, 20 nt, Human
cacacacaacagccaacagc

SEQ ID NO: 3863047 - RNA, 10 nt, Human
cacacacaca

SEQ ID NO: 3863048 - RNA, 14 nt, Human
cacacacacacaag

SEQ ID NO: 3863049 - RNA, 13 nt, Human
cacacacacacac

SEQ ID NO: 3863050 - RNA, 16 nt, Human
cacacacacacacaca

SEQ ID NO: 3863051 - RNA, 15 nt, Human
cacacacacacacau

SEQ ID NO: 3863052 - RNA, 16 nt, Human
cacacacacacacaug

SEQ ID NO: 3863053 - RNA, 15 nt, Human
cacacacacacagcc

SEQ ID NO: 3863054 - RNA, 14 nt, Human
cacacacacacagg

SEQ ID NO: 3863055 - RNA, 15 nt, Human
cacacacacacaugc

SEQ ID NO: 3863056 - RNA, 12 nt, Human
cacacacacaga

SEQ ID NO: 3863057 - RNA, 13 nt, Human
cacacacacagaa

SEQ ID NO: 3863058 - RNA, 14 nt, Human
cacacacacagaaa

SEQ ID NO: 3863059 - RNA, 15 nt, Human
cacacacacagccac

SEQ ID NO: 3863060 - RNA, 13 nt, Human
cacacacacagga

SEQ ID NO: 3863061 - RNA, 12 nt, Human
cacacacacauc

SEQ ID NO: 3863062 - RNA, 19 nt, Human
cacacacagaaaauauacu

SEQ ID NO: 3863063 - RNA, 21 nt, Human
cacacacagaaaauauacugu

SEQ ID NO: 3863064 - RNA, 11 nt, Human
cacacacagcc

SEQ ID NO: 3863065 - RNA, 16 nt, Human
cacacacagccacaca

SEQ ID NO: 3863066 - RNA, 15 nt, Human
cacacacaggagcau

SEQ ID NO: 3863067 - RNA, 13 nt, Human
cacacacaggcaa

SEQ ID NO: 3863068 - RNA, 21 nt, Human
cacacacaggcaacugaggca

SEQ ID NO: 3863069 - RNA, 12 nt, Human
cacacacauaca

SEQ ID NO: 3863070 - RNA, 13 nt, Human
cacacacauagau

SEQ ID NO: 3863071 - RNA, 12 nt, Human
cacacacaugca

SEQ ID NO: 3863072 - RNA, 16 nt, Human
cacacacaugcauaca

SEQ ID NO: 3863073 - RNA, 18 nt, Human
cacacacaugcuaggaug

SEQ ID NO: 3863074 - RNA, 22 nt, Human
cacacacauugcugugaacagg

SEQ ID NO: 3863075 - RNA, 16 nt, Human
cacacaccagagccca

SEQ ID NO: 3863076 - RNA, 20 nt, Human
cacacaccagagcccaccuu

SEQ ID NO: 3863077 - RNA, 14 nt, Human
cacacacgcacaua

SEQ ID NO: 3863078 - RNA, 14 nt, Human
cacacacgcacgca

SEQ ID NO: 3863079 - RNA, 17 nt, Human
cacacacgcgugcacac

SEQ ID NO: 3863080 - RNA, 19 nt, Human
cacacacgcuuucuuaugc

SEQ ID NO: 3863081 - RNA, 20 nt, Human
cacacacucgcccgcccacu

SEQ ID NO: 3863082 - RNA, 23 nt, Human
cacacacugugcuuucuauugua

SEQ ID NO: 3863083 - RNA, 13 nt, Human
cacacagaaaaua

SEQ ID NO: 3863084 - RNA, 14 nt, Human
cacacagaaaauau

SEQ ID NO: 3863085 - RNA, 16 nt, Human
cacacagaaaauauac

SEQ ID NO: 3863086 - RNA, 21 nt, Human
cacacagaaaauauacuguaa

SEQ ID NO: 3863087 - RNA, 15 nt, Human
cacacagaaacucuu

SEQ ID NO: 3863088 - RNA, 14 nt, Human
cacacagaaauaua

SEQ ID NO: 3863089 - RNA, 16 nt, Human
cacacagaaauauaua

SEQ ID NO: 3863090 - RNA, 15 nt, Human
cacacagacuauuuu

SEQ ID NO: 3863091 - RNA, 21 nt, Human
cacacagaggcugccucuccc

SEQ ID NO: 3863092 - RNA, 11 nt, Human
cacacagccac

SEQ ID NO: 3863093 - RNA, 15 nt, Human
cacacagccacacac

SEQ ID NO: 3863094 - RNA, 19 nt, Human
cacacagccacacacacag

SEQ ID NO: 3863095 - RNA, 15 nt, Human
cacacagccaggugc

SEQ ID NO: 3863096 - RNA, 19 nt, Human
cacacagccaggugccuug

SEQ ID NO: 3863097 - RNA, 12 nt, Human
cacacagcucug

SEQ ID NO: 3863098 - RNA, 15 nt, Human
cacacagcucugucc

SEQ ID NO: 3863099 - RNA, 22 nt, Human
cacagcuguucuucuguucugc

SEQ ID NO: 3863100 - RNA, 15 nt, Human
cacagcuuagauuuc

SEQ ID NO: 3863101 - RNA, 17 nt, Human
cacagcuucagccagga

SEQ ID NO: 3863102 - RNA, 22 nt, Human
cacagcuucagccaggagcugg

SEQ ID NO: 3863103 - RNA, 21 nt, Human
cacagcuucauuuccuguguc

SEQ ID NO: 3863104 - RNA, 14 nt, Human
cacagcuuccccuc

SEQ ID NO: 3863105 - RNA, 22 nt, Human
cacagcuuccccucucuccucc

SEQ ID NO: 3863106 - RNA, 15 nt, Human
cacagcuuccugucc

SEQ ID NO: 3863107 - RNA, 20 nt, Human
cacagcuuuaucaccagaga

SEQ ID NO: 3863108 - RNA, 16 nt, Human
cacaggaaaagaauuu

SEQ ID NO: 3863109 - RNA, 12 nt, Human
cacaggaaaagg

SEQ ID NO: 3863110 - RNA, 19 nt, Human
cacaggacagggguuccuu

SEQ ID NO: 3863111 - RNA, 23 nt, Human
cacaggacaugcgguagccagca

SEQ ID NO: 3863112 - RNA, 16 nt, Human
cacaggacccccuucc

SEQ ID NO: 3863113 - RNA, 17 nt, Human
cacaggacccccuuccc

SEQ ID NO: 3863114 - RNA, 21 nt, Human
cacaggacugauucugggaug

SEQ ID NO: 3863115 - RNA, 15 nt, Human
cacaggaggcaagca

SEQ ID NO: 3863116 - RNA, 20 nt, Human
cacaggaggcaagcaagcuc

SEQ ID NO: 3863117 - RNA, 21 nt, Human
cacaggaggcaggcauggccc

SEQ ID NO: 3863118 - RNA, 18 nt, Human
cacaggagugggaaaaca

SEQ ID NO: 3863119 - RNA, 20 nt, Human
cacaggaguguccucuuccc

SEQ ID NO: 3863120 - RNA, 14 nt, Human
cacaggauagauaa

SEQ ID NO: 3863121 - RNA, 15 nt, Human
cacaggaucagucug

SEQ ID NO: 3863122 - RNA, 16 nt, Human
cacaggaucagucuga

SEQ ID NO: 3863123 - RNA, 17 nt, Human
cacaggaucagucugau

SEQ ID NO: 3863124 - RNA, 24 nt, Human
cacaggauccuauucucaccagga

SEQ ID NO: 3863125 - RNA, 23 nt, Human
cacaggaugaggugguggagugg

SEQ ID NO: 3863126 - RNA, 16 nt, Human
cacaggaugcuguguu

SEQ ID NO: 3863127 - RNA, 16 nt, Human
cacaggcaaaauccuu

SEQ ID NO: 3863128 - RNA, 13 nt, Human
cacaggcaacuga

SEQ ID NO: 3863129 - RNA, 19 nt, Human
cacaggcaacugaggcaga

SEQ ID NO: 3863130 - RNA, 10 nt, Human
cacaggcagc

SEQ ID NO: 3863131 - RNA, 15 nt, Human
cacaggcagcauuua

SEQ ID NO: 3863132 - RNA, 11 nt, Human
cacaggcagcc

SEQ ID NO: 3863133 - RNA, 15 nt, Human
cacaggcagccagug

SEQ ID NO: 3863134 - RNA, 16 nt, Human
cacaggcagcuggaug

SEQ ID NO: 3863135 - RNA, 18 nt, Human
cacaggcagggcaggacc

SEQ ID NO: 3863136 - RNA, 15 nt, Human
cacaggcauuuccug

SEQ ID NO: 3863137 - RNA, 23 nt, Human
cacaggcauuuccuggguggcua

SEQ ID NO: 3863138 - RNA, 18 nt, Human
cacaggccacccugugca

SEQ ID NO: 3863139 - RNA, 13 nt, Human
cacaggcccccuu

SEQ ID NO: 3863140 - RNA, 18 nt, Human
cacaggcccggcuccagg

SEQ ID NO: 3863141 - RNA, 23 nt, Human
cacaggcccggcuccaggcuccu

SEQ ID NO: 3863142 - RNA, 13 nt, Human
cacaggcccuccc

SEQ ID NO: 3863143 - RNA, 16 nt, Human
cacaggcccuuccucu

SEQ ID NO: 3863144 - RNA, 17 nt, Human
cacaggcccuuccucuc

SEQ ID NO: 3863145 - RNA, 21 nt, Human
cacaggcccuuccucuccacu

SEQ ID NO: 3863146 - RNA, 22 nt, Human
cacaggcccuuccucuccacug

SEQ ID NO: 3863147 - RNA, 21 nt, Human
cacaggccuguguagcuguga

SEQ ID NO: 3863148 - RNA, 22 nt, Human
cacaggcugggcugggcacugc

SEQ ID NO: 3863149 - RNA, 19 nt, Human
cacagggaagagcuccccu

SEQ ID NO: 3863150 - RNA, 16 nt, Human
cacagggacuugaagu

SEQ ID NO: 3863151 - RNA, 15 nt, Human
cacagggauccgacu

SEQ ID NO: 3863152 - RNA, 20 nt, Human
cacagggauucucacaauag

SEQ ID NO: 3863153 - RNA, 22 nt, Human
cacagggcagcugggcccaacc

SEQ ID NO: 3863154 - RNA, 21 nt, Human
cacagggcaguaccugagggu

SEQ ID NO: 3863155 - RNA, 14 nt, Human
cacagggccccaga

SEQ ID NO: 3863156 - RNA, 22 nt, Human
cacagggccccagaaggcaggg

SEQ ID NO: 3863157 - RNA, 15 nt, Human
cacagggccuggccc

SEQ ID NO: 3863158 - RNA, 16 nt, Human
cacagggccuggccca

SEQ ID NO: 3863159 - RNA, 18 nt, Human
cacagggccuggcccaug

SEQ ID NO: 3863160 - RNA, 13 nt, Human
cacagggcgagac

SEQ ID NO: 3863161 - RNA, 17 nt, Human
cacagggucccacagcc

SEQ ID NO: 3863162 - RNA, 19 nt, Human
cacagggucugcucuuucu

SEQ ID NO: 3863163 - RNA, 23 nt, Human
cacagggucugcucuuucucugc

SEQ ID NO: 3863164 - RNA, 16 nt, Human
cacaggguugggccca

SEQ ID NO: 3863165 - RNA, 13 nt, Human
cacaggucaggcu

SEQ ID NO: 3863166 - RNA, 14 nt, Human
cacaggucccaaau

SEQ ID NO: 3863167 - RNA, 22 nt, Human
cacaggucccaccuccagcccg

SEQ ID NO: 3863168 - RNA, 18 nt, Human
cacagguggugucacugu

SEQ ID NO: 3863169 - RNA, 13 nt, Human
cacaggugucagc

SEQ ID NO: 3863170 - RNA, 16 nt, Human
cacaggugucagccau

SEQ ID NO: 3863171 - RNA, 21 nt, Human
cacagguguccccagcccacu

SEQ ID NO: 3863172 - RNA, 19 nt, Human
cacagguucaugccaccau

SEQ ID NO: 3863173 - RNA, 15 nt, Human
cacagguuggaagag

SEQ ID NO: 3863174 - RNA, 16 nt, Human
cacagguuggaagaga

SEQ ID NO: 3863175 - RNA, 18 nt, Human
cacagguuggaagagaau

SEQ ID NO: 3863176 - RNA, 20 nt, Human
cacagguuggaagagaauca

SEQ ID NO: 3863177 - RNA, 13 nt, Human
cacaguagaacug

SEQ ID NO: 3863178 - RNA, 14 nt, Human
cacaguagagccag

SEQ ID NO: 3863179 - RNA, 15 nt, Human
cacaguagagccagc

SEQ ID NO: 3863180 - RNA, 13 nt, Human
cacaguauauuuu

SEQ ID NO: 3863181 - RNA, 20 nt, Human
cacaguauuacuucugcuac

SEQ ID NO: 3863182 - RNA, 15 nt, Human
cacaguauugcucac

SEQ ID NO: 3863183 - RNA, 19 nt, Human
cacaguauugcucacccag

SEQ ID NO: 3863184 - RNA, 21 nt, Human
cacaguccuuaccagcagagc

SEQ ID NO: 3863185 - RNA, 14 nt, Human
cacagucuccccca

SEQ ID NO: 3863186 - RNA, 15 nt, Human
cacagugaagcaaau

SEQ ID NO: 3863187 - RNA, 17 nt, Human
cacagugaaggcugucc

SEQ ID NO: 3863188 - RNA, 15 nt, Human
cacagugaagugcug

SEQ ID NO: 3863189 - RNA, 16 nt, Human
cacagugacccuuccc

SEQ ID NO: 3863190 - RNA, 18 nt, Human
cacagugagucgaggaca

SEQ ID NO: 3863191 - RNA, 20 nt, Human
cacagugagucgaggacagg

SEQ ID NO: 3863192 - RNA, 11 nt, Human
cacagugauuu

SEQ ID NO: 3863193 - RNA, 14 nt, Human
cacagugcaucuca

SEQ ID NO: 3863194 - RNA, 18 nt, Human
cacagugcaucucagccc

SEQ ID NO: 3863195 - RNA, 17 nt, Human
cacagugccuucaauaa

SEQ ID NO: 3863196 - RNA, 14 nt, Human
cacagugggaacuc

SEQ ID NO: 3863197 - RNA, 15 nt, Human
cacagugguggcagg

SEQ ID NO: 3863198 - RNA, 23 nt, Human
cacagugguggcagggccuagcu

SEQ ID NO: 3863199 - RNA, 21 nt, Human
cacaguguaccauuaaaauau

SEQ ID NO: 3863200 - RNA, 20 nt, Human
cacagugucugggcugacug

SEQ ID NO: 3863201 - RNA, 21 nt, Human
cacagugucugggcugacugg

SEQ ID NO: 3863202 - RNA, 22 nt, Human
cacagugugaauaaagugcugc

SEQ ID NO: 3863203 - RNA, 10 nt, Human
cacaguguuu

SEQ ID NO: 3863204 - RNA, 16 nt, Human
cacaguguuuuuguaa

SEQ ID NO: 3863205 - RNA, 22 nt, Human
cacaguguuuuuguaaagugug

SEQ ID NO: 3863206 - RNA, 15 nt, Human
cacaguuauuacaua

SEQ ID NO: 3863207 - RNA, 21 nt, Human
cacaguucaguggcagggcuc

SEQ ID NO: 3863208 - RNA, 16 nt, Human
cacaguuccucgcccu

SEQ ID NO: 3863209 - RNA, 19 nt, Human
cacaguuccucgcccuggg

SEQ ID NO: 3863210 - RNA, 14 nt, Human
cacaguucucuccu

SEQ ID NO: 3863211 - RNA, 16 nt, Human
cacaguucucuccuuc

SEQ ID NO: 3863212 - RNA, 23 nt, Human
cacaguugaagggaggggcugug

SEQ ID NO: 3863213 - RNA, 14 nt, Human
cacaguugccacca

SEQ ID NO: 3863214 - RNA, 15 nt, Human
cacaguuggccuuca

SEQ ID NO: 3863215 - RNA, 12 nt, Human
cacaguuugaac

SEQ ID NO: 3863216 - RNA, 19 nt, Human
cacaguuuucugagaaaga

SEQ ID NO: 3863217 - RNA, 13 nt, Human
cacauacaacaca

SEQ ID NO: 3863218 - RNA, 17 nt, Human
cacauacacacacacgc

SEQ ID NO: 3863219 - RNA, 15 nt, Human
cacauacacacauau

SEQ ID NO: 3863220 - RNA, 20 nt, Human
cacauacacgaaagagagag

SEQ ID NO: 3863221 - RNA, 13 nt, Human
cacauacaguuuu

SEQ ID NO: 3863222 - RNA, 14 nt, Human
cacauacaguuuua

SEQ ID NO: 3863223 - RNA, 17 nt, Human
cacauacaguuuuaugc

SEQ ID NO: 3863224 - RNA, 13 nt, Human
cacauacccuccc

SEQ ID NO: 3863225 - RNA, 15 nt, Human
cacauacccuccccc

SEQ ID NO: 3863226 - RNA, 18 nt, Human
cacauacccugaccuggc

SEQ ID NO: 3863227 - RNA, 19 nt, Human
cacauacucauuuuucaug

SEQ ID NO: 3863228 - RNA, 15 nt, Human
cacauagagaucauc

SEQ ID NO: 3863229 - RNA, 21 nt, Human
cacauagauuaauggcacuga

SEQ ID NO: 3863230 - RNA, 14 nt, Human
cacauagauucacc

SEQ ID NO: 3863231 - RNA, 16 nt, Human
cacauagauucaccug

SEQ ID NO: 3863232 - RNA, 19 nt, Human
cacauagauucaccuguaa

SEQ ID NO: 3863233 - RNA, 22 nt, Human
cacauagauucaccuguaaaac

SEQ ID NO: 3863234 - RNA, 21 nt, Human
cacauauaaacaucacacaca

SEQ ID NO: 3863235 - RNA, 13 nt, Human
cacauauacacga

SEQ ID NO: 3863236 - RNA, 12 nt, Human
cacauaucuguc

SEQ ID NO: 3863237 - RNA, 14 nt, Human
cacauaucugucau

SEQ ID NO: 3863238 - RNA, 18 nt, Human
cacauaugcaccuugugu

SEQ ID NO: 3863239 - RNA, 20 nt, Human
cacauauugauuuccguuaa

SEQ ID NO: 3863240 - RNA, 22 nt, Human
cacaucaagcgaugaaacugga

SEQ ID NO: 3863241 - RNA, 20 nt, Human
cacaucacaagacuaugcca

SEQ ID NO: 3863242 - RNA, 19 nt, Human
cacaucacccuuaccaugu

SEQ ID NO: 3863243 - RNA, 18 nt, Human
cacaucagcacgauuucu

SEQ ID NO: 3863244 - RNA, 18 nt, Human
cacuggguguaaacacau

SEQ ID NO: 3863245 - RNA, 18 nt, Human
cacugguagguugggaca

SEQ ID NO: 3863246 - RNA, 17 nt, Human
cacugguauuccugccu

SEQ ID NO: 3863247 - RNA, 19 nt, Human
cacugguauuccugccucc

SEQ ID NO: 3863248 - RNA, 21 nt, Human
cacuggucugcuguuccagug

SEQ ID NO: 3863249 - RNA, 17 nt, Human
cacuggugacaugucuu

SEQ ID NO: 3863250 - RNA, 22 nt, Human
cacuggugacugcgaucuucag

SEQ ID NO: 3863251 - RNA, 22 nt, Human
cacugguggcccgacagccugg

SEQ ID NO: 3863252 - RNA, 21 nt, Human
cacugguggggauaggccagc

SEQ ID NO: 3863253 - RNA, 23 nt, Human
cacugguggggauaggccagccg

SEQ ID NO: 3863254 - RNA, 22 nt, Human
cacugguguggauuaaccugcc

SEQ ID NO: 3863255 - RNA, 18 nt, Human
cacugguguuuaggugaa

SEQ ID NO: 3863256 - RNA, 22 nt, Human
cacugguucuucuuggucucag

SEQ ID NO: 3863257 - RNA, 20 nt, Human
cacugguugcacuuaugauu

SEQ ID NO: 3863258 - RNA, 13 nt, Human
cacugguuuuaaa

SEQ ID NO: 3863259 - RNA, 16 nt, Human
cacugguuuuaaauau

SEQ ID NO: 3863260 - RNA, 14 nt, Human
cacuguaaaaugaa

SEQ ID NO: 3863261 - RNA, 18 nt, Human
cacuguacuugcucuuga

SEQ ID NO: 3863262 - RNA, 21 nt, Human
cacuguaguaaauaaugcuuu

SEQ ID NO: 3863263 - RNA, 22 nt, Human
cacuguaguaaauggcaauucu

SEQ ID NO: 3863264 - RNA, 18 nt, Human
cacuguaguucuaagacu

SEQ ID NO: 3863265 - RNA, 13 nt, Human
cacuguauaaaua

SEQ ID NO: 3863266 - RNA, 14 nt, Human
cacuguauaaauag

SEQ ID NO: 3863267 - RNA, 18 nt, Human
cacuguauaaauaggaga

SEQ ID NO: 3863268 - RNA, 19 nt, Human
cacuguauaaauaggagag

SEQ ID NO: 3863269 - RNA, 23 nt, Human
cacuguauaaauaggagaggaug

SEQ ID NO: 3863270 - RNA, 22 nt, Human
cacuguauaccccgugaagcau

SEQ ID NO: 3863271 - RNA, 15 nt, Human
cacuguaugauuuau

SEQ ID NO: 3863272 - RNA, 18 nt, Human
cacuguaugcuggacggc

SEQ ID NO: 3863273 - RNA, 17 nt, Human
cacuguauguuauagaa

SEQ ID NO: 3863274 - RNA, 14 nt, Human
cacuguauuuguau

SEQ ID NO: 3863275 - RNA, 19 nt, Human
cacugucacuguuucucug

SEQ ID NO: 3863276 - RNA, 13 nt, Human
cacugucacuuug

SEQ ID NO: 3863277 - RNA, 17 nt, Human
cacugucacuuugcucu

SEQ ID NO: 3863278 - RNA, 19 nt, Human
cacugucacuuugcucugg

SEQ ID NO: 3863279 - RNA, 18 nt, Human
cacugucccucaaaugac

SEQ ID NO: 3863280 - RNA, 20 nt, Human
cacugucccuccugguguca

SEQ ID NO: 3863281 - RNA, 14 nt, Human
cacuguccuccaag

SEQ ID NO: 3863282 - RNA, 15 nt, Human
cacuguccugcucca

SEQ ID NO: 3863283 - RNA, 11 nt, Human
cacuguccugg

SEQ ID NO: 3863284 - RNA, 12 nt, Human
cacuguccuggg

SEQ ID NO: 3863285 - RNA, 13 nt, Human
cacuguccugggc

SEQ ID NO: 3863286 - RNA, 18 nt, Human
cacuguccugggccugca

SEQ ID NO: 3863287 - RNA, 15 nt, Human
cacuguccugggcgc

SEQ ID NO: 3863288 - RNA, 23 nt, Human
cacugucugagaguuuaguugua

SEQ ID NO: 3863289 - RNA, 13 nt, Human
cacugugaagaga

SEQ ID NO: 3863290 - RNA, 13 nt, Human
cacugugaaggac

SEQ ID NO: 3863291 - RNA, 17 nt, Human
cacugugaaggacccuu

SEQ ID NO: 3863292 - RNA, 15 nt, Human
cacugugacccccag

SEQ ID NO: 3863293 - RNA, 20 nt, Human
cacugugacccccagcuccg

SEQ ID NO: 3863294 - RNA, 16 nt, Human
cacugugaccuugacu

SEQ ID NO: 3863295 - RNA, 17 nt, Human
cacugugaccuugagaa

SEQ ID NO: 3863296 - RNA, 16 nt, Human
cacugugagcucccag

SEQ ID NO: 3863297 - RNA, 22 nt, Human
cacugugagcucccaggugcag

SEQ ID NO: 3863298 - RNA, 19 nt, Human
cacugugaucaauauuuuu

SEQ ID NO: 3863299 - RNA, 21 nt, Human
cacugugaucaauauuuuuau

SEQ ID NO: 3863300 - RNA, 15 nt, Human
cacugugcacaccca

SEQ ID NO: 3863301 - RNA, 13 nt, Human
cacugugcaggug

SEQ ID NO: 3863302 - RNA, 18 nt, Human
cacugugccaugugccag

SEQ ID NO: 3863303 - RNA, 15 nt, Human
cacugugcccuggug

SEQ ID NO: 3863304 - RNA, 18 nt, Human
cacugugcccugguggag

SEQ ID NO: 3863305 - RNA, 17 nt, Human
cacugugccucagagac

SEQ ID NO: 3863306 - RNA, 19 nt, Human
cacugugcgucuuggugua

SEQ ID NO: 3863307 - RNA, 15 nt, Human
cacugugcugagucu

SEQ ID NO: 3863308 - RNA, 17 nt, Human
cacugugcugagucuga

SEQ ID NO: 3863309 - RNA, 22 nt, Human
cacugugcugagucugaaggcu

SEQ ID NO: 3863310 - RNA, 17 nt, Human
cacugugcuguuguuau

SEQ ID NO: 3863311 - RNA, 14 nt, Human
cacugugcuuucag

SEQ ID NO: 3863312 - RNA, 22 nt, Human
cacugugcuuucuauuguacag

SEQ ID NO: 3863313 - RNA, 13 nt, Human
cacuguggacuug

SEQ ID NO: 3863314 - RNA, 23 nt, Human
cacuguggacuuggucaccagcu

SEQ ID NO: 3863315 - RNA, 15 nt, Human
cacuguggcugucug

SEQ ID NO: 3863316 - RNA, 20 nt, Human
cacugugggaaggccagcug

SEQ ID NO: 3863317 - RNA, 22 nt, Human
cacuguggguagacacacauga

SEQ ID NO: 3863318 - RNA, 12 nt, Human
cacugugggugu

SEQ ID NO: 3863319 - RNA, 13 nt, Human
cacugugguggca

SEQ ID NO: 3863320 - RNA, 14 nt, Human
cacuguggugucug

SEQ ID NO: 3863321 - RNA, 21 nt, Human
cacuguguauauuugauuuau

SEQ ID NO: 3863322 - RNA, 23 nt, Human
cacuguuacuuucguacauuggc

SEQ ID NO: 3863323 - RNA, 22 nt, Human
cacuguuagcuuuuuaaaacau

SEQ ID NO: 3863324 - RNA, 15 nt, Human
cacuguuaucaaaac

SEQ ID NO: 3863325 - RNA, 21 nt, Human
cacuguuaucauuuuuuccug

SEQ ID NO: 3863326 - RNA, 14 nt, Human
cacuguucaugcug

SEQ ID NO: 3863327 - RNA, 22 nt, Human
cacuguucccucugcuccugga

SEQ ID NO: 3863328 - RNA, 21 nt, Human
cacuguucucccuucggugga

SEQ ID NO: 3863329 - RNA, 13 nt, Human
cacuguucucugc

SEQ ID NO: 3863330 - RNA, 16 nt, Human
cacuguucuuagcuca

SEQ ID NO: 3863331 - RNA, 13 nt, Human
cacuguugauaaa

SEQ ID NO: 3863332 - RNA, 14 nt, Human
cacuguugauaaaa

SEQ ID NO: 3863333 - RNA, 15 nt, Human
cacuguugauguauc

SEQ ID NO: 3863334 - RNA, 17 nt, Human
cacuguugcccaggcug

SEQ ID NO: 3863335 - RNA, 11 nt, Human
cacuguuuaag

SEQ ID NO: 3863336 - RNA, 13 nt, Human
cacuguuuccugg

SEQ ID NO: 3863337 - RNA, 19 nt, Human
cacuguuucucuugagcug

SEQ ID NO: 3863338 - RNA, 17 nt, Human
cacuguuucuugcuugu

SEQ ID NO: 3863339 - RNA, 21 nt, Human
cacuguuucuugcuuguaccu

SEQ ID NO: 3863340 - RNA, 14 nt, Human
cacuguuuucuagu

SEQ ID NO: 3863341 - RNA, 21 nt, Human
cacuguuuucuaguguaucaa

SEQ ID NO: 3863342 - RNA, 23 nt, Human
cacuguuuucuaguguaucaaaa

SEQ ID NO: 3863343 - RNA, 15 nt, Human
cacuuaaaaaugguu

SEQ ID NO: 3863344 - RNA, 21 nt, Human
cacuuaaacgaagaguucccu

SEQ ID NO: 3863345 - RNA, 15 nt, Human
cacuuaaagaaguau

SEQ ID NO: 3863346 - RNA, 16 nt, Human
cacuuaaagaaguauu

SEQ ID NO: 3863347 - RNA, 18 nt, Human
cacuuaaagaaguauuuu

SEQ ID NO: 3863348 - RNA, 16 nt, Human
cacuuaaauuaugaua

SEQ ID NO: 3863349 - RNA, 13 nt, Human
cacuuaagacugu

SEQ ID NO: 3863350 - RNA, 17 nt, Human
cacuuaagagaauauuu

SEQ ID NO: 3863351 - RNA, 20 nt, Human
cacuuaaguuaguuccacug

SEQ ID NO: 3863352 - RNA, 15 nt, Human
cacuuaauguauguu

SEQ ID NO: 3863353 - RNA, 16 nt, Human
cacuuacacuuuaugc

SEQ ID NO: 3863354 - RNA, 16 nt, Human
cacuuaccuucaauaa

SEQ ID NO: 3863355 - RNA, 17 nt, Human
cacuuaccuucaauaaa

SEQ ID NO: 3863356 - RNA, 19 nt, Human
cacuuaccuucaauaaagu

SEQ ID NO: 3863357 - RNA, 21 nt, Human
cacuuaccuucaauaaaguau

SEQ ID NO: 3863358 - RNA, 18 nt, Human
cacuuacuguuucuguca

SEQ ID NO: 3863359 - RNA, 20 nt, Human
cacuuacuguuucugucagg

SEQ ID NO: 3863360 - RNA, 16 nt, Human
cacuuacuugcuuauu

SEQ ID NO: 3863361 - RNA, 19 nt, Human
cacuuagaaauugcauuuc

SEQ ID NO: 3863362 - RNA, 24 nt, Human
cacuuagaaauugcauuuccugac

SEQ ID NO: 3863363 - RNA, 20 nt, Human
cacuuagccuuucuuuucuu

SEQ ID NO: 3863364 - RNA, 15 nt, Human
cacuuagcuaucaga

SEQ ID NO: 3863365 - RNA, 23 nt, Human
cacuuaggaacguaaucgugucc

SEQ ID NO: 3863366 - RNA, 23 nt, Human
cacuuauaagguguuuucugugu

SEQ ID NO: 3863367 - RNA, 12 nt, Human
cacuuaugauuu

SEQ ID NO: 3863368 - RNA, 16 nt, Human
cacuuauugaauauau

SEQ ID NO: 3863369 - RNA, 17 nt, Human
cacuuauugaauauaug

SEQ ID NO: 3863370 - RNA, 21 nt, Human
cacuuauuggaacucugcuug

SEQ ID NO: 3863371 - RNA, 22 nt, Human
cacuuauuggaacucugcuuga

SEQ ID NO: 3863372 - RNA, 12 nt, Human
cacuucaaacua

SEQ ID NO: 3863373 - RNA, 18 nt, Human
cacuucaaggugacagaa

SEQ ID NO: 3863374 - RNA, 18 nt, Human
cacuucacacacaggcaa

SEQ ID NO: 3863375 - RNA, 14 nt, Human
cacuucacagagug

SEQ ID NO: 3863376 - RNA, 14 nt, Human
cacuucacccugga

SEQ ID NO: 3863377 - RNA, 17 nt, Human
cacuucacgcccuuggc

SEQ ID NO: 3863378 - RNA, 20 nt, Human
cacuucacgcccuuggccau

SEQ ID NO: 3863379 - RNA, 21 nt, Human
cacuucacgcccuuggccaug

SEQ ID NO: 3863380 - RNA, 17 nt, Human
cacuucacgcuuucagc

SEQ ID NO: 3863381 - RNA, 15 nt, Human
cacuucacugugcug

SEQ ID NO: 3863382 - RNA, 16 nt, Human
cacuucagaauuccau

SEQ ID NO: 3863383 - RNA, 13 nt, Human
cacuucagagagc

SEQ ID NO: 3863384 - RNA, 16 nt, Human
cacuucagagagcugg

SEQ ID NO: 3863385 - RNA, 17 nt, Human
cacuucagagagcuggu

SEQ ID NO: 3863386 - RNA, 12 nt, Human
cacuucagcuga

SEQ ID NO: 3863387 - RNA, 16 nt, Human
cacuucaggcucuucu

SEQ ID NO: 3863388 - RNA, 17 nt, Human
cacuucagggcagauuu

SEQ ID NO: 3863389 - RNA, 19 nt, Human
cagaacuugugcccucccu

SEQ ID NO: 3863390 - RNA, 13 nt, Human
cagaagaaaauag

SEQ ID NO: 3863391 - RNA, 19 nt, Human
cagaagaaaauagaauuga

SEQ ID NO: 3863392 - RNA, 14 nt, Human
cagaagaaaauucu

SEQ ID NO: 3863393 - RNA, 14 nt, Human
cagaagaagagaag

SEQ ID NO: 3863394 - RNA, 18 nt, Human
cagaagaauaugacagcu

SEQ ID NO: 3863395 - RNA, 18 nt, Human
cagaagaauauucaggac

SEQ ID NO: 3863396 - RNA, 17 nt, Human
cagaagaauugaaccca

SEQ ID NO: 3863397 - RNA, 22 nt, Human
cagaagaauugaacccaggagg

SEQ ID NO: 3863398 - RNA, 17 nt, Human
cagaagacaccagagca

SEQ ID NO: 3863399 - RNA, 21 nt, Human
cagaagacaccagagcagaug

SEQ ID NO: 3863400 - RNA, 21 nt, Human
cagaagaccacaaaaauugac

SEQ ID NO: 3863401 - RNA, 16 nt, Human
cagaagaccccugacu

SEQ ID NO: 3863402 - RNA, 18 nt, Human
cagaagacuucccagcuu

SEQ ID NO: 3863403 - RNA, 18 nt, Human
cagaagauccccucagga

SEQ ID NO: 3863404 - RNA, 23 nt, Human
cagaagauccccucaggacugca

SEQ ID NO: 3863405 - RNA, 14 nt, Human
cagaagaugacuga

SEQ ID NO: 3863406 - RNA, 14 nt, Human
cagaagcaggcugg

SEQ ID NO: 3863407 - RNA, 15 nt, Human
cagaagcaggcugga

SEQ ID NO: 3863408 - RNA, 14 nt, Human
cagaagcauuaacu

SEQ ID NO: 3863409 - RNA, 19 nt, Human
cagaagcauuuguauuuug

SEQ ID NO: 3863410 - RNA, 22 nt, Human
cagaagcauuuguauuuugugu

SEQ ID NO: 3863411 - RNA, 15 nt, Human
cagaagccaggagca

SEQ ID NO: 3863412 - RNA, 19 nt, Human
cagaagccaggagcaaaug

SEQ ID NO: 3863413 - RNA, 11 nt, Human
cagaagcccag

SEQ ID NO: 3863414 - RNA, 14 nt, Human
cagaagcccagaau

SEQ ID NO: 3863415 - RNA, 23 nt, Human
cagaagcccugauguguccucag

SEQ ID NO: 3863416 - RNA, 18 nt, Human
cagaagccuauuguaaau

SEQ ID NO: 3863417 - RNA, 22 nt, Human
cagaagccuauuguaaauacaa

SEQ ID NO: 3863418 - RNA, 13 nt, Human
cagaagccucugg

SEQ ID NO: 3863419 - RNA, 14 nt, Human
cagaagccugaggc

SEQ ID NO: 3863420 - RNA, 14 nt, Human
cagaagccuggggg

SEQ ID NO: 3863421 - RNA, 22 nt, Human
cagaagccugggggccuggcug

SEQ ID NO: 3863422 - RNA, 23 nt, Human
cagaagccugggggccuggcugg

SEQ ID NO: 3863423 - RNA, 18 nt, Human
cagaagcgggacgagacc

SEQ ID NO: 3863424 - RNA, 17 nt, Human
cagaagcuaagcugcag

SEQ ID NO: 3863425 - RNA, 15 nt, Human
cagaagcucccccag

SEQ ID NO: 3863426 - RNA, 22 nt, Human
cagaagcucuuacucuuuccua

SEQ ID NO: 3863427 - RNA, 16 nt, Human
cagaagcugagcacca

SEQ ID NO: 3863428 - RNA, 14 nt, Human
cagaagcuucagaa

SEQ ID NO: 3863429 - RNA, 19 nt, Human
cagaaggaaaaauguguaa

SEQ ID NO: 3863430 - RNA, 15 nt, Human
cagaaggaaggcagg

SEQ ID NO: 3863431 - RNA, 14 nt, Human
cagaaggaccuccu

SEQ ID NO: 3863432 - RNA, 17 nt, Human
cagaaggagacaggcag

SEQ ID NO: 3863433 - RNA, 18 nt, Human
cagaaggagacaggcaga

SEQ ID NO: 3863434 - RNA, 13 nt, Human
cagaaggaggagg

SEQ ID NO: 3863435 - RNA, 19 nt, Human
cagaaggcaaaugacuuug

SEQ ID NO: 3863436 - RNA, 13 nt, Human
cagaaggccaaga

SEQ ID NO: 3863437 - RNA, 18 nt, Human
cagaaggccaagaggcug

SEQ ID NO: 3863438 - RNA, 14 nt, Human
cagaaggcuccugc

SEQ ID NO: 3863439 - RNA, 17 nt, Human
cagaaggcuccugcccc

SEQ ID NO: 3863440 - RNA, 14 nt, Human
cagaaggcucuucu

SEQ ID NO: 3863441 - RNA, 15 nt, Human
cagaagggaaacagu

SEQ ID NO: 3863442 - RNA, 21 nt, Human
cagaagggagcuagccagagg

SEQ ID NO: 3863443 - RNA, 19 nt, Human
cagaagggagggcagagcu

SEQ ID NO: 3863444 - RNA, 22 nt, Human
cagaaggggacugccaccuccc

SEQ ID NO: 3863445 - RNA, 17 nt, Human
cagaaggggagauggac

SEQ ID NO: 3863446 - RNA, 17 nt, Human
cagaagggggagaccaa

SEQ ID NO: 3863447 - RNA, 15 nt, Human
cagaagggggccaug

SEQ ID NO: 3863448 - RNA, 15 nt, Human
cagaagggggucucu

SEQ ID NO: 3863449 - RNA, 19 nt, Human
cagaaggggguggugucuc

SEQ ID NO: 3863450 - RNA, 22 nt, Human
cagaagggguuuggucugggac

SEQ ID NO: 3863451 - RNA, 23 nt, Human
cagaagguggggguuggcugggu

SEQ ID NO: 3863452 - RNA, 16 nt, Human
cagaagucaagcccag

SEQ ID NO: 3863453 - RNA, 16 nt, Human
cagaagucaaggcuua

SEQ ID NO: 3863454 - RNA, 20 nt, Human
cagaagucacucaauuguuu

SEQ ID NO: 3863455 - RNA, 22 nt, Human
cagaagucacucaauuguuuuu

SEQ ID NO: 3863456 - RNA, 14 nt, Human
cagaagucaucuug

SEQ ID NO: 3863457 - RNA, 16 nt, Human
cagaagucaucuugcu

SEQ ID NO: 3863458 - RNA, 16 nt, Human
cagaagucaugaagcc

SEQ ID NO: 3863459 - RNA, 14 nt, Human
cagaagucuccuca

SEQ ID NO: 3863460 - RNA, 21 nt, Human
cagaagugagcuuugcugcua

SEQ ID NO: 3863461 - RNA, 12 nt, Human
cagaagugcauc

SEQ ID NO: 3863462 - RNA, 14 nt, Human
cagaaguggagcug

SEQ ID NO: 3863463 - RNA, 15 nt, Human
cagaaguggagcugg

SEQ ID NO: 3863464 - RNA, 17 nt, Human
cagaaguguuucaugca

SEQ ID NO: 3863465 - RNA, 19 nt, Human
cagaaguuaguuuguauau

SEQ ID NO: 3863466 - RNA, 21 nt, Human
cagaaguuguggauuucaguu

SEQ ID NO: 3863467 - RNA, 16 nt, Human
cagaaguuuaaauauu

SEQ ID NO: 3863468 - RNA, 20 nt, Human
cagaaguuucugccgcagcc

SEQ ID NO: 3863469 - RNA, 23 nt, Human
cagaaguuucugccgcagcccug

SEQ ID NO: 3863470 - RNA, 20 nt, Human
cagaaguuugagaucagccu

SEQ ID NO: 3863471 - RNA, 23 nt, Human
cagaaguuugagaucagccuggg

SEQ ID NO: 3863472 - RNA, 22 nt, Human
cagaaguuugcacuaucuuuca

SEQ ID NO: 3863473 - RNA, 16 nt, Human
cagaaguuuggcaaua

SEQ ID NO: 3863474 - RNA, 18 nt, Human
cagaauaaguuauugcag

SEQ ID NO: 3863475 - RNA, 20 nt, Human
cagaauaaucaaauacauuu

SEQ ID NO: 3863476 - RNA, 23 nt, Human
cagaauaaugaauggacucaaac

SEQ ID NO: 3863477 - RNA, 22 nt, Human
cagaauacuguuaaaggaaaaa

SEQ ID NO: 3863478 - RNA, 21 nt, Human
cagaauagccacauuuggaau

SEQ ID NO: 3863479 - RNA, 14 nt, Human
cagaauaguauuuu

SEQ ID NO: 3863480 - RNA, 15 nt, Human
cagaauaucacagaa

SEQ ID NO: 3863481 - RNA, 17 nt, Human
cagaauauuucuauuga

SEQ ID NO: 3863482 - RNA, 19 nt, Human
cagaauauuucuauugaau

SEQ ID NO: 3863483 - RNA, 16 nt, Human
cagaaucagcacagau

SEQ ID NO: 3863484 - RNA, 19 nt, Human
cagaaucauaugauucugc

SEQ ID NO: 3863485 - RNA, 19 nt, Human
cagaauccaagugaacacu

SEQ ID NO: 3863486 - RNA, 14 nt, Human
cagaaucccagccg

SEQ ID NO: 3863487 - RNA, 18 nt, Human
cagaaucccagccggcca

SEQ ID NO: 3863488 - RNA, 17 nt, Human
cagaaucuaaagccagu

SEQ ID NO: 3863489 - RNA, 18 nt, Human
cagaaucucaaauaacua

SEQ ID NO: 3863490 - RNA, 15 nt, Human
cagaaucucgcucug

SEQ ID NO: 3863491 - RNA, 17 nt, Human
cagaaucuuguuuugaa

SEQ ID NO: 3863492 - RNA, 15 nt, Human
cagaaucuuuguuaa

SEQ ID NO: 3863493 - RNA, 19 nt, Human
cagaaugaaaaaugaaaga

SEQ ID NO: 3863494 - RNA, 22 nt, Human
cagaaugaaaaaugaaagauga

SEQ ID NO: 3863495 - RNA, 12 nt, Human
cagaaugaaucu

SEQ ID NO: 3863496 - RNA, 21 nt, Human
cagaaugagacauccagcaga

SEQ ID NO: 3863497 - RNA, 15 nt, Human
cagaaugaggcugcu

SEQ ID NO: 3863498 - RNA, 16 nt, Human
cagaaugagugcuuca

SEQ ID NO: 3863499 - RNA, 21 nt, Human
cagaaugcaaccaagucacac

SEQ ID NO: 3863500 - RNA, 21 nt, Human
cagaaugcuguacaucuauuu

SEQ ID NO: 3863501 - RNA, 19 nt, Human
cagaauggaagagagaaag

SEQ ID NO: 3863502 - RNA, 13 nt, Human
cagaauggcauuu

SEQ ID NO: 3863503 - RNA, 19 nt, Human
cagaauggugaucacucca

SEQ ID NO: 3863504 - RNA, 21 nt, Human
cagaauguaagugggcccacc

SEQ ID NO: 3863505 - RNA, 17 nt, Human
cagaauguaucugugaa

SEQ ID NO: 3863506 - RNA, 18 nt, Human
cagaauguaucugugaag

SEQ ID NO: 3863507 - RNA, 13 nt, Human
cagaaugucagau

SEQ ID NO: 3863508 - RNA, 16 nt, Human
cagaauguugauuaca

SEQ ID NO: 3863509 - RNA, 14 nt, Human
cagaauuaaacuuu

SEQ ID NO: 3863510 - RNA, 17 nt, Human
cagaauuaaacuuuuaa

SEQ ID NO: 3863511 - RNA, 21 nt, Human
cagaauuaugauggaagacag

SEQ ID NO: 3863512 - RNA, 15 nt, Human
cagaauuauuuuuaa

SEQ ID NO: 3863513 - RNA, 23 nt, Human
cagaauucccagcugucuguguc

SEQ ID NO: 3863514 - RNA, 14 nt, Human
cagaauucugcuac

SEQ ID NO: 3863515 - RNA, 23 nt, Human
cagaauucugcuaccucacuggg

SEQ ID NO: 3863516 - RNA, 17 nt, Human
cagaauugaaacacuuu

SEQ ID NO: 3863517 - RNA, 14 nt, Human
cagaauuggaaaag

SEQ ID NO: 3863518 - RNA, 24 nt, Human
cagaauuucccaaagcagugcaug

SEQ ID NO: 3863519 - RNA, 21 nt, Human
cagaauuuuaggaacuucaga

SEQ ID NO: 3863520 - RNA, 15 nt, Human
cagaauuuuuuuugu

SEQ ID NO: 3863521 - RNA, 19 nt, Human
cagaauuuuuuuuguuguu

SEQ ID NO: 3863522 - RNA, 11 nt, Human
cagacaaaaug

SEQ ID NO: 3863523 - RNA, 20 nt, Human
cagacaaaauggauacauaa

SEQ ID NO: 3863524 - RNA, 14 nt, Human
cagacaacagaagu

SEQ ID NO: 3863525 - RNA, 16 nt, Human
cagacaagguagcccu

SEQ ID NO: 3863526 - RNA, 23 nt, Human
cagacaagguagcccuggccaga

SEQ ID NO: 3863527 - RNA, 16 nt, Human
cagacaauacguuuga

SEQ ID NO: 3863528 - RNA, 15 nt, Human
cagacaaucuucugu

SEQ ID NO: 3863529 - RNA, 12 nt, Human
cagacacacaca

SEQ ID NO: 3863530 - RNA, 15 nt, Human
cagacacacacacgc

SEQ ID NO: 3863531 - RNA, 18 nt, Human
cagacacacacacgcacg

SEQ ID NO: 3863532 - RNA, 15 nt, Human
cagacacaggcccgg

SEQ ID NO: 3863533 - RNA, 13 nt, Human
cagagguacccug

SEQ ID NO: 3863534 - RNA, 16 nt, Human
cagagguacccugggu

SEQ ID NO: 3863535 - RNA, 17 nt, Human
cagagguacccugggug

SEQ ID NO: 3863536 - RNA, 18 nt, Human
cagagguagggcugccac

SEQ ID NO: 3863537 - RNA, 22 nt, Human
cagagguagucucacugcuuga

SEQ ID NO: 3863538 - RNA, 17 nt, Human
cagagguccagcccauc

SEQ ID NO: 3863539 - RNA, 13 nt, Human
cagaggucuccca

SEQ ID NO: 3863540 - RNA, 14 nt, Human
cagagguggccaga

SEQ ID NO: 3863541 - RNA, 20 nt, Human
cagagguggcucuggaauga

SEQ ID NO: 3863542 - RNA, 12 nt, Human
cagaggugggca

SEQ ID NO: 3863543 - RNA, 21 nt, Human
cagagguuaucugucccaggu

SEQ ID NO: 3863544 - RNA, 21 nt, Human
cagagguucuuugagggacug

SEQ ID NO: 3863545 - RNA, 16 nt, Human
cagagguugcagugag

SEQ ID NO: 3863546 - RNA, 17 nt, Human
cagagguugcagugagc

SEQ ID NO: 3863547 - RNA, 18 nt, Human
cagagguugcagugagcu

SEQ ID NO: 3863548 - RNA, 15 nt, Human
cagaguaagacauug

SEQ ID NO: 3863549 - RNA, 20 nt, Human
cagaguauggagcucagaga

SEQ ID NO: 3863550 - RNA, 20 nt, Human
cagaguauuugaaaaaugua

SEQ ID NO: 3863551 - RNA, 16 nt, Human
cagagucaaggccugc

SEQ ID NO: 3863552 - RNA, 18 nt, Human
cagagucaaggccugcuc

SEQ ID NO: 3863553 - RNA, 19 nt, Human
cagagucaaggccugcucc

SEQ ID NO: 3863554 - RNA, 21 nt, Human
cagagucacacgggggcagcu

SEQ ID NO: 3863555 - RNA, 15 nt, Human
cagagucagcagaac

SEQ ID NO: 3863556 - RNA, 17 nt, Human
cagagucagccaggacc

SEQ ID NO: 3863557 - RNA, 18 nt, Human
cagagucagccaggacca

SEQ ID NO: 3863558 - RNA, 14 nt, Human
cagaguccaggccc

SEQ ID NO: 3863559 - RNA, 22 nt, Human
cagaguccccccacucccagca

SEQ ID NO: 3863560 - RNA, 18 nt, Human
cagagucccugccuggac

SEQ ID NO: 3863561 - RNA, 16 nt, Human
cagaguccuuaaaaug

SEQ ID NO: 3863562 - RNA, 23 nt, Human
cagagucggaacggagaaaggug

SEQ ID NO: 3863563 - RNA, 20 nt, Human
cagagucuagcguagugcag

SEQ ID NO: 3863564 - RNA, 13 nt, Human
cagagucucacug

SEQ ID NO: 3863565 - RNA, 20 nt, Human
cagagucucacuguugccca

SEQ ID NO: 3863566 - RNA, 20 nt, Human
cagagucuggugaagcucac

SEQ ID NO: 3863567 - RNA, 18 nt, Human
cagagucuugcuaccuca

SEQ ID NO: 3863568 - RNA, 14 nt, Human
cagagugagaccca

SEQ ID NO: 3863569 - RNA, 15 nt, Human
cagagugagacccag

SEQ ID NO: 3863570 - RNA, 17 nt, Human
cagagugagacccagcc

SEQ ID NO: 3863571 - RNA, 20 nt, Human
cagagugagacccugucucu

SEQ ID NO: 3863572 - RNA, 20 nt, Human
cagagugcaagccccugcuc

SEQ ID NO: 3863573 - RNA, 15 nt, Human
cagagugcacagcug

SEQ ID NO: 3863574 - RNA, 16 nt, Human
cagagugcacagcugu

SEQ ID NO: 3863575 - RNA, 12 nt, Human
cagagugcccca

SEQ ID NO: 3863576 - RNA, 14 nt, Human
cagagugccccacc

SEQ ID NO: 3863577 - RNA, 19 nt, Human
cagagugccccaccugcca

SEQ ID NO: 3863578 - RNA, 21 nt, Human
cagagugccccaccugccacu

SEQ ID NO: 3863579 - RNA, 20 nt, Human
cagaguggaauaagacagag

SEQ ID NO: 3863580 - RNA, 16 nt, Human
cagaguggccuggcca

SEQ ID NO: 3863581 - RNA, 21 nt, Human
cagaguggccuggccaggagc

SEQ ID NO: 3863582 - RNA, 23 nt, Human
cagaguggccuggccaggagcuc

SEQ ID NO: 3863583 - RNA, 14 nt, Human
cagaguuacaguuc

SEQ ID NO: 3863584 - RNA, 15 nt, Human
cagaguuacaguucu

SEQ ID NO: 3863585 - RNA, 14 nt, Human
cagaguucacuaua

SEQ ID NO: 3863586 - RNA, 20 nt, Human
cagaguucacuauaaauggu

SEQ ID NO: 3863587 - RNA, 22 nt, Human
cagaguuccugcggagugaaga

SEQ ID NO: 3863588 - RNA, 23 nt, Human
cagaguuccugcggagugaagag

SEQ ID NO: 3863589 - RNA, 20 nt, Human
cagaguucuauacuguaaag

SEQ ID NO: 3863590 - RNA, 15 nt, Human
cagaguucugcucua

SEQ ID NO: 3863591 - RNA, 16 nt, Human
cagaguugaagacaga

SEQ ID NO: 3863592 - RNA, 17 nt, Human
cagaguugaagacagag

SEQ ID NO: 3863593 - RNA, 18 nt, Human
cagaguugaagacagagc

SEQ ID NO: 3863594 - RNA, 20 nt, Human
cagaguugaagacagagcua

SEQ ID NO: 3863595 - RNA, 22 nt, Human
cagaguugaagacagagcuaca

SEQ ID NO: 3863596 - RNA, 15 nt, Human
cagaguugcugggag

SEQ ID NO: 3863597 - RNA, 17 nt, Human
cagaguuguaaauauau

SEQ ID NO: 3863598 - RNA, 18 nt, Human
cagaguuguaaauauaua

SEQ ID NO: 3863599 - RNA, 20 nt, Human
cagaguuguaaauauauaaa

SEQ ID NO: 3863600 - RNA, 23 nt, Human
cagaguugugcacauggcuuagu

SEQ ID NO: 3863601 - RNA, 15 nt, Human
cagaguuguuacauu

SEQ ID NO: 3863602 - RNA, 16 nt, Human
cagaguuugccuuccu

SEQ ID NO: 3863603 - RNA, 17 nt, Human
cagaguuugccuuccuu

SEQ ID NO: 3863604 - RNA, 22 nt, Human
cagaguuuucauuaaauccuuu

SEQ ID NO: 3863605 - RNA, 23 nt, Human
cagaguuuucauuaaauccuuuu

SEQ ID NO: 3863606 - RNA, 16 nt, Human
cagauaaaauuauaga

SEQ ID NO: 3863607 - RNA, 21 nt, Human
cagauaaaauuauagauggga

SEQ ID NO: 3863608 - RNA, 16 nt, Human
cagauaaagauugugu

SEQ ID NO: 3863609 - RNA, 17 nt, Human
cagauaaccagcuguaa

SEQ ID NO: 3863610 - RNA, 19 nt, Human
cagauaacugaaaauuauu

SEQ ID NO: 3863611 - RNA, 13 nt, Human
cagauaacugagg

SEQ ID NO: 3863612 - RNA, 16 nt, Human
cagauaacuuagcuua

SEQ ID NO: 3863613 - RNA, 12 nt, Human
cagauaacuuuu

SEQ ID NO: 3863614 - RNA, 22 nt, Human
cagauaagguaaaaugccauga

SEQ ID NO: 3863615 - RNA, 18 nt, Human
cagauaaucagccucuua

SEQ ID NO: 3863616 - RNA, 13 nt, Human
cagauacaaugua

SEQ ID NO: 3863617 - RNA, 14 nt, Human
cagauacaucacug

SEQ ID NO: 3863618 - RNA, 14 nt, Human
cagauaccagcccc

SEQ ID NO: 3863619 - RNA, 16 nt, Human
cagauaccagccccug

SEQ ID NO: 3863620 - RNA, 21 nt, Human
cagauaccauacucauuucua

SEQ ID NO: 3863621 - RNA, 18 nt, Human
cagauaccuccaacccug

SEQ ID NO: 3863622 - RNA, 19 nt, Human
cagauaccuuaucuuacaa

SEQ ID NO: 3863623 - RNA, 18 nt, Human
cagauacuacugaccaga

SEQ ID NO: 3863624 - RNA, 18 nt, Human
cagauacuggauuguacu

SEQ ID NO: 3863625 - RNA, 19 nt, Human
cagauacuuggggggcuga

SEQ ID NO: 3863626 - RNA, 22 nt, Human
cagauauaaaagacugaccaau

SEQ ID NO: 3863627 - RNA, 18 nt, Human
cagauauaaauggcuggu

SEQ ID NO: 3863628 - RNA, 22 nt, Human
cagauauaaauggcugguuuuu

SEQ ID NO: 3863629 - RNA, 15 nt, Human
cagauauacuuugug

SEQ ID NO: 3863630 - RNA, 13 nt, Human
cagauauauuuuu

SEQ ID NO: 3863631 - RNA, 15 nt, Human
cagauauauuuuuca

SEQ ID NO: 3863632 - RNA, 18 nt, Human
cagauauauuuuucacag

SEQ ID NO: 3863633 - RNA, 19 nt, Human
cagauauauuuuucacagu

SEQ ID NO: 3863634 - RNA, 14 nt, Human
cagauaugauucaa

SEQ ID NO: 3863635 - RNA, 19 nt, Human
cagauaugauucaaauguc

SEQ ID NO: 3863636 - RNA, 14 nt, Human
cagauauuuauauu

SEQ ID NO: 3863637 - RNA, 15 nt, Human
cagaucaagcuguga

SEQ ID NO: 3863638 - RNA, 18 nt, Human
cagaucaauggcgcagug

SEQ ID NO: 3863639 - RNA, 21 nt, Human
cagaucaccagcccggccugc

SEQ ID NO: 3863640 - RNA, 14 nt, Human
cagaucacugccac

SEQ ID NO: 3863641 - RNA, 13 nt, Human
cagaucagccaga

SEQ ID NO: 3863642 - RNA, 16 nt, Human
cagaucaguaaagaac

SEQ ID NO: 3863643 - RNA, 16 nt, Human
cagaucaguguaccau

SEQ ID NO: 3863644 - RNA, 20 nt, Human
cagaucauagauuucugauu

SEQ ID NO: 3863645 - RNA, 21 nt, Human
cagaucauagauuucugauuu

SEQ ID NO: 3863646 - RNA, 15 nt, Human
cagaucaucuuggaa

SEQ ID NO: 3863647 - RNA, 16 nt, Human
cagaucauugugaaau

SEQ ID NO: 3863648 - RNA, 22 nt, Human
cagaucauugugaaauuauuca

SEQ ID NO: 3863649 - RNA, 13 nt, Human
cagauccagccug

SEQ ID NO: 3863650 - RNA, 14 nt, Human
cagauccagccugg

SEQ ID NO: 3863651 - RNA, 15 nt, Human
cagauccagccuggg

SEQ ID NO: 3863652 - RNA, 18 nt, Human
cagauccagccugggguc

SEQ ID NO: 3863653 - RNA, 12 nt, Human
cagauccaggac

SEQ ID NO: 3863654 - RNA, 18 nt, Human
cagauccaggagcuccag

SEQ ID NO: 3863655 - RNA, 20 nt, Human
cagauccaggagcuccagug

SEQ ID NO: 3863656 - RNA, 13 nt, Human
cagauccagggac

SEQ ID NO: 3863657 - RNA, 15 nt, Human
cagauccagggacag

SEQ ID NO: 3863658 - RNA, 20 nt, Human
cagaucccaggccccuggag

SEQ ID NO: 3863659 - RNA, 22 nt, Human
cagaucccaggccccuggaggc

SEQ ID NO: 3863660 - RNA, 12 nt, Human
cagauccuaccc

SEQ ID NO: 3863661 - RNA, 16 nt, Human
cagauccuccucauuc

SEQ ID NO: 3863662 - RNA, 14 nt, Human
cagauccucucugg

SEQ ID NO: 3863663 - RNA, 19 nt, Human
cagaucuaccccuuacuua

SEQ ID NO: 3863664 - RNA, 16 nt, Human
cagaucuccaaagcuu

SEQ ID NO: 3863665 - RNA, 13 nt, Human
cagaucugcaccg

SEQ ID NO: 3863666 - RNA, 15 nt, Human
cagaucugcaccgcc

SEQ ID NO: 3863667 - RNA, 18 nt, Human
cagaucuggaaccucagc

SEQ ID NO: 3863668 - RNA, 21 nt, Human
cagaucuggaaccucagccug

SEQ ID NO: 3863669 - RNA, 22 nt, Human
cagaucuggaaccucagccugg

SEQ ID NO: 3863670 - RNA, 18 nt, Human
cagaucuggucccuugca

SEQ ID NO: 3863671 - RNA, 13 nt, Human
cagaucugugccc

SEQ ID NO: 3863672 - RNA, 20 nt, Human
cagaucugugccccaugccu

SEQ ID NO: 3863673 - RNA, 12 nt, Human
cagaucuguuuu

SEQ ID NO: 3863674 - RNA, 13 nt, Human
cagaucuguuuug

SEQ ID NO: 3863675 - RNA, 15 nt, Human
cagaucuuaauauaa

SEQ ID NO: 3863676 - RNA, 18 nt, Human
cagaucuuaauauaaauu

SEQ ID NO: 3863677 - RNA, 20 nt, Human
cagaucuuucagaaauauaa

SEQ ID NO: 3863678 - RNA, 14 nt, Human
caggacgccacuca

SEQ ID NO: 3863679 - RNA, 20 nt, Human
caggacgccacucauuucau

SEQ ID NO: 3863680 - RNA, 15 nt, Human
caggacgcuucugaa

SEQ ID NO: 3863681 - RNA, 16 nt, Human
caggacgcuucugaau

SEQ ID NO: 3863682 - RNA, 22 nt, Human
caggacgcuucugaaugcugcu

SEQ ID NO: 3863683 - RNA, 24 nt, Human
caggacggggccggccaggugggc

SEQ ID NO: 3863684 - RNA, 16 nt, Human
caggacgugggcuggg

SEQ ID NO: 3863685 - RNA, 19 nt, Human
caggacuaacacucagaag

SEQ ID NO: 3863686 - RNA, 21 nt, Human
caggacuauagcccagguccu

SEQ ID NO: 3863687 - RNA, 20 nt, Human
caggacuauauuugggccug

SEQ ID NO: 3863688 - RNA, 13 nt, Human
caggacucacagg

SEQ ID NO: 3863689 - RNA, 19 nt, Human
caggacucagaagccucug

SEQ ID NO: 3863690 - RNA, 21 nt, Human
caggacucagaagccucuggg

SEQ ID NO: 3863691 - RNA, 14 nt, Human
caggacucagcucc

SEQ ID NO: 3863692 - RNA, 19 nt, Human
caggacucagcuccccaga

SEQ ID NO: 3863693 - RNA, 12 nt, Human
caggacuccagc

SEQ ID NO: 3863694 - RNA, 13 nt, Human
caggacuccagcc

SEQ ID NO: 3863695 - RNA, 16 nt, Human
caggacuccagcccau

SEQ ID NO: 3863696 - RNA, 17 nt, Human
caggacuccaggcccaa

SEQ ID NO: 3863697 - RNA, 18 nt, Human
caggacuccaggcccaag

SEQ ID NO: 3863698 - RNA, 21 nt, Human
caggacuccaggcccaaggcu

SEQ ID NO: 3863699 - RNA, 20 nt, Human
caggacuccccaggccaggc

SEQ ID NO: 3863700 - RNA, 20 nt, Human
caggacucccuccucaccuc

SEQ ID NO: 3863701 - RNA, 21 nt, Human
caggacucccuccucaccucu

SEQ ID NO: 3863702 - RNA, 12 nt, Human
caggacucugac

SEQ ID NO: 3863703 - RNA, 14 nt, Human
caggacucugaccc

SEQ ID NO: 3863704 - RNA, 14 nt, Human
caggacucugcagc

SEQ ID NO: 3863705 - RNA, 15 nt, Human
caggacucugcagcc

SEQ ID NO: 3863706 - RNA, 18 nt, Human
caggacucugcagccuca

SEQ ID NO: 3863707 - RNA, 19 nt, Human
caggacucugcagccucag

SEQ ID NO: 3863708 - RNA, 12 nt, Human
caggacucugcc

SEQ ID NO: 3863709 - RNA, 18 nt, Human
caggacucuugugaaaag

SEQ ID NO: 3863710 - RNA, 20 nt, Human
caggacugagccccgcagac

SEQ ID NO: 3863711 - RNA, 18 nt, Human
caggacugaugucuccua

SEQ ID NO: 3863712 - RNA, 23 nt, Human
caggacugaugucuccuaagcac

SEQ ID NO: 3863713 - RNA, 19 nt, Human
caggacugcaacaggcuug

SEQ ID NO: 3863714 - RNA, 22 nt, Human
caggacugggagcccccagccu

SEQ ID NO: 3863715 - RNA, 23 nt, Human
caggacugggagcccccagccug

SEQ ID NO: 3863716 - RNA, 22 nt, Human
caggacuguccccuugaaggag

SEQ ID NO: 3863717 - RNA, 20 nt, Human
caggacuuaacggcuccagg

SEQ ID NO: 3863718 - RNA, 16 nt, Human
caggacuugaaagaaa

SEQ ID NO: 3863719 - RNA, 14 nt, Human
caggagaagaaaga

SEQ ID NO: 3863720 - RNA, 16 nt, Human
caggagaagcucagcu

SEQ ID NO: 3863721 - RNA, 19 nt, Human
caggagaagcucagcugca

SEQ ID NO: 3863722 - RNA, 20 nt, Human
caggagaagcucagcugcau

SEQ ID NO: 3863723 - RNA, 19 nt, Human
caggagaaggccaauuccu

SEQ ID NO: 3863724 - RNA, 22 nt, Human
caggagacuggcgugaacccag

SEQ ID NO: 3863725 - RNA, 14 nt, Human
caggagagaaaggg

SEQ ID NO: 3863726 - RNA, 12 nt, Human
caggagagcagc

SEQ ID NO: 3863727 - RNA, 22 nt, Human
caggagagcagcggggcgaagc

SEQ ID NO: 3863728 - RNA, 15 nt, Human
caggagagccagccc

SEQ ID NO: 3863729 - RNA, 17 nt, Human
caggagagccagcccuc

SEQ ID NO: 3863730 - RNA, 18 nt, Human
caggagagccagcccucc

SEQ ID NO: 3863731 - RNA, 23 nt, Human
caggagagccagcccucccuguc

SEQ ID NO: 3863732 - RNA, 18 nt, Human
caggagagcuuagggucu

SEQ ID NO: 3863733 - RNA, 22 nt, Human
caggagaggagagccagagaag

SEQ ID NO: 3863734 - RNA, 15 nt, Human
caggagaggggcaga

SEQ ID NO: 3863735 - RNA, 12 nt, Human
caggagaguaga

SEQ ID NO: 3863736 - RNA, 20 nt, Human
caggagauggaaguugcagu

SEQ ID NO: 3863737 - RNA, 23 nt, Human
caggagauugagaaggagagaaa

SEQ ID NO: 3863738 - RNA, 18 nt, Human
caggagcaaauguuucug

SEQ ID NO: 3863739 - RNA, 15 nt, Human
caggagcacaggcag

SEQ ID NO: 3863740 - RNA, 16 nt, Human
caggagcacggcucug

SEQ ID NO: 3863741 - RNA, 17 nt, Human
caggagcacggcucugu

SEQ ID NO: 3863742 - RNA, 19 nt, Human
caggagcagccacauuccu

SEQ ID NO: 3863743 - RNA, 15 nt, Human
caggagcagccucag

SEQ ID NO: 3863744 - RNA, 20 nt, Human
caggagcaguaucaugaagc

SEQ ID NO: 3863745 - RNA, 20 nt, Human
caggagcauccaccuccuuc

SEQ ID NO: 3863746 - RNA, 22 nt, Human
caggagcauccaccuccuucuc

SEQ ID NO: 3863747 - RNA, 23 nt, Human
caggagcccauuuggagggccug

SEQ ID NO: 3863748 - RNA, 20 nt, Human
caggagccccgaggccuucu

SEQ ID NO: 3863749 - RNA, 22 nt, Human
caggagccccgaggccuucucu

SEQ ID NO: 3863750 - RNA, 23 nt, Human
caggagccccgaggccuucucug

SEQ ID NO: 3863751 - RNA, 14 nt, Human
caggagcccuggga

SEQ ID NO: 3863752 - RNA, 16 nt, Human
caggagcccugggagg

SEQ ID NO: 3863753 - RNA, 18 nt, Human
caggagcccugggaggcu

SEQ ID NO: 3863754 - RNA, 19 nt, Human
caggagcccugggaggcuc

SEQ ID NO: 3863755 - RNA, 21 nt, Human
caggagcccugggaggcucug

SEQ ID NO: 3863756 - RNA, 17 nt, Human
caggagccgaagcccag

SEQ ID NO: 3863757 - RNA, 14 nt, Human
caggagccugugac

SEQ ID NO: 3863758 - RNA, 15 nt, Human
caggagccugugccu

SEQ ID NO: 3863759 - RNA, 22 nt, Human
caggagcgcucccuugaccugc

SEQ ID NO: 3863760 - RNA, 12 nt, Human
caggagcucaga

SEQ ID NO: 3863761 - RNA, 18 nt, Human
caggagcuccccucccca

SEQ ID NO: 3863762 - RNA, 19 nt, Human
caggagcucuucaggccuc

SEQ ID NO: 3863763 - RNA, 13 nt, Human
caggagcugccca

SEQ ID NO: 3863764 - RNA, 22 nt, Human
caggagcugcccagaguugcug

SEQ ID NO: 3863765 - RNA, 22 nt, Human
caggagcugggauccuaagggc

SEQ ID NO: 3863766 - RNA, 12 nt, Human
caggagcugggc

SEQ ID NO: 3863767 - RNA, 15 nt, Human
caggagcugggcaga

SEQ ID NO: 3863768 - RNA, 19 nt, Human
caggagcugucaccaagga

SEQ ID NO: 3863769 - RNA, 15 nt, Human
caggaggaauacuga

SEQ ID NO: 3863770 - RNA, 15 nt, Human
caggaggacaauuca

SEQ ID NO: 3863771 - RNA, 16 nt, Human
caggaggacaauucau

SEQ ID NO: 3863772 - RNA, 16 nt, Human
caggaggacccagggc

SEQ ID NO: 3863773 - RNA, 23 nt, Human
caggaggacugccccgugcagac

SEQ ID NO: 3863774 - RNA, 22 nt, Human
caggaggauugcuugagcccag

SEQ ID NO: 3863775 - RNA, 23 nt, Human
caggaggauugcuugagcccagg

SEQ ID NO: 3863776 - RNA, 18 nt, Human
caggaggcaggaccuucg

SEQ ID NO: 3863777 - RNA, 21 nt, Human
caggaggcaggcauggcccug

SEQ ID NO: 3863778 - RNA, 19 nt, Human
caggaggcagggaggcagc

SEQ ID NO: 3863779 - RNA, 13 nt, Human
caggaggccagcc

SEQ ID NO: 3863780 - RNA, 19 nt, Human
caggaggccagccuugacc

SEQ ID NO: 3863781 - RNA, 20 nt, Human
caggaggccccuggcccagc

SEQ ID NO: 3863782 - RNA, 12 nt, Human
caggaggcugag

SEQ ID NO: 3863783 - RNA, 16 nt, Human
caggaggcugaggcag

SEQ ID NO: 3863784 - RNA, 18 nt, Human
caggaggcugaggcagaa

SEQ ID NO: 3863785 - RNA, 20 nt, Human
caggaggcugaggcagaaga

SEQ ID NO: 3863786 - RNA, 21 nt, Human
caggaggcugaggcagaagaa

SEQ ID NO: 3863787 - RNA, 17 nt, Human
caggaggcugaggcagg

SEQ ID NO: 3863788 - RNA, 19 nt, Human
caggaggcugaggcaggag

SEQ ID NO: 3863789 - RNA, 21 nt, Human
caggaggcugggacgcucugc

SEQ ID NO: 3863790 - RNA, 23 nt, Human
caggaggcugggacgcucugcug

SEQ ID NO: 3863791 - RNA, 18 nt, Human
caggagggacaaaggagc

SEQ ID NO: 3863792 - RNA, 22 nt, Human
caggagggacaaaggagccugu

SEQ ID NO: 3863793 - RNA, 23 nt, Human
caggagggacaaaggagccugug

SEQ ID NO: 3863794 - RNA, 24 nt, Human
caggagggacaaaggagccuguga

SEQ ID NO: 3863795 - RNA, 16 nt, Human
caggagggacagucuc

SEQ ID NO: 3863796 - RNA, 19 nt, Human
caggagggagguuugugag

SEQ ID NO: 3863797 - RNA, 16 nt, Human
caggagggcauccaua

SEQ ID NO: 3863798 - RNA, 16 nt, Human
caggagggcccuaccu

SEQ ID NO: 3863799 - RNA, 16 nt, Human
caggagggggucgugg

SEQ ID NO: 3863800 - RNA, 18 nt, Human
caggagggggucguggag

SEQ ID NO: 3863801 - RNA, 23 nt, Human
caggagggggucguggagagcua

SEQ ID NO: 3863802 - RNA, 15 nt, Human
caggagggucuaugg

SEQ ID NO: 3863803 - RNA, 19 nt, Human
caggaggugccacuggagu

SEQ ID NO: 3863804 - RNA, 18 nt, Human
caggagguggcuauggcc

SEQ ID NO: 3863805 - RNA, 15 nt, Human
caggagguggucugg

SEQ ID NO: 3863806 - RNA, 19 nt, Human
caggagguuuuuuugucaa

SEQ ID NO: 3863807 - RNA, 15 nt, Human
caggaguagcugagc

SEQ ID NO: 3863808 - RNA, 16 nt, Human
caggaguagcugagcu

SEQ ID NO: 3863809 - RNA, 17 nt, Human
caggaguagcugagcuc

SEQ ID NO: 3863810 - RNA, 20 nt, Human
caggaguccaagaccagacu

SEQ ID NO: 3863811 - RNA, 16 nt, Human
caggagucccaaggaa

SEQ ID NO: 3863812 - RNA, 21 nt, Human
caggagucccaaggaaagccc

SEQ ID NO: 3863813 - RNA, 24 nt, Human
caggagucccaaggaaagccccag

SEQ ID NO: 3863814 - RNA, 15 nt, Human
caggagucccugcca

SEQ ID NO: 3863815 - RNA, 21 nt, Human
caggagucccugccaucaugu

SEQ ID NO: 3863816 - RNA, 12 nt, Human
caggagugagca

SEQ ID NO: 3863817 - RNA, 16 nt, Human
caggagugggugggga

SEQ ID NO: 3863818 - RNA, 17 nt, Human
caggaguggugcagaca

SEQ ID NO: 3863819 - RNA, 24 nt, Human
caggaguggugcagacagaagucu

SEQ ID NO: 3863820 - RNA, 17 nt, Human
caggaguguccucuucc

SEQ ID NO: 3863821 - RNA, 14 nt, Human
caggccucccuguu

SEQ ID NO: 3863822 - RNA, 22 nt, Human
caggccucucccuccuccagga

SEQ ID NO: 3863823 - RNA, 14 nt, Human
caggccucuguguc

SEQ ID NO: 3863824 - RNA, 12 nt, Human
caggccucuugg

SEQ ID NO: 3863825 - RNA, 19 nt, Human
caggccucuuggcagucac

SEQ ID NO: 3863826 - RNA, 13 nt, Human
caggccugacucu

SEQ ID NO: 3863827 - RNA, 14 nt, Human
caggccugagauuu

SEQ ID NO: 3863828 - RNA, 19 nt, Human
caggccugagauuucaucu

SEQ ID NO: 3863829 - RNA, 22 nt, Human
caggccugcagcaggaguggug

SEQ ID NO: 3863830 - RNA, 18 nt, Human
caggccugccagacggca

SEQ ID NO: 3863831 - RNA, 16 nt, Human
caggccugccucccac

SEQ ID NO: 3863832 - RNA, 13 nt, Human
caggccugcgaga

SEQ ID NO: 3863833 - RNA, 12 nt, Human
caggccugggcc

SEQ ID NO: 3863834 - RNA, 20 nt, Human
caggccugggggcugggcag

SEQ ID NO: 3863835 - RNA, 18 nt, Human
caggccugggucuguguc

SEQ ID NO: 3863836 - RNA, 19 nt, Human
caggccugggucugugucu

SEQ ID NO: 3863837 - RNA, 16 nt, Human
caggccuguguagcug

SEQ ID NO: 3863838 - RNA, 20 nt, Human
caggccuguguagcugugac

SEQ ID NO: 3863839 - RNA, 13 nt, Human
caggccuguugcu

SEQ ID NO: 3863840 - RNA, 23 nt, Human
caggccuguugcuauagagccua

SEQ ID NO: 3863841 - RNA, 15 nt, Human
caggcgaggccugga

SEQ ID NO: 3863842 - RNA, 17 nt, Human
caggcgccccuuccccc

SEQ ID NO: 3863843 - RNA, 23 nt, Human
caggcgcugcccaccugccggcc

SEQ ID NO: 3863844 - RNA, 20 nt, Human
caggcgcugugcuaucauga

SEQ ID NO: 3863845 - RNA, 16 nt, Human
caggcgggcucaagga

SEQ ID NO: 3863846 - RNA, 13 nt, Human
caggcguucagcu

SEQ ID NO: 3863847 - RNA, 19 nt, Human
caggcguucagcucacugu

SEQ ID NO: 3863848 - RNA, 22 nt, Human
caggcguucagcucacuguucu

SEQ ID NO: 3863849 - RNA, 19 nt, Human
caggcuaaggcguggagcu

SEQ ID NO: 3863850 - RNA, 16 nt, Human
caggcuagagugcagu

SEQ ID NO: 3863851 - RNA, 16 nt, Human
caggcucacucacaga

SEQ ID NO: 3863852 - RNA, 22 nt, Human
caggcucacugccaggccagcc

SEQ ID NO: 3863853 - RNA, 15 nt, Human
caggcucccaggagc

SEQ ID NO: 3863854 - RNA, 19 nt, Human
caggcucccagggacaccu

SEQ ID NO: 3863855 - RNA, 14 nt, Human
caggcuccccugag

SEQ ID NO: 3863856 - RNA, 15 nt, Human
caggcuccccugagg

SEQ ID NO: 3863857 - RNA, 13 nt, Human
caggcuccucccu

SEQ ID NO: 3863858 - RNA, 21 nt, Human
caggcuccucccucccucugc

SEQ ID NO: 3863859 - RNA, 13 nt, Human
caggcuccugcca

SEQ ID NO: 3863860 - RNA, 18 nt, Human
caggcuccugccaccacg

SEQ ID NO: 3863861 - RNA, 17 nt, Human
caggcuccuuccugucu

SEQ ID NO: 3863862 - RNA, 21 nt, Human
caggcuccuuccugucuuccu

SEQ ID NO: 3863863 - RNA, 19 nt, Human
caggcuccuuuagcgccca

SEQ ID NO: 3863864 - RNA, 14 nt, Human
caggcucucaacag

SEQ ID NO: 3863865 - RNA, 12 nt, Human
caggcucucagg

SEQ ID NO: 3863866 - RNA, 13 nt, Human
caggcucuccauu

SEQ ID NO: 3863867 - RNA, 13 nt, Human
caggcucugcccu

SEQ ID NO: 3863868 - RNA, 22 nt, Human
caggcucugcccugcccuagcu

SEQ ID NO: 3863869 - RNA, 17 nt, Human
caggcucugccucaccu

SEQ ID NO: 3863870 - RNA, 14 nt, Human
caggcucugugcug

SEQ ID NO: 3863871 - RNA, 15 nt, Human
caggcucugugcuga

SEQ ID NO: 3863872 - RNA, 19 nt, Human
caggcucugugcugacccu

SEQ ID NO: 3863873 - RNA, 22 nt, Human
caggcucugugcugacccuccu

SEQ ID NO: 3863874 - RNA, 23 nt, Human
caggcucugugcugacccuccug

SEQ ID NO: 3863875 - RNA, 24 nt, Human
caggcucugugcugacccuccugu

SEQ ID NO: 3863876 - RNA, 21 nt, Human
caggcucuuagcagcuuccag

SEQ ID NO: 3863877 - RNA, 14 nt, Human
caggcucuucuccu

SEQ ID NO: 3863878 - RNA, 22 nt, Human
caggcucuuuggggucagccag

SEQ ID NO: 3863879 - RNA, 23 nt, Human
caggcucuuuggggucagccagg

SEQ ID NO: 3863880 - RNA, 14 nt, Human
caggcugaaaacaa

SEQ ID NO: 3863881 - RNA, 18 nt, Human
caggcugaagcagguucc

SEQ ID NO: 3863882 - RNA, 14 nt, Human
caggcugaccacag

SEQ ID NO: 3863883 - RNA, 17 nt, Human
caggcugaccacagcac

SEQ ID NO: 3863884 - RNA, 13 nt, Human
caggcugagcuga

SEQ ID NO: 3863885 - RNA, 11 nt, Human
caggcugaggu

SEQ ID NO: 3863886 - RNA, 14 nt, Human
caggcugagugcag

SEQ ID NO: 3863887 - RNA, 16 nt, Human
caggcugagugcaggc

SEQ ID NO: 3863888 - RNA, 14 nt, Human
caggcugcagcugg

SEQ ID NO: 3863889 - RNA, 17 nt, Human
caggcugcagcuggaca

SEQ ID NO: 3863890 - RNA, 21 nt, Human
caggcugcauagaaggaggag

SEQ ID NO: 3863891 - RNA, 19 nt, Human
caggcugccagugccuggg

SEQ ID NO: 3863892 - RNA, 15 nt, Human
caggcugccugagca

SEQ ID NO: 3863893 - RNA, 18 nt, Human
caggcugcggccccuccc

SEQ ID NO: 3863894 - RNA, 15 nt, Human
caggcugcucucaaa

SEQ ID NO: 3863895 - RNA, 23 nt, Human
caggcugcucuugaacuccugac

SEQ ID NO: 3863896 - RNA, 16 nt, Human
caggcugcuggcgccu

SEQ ID NO: 3863897 - RNA, 21 nt, Human
caggcugcuggggccucagac

SEQ ID NO: 3863898 - RNA, 15 nt, Human
caggcugcuugggau

SEQ ID NO: 3863899 - RNA, 21 nt, Human
caggcuggagguaaggccuuu

SEQ ID NO: 3863900 - RNA, 15 nt, Human
caggcuggaguacag

SEQ ID NO: 3863901 - RNA, 13 nt, Human
caggcuggaguua

SEQ ID NO: 3863902 - RNA, 20 nt, Human
caggcuggcaccgccuucuc

SEQ ID NO: 3863903 - RNA, 17 nt, Human
caggcuggcagcucucc

SEQ ID NO: 3863904 - RNA, 19 nt, Human
caggcuggcagcucuccag

SEQ ID NO: 3863905 - RNA, 11 nt, Human
caggcuggcca

SEQ ID NO: 3863906 - RNA, 12 nt, Human
caggcuggccag

SEQ ID NO: 3863907 - RNA, 13 nt, Human
caggcuggccagc

SEQ ID NO: 3863908 - RNA, 15 nt, Human
caggcuggccagccc

SEQ ID NO: 3863909 - RNA, 18 nt, Human
caggcuggccagccccac

SEQ ID NO: 3863910 - RNA, 19 nt, Human
caggcuggccagccccaca

SEQ ID NO: 3863911 - RNA, 19 nt, Human
caggcuggccagccgcucu

SEQ ID NO: 3863912 - RNA, 14 nt, Human
caggcuggccaguc

SEQ ID NO: 3863913 - RNA, 16 nt, Human
caggcuggccagucca

SEQ ID NO: 3863914 - RNA, 17 nt, Human
caggcuggcccugcccu

SEQ ID NO: 3863915 - RNA, 18 nt, Human
caggcuggcccugcccug

SEQ ID NO: 3863916 - RNA, 19 nt, Human
caggcuggcccugcccugg

SEQ ID NO: 3863917 - RNA, 15 nt, Human
caggcuggcgcagcc

SEQ ID NO: 3863918 - RNA, 18 nt, Human
caggcuggcgugcagugg

SEQ ID NO: 3863919 - RNA, 19 nt, Human
caggcuggcgugcaguggu

SEQ ID NO: 3863920 - RNA, 21 nt, Human
caggcugggagagccuuccag

SEQ ID NO: 3863921 - RNA, 12 nt, Human
caggcugggcca

SEQ ID NO: 3863922 - RNA, 23 nt, Human
caggcugggccauguccaaagag

SEQ ID NO: 3863923 - RNA, 15 nt, Human
caggcugggcuucag

SEQ ID NO: 3863924 - RNA, 17 nt, Human
caggcugggcuucagug

SEQ ID NO: 3863925 - RNA, 23 nt, Human
caggcugggcuucaguggcagcu

SEQ ID NO: 3863926 - RNA, 21 nt, Human
caggcugggucgcccuggacu

SEQ ID NO: 3863927 - RNA, 16 nt, Human
caggcugggugacaga

SEQ ID NO: 3863928 - RNA, 23 nt, Human
caggcuggucucaaacuccugac

SEQ ID NO: 3863929 - RNA, 19 nt, Human
caggcuggucucaaacucu

SEQ ID NO: 3863930 - RNA, 22 nt, Human
caggcuggucucgaacuccuga

SEQ ID NO: 3863931 - RNA, 23 nt, Human
caggcuggucucgaacuccugac

SEQ ID NO: 3863932 - RNA, 23 nt, Human
caggcuguaucccaugagccuca

SEQ ID NO: 3863933 - RNA, 16 nt, Human
caggcugucuggccag

SEQ ID NO: 3863934 - RNA, 19 nt, Human
caggcuguucugcacugaa

SEQ ID NO: 3863935 - RNA, 21 nt, Human
caggcuuaauaaaaaugacag

SEQ ID NO: 3863936 - RNA, 16 nt, Human
caggcuuagggacagg

SEQ ID NO: 3863937 - RNA, 23 nt, Human
caggcuuagucacugagacagcc

SEQ ID NO: 3863938 - RNA, 21 nt, Human
caggcuuccugcaauuuucua

SEQ ID NO: 3863939 - RNA, 19 nt, Human
caggcuuuguacagagugc

SEQ ID NO: 3863940 - RNA, 21 nt, Human
caggcuuuuuuccagacucua

SEQ ID NO: 3863941 - RNA, 20 nt, Human
cagggaaaagcagcucuccc

SEQ ID NO: 3863942 - RNA, 15 nt, Human
cagggaaaauaggca

SEQ ID NO: 3863943 - RNA, 15 nt, Human
cagggaaaauauaua

SEQ ID NO: 3863944 - RNA, 14 nt, Human
cagggaaaggcucu

SEQ ID NO: 3863945 - RNA, 19 nt, Human
cagggaacccugcuugcac

SEQ ID NO: 3863946 - RNA, 16 nt, Human
cagggaagagaaagug

SEQ ID NO: 3863947 - RNA, 22 nt, Human
cagggaagagcagaacggagcc

SEQ ID NO: 3863948 - RNA, 15 nt, Human
cagggaagaggggug

SEQ ID NO: 3863949 - RNA, 23 nt, Human
cagggaagaggggugcagaggcu

SEQ ID NO: 3863950 - RNA, 15 nt, Human
cagggaagcagcagc

SEQ ID NO: 3863951 - RNA, 12 nt, Human
cagggaagccca

SEQ ID NO: 3863952 - RNA, 15 nt, Human
cagggaagccccaca

SEQ ID NO: 3863953 - RNA, 17 nt, Human
cagggaagccccacaug

SEQ ID NO: 3863954 - RNA, 22 nt, Human
cagggaagccccacauguccag

SEQ ID NO: 3863955 - RNA, 14 nt, Human
cagggaagcuacag

SEQ ID NO: 3863956 - RNA, 21 nt, Human
cagggaagcuacagguuacaa

SEQ ID NO: 3863957 - RNA, 16 nt, Human
cagggaaggaggagcc

SEQ ID NO: 3863958 - RNA, 13 nt, Human
cagggaaggaucc

SEQ ID NO: 3863959 - RNA, 12 nt, Human
cagggaaggcag

SEQ ID NO: 3863960 - RNA, 17 nt, Human
cagggaaggcaggcagg

SEQ ID NO: 3863961 - RNA, 22 nt, Human
cagggaaggcaggcagggcucu

SEQ ID NO: 3863962 - RNA, 17 nt, Human
cagggaaggggacaagg

SEQ ID NO: 3863963 - RNA, 23 nt, Human
cagggaaguccccaggccccagg

SEQ ID NO: 3863964 - RNA, 15 nt, Human
cagggaaguggggag

SEQ ID NO: 3863965 - RNA, 20 nt, Human
cauacuacugaaacagauuu

SEQ ID NO: 3863966 - RNA, 14 nt, Human
cauacucagccugc

SEQ ID NO: 3863967 - RNA, 15 nt, Human
cauacucagccugcu

SEQ ID NO: 3863968 - RNA, 20 nt, Human
cauacucagccugcugccca

SEQ ID NO: 3863969 - RNA, 18 nt, Human
cauacucauuucuaaaag

SEQ ID NO: 3863970 - RNA, 21 nt, Human
cauacucauuucuaaaagaau

SEQ ID NO: 3863971 - RNA, 22 nt, Human
cauacucauuuuucaugauaau

SEQ ID NO: 3863972 - RNA, 20 nt, Human
cauacuccuuccaucaaaua

SEQ ID NO: 3863973 - RNA, 22 nt, Human
cauacugagccaaguauaauuu

SEQ ID NO: 3863974 - RNA, 15 nt, Human
cauacugagggacca

SEQ ID NO: 3863975 - RNA, 18 nt, Human
cauacugugcuggagcca

SEQ ID NO: 3863976 - RNA, 16 nt, Human
cauacuuaucucucug

SEQ ID NO: 3863977 - RNA, 20 nt, Human
cauacuuaucucucugugcu

SEQ ID NO: 3863978 - RNA, 17 nt, Human
cauacuucaaaaguauu

SEQ ID NO: 3863979 - RNA, 20 nt, Human
cauacuugaacguuuucuaa

SEQ ID NO: 3863980 - RNA, 23 nt, Human
cauacuugaacguuuucuaauug

SEQ ID NO: 3863981 - RNA, 21 nt, Human
cauacuugaagggccagagcc

SEQ ID NO: 3863982 - RNA, 23 nt, Human
cauacuugaagggccagagccag

SEQ ID NO: 3863983 - RNA, 14 nt, Human
cauacuuuccugua

SEQ ID NO: 3863984 - RNA, 16 nt, Human
cauacuuuguauuuug

SEQ ID NO: 3863985 - RNA, 12 nt, Human
cauacuuugucu

SEQ ID NO: 3863986 - RNA, 16 nt, Human
cauacuuugucugaaa

SEQ ID NO: 3863987 - RNA, 18 nt, Human
cauacuuugucugaaaaa

SEQ ID NO: 3863988 - RNA, 16 nt, Human
cauacuuuuuaaaugu

SEQ ID NO: 3863989 - RNA, 20 nt, Human
cauacuuuuuaaauguaaag

SEQ ID NO: 3863990 - RNA, 14 nt, Human
cauagaaacaugac

SEQ ID NO: 3863991 - RNA, 19 nt, Human
cauagaaacaugacacuga

SEQ ID NO: 3863992 - RNA, 20 nt, Human
cauagaaauggaaauuuugc

SEQ ID NO: 3863993 - RNA, 23 nt, Human
cauagaaauguaacuuuuguaag

SEQ ID NO: 3863994 - RNA, 20 nt, Human
cauagaacuggguaaaugca

SEQ ID NO: 3863995 - RNA, 14 nt, Human
cauagaauaaaauu

SEQ ID NO: 3863996 - RNA, 15 nt, Human
cauagaauagcaugu

SEQ ID NO: 3863997 - RNA, 19 nt, Human
cauagacagaagaaacaag

SEQ ID NO: 3863998 - RNA, 20 nt, Human
cauagacagaagaaacaagg

SEQ ID NO: 3863999 - RNA, 14 nt, Human
cauagacaugaaag

SEQ ID NO: 3864000 - RNA, 15 nt, Human
cauagacccucucaa

SEQ ID NO: 3864001 - RNA, 17 nt, Human
cauagaccuuuucauuu

SEQ ID NO: 3864002 - RNA, 15 nt, Human
cauagacuagagaaa

SEQ ID NO: 3864003 - RNA, 16 nt, Human
cauagacuagagaaac

SEQ ID NO: 3864004 - RNA, 18 nt, Human
cauagagacuugggaaug

SEQ ID NO: 3864005 - RNA, 14 nt, Human
cauagagcagcacu

SEQ ID NO: 3864006 - RNA, 21 nt, Human
cauagaggugagggaagccug

SEQ ID NO: 3864007 - RNA, 14 nt, Human
cauagaguacacug

SEQ ID NO: 3864008 - RNA, 18 nt, Human
cauagaguuuaacacaag

SEQ ID NO: 3864009 - RNA, 16 nt, Human
cauagauaauauuguu

SEQ ID NO: 3864010 - RNA, 17 nt, Human
cauagauaauauuguuu

SEQ ID NO: 3864011 - RNA, 22 nt, Human
cauagauaauauuguuugguaa

SEQ ID NO: 3864012 - RNA, 15 nt, Human
cauagaucuucugaa

SEQ ID NO: 3864013 - RNA, 15 nt, Human
cauagaugcagguga

SEQ ID NO: 3864014 - RNA, 23 nt, Human
cauagaugucccuuucuuggcca

SEQ ID NO: 3864015 - RNA, 16 nt, Human
cauagauguuuuggua

SEQ ID NO: 3864016 - RNA, 18 nt, Human
cauagauuaauggcacug

SEQ ID NO: 3864017 - RNA, 20 nt, Human
cauagauuaauggcacugau

SEQ ID NO: 3864018 - RNA, 14 nt, Human
cauagauucaccug

SEQ ID NO: 3864019 - RNA, 20 nt, Human
cauagauucaccuguaaaac

SEQ ID NO: 3864020 - RNA, 21 nt, Human
cauagauucaccuguaaaacu

SEQ ID NO: 3864021 - RNA, 23 nt, Human
cauagauucaccuguaaaacuuu

SEQ ID NO: 3864022 - RNA, 18 nt, Human
cauagauugagaaguuuu

SEQ ID NO: 3864023 - RNA, 16 nt, Human
cauagauuuauuuuuc

SEQ ID NO: 3864024 - RNA, 23 nt, Human
cauagauuuauuuuucaguucca

SEQ ID NO: 3864025 - RNA, 15 nt, Human
cauagcaagacacau

SEQ ID NO: 3864026 - RNA, 22 nt, Human
cauagcaccuaacaacauugua

SEQ ID NO: 3864027 - RNA, 13 nt, Human
cauagcacuuccc

SEQ ID NO: 3864028 - RNA, 23 nt, Human
cauagcagagaaugaaagggccc

SEQ ID NO: 3864029 - RNA, 14 nt, Human
cauagcagaucugu

SEQ ID NO: 3864030 - RNA, 16 nt, Human
cauagcagaucuguuu

SEQ ID NO: 3864031 - RNA, 20 nt, Human
cauagcagcuuauucacaag

SEQ ID NO: 3864032 - RNA, 14 nt, Human
cauagcaguauaug

SEQ ID NO: 3864033 - RNA, 21 nt, Human
cauagcauagcuagagauugg

SEQ ID NO: 3864034 - RNA, 18 nt, Human
cauagcaugacauuucuu

SEQ ID NO: 3864035 - RNA, 11 nt, Human
cauagcauuca

SEQ ID NO: 3864036 - RNA, 17 nt, Human
cauagcccaucccugcc

SEQ ID NO: 3864037 - RNA, 19 nt, Human
cauagcccucacccugggg

SEQ ID NO: 3864038 - RNA, 18 nt, Human
cauagcgggggccuaaaa

SEQ ID NO: 3864039 - RNA, 21 nt, Human
cauagcuaagaaauaaaacug

SEQ ID NO: 3864040 - RNA, 22 nt, Human
cauagcuacccaaaagagaaaa

SEQ ID NO: 3864041 - RNA, 14 nt, Human
cauagcuccugcuc

SEQ ID NO: 3864042 - RNA, 13 nt, Human
cauagcugcugcc

SEQ ID NO: 3864043 - RNA, 20 nt, Human
cauagcugguuccugcuaga

SEQ ID NO: 3864044 - RNA, 15 nt, Human
cauagcugucuagag

SEQ ID NO: 3864045 - RNA, 13 nt, Human
cauagcugugauu

SEQ ID NO: 3864046 - RNA, 20 nt, Human
cauagcuuauuauugaagga

SEQ ID NO: 3864047 - RNA, 16 nt, Human
cauaggaccuuuccac

SEQ ID NO: 3864048 - RNA, 18 nt, Human
cauaggaccuuuccacca

SEQ ID NO: 3864049 - RNA, 17 nt, Human
cauaggaggcuucuguu

SEQ ID NO: 3864050 - RNA, 16 nt, Human
cauaggaguuuggagg

SEQ ID NO: 3864051 - RNA, 21 nt, Human
cauaggcaccuuuuacuguga

SEQ ID NO: 3864052 - RNA, 15 nt, Human
cauaggcccacacac

SEQ ID NO: 3864053 - RNA, 16 nt, Human
cauaggccugcuuugu

SEQ ID NO: 3864054 - RNA, 19 nt, Human
cauaggccugggugcuggc

SEQ ID NO: 3864055 - RNA, 15 nt, Human
cauagggucucuuca

SEQ ID NO: 3864056 - RNA, 17 nt, Human
cauagggucucuucagg

SEQ ID NO: 3864057 - RNA, 23 nt, Human
cauagguagaauguaaagcuugu

SEQ ID NO: 3864058 - RNA, 23 nt, Human
cauaggugauccauguaacugcc

SEQ ID NO: 3864059 - RNA, 16 nt, Human
cauaggugaucucauu

SEQ ID NO: 3864060 - RNA, 15 nt, Human
cauagguuaaaaaaa

SEQ ID NO: 3864061 - RNA, 22 nt, Human
cauagguuaaaaaaaaaaguca

SEQ ID NO: 3864062 - RNA, 20 nt, Human
cauaguaacugacaugauua

SEQ ID NO: 3864063 - RNA, 22 nt, Human
cauaguaacuucuuauggaauu

SEQ ID NO: 3864064 - RNA, 20 nt, Human
cauaguaaguucagcacuug

SEQ ID NO: 3864065 - RNA, 19 nt, Human
cauaguaccauuuauacaa

SEQ ID NO: 3864066 - RNA, 21 nt, Human
cauaguacucuuuguagcaaa

SEQ ID NO: 3864067 - RNA, 23 nt, Human
cauaguauauuaaaaaugguaaa

SEQ ID NO: 3864068 - RNA, 17 nt, Human
cauaguaugguggcugg

SEQ ID NO: 3864069 - RNA, 13 nt, Human
cauagucccagcu

SEQ ID NO: 3864070 - RNA, 20 nt, Human
cauagucugaagugaaguac

SEQ ID NO: 3864071 - RNA, 19 nt, Human
cauagucuggcuguaccca

SEQ ID NO: 3864072 - RNA, 19 nt, Human
cauagugaaaauuguuuag

SEQ ID NO: 3864073 - RNA, 20 nt, Human
cauagugacuuuucaaguau

SEQ ID NO: 3864074 - RNA, 20 nt, Human
cauagugcuaacaugaagac

SEQ ID NO: 3864075 - RNA, 17 nt, Human
cauagugcugggaugga

SEQ ID NO: 3864076 - RNA, 22 nt, Human
cauaguggcuuaaaacaacacu

SEQ ID NO: 3864077 - RNA, 15 nt, Human
cauaguggugcagag

SEQ ID NO: 3864078 - RNA, 14 nt, Human
cauaguuacugugu

SEQ ID NO: 3864079 - RNA, 18 nt, Human
cauaguuacuguguaaac

SEQ ID NO: 3864080 - RNA, 19 nt, Human
cauaguucccauguuaaau

SEQ ID NO: 3864081 - RNA, 22 nt, Human
cauaguucuagugcagcugaaa

SEQ ID NO: 3864082 - RNA, 16 nt, Human
cauaguuucuuuauuu

SEQ ID NO: 3864083 - RNA, 18 nt, Human
cauaguuuggcauuugca

SEQ ID NO: 3864084 - RNA, 21 nt, Human
cauaguuugggcuuguaccac

SEQ ID NO: 3864085 - RNA, 15 nt, Human
cauaguuuuauuuau

SEQ ID NO: 3864086 - RNA, 20 nt, Human
cauaguuuugaugacuggca

SEQ ID NO: 3864087 - RNA, 14 nt, Human
cauauaaaauaaug

SEQ ID NO: 3864088 - RNA, 22 nt, Human
cauauaaaauaaugcaaagaau

SEQ ID NO: 3864089 - RNA, 18 nt, Human
cauauaaaauggcaacaa

SEQ ID NO: 3864090 - RNA, 21 nt, Human
cauauaaaauggcaacaaacu

SEQ ID NO: 3864091 - RNA, 11 nt, Human
cauauaagaca

SEQ ID NO: 3864092 - RNA, 18 nt, Human
cauauaagacaaauauuc

SEQ ID NO: 3864093 - RNA, 23 nt, Human
cauauaagauucauauuuacuuc

SEQ ID NO: 3864094 - RNA, 17 nt, Human
cauauaagcccuugauu

SEQ ID NO: 3864095 - RNA, 16 nt, Human
cauauaagugauugcu

SEQ ID NO: 3864096 - RNA, 20 nt, Human
cauauaaguuugaaggaaac

SEQ ID NO: 3864097 - RNA, 21 nt, Human
cauauaaguuugaaggaaaca

SEQ ID NO: 3864098 - RNA, 23 nt, Human
cauauaaguuugaaggaaacagu

SEQ ID NO: 3864099 - RNA, 22 nt, Human
cauauaauagguuugaaaguac

SEQ ID NO: 3864100 - RNA, 15 nt, Human
cauauaauauauguu

SEQ ID NO: 3864101 - RNA, 17 nt, Human
cauauaauauauguuuu

SEQ ID NO: 3864102 - RNA, 14 nt, Human
cauauacacacaca

SEQ ID NO: 3864103 - RNA, 23 nt, Human
cauauacacgaauagacaucaaa

SEQ ID NO: 3864104 - RNA, 12 nt, Human
cauauacacuug

SEQ ID NO: 3864105 - RNA, 19 nt, Human
cauauaccagcaauauauc

SEQ ID NO: 3864106 - RNA, 17 nt, Human
cauauaccuauaaugug

SEQ ID NO: 3864107 - RNA, 20 nt, Human
cauauagagaugaaguuugu

SEQ ID NO: 3864108 - RNA, 19 nt, Human
cauccuccaguaccuugcu

SEQ ID NO: 3864109 - RNA, 13 nt, Human
cauccucccaagg

SEQ ID NO: 3864110 - RNA, 21 nt, Human
cauccuccccuucccugcaaa

SEQ ID NO: 3864111 - RNA, 16 nt, Human
cauccuccguccagcc

SEQ ID NO: 3864112 - RNA, 19 nt, Human
cauccuccguccagccgcc

SEQ ID NO: 3864113 - RNA, 20 nt, Human
cauccuccucccacccggcu

SEQ ID NO: 3864114 - RNA, 15 nt, Human
cauccuccuccuucc

SEQ ID NO: 3864115 - RNA, 18 nt, Human
cauccuccuccuuccuag

SEQ ID NO: 3864116 - RNA, 18 nt, Human
cauccucuggagccagcc

SEQ ID NO: 3864117 - RNA, 11 nt, Human
cauccucuuuc

SEQ ID NO: 3864118 - RNA, 21 nt, Human
cauccucuuucucuuuucuag

SEQ ID NO: 3864119 - RNA, 16 nt, Human
cauccugaacagcaug

SEQ ID NO: 3864120 - RNA, 17 nt, Human
cauccugacucugcccc

SEQ ID NO: 3864121 - RNA, 13 nt, Human
cauccugagcccc

SEQ ID NO: 3864122 - RNA, 14 nt, Human
cauccugagccccg

SEQ ID NO: 3864123 - RNA, 19 nt, Human
cauccugaggcuccacuug

SEQ ID NO: 3864124 - RNA, 13 nt, Human
cauccugccagcc

SEQ ID NO: 3864125 - RNA, 14 nt, Human
cauccugccagccc

SEQ ID NO: 3864126 - RNA, 15 nt, Human
cauccugccagcccc

SEQ ID NO: 3864127 - RNA, 21 nt, Human
cauccugccuuagagccaggc

SEQ ID NO: 3864128 - RNA, 11 nt, Human
cauccuggccc

SEQ ID NO: 3864129 - RNA, 16 nt, Human
cauccuggcccagggc

SEQ ID NO: 3864130 - RNA, 19 nt, Human
cauccuggcccagggcauc

SEQ ID NO: 3864131 - RNA, 14 nt, Human
cauccuggcccauc

SEQ ID NO: 3864132 - RNA, 15 nt, Human
cauccuggcccauca

SEQ ID NO: 3864133 - RNA, 14 nt, Human
cauccuggccuggc

SEQ ID NO: 3864134 - RNA, 18 nt, Human
cauccuggccuggcacau

SEQ ID NO: 3864135 - RNA, 13 nt, Human
cauccuggguaau

SEQ ID NO: 3864136 - RNA, 19 nt, Human
cauccuguauaagcacuga

SEQ ID NO: 3864137 - RNA, 20 nt, Human
cauccugucccaccaugcag

SEQ ID NO: 3864138 - RNA, 19 nt, Human
cauccugugccuccaucag

SEQ ID NO: 3864139 - RNA, 23 nt, Human
cauccuguguguuaagcucugcu

SEQ ID NO: 3864140 - RNA, 11 nt, Human
cauccuuaaag

SEQ ID NO: 3864141 - RNA, 19 nt, Human
cauccuuauccuucaucuu

SEQ ID NO: 3864142 - RNA, 21 nt, Human
cauccuucaagaacucugggc

SEQ ID NO: 3864143 - RNA, 15 nt, Human
cauccuucccacucu

SEQ ID NO: 3864144 - RNA, 16 nt, Human
cauccuucccacucug

SEQ ID NO: 3864145 - RNA, 22 nt, Human
cauccuucccugucugccaggg

SEQ ID NO: 3864146 - RNA, 13 nt, Human
cauccuuccuaua

SEQ ID NO: 3864147 - RNA, 18 nt, Human
cauccuuccucacaccag

SEQ ID NO: 3864148 - RNA, 15 nt, Human
cauccuuccuuccca

SEQ ID NO: 3864149 - RNA, 15 nt, Human
cauccuuuacguguu

SEQ ID NO: 3864150 - RNA, 22 nt, Human
cauccuuuaggguucugccucu

SEQ ID NO: 3864151 - RNA, 21 nt, Human
cauccuuucacuucuuucccu

SEQ ID NO: 3864152 - RNA, 18 nt, Human
cauccuuucugccucuca

SEQ ID NO: 3864153 - RNA, 19 nt, Human
cauccuuugcagggcagcc

SEQ ID NO: 3864154 - RNA, 17 nt, Human
cauccuuuucuccuauc

SEQ ID NO: 3864155 - RNA, 17 nt, Human
cauccuuuucugcagag

SEQ ID NO: 3864156 - RNA, 12 nt, Human
caucgcaaugua

SEQ ID NO: 3864157 - RNA, 14 nt, Human
caucgcacugugga

SEQ ID NO: 3864158 - RNA, 15 nt, Human
caucgccacaaacuc

SEQ ID NO: 3864159 - RNA, 20 nt, Human
caucgccagaggugcuucac

SEQ ID NO: 3864160 - RNA, 20 nt, Human
caucgccagcugaugacuca

SEQ ID NO: 3864161 - RNA, 20 nt, Human
caucggacaagacccccagc

SEQ ID NO: 3864162 - RNA, 16 nt, Human
caucggccuagggccc

SEQ ID NO: 3864163 - RNA, 15 nt, Human
caucguaggugauuu

SEQ ID NO: 3864164 - RNA, 17 nt, Human
caucgucuucuuggcca

SEQ ID NO: 3864165 - RNA, 18 nt, Human
caucgugaagaagccugu

SEQ ID NO: 3864166 - RNA, 22 nt, Human
caucguuuucuucacuguccuc

SEQ ID NO: 3864167 - RNA, 19 nt, Human
caucuaaaaauauacaugu

SEQ ID NO: 3864168 - RNA, 17 nt, Human
caucuaaacuaagaugu

SEQ ID NO: 3864169 - RNA, 15 nt, Human
caucuaaacugcccc

SEQ ID NO: 3864170 - RNA, 15 nt, Human
caucuaaacuuuaau

SEQ ID NO: 3864171 - RNA, 16 nt, Human
caucuaagccugaagg

SEQ ID NO: 3864172 - RNA, 16 nt, Human
caucuaagcugcagcu

SEQ ID NO: 3864173 - RNA, 23 nt, Human
caucuaagcugcagcuuccuguc

SEQ ID NO: 3864174 - RNA, 20 nt, Human
caucuaaguuauaagacucu

SEQ ID NO: 3864175 - RNA, 15 nt, Human
caucuaauucugauu

SEQ ID NO: 3864176 - RNA, 19 nt, Human
caucuaccuagauuuaaua

SEQ ID NO: 3864177 - RNA, 21 nt, Human
caucuaccuuuucucuucauu

SEQ ID NO: 3864178 - RNA, 14 nt, Human
caucuacucccaag

SEQ ID NO: 3864179 - RNA, 14 nt, Human
caucuacuucaggc

SEQ ID NO: 3864180 - RNA, 16 nt, Human
caucuagagcuugaug

SEQ ID NO: 3864181 - RNA, 20 nt, Human
caucuagaggcuuccuucau

SEQ ID NO: 3864182 - RNA, 22 nt, Human
caucuagaggcuuccuucauuu

SEQ ID NO: 3864183 - RNA, 14 nt, Human
caucuagcaaaugu

SEQ ID NO: 3864184 - RNA, 17 nt, Human
caucuagccagccccuc

SEQ ID NO: 3864185 - RNA, 17 nt, Human
caucuagguaaauuaca

SEQ ID NO: 3864186 - RNA, 18 nt, Human
caucuagguaauuuuuac

SEQ ID NO: 3864187 - RNA, 13 nt, Human
caucuaguuuuaa

SEQ ID NO: 3864188 - RNA, 13 nt, Human
caucuaucugugc

SEQ ID NO: 3864189 - RNA, 14 nt, Human
caucuaucugugcu

SEQ ID NO: 3864190 - RNA, 20 nt, Human
caucuaugggagagugucaa

SEQ ID NO: 3864191 - RNA, 20 nt, Human
caucuauucucuccaaaaau

SEQ ID NO: 3864192 - RNA, 13 nt, Human
caucuauuucuga

SEQ ID NO: 3864193 - RNA, 11 nt, Human
caucuauuuug

SEQ ID NO: 3864194 - RNA, 19 nt, Human
caucuauuuugaugcagca

SEQ ID NO: 3864195 - RNA, 14 nt, Human
caucucaaaauuau

SEQ ID NO: 3864196 - RNA, 20 nt, Human
caucucaacaggccucaggg

SEQ ID NO: 3864197 - RNA, 21 nt, Human
caucucaacaggccucagggc

SEQ ID NO: 3864198 - RNA, 22 nt, Human
caucucaaggaauaaugggcuu

SEQ ID NO: 3864199 - RNA, 16 nt, Human
caucucacacaugagc

SEQ ID NO: 3864200 - RNA, 17 nt, Human
caucucaccuccugcug

SEQ ID NO: 3864201 - RNA, 21 nt, Human
caucucagcucaucuucacug

SEQ ID NO: 3864202 - RNA, 15 nt, Human
caucucaggccaccu

SEQ ID NO: 3864203 - RNA, 21 nt, Human
caucucaggccaccugccccc

SEQ ID NO: 3864204 - RNA, 22 nt, Human
caucucaggccaccugcccccu

SEQ ID NO: 3864205 - RNA, 18 nt, Human
caucucaggccagagcca

SEQ ID NO: 3864206 - RNA, 18 nt, Human
caucucaggccucccuca

SEQ ID NO: 3864207 - RNA, 19 nt, Human
caucucaggggccagagga

SEQ ID NO: 3864208 - RNA, 21 nt, Human
caucucaucaugucuauuguc

SEQ ID NO: 3864209 - RNA, 15 nt, Human
caucucauccaucaa

SEQ ID NO: 3864210 - RNA, 19 nt, Human
caucucaugaggggagagg

SEQ ID NO: 3864211 - RNA, 20 nt, Human
caucucauguaucaucugga

SEQ ID NO: 3864212 - RNA, 22 nt, Human
caucucauucaaaccccacccu

SEQ ID NO: 3864213 - RNA, 17 nt, Human
caucucauuccaacuuc

SEQ ID NO: 3864214 - RNA, 14 nt, Human
caucuccaagaaug

SEQ ID NO: 3864215 - RNA, 17 nt, Human
caucuccaagaaugcug

SEQ ID NO: 3864216 - RNA, 13 nt, Human
caucuccaagcag

SEQ ID NO: 3864217 - RNA, 16 nt, Human
caucuccaccugcucc

SEQ ID NO: 3864218 - RNA, 21 nt, Human
caucuccagggaguccccucc

SEQ ID NO: 3864219 - RNA, 14 nt, Human
caucucccacccug

SEQ ID NO: 3864220 - RNA, 15 nt, Human
caucucccacccugu

SEQ ID NO: 3864221 - RNA, 17 nt, Human
caucucccagauaaugu

SEQ ID NO: 3864222 - RNA, 22 nt, Human
caucucccagauaaugugaaaa

SEQ ID NO: 3864223 - RNA, 14 nt, Human
caucuccccucagc

SEQ ID NO: 3864224 - RNA, 16 nt, Human
caucuccccucagcuc

SEQ ID NO: 3864225 - RNA, 15 nt, Human
caucucccucccaca

SEQ ID NO: 3864226 - RNA, 22 nt, Human
caucucccucgaacccacacug

SEQ ID NO: 3864227 - RNA, 23 nt, Human
caucucccucgaacccacacugc

SEQ ID NO: 3864228 - RNA, 15 nt, Human
caucucccugccugg

SEQ ID NO: 3864229 - RNA, 18 nt, Human
caucucccugccuggccc

SEQ ID NO: 3864230 - RNA, 15 nt, Human
caucucccugcuuug

SEQ ID NO: 3864231 - RNA, 17 nt, Human
caucucccuuuuccaug

SEQ ID NO: 3864232 - RNA, 13 nt, Human
caucuccugugca

SEQ ID NO: 3864233 - RNA, 19 nt, Human
caucuccugugcaugggug

SEQ ID NO: 3864234 - RNA, 20 nt, Human
caucuccugugcauggguga

SEQ ID NO: 3864235 - RNA, 21 nt, Human
caucucgccaccccuccuucc

SEQ ID NO: 3864236 - RNA, 14 nt, Human
caucucgcucccuc

SEQ ID NO: 3864237 - RNA, 19 nt, Human
caucucgcucccucccagg

SEQ ID NO: 3864238 - RNA, 14 nt, Human
caucucggagcauc

SEQ ID NO: 3864239 - RNA, 20 nt, Human
caucucggagcaucccggag

SEQ ID NO: 3864240 - RNA, 16 nt, Human
caucucuaacagcuca

SEQ ID NO: 3864241 - RNA, 19 nt, Human
caucucuaacagcucagga

SEQ ID NO: 3864242 - RNA, 21 nt, Human
caucucuaacagcucaggauc

SEQ ID NO: 3864243 - RNA, 22 nt, Human
caucucuaacagcucaggaucu

SEQ ID NO: 3864244 - RNA, 16 nt, Human
caucucuacaaaaagc

SEQ ID NO: 3864245 - RNA, 18 nt, Human
caucucucugcccaaccc

SEQ ID NO: 3864246 - RNA, 14 nt, Human
caucucucuggccc

SEQ ID NO: 3864247 - RNA, 15 nt, Human
caucucucuggcccu

SEQ ID NO: 3864248 - RNA, 14 nt, Human
caucucucuuuaau

SEQ ID NO: 3864249 - RNA, 18 nt, Human
caucucugaacuucagcu

SEQ ID NO: 3864250 - RNA, 13 nt, Human
caucucugacuuu

SEQ ID NO: 3864251 - RNA, 15 nt, Human
caucucugcaaucuu

SEQ ID NO: 3864252 - RNA, 21 nt, Human
caucucugcuugagucagguu

SEQ ID NO: 3864253 - RNA, 15 nt, Human
caucuuuuguauuaa

SEQ ID NO: 3864254 - RNA, 21 nt, Human
caucuuuugugagauguaauu

SEQ ID NO: 3864255 - RNA, 21 nt, Human
caucuuuuguuacucuuggga

SEQ ID NO: 3864256 - RNA, 21 nt, Human
caucuuuuuaaccugcaaaau

SEQ ID NO: 3864257 - RNA, 23 nt, Human
caugaaaaagcagcuaccaggug

SEQ ID NO: 3864258 - RNA, 15 nt, Human
caugaaaacacauuu

SEQ ID NO: 3864259 - RNA, 21 nt, Human
caugaaaaccauuaccugacu

SEQ ID NO: 3864260 - RNA, 22 nt, Human
caugaaaaccauuaccugacuu

SEQ ID NO: 3864261 - RNA, 22 nt, Human
caugaaaacguuuuauuguguu

SEQ ID NO: 3864262 - RNA, 22 nt, Human
caugaaaaugcaacaacaugua

SEQ ID NO: 3864263 - RNA, 17 nt, Human
caugaaaauguguguuu

SEQ ID NO: 3864264 - RNA, 15 nt, Human
caugaaaauucagaa

SEQ ID NO: 3864265 - RNA, 11 nt, Human
caugaaaauuu

SEQ ID NO: 3864266 - RNA, 15 nt, Human
caugaaacagaaaca

SEQ ID NO: 3864267 - RNA, 22 nt, Human
caugaaaccuuauuuuuuccca

SEQ ID NO: 3864268 - RNA, 15 nt, Human
caugaaacuccaccu

SEQ ID NO: 3864269 - RNA, 12 nt, Human
caugaaagaaaa

SEQ ID NO: 3864270 - RNA, 21 nt, Human
caugaaauaaaauauaucuua

SEQ ID NO: 3864271 - RNA, 14 nt, Human
caugaaauaugcau

SEQ ID NO: 3864272 - RNA, 20 nt, Human
caugaaaugaacacaaauua

SEQ ID NO: 3864273 - RNA, 21 nt, Human
caugaaaugcuaugucauuuc

SEQ ID NO: 3864274 - RNA, 16 nt, Human
caugaaaugugaauuu

SEQ ID NO: 3864275 - RNA, 20 nt, Human
caugaaaugugaauuuuuau

SEQ ID NO: 3864276 - RNA, 14 nt, Human
caugaaauuuuuaa

SEQ ID NO: 3864277 - RNA, 16 nt, Human
caugaaauuuuuguaa

SEQ ID NO: 3864278 - RNA, 22 nt, Human
caugaacagaaaacauucugau

SEQ ID NO: 3864279 - RNA, 16 nt, Human
caugaacauguuccug

SEQ ID NO: 3864280 - RNA, 20 nt, Human
caugaaccucaagcugcauc

SEQ ID NO: 3864281 - RNA, 23 nt, Human
caugaacuucgcaucaaaagaca

SEQ ID NO: 3864282 - RNA, 14 nt, Human
caugaagacaggau

SEQ ID NO: 3864283 - RNA, 17 nt, Human
caugaagaccacaucca

SEQ ID NO: 3864284 - RNA, 19 nt, Human
caugaagaccuuuuucugc

SEQ ID NO: 3864285 - RNA, 12 nt, Human
caugaagagaag

SEQ ID NO: 3864286 - RNA, 17 nt, Human
caugaagauauuuuucc

SEQ ID NO: 3864287 - RNA, 17 nt, Human
caugaagccacagccca

SEQ ID NO: 3864288 - RNA, 21 nt, Human
caugaagccacagcccaggcc

SEQ ID NO: 3864289 - RNA, 24 nt, Human
caugaagccacagcccaggccucc

SEQ ID NO: 3864290 - RNA, 22 nt, Human
caugaagccacgggugccagaa

SEQ ID NO: 3864291 - RNA, 11 nt, Human
caugaagccug

SEQ ID NO: 3864292 - RNA, 13 nt, Human
caugaagccugug

SEQ ID NO: 3864293 - RNA, 15 nt, Human
caugaagcuguugug

SEQ ID NO: 3864294 - RNA, 22 nt, Human
caugaaggaugccaagaaguuu

SEQ ID NO: 3864295 - RNA, 22 nt, Human
caugaagggacccuuugggggu

SEQ ID NO: 3864296 - RNA, 17 nt, Human
caugaagguaaauaaaa

SEQ ID NO: 3864297 - RNA, 21 nt, Human
caugaagguaaauaaaaagaa

SEQ ID NO: 3864298 - RNA, 22 nt, Human
caugaaguaauaugcacacauu

SEQ ID NO: 3864299 - RNA, 13 nt, Human
caugaaguauuuu

SEQ ID NO: 3864300 - RNA, 19 nt, Human
caugaagucguugugaggg

SEQ ID NO: 3864301 - RNA, 24 nt, Human
caugaagucuuaaggacaaagugc

SEQ ID NO: 3864302 - RNA, 20 nt, Human
caugaaguguguuuccuuca

SEQ ID NO: 3864303 - RNA, 21 nt, Human
caugaauauuuaguguucaua

SEQ ID NO: 3864304 - RNA, 16 nt, Human
caugaaucaaaagugc

SEQ ID NO: 3864305 - RNA, 17 nt, Human
caugaaucgcuucucuu

SEQ ID NO: 3864306 - RNA, 20 nt, Human
caugaaucgcuucucuuuug

SEQ ID NO: 3864307 - RNA, 15 nt, Human
caugaaucugcaaug

SEQ ID NO: 3864308 - RNA, 14 nt, Human
caugaaucugucuc

SEQ ID NO: 3864309 - RNA, 13 nt, Human
caugaauguaaau

SEQ ID NO: 3864310 - RNA, 14 nt, Human
caugaauguaaauu

SEQ ID NO: 3864311 - RNA, 18 nt, Human
caugaauguaucaggaaa

SEQ ID NO: 3864312 - RNA, 22 nt, Human
caugaauuaccuggauguucuu

SEQ ID NO: 3864313 - RNA, 18 nt, Human
caugaauuauuacagugu

SEQ ID NO: 3864314 - RNA, 18 nt, Human
caugaauuuauugcacau

SEQ ID NO: 3864315 - RNA, 12 nt, Human
caugaauuugua

SEQ ID NO: 3864316 - RNA, 18 nt, Human
caugaauuuguaaugucu

SEQ ID NO: 3864317 - RNA, 19 nt, Human
caugaauuuguaaugucuu

SEQ ID NO: 3864318 - RNA, 16 nt, Human
caugaauuugugaagg

SEQ ID NO: 3864319 - RNA, 15 nt, Human
caugaauuuuagcuu

SEQ ID NO: 3864320 - RNA, 17 nt, Human
caugaauuuuagcuuuu

SEQ ID NO: 3864321 - RNA, 19 nt, Human
caugaauuuuagcuuuugu

SEQ ID NO: 3864322 - RNA, 13 nt, Human
caugacaaagacu

SEQ ID NO: 3864323 - RNA, 15 nt, Human
caugacaagccccag

SEQ ID NO: 3864324 - RNA, 18 nt, Human
caugacaagccccaggca

SEQ ID NO: 3864325 - RNA, 19 nt, Human
caugacaagccccaggcag

SEQ ID NO: 3864326 - RNA, 20 nt, Human
caugacaagccccaggcagg

SEQ ID NO: 3864327 - RNA, 16 nt, Human
caugacaauguuguag

SEQ ID NO: 3864328 - RNA, 21 nt, Human
caugacacccgugagcgccug

SEQ ID NO: 3864329 - RNA, 15 nt, Human
caugacacugaaaug

SEQ ID NO: 3864330 - RNA, 16 nt, Human
caugacacugaaaugc

SEQ ID NO: 3864331 - RNA, 13 nt, Human
caugacacugacc

SEQ ID NO: 3864332 - RNA, 15 nt, Human
caugacacugaccuu

SEQ ID NO: 3864333 - RNA, 14 nt, Human
caugacagaaaaua

SEQ ID NO: 3864334 - RNA, 16 nt, Human
caugacagaaaauaug

SEQ ID NO: 3864335 - RNA, 21 nt, Human
caugacagaaaauauguauua

SEQ ID NO: 3864336 - RNA, 18 nt, Human
caugacauaacagugcag

SEQ ID NO: 3864337 - RNA, 20 nt, Human
caugacauaacagugcaggg

SEQ ID NO: 3864338 - RNA, 13 nt, Human
caugacauuucuu

SEQ ID NO: 3864339 - RNA, 14 nt, Human
caugaccaguaaag

SEQ ID NO: 3864340 - RNA, 13 nt, Human
caugacccaggcu

SEQ ID NO: 3864341 - RNA, 15 nt, Human
caugacccaggcugg

SEQ ID NO: 3864342 - RNA, 14 nt, Human
caugacccugccuc

SEQ ID NO: 3864343 - RNA, 15 nt, Human
caugacccugccucu

SEQ ID NO: 3864344 - RNA, 19 nt, Human
caugaccuaguuuuccaug

SEQ ID NO: 3864345 - RNA, 17 nt, Human
caugaccuccagcuuuc

SEQ ID NO: 3864346 - RNA, 14 nt, Human
caugaccuccaggg

SEQ ID NO: 3864347 - RNA, 22 nt, Human
caugaccugaucacuagccugu

SEQ ID NO: 3864348 - RNA, 16 nt, Human
caugaccugugaccag

SEQ ID NO: 3864349 - RNA, 23 nt, Human
caugacgacaaagcugcuaaauc

SEQ ID NO: 3864350 - RNA, 20 nt, Human
caugacucguauaugucuca

SEQ ID NO: 3864351 - RNA, 17 nt, Human
caugacucuuuauuguc

SEQ ID NO: 3864352 - RNA, 13 nt, Human
caugacugcauuu

SEQ ID NO: 3864353 - RNA, 13 nt, Human
caugacugcuugc

SEQ ID NO: 3864354 - RNA, 21 nt, Human
caugacuuuuccauguaucua

SEQ ID NO: 3864355 - RNA, 17 nt, Human
caugagaagagggccug

SEQ ID NO: 3864356 - RNA, 22 nt, Human
caugagaaguugauauagaaca

SEQ ID NO: 3864357 - RNA, 12 nt, Human
caugagaaucua

SEQ ID NO: 3864358 - RNA, 19 nt, Human
caugagaaucuauauuuaa

SEQ ID NO: 3864359 - RNA, 18 nt, Human
caugagacucagugcaga

SEQ ID NO: 3864360 - RNA, 15 nt, Human
caugagaggaggcag

SEQ ID NO: 3864361 - RNA, 17 nt, Human
caugagauguguggacu

SEQ ID NO: 3864362 - RNA, 16 nt, Human
caugagcaauucuccu

SEQ ID NO: 3864363 - RNA, 21 nt, Human
caugagcaccccaaggcugcg

SEQ ID NO: 3864364 - RNA, 18 nt, Human
caugagcaucaggccagg

SEQ ID NO: 3864365 - RNA, 17 nt, Human
caugagcauuggauaca

SEQ ID NO: 3864366 - RNA, 21 nt, Human
caugagccgcccaaggccuuc

SEQ ID NO: 3864367 - RNA, 18 nt, Human
caugagccucagcauccu

SEQ ID NO: 3864368 - RNA, 12 nt, Human
caugagccugcu

SEQ ID NO: 3864369 - RNA, 15 nt, Human
caugagccugcugga

SEQ ID NO: 3864370 - RNA, 16 nt, Human
caugagccugcuggaa

SEQ ID NO: 3864371 - RNA, 18 nt, Human
caugagccugcuggaagc

SEQ ID NO: 3864372 - RNA, 16 nt, Human
caugagcuauuuccau

SEQ ID NO: 3864373 - RNA, 14 nt, Human
caugagcuccagac

SEQ ID NO: 3864374 - RNA, 17 nt, Human
caugagcuccagacccc

SEQ ID NO: 3864375 - RNA, 22 nt, Human
caugaggaaagcaguugaaaug

SEQ ID NO: 3864376 - RNA, 23 nt, Human
caugaggaacaaggcaaggcugu

SEQ ID NO: 3864377 - RNA, 20 nt, Human
caugaggacaugauggagcg

SEQ ID NO: 3864378 - RNA, 22 nt, Human
caugaggacaugauggagcgca

SEQ ID NO: 3864379 - RNA, 20 nt, Human
caugaggacucuauucuuua

SEQ ID NO: 3864380 - RNA, 19 nt, Human
caugaggagaaaaaaagca

SEQ ID NO: 3864381 - RNA, 19 nt, Human
caugaggagauucugccuu

SEQ ID NO: 3864382 - RNA, 20 nt, Human
caugaggagauucugccuuu

SEQ ID NO: 3864383 - RNA, 21 nt, Human
caugaggagauucugccuuug

SEQ ID NO: 3864384 - RNA, 14 nt, Human
caugaggaggcaga

SEQ ID NO: 3864385 - RNA, 13 nt, Human
caugaggaggggc

SEQ ID NO: 3864386 - RNA, 21 nt, Human
caugaggaggggccccccugc

SEQ ID NO: 3864387 - RNA, 12 nt, Human
caugaggagggu

SEQ ID NO: 3864388 - RNA, 13 nt, Human
caugaggagggug

SEQ ID NO: 3864389 - RNA, 16 nt, Human
caugaggaguugcugu

SEQ ID NO: 3864390 - RNA, 24 nt, Human
caugaggcaaugucaggaacagaa

SEQ ID NO: 3864391 - RNA, 16 nt, Human
caugaggccacugcug

SEQ ID NO: 3864392 - RNA, 18 nt, Human
caugaggccacuggagac

SEQ ID NO: 3864393 - RNA, 15 nt, Human
caugagggaagaaua

SEQ ID NO: 3864394 - RNA, 19 nt, Human
caugagggaagaauaaaga

SEQ ID NO: 3864395 - RNA, 18 nt, Human
caugagggagaugccaug

SEQ ID NO: 3864396 - RNA, 17 nt, Human
caugagggaucacaggg

SEQ ID NO: 3864397 - RNA, 17 nt, Human
ccaaagcaagcaagagg

SEQ ID NO: 3864398 - RNA, 12 nt, Human
ccaaagcagggu

SEQ ID NO: 3864399 - RNA, 20 nt, Human
ccaaagccaauaacacacag

SEQ ID NO: 3864400 - RNA, 22 nt, Human
ccaaagccuccuccagccgcca

SEQ ID NO: 3864401 - RNA, 20 nt, Human
ccaaagcugacgaggcuggg

SEQ ID NO: 3864402 - RNA, 14 nt, Human
ccaaagcugagccu

SEQ ID NO: 3864403 - RNA, 15 nt, Human
ccaaagcugagccug

SEQ ID NO: 3864404 - RNA, 12 nt, Human
ccaaaggaaaaa

SEQ ID NO: 3864405 - RNA, 22 nt, Human
ccaaaggaaaaagcacaagaag

SEQ ID NO: 3864406 - RNA, 23 nt, Human
ccaaaggaaaaagcacaagaagc

SEQ ID NO: 3864407 - RNA, 17 nt, Human
ccaaaggacagccgccu

SEQ ID NO: 3864408 - RNA, 18 nt, Human
ccaaaggacgcacugagc

SEQ ID NO: 3864409 - RNA, 16 nt, Human
ccaaaggaggcuggca

SEQ ID NO: 3864410 - RNA, 18 nt, Human
ccaaaggaggcuggcagg

SEQ ID NO: 3864411 - RNA, 19 nt, Human
ccaaaggccauggagagcu

SEQ ID NO: 3864412 - RNA, 12 nt, Human
ccaaaggccccc

SEQ ID NO: 3864413 - RNA, 13 nt, Human
ccaaaggcuggug

SEQ ID NO: 3864414 - RNA, 21 nt, Human
ccaaaggcugguggcaagugc

SEQ ID NO: 3864415 - RNA, 19 nt, Human
ccaaagggagucugccagg

SEQ ID NO: 3864416 - RNA, 18 nt, Human
ccaaaggggacaggccuc

SEQ ID NO: 3864417 - RNA, 19 nt, Human
ccaaaggggacaggccuca

SEQ ID NO: 3864418 - RNA, 20 nt, Human
ccaaaggggaccccuaugaa

SEQ ID NO: 3864419 - RNA, 17 nt, Human
ccaaaguaaaagaaacc

SEQ ID NO: 3864420 - RNA, 18 nt, Human
ccaaaguacacuguuuca

SEQ ID NO: 3864421 - RNA, 22 nt, Human
ccaaaguacacuguuucaaacu

SEQ ID NO: 3864422 - RNA, 13 nt, Human
ccaaaguauuuuu

SEQ ID NO: 3864423 - RNA, 15 nt, Human
ccaaagucucuaauu

SEQ ID NO: 3864424 - RNA, 17 nt, Human
ccaaagugaccuaccca

SEQ ID NO: 3864425 - RNA, 15 nt, Human
ccaaagugcugagau

SEQ ID NO: 3864426 - RNA, 19 nt, Human
ccaaagugcugggauuaca

SEQ ID NO: 3864427 - RNA, 22 nt, Human
ccaaagugcugggauuacaggu

SEQ ID NO: 3864428 - RNA, 19 nt, Human
ccaaagugguauagaaaug

SEQ ID NO: 3864429 - RNA, 22 nt, Human
ccaaagugguauagaaaugcug

SEQ ID NO: 3864430 - RNA, 16 nt, Human
ccaaagugguuucagc

SEQ ID NO: 3864431 - RNA, 14 nt, Human
ccaaaguucuaaua

SEQ ID NO: 3864432 - RNA, 23 nt, Human
ccaaaguuguuguaaccugcugu

SEQ ID NO: 3864433 - RNA, 15 nt, Human
ccaaauaagaaaccu

SEQ ID NO: 3864434 - RNA, 16 nt, Human
ccaaauaagaaaccua

SEQ ID NO: 3864435 - RNA, 19 nt, Human
ccaaauagugugaaauaua

SEQ ID NO: 3864436 - RNA, 18 nt, Human
ccaaauauagcguuccca

SEQ ID NO: 3864437 - RNA, 18 nt, Human
ccaaauaucaccaggacu

SEQ ID NO: 3864438 - RNA, 20 nt, Human
ccaaauauuaggcuuaaaaa

SEQ ID NO: 3864439 - RNA, 22 nt, Human
ccaaaucaaaagacuuuuuccu

SEQ ID NO: 3864440 - RNA, 23 nt, Human
ccaaaucagcugcuacuacuccu

SEQ ID NO: 3864441 - RNA, 23 nt, Human
ccaaauccgaaccuccucuguga

SEQ ID NO: 3864442 - RNA, 15 nt, Human
ccaaauccgcucucu

SEQ ID NO: 3864443 - RNA, 13 nt, Human
ccaaauccucucc

SEQ ID NO: 3864444 - RNA, 20 nt, Human
ccaaauccuuagaucuggca

SEQ ID NO: 3864445 - RNA, 21 nt, Human
ccaaauccuuagaucuggcau

SEQ ID NO: 3864446 - RNA, 13 nt, Human
ccaaauccuuccc

SEQ ID NO: 3864447 - RNA, 15 nt, Human
ccaaaugcagcuuua

SEQ ID NO: 3864448 - RNA, 18 nt, Human
ccaaaugcagcuuuaaaa

SEQ ID NO: 3864449 - RNA, 19 nt, Human
ccaaaugcaucaauccugu

SEQ ID NO: 3864450 - RNA, 22 nt, Human
ccaaaugcauggugcaguugac

SEQ ID NO: 3864451 - RNA, 22 nt, Human
ccaaaugcuuuaaaaacuauuu

SEQ ID NO: 3864452 - RNA, 21 nt, Human
ccaaauggaaacagaggacca

SEQ ID NO: 3864453 - RNA, 19 nt, Human
ccaaauggagaagcugcag

SEQ ID NO: 3864454 - RNA, 18 nt, Human
ccaaauguuuacagggag

SEQ ID NO: 3864455 - RNA, 13 nt, Human
ccaaauuaaaaaa

SEQ ID NO: 3864456 - RNA, 12 nt, Human
ccaaauuaagag

SEQ ID NO: 3864457 - RNA, 11 nt, Human
ccaaauuauuu

SEQ ID NO: 3864458 - RNA, 14 nt, Human
ccaaauuauuugug

SEQ ID NO: 3864459 - RNA, 15 nt, Human
ccaaauucccuccuc

SEQ ID NO: 3864460 - RNA, 15 nt, Human
ccaaauucuuucagu

SEQ ID NO: 3864461 - RNA, 14 nt, Human
ccaaauugucaccu

SEQ ID NO: 3864462 - RNA, 22 nt, Human
ccaaauugucaccugcuucucu

SEQ ID NO: 3864463 - RNA, 20 nt, Human
ccaaauugugcuucucccca

SEQ ID NO: 3864464 - RNA, 18 nt, Human
ccaaauuuaaaacuguug

SEQ ID NO: 3864465 - RNA, 15 nt, Human
ccaaauuugauugau

SEQ ID NO: 3864466 - RNA, 13 nt, Human
ccaacaaaccauc

SEQ ID NO: 3864467 - RNA, 16 nt, Human
ccaacaaaccauccag

SEQ ID NO: 3864468 - RNA, 21 nt, Human
ccaacaagaauaaaggcagcu

SEQ ID NO: 3864469 - RNA, 18 nt, Human
ccaacaagaaugcauuga

SEQ ID NO: 3864470 - RNA, 13 nt, Human
ccaacaccaagca

SEQ ID NO: 3864471 - RNA, 16 nt, Human
ccaacaccaagcacag

SEQ ID NO: 3864472 - RNA, 22 nt, Human
ccaacaccaagcacagcagccu

SEQ ID NO: 3864473 - RNA, 16 nt, Human
ccaacaccacagacac

SEQ ID NO: 3864474 - RNA, 17 nt, Human
ccaacaccagccccugc

SEQ ID NO: 3864475 - RNA, 13 nt, Human
ccaacaccaggga

SEQ ID NO: 3864476 - RNA, 20 nt, Human
ccaacacccaaagcauggac

SEQ ID NO: 3864477 - RNA, 21 nt, Human
ccaacacgagcaggcuacugu

SEQ ID NO: 3864478 - RNA, 16 nt, Human
ccaacacgcaccugcc

SEQ ID NO: 3864479 - RNA, 21 nt, Human
ccaacacgcaccugccucagg

SEQ ID NO: 3864480 - RNA, 21 nt, Human
ccaacacucaagaagcaggcu

SEQ ID NO: 3864481 - RNA, 15 nt, Human
ccaacacugugcccu

SEQ ID NO: 3864482 - RNA, 16 nt, Human
ccaacacugugcccug

SEQ ID NO: 3864483 - RNA, 19 nt, Human
ccaacacugugcccuggug

SEQ ID NO: 3864484 - RNA, 18 nt, Human
ccaacagaacuaaauguu

SEQ ID NO: 3864485 - RNA, 17 nt, Human
ccaacagaugcuuuucu

SEQ ID NO: 3864486 - RNA, 20 nt, Human
ccaacagccacucagaaaag

SEQ ID NO: 3864487 - RNA, 13 nt, Human
ccaacagccaugc

SEQ ID NO: 3864488 - RNA, 16 nt, Human
ccaacagcgcccaaag

SEQ ID NO: 3864489 - RNA, 16 nt, Human
ccaacagcuacaacag

SEQ ID NO: 3864490 - RNA, 21 nt, Human
ccaacagcuacaacagccuca

SEQ ID NO: 3864491 - RNA, 23 nt, Human
ccaacaggagcugggauccuaag

SEQ ID NO: 3864492 - RNA, 15 nt, Human
ccaacaggaggacaa

SEQ ID NO: 3864493 - RNA, 16 nt, Human
ccaacaggaggacaau

SEQ ID NO: 3864494 - RNA, 22 nt, Human
ccaacaggcuguucugcacuga

SEQ ID NO: 3864495 - RNA, 14 nt, Human
ccaacagguggcag

SEQ ID NO: 3864496 - RNA, 18 nt, Human
ccaacagguggcaggacc

SEQ ID NO: 3864497 - RNA, 20 nt, Human
ccaacagugagucugucagc

SEQ ID NO: 3864498 - RNA, 13 nt, Human
ccaacagugugaa

SEQ ID NO: 3864499 - RNA, 15 nt, Human
ccaacagugugaagu

SEQ ID NO: 3864500 - RNA, 20 nt, Human
ccaacaguguuaggccuggc

SEQ ID NO: 3864501 - RNA, 22 nt, Human
ccaacaguuuaaugaagaucua

SEQ ID NO: 3864502 - RNA, 15 nt, Human
ccaacauaaaaauga

SEQ ID NO: 3864503 - RNA, 20 nt, Human
ccaacauacucccaucugug

SEQ ID NO: 3864504 - RNA, 16 nt, Human
ccaacaucucccuccc

SEQ ID NO: 3864505 - RNA, 21 nt, Human
ccaacaugcacugauguugug

SEQ ID NO: 3864506 - RNA, 23 nt, Human
ccaacaugcacugauguuguguu

SEQ ID NO: 3864507 - RNA, 15 nt, Human
ccaacauggagaaac

SEQ ID NO: 3864508 - RNA, 15 nt, Human
ccaacauggugaaac

SEQ ID NO: 3864509 - RNA, 15 nt, Human
ccaacauguggcucc

SEQ ID NO: 3864510 - RNA, 22 nt, Human
ccaacauguggcuccucccagc

SEQ ID NO: 3864511 - RNA, 20 nt, Human
ccaacauugccuauuucagu

SEQ ID NO: 3864512 - RNA, 21 nt, Human
ccaaccacacuugucggcucc

SEQ ID NO: 3864513 - RNA, 14 nt, Human
ccaaccauuuccuc

SEQ ID NO: 3864514 - RNA, 19 nt, Human
ccaacccaaaccuggagau

SEQ ID NO: 3864515 - RNA, 16 nt, Human
ccaacccagccgcugc

SEQ ID NO: 3864516 - RNA, 12 nt, Human
ccaacccaucag

SEQ ID NO: 3864517 - RNA, 13 nt, Human
ccaaccccagccg

SEQ ID NO: 3864518 - RNA, 18 nt, Human
ccaacccccaccccacac

SEQ ID NO: 3864519 - RNA, 15 nt, Human
ccaacccccagcacc

SEQ ID NO: 3864520 - RNA, 17 nt, Human
ccaaccccccagcacug

SEQ ID NO: 3864521 - RNA, 18 nt, Human
ccaaccccccagcacuga

SEQ ID NO: 3864522 - RNA, 20 nt, Human
ccaaccccccagcacugagg

SEQ ID NO: 3864523 - RNA, 22 nt, Human
ccaaccccucgcccagucccag

SEQ ID NO: 3864524 - RNA, 12 nt, Human
ccaaccccugug

SEQ ID NO: 3864525 - RNA, 15 nt, Human
ccaaccccuguggag

SEQ ID NO: 3864526 - RNA, 15 nt, Human
ccaacccgaggcccg

SEQ ID NO: 3864527 - RNA, 17 nt, Human
ccaacccgaggcccgca

SEQ ID NO: 3864528 - RNA, 17 nt, Human
ccaacccguggaggcug

SEQ ID NO: 3864529 - RNA, 20 nt, Human
ccaacccguggaggcugcuc

SEQ ID NO: 3864530 - RNA, 19 nt, Human
ccaacccuagguucccugu

SEQ ID NO: 3864531 - RNA, 12 nt, Human
ccaacccucagg

SEQ ID NO: 3864532 - RNA, 13 nt, Human
ccaacccucaggg

SEQ ID NO: 3864533 - RNA, 15 nt, Human
ccaacccucagggca

SEQ ID NO: 3864534 - RNA, 15 nt, Human
ccaacccucaucacc

SEQ ID NO: 3864535 - RNA, 13 nt, Human
ccaacccugccgu

SEQ ID NO: 3864536 - RNA, 22 nt, Human
ccaacccugccgucaccaccac

SEQ ID NO: 3864537 - RNA, 16 nt, Human
ccaacccuggggaagg

SEQ ID NO: 3864538 - RNA, 17 nt, Human
ccaacccuggggaagga

SEQ ID NO: 3864539 - RNA, 18 nt, Human
ccaacccuggggaaggag

SEQ ID NO: 3864540 - RNA, 20 nt, Human
ccaacccuggggaaggagcc

SEQ ID NO: 3864541 - RNA, 23 nt, Human
ccacaggaagccugcaguccugg

SEQ ID NO: 3864542 - RNA, 16 nt, Human
ccacaggacacaguca

SEQ ID NO: 3864543 - RNA, 21 nt, Human
ccacaggacauuucucuaaga

SEQ ID NO: 3864544 - RNA, 21 nt, Human
ccacaggaggcaagcaagcuc

SEQ ID NO: 3864545 - RNA, 20 nt, Human
ccacaggagugggaaaacac

SEQ ID NO: 3864546 - RNA, 16 nt, Human
ccacaggcauguccca

SEQ ID NO: 3864547 - RNA, 19 nt, Human
ccacaggcccuuccucucc

SEQ ID NO: 3864548 - RNA, 22 nt, Human
ccacaggcccuuccucuccacu

SEQ ID NO: 3864549 - RNA, 17 nt, Human
ccacaggccgcccugcg

SEQ ID NO: 3864550 - RNA, 14 nt, Human
ccacaggccugaga

SEQ ID NO: 3864551 - RNA, 21 nt, Human
ccacaggcucaggcaggggcc

SEQ ID NO: 3864552 - RNA, 14 nt, Human
ccacaggcuucuga

SEQ ID NO: 3864553 - RNA, 19 nt, Human
ccacaggcuucugagcagc

SEQ ID NO: 3864554 - RNA, 20 nt, Human
ccacagggcuaagagcuagc

SEQ ID NO: 3864555 - RNA, 21 nt, Human
ccacagggucccacagccacg

SEQ ID NO: 3864556 - RNA, 19 nt, Human
ccacagguguccccagccc

SEQ ID NO: 3864557 - RNA, 22 nt, Human
ccacagguguccccagcccacu

SEQ ID NO: 3864558 - RNA, 15 nt, Human
ccacaguagucuuga

SEQ ID NO: 3864559 - RNA, 14 nt, Human
ccacagucaaagaa

SEQ ID NO: 3864560 - RNA, 19 nt, Human
ccacagucccaucugcuuc

SEQ ID NO: 3864561 - RNA, 21 nt, Human
ccacagugacucgggcuccug

SEQ ID NO: 3864562 - RNA, 15 nt, Human
ccacaguucaguggc

SEQ ID NO: 3864563 - RNA, 19 nt, Human
ccacauacaacacaaagag

SEQ ID NO: 3864564 - RNA, 15 nt, Human
ccacauacccugacc

SEQ ID NO: 3864565 - RNA, 23 nt, Human
ccacauagugaugguuccccugu

SEQ ID NO: 3864566 - RNA, 19 nt, Human
ccacauccaacuccagcaa

SEQ ID NO: 3864567 - RNA, 12 nt, Human
ccacauccacag

SEQ ID NO: 3864568 - RNA, 12 nt, Human
ccacaucccagg

SEQ ID NO: 3864569 - RNA, 15 nt, Human
ccacaucccaggcuu

SEQ ID NO: 3864570 - RNA, 13 nt, Human
ccacaucccuggg

SEQ ID NO: 3864571 - RNA, 15 nt, Human
ccacaucccugggcc

SEQ ID NO: 3864572 - RNA, 22 nt, Human
ccacaucccugggccugcugcu

SEQ ID NO: 3864573 - RNA, 23 nt, Human
ccacaucccugggccugcugcug

SEQ ID NO: 3864574 - RNA, 21 nt, Human
ccacauccggggccagcuccg

SEQ ID NO: 3864575 - RNA, 14 nt, Human
ccacaucuacguuu

SEQ ID NO: 3864576 - RNA, 19 nt, Human
ccacaucuacguuuuuggu

SEQ ID NO: 3864577 - RNA, 16 nt, Human
ccacaucucugaaagc

SEQ ID NO: 3864578 - RNA, 23 nt, Human
ccacaucugccuuaaaaccaaag

SEQ ID NO: 3864579 - RNA, 20 nt, Human
ccacaucuugaucugcucag

SEQ ID NO: 3864580 - RNA, 16 nt, Human
ccacaucuugcucugc

SEQ ID NO: 3864581 - RNA, 17 nt, Human
ccacaucuugcucugcu

SEQ ID NO: 3864582 - RNA, 24 nt, Human
ccacaugauucugauguacucuaa

SEQ ID NO: 3864583 - RNA, 15 nt, Human
ccacauggcacagag

SEQ ID NO: 3864584 - RNA, 17 nt, Human
ccacaugggagcagucc

SEQ ID NO: 3864585 - RNA, 24 nt, Human
ccacaugggagcaguccaugcaug

SEQ ID NO: 3864586 - RNA, 20 nt, Human
ccacauggggcugggcagcu

SEQ ID NO: 3864587 - RNA, 14 nt, Human
ccacaugucaccgu

SEQ ID NO: 3864588 - RNA, 15 nt, Human
ccacaugugacacau

SEQ ID NO: 3864589 - RNA, 20 nt, Human
ccacauguguccaucccagc

SEQ ID NO: 3864590 - RNA, 22 nt, Human
ccacauguuacuggauaaauug

SEQ ID NO: 3864591 - RNA, 13 nt, Human
ccacauuaaagaa

SEQ ID NO: 3864592 - RNA, 14 nt, Human
ccacauuagaacuu

SEQ ID NO: 3864593 - RNA, 16 nt, Human
ccacauugaagaaugu

SEQ ID NO: 3864594 - RNA, 14 nt, Human
ccacauuggaagag

SEQ ID NO: 3864595 - RNA, 19 nt, Human
ccacauuggaagagcagca

SEQ ID NO: 3864596 - RNA, 19 nt, Human
ccacauuuggaauacuuuu

SEQ ID NO: 3864597 - RNA, 16 nt, Human
ccaccaaagcugccca

SEQ ID NO: 3864598 - RNA, 20 nt, Human
ccaccaaaggccagggucac

SEQ ID NO: 3864599 - RNA, 18 nt, Human
ccaccaacauacucccau

SEQ ID NO: 3864600 - RNA, 15 nt, Human
ccaccaacccucagg

SEQ ID NO: 3864601 - RNA, 17 nt, Human
ccaccaacccucagggc

SEQ ID NO: 3864602 - RNA, 17 nt, Human
ccaccaagacuuguuuu

SEQ ID NO: 3864603 - RNA, 12 nt, Human
ccaccaagccuu

SEQ ID NO: 3864604 - RNA, 11 nt, Human
ccaccaagggc

SEQ ID NO: 3864605 - RNA, 17 nt, Human
ccaccacacaucccagc

SEQ ID NO: 3864606 - RNA, 17 nt, Human
ccaccacaccgcagaag

SEQ ID NO: 3864607 - RNA, 14 nt, Human
ccaccacagccagc

SEQ ID NO: 3864608 - RNA, 18 nt, Human
ccaccacagccagcaccu

SEQ ID NO: 3864609 - RNA, 20 nt, Human
ccaccacagccagcaccugg

SEQ ID NO: 3864610 - RNA, 21 nt, Human
ccaccacagccagcaccuggc

SEQ ID NO: 3864611 - RNA, 11 nt, Human
ccaccacccaa

SEQ ID NO: 3864612 - RNA, 16 nt, Human
ccaccaccccccacuc

SEQ ID NO: 3864613 - RNA, 13 nt, Human
ccaccacccugag

SEQ ID NO: 3864614 - RNA, 20 nt, Human
ccaccaccuaggccacuccu

SEQ ID NO: 3864615 - RNA, 21 nt, Human
ccaccaccuaggccacuccuc

SEQ ID NO: 3864616 - RNA, 12 nt, Human
ccaccaccuccc

SEQ ID NO: 3864617 - RNA, 16 nt, Human
ccaccacgccuagccu

SEQ ID NO: 3864618 - RNA, 16 nt, Human
ccaccacggccacugg

SEQ ID NO: 3864619 - RNA, 14 nt, Human
ccaccacuauaaaa

SEQ ID NO: 3864620 - RNA, 14 nt, Human
ccaccacuggccac

SEQ ID NO: 3864621 - RNA, 20 nt, Human
ccaccacuggccaccaggcu

SEQ ID NO: 3864622 - RNA, 11 nt, Human
ccaccagaagc

SEQ ID NO: 3864623 - RNA, 12 nt, Human
ccaccagaagcc

SEQ ID NO: 3864624 - RNA, 18 nt, Human
ccaccagaagcccagaau

SEQ ID NO: 3864625 - RNA, 17 nt, Human
ccaccagagaccguccu

SEQ ID NO: 3864626 - RNA, 19 nt, Human
ccaccagcaucaccugccu

SEQ ID NO: 3864627 - RNA, 16 nt, Human
ccaccagcugugucca

SEQ ID NO: 3864628 - RNA, 18 nt, Human
ccaccaggaaccucuuca

SEQ ID NO: 3864629 - RNA, 19 nt, Human
ccaccaggagaaccacuac

SEQ ID NO: 3864630 - RNA, 18 nt, Human
ccaccaggcuggcgcagc

SEQ ID NO: 3864631 - RNA, 16 nt, Human
ccaccagggcaucucu

SEQ ID NO: 3864632 - RNA, 19 nt, Human
ccaccagggcaucucuggg

SEQ ID NO: 3864633 - RNA, 16 nt, Human
ccaccaggugccuuuc

SEQ ID NO: 3864634 - RNA, 20 nt, Human
ccaccaggugccuuucaaau

SEQ ID NO: 3864635 - RNA, 17 nt, Human
ccaccagugccucuccc

SEQ ID NO: 3864636 - RNA, 23 nt, Human
ccaccauauucagugcuguggcc

SEQ ID NO: 3864637 - RNA, 14 nt, Human
ccaccaucaagcca

SEQ ID NO: 3864638 - RNA, 17 nt, Human
ccaccaucaagccacca

SEQ ID NO: 3864639 - RNA, 18 nt, Human
ccaccaucaccagacagg

SEQ ID NO: 3864640 - RNA, 14 nt, Human
ccaccaucugcugu

SEQ ID NO: 3864641 - RNA, 15 nt, Human
ccaccaucugcuguc

SEQ ID NO: 3864642 - RNA, 22 nt, Human
ccaccaucuuugcagguugcuu

SEQ ID NO: 3864643 - RNA, 15 nt, Human
ccaccaugcccagcu

SEQ ID NO: 3864644 - RNA, 17 nt, Human
ccaccauggccagccaa

SEQ ID NO: 3864645 - RNA, 17 nt, Human
ccaccaugucugcccca

SEQ ID NO: 3864646 - RNA, 18 nt, Human
ccaccauuuggcaucccu

SEQ ID NO: 3864647 - RNA, 13 nt, Human
ccacccaaagcag

SEQ ID NO: 3864648 - RNA, 16 nt, Human
ccacccaacccuaucu

SEQ ID NO: 3864649 - RNA, 15 nt, Human
ccacccaagcaggag

SEQ ID NO: 3864650 - RNA, 21 nt, Human
ccacccaagggccuggccuga

SEQ ID NO: 3864651 - RNA, 22 nt, Human
ccacccaagggccuggccugag

SEQ ID NO: 3864652 - RNA, 22 nt, Human
ccacccaauucaaaacauugug

SEQ ID NO: 3864653 - RNA, 15 nt, Human
ccacccaccagggcg

SEQ ID NO: 3864654 - RNA, 15 nt, Human
ccacccacuucugca

SEQ ID NO: 3864655 - RNA, 17 nt, Human
ccacccacuucugcacu

SEQ ID NO: 3864656 - RNA, 11 nt, Human
ccacccagagg

SEQ ID NO: 3864657 - RNA, 12 nt, Human
ccacccaggagc

SEQ ID NO: 3864658 - RNA, 14 nt, Human
ccacccaggagccc

SEQ ID NO: 3864659 - RNA, 16 nt, Human
ccacccaggaggcagg

SEQ ID NO: 3864660 - RNA, 14 nt, Human
ccacccaggaggga

SEQ ID NO: 3864661 - RNA, 17 nt, Human
ccacccaggagggaggg

SEQ ID NO: 3864662 - RNA, 23 nt, Human
ccacccaggagggagggggcuau

SEQ ID NO: 3864663 - RNA, 18 nt, Human
ccacccaggaguguggcc

SEQ ID NO: 3864664 - RNA, 17 nt, Human
ccacccaggggcagccc

SEQ ID NO: 3864665 - RNA, 15 nt, Human
ccacccagucucugc

SEQ ID NO: 3864666 - RNA, 23 nt, Human
ccacccauaauccuuucugccga

SEQ ID NO: 3864667 - RNA, 21 nt, Human
ccacccauccuaccaaugcau

SEQ ID NO: 3864668 - RNA, 12 nt, Human
ccaccccaacau

SEQ ID NO: 3864669 - RNA, 22 nt, Human
ccaccccaaccugcucuccucu

SEQ ID NO: 3864670 - RNA, 19 nt, Human
ccaccccaagagaacucgc

SEQ ID NO: 3864671 - RNA, 12 nt, Human
ccaccccacacu

SEQ ID NO: 3864672 - RNA, 13 nt, Human
ccaccccacacuu

SEQ ID NO: 3864673 - RNA, 14 nt, Human
ccaccccagccccc

SEQ ID NO: 3864674 - RNA, 13 nt, Human
ccaccccagcugc

SEQ ID NO: 3864675 - RNA, 20 nt, Human
ccaccccagggcagccaggg

SEQ ID NO: 3864676 - RNA, 17 nt, Human
ccaccccagugcaccca

SEQ ID NO: 3864677 - RNA, 13 nt, Human
ccacccccaaggu

SEQ ID NO: 3864678 - RNA, 15 nt, Human
ccacccccaccaagg

SEQ ID NO: 3864679 - RNA, 15 nt, Human
ccacccccacccaag

SEQ ID NO: 3864680 - RNA, 17 nt, Human
ccacccccacccaaggg

SEQ ID NO: 3864681 - RNA, 19 nt, Human
ccacccccacccaagggcc

SEQ ID NO: 3864682 - RNA, 15 nt, Human
ccacccccaccccca

SEQ ID NO: 3864683 - RNA, 12 nt, Human
ccacccccagcc

SEQ ID NO: 3864684 - RNA, 19 nt, Human
ccacccccaggaccccuga

SEQ ID NO: 3864685 - RNA, 15 nt, Human
ccaccccccaggccu

SEQ ID NO: 3864686 - RNA, 12 nt, Human
ccagguccuggu

SEQ ID NO: 3864687 - RNA, 15 nt, Human
ccagguccugguggg

SEQ ID NO: 3864688 - RNA, 19 nt, Human
ccaggucuuggagcugagc

SEQ ID NO: 3864689 - RNA, 20 nt, Human
ccaggucuuggagcugagcc

SEQ ID NO: 3864690 - RNA, 21 nt, Human
ccaggucuuggagcugagccu

SEQ ID NO: 3864691 - RNA, 22 nt, Human
ccaggucuuggagcugagccuc

SEQ ID NO: 3864692 - RNA, 23 nt, Human
ccaggucuuggagcugagccucu

SEQ ID NO: 3864693 - RNA, 16 nt, Human
ccaggugaaggaggcu

SEQ ID NO: 3864694 - RNA, 21 nt, Human
ccaggugaaggaggcuccagg

SEQ ID NO: 3864695 - RNA, 18 nt, Human
ccaggugcaaccagggag

SEQ ID NO: 3864696 - RNA, 20 nt, Human
ccaggugcacaagcuccaag

SEQ ID NO: 3864697 - RNA, 24 nt, Human
ccaggugcacaagcuccaagcucc

SEQ ID NO: 3864698 - RNA, 19 nt, Human
ccaggugcacagacguccc

SEQ ID NO: 3864699 - RNA, 14 nt, Human
ccaggugcaguggc

SEQ ID NO: 3864700 - RNA, 12 nt, Human
ccaggugccuug

SEQ ID NO: 3864701 - RNA, 22 nt, Human
ccaggugcuacacccuuuucca

SEQ ID NO: 3864702 - RNA, 19 nt, Human
ccagguggaaggcagacag

SEQ ID NO: 3864703 - RNA, 20 nt, Human
ccaggugggcgggcagcaca

SEQ ID NO: 3864704 - RNA, 23 nt, Human
ccaggugggcgggcagcacagca

SEQ ID NO: 3864705 - RNA, 20 nt, Human
ccagguguuaacauuccaag

SEQ ID NO: 3864706 - RNA, 20 nt, Human
ccagguucaacccacagcua

SEQ ID NO: 3864707 - RNA, 23 nt, Human
ccagguucaagcgauucuccugc

SEQ ID NO: 3864708 - RNA, 14 nt, Human
ccagguucagcuug

SEQ ID NO: 3864709 - RNA, 15 nt, Human
ccagguuccacagag

SEQ ID NO: 3864710 - RNA, 18 nt, Human
ccagguuccacagaggac

SEQ ID NO: 3864711 - RNA, 21 nt, Human
ccagguuccccagccgcccac

SEQ ID NO: 3864712 - RNA, 15 nt, Human
ccagguucuauuugg

SEQ ID NO: 3864713 - RNA, 14 nt, Human
ccagguuggcucug

SEQ ID NO: 3864714 - RNA, 17 nt, Human
ccagguuggcucugcca

SEQ ID NO: 3864715 - RNA, 20 nt, Human
ccagguuggcucugccaguc

SEQ ID NO: 3864716 - RNA, 17 nt, Human
ccagguuucuggucucu

SEQ ID NO: 3864717 - RNA, 22 nt, Human
ccagguuucuggucucuaggcu

SEQ ID NO: 3864718 - RNA, 23 nt, Human
ccagguuuuguuccgcccagugg

SEQ ID NO: 3864719 - RNA, 23 nt, Human
ccagguuuuucaauuaaacggau

SEQ ID NO: 3864720 - RNA, 17 nt, Human
ccagguuuuuggucuga

SEQ ID NO: 3864721 - RNA, 11 nt, Human
ccaguaaaauu

SEQ ID NO: 3864722 - RNA, 23 nt, Human
ccaguaaaauugccauauugcac

SEQ ID NO: 3864723 - RNA, 12 nt, Human
ccaguaacacag

SEQ ID NO: 3864724 - RNA, 14 nt, Human
ccaguaacaggcuc

SEQ ID NO: 3864725 - RNA, 15 nt, Human
ccaguaacaggcuca

SEQ ID NO: 3864726 - RNA, 22 nt, Human
ccaguaacgggucguaaugacu

SEQ ID NO: 3864727 - RNA, 16 nt, Human
ccaguaacucaucugu

SEQ ID NO: 3864728 - RNA, 17 nt, Human
ccaguaagaucacuguu

SEQ ID NO: 3864729 - RNA, 15 nt, Human
ccaguacauucucag

SEQ ID NO: 3864730 - RNA, 18 nt, Human
ccaguaccuagcuggcuc

SEQ ID NO: 3864731 - RNA, 14 nt, Human
ccaguacuggagcu

SEQ ID NO: 3864732 - RNA, 14 nt, Human
ccaguacuugucau

SEQ ID NO: 3864733 - RNA, 22 nt, Human
ccaguagaccuuguuacuucug

SEQ ID NO: 3864734 - RNA, 20 nt, Human
ccaguaggggcuuauaauaa

SEQ ID NO: 3864735 - RNA, 13 nt, Human
ccaguaucgcuca

SEQ ID NO: 3864736 - RNA, 16 nt, Human
ccaguaucucuucagu

SEQ ID NO: 3864737 - RNA, 20 nt, Human
ccaguaucucuucagucucu

SEQ ID NO: 3864738 - RNA, 22 nt, Human
ccaguauucuagguagugcccu

SEQ ID NO: 3864739 - RNA, 14 nt, Human
ccaguauuuuaaaa

SEQ ID NO: 3864740 - RNA, 17 nt, Human
ccaguauuuuugcugcu

SEQ ID NO: 3864741 - RNA, 16 nt, Human
ccagucaagaagaaaa

SEQ ID NO: 3864742 - RNA, 12 nt, Human
ccagucaccccg

SEQ ID NO: 3864743 - RNA, 16 nt, Human
ccagucaccccggcca

SEQ ID NO: 3864744 - RNA, 21 nt, Human
ccagucacugugagcucccag

SEQ ID NO: 3864745 - RNA, 14 nt, Human
ccagucagccucuc

SEQ ID NO: 3864746 - RNA, 23 nt, Human
ccagucagccucucucccagucu

SEQ ID NO: 3864747 - RNA, 15 nt, Human
ccagucaggcccagg

SEQ ID NO: 3864748 - RNA, 21 nt, Human
ccagucauuauguuaauauuu

SEQ ID NO: 3864749 - RNA, 13 nt, Human
ccaguccaggcug

SEQ ID NO: 3864750 - RNA, 15 nt, Human
ccaguccaggcugcc

SEQ ID NO: 3864751 - RNA, 22 nt, Human
ccagucccaaugguccugacuu

SEQ ID NO: 3864752 - RNA, 17 nt, Human
ccagucccagcagccag

SEQ ID NO: 3864753 - RNA, 16 nt, Human
ccaguccccaccccug

SEQ ID NO: 3864754 - RNA, 15 nt, Human
ccaguccccagaacu

SEQ ID NO: 3864755 - RNA, 15 nt, Human
ccaguccccagcccu

SEQ ID NO: 3864756 - RNA, 15 nt, Human
ccagucccccaaccc

SEQ ID NO: 3864757 - RNA, 15 nt, Human
ccagucccccuaucc

SEQ ID NO: 3864758 - RNA, 15 nt, Human
ccaguccccgugccc

SEQ ID NO: 3864759 - RNA, 14 nt, Human
ccaguccccuuugu

SEQ ID NO: 3864760 - RNA, 15 nt, Human
ccagucccugaggca

SEQ ID NO: 3864761 - RNA, 13 nt, Human
ccagucccugucc

SEQ ID NO: 3864762 - RNA, 16 nt, Human
ccaguccuaucugggc

SEQ ID NO: 3864763 - RNA, 12 nt, Human
ccaguccugccc

SEQ ID NO: 3864764 - RNA, 14 nt, Human
ccaguccugccugg

SEQ ID NO: 3864765 - RNA, 15 nt, Human
ccaguccugccuggc

SEQ ID NO: 3864766 - RNA, 21 nt, Human
ccaguccugccuggccaggca

SEQ ID NO: 3864767 - RNA, 12 nt, Human
ccaguccugcuc

SEQ ID NO: 3864768 - RNA, 13 nt, Human
ccaguccuggccu

SEQ ID NO: 3864769 - RNA, 15 nt, Human
ccaguccuggccugg

SEQ ID NO: 3864770 - RNA, 20 nt, Human
ccaguccuggccuggcuucu

SEQ ID NO: 3864771 - RNA, 17 nt, Human
ccaguccuuccaccucg

SEQ ID NO: 3864772 - RNA, 23 nt, Human
ccagucgcccuuacuucuugccc

SEQ ID NO: 3864773 - RNA, 14 nt, Human
ccagucgcgcugcc

SEQ ID NO: 3864774 - RNA, 20 nt, Human
ccagucgcgcugccugugug

SEQ ID NO: 3864775 - RNA, 21 nt, Human
ccagucgcgcugccugugugg

SEQ ID NO: 3864776 - RNA, 20 nt, Human
ccagucgucaucagaugcuu

SEQ ID NO: 3864777 - RNA, 18 nt, Human
ccagucguuagaauauag

SEQ ID NO: 3864778 - RNA, 16 nt, Human
ccagucuacccagaga

SEQ ID NO: 3864779 - RNA, 18 nt, Human
ccagucuccaccaggaac

SEQ ID NO: 3864780 - RNA, 19 nt, Human
ccagucuccaccaggaacc

SEQ ID NO: 3864781 - RNA, 23 nt, Human
ccagucucugcuccaccuuucag

SEQ ID NO: 3864782 - RNA, 20 nt, Human
ccagucugaaguuucauuua

SEQ ID NO: 3864783 - RNA, 21 nt, Human
ccagucugaaguuucauuuau

SEQ ID NO: 3864784 - RNA, 22 nt, Human
ccagucugcugcccuccauccc

SEQ ID NO: 3864785 - RNA, 16 nt, Human
ccagucuguggaucag

SEQ ID NO: 3864786 - RNA, 20 nt, Human
ccagucuuuaaaggcccagc

SEQ ID NO: 3864787 - RNA, 14 nt, Human
ccagugaaaacuag

SEQ ID NO: 3864788 - RNA, 15 nt, Human
ccagugaaaacuaga

SEQ ID NO: 3864789 - RNA, 15 nt, Human
ccagugaaccaaaga

SEQ ID NO: 3864790 - RNA, 17 nt, Human
ccagugaauuuuugcaa

SEQ ID NO: 3864791 - RNA, 21 nt, Human
ccagugaauuuuugcaauaau

SEQ ID NO: 3864792 - RNA, 24 nt, Human
ccagugacacuucagagagcuggu

SEQ ID NO: 3864793 - RNA, 20 nt, Human
ccagugaccugcuggguaaa

SEQ ID NO: 3864794 - RNA, 22 nt, Human
ccagugaccugcuggguaaacu

SEQ ID NO: 3864795 - RNA, 16 nt, Human
ccagugacuccaggag

SEQ ID NO: 3864796 - RNA, 13 nt, Human
ccagugagacugu

SEQ ID NO: 3864797 - RNA, 21 nt, Human
ccagugagaugagggaugggc

SEQ ID NO: 3864798 - RNA, 14 nt, Human
ccagugagaugcau

SEQ ID NO: 3864799 - RNA, 16 nt, Human
ccagugagcacuccca

SEQ ID NO: 3864800 - RNA, 19 nt, Human
ccagugagcacucccaagu

SEQ ID NO: 3864801 - RNA, 13 nt, Human
ccagugaggcucu

SEQ ID NO: 3864802 - RNA, 14 nt, Human
ccagugcaaaugca

SEQ ID NO: 3864803 - RNA, 15 nt, Human
ccagugcaacagcac

SEQ ID NO: 3864804 - RNA, 18 nt, Human
ccagugcaacagcacugg

SEQ ID NO: 3864805 - RNA, 15 nt, Human
ccagugcaggcuggc

SEQ ID NO: 3864806 - RNA, 20 nt, Human
ccagugcaggcuggccagcc

SEQ ID NO: 3864807 - RNA, 22 nt, Human
ccagugcaggcuggccagccgc

SEQ ID NO: 3864808 - RNA, 19 nt, Human
ccagugcaugguggccaga

SEQ ID NO: 3864809 - RNA, 18 nt, Human
ccagugcccauuccucac

SEQ ID NO: 3864810 - RNA, 23 nt, Human
ccagugcccucuccccucagccu

SEQ ID NO: 3864811 - RNA, 16 nt, Human
ccagugcccugagcca

SEQ ID NO: 3864812 - RNA, 18 nt, Human
ccagugcccugaucccag

SEQ ID NO: 3864813 - RNA, 24 nt, Human
ccagugcccugaucccagagagcc

SEQ ID NO: 3864814 - RNA, 14 nt, Human
ccagugccugggug

SEQ ID NO: 3864815 - RNA, 17 nt, Human
ccagugccuuaccuccu

SEQ ID NO: 3864816 - RNA, 21 nt, Human
ccagugccuuaccuccugccc

SEQ ID NO: 3864817 - RNA, 22 nt, Human
ccagugccuuaccuccugccca

SEQ ID NO: 3864818 - RNA, 22 nt, Human
ccaguggauucuuguuuugcuu

SEQ ID NO: 3864819 - RNA, 20 nt, Human
ccaguggcagggcacagggc

SEQ ID NO: 3864820 - RNA, 21 nt, Human
ccaguggcagggcacagggcc

SEQ ID NO: 3864821 - RNA, 16 nt, Human
ccaguggccacucagc

SEQ ID NO: 3864822 - RNA, 24 nt, Human
ccaguggccucaacccucccucag

SEQ ID NO: 3864823 - RNA, 14 nt, Human
ccaguggccuggcu

SEQ ID NO: 3864824 - RNA, 17 nt, Human
ccaguggccuuccccag

SEQ ID NO: 3864825 - RNA, 19 nt, Human
ccaguggccuuccccagca

SEQ ID NO: 3864826 - RNA, 18 nt, Human
ccaguggcuauggccugu

SEQ ID NO: 3864827 - RNA, 21 nt, Human
ccaguggcugcugcccaggcc

SEQ ID NO: 3864828 - RNA, 16 nt, Human
ccagugggagauguua

SEQ ID NO: 3864829 - RNA, 14 nt, Human
ccagugggaggcgc

SEQ ID NO: 3864830 - RNA, 17 nt, Human
ccaugugacucuggcuu

SEQ ID NO: 3864831 - RNA, 18 nt, Human
ccaugugacucuggcuug

SEQ ID NO: 3864832 - RNA, 19 nt, Human
ccaugugagcugcugccau

SEQ ID NO: 3864833 - RNA, 21 nt, Human
ccaugugauggacacuccagg

SEQ ID NO: 3864834 - RNA, 18 nt, Human
ccaugugcuacaggggcc

SEQ ID NO: 3864835 - RNA, 23 nt, Human
ccaugugcuacaggggccagaag

SEQ ID NO: 3864836 - RNA, 17 nt, Human
ccauguggagacuucau

SEQ ID NO: 3864837 - RNA, 21 nt, Human
ccauguggauaacuuuacaga

SEQ ID NO: 3864838 - RNA, 14 nt, Human
ccauguggccacaa

SEQ ID NO: 3864839 - RNA, 12 nt, Human
ccaugugucacu

SEQ ID NO: 3864840 - RNA, 20 nt, Human
ccaugugucacuugugcuuu

SEQ ID NO: 3864841 - RNA, 17 nt, Human
ccaugugugagugugug

SEQ ID NO: 3864842 - RNA, 12 nt, Human
ccaugugugugc

SEQ ID NO: 3864843 - RNA, 16 nt, Human
ccauguguuauguuuu

SEQ ID NO: 3864844 - RNA, 22 nt, Human
ccauguucacaccgcugcacuc

SEQ ID NO: 3864845 - RNA, 14 nt, Human
ccauguucugcccc

SEQ ID NO: 3864846 - RNA, 21 nt, Human
ccauguucugcccccagccca

SEQ ID NO: 3864847 - RNA, 22 nt, Human
ccauguucugcccccagcccaa

SEQ ID NO: 3864848 - RNA, 13 nt, Human
ccauguugcugcc

SEQ ID NO: 3864849 - RNA, 14 nt, Human
ccauguugcugcca

SEQ ID NO: 3864850 - RNA, 15 nt, Human
ccauguugcugccaa

SEQ ID NO: 3864851 - RNA, 14 nt, Human
ccauguuggccagg

SEQ ID NO: 3864852 - RNA, 17 nt, Human
ccauguuggccaggcug

SEQ ID NO: 3864853 - RNA, 21 nt, Human
ccauguuggccaggcuggucu

SEQ ID NO: 3864854 - RNA, 20 nt, Human
ccauguuguaaugcugcacu

SEQ ID NO: 3864855 - RNA, 15 nt, Human
ccauguuucucuggc

SEQ ID NO: 3864856 - RNA, 16 nt, Human
ccauguuucucuggcc

SEQ ID NO: 3864857 - RNA, 21 nt, Human
ccauguuucucuggccccaag

SEQ ID NO: 3864858 - RNA, 21 nt, Human
ccauguuuguggcuauuaaaa

SEQ ID NO: 3864859 - RNA, 14 nt, Human
ccauuaaaacugcu

SEQ ID NO: 3864860 - RNA, 15 nt, Human
ccauuaaaacugcuu

SEQ ID NO: 3864861 - RNA, 18 nt, Human
ccauuaaaccaucucccu

SEQ ID NO: 3864862 - RNA, 19 nt, Human
ccauuaaaccaucucccug

SEQ ID NO: 3864863 - RNA, 10 nt, Human
ccauuaaacg

SEQ ID NO: 3864864 - RNA, 13 nt, Human
ccauuaaagucug

SEQ ID NO: 3864865 - RNA, 14 nt, Human
ccauuaacugcuuc

SEQ ID NO: 3864866 - RNA, 15 nt, Human
ccauuaaggggaaga

SEQ ID NO: 3864867 - RNA, 23 nt, Human
ccauuacagagguauuaaaacua

SEQ ID NO: 3864868 - RNA, 14 nt, Human
ccauuaccauggag

SEQ ID NO: 3864869 - RNA, 12 nt, Human
ccauuacccuca

SEQ ID NO: 3864870 - RNA, 16 nt, Human
ccauuaggccagcaac

SEQ ID NO: 3864871 - RNA, 20 nt, Human
ccauuauaaugaauuuagug

SEQ ID NO: 3864872 - RNA, 17 nt, Human
ccauuaugaagaagaga

SEQ ID NO: 3864873 - RNA, 15 nt, Human
ccauuauguccuagu

SEQ ID NO: 3864874 - RNA, 14 nt, Human
ccauuauucaaagu

SEQ ID NO: 3864875 - RNA, 18 nt, Human
ccauuauuuucugucaga

SEQ ID NO: 3864876 - RNA, 20 nt, Human
ccauucacuucauaauccag

SEQ ID NO: 3864877 - RNA, 22 nt, Human
ccauucagcccauuucacaccu

SEQ ID NO: 3864878 - RNA, 11 nt, Human
ccauucaguca

SEQ ID NO: 3864879 - RNA, 13 nt, Human
ccauucauuccau

SEQ ID NO: 3864880 - RNA, 18 nt, Human
ccauucauuccauucugg

SEQ ID NO: 3864881 - RNA, 20 nt, Human
ccauucauuccauucuggaa

SEQ ID NO: 3864882 - RNA, 11 nt, Human
ccauuccaaaa

SEQ ID NO: 3864883 - RNA, 13 nt, Human
ccauuccaaaaua

SEQ ID NO: 3864884 - RNA, 18 nt, Human
ccauuccacacagaaugc

SEQ ID NO: 3864885 - RNA, 19 nt, Human
ccauuccccagccucucuu

SEQ ID NO: 3864886 - RNA, 15 nt, Human
ccauucccccagugc

SEQ ID NO: 3864887 - RNA, 14 nt, Human
ccauucccugccug

SEQ ID NO: 3864888 - RNA, 19 nt, Human
ccauucccugggaucuggu

SEQ ID NO: 3864889 - RNA, 22 nt, Human
ccauuccucaccuuuucccggg

SEQ ID NO: 3864890 - RNA, 12 nt, Human
ccauuccucagg

SEQ ID NO: 3864891 - RNA, 22 nt, Human
ccauuccuggaaaccacagucc

SEQ ID NO: 3864892 - RNA, 16 nt, Human
ccauuccuucccagag

SEQ ID NO: 3864893 - RNA, 12 nt, Human
ccauucuacuug

SEQ ID NO: 3864894 - RNA, 17 nt, Human
ccauucuauuuuagaau

SEQ ID NO: 3864895 - RNA, 18 nt, Human
ccauucucaagcccugca

SEQ ID NO: 3864896 - RNA, 16 nt, Human
ccauucuccaccugcc

SEQ ID NO: 3864897 - RNA, 19 nt, Human
ccauucuccaccugccagg

SEQ ID NO: 3864898 - RNA, 20 nt, Human
ccauucuccaccugccaggg

SEQ ID NO: 3864899 - RNA, 22 nt, Human
ccauucuccagggguuuacagu

SEQ ID NO: 3864900 - RNA, 13 nt, Human
ccauucuccauuu

SEQ ID NO: 3864901 - RNA, 13 nt, Human
ccauucucccagg

SEQ ID NO: 3864902 - RNA, 15 nt, Human
ccauucugccugccc

SEQ ID NO: 3864903 - RNA, 19 nt, Human
ccauucugcuccuucccca

SEQ ID NO: 3864904 - RNA, 22 nt, Human
ccauucuuacuuacuaaaauau

SEQ ID NO: 3864905 - RNA, 20 nt, Human
ccauucuuccuaguuuucuc

SEQ ID NO: 3864906 - RNA, 14 nt, Human
ccauucuuucccaa

SEQ ID NO: 3864907 - RNA, 13 nt, Human
ccauucuuucuga

SEQ ID NO: 3864908 - RNA, 18 nt, Human
ccauucuuuuguaauuua

SEQ ID NO: 3864909 - RNA, 23 nt, Human
ccauugaagccgacucuggcccu

SEQ ID NO: 3864910 - RNA, 21 nt, Human
ccauugaaggcuuaaacccau

SEQ ID NO: 3864911 - RNA, 13 nt, Human
ccauugaauucuu

SEQ ID NO: 3864912 - RNA, 16 nt, Human
ccauugacauguacag

SEQ ID NO: 3864913 - RNA, 17 nt, Human
ccauugacauguacaga

SEQ ID NO: 3864914 - RNA, 24 nt, Human
ccauugaggcuugguuccuuccca

SEQ ID NO: 3864915 - RNA, 18 nt, Human
ccauugcacuccagccug

SEQ ID NO: 3864916 - RNA, 20 nt, Human
ccauugcacuccagccuggg

SEQ ID NO: 3864917 - RNA, 15 nt, Human
ccauugccaccagga

SEQ ID NO: 3864918 - RNA, 14 nt, Human
ccauugcccugguu

SEQ ID NO: 3864919 - RNA, 17 nt, Human
ccauugccuagcucuuu

SEQ ID NO: 3864920 - RNA, 15 nt, Human
ccauugccuccuccu

SEQ ID NO: 3864921 - RNA, 23 nt, Human
ccauugccuccuccuucccaaag

SEQ ID NO: 3864922 - RNA, 19 nt, Human
ccauugcuguucuacuuuu

SEQ ID NO: 3864923 - RNA, 11 nt, Human
ccauuggaaau

SEQ ID NO: 3864924 - RNA, 15 nt, Human
ccauuggaaauuuca

SEQ ID NO: 3864925 - RNA, 19 nt, Human
ccauuggcuauuuaaaacu

SEQ ID NO: 3864926 - RNA, 17 nt, Human
ccauuggggcucccagc

SEQ ID NO: 3864927 - RNA, 22 nt, Human
ccauuggggcucccagccaggc

SEQ ID NO: 3864928 - RNA, 15 nt, Human
ccauugucccucugc

SEQ ID NO: 3864929 - RNA, 19 nt, Human
ccauugugaaccaaugcaa

SEQ ID NO: 3864930 - RNA, 12 nt, Human
ccauugugugag

SEQ ID NO: 3864931 - RNA, 21 nt, Human
ccauuguuugaaacaaagaag

SEQ ID NO: 3864932 - RNA, 13 nt, Human
ccauuuaaagcuu

SEQ ID NO: 3864933 - RNA, 20 nt, Human
ccauuuaauggggaggacaa

SEQ ID NO: 3864934 - RNA, 12 nt, Human
ccauuuacacuu

SEQ ID NO: 3864935 - RNA, 18 nt, Human
ccauuuacacuuuugaga

SEQ ID NO: 3864936 - RNA, 16 nt, Human
ccauuuacugcauucu

SEQ ID NO: 3864937 - RNA, 23 nt, Human
ccauuuacugcauucuucugauc

SEQ ID NO: 3864938 - RNA, 21 nt, Human
ccauuuagguuucugaguucc

SEQ ID NO: 3864939 - RNA, 14 nt, Human
ccauuuauccaccu

SEQ ID NO: 3864940 - RNA, 20 nt, Human
ccauuuaugugagugugugu

SEQ ID NO: 3864941 - RNA, 22 nt, Human
ccauuucacaccugaaaauguu

SEQ ID NO: 3864942 - RNA, 17 nt, Human
ccauuucaucuauuucu

SEQ ID NO: 3864943 - RNA, 15 nt, Human
ccauuucauguccau

SEQ ID NO: 3864944 - RNA, 21 nt, Human
ccauuucauuugugccagaau

SEQ ID NO: 3864945 - RNA, 22 nt, Human
ccauuuccauguccccucccag

SEQ ID NO: 3864946 - RNA, 17 nt, Human
ccauuucccaucugcac

SEQ ID NO: 3864947 - RNA, 21 nt, Human
ccauuucgugagccccaucuu

SEQ ID NO: 3864948 - RNA, 11 nt, Human
ccauuucuaau

SEQ ID NO: 3864949 - RNA, 21 nt, Human
ccauuucuaauuauguagcuc

SEQ ID NO: 3864950 - RNA, 13 nt, Human
ccauuucuacucu

SEQ ID NO: 3864951 - RNA, 13 nt, Human
ccauuucugccuu

SEQ ID NO: 3864952 - RNA, 15 nt, Human
ccauuugaaagaaag

SEQ ID NO: 3864953 - RNA, 19 nt, Human
ccauuugauaccccugggg

SEQ ID NO: 3864954 - RNA, 18 nt, Human
ccauuugcaauaacagcu

SEQ ID NO: 3864955 - RNA, 21 nt, Human
ccauuugcguuccaugaugcu

SEQ ID NO: 3864956 - RNA, 20 nt, Human
ccauuugcuacuguacauaa

SEQ ID NO: 3864957 - RNA, 21 nt, Human
ccauuuggagggccugggccu

SEQ ID NO: 3864958 - RNA, 18 nt, Human
ccauuuggcaucccuggg

SEQ ID NO: 3864959 - RNA, 12 nt, Human
ccauuuguaaaa

SEQ ID NO: 3864960 - RNA, 13 nt, Human
ccauuuguaauaa

SEQ ID NO: 3864961 - RNA, 15 nt, Human
ccauuugugccagag

SEQ ID NO: 3864962 - RNA, 18 nt, Human
ccauuugugccagaggaa

SEQ ID NO: 3864963 - RNA, 14 nt, Human
ccauuugugugugu

SEQ ID NO: 3864964 - RNA, 14 nt, Human
ccauuuguuaucug

SEQ ID NO: 3864965 - RNA, 13 nt, Human
ccauuuguucaua

SEQ ID NO: 3864966 - RNA, 16 nt, Human
ccauuuguucauauua

SEQ ID NO: 3864967 - RNA, 20 nt, Human
ccauuuguucauauuaagaa

SEQ ID NO: 3864968 - RNA, 14 nt, Human
ccauuuuaaguccc

SEQ ID NO: 3864969 - RNA, 15 nt, Human
ccauuuuaagucccu

SEQ ID NO: 3864970 - RNA, 19 nt, Human
ccauuuuagucacuuuuuu

SEQ ID NO: 3864971 - RNA, 18 nt, Human
ccauuuuccuacaggcag

SEQ ID NO: 3864972 - RNA, 12 nt, Human
ccauuuucugug

SEQ ID NO: 3864973 - RNA, 13 nt, Human
ccauuuucugugg

SEQ ID NO: 3864974 - RNA, 17 nt, Human
ccauuuugcaaaauuuc

SEQ ID NO: 3864975 - RNA, 23 nt, Human
ccauuuuggauucuuauggacaa

SEQ ID NO: 3864976 - RNA, 20 nt, Human
cccacguucucacacccacc

SEQ ID NO: 3864977 - RNA, 15 nt, Human
cccacuacugcagca

SEQ ID NO: 3864978 - RNA, 18 nt, Human
cccacuagacccacugga

SEQ ID NO: 3864979 - RNA, 18 nt, Human
cccacuagccuaggucau

SEQ ID NO: 3864980 - RNA, 23 nt, Human
cccacucaagccaagcagccaag

SEQ ID NO: 3864981 - RNA, 12 nt, Human
cccacucacaga

SEQ ID NO: 3864982 - RNA, 12 nt, Human
cccacucccaca

SEQ ID NO: 3864983 - RNA, 13 nt, Human
cccacucccucac

SEQ ID NO: 3864984 - RNA, 14 nt, Human
cccacucccucaca

SEQ ID NO: 3864985 - RNA, 22 nt, Human
cccacucccuggcucucagaag

SEQ ID NO: 3864986 - RNA, 18 nt, Human
cccacuccugcucugcuc

SEQ ID NO: 3864987 - RNA, 21 nt, Human
cccacucuaggggucaggcuc

SEQ ID NO: 3864988 - RNA, 13 nt, Human
cccacucucagag

SEQ ID NO: 3864989 - RNA, 14 nt, Human
cccacucucagagg

SEQ ID NO: 3864990 - RNA, 14 nt, Human
cccacucucauucc

SEQ ID NO: 3864991 - RNA, 21 nt, Human
cccacucucauuccccaggug

SEQ ID NO: 3864992 - RNA, 11 nt, Human
cccacucuccc

SEQ ID NO: 3864993 - RNA, 14 nt, Human
cccacucuccccac

SEQ ID NO: 3864994 - RNA, 15 nt, Human
cccacucuccccaca

SEQ ID NO: 3864995 - RNA, 17 nt, Human
cccacucuccccacacu

SEQ ID NO: 3864996 - RNA, 14 nt, Human
cccacucuccuagg

SEQ ID NO: 3864997 - RNA, 15 nt, Human
cccacucuccuaggc

SEQ ID NO: 3864998 - RNA, 21 nt, Human
cccacucuccuaggcauucug

SEQ ID NO: 3864999 - RNA, 13 nt, Human
cccacucugcucu

SEQ ID NO: 3865000 - RNA, 16 nt, Human
cccacucugcucugau

SEQ ID NO: 3865001 - RNA, 17 nt, Human
cccacucugcucugaug

SEQ ID NO: 3865002 - RNA, 18 nt, Human
cccacucugcucugaugc

SEQ ID NO: 3865003 - RNA, 21 nt, Human
cccacucugcuuugacugagc

SEQ ID NO: 3865004 - RNA, 12 nt, Human
cccacugaugcu

SEQ ID NO: 3865005 - RNA, 15 nt, Human
cccacugcaauccug

SEQ ID NO: 3865006 - RNA, 14 nt, Human
cccacugcaccccc

SEQ ID NO: 3865007 - RNA, 23 nt, Human
cccacugcacccccuccugcugc

SEQ ID NO: 3865008 - RNA, 15 nt, Human
cccacugcaggcccc

SEQ ID NO: 3865009 - RNA, 13 nt, Human
cccacugccagca

SEQ ID NO: 3865010 - RNA, 14 nt, Human
cccacugccagcag

SEQ ID NO: 3865011 - RNA, 15 nt, Human
cccacugccagcagc

SEQ ID NO: 3865012 - RNA, 17 nt, Human
cccacugccagcagcag

SEQ ID NO: 3865013 - RNA, 21 nt, Human
cccacugccagcagcagcagg

SEQ ID NO: 3865014 - RNA, 17 nt, Human
cccacugccauaaaaca

SEQ ID NO: 3865015 - RNA, 17 nt, Human
cccacugcccacccccu

SEQ ID NO: 3865016 - RNA, 19 nt, Human
cccacugcccacccccuca

SEQ ID NO: 3865017 - RNA, 22 nt, Human
cccacugcccacccccucaagc

SEQ ID NO: 3865018 - RNA, 16 nt, Human
cccacugccucagguu

SEQ ID NO: 3865019 - RNA, 14 nt, Human
cccacugccugccc

SEQ ID NO: 3865020 - RNA, 16 nt, Human
cccacugccugcccac

SEQ ID NO: 3865021 - RNA, 13 nt, Human
cccacugcucugg

SEQ ID NO: 3865022 - RNA, 15 nt, Human
cccacuggcagcauc

SEQ ID NO: 3865023 - RNA, 15 nt, Human
cccacuggcuguggg

SEQ ID NO: 3865024 - RNA, 22 nt, Human
cccacuggcugugggcucccuu

SEQ ID NO: 3865025 - RNA, 21 nt, Human
cccacuggggaaauaacagcu

SEQ ID NO: 3865026 - RNA, 21 nt, Human
cccacugguuccuucuuccug

SEQ ID NO: 3865027 - RNA, 18 nt, Human
cccacuguacuugcucuu

SEQ ID NO: 3865028 - RNA, 19 nt, Human
cccacuguacuugcucuug

SEQ ID NO: 3865029 - RNA, 19 nt, Human
cccacuguaucuaggcaac

SEQ ID NO: 3865030 - RNA, 12 nt, Human
cccacuguauga

SEQ ID NO: 3865031 - RNA, 16 nt, Human
cccacugugcaggugc

SEQ ID NO: 3865032 - RNA, 16 nt, Human
cccacugugccucaga

SEQ ID NO: 3865033 - RNA, 13 nt, Human
cccacuucagccu

SEQ ID NO: 3865034 - RNA, 12 nt, Human
cccacuucccug

SEQ ID NO: 3865035 - RNA, 15 nt, Human
cccacuucccugggc

SEQ ID NO: 3865036 - RNA, 12 nt, Human
cccacuucucau

SEQ ID NO: 3865037 - RNA, 19 nt, Human
cccacuucucaucacacac

SEQ ID NO: 3865038 - RNA, 20 nt, Human
cccacuucucaucacacaca

SEQ ID NO: 3865039 - RNA, 21 nt, Human
cccacuucucaucacacacau

SEQ ID NO: 3865040 - RNA, 12 nt, Human
cccacuucugca

SEQ ID NO: 3865041 - RNA, 23 nt, Human
cccacuugagaauuacccuuuug

SEQ ID NO: 3865042 - RNA, 13 nt, Human
cccacuugccucu

SEQ ID NO: 3865043 - RNA, 23 nt, Human
cccacuugucacugacacaaagg

SEQ ID NO: 3865044 - RNA, 22 nt, Human
cccacuuugcuguuccuuacuu

SEQ ID NO: 3865045 - RNA, 15 nt, Human
cccacuuuggccucc

SEQ ID NO: 3865046 - RNA, 13 nt, Human
cccagaaaagaaa

SEQ ID NO: 3865047 - RNA, 14 nt, Human
cccagaaaggagac

SEQ ID NO: 3865048 - RNA, 17 nt, Human
cccagaaaggagacuag

SEQ ID NO: 3865049 - RNA, 14 nt, Human
cccagaacacacuc

SEQ ID NO: 3865050 - RNA, 17 nt, Human
cccagaacucugccugc

SEQ ID NO: 3865051 - RNA, 21 nt, Human
cccagaacucugccugcccuu

SEQ ID NO: 3865052 - RNA, 19 nt, Human
cccagaaggaccuccugag

SEQ ID NO: 3865053 - RNA, 23 nt, Human
cccagaaggcagggaaaggcucu

SEQ ID NO: 3865054 - RNA, 22 nt, Human
cccagaauaaacuggcagcuca

SEQ ID NO: 3865055 - RNA, 19 nt, Human
cccagaauaaguuauugca

SEQ ID NO: 3865056 - RNA, 14 nt, Human
cccagaauacugau

SEQ ID NO: 3865057 - RNA, 12 nt, Human
cccagaaugaga

SEQ ID NO: 3865058 - RNA, 18 nt, Human
cccagaaugagacaucca

SEQ ID NO: 3865059 - RNA, 21 nt, Human
cccagacagcucccucugccu

SEQ ID NO: 3865060 - RNA, 17 nt, Human
cccagacccuggaggaa

SEQ ID NO: 3865061 - RNA, 14 nt, Human
cccagaccugccuc

SEQ ID NO: 3865062 - RNA, 18 nt, Human
cccagaccugccucuucc

SEQ ID NO: 3865063 - RNA, 22 nt, Human
cccagaccuguuagcagacagg

SEQ ID NO: 3865064 - RNA, 17 nt, Human
cccagacgaugucuuca

SEQ ID NO: 3865065 - RNA, 15 nt, Human
cccagacgccuggcu

SEQ ID NO: 3865066 - RNA, 20 nt, Human
cccagacuagauguaguauu

SEQ ID NO: 3865067 - RNA, 21 nt, Human
cccagagaaagcgcagaugcu

SEQ ID NO: 3865068 - RNA, 14 nt, Human
cccagagaagcccc

SEQ ID NO: 3865069 - RNA, 16 nt, Human
cccagagaagccccuu

SEQ ID NO: 3865070 - RNA, 22 nt, Human
cccagagaagccccuuccccau

SEQ ID NO: 3865071 - RNA, 13 nt, Human
cccagagacagga

SEQ ID NO: 3865072 - RNA, 15 nt, Human
cccagagacaggaaa

SEQ ID NO: 3865073 - RNA, 21 nt, Human
cccagagacauacuugaaggg

SEQ ID NO: 3865074 - RNA, 22 nt, Human
cccagagacauacuugaagggc

SEQ ID NO: 3865075 - RNA, 13 nt, Human
cccagagagcccg

SEQ ID NO: 3865076 - RNA, 17 nt, Human
cccagagaugccuccac

SEQ ID NO: 3865077 - RNA, 18 nt, Human
cccagagaugccuccacc

SEQ ID NO: 3865078 - RNA, 20 nt, Human
cccagagaugucaucagagc

SEQ ID NO: 3865079 - RNA, 20 nt, Human
cccagagcaccugcugucug

SEQ ID NO: 3865080 - RNA, 12 nt, Human
cccagagcacug

SEQ ID NO: 3865081 - RNA, 21 nt, Human
cccagagcaggaggccccugg

SEQ ID NO: 3865082 - RNA, 15 nt, Human
cccagagccacacau

SEQ ID NO: 3865083 - RNA, 13 nt, Human
cccagagccacag

SEQ ID NO: 3865084 - RNA, 14 nt, Human
cccagagccacagu

SEQ ID NO: 3865085 - RNA, 15 nt, Human
cccagagcccagcuc

SEQ ID NO: 3865086 - RNA, 17 nt, Human
cccagagcccagcucca

SEQ ID NO: 3865087 - RNA, 15 nt, Human
cccagagcccaggcu

SEQ ID NO: 3865088 - RNA, 16 nt, Human
cccagagccccuccuc

SEQ ID NO: 3865089 - RNA, 20 nt, Human
cccagagccccuccuccagc

SEQ ID NO: 3865090 - RNA, 14 nt, Human
cccagagcugggug

SEQ ID NO: 3865091 - RNA, 18 nt, Human
cccagagcugggugagug

SEQ ID NO: 3865092 - RNA, 11 nt, Human
cccagagcugu

SEQ ID NO: 3865093 - RNA, 21 nt, Human
cccagagcuguggacuuuguu

SEQ ID NO: 3865094 - RNA, 13 nt, Human
cccagagcuguuu

SEQ ID NO: 3865095 - RNA, 21 nt, Human
cccagagcuguuuauggccuc

SEQ ID NO: 3865096 - RNA, 23 nt, Human
cccagagcuguuuauggccucag

SEQ ID NO: 3865097 - RNA, 22 nt, Human
cccagaggaaggggccagaggc

SEQ ID NO: 3865098 - RNA, 15 nt, Human
cccagaggagggcag

SEQ ID NO: 3865099 - RNA, 20 nt, Human
cccagaggccgagagcuaug

SEQ ID NO: 3865100 - RNA, 23 nt, Human
cccagaggcgucccgcaccuguc

SEQ ID NO: 3865101 - RNA, 24 nt, Human
cccagaggcgucccgcaccugucu

SEQ ID NO: 3865102 - RNA, 16 nt, Human
cccagaggcuggguga

SEQ ID NO: 3865103 - RNA, 14 nt, Human
cccagagggccugc

SEQ ID NO: 3865104 - RNA, 14 nt, Human
cccagaggggccug

SEQ ID NO: 3865105 - RNA, 22 nt, Human
cccagagggucugggggcacaa

SEQ ID NO: 3865106 - RNA, 20 nt, Human
cccagagguaacagaacagc

SEQ ID NO: 3865107 - RNA, 19 nt, Human
cccagagguccagcccauc

SEQ ID NO: 3865108 - RNA, 15 nt, Human
cccagagucaucuga

SEQ ID NO: 3865109 - RNA, 17 nt, Human
cccagagugugaaacuu

SEQ ID NO: 3865110 - RNA, 16 nt, Human
cccagagugugggaag

SEQ ID NO: 3865111 - RNA, 21 nt, Human
cccagaguuuuuauguagcag

SEQ ID NO: 3865112 - RNA, 18 nt, Human
cccagauaccagccccug

SEQ ID NO: 3865113 - RNA, 14 nt, Human
cccagaucagccag

SEQ ID NO: 3865114 - RNA, 23 nt, Human
cccagauggcuggaaggggucca

SEQ ID NO: 3865115 - RNA, 21 nt, Human
cccagauguuuuacgucuggg

SEQ ID NO: 3865116 - RNA, 22 nt, Human
cccagauguuuuacgucuggga

SEQ ID NO: 3865117 - RNA, 19 nt, Human
cccagauuccccuguguca

SEQ ID NO: 3865118 - RNA, 20 nt, Human
cccagauugcaacaggcugg

SEQ ID NO: 3865119 - RNA, 21 nt, Human
cccagauugcaacaggcuggg

SEQ ID NO: 3865120 - RNA, 23 nt, Human
cccagauugcaacaggcugggcu

SEQ ID NO: 3865121 - RNA, 11 nt, Human
cccucucugga

SEQ ID NO: 3865122 - RNA, 22 nt, Human
cccucucuggcuaaggacaggc

SEQ ID NO: 3865123 - RNA, 19 nt, Human
cccucucugggccucagag

SEQ ID NO: 3865124 - RNA, 14 nt, Human
cccucucuugucag

SEQ ID NO: 3865125 - RNA, 20 nt, Human
cccucugaaaguuguacaug

SEQ ID NO: 3865126 - RNA, 16 nt, Human
cccucugaacuugccu

SEQ ID NO: 3865127 - RNA, 19 nt, Human
cccucugaaugguccaggg

SEQ ID NO: 3865128 - RNA, 14 nt, Human
cccucugaccugca

SEQ ID NO: 3865129 - RNA, 17 nt, Human
cccucugaccugcacug

SEQ ID NO: 3865130 - RNA, 19 nt, Human
cccucugaccugcacuggg

SEQ ID NO: 3865131 - RNA, 16 nt, Human
cccucugcacccagaa

SEQ ID NO: 3865132 - RNA, 14 nt, Human
cccucugccaccag

SEQ ID NO: 3865133 - RNA, 19 nt, Human
cccucugcccacucccugc

SEQ ID NO: 3865134 - RNA, 14 nt, Human
cccucugcccagcu

SEQ ID NO: 3865135 - RNA, 15 nt, Human
cccucugcccagcuu

SEQ ID NO: 3865136 - RNA, 14 nt, Human
cccucugccccucc

SEQ ID NO: 3865137 - RNA, 12 nt, Human
cccucugcccug

SEQ ID NO: 3865138 - RNA, 14 nt, Human
cccucugccugucc

SEQ ID NO: 3865139 - RNA, 15 nt, Human
cccucugccuguccc

SEQ ID NO: 3865140 - RNA, 16 nt, Human
cccucugccugucccu

SEQ ID NO: 3865141 - RNA, 19 nt, Human
cccucugcugaagacuugc

SEQ ID NO: 3865142 - RNA, 21 nt, Human
cccucuggaguggccacuaag

SEQ ID NO: 3865143 - RNA, 13 nt, Human
cccucuggaucaa

SEQ ID NO: 3865144 - RNA, 19 nt, Human
cccucuggauucugaaucu

SEQ ID NO: 3865145 - RNA, 12 nt, Human
cccucuggccag

SEQ ID NO: 3865146 - RNA, 18 nt, Human
cccucuggccaggaugga

SEQ ID NO: 3865147 - RNA, 14 nt, Human
cccucugggaaccu

SEQ ID NO: 3865148 - RNA, 17 nt, Human
cccucugggcucugagu

SEQ ID NO: 3865149 - RNA, 15 nt, Human
cccucuggucccaca

SEQ ID NO: 3865150 - RNA, 20 nt, Human
cccucuggucgcuccugccc

SEQ ID NO: 3865151 - RNA, 22 nt, Human
cccucuggucgcuccugcccac

SEQ ID NO: 3865152 - RNA, 18 nt, Human
cccucuguguauuugcuu

SEQ ID NO: 3865153 - RNA, 20 nt, Human
cccucuguucugcacacagc

SEQ ID NO: 3865154 - RNA, 21 nt, Human
cccucuguucugcacacagca

SEQ ID NO: 3865155 - RNA, 18 nt, Human
cccucuguugccaggcua

SEQ ID NO: 3865156 - RNA, 20 nt, Human
cccucuuauguaccucuuuu

SEQ ID NO: 3865157 - RNA, 14 nt, Human
cccucuucccuggu

SEQ ID NO: 3865158 - RNA, 22 nt, Human
cccucuuccuacuggucucucu

SEQ ID NO: 3865159 - RNA, 12 nt, Human
cccucuuccucu

SEQ ID NO: 3865160 - RNA, 20 nt, Human
cccucuuccugacgaaacug

SEQ ID NO: 3865161 - RNA, 14 nt, Human
cccucuucugagca

SEQ ID NO: 3865162 - RNA, 15 nt, Human
cccucuucugagcac

SEQ ID NO: 3865163 - RNA, 19 nt, Human
cccucuugacccaucuccc

SEQ ID NO: 3865164 - RNA, 15 nt, Human
cccucuugcccaucc

SEQ ID NO: 3865165 - RNA, 22 nt, Human
cccucuugcccauccugacuga

SEQ ID NO: 3865166 - RNA, 12 nt, Human
cccucuugcccc

SEQ ID NO: 3865167 - RNA, 19 nt, Human
cccucuugccccaaccccc

SEQ ID NO: 3865168 - RNA, 23 nt, Human
cccucuugccccaacccccagca

SEQ ID NO: 3865169 - RNA, 22 nt, Human
cccucuugccccccaccccagc

SEQ ID NO: 3865170 - RNA, 13 nt, Human
cccucuugucucc

SEQ ID NO: 3865171 - RNA, 21 nt, Human
cccucuuguuuuguuugucuc

SEQ ID NO: 3865172 - RNA, 17 nt, Human
cccucuuucccucccuu

SEQ ID NO: 3865173 - RNA, 16 nt, Human
cccucuuucucuuucu

SEQ ID NO: 3865174 - RNA, 22 nt, Human
cccucuuucucuuucuuccuuu

SEQ ID NO: 3865175 - RNA, 19 nt, Human
cccucuuugcugcagagaa

SEQ ID NO: 3865176 - RNA, 21 nt, Human
cccucuuuggcuccccuguac

SEQ ID NO: 3865177 - RNA, 12 nt, Human
cccucuuuucuu

SEQ ID NO: 3865178 - RNA, 16 nt, Human
cccucuuuucuuacuc

SEQ ID NO: 3865179 - RNA, 16 nt, Human
cccugaaaacccagag

SEQ ID NO: 3865180 - RNA, 18 nt, Human
cccugaaaacccagagag

SEQ ID NO: 3865181 - RNA, 22 nt, Human
cccugaaaauguuuuucugcca

SEQ ID NO: 3865182 - RNA, 13 nt, Human
cccugaaacacga

SEQ ID NO: 3865183 - RNA, 21 nt, Human
cccugaaacacgaaacuuguu

SEQ ID NO: 3865184 - RNA, 15 nt, Human
cccugaaacuuauuu

SEQ ID NO: 3865185 - RNA, 17 nt, Human
cccugaaacuuauuuuu

SEQ ID NO: 3865186 - RNA, 22 nt, Human
cccugaacaacgagccuuuuca

SEQ ID NO: 3865187 - RNA, 13 nt, Human
cccugaaccaucc

SEQ ID NO: 3865188 - RNA, 16 nt, Human
cccugaagccagccuu

SEQ ID NO: 3865189 - RNA, 14 nt, Human
cccugaaggaacca

SEQ ID NO: 3865190 - RNA, 19 nt, Human
cccugaaggccccgcccag

SEQ ID NO: 3865191 - RNA, 20 nt, Human
cccugaaggccccgcccagg

SEQ ID NO: 3865192 - RNA, 20 nt, Human
cccugaagugagcacagccu

SEQ ID NO: 3865193 - RNA, 20 nt, Human
cccugaauuuaaauagcuuu

SEQ ID NO: 3865194 - RNA, 16 nt, Human
cccugaccacucagag

SEQ ID NO: 3865195 - RNA, 15 nt, Human
cccugaccagcuccc

SEQ ID NO: 3865196 - RNA, 16 nt, Human
cccugaccagcucccc

SEQ ID NO: 3865197 - RNA, 12 nt, Human
cccugacccugc

SEQ ID NO: 3865198 - RNA, 16 nt, Human
cccugaccucccagcc

SEQ ID NO: 3865199 - RNA, 22 nt, Human
cccugaccucccagcccuaugg

SEQ ID NO: 3865200 - RNA, 16 nt, Human
cccugaccuggccccc

SEQ ID NO: 3865201 - RNA, 15 nt, Human
cccugacucauucug

SEQ ID NO: 3865202 - RNA, 12 nt, Human
cccugacugggg

SEQ ID NO: 3865203 - RNA, 19 nt, Human
cccugagauccccugagcc

SEQ ID NO: 3865204 - RNA, 20 nt, Human
cccugagauccccugagccc

SEQ ID NO: 3865205 - RNA, 16 nt, Human
cccugagcaaugucug

SEQ ID NO: 3865206 - RNA, 20 nt, Human
cccugagcaaugucugugcu

SEQ ID NO: 3865207 - RNA, 16 nt, Human
cccugagcaggaaagu

SEQ ID NO: 3865208 - RNA, 14 nt, Human
cccugagcaggauu

SEQ ID NO: 3865209 - RNA, 20 nt, Human
cccugagccagggucuccag

SEQ ID NO: 3865210 - RNA, 17 nt, Human
cccugagcccacugugc

SEQ ID NO: 3865211 - RNA, 15 nt, Human
cccugagccccuucc

SEQ ID NO: 3865212 - RNA, 12 nt, Human
cccugagccggc

SEQ ID NO: 3865213 - RNA, 11 nt, Human
cccugagcuga

SEQ ID NO: 3865214 - RNA, 14 nt, Human
cccugagcugacca

SEQ ID NO: 3865215 - RNA, 16 nt, Human
cccugagcuuucugcu

SEQ ID NO: 3865216 - RNA, 22 nt, Human
cccugaggaaggaggggaagcu

SEQ ID NO: 3865217 - RNA, 19 nt, Human
cccugaggagucugagguc

SEQ ID NO: 3865218 - RNA, 22 nt, Human
cccugaggagucugagguccug

SEQ ID NO: 3865219 - RNA, 17 nt, Human
cccugaggcccagaggg

SEQ ID NO: 3865220 - RNA, 23 nt, Human
cccugaggcccagagggccugca

SEQ ID NO: 3865221 - RNA, 19 nt, Human
cccugaggccuagacucug

SEQ ID NO: 3865222 - RNA, 23 nt, Human
cccugagggcggggugucugucu

SEQ ID NO: 3865223 - RNA, 21 nt, Human
cccugaggucagggagugcug

SEQ ID NO: 3865224 - RNA, 17 nt, Human
cccugaggugagcauca

SEQ ID NO: 3865225 - RNA, 15 nt, Human
cccugaggugugggg

SEQ ID NO: 3865226 - RNA, 20 nt, Human
cccugaggugugggggcugc

SEQ ID NO: 3865227 - RNA, 20 nt, Human
cccugaguggaucuccaagg

SEQ ID NO: 3865228 - RNA, 22 nt, Human
cccugaucccauuuuccucuga

SEQ ID NO: 3865229 - RNA, 21 nt, Human
cccugaucugacauccccacu

SEQ ID NO: 3865230 - RNA, 19 nt, Human
cccugauuacaccagccuc

SEQ ID NO: 3865231 - RNA, 19 nt, Human
cccugauugaccugcuccg

SEQ ID NO: 3865232 - RNA, 21 nt, Human
cccugauugaccugcuccgcu

SEQ ID NO: 3865233 - RNA, 21 nt, Human
cccugauuuaauaugcaaagu

SEQ ID NO: 3865234 - RNA, 18 nt, Human
cccugcaaaaggacucuc

SEQ ID NO: 3865235 - RNA, 20 nt, Human
cccugcaaaaggacucucag

SEQ ID NO: 3865236 - RNA, 22 nt, Human
cccugcaaacagaacaggguca

SEQ ID NO: 3865237 - RNA, 14 nt, Human
cccugcacagcagg

SEQ ID NO: 3865238 - RNA, 22 nt, Human
cccugcacagcaggcugccagu

SEQ ID NO: 3865239 - RNA, 15 nt, Human
cccugcacccuccua

SEQ ID NO: 3865240 - RNA, 17 nt, Human
cccugcacccuccuagg

SEQ ID NO: 3865241 - RNA, 21 nt, Human
cccugcacuaaagccagccug

SEQ ID NO: 3865242 - RNA, 22 nt, Human
cccugcacuaaagccagccuga

SEQ ID NO: 3865243 - RNA, 13 nt, Human
cccugcacuggag

SEQ ID NO: 3865244 - RNA, 20 nt, Human
cccugcacuguaaaaugugg

SEQ ID NO: 3865245 - RNA, 14 nt, Human
cccugcacuguccu

SEQ ID NO: 3865246 - RNA, 13 nt, Human
cccugcagacccu

SEQ ID NO: 3865247 - RNA, 15 nt, Human
cccugcagacccugc

SEQ ID NO: 3865248 - RNA, 17 nt, Human
cccugcagacccugccc

SEQ ID NO: 3865249 - RNA, 20 nt, Human
cccugcagagaugcgguggc

SEQ ID NO: 3865250 - RNA, 15 nt, Human
cccugcagaugccac

SEQ ID NO: 3865251 - RNA, 18 nt, Human
cccugcagaugccacccu

SEQ ID NO: 3865252 - RNA, 19 nt, Human
cccugcagcacggacaaua

SEQ ID NO: 3865253 - RNA, 13 nt, Human
cccugcagcccug

SEQ ID NO: 3865254 - RNA, 13 nt, Human
cccugcagcucuc

SEQ ID NO: 3865255 - RNA, 21 nt, Human
cccugcagcucucaugcugcc

SEQ ID NO: 3865256 - RNA, 15 nt, Human
cccugcaggaaggag

SEQ ID NO: 3865257 - RNA, 22 nt, Human
cccugcaggaaggagcugccug

SEQ ID NO: 3865258 - RNA, 21 nt, Human
cccugcaguguucgcuuggcu

SEQ ID NO: 3865259 - RNA, 17 nt, Human
cccugcaguuccccugg

SEQ ID NO: 3865260 - RNA, 19 nt, Human
cccugcaucugaccagcag

SEQ ID NO: 3865261 - RNA, 22 nt, Human
cccugcaugggccagccccucc

SEQ ID NO: 3865262 - RNA, 15 nt, Human
cccugccacccuggg

SEQ ID NO: 3865263 - RNA, 18 nt, Human
cccugccaccuccugccu

SEQ ID NO: 3865264 - RNA, 14 nt, Human
cccugccaccuguc

SEQ ID NO: 3865265 - RNA, 12 nt, Human
cccuuugcuguc

SEQ ID NO: 3865266 - RNA, 14 nt, Human
cccuuugggcccag

SEQ ID NO: 3865267 - RNA, 15 nt, Human
cccuuugggcccugc

SEQ ID NO: 3865268 - RNA, 17 nt, Human
cccuuugggcccugcau

SEQ ID NO: 3865269 - RNA, 18 nt, Human
cccuuugggcccugcaug

SEQ ID NO: 3865270 - RNA, 14 nt, Human
cccuuugugcugug

SEQ ID NO: 3865271 - RNA, 15 nt, Human
cccuuuuaaaguuga

SEQ ID NO: 3865272 - RNA, 16 nt, Human
cccuuuucagcuucug

SEQ ID NO: 3865273 - RNA, 23 nt, Human
cccuuuucuuuucuacccuagcc

SEQ ID NO: 3865274 - RNA, 14 nt, Human
cccuuuuggccccc

SEQ ID NO: 3865275 - RNA, 16 nt, Human
cccuuuuggguuucug

SEQ ID NO: 3865276 - RNA, 20 nt, Human
cccuuuuggguuucugcccu

SEQ ID NO: 3865277 - RNA, 13 nt, Human
cccuuuugucucu

SEQ ID NO: 3865278 - RNA, 16 nt, Human
cccuuuuguuccccag

SEQ ID NO: 3865279 - RNA, 16 nt, Human
cccuuuuuacuccccu

SEQ ID NO: 3865280 - RNA, 16 nt, Human
cccuuuuuccuugucc

SEQ ID NO: 3865281 - RNA, 23 nt, Human
cccuuuuuccuuguccccacacu

SEQ ID NO: 3865282 - RNA, 15 nt, Human
cccuuuuucuccagc

SEQ ID NO: 3865283 - RNA, 16 nt, Human
cccuuuuucuccagcu

SEQ ID NO: 3865284 - RNA, 21 nt, Human
cccuuuuuuccuuuccaccuu

SEQ ID NO: 3865285 - RNA, 22 nt, Human
cccuuuuuuggcugcugaaggc

SEQ ID NO: 3865286 - RNA, 21 nt, Human
cccuuuuuugucccccaacuu

SEQ ID NO: 3865287 - RNA, 23 nt, Human
cccuuuuuuuccuuuuucugauu

SEQ ID NO: 3865288 - RNA, 15 nt, Human
ccgaaaaauccucuu

SEQ ID NO: 3865289 - RNA, 16 nt, Human
ccgaaaacguggcugc

SEQ ID NO: 3865290 - RNA, 15 nt, Human
ccgaaaaucauauaa

SEQ ID NO: 3865291 - RNA, 15 nt, Human
ccgaacacccucgaa

SEQ ID NO: 3865292 - RNA, 18 nt, Human
ccgaagaauggagaggaa

SEQ ID NO: 3865293 - RNA, 18 nt, Human
ccgaagccgccuguggac

SEQ ID NO: 3865294 - RNA, 21 nt, Human
ccgaagcuaacagggaaggca

SEQ ID NO: 3865295 - RNA, 19 nt, Human
ccgaagcucuggcugaacc

SEQ ID NO: 3865296 - RNA, 19 nt, Human
ccgaaggaaaagggcuuuc

SEQ ID NO: 3865297 - RNA, 23 nt, Human
ccgaaggugaggagcuugaaacc

SEQ ID NO: 3865298 - RNA, 15 nt, Human
ccgaaggugcuggag

SEQ ID NO: 3865299 - RNA, 14 nt, Human
ccgaaugugucuuu

SEQ ID NO: 3865300 - RNA, 16 nt, Human
ccgaauugagcacaaa

SEQ ID NO: 3865301 - RNA, 22 nt, Human
ccgacaacuauuucggccuuuu

SEQ ID NO: 3865302 - RNA, 12 nt, Human
ccgacagccugg

SEQ ID NO: 3865303 - RNA, 15 nt, Human
ccgacagcuuuccag

SEQ ID NO: 3865304 - RNA, 13 nt, Human
ccgacauggcucc

SEQ ID NO: 3865305 - RNA, 17 nt, Human
ccgacauugucucccgc

SEQ ID NO: 3865306 - RNA, 15 nt, Human
ccgacccucugggaa

SEQ ID NO: 3865307 - RNA, 22 nt, Human
ccgacccuugccgucuaccuga

SEQ ID NO: 3865308 - RNA, 12 nt, Human
ccgaccucagcc

SEQ ID NO: 3865309 - RNA, 13 nt, Human
ccgaccucagccu

SEQ ID NO: 3865310 - RNA, 14 nt, Human
ccgaccucagccuu

SEQ ID NO: 3865311 - RNA, 15 nt, Human
ccgaccucagccuuc

SEQ ID NO: 3865312 - RNA, 18 nt, Human
ccgaccuggccugucugu

SEQ ID NO: 3865313 - RNA, 21 nt, Human
ccgacgccacagcccagccac

SEQ ID NO: 3865314 - RNA, 17 nt, Human
ccgacgcgucuccuguu

SEQ ID NO: 3865315 - RNA, 17 nt, Human
ccgacuagacacacaaa

SEQ ID NO: 3865316 - RNA, 14 nt, Human
ccgacucacaccac

SEQ ID NO: 3865317 - RNA, 12 nt, Human
ccgacuccagcc

SEQ ID NO: 3865318 - RNA, 14 nt, Human
ccgacuccagccag

SEQ ID NO: 3865319 - RNA, 19 nt, Human
ccgacucuuucugagugcc

SEQ ID NO: 3865320 - RNA, 20 nt, Human
ccgacugaaaauauuguuuu

SEQ ID NO: 3865321 - RNA, 16 nt, Human
ccgacugcuuuggacc

SEQ ID NO: 3865322 - RNA, 20 nt, Human
ccgacuugaauuuucccacu

SEQ ID NO: 3865323 - RNA, 18 nt, Human
ccgacuugugcacaggca

SEQ ID NO: 3865324 - RNA, 19 nt, Human
ccgacuugugcacaggcag

SEQ ID NO: 3865325 - RNA, 17 nt, Human
ccgagaaggaagccucc

SEQ ID NO: 3865326 - RNA, 17 nt, Human
ccgagacggcacugaga

SEQ ID NO: 3865327 - RNA, 13 nt, Human
ccgagagggagag

SEQ ID NO: 3865328 - RNA, 15 nt, Human
ccgagaggugggcca

SEQ ID NO: 3865329 - RNA, 19 nt, Human
ccgagaggugggccagucu

SEQ ID NO: 3865330 - RNA, 16 nt, Human
ccgagaguagccgaga

SEQ ID NO: 3865331 - RNA, 21 nt, Human
ccgagaguccaucagccucca

SEQ ID NO: 3865332 - RNA, 18 nt, Human
ccgagaucacgccacugc

SEQ ID NO: 3865333 - RNA, 22 nt, Human
ccgagaucgcgccacugcacuc

SEQ ID NO: 3865334 - RNA, 20 nt, Human
ccgagaucgugccauugcac

SEQ ID NO: 3865335 - RNA, 14 nt, Human
ccgagcaaccgugg

SEQ ID NO: 3865336 - RNA, 14 nt, Human
ccgagcagcugagc

SEQ ID NO: 3865337 - RNA, 17 nt, Human
ccgagcagcugagcagg

SEQ ID NO: 3865338 - RNA, 16 nt, Human
ccgagcaggaggccua

SEQ ID NO: 3865339 - RNA, 17 nt, Human
ccgagcccuacuuccag

SEQ ID NO: 3865340 - RNA, 19 nt, Human
ccgagccgggccuggggcu

SEQ ID NO: 3865341 - RNA, 16 nt, Human
ccgagccuggcuccaa

SEQ ID NO: 3865342 - RNA, 19 nt, Human
ccgagccuggcuccaaacc

SEQ ID NO: 3865343 - RNA, 19 nt, Human
ccgagcgcuuucuggaaaa

SEQ ID NO: 3865344 - RNA, 11 nt, Human
ccgagcuccuc

SEQ ID NO: 3865345 - RNA, 18 nt, Human
ccgagcugggggccauga

SEQ ID NO: 3865346 - RNA, 17 nt, Human
ccgagcuggugcauuac

SEQ ID NO: 3865347 - RNA, 19 nt, Human
ccgaggacgcucccugcuc

SEQ ID NO: 3865348 - RNA, 16 nt, Human
ccgaggagccaggcaa

SEQ ID NO: 3865349 - RNA, 16 nt, Human
ccgaggcccugcaugg

SEQ ID NO: 3865350 - RNA, 17 nt, Human
ccgaggcuggagcuggc

SEQ ID NO: 3865351 - RNA, 16 nt, Human
ccgagggaugaugcca

SEQ ID NO: 3865352 - RNA, 18 nt, Human
ccgagggaugaugccaca

SEQ ID NO: 3865353 - RNA, 15 nt, Human
ccgagggcgaccccg

SEQ ID NO: 3865354 - RNA, 22 nt, Human
ccgagggcugagccugguccca

SEQ ID NO: 3865355 - RNA, 17 nt, Human
ccgaggguccuggcucc

SEQ ID NO: 3865356 - RNA, 21 nt, Human
ccgaggguccuggcuccugag

SEQ ID NO: 3865357 - RNA, 13 nt, Human
ccgaguacagucu

SEQ ID NO: 3865358 - RNA, 18 nt, Human
ccgaguagaaaaugugac

SEQ ID NO: 3865359 - RNA, 20 nt, Human
ccgaguagcugagauuauag

SEQ ID NO: 3865360 - RNA, 14 nt, Human
ccgaguagcuggga

SEQ ID NO: 3865361 - RNA, 17 nt, Human
ccgaguagcugggacua

SEQ ID NO: 3865362 - RNA, 20 nt, Human
ccgaguagcugggacuacag

SEQ ID NO: 3865363 - RNA, 20 nt, Human
ccgaguagcugggauuacag

SEQ ID NO: 3865364 - RNA, 19 nt, Human
ccgagucauucguucugug

SEQ ID NO: 3865365 - RNA, 12 nt, Human
ccgaguccaagc

SEQ ID NO: 3865366 - RNA, 15 nt, Human
ccgaguccaagcugg

SEQ ID NO: 3865367 - RNA, 16 nt, Human
ccgagucucuucucca

SEQ ID NO: 3865368 - RNA, 18 nt, Human
ccgagucucuucuccacu

SEQ ID NO: 3865369 - RNA, 19 nt, Human
ccgagucucuucuccacug

SEQ ID NO: 3865370 - RNA, 22 nt, Human
ccgagucugggacacaaaacuc

SEQ ID NO: 3865371 - RNA, 17 nt, Human
ccgagucugucucuguc

SEQ ID NO: 3865372 - RNA, 16 nt, Human
ccgagugaaccuaccu

SEQ ID NO: 3865373 - RNA, 20 nt, Human
ccgagugaacuggucuuccu

SEQ ID NO: 3865374 - RNA, 22 nt, Human
ccgaguggauagaugcccugcu

SEQ ID NO: 3865375 - RNA, 15 nt, Human
ccgaguuuccccaga

SEQ ID NO: 3865376 - RNA, 18 nt, Human
ccgauagagggacggcca

SEQ ID NO: 3865377 - RNA, 13 nt, Human
ccgauccuuccuc

SEQ ID NO: 3865378 - RNA, 13 nt, Human
ccgaugcccagag

SEQ ID NO: 3865379 - RNA, 14 nt, Human
ccgaugcuccagcc

SEQ ID NO: 3865380 - RNA, 21 nt, Human
ccgaugcugcuuuccccugug

SEQ ID NO: 3865381 - RNA, 22 nt, Human
ccgaugcuuuaccaaacagcaa

SEQ ID NO: 3865382 - RNA, 21 nt, Human
ccgaugguggguggggcugca

SEQ ID NO: 3865383 - RNA, 13 nt, Human
ccgauucacccug

SEQ ID NO: 3865384 - RNA, 21 nt, Human
ccgcaaugugcccccagacgc

SEQ ID NO: 3865385 - RNA, 14 nt, Human
ccgcacacccucac

SEQ ID NO: 3865386 - RNA, 22 nt, Human
ccgcacacccucacucugccag

SEQ ID NO: 3865387 - RNA, 16 nt, Human
ccgcacagcagccugc

SEQ ID NO: 3865388 - RNA, 23 nt, Human
ccgcaccgaccacggggccgaca

SEQ ID NO: 3865389 - RNA, 19 nt, Human
ccgcacugggcuuggggac

SEQ ID NO: 3865390 - RNA, 20 nt, Human
ccgcagaagccuccccagcu

SEQ ID NO: 3865391 - RNA, 22 nt, Human
ccgcagaagccuccccagcuca

SEQ ID NO: 3865392 - RNA, 15 nt, Human
ccgcagaaggaaggc

SEQ ID NO: 3865393 - RNA, 17 nt, Human
ccgcagaccuccccagc

SEQ ID NO: 3865394 - RNA, 23 nt, Human
ccgcagcccugcagagggcacag

SEQ ID NO: 3865395 - RNA, 17 nt, Human
ccgcagcucuugcccuu

SEQ ID NO: 3865396 - RNA, 18 nt, Human
ccgcagcucuugcccuuc

SEQ ID NO: 3865397 - RNA, 22 nt, Human
ccgcagcucuugcccuucccug

SEQ ID NO: 3865398 - RNA, 12 nt, Human
ccgcaggaagcu

SEQ ID NO: 3865399 - RNA, 19 nt, Human
ccgcaggaagcugcuccgu

SEQ ID NO: 3865400 - RNA, 19 nt, Human
ccgcagucgucgcacaguc

SEQ ID NO: 3865401 - RNA, 16 nt, Human
ccgcagugggagcaaa

SEQ ID NO: 3865402 - RNA, 18 nt, Human
ccgcaguguggccaggcu

SEQ ID NO: 3865403 - RNA, 16 nt, Human
ccgcaguguuugugug

SEQ ID NO: 3865404 - RNA, 15 nt, Human
ccgcauccccugccu

SEQ ID NO: 3865405 - RNA, 17 nt, Human
ccgcauccccugccucc

SEQ ID NO: 3865406 - RNA, 21 nt, Human
ccgcauccuagucucuaucau

SEQ ID NO: 3865407 - RNA, 16 nt, Human
ccgcaucuucuccauc

SEQ ID NO: 3865408 - RNA, 23 nt, Human
ccgcaugcccccucgugccaguc

SEQ ID NO: 3865409 - RNA, 15 nt, Human
ccgcauuccaggcuc

SEQ ID NO: 3865410 - RNA, 23 nt, Human
ccucuuccucuugacccugcacc

SEQ ID NO: 3865411 - RNA, 11 nt, Human
ccucuuccuga

SEQ ID NO: 3865412 - RNA, 14 nt, Human
ccucuuccuggccg

SEQ ID NO: 3865413 - RNA, 13 nt, Human
ccucuuccuguga

SEQ ID NO: 3865414 - RNA, 23 nt, Human
ccucuuccuucccugcugugaaa

SEQ ID NO: 3865415 - RNA, 14 nt, Human
ccucuucucaagug

SEQ ID NO: 3865416 - RNA, 17 nt, Human
ccucuucucaagugccu

SEQ ID NO: 3865417 - RNA, 14 nt, Human
ccucuucucucaga

SEQ ID NO: 3865418 - RNA, 17 nt, Human
ccucuucugacgugccu

SEQ ID NO: 3865419 - RNA, 14 nt, Human
ccucuucugcaucu

SEQ ID NO: 3865420 - RNA, 20 nt, Human
ccucuucugcuuaggagaga

SEQ ID NO: 3865421 - RNA, 13 nt, Human
ccucuucugggag

SEQ ID NO: 3865422 - RNA, 17 nt, Human
ccucuucugggagggca

SEQ ID NO: 3865423 - RNA, 21 nt, Human
ccucuucugggagggcagcag

SEQ ID NO: 3865424 - RNA, 17 nt, Human
ccucuucuuacuugaug

SEQ ID NO: 3865425 - RNA, 14 nt, Human
ccucuugaccaggc

SEQ ID NO: 3865426 - RNA, 16 nt, Human
ccucuugacccugcac

SEQ ID NO: 3865427 - RNA, 14 nt, Human
ccucuugagcagug

SEQ ID NO: 3865428 - RNA, 19 nt, Human
ccucuugagcaguggcugg

SEQ ID NO: 3865429 - RNA, 14 nt, Human
ccucuugccacugc

SEQ ID NO: 3865430 - RNA, 21 nt, Human
ccucuugccccaacccccagc

SEQ ID NO: 3865431 - RNA, 22 nt, Human
ccucuugccccaacccccagca

SEQ ID NO: 3865432 - RNA, 16 nt, Human
ccucuugccccccacc

SEQ ID NO: 3865433 - RNA, 14 nt, Human
ccucuugcugucuc

SEQ ID NO: 3865434 - RNA, 18 nt, Human
ccucuuggaccucugcuc

SEQ ID NO: 3865435 - RNA, 14 nt, Human
ccucuuggagaagu

SEQ ID NO: 3865436 - RNA, 21 nt, Human
ccucuuggagaagucucagcu

SEQ ID NO: 3865437 - RNA, 22 nt, Human
ccucuuggagaagucucagcua

SEQ ID NO: 3865438 - RNA, 12 nt, Human
ccucuuggagac

SEQ ID NO: 3865439 - RNA, 15 nt, Human
ccucuuggcagucac

SEQ ID NO: 3865440 - RNA, 13 nt, Human
ccucuuguaaaua

SEQ ID NO: 3865441 - RNA, 20 nt, Human
ccucuuguaaauaaagcccu

SEQ ID NO: 3865442 - RNA, 12 nt, Human
ccucuugucucc

SEQ ID NO: 3865443 - RNA, 14 nt, Human
ccucuugucucccc

SEQ ID NO: 3865444 - RNA, 19 nt, Human
ccucuugucuuccuauuuc

SEQ ID NO: 3865445 - RNA, 13 nt, Human
ccucuuuaaaaca

SEQ ID NO: 3865446 - RNA, 17 nt, Human
ccucuuuaaaacaaaac

SEQ ID NO: 3865447 - RNA, 23 nt, Human
ccucuuuaguuuuugguugggaa

SEQ ID NO: 3865448 - RNA, 23 nt, Human
ccucuuucagaaaacagaaaaaa

SEQ ID NO: 3865449 - RNA, 13 nt, Human
ccucuuucagcuc

SEQ ID NO: 3865450 - RNA, 15 nt, Human
ccucuuucagcuccu

SEQ ID NO: 3865451 - RNA, 15 nt, Human
ccucuuucauccacu

SEQ ID NO: 3865452 - RNA, 11 nt, Human
ccucuuucccu

SEQ ID NO: 3865453 - RNA, 15 nt, Human
ccucuuucccuagga

SEQ ID NO: 3865454 - RNA, 13 nt, Human
ccucuuucccucc

SEQ ID NO: 3865455 - RNA, 19 nt, Human
ccucuuucccucccuuccu

SEQ ID NO: 3865456 - RNA, 16 nt, Human
ccucuuucccuuccag

SEQ ID NO: 3865457 - RNA, 23 nt, Human
ccucuuuccucucuuuguucuca

SEQ ID NO: 3865458 - RNA, 12 nt, Human
ccucuuucucuc

SEQ ID NO: 3865459 - RNA, 13 nt, Human
ccucuuucucuuu

SEQ ID NO: 3865460 - RNA, 18 nt, Human
ccucuuucucuuucuucc

SEQ ID NO: 3865461 - RNA, 15 nt, Human
ccucuuugcauggaa

SEQ ID NO: 3865462 - RNA, 11 nt, Human
ccucuuugcuu

SEQ ID NO: 3865463 - RNA, 17 nt, Human
ccucuuugcuuugcuuu

SEQ ID NO: 3865464 - RNA, 18 nt, Human
ccucuuuggcuccccugu

SEQ ID NO: 3865465 - RNA, 23 nt, Human
ccucuuugucuaaaacaauaaaa

SEQ ID NO: 3865466 - RNA, 17 nt, Human
ccucuuuuaccugcugc

SEQ ID NO: 3865467 - RNA, 15 nt, Human
ccucuuuucuuacuc

SEQ ID NO: 3865468 - RNA, 22 nt, Human
ccucuuuucuuacuccuccucu

SEQ ID NO: 3865469 - RNA, 24 nt, Human
ccucuuuugcuugccaaaguacag

SEQ ID NO: 3865470 - RNA, 21 nt, Human
ccugaaaauguuuuucugcca

SEQ ID NO: 3865471 - RNA, 15 nt, Human
ccugaaacaacuugg

SEQ ID NO: 3865472 - RNA, 19 nt, Human
ccugaaacacgaaacuugu

SEQ ID NO: 3865473 - RNA, 18 nt, Human
ccugaaacuuacacacaa

SEQ ID NO: 3865474 - RNA, 23 nt, Human
ccugaaagaggaaugaaguacuc

SEQ ID NO: 3865475 - RNA, 15 nt, Human
ccugaaagaggcuga

SEQ ID NO: 3865476 - RNA, 15 nt, Human
ccugaaauuccaaag

SEQ ID NO: 3865477 - RNA, 16 nt, Human
ccugaaauuccaaagu

SEQ ID NO: 3865478 - RNA, 15 nt, Human
ccugaaauuucagau

SEQ ID NO: 3865479 - RNA, 14 nt, Human
ccugaacagaagcu

SEQ ID NO: 3865480 - RNA, 15 nt, Human
ccugaaccgcacagc

SEQ ID NO: 3865481 - RNA, 16 nt, Human
ccugaaccgcacagcu

SEQ ID NO: 3865482 - RNA, 18 nt, Human
ccugaaccgcacagcuca

SEQ ID NO: 3865483 - RNA, 20 nt, Human
ccugaaccgcacagcucagg

SEQ ID NO: 3865484 - RNA, 13 nt, Human
ccugaaccuagga

SEQ ID NO: 3865485 - RNA, 17 nt, Human
ccugaagaaccaguccc

SEQ ID NO: 3865486 - RNA, 12 nt, Human
ccugaagacuga

SEQ ID NO: 3865487 - RNA, 21 nt, Human
ccugaagaggcgggccagcca

SEQ ID NO: 3865488 - RNA, 21 nt, Human
ccugaagaguccucugaauga

SEQ ID NO: 3865489 - RNA, 12 nt, Human
ccugaagccagc

SEQ ID NO: 3865490 - RNA, 14 nt, Human
ccugaagccagccu

SEQ ID NO: 3865491 - RNA, 22 nt, Human
ccugaagcuaucguaaaauuaa

SEQ ID NO: 3865492 - RNA, 13 nt, Human
ccugaaggccccg

SEQ ID NO: 3865493 - RNA, 23 nt, Human
ccugaaggccugagguuacugga

SEQ ID NO: 3865494 - RNA, 14 nt, Human
ccugaaggggcguc

SEQ ID NO: 3865495 - RNA, 16 nt, Human
ccugaaggggcgucug

SEQ ID NO: 3865496 - RNA, 15 nt, Human
ccugaagucacacag

SEQ ID NO: 3865497 - RNA, 17 nt, Human
ccugaaucaugagccug

SEQ ID NO: 3865498 - RNA, 19 nt, Human
ccugaaucaugagccugcu

SEQ ID NO: 3865499 - RNA, 21 nt, Human
ccugaaucaugagccugcugg

SEQ ID NO: 3865500 - RNA, 22 nt, Human
ccugaaucaugagccugcugga

SEQ ID NO: 3865501 - RNA, 12 nt, Human
ccugaaucauuc

SEQ ID NO: 3865502 - RNA, 17 nt, Human
ccugaauccaaacuaau

SEQ ID NO: 3865503 - RNA, 16 nt, Human
ccugaaugcucuguag

SEQ ID NO: 3865504 - RNA, 21 nt, Human
ccugaauguuuaaagaucaug

SEQ ID NO: 3865505 - RNA, 14 nt, Human
ccugaauucuauuu

SEQ ID NO: 3865506 - RNA, 18 nt, Human
ccugaauucuauuugcug

SEQ ID NO: 3865507 - RNA, 20 nt, Human
ccugaauuuggccugcacua

SEQ ID NO: 3865508 - RNA, 14 nt, Human
ccugacaacacuca

SEQ ID NO: 3865509 - RNA, 15 nt, Human
ccugacaacacucau

SEQ ID NO: 3865510 - RNA, 14 nt, Human
ccugacacaccagg

SEQ ID NO: 3865511 - RNA, 20 nt, Human
ccugacacacuaaccaagcu

SEQ ID NO: 3865512 - RNA, 23 nt, Human
ccugacacacuaaccaagcugag

SEQ ID NO: 3865513 - RNA, 18 nt, Human
ccugacaccccacuuagc

SEQ ID NO: 3865514 - RNA, 14 nt, Human
ccugacacugcugg

SEQ ID NO: 3865515 - RNA, 15 nt, Human
ccugacacugcugga

SEQ ID NO: 3865516 - RNA, 16 nt, Human
ccugacagaaggugcc

SEQ ID NO: 3865517 - RNA, 17 nt, Human
ccugacagaaggugcca

SEQ ID NO: 3865518 - RNA, 23 nt, Human
ccugacagagggauggaggaaga

SEQ ID NO: 3865519 - RNA, 20 nt, Human
ccugacagccccucccuccu

SEQ ID NO: 3865520 - RNA, 23 nt, Human
ccugacaggugaggucuguuccu

SEQ ID NO: 3865521 - RNA, 13 nt, Human
ccugacauugucu

SEQ ID NO: 3865522 - RNA, 23 nt, Human
ccugaccaaacagccaacuagcc

SEQ ID NO: 3865523 - RNA, 20 nt, Human
ccugaccaacaguuccuuca

SEQ ID NO: 3865524 - RNA, 19 nt, Human
ccugaccaacauggagaaa

SEQ ID NO: 3865525 - RNA, 13 nt, Human
ccugaccacccuc

SEQ ID NO: 3865526 - RNA, 17 nt, Human
ccugaccacccuccccu

SEQ ID NO: 3865527 - RNA, 20 nt, Human
ccugaccacgcuuucuagcu

SEQ ID NO: 3865528 - RNA, 13 nt, Human
ccugaccacucag

SEQ ID NO: 3865529 - RNA, 16 nt, Human
ccugaccacucagaga

SEQ ID NO: 3865530 - RNA, 17 nt, Human
ccugaccacucagagac

SEQ ID NO: 3865531 - RNA, 21 nt, Human
ccugaccagcugcuccgagga

SEQ ID NO: 3865532 - RNA, 13 nt, Human
ccugaccaguugc

SEQ ID NO: 3865533 - RNA, 16 nt, Human
ccugaccgugggcggg

SEQ ID NO: 3865534 - RNA, 14 nt, Human
ccugaccucccagc

SEQ ID NO: 3865535 - RNA, 14 nt, Human
ccugaccucccccu

SEQ ID NO: 3865536 - RNA, 19 nt, Human
ccugaccucccccuccuuc

SEQ ID NO: 3865537 - RNA, 16 nt, Human
ccugaccucccucuaa

SEQ ID NO: 3865538 - RNA, 18 nt, Human
ccugaccucuugcugucu

SEQ ID NO: 3865539 - RNA, 21 nt, Human
ccugaccucuugcugucucug

SEQ ID NO: 3865540 - RNA, 15 nt, Human
ccugaccugaggcuc

SEQ ID NO: 3865541 - RNA, 15 nt, Human
ccugaccuggccccc

SEQ ID NO: 3865542 - RNA, 16 nt, Human
ccugaccugucucacc

SEQ ID NO: 3865543 - RNA, 19 nt, Human
ccugaccugugagcccagc

SEQ ID NO: 3865544 - RNA, 22 nt, Human
ccugaccugugagcccagcugg

SEQ ID NO: 3865545 - RNA, 21 nt, Human
ccugaccuugaggagucuugu

SEQ ID NO: 3865546 - RNA, 13 nt, Human
ccugacgaaacug

SEQ ID NO: 3865547 - RNA, 19 nt, Human
ccugacucccccagucccc

SEQ ID NO: 3865548 - RNA, 20 nt, Human
ccugacuccucuaagccacu

SEQ ID NO: 3865549 - RNA, 18 nt, Human
ccugacucgucugacugu

SEQ ID NO: 3865550 - RNA, 21 nt, Human
ccugacucgucugacugugug

SEQ ID NO: 3865551 - RNA, 13 nt, Human
ccugacucugaaa

SEQ ID NO: 3865552 - RNA, 15 nt, Human
ccugacucugccccc

SEQ ID NO: 3865553 - RNA, 13 nt, Human
ccugacugccaag

SEQ ID NO: 3865554 - RNA, 18 nt, Human
ccugacugccaagccaug

SEQ ID NO: 3865555 - RNA, 14 nt, Human
ccugacugcucaga

SEQ ID NO: 3865556 - RNA, 17 nt, Human
ccugcccaccuggccuc

SEQ ID NO: 3865557 - RNA, 18 nt, Human
ccugcccaccuggccucu

SEQ ID NO: 3865558 - RNA, 17 nt, Human
ccugcccacugcugcag

SEQ ID NO: 3865559 - RNA, 22 nt, Human
ccugcccagaucagccagaagc

SEQ ID NO: 3865560 - RNA, 18 nt, Human
ccugcccagcccccuggu

SEQ ID NO: 3865561 - RNA, 12 nt, Human
ccugcccaggag

SEQ ID NO: 3865562 - RNA, 22 nt, Human
ccugcccaggagagccagcccu

SEQ ID NO: 3865563 - RNA, 23 nt, Human
ccugcccaggagagccagcccuc

SEQ ID NO: 3865564 - RNA, 15 nt, Human
ccugcccaggccccu

SEQ ID NO: 3865565 - RNA, 19 nt, Human
ccugcccaggccccugcca

SEQ ID NO: 3865566 - RNA, 15 nt, Human
ccugcccaggccggc

SEQ ID NO: 3865567 - RNA, 18 nt, Human
ccugcccaggccggccag

SEQ ID NO: 3865568 - RNA, 12 nt, Human
ccugcccagucc

SEQ ID NO: 3865569 - RNA, 15 nt, Human
ccugcccaguccccc

SEQ ID NO: 3865570 - RNA, 18 nt, Human
ccugcccagugcacuugc

SEQ ID NO: 3865571 - RNA, 23 nt, Human
ccugcccaguguuguuuguaaau

SEQ ID NO: 3865572 - RNA, 16 nt, Human
ccugcccaguugcacu

SEQ ID NO: 3865573 - RNA, 16 nt, Human
ccugcccauuggagag

SEQ ID NO: 3865574 - RNA, 14 nt, Human
ccugcccauuucau

SEQ ID NO: 3865575 - RNA, 23 nt, Human
ccugccccaaauaacuucagucc

SEQ ID NO: 3865576 - RNA, 21 nt, Human
ccugccccaacucuccccuga

SEQ ID NO: 3865577 - RNA, 24 nt, Human
ccugccccaacucuccccugaccu

SEQ ID NO: 3865578 - RNA, 19 nt, Human
ccugccccagcccaagucc

SEQ ID NO: 3865579 - RNA, 14 nt, Human
ccugccccagcgcu

SEQ ID NO: 3865580 - RNA, 17 nt, Human
ccugccccagggcuccc

SEQ ID NO: 3865581 - RNA, 13 nt, Human
ccugccccauccc

SEQ ID NO: 3865582 - RNA, 15 nt, Human
ccugcccccaaauaa

SEQ ID NO: 3865583 - RNA, 21 nt, Human
ccugcccccacaccuggcccu

SEQ ID NO: 3865584 - RNA, 22 nt, Human
ccugcccccacaccuggcccug

SEQ ID NO: 3865585 - RNA, 14 nt, Human
ccugcccccacccc

SEQ ID NO: 3865586 - RNA, 18 nt, Human
ccugcccccagccccggg

SEQ ID NO: 3865587 - RNA, 16 nt, Human
ccugcccccaggacug

SEQ ID NO: 3865588 - RNA, 15 nt, Human
ccugccccccagccu

SEQ ID NO: 3865589 - RNA, 15 nt, Human
ccugcccccugaaac

SEQ ID NO: 3865590 - RNA, 18 nt, Human
ccugcccccugaaacuua

SEQ ID NO: 3865591 - RNA, 15 nt, Human
ccugcccccugcagg

SEQ ID NO: 3865592 - RNA, 16 nt, Human
ccugcccccugcagga

SEQ ID NO: 3865593 - RNA, 18 nt, Human
ccugcccccuucucccac

SEQ ID NO: 3865594 - RNA, 22 nt, Human
ccugccccgcccagcugcaccu

SEQ ID NO: 3865595 - RNA, 20 nt, Human
ccugccccgcccccaguccc

SEQ ID NO: 3865596 - RNA, 22 nt, Human
ccugccccgucaccaucucagg

SEQ ID NO: 3865597 - RNA, 23 nt, Human
ccugccccgucaccaucucaggc

SEQ ID NO: 3865598 - RNA, 22 nt, Human
ccugccccucaacucuccucca

SEQ ID NO: 3865599 - RNA, 14 nt, Human
ccugccccucccuu

SEQ ID NO: 3865600 - RNA, 19 nt, Human
ccugccccuccucucugcc

SEQ ID NO: 3865601 - RNA, 15 nt, Human
ccugccccucucccg

SEQ ID NO: 3865602 - RNA, 12 nt, Human
ccugccccucuu

SEQ ID NO: 3865603 - RNA, 17 nt, Human
ccugccccucuuucucu

SEQ ID NO: 3865604 - RNA, 11 nt, Human
ccugccccugc

SEQ ID NO: 3865605 - RNA, 23 nt, Human
ccugccccuucuacacucuccug

SEQ ID NO: 3865606 - RNA, 17 nt, Human
ccugcccgcacagcagc

SEQ ID NO: 3865607 - RNA, 22 nt, Human
ccugcccgcacagcagccugcu

SEQ ID NO: 3865608 - RNA, 19 nt, Human
ccugcccgcagaccucugg

SEQ ID NO: 3865609 - RNA, 14 nt, Human
ccugcccggcugcg

SEQ ID NO: 3865610 - RNA, 16 nt, Human
ccugcccggcugcgga

SEQ ID NO: 3865611 - RNA, 22 nt, Human
ccugcccguaaacacgccugca

SEQ ID NO: 3865612 - RNA, 12 nt, Human
ccugcccgucuc

SEQ ID NO: 3865613 - RNA, 13 nt, Human
ccugcccgucucu

SEQ ID NO: 3865614 - RNA, 22 nt, Human
ccugcccgucucucucccaugg

SEQ ID NO: 3865615 - RNA, 23 nt, Human
ccugcccgucucucucccaugga

SEQ ID NO: 3865616 - RNA, 16 nt, Human
ccugcccguguacaua

SEQ ID NO: 3865617 - RNA, 14 nt, Human
ccugcccucaggga

SEQ ID NO: 3865618 - RNA, 23 nt, Human
ccugcccucauggccccucugac

SEQ ID NO: 3865619 - RNA, 21 nt, Human
ccugcccuccccagagcacug

SEQ ID NO: 3865620 - RNA, 22 nt, Human
ccugcccuccccagagcacugg

SEQ ID NO: 3865621 - RNA, 15 nt, Human
ccugcccucguggcc

SEQ ID NO: 3865622 - RNA, 18 nt, Human
ccugcccucguggccagc

SEQ ID NO: 3865623 - RNA, 13 nt, Human
ccugcccugcacg

SEQ ID NO: 3865624 - RNA, 15 nt, Human
ccugcccugccaccu

SEQ ID NO: 3865625 - RNA, 16 nt, Human
ccugcccugcccugcc

SEQ ID NO: 3865626 - RNA, 17 nt, Human
ccugcccugcccugcca

SEQ ID NO: 3865627 - RNA, 13 nt, Human
ccugcccugccug

SEQ ID NO: 3865628 - RNA, 15 nt, Human
ccugcccugggaggc

SEQ ID NO: 3865629 - RNA, 22 nt, Human
ccugcccugggaggcagugaug

SEQ ID NO: 3865630 - RNA, 21 nt, Human
ccugcccugucaggaggcaga

SEQ ID NO: 3865631 - RNA, 12 nt, Human
ccugcccugugg

SEQ ID NO: 3865632 - RNA, 19 nt, Human
ccugcccugugggccccca

SEQ ID NO: 3865633 - RNA, 19 nt, Human
ccugcccuuaccugccagg

SEQ ID NO: 3865634 - RNA, 22 nt, Human
ccugcccuuaccugccaggaag

SEQ ID NO: 3865635 - RNA, 15 nt, Human
ccugcccuuguccca

SEQ ID NO: 3865636 - RNA, 13 nt, Human
ccugcccuugucu

SEQ ID NO: 3865637 - RNA, 22 nt, Human
ccugcccuuuuuucugccuccu

SEQ ID NO: 3865638 - RNA, 14 nt, Human
ccugccgacuccug

SEQ ID NO: 3865639 - RNA, 22 nt, Human
ccugccgagaguccaucagccu

SEQ ID NO: 3865640 - RNA, 13 nt, Human
ccugccgcagagc

SEQ ID NO: 3865641 - RNA, 14 nt, Human
ccugccgcagagcu

SEQ ID NO: 3865642 - RNA, 18 nt, Human
ccugccggagaggaagag

SEQ ID NO: 3865643 - RNA, 15 nt, Human
ccugccggccggggc

SEQ ID NO: 3865644 - RNA, 19 nt, Human
ccugccgggcugagggccu

SEQ ID NO: 3865645 - RNA, 21 nt, Human
ccugccgggcugagggccugc

SEQ ID NO: 3865646 - RNA, 23 nt, Human
ccugccgggcugagggccugcug

SEQ ID NO: 3865647 - RNA, 15 nt, Human
ccugccgguaaacac

SEQ ID NO: 3865648 - RNA, 23 nt, Human
ccugccgguaaacacgccugcaa

SEQ ID NO: 3865649 - RNA, 17 nt, Human
ccugccgucaccaccac

SEQ ID NO: 3865650 - RNA, 20 nt, Human
ccugccuaagggagaguggu

SEQ ID NO: 3865651 - RNA, 21 nt, Human
ccugccuagcacucacaugcu

SEQ ID NO: 3865652 - RNA, 21 nt, Human
ccugccuaggaauucccagcc

SEQ ID NO: 3865653 - RNA, 21 nt, Human
ccugccucacagcuggccguc

SEQ ID NO: 3865654 - RNA, 11 nt, Human
ccugccucagc

SEQ ID NO: 3865655 - RNA, 13 nt, Human
ccugccucagccu

SEQ ID NO: 3865656 - RNA, 14 nt, Human
ccugccucagccuc

SEQ ID NO: 3865657 - RNA, 19 nt, Human
ccugccucaggccucugug

SEQ ID NO: 3865658 - RNA, 13 nt, Human
ccugccuccaccc

SEQ ID NO: 3865659 - RNA, 12 nt, Human
ccugccuccagg

SEQ ID NO: 3865660 - RNA, 14 nt, Human
ccugccuccaggaa

SEQ ID NO: 3865661 - RNA, 20 nt, Human
ccugccuccagggcuggacu

SEQ ID NO: 3865662 - RNA, 23 nt, Human
ccugccuccagggcuggacugag

SEQ ID NO: 3865663 - RNA, 14 nt, Human
ccugccuccauccu

SEQ ID NO: 3865664 - RNA, 20 nt, Human
ccugccucccacuucacugc

SEQ ID NO: 3865665 - RNA, 13 nt, Human
ccugccuccuuug

SEQ ID NO: 3865666 - RNA, 19 nt, Human
ccugccuccuuugugagga

SEQ ID NO: 3865667 - RNA, 19 nt, Human
ccugccucgaacuggcugc

SEQ ID NO: 3865668 - RNA, 21 nt, Human
ccugccucgaacuggcugcaa

SEQ ID NO: 3865669 - RNA, 14 nt, Human
ccugccucucccag

SEQ ID NO: 3865670 - RNA, 21 nt, Human
ccugccucucccaggcagggg

SEQ ID NO: 3865671 - RNA, 13 nt, Human
ccugccucuccgc

SEQ ID NO: 3865672 - RNA, 13 nt, Human
ccugccucucugc

SEQ ID NO: 3865673 - RNA, 18 nt, Human
ccugccugagggccccuc

SEQ ID NO: 3865674 - RNA, 14 nt, Human
ccugccugccaugu

SEQ ID NO: 3865675 - RNA, 16 nt, Human
ccugccugcccuguca

SEQ ID NO: 3865676 - RNA, 18 nt, Human
ccugccugcccugucagg

SEQ ID NO: 3865677 - RNA, 13 nt, Human
ccugccugcgucu

SEQ ID NO: 3865678 - RNA, 18 nt, Human
ccugccugcucgcucccu

SEQ ID NO: 3865679 - RNA, 12 nt, Human
ccugccuggacc

SEQ ID NO: 3865680 - RNA, 12 nt, Human
ccugccuggagg

SEQ ID NO: 3865681 - RNA, 19 nt, Human
ccugccuggaggaccugag

SEQ ID NO: 3865682 - RNA, 24 nt, Human
ccugccuggaggaccugagccugc

SEQ ID NO: 3865683 - RNA, 13 nt, Human
ccugccuggccag

SEQ ID NO: 3865684 - RNA, 14 nt, Human
ccugccuggccccu

SEQ ID NO: 3865685 - RNA, 15 nt, Human
ccugccuggccggcc

SEQ ID NO: 3865686 - RNA, 17 nt, Human
ccugccuggccggccag

SEQ ID NO: 3865687 - RNA, 19 nt, Human
ccugccuggccggccagcc

SEQ ID NO: 3865688 - RNA, 23 nt, Human
ccugccuggggcgggccccucau

SEQ ID NO: 3865689 - RNA, 18 nt, Human
ccugccugguccucacac

SEQ ID NO: 3865690 - RNA, 12 nt, Human
ccugccugucug

SEQ ID NO: 3865691 - RNA, 16 nt, Human
ccugccugucugcccc

SEQ ID NO: 3865692 - RNA, 22 nt, Human
ccugccugucugucucuccauc

SEQ ID NO: 3865693 - RNA, 12 nt, Human
ccugccugugcu

SEQ ID NO: 3865694 - RNA, 22 nt, Human
ccugccuguucccauucuugca

SEQ ID NO: 3865695 - RNA, 19 nt, Human
ccugccuucuguccuggug

SEQ ID NO: 3865696 - RNA, 23 nt, Human
ccugccuucuucuuuuugcuguu

SEQ ID NO: 3865697 - RNA, 22 nt, Human
ccugccuugaagccacugaagc

SEQ ID NO: 3865698 - RNA, 16 nt, Human
ccugccuuguuuggau

SEQ ID NO: 3865699 - RNA, 13 nt, Human
ccugccuuuccau

SEQ ID NO: 3865700 - RNA, 16 nt, Human
ccuuuuugacacugaa

SEQ ID NO: 3865701 - RNA, 13 nt, Human
ccuuuuugcuuga

SEQ ID NO: 3865702 - RNA, 21 nt, Human
ccuuuuugcuugaagcaaaca

SEQ ID NO: 3865703 - RNA, 19 nt, Human
ccuuuuuguauaaaauaga

SEQ ID NO: 3865704 - RNA, 16 nt, Human
ccuuuuuuaaaaaugc

SEQ ID NO: 3865705 - RNA, 13 nt, Human
ccuuuuuuaaaag

SEQ ID NO: 3865706 - RNA, 20 nt, Human
ccuuuuuuaaaaguaaaugu

SEQ ID NO: 3865707 - RNA, 13 nt, Human
ccuuuuuuaagau

SEQ ID NO: 3865708 - RNA, 14 nt, Human
ccuuuuuuccuuuc

SEQ ID NO: 3865709 - RNA, 15 nt, Human
ccuuuuuucuguaua

SEQ ID NO: 3865710 - RNA, 14 nt, Human
ccuuuuuucuuuuu

SEQ ID NO: 3865711 - RNA, 23 nt, Human
ccuuuuuugauaaaguuucucag

SEQ ID NO: 3865712 - RNA, 12 nt, Human
ccuuuuuugauc

SEQ ID NO: 3865713 - RNA, 15 nt, Human
ccuuuuuuggcugcu

SEQ ID NO: 3865714 - RNA, 18 nt, Human
ccuuuuuuggcugcugaa

SEQ ID NO: 3865715 - RNA, 22 nt, Human
ccuuuuuuggcugcugaaggcu

SEQ ID NO: 3865716 - RNA, 23 nt, Human
ccuuuuuugucccccaacuugag

SEQ ID NO: 3865717 - RNA, 22 nt, Human
ccuuuuuuguuuuuucaaaaua

SEQ ID NO: 3865718 - RNA, 12 nt, Human
cgaaaacauugu

SEQ ID NO: 3865719 - RNA, 15 nt, Human
cgaaaacguggcugc

SEQ ID NO: 3865720 - RNA, 18 nt, Human
cgaaaauucauuucacau

SEQ ID NO: 3865721 - RNA, 13 nt, Human
cgaaacagcgcug

SEQ ID NO: 3865722 - RNA, 21 nt, Human
cgaaaccaauuccucauccuc

SEQ ID NO: 3865723 - RNA, 14 nt, Human
cgaaaccccaucuc

SEQ ID NO: 3865724 - RNA, 17 nt, Human
cgaaacuuguuauugug

SEQ ID NO: 3865725 - RNA, 12 nt, Human
cgaaagaacagu

SEQ ID NO: 3865726 - RNA, 22 nt, Human
cgaaagagagagaaacaaacuu

SEQ ID NO: 3865727 - RNA, 12 nt, Human
cgaaagaggcac

SEQ ID NO: 3865728 - RNA, 19 nt, Human
cgaaagaggcacccuucca

SEQ ID NO: 3865729 - RNA, 20 nt, Human
cgaaagaggcacccuuccau

SEQ ID NO: 3865730 - RNA, 22 nt, Human
cgaaaggauguaaacagugccu

SEQ ID NO: 3865731 - RNA, 16 nt, Human
cgaaaggucaccucac

SEQ ID NO: 3865732 - RNA, 18 nt, Human
cgaaaggucaccucacuc

SEQ ID NO: 3865733 - RNA, 16 nt, Human
cgaaauaacaauguua

SEQ ID NO: 3865734 - RNA, 20 nt, Human
cgaaauaacaauguuaagga

SEQ ID NO: 3865735 - RNA, 19 nt, Human
cgaaauaauuguuguucug

SEQ ID NO: 3865736 - RNA, 20 nt, Human
cgaaauaauuguuguucugu

SEQ ID NO: 3865737 - RNA, 22 nt, Human
cgaaauaauuguuguucuguua

SEQ ID NO: 3865738 - RNA, 20 nt, Human
cgaaauaucuauguuuuacc

SEQ ID NO: 3865739 - RNA, 17 nt, Human
cgaaaucccugcucacu

SEQ ID NO: 3865740 - RNA, 21 nt, Human
cgaacacccucgaagcgcgcc

SEQ ID NO: 3865741 - RNA, 20 nt, Human
cgaacauggaacucauuccu

SEQ ID NO: 3865742 - RNA, 23 nt, Human
cgaacauguuuuucuucucccuc

SEQ ID NO: 3865743 - RNA, 15 nt, Human
cgaaccaggagcugc

SEQ ID NO: 3865744 - RNA, 23 nt, Human
cgaacccaccugcugagagaccc

SEQ ID NO: 3865745 - RNA, 23 nt, Human
cgaaccgugagcaggaaggccug

SEQ ID NO: 3865746 - RNA, 15 nt, Human
cgaaccuccucugug

SEQ ID NO: 3865747 - RNA, 19 nt, Human
cgaacuccuaaccucaagu

SEQ ID NO: 3865748 - RNA, 16 nt, Human
cgaacuguuguauaaa

SEQ ID NO: 3865749 - RNA, 18 nt, Human
cgaagaagagccacagug

SEQ ID NO: 3865750 - RNA, 13 nt, Human
cgaagacacagac

SEQ ID NO: 3865751 - RNA, 20 nt, Human
cgaagccaucuuucuuugga

SEQ ID NO: 3865752 - RNA, 14 nt, Human
cgaagcccaggccc

SEQ ID NO: 3865753 - RNA, 16 nt, Human
cgaagcgcgccacucg

SEQ ID NO: 3865754 - RNA, 16 nt, Human
cgaagcguuguccuca

SEQ ID NO: 3865755 - RNA, 22 nt, Human
cgaagcuaacagggaaggcagg

SEQ ID NO: 3865756 - RNA, 19 nt, Human
cgaagggggcaucuggccu

SEQ ID NO: 3865757 - RNA, 16 nt, Human
cgaaggugcuggaggu

SEQ ID NO: 3865758 - RNA, 17 nt, Human
cgaaguccuauggaaac

SEQ ID NO: 3865759 - RNA, 23 nt, Human
cgaagucucuuuuuuuggcccag

SEQ ID NO: 3865760 - RNA, 16 nt, Human
cgaaguucaagaucaa

SEQ ID NO: 3865761 - RNA, 15 nt, Human
cgaauagacaucaaa

SEQ ID NO: 3865762 - RNA, 16 nt, Human
cgaauagcugggacua

SEQ ID NO: 3865763 - RNA, 11 nt, Human
cgaauauugcu

SEQ ID NO: 3865764 - RNA, 19 nt, Human
cgaauccccucccugucaa

SEQ ID NO: 3865765 - RNA, 17 nt, Human
cgaaucuacuaauucca

SEQ ID NO: 3865766 - RNA, 22 nt, Human
cgaaucucuuuuugcuuucgaa

SEQ ID NO: 3865767 - RNA, 18 nt, Human
cgaaugacaaaaucaucu

SEQ ID NO: 3865768 - RNA, 13 nt, Human
cgaaugacacugu

SEQ ID NO: 3865769 - RNA, 20 nt, Human
cgaauggacuuuggaagcag

SEQ ID NO: 3865770 - RNA, 22 nt, Human
cgaaugguagucuaaccaaaug

SEQ ID NO: 3865771 - RNA, 21 nt, Human
cgaaugugcagguuuguuaca

SEQ ID NO: 3865772 - RNA, 13 nt, Human
cgaaugugucuuu

SEQ ID NO: 3865773 - RNA, 14 nt, Human
cgaaugugucuuua

SEQ ID NO: 3865774 - RNA, 16 nt, Human
cgaaugugucuuuaga

SEQ ID NO: 3865775 - RNA, 14 nt, Human
cgaauuaauagcuu

SEQ ID NO: 3865776 - RNA, 13 nt, Human
cgacaaagcugcu

SEQ ID NO: 3865777 - RNA, 17 nt, Human
cgacaacagauuggauu

SEQ ID NO: 3865778 - RNA, 16 nt, Human
cgacacggucggggca

SEQ ID NO: 3865779 - RNA, 14 nt, Human
cgacacuguucucc

SEQ ID NO: 3865780 - RNA, 18 nt, Human
cgacagccuggcacaggg

SEQ ID NO: 3865781 - RNA, 17 nt, Human
cgacaggcgagagagga

SEQ ID NO: 3865782 - RNA, 21 nt, Human
cgacaggcgagagaggagcca

SEQ ID NO: 3865783 - RNA, 23 nt, Human
cgacaggcgagagaggagccaga

SEQ ID NO: 3865784 - RNA, 17 nt, Human
cgacaucacuguucaug

SEQ ID NO: 3865785 - RNA, 23 nt, Human
cgacauggcuccggccucugccu

SEQ ID NO: 3865786 - RNA, 23 nt, Human
cgaccacagggucugcacucuaa

SEQ ID NO: 3865787 - RNA, 15 nt, Human
cgaccaccccugccu

SEQ ID NO: 3865788 - RNA, 21 nt, Human
cgaccaccccugccuccaccc

SEQ ID NO: 3865789 - RNA, 12 nt, Human
cgaccaccugcc

SEQ ID NO: 3865790 - RNA, 15 nt, Human
cgaccagagccccac

SEQ ID NO: 3865791 - RNA, 16 nt, Human
cgaccagaggagccuu

SEQ ID NO: 3865792 - RNA, 16 nt, Human
cgaccagggccgagga

SEQ ID NO: 3865793 - RNA, 13 nt, Human
cgaccaucugauu

SEQ ID NO: 3865794 - RNA, 18 nt, Human
cgaccccccgugggcucc

SEQ ID NO: 3865795 - RNA, 23 nt, Human
cgacccccucucccugcauggca

SEQ ID NO: 3865796 - RNA, 16 nt, Human
cgacccucugggaacc

SEQ ID NO: 3865797 - RNA, 17 nt, Human
cgacccucugggaaccu

SEQ ID NO: 3865798 - RNA, 21 nt, Human
cgacccucugggaaccuccca

SEQ ID NO: 3865799 - RNA, 12 nt, Human
cgacccuggggg

SEQ ID NO: 3865800 - RNA, 20 nt, Human
cgaccgaggcuggagcuggc

SEQ ID NO: 3865801 - RNA, 13 nt, Human
cgaccgccccagu

SEQ ID NO: 3865802 - RNA, 12 nt, Human
cgaccucagccu

SEQ ID NO: 3865803 - RNA, 19 nt, Human
cgaccucguccucccccug

SEQ ID NO: 3865804 - RNA, 23 nt, Human
cgaccugaggacauggcuucuga

SEQ ID NO: 3865805 - RNA, 18 nt, Human
cgaccugauuuacaguuu

SEQ ID NO: 3865806 - RNA, 15 nt, Human
cgacgccacagccca

SEQ ID NO: 3865807 - RNA, 22 nt, Human
cgacggugggcauuugugaggc

SEQ ID NO: 3865808 - RNA, 15 nt, Human
cgacuaaacuagauu

SEQ ID NO: 3865809 - RNA, 14 nt, Human
cgacuaauuucaaa

SEQ ID NO: 3865810 - RNA, 12 nt, Human
cgacuauagaaa

SEQ ID NO: 3865811 - RNA, 19 nt, Human
cgacucacaccacuagccu

SEQ ID NO: 3865812 - RNA, 11 nt, Human
cgacucaggau

SEQ ID NO: 3865813 - RNA, 13 nt, Human
cgacuccagccag

SEQ ID NO: 3865814 - RNA, 19 nt, Human
cgacuccguuggccacucc

SEQ ID NO: 3865815 - RNA, 20 nt, Human
cgacucuauagacucuagga

SEQ ID NO: 3865816 - RNA, 19 nt, Human
cgacucuuucugagugccu

SEQ ID NO: 3865817 - RNA, 16 nt, Human
cgacugcacagcggcc

SEQ ID NO: 3865818 - RNA, 17 nt, Human
cgacuggccagggccac

SEQ ID NO: 3865819 - RNA, 11 nt, Human
cgacuguuguu

SEQ ID NO: 3865820 - RNA, 18 nt, Human
cgacuugaauuuucccac

SEQ ID NO: 3865821 - RNA, 21 nt, Human
cgacuugaauuuucccacugc

SEQ ID NO: 3865822 - RNA, 19 nt, Human
cgacuuguuuuugcacaug

SEQ ID NO: 3865823 - RNA, 17 nt, Human
cgacuuuguacccccca

SEQ ID NO: 3865824 - RNA, 16 nt, Human
cgagaacuuucauuuu

SEQ ID NO: 3865825 - RNA, 13 nt, Human
cgagaagcaagaa

SEQ ID NO: 3865826 - RNA, 15 nt, Human
cgagaagcaagaaag

SEQ ID NO: 3865827 - RNA, 18 nt, Human
cgagaagcugcucuggaa

SEQ ID NO: 3865828 - RNA, 16 nt, Human
cgagaagggcugcuuc

SEQ ID NO: 3865829 - RNA, 14 nt, Human
cgagaccagccugg

SEQ ID NO: 3865830 - RNA, 15 nt, Human
cgagaccauccuggc

SEQ ID NO: 3865831 - RNA, 17 nt, Human
cgagacccaagggcaga

SEQ ID NO: 3865832 - RNA, 20 nt, Human
cgagaccccggcuuccuuuc

SEQ ID NO: 3865833 - RNA, 15 nt, Human
cgagacucugucuca

SEQ ID NO: 3865834 - RNA, 14 nt, Human
cgagacugcaaugu

SEQ ID NO: 3865835 - RNA, 17 nt, Human
cgagagaucaaagauga

SEQ ID NO: 3865836 - RNA, 14 nt, Human
cgagagaugugugu

SEQ ID NO: 3865837 - RNA, 15 nt, Human
cgagagccugcuccc

SEQ ID NO: 3865838 - RNA, 20 nt, Human
cgagaggugggccagucugu

SEQ ID NO: 3865839 - RNA, 22 nt, Human
cgagaggugggccagucugugg

SEQ ID NO: 3865840 - RNA, 14 nt, Human
cgagagucuggccc

SEQ ID NO: 3865841 - RNA, 20 nt, Human
cgagagucuggcccuagacu

SEQ ID NO: 3865842 - RNA, 13 nt, Human
cgagauaccccac

SEQ ID NO: 3865843 - RNA, 20 nt, Human
cgagauaccccaccucccuc

SEQ ID NO: 3865844 - RNA, 18 nt, Human
cgagauagccaaggccaa

SEQ ID NO: 3865845 - RNA, 19 nt, Human
cgccgcaaaccacacugga

SEQ ID NO: 3865846 - RNA, 22 nt, Human
cgccgcaaaccacacuggacuc

SEQ ID NO: 3865847 - RNA, 13 nt, Human
cgccgccucgccc

SEQ ID NO: 3865848 - RNA, 16 nt, Human
cgccgccucgcccacc

SEQ ID NO: 3865849 - RNA, 18 nt, Human
cgccgccucgcccaccgc

SEQ ID NO: 3865850 - RNA, 15 nt, Human
cgccgccugguacuc

SEQ ID NO: 3865851 - RNA, 21 nt, Human
cgccggcaauaaaagcccagg

SEQ ID NO: 3865852 - RNA, 17 nt, Human
cgccggggacagaggcc

SEQ ID NO: 3865853 - RNA, 19 nt, Human
cgccggggacagaggccug

SEQ ID NO: 3865854 - RNA, 14 nt, Human
cgccgugcugggca

SEQ ID NO: 3865855 - RNA, 15 nt, Human
cgccgugcugggcag

SEQ ID NO: 3865856 - RNA, 17 nt, Human
cgccgugcugggcagcc

SEQ ID NO: 3865857 - RNA, 18 nt, Human
cgccuaaggucacagcua

SEQ ID NO: 3865858 - RNA, 13 nt, Human
cgccuagcugcug

SEQ ID NO: 3865859 - RNA, 20 nt, Human
cgccuaguggggucucccuc

SEQ ID NO: 3865860 - RNA, 16 nt, Human
cgccuaugaucccagc

SEQ ID NO: 3865861 - RNA, 22 nt, Human
cgccucaaugugguugcaaggc

SEQ ID NO: 3865862 - RNA, 15 nt, Human
cgccucaguaagacg

SEQ ID NO: 3865863 - RNA, 19 nt, Human
cgccuccaaccccucgccc

SEQ ID NO: 3865864 - RNA, 21 nt, Human
cgccuccaaccccucgcccag

SEQ ID NO: 3865865 - RNA, 17 nt, Human
cgccuccaacccuagca

SEQ ID NO: 3865866 - RNA, 18 nt, Human
cgccuccauccaaggcca

SEQ ID NO: 3865867 - RNA, 19 nt, Human
cgccucccacuggggucca

SEQ ID NO: 3865868 - RNA, 24 nt, Human
cgccuccccacggccgcuccaggg

SEQ ID NO: 3865869 - RNA, 18 nt, Human
cgccucccuccaccccag

SEQ ID NO: 3865870 - RNA, 20 nt, Human
cgccucccuccccugcccuc

SEQ ID NO: 3865871 - RNA, 20 nt, Human
cgccuccgggacccccagga

SEQ ID NO: 3865872 - RNA, 13 nt, Human
cgccucgcccacc

SEQ ID NO: 3865873 - RNA, 16 nt, Human
cgccucgcccaccgca

SEQ ID NO: 3865874 - RNA, 12 nt, Human
cgccucucccac

SEQ ID NO: 3865875 - RNA, 15 nt, Human
cgccucuccucgguu

SEQ ID NO: 3865876 - RNA, 13 nt, Human
cgccucugcuggc

SEQ ID NO: 3865877 - RNA, 15 nt, Human
cgccucuugaccagg

SEQ ID NO: 3865878 - RNA, 17 nt, Human
cgccucuugaccaggcu

SEQ ID NO: 3865879 - RNA, 20 nt, Human
cgccugacaaccacuggucu

SEQ ID NO: 3865880 - RNA, 23 nt, Human
cgccugacaaccacuggucugua

SEQ ID NO: 3865881 - RNA, 14 nt, Human
cgccugagcccagg

SEQ ID NO: 3865882 - RNA, 21 nt, Human
cgccugcaaacgcugccugcc

SEQ ID NO: 3865883 - RNA, 22 nt, Human
cgccugcauguaaacacgccug

SEQ ID NO: 3865884 - RNA, 12 nt, Human
cgccugcccacc

SEQ ID NO: 3865885 - RNA, 20 nt, Human
cgccugcccaccugccuggc

SEQ ID NO: 3865886 - RNA, 15 nt, Human
cgccugccccuccca

SEQ ID NO: 3865887 - RNA, 17 nt, Human
cgccugcccuccccaga

SEQ ID NO: 3865888 - RNA, 20 nt, Human
cgccugcccuccccagagca

SEQ ID NO: 3865889 - RNA, 19 nt, Human
cgccugccuccccugugca

SEQ ID NO: 3865890 - RNA, 19 nt, Human
cgccugccuuuggcacucu

SEQ ID NO: 3865891 - RNA, 14 nt, Human
cgccuggagcccuc

SEQ ID NO: 3865892 - RNA, 16 nt, Human
cgccuggauuucuggu

SEQ ID NO: 3865893 - RNA, 20 nt, Human
cgccuggcagaacugagcuc

SEQ ID NO: 3865894 - RNA, 18 nt, Human
cgccuggccaggagcagg

SEQ ID NO: 3865895 - RNA, 14 nt, Human
cgccuggccuggcc

SEQ ID NO: 3865896 - RNA, 17 nt, Human
cgccuguaaucccagca

SEQ ID NO: 3865897 - RNA, 18 nt, Human
cgccuguaaucccagcac

SEQ ID NO: 3865898 - RNA, 20 nt, Human
cgccuguagucccagcuacu

SEQ ID NO: 3865899 - RNA, 15 nt, Human
cgccugugcacacac

SEQ ID NO: 3865900 - RNA, 21 nt, Human
cgccuguucccccgccgcuuu

SEQ ID NO: 3865901 - RNA, 16 nt, Human
cgccuuaaggauguuc

SEQ ID NO: 3865902 - RNA, 20 nt, Human
cgccuuccaccucugggagc

SEQ ID NO: 3865903 - RNA, 14 nt, Human
cgccuuccccaccc

SEQ ID NO: 3865904 - RNA, 15 nt, Human
cgccuucccuccugc

SEQ ID NO: 3865905 - RNA, 13 nt, Human
cgccuuccuugac

SEQ ID NO: 3865906 - RNA, 16 nt, Human
cgccuugcccagccug

SEQ ID NO: 3865907 - RNA, 19 nt, Human
cgccuugcccagccuggau

SEQ ID NO: 3865908 - RNA, 19 nt, Human
cgccuugucuccuacuccu

SEQ ID NO: 3865909 - RNA, 18 nt, Human
cgccuuucagcaggcagc

SEQ ID NO: 3865910 - RNA, 14 nt, Human
cgccuuuuguauac

SEQ ID NO: 3865911 - RNA, 16 nt, Human
cgccuuuuguauacau

SEQ ID NO: 3865912 - RNA, 19 nt, Human
cgcgaaaccaauuccucau

SEQ ID NO: 3865913 - RNA, 17 nt, Human
cgcgacaaugcaaacca

SEQ ID NO: 3865914 - RNA, 15 nt, Human
cgcgacuaauuucaa

SEQ ID NO: 3865915 - RNA, 14 nt, Human
cgcgauguggaacu

SEQ ID NO: 3865916 - RNA, 22 nt, Human
cgcgauguggaacugcugccac

SEQ ID NO: 3865917 - RNA, 12 nt, Human
cgcgcacacaca

SEQ ID NO: 3865918 - RNA, 21 nt, Human
cgcgccaaauaaugucucugu

SEQ ID NO: 3865919 - RNA, 23 nt, Human
cgcgccaaauaaugucucuguga

SEQ ID NO: 3865920 - RNA, 17 nt, Human
cgcgccacaggacccuc

SEQ ID NO: 3865921 - RNA, 16 nt, Human
cgcgccaggauggcgc

SEQ ID NO: 3865922 - RNA, 17 nt, Human
cgcgccccccucccaga

SEQ ID NO: 3865923 - RNA, 16 nt, Human
cgcgcccgccccugca

SEQ ID NO: 3865924 - RNA, 13 nt, Human
cgcgcgcacacac

SEQ ID NO: 3865925 - RNA, 13 nt, Human
cgcgcugccugug

SEQ ID NO: 3865926 - RNA, 15 nt, Human
cgcgcugccugugug

SEQ ID NO: 3865927 - RNA, 14 nt, Human
cgcgcuugcuggcc

SEQ ID NO: 3865928 - RNA, 22 nt, Human
cgcggcggagcuggccccgccg

SEQ ID NO: 3865929 - RNA, 15 nt, Human
cgcggcgggcccugc

SEQ ID NO: 3865930 - RNA, 12 nt, Human
cgcggcugggag

SEQ ID NO: 3865931 - RNA, 23 nt, Human
cgcgggagccaugcgcccccucc

SEQ ID NO: 3865932 - RNA, 15 nt, Human
cgcggggacauuggg

SEQ ID NO: 3865933 - RNA, 20 nt, Human
cgcgucgcccucccaggcuc

SEQ ID NO: 3865934 - RNA, 14 nt, Human
cgcgucuacccugg

SEQ ID NO: 3865935 - RNA, 16 nt, Human
cgcgugcacacaccag

SEQ ID NO: 3865936 - RNA, 19 nt, Human
cgcgugcacguggagagcu

SEQ ID NO: 3865937 - RNA, 17 nt, Human
cgcgugccguggcacca

SEQ ID NO: 3865938 - RNA, 23 nt, Human
cgcguguguggguggauauaaau

SEQ ID NO: 3865939 - RNA, 17 nt, Human
cgcguugccugucgcuu

SEQ ID NO: 3865940 - RNA, 15 nt, Human
cgcguuuagaccaag

SEQ ID NO: 3865941 - RNA, 19 nt, Human
cgcuaaagagcccuugccu

SEQ ID NO: 3865942 - RNA, 18 nt, Human
cgcuaacuugcuuaaaug

SEQ ID NO: 3865943 - RNA, 21 nt, Human
cgcuaacuugcuuaaauguga

SEQ ID NO: 3865944 - RNA, 15 nt, Human
cgcuaagagggaggg

SEQ ID NO: 3865945 - RNA, 23 nt, Human
cgcuaauucaaggaauuucuuaa

SEQ ID NO: 3865946 - RNA, 20 nt, Human
cgcuacaaaacgcgcagaug

SEQ ID NO: 3865947 - RNA, 17 nt, Human
cgcuacaccacucuggc

SEQ ID NO: 3865948 - RNA, 20 nt, Human
cgcuacaccacucuggcagc

SEQ ID NO: 3865949 - RNA, 18 nt, Human
cgcuacccgggaaggggg

SEQ ID NO: 3865950 - RNA, 21 nt, Human
cgcuacccgggaagggggcug

SEQ ID NO: 3865951 - RNA, 24 nt, Human
cgcuacccgggaagggggcuggga

SEQ ID NO: 3865952 - RNA, 16 nt, Human
cgcuacuauaaagaga

SEQ ID NO: 3865953 - RNA, 15 nt, Human
cgcuagagcagccca

SEQ ID NO: 3865954 - RNA, 15 nt, Human
cgcuagaggccugag

SEQ ID NO: 3865955 - RNA, 14 nt, Human
cgcuagcaguggca

SEQ ID NO: 3865956 - RNA, 20 nt, Human
cgcuagcaguggcaggcaga

SEQ ID NO: 3865957 - RNA, 21 nt, Human
cgcuaggcucgccuucccucc

SEQ ID NO: 3865958 - RNA, 13 nt, Human
cgcuauuacaaau

SEQ ID NO: 3865959 - RNA, 21 nt, Human
cgcucagcccucccugccccu

SEQ ID NO: 3865960 - RNA, 15 nt, Human
cgcucaguaaacggg

SEQ ID NO: 3865961 - RNA, 16 nt, Human
cgcucauucagcaucu

SEQ ID NO: 3865962 - RNA, 14 nt, Human
cgcuccaacuccaa

SEQ ID NO: 3865963 - RNA, 13 nt, Human
cgcuccagcugcc

SEQ ID NO: 3865964 - RNA, 21 nt, Human
cgcucccagugucuuccugug

SEQ ID NO: 3865965 - RNA, 22 nt, Human
cgcucccagugucuuccugugg

SEQ ID NO: 3865966 - RNA, 15 nt, Human
cgcuccccacucugc

SEQ ID NO: 3865967 - RNA, 16 nt, Human
cgcuccccacucugcu

SEQ ID NO: 3865968 - RNA, 14 nt, Human
cgcuccccgccugu

SEQ ID NO: 3865969 - RNA, 19 nt, Human
cgcuccccgccuguucccc

SEQ ID NO: 3865970 - RNA, 16 nt, Human
cgcucccuugaccugc

SEQ ID NO: 3865971 - RNA, 20 nt, Human
cgcuccgggacguggcaccu

SEQ ID NO: 3865972 - RNA, 20 nt, Human
cgcuccugccgcagagcugg

SEQ ID NO: 3865973 - RNA, 16 nt, Human
cgcuccuggcccagcc

SEQ ID NO: 3865974 - RNA, 18 nt, Human
cgcuccuggcccagccuu

SEQ ID NO: 3865975 - RNA, 17 nt, Human
cgcuccugucugccagc

SEQ ID NO: 3865976 - RNA, 21 nt, Human
cgcucgcuuccgcauccuagu

SEQ ID NO: 3865977 - RNA, 12 nt, Human
cgcucggaggcc

SEQ ID NO: 3865978 - RNA, 15 nt, Human
cgcucggaggcccca

SEQ ID NO: 3865979 - RNA, 14 nt, Human
cgcucuccugccac

SEQ ID NO: 3865980 - RNA, 18 nt, Human
cgcucucuggccuucggc

SEQ ID NO: 3865981 - RNA, 15 nt, Human
cgcucucuuugcaac

SEQ ID NO: 3865982 - RNA, 12 nt, Human
cgcucugcaugc

SEQ ID NO: 3865983 - RNA, 19 nt, Human
cgcucugcaugcggcccag

SEQ ID NO: 3865984 - RNA, 21 nt, Human
cgcucugcaugcggcccagcc

SEQ ID NO: 3865985 - RNA, 21 nt, Human
cgcucugccucaccgcuuccc

SEQ ID NO: 3865986 - RNA, 20 nt, Human
cgcucugcuggccuggccgg

SEQ ID NO: 3865987 - RNA, 16 nt, Human
cgcugagacugugcug

SEQ ID NO: 3865988 - RNA, 17 nt, Human
cgcugaguggacuggag

SEQ ID NO: 3865989 - RNA, 20 nt, Human
cgcugagugggagaaggcag

SEQ ID NO: 3865990 - RNA, 19 nt, Human
cuacuuccaaacuaauuuu

SEQ ID NO: 3865991 - RNA, 15 nt, Human
cuacuuccccuuccu

SEQ ID NO: 3865992 - RNA, 19 nt, Human
cuacuuccuccuccccacu

SEQ ID NO: 3865993 - RNA, 14 nt, Human
cuacuuccugccug

SEQ ID NO: 3865994 - RNA, 17 nt, Human
cuacuucggggcuggga

SEQ ID NO: 3865995 - RNA, 23 nt, Human
cuacuucuuuuuucaaaagaaag

SEQ ID NO: 3865996 - RNA, 14 nt, Human
cuacuugcucugga

SEQ ID NO: 3865997 - RNA, 13 nt, Human
cuacuugggaggc

SEQ ID NO: 3865998 - RNA, 15 nt, Human
cuacuugggaggcug

SEQ ID NO: 3865999 - RNA, 14 nt, Human
cuacuugguuugug

SEQ ID NO: 3866000 - RNA, 15 nt, Human
cuacuuuaagcacua

SEQ ID NO: 3866001 - RNA, 14 nt, Human
cuacuuuauaacua

SEQ ID NO: 3866002 - RNA, 19 nt, Human
cuacuuugacuuuuugcau

SEQ ID NO: 3866003 - RNA, 21 nt, Human
cuacuuugacuuuuugcauuu

SEQ ID NO: 3866004 - RNA, 14 nt, Human
cuacuuuguccuuu

SEQ ID NO: 3866005 - RNA, 18 nt, Human
cuacuuugucuaaaaaua

SEQ ID NO: 3866006 - RNA, 17 nt, Human
cuacuuuguggcaaucu

SEQ ID NO: 3866007 - RNA, 13 nt, Human
cuacuuuuacuca

SEQ ID NO: 3866008 - RNA, 16 nt, Human
cuacuuuuccuucccu

SEQ ID NO: 3866009 - RNA, 17 nt, Human
cuagaaaaacaggcacu

SEQ ID NO: 3866010 - RNA, 17 nt, Human
cuagaaacccaagcucc

SEQ ID NO: 3866011 - RNA, 23 nt, Human
cuagaaacccaagcuccuccucg

SEQ ID NO: 3866012 - RNA, 21 nt, Human
cuagaaacgaguuggugucuu

SEQ ID NO: 3866013 - RNA, 14 nt, Human
cuagaaacuuccaa

SEQ ID NO: 3866014 - RNA, 22 nt, Human
cuagaaagccuguuccccucac

SEQ ID NO: 3866015 - RNA, 20 nt, Human
cuagaaauugacacaagugg

SEQ ID NO: 3866016 - RNA, 19 nt, Human
cuagaacacaggcaaaauc

SEQ ID NO: 3866017 - RNA, 18 nt, Human
cuagaaccuagaagggcu

SEQ ID NO: 3866018 - RNA, 14 nt, Human
cuagaaccuggagg

SEQ ID NO: 3866019 - RNA, 16 nt, Human
cuagaaccuggagggc

SEQ ID NO: 3866020 - RNA, 18 nt, Human
cuagaaccuggagggcug

SEQ ID NO: 3866021 - RNA, 16 nt, Human
cuagaacucccuuuca

SEQ ID NO: 3866022 - RNA, 17 nt, Human
cuagaacuuuuuuaaau

SEQ ID NO: 3866023 - RNA, 19 nt, Human
cuagaacuuuuuuaaauaa

SEQ ID NO: 3866024 - RNA, 22 nt, Human
cuagaacuuuuuuaaauaaacu

SEQ ID NO: 3866025 - RNA, 18 nt, Human
cuagaagaaaugaaauuu

SEQ ID NO: 3866026 - RNA, 20 nt, Human
cuagaagaaaugaaauuuua

SEQ ID NO: 3866027 - RNA, 21 nt, Human
cuagaagaaaugaaauuuuac

SEQ ID NO: 3866028 - RNA, 16 nt, Human
cuagaagagucuauug

SEQ ID NO: 3866029 - RNA, 22 nt, Human
cuagaagauuuugaaauuuuua

SEQ ID NO: 3866030 - RNA, 12 nt, Human
cuagaagccaag

SEQ ID NO: 3866031 - RNA, 13 nt, Human
cuagaagccaagg

SEQ ID NO: 3866032 - RNA, 13 nt, Human
cuagaagggaagg

SEQ ID NO: 3866033 - RNA, 22 nt, Human
cuagaagggcuagaaccuggag

SEQ ID NO: 3866034 - RNA, 21 nt, Human
cuagaagugggccaggacagg

SEQ ID NO: 3866035 - RNA, 19 nt, Human
cuagaaguuacugaaugca

SEQ ID NO: 3866036 - RNA, 16 nt, Human
cuagaauaaucuugcu

SEQ ID NO: 3866037 - RNA, 20 nt, Human
cuagaauauccuacuucucc

SEQ ID NO: 3866038 - RNA, 20 nt, Human
cuagaauuauaagucacaaa

SEQ ID NO: 3866039 - RNA, 22 nt, Human
cuagaauucccucucucugacu

SEQ ID NO: 3866040 - RNA, 12 nt, Human
cuagaauuuauu

SEQ ID NO: 3866041 - RNA, 12 nt, Human
cuagaauuuuaa

SEQ ID NO: 3866042 - RNA, 14 nt, Human
cuagacaagccaga

SEQ ID NO: 3866043 - RNA, 12 nt, Human
cuagacacacaa

SEQ ID NO: 3866044 - RNA, 17 nt, Human
cuagacacacaaagcag

SEQ ID NO: 3866045 - RNA, 17 nt, Human
cuagacaccaaaguucu

SEQ ID NO: 3866046 - RNA, 18 nt, Human
cuagacaccaaaguucua

SEQ ID NO: 3866047 - RNA, 18 nt, Human
cuagacagauccccguuc

SEQ ID NO: 3866048 - RNA, 19 nt, Human
cuagacauggagguucuaa

SEQ ID NO: 3866049 - RNA, 14 nt, Human
cuagacauucuguc

SEQ ID NO: 3866050 - RNA, 18 nt, Human
cuagaccagcagacagag

SEQ ID NO: 3866051 - RNA, 21 nt, Human
cuagacccacuggacucaccu

SEQ ID NO: 3866052 - RNA, 17 nt, Human
cuagaccguuauaaagu

SEQ ID NO: 3866053 - RNA, 21 nt, Human
cuagacgagcaggcuucuucc

SEQ ID NO: 3866054 - RNA, 19 nt, Human
cuagacgcuucaucccaca

SEQ ID NO: 3866055 - RNA, 20 nt, Human
cuagacguucauuugugugc

SEQ ID NO: 3866056 - RNA, 16 nt, Human
cuagacuauaaauguu

SEQ ID NO: 3866057 - RNA, 13 nt, Human
cuagacucggggu

SEQ ID NO: 3866058 - RNA, 16 nt, Human
cuagacucggggugcu

SEQ ID NO: 3866059 - RNA, 18 nt, Human
cuagacugccacaaggaa

SEQ ID NO: 3866060 - RNA, 15 nt, Human
cuagacuggugacug

SEQ ID NO: 3866061 - RNA, 22 nt, Human
cuagacuuuaggcuuucagcuu

SEQ ID NO: 3866062 - RNA, 13 nt, Human
cuagacuuucugu

SEQ ID NO: 3866063 - RNA, 19 nt, Human
cuagagaaauaagaucuuu

SEQ ID NO: 3866064 - RNA, 16 nt, Human
cuagagaaauucuugu

SEQ ID NO: 3866065 - RNA, 15 nt, Human
cuagagaacgcagcc

SEQ ID NO: 3866066 - RNA, 15 nt, Human
cuagagaagacaggc

SEQ ID NO: 3866067 - RNA, 17 nt, Human
cuagagaagaggcuggu

SEQ ID NO: 3866068 - RNA, 19 nt, Human
cuagagaauguuagaggau

SEQ ID NO: 3866069 - RNA, 13 nt, Human
cuagagagggagg

SEQ ID NO: 3866070 - RNA, 15 nt, Human
cuagagauauuuugu

SEQ ID NO: 3866071 - RNA, 18 nt, Human
cuagagauauuuuguaaa

SEQ ID NO: 3866072 - RNA, 19 nt, Human
cuagagauauuuuguaaaa

SEQ ID NO: 3866073 - RNA, 21 nt, Human
cuagagaugugcaauugauuu

SEQ ID NO: 3866074 - RNA, 14 nt, Human
cuagagcacugcca

SEQ ID NO: 3866075 - RNA, 15 nt, Human
cuagagcacugccac

SEQ ID NO: 3866076 - RNA, 21 nt, Human
cuagagcagcccaaauuuuuc

SEQ ID NO: 3866077 - RNA, 15 nt, Human
cuagagcagggauua

SEQ ID NO: 3866078 - RNA, 15 nt, Human
cuagagccagaccaa

SEQ ID NO: 3866079 - RNA, 15 nt, Human
cuagagccugccugg

SEQ ID NO: 3866080 - RNA, 16 nt, Human
cuagagccugccugga

SEQ ID NO: 3866081 - RNA, 17 nt, Human
cuagagccuucagccuu

SEQ ID NO: 3866082 - RNA, 13 nt, Human
cuagagcuccucc

SEQ ID NO: 3866083 - RNA, 17 nt, Human
cuagagcuccucccucu

SEQ ID NO: 3866084 - RNA, 20 nt, Human
cuagagcuccucccucucaa

SEQ ID NO: 3866085 - RNA, 14 nt, Human
cuagagcuuucuuu

SEQ ID NO: 3866086 - RNA, 22 nt, Human
cuagagcuuucuuucacaaaaa

SEQ ID NO: 3866087 - RNA, 15 nt, Human
cuagaggaaaagaaa

SEQ ID NO: 3866088 - RNA, 19 nt, Human
cuagaggaaccaaccccca

SEQ ID NO: 3866089 - RNA, 18 nt, Human
cuagaggcagggagggga

SEQ ID NO: 3866090 - RNA, 20 nt, Human
cuagaggccagccccaccca

SEQ ID NO: 3866091 - RNA, 21 nt, Human
cuagaggccagccccacccag

SEQ ID NO: 3866092 - RNA, 20 nt, Human
cuagaggcccuuugcugucc

SEQ ID NO: 3866093 - RNA, 22 nt, Human
cuagaggccugaaauccugguu

SEQ ID NO: 3866094 - RNA, 23 nt, Human
cuagaggccuuuaguuauaaagg

SEQ ID NO: 3866095 - RNA, 16 nt, Human
cuagagggaccucucc

SEQ ID NO: 3866096 - RNA, 17 nt, Human
cuagagggaccucuccc

SEQ ID NO: 3866097 - RNA, 20 nt, Human
cuagagggaccucucccagg

SEQ ID NO: 3866098 - RNA, 21 nt, Human
cuagagggaggggccuaggcc

SEQ ID NO: 3866099 - RNA, 22 nt, Human
cuagagggaggggccuaggccu

SEQ ID NO: 3866100 - RNA, 19 nt, Human
cuagaggugagaaauuuaa

SEQ ID NO: 3866101 - RNA, 18 nt, Human
cuagagguucaaagauau

SEQ ID NO: 3866102 - RNA, 21 nt, Human
cuagagguucaaagauauuuu

SEQ ID NO: 3866103 - RNA, 15 nt, Human
cuagaguccaagguu

SEQ ID NO: 3866104 - RNA, 15 nt, Human
cuagaguccucacuc

SEQ ID NO: 3866105 - RNA, 19 nt, Human
cuagaguccucacucccag

SEQ ID NO: 3866106 - RNA, 17 nt, Human
cuagagugagggccuga

SEQ ID NO: 3866107 - RNA, 18 nt, Human
cuagagugagggccugag

SEQ ID NO: 3866108 - RNA, 18 nt, Human
cuagaguuuuauagccug

SEQ ID NO: 3866109 - RNA, 15 nt, Human
cuagauaaaaagaug

SEQ ID NO: 3866110 - RNA, 16 nt, Human
cuagauaaaaagaugg

SEQ ID NO: 3866111 - RNA, 16 nt, Human
cuagauacaauaaauu

SEQ ID NO: 3866112 - RNA, 24 nt, Human
cuagauaccuaaaacauaagauca

SEQ ID NO: 3866113 - RNA, 24 nt, Human
cuagauacuguaucaugacaaaga

SEQ ID NO: 3866114 - RNA, 16 nt, Human
cuagauaggaggaugg

SEQ ID NO: 3866115 - RNA, 24 nt, Human
cuagauaugaauauauggcauuug

SEQ ID NO: 3866116 - RNA, 15 nt, Human
cuagaucagaugcuc

SEQ ID NO: 3866117 - RNA, 18 nt, Human
cuagaucaugaagaaccu

SEQ ID NO: 3866118 - RNA, 14 nt, Human
cuagaucauuuguu

SEQ ID NO: 3866119 - RNA, 23 nt, Human
cuagaucauuuguucugggagua

SEQ ID NO: 3866120 - RNA, 17 nt, Human
cuagauccuaagggucg

SEQ ID NO: 3866121 - RNA, 17 nt, Human
cuagaucuuugugccaa

SEQ ID NO: 3866122 - RNA, 16 nt, Human
cuagaugaccucauua

SEQ ID NO: 3866123 - RNA, 23 nt, Human
cuagaugagcccagcccuguucu

SEQ ID NO: 3866124 - RNA, 20 nt, Human
cuagaugauuaaauaagauu

SEQ ID NO: 3866125 - RNA, 23 nt, Human
cuagaugauuaaauaagauucua

SEQ ID NO: 3866126 - RNA, 14 nt, Human
cuagaugauuuuuu

SEQ ID NO: 3866127 - RNA, 17 nt, Human
cuagaugauuuuuugaa

SEQ ID NO: 3866128 - RNA, 21 nt, Human
cuagaugcuuuccuaaaucag

SEQ ID NO: 3866129 - RNA, 13 nt, Human
cuagauggaccug

SEQ ID NO: 3866130 - RNA, 16 nt, Human
cuagauggaccugccu

SEQ ID NO: 3866131 - RNA, 18 nt, Human
cuagauggaccugccugc

SEQ ID NO: 3866132 - RNA, 16 nt, Human
cuagauggcagucacu

SEQ ID NO: 3866133 - RNA, 16 nt, Human
cuagauggcuccucuc

SEQ ID NO: 3866134 - RNA, 15 nt, Human
cuauaaaagcuuucu

SEQ ID NO: 3866135 - RNA, 13 nt, Human
cuauaaaauagau

SEQ ID NO: 3866136 - RNA, 16 nt, Human
cuauaaacaauuacau

SEQ ID NO: 3866137 - RNA, 12 nt, Human
cuauaaacacug

SEQ ID NO: 3866138 - RNA, 14 nt, Human
cuauaaacacuguu

SEQ ID NO: 3866139 - RNA, 21 nt, Human
cuauaaacacuguuuguucca

SEQ ID NO: 3866140 - RNA, 18 nt, Human
cuauaaagcaguauuuuu

SEQ ID NO: 3866141 - RNA, 19 nt, Human
cuauaaagcaguauuuuuc

SEQ ID NO: 3866142 - RNA, 17 nt, Human
cuauaaaguaaagcuaa

SEQ ID NO: 3866143 - RNA, 22 nt, Human
cuauaaaucaacaccuuaauau

SEQ ID NO: 3866144 - RNA, 16 nt, Human
cuauaaaugguguuuu

SEQ ID NO: 3866145 - RNA, 18 nt, Human
cuauaaaugguguuuuuu

SEQ ID NO: 3866146 - RNA, 13 nt, Human
cuauaaauuauau

SEQ ID NO: 3866147 - RNA, 15 nt, Human
cuauaaauuccucuu

SEQ ID NO: 3866148 - RNA, 23 nt, Human
cuauaaauuccucuuugcuuugc

SEQ ID NO: 3866149 - RNA, 22 nt, Human
cuauaacaaaggauacuuauuu

SEQ ID NO: 3866150 - RNA, 12 nt, Human
cuauaacagaua

SEQ ID NO: 3866151 - RNA, 12 nt, Human
cuauaacuugau

SEQ ID NO: 3866152 - RNA, 17 nt, Human
cuauaacuugaugcaug

SEQ ID NO: 3866153 - RNA, 22 nt, Human
cuauaagcaagaaggcaaaaau

SEQ ID NO: 3866154 - RNA, 16 nt, Human
cuauaaggcagccuug

SEQ ID NO: 3866155 - RNA, 21 nt, Human
cuauaaggugcucucuuucug

SEQ ID NO: 3866156 - RNA, 22 nt, Human
cuauaaggugcucucuuucugu

SEQ ID NO: 3866157 - RNA, 15 nt, Human
cuauaauaaagaagu

SEQ ID NO: 3866158 - RNA, 14 nt, Human
cuauaaucugucaa

SEQ ID NO: 3866159 - RNA, 15 nt, Human
cuauaaucugucaaa

SEQ ID NO: 3866160 - RNA, 21 nt, Human
cuauaaucugucaaaacacug

SEQ ID NO: 3866161 - RNA, 14 nt, Human
cuauaaucuguuuu

SEQ ID NO: 3866162 - RNA, 16 nt, Human
cuauaauguaagcucu

SEQ ID NO: 3866163 - RNA, 22 nt, Human
cuauaaugugaaauguaacugu

SEQ ID NO: 3866164 - RNA, 16 nt, Human
cuauaauguguguaug

SEQ ID NO: 3866165 - RNA, 12 nt, Human
cuauaauuuaaa

SEQ ID NO: 3866166 - RNA, 22 nt, Human
cuauaauuuaccuaagauuaca

SEQ ID NO: 3866167 - RNA, 14 nt, Human
cuauacaaauauaa

SEQ ID NO: 3866168 - RNA, 14 nt, Human
cuauacauaucuuu

SEQ ID NO: 3866169 - RNA, 13 nt, Human
cuauaccaauaaa

SEQ ID NO: 3866170 - RNA, 14 nt, Human
cuauaccaauaaag

SEQ ID NO: 3866171 - RNA, 15 nt, Human
cuauaccaauaaagu

SEQ ID NO: 3866172 - RNA, 20 nt, Human
cuauaccugggcauacuaau

SEQ ID NO: 3866173 - RNA, 14 nt, Human
cuauaccugugccu

SEQ ID NO: 3866174 - RNA, 11 nt, Human
cuauacuugaa

SEQ ID NO: 3866175 - RNA, 17 nt, Human
cuauacuugaacaaaag

SEQ ID NO: 3866176 - RNA, 21 nt, Human
cuauacuugaacaaaaggguc

SEQ ID NO: 3866177 - RNA, 15 nt, Human
cuauagaaaguguuc

SEQ ID NO: 3866178 - RNA, 20 nt, Human
cuauagaaaguguucuguua

SEQ ID NO: 3866179 - RNA, 22 nt, Human
cuauagaaaguguucuguuaca

SEQ ID NO: 3866180 - RNA, 15 nt, Human
cuauagaugucuuuu

SEQ ID NO: 3866181 - RNA, 22 nt, Human
cuauagaugucuuuucccauuu

SEQ ID NO: 3866182 - RNA, 10 nt, Human
cuauagcacc

SEQ ID NO: 3866183 - RNA, 20 nt, Human
cuauagcaucacuuaaaaca

SEQ ID NO: 3866184 - RNA, 12 nt, Human
cuauagccuggg

SEQ ID NO: 3866185 - RNA, 13 nt, Human
cuauagccugggg

SEQ ID NO: 3866186 - RNA, 17 nt, Human
cuauagcuaaguacaca

SEQ ID NO: 3866187 - RNA, 14 nt, Human
cuauagcucaggac

SEQ ID NO: 3866188 - RNA, 22 nt, Human
cuauagcuguucuaauggauua

SEQ ID NO: 3866189 - RNA, 21 nt, Human
cuauagcuugcagaacuguag

SEQ ID NO: 3866190 - RNA, 22 nt, Human
cuauaggcuggagaagcucacc

SEQ ID NO: 3866191 - RNA, 15 nt, Human
cuauagguccagaag

SEQ ID NO: 3866192 - RNA, 21 nt, Human
cuauaggugcuacaaaaacac

SEQ ID NO: 3866193 - RNA, 15 nt, Human
cuauaguauuugauu

SEQ ID NO: 3866194 - RNA, 14 nt, Human
cuauagucccagcu

SEQ ID NO: 3866195 - RNA, 18 nt, Human
cuauaguuacuguccugu

SEQ ID NO: 3866196 - RNA, 20 nt, Human
cuauaguuauuaaguucuuu

SEQ ID NO: 3866197 - RNA, 13 nt, Human
cuauaguucuaga

SEQ ID NO: 3866198 - RNA, 14 nt, Human
cuauaguucuagac

SEQ ID NO: 3866199 - RNA, 12 nt, Human
cuauauaaaaua

SEQ ID NO: 3866200 - RNA, 20 nt, Human
cuauauaauuccuguuuuua

SEQ ID NO: 3866201 - RNA, 17 nt, Human
cuauauacaugugugua

SEQ ID NO: 3866202 - RNA, 19 nt, Human
cuauauaccaaagcacauu

SEQ ID NO: 3866203 - RNA, 21 nt, Human
cuauauacucacuuucuagau

SEQ ID NO: 3866204 - RNA, 14 nt, Human
cuauauagagaugu

SEQ ID NO: 3866205 - RNA, 16 nt, Human
cuauauaguuuauuga

SEQ ID NO: 3866206 - RNA, 22 nt, Human
cuauauaguuuauugacaauaa

SEQ ID NO: 3866207 - RNA, 15 nt, Human
cuauauauaaaacgg

SEQ ID NO: 3866208 - RNA, 13 nt, Human
cuauauauaauuc

SEQ ID NO: 3866209 - RNA, 19 nt, Human
cuauauauaauucuguaca

SEQ ID NO: 3866210 - RNA, 15 nt, Human
cuauauauauaaaua

SEQ ID NO: 3866211 - RNA, 16 nt, Human
cuauauauauaaauau

SEQ ID NO: 3866212 - RNA, 16 nt, Human
cuauauauauaaaugu

SEQ ID NO: 3866213 - RNA, 15 nt, Human
cuauauauguguaug

SEQ ID NO: 3866214 - RNA, 18 nt, Human
cuauauccauguacugua

SEQ ID NO: 3866215 - RNA, 19 nt, Human
cuauauccauguacuguag

SEQ ID NO: 3866216 - RNA, 18 nt, Human
cuauaucuauaaacacug

SEQ ID NO: 3866217 - RNA, 20 nt, Human
cuauaugaauuuaaauauaa

SEQ ID NO: 3866218 - RNA, 19 nt, Human
cuauauggcaagaaagcug

SEQ ID NO: 3866219 - RNA, 21 nt, Human
cuauauguacuugucaaagaa

SEQ ID NO: 3866220 - RNA, 21 nt, Human
cuauauguaguauaaagaaaa

SEQ ID NO: 3866221 - RNA, 12 nt, Human
cuauaugugaau

SEQ ID NO: 3866222 - RNA, 20 nt, Human
cuauauugcugaaugcaaga

SEQ ID NO: 3866223 - RNA, 13 nt, Human
cuauauuguacac

SEQ ID NO: 3866224 - RNA, 15 nt, Human
cuauauuguacacac

SEQ ID NO: 3866225 - RNA, 23 nt, Human
cuauauuguuuucaguguacaug

SEQ ID NO: 3866226 - RNA, 13 nt, Human
cuauauuuaagua

SEQ ID NO: 3866227 - RNA, 16 nt, Human
cuauauuuaaguauuc

SEQ ID NO: 3866228 - RNA, 22 nt, Human
cuauauuuaaguauucaagaaa

SEQ ID NO: 3866229 - RNA, 16 nt, Human
cuauauuuacagugaa

SEQ ID NO: 3866230 - RNA, 13 nt, Human
cuauauuuagauu

SEQ ID NO: 3866231 - RNA, 22 nt, Human
cuauauuugcuagacucuagac

SEQ ID NO: 3866232 - RNA, 12 nt, Human
cuauauuugggc

SEQ ID NO: 3866233 - RNA, 15 nt, Human
cuauauuuucauucu

SEQ ID NO: 3866234 - RNA, 15 nt, Human
cuaucaaaauaaauu

SEQ ID NO: 3866235 - RNA, 21 nt, Human
cuaucaaagaccuugugugua

SEQ ID NO: 3866236 - RNA, 20 nt, Human
cuaucaaccccagacacugg

SEQ ID NO: 3866237 - RNA, 15 nt, Human
cuaucaagcccaggu

SEQ ID NO: 3866238 - RNA, 17 nt, Human
cuaucaagucaaucauu

SEQ ID NO: 3866239 - RNA, 19 nt, Human
cuaucaagucaaucauuuc

SEQ ID NO: 3866240 - RNA, 14 nt, Human
cuaucacacagugg

SEQ ID NO: 3866241 - RNA, 19 nt, Human
cuaucacccaacgcuccaa

SEQ ID NO: 3866242 - RNA, 16 nt, Human
cuaucaccuauuucca

SEQ ID NO: 3866243 - RNA, 15 nt, Human
cuaucaccuccccuc

SEQ ID NO: 3866244 - RNA, 16 nt, Human
cuaucaccuccccucc

SEQ ID NO: 3866245 - RNA, 18 nt, Human
cuaucagacuaagccagc

SEQ ID NO: 3866246 - RNA, 21 nt, Human
cuaucagaggugaaagcuaua

SEQ ID NO: 3866247 - RNA, 19 nt, Human
cuaucagcagcuagaaaac

SEQ ID NO: 3866248 - RNA, 20 nt, Human
cuaucagccugucucuucca

SEQ ID NO: 3866249 - RNA, 21 nt, Human
cuaucagugugccccccaucc

SEQ ID NO: 3866250 - RNA, 23 nt, Human
cuaucagugugccccccauccug

SEQ ID NO: 3866251 - RNA, 18 nt, Human
cuaucaugucaaacguga

SEQ ID NO: 3866252 - RNA, 13 nt, Human
cuaucauuaaagu

SEQ ID NO: 3866253 - RNA, 17 nt, Human
cuaucauuaaaguucua

SEQ ID NO: 3866254 - RNA, 19 nt, Human
cuaucauugcuuccuccuc

SEQ ID NO: 3866255 - RNA, 20 nt, Human
cuaucauugcuuccuccucc

SEQ ID NO: 3866256 - RNA, 13 nt, Human
cuaucauuuaaua

SEQ ID NO: 3866257 - RNA, 15 nt, Human
cuaucauuuuuguac

SEQ ID NO: 3866258 - RNA, 16 nt, Human
cuaucauuuuuguaca

SEQ ID NO: 3866259 - RNA, 13 nt, Human
cuauccacagaga

SEQ ID NO: 3866260 - RNA, 19 nt, Human
cuauccacagagaguccca

SEQ ID NO: 3866261 - RNA, 12 nt, Human
cuauccacccag

SEQ ID NO: 3866262 - RNA, 13 nt, Human
cuauccacccagc

SEQ ID NO: 3866263 - RNA, 14 nt, Human
cuauccacccagcc

SEQ ID NO: 3866264 - RNA, 15 nt, Human
cuauccaugcaccaa

SEQ ID NO: 3866265 - RNA, 21 nt, Human
cuaucccaauaggcagacugg

SEQ ID NO: 3866266 - RNA, 16 nt, Human
cuaucccaucccaucc

SEQ ID NO: 3866267 - RNA, 19 nt, Human
cuauccccaucucccugcc

SEQ ID NO: 3866268 - RNA, 22 nt, Human
cuauccccaucucccugccugg

SEQ ID NO: 3866269 - RNA, 23 nt, Human
cuauccccaucucccugccuggc

SEQ ID NO: 3866270 - RNA, 15 nt, Human
cuaucccggcugccc

SEQ ID NO: 3866271 - RNA, 17 nt, Human
cuaucccggcugcccuu

SEQ ID NO: 3866272 - RNA, 15 nt, Human
cuauccgcugccagc

SEQ ID NO: 3866273 - RNA, 22 nt, Human
cuauccgcugccagccuugagc

SEQ ID NO: 3866274 - RNA, 20 nt, Human
cuauccggacagagcacguu

SEQ ID NO: 3866275 - RNA, 17 nt, Human
cuauccguguugcaggu

SEQ ID NO: 3866276 - RNA, 17 nt, Human
cuauccuacuuccccuu

SEQ ID NO: 3866277 - RNA, 20 nt, Human
cuauccucucuuccucuucc

SEQ ID NO: 3866278 - RNA, 23 nt, Human
cuauccugacuucuaauaucauu

SEQ ID NO: 3866279 - RNA, 13 nt, Human
cucaaauccagga

SEQ ID NO: 3866280 - RNA, 15 nt, Human
cucaaauccaggacc

SEQ ID NO: 3866281 - RNA, 15 nt, Human
cucaaaucuauucag

SEQ ID NO: 3866282 - RNA, 22 nt, Human
cucaaaucuauucagacaagca

SEQ ID NO: 3866283 - RNA, 15 nt, Human
cucaaaucuuaagaa

SEQ ID NO: 3866284 - RNA, 16 nt, Human
cucaaaucuuaagaaa

SEQ ID NO: 3866285 - RNA, 21 nt, Human
cucaaaucuuuuagucauuau

SEQ ID NO: 3866286 - RNA, 17 nt, Human
cucaaaugacccaaaga

SEQ ID NO: 3866287 - RNA, 22 nt, Human
cucaaaugaguaacauuugcug

SEQ ID NO: 3866288 - RNA, 22 nt, Human
cucaaaugcaguauuuuuguug

SEQ ID NO: 3866289 - RNA, 19 nt, Human
cucaaaugcucagaccagc

SEQ ID NO: 3866290 - RNA, 20 nt, Human
cucaaauggggccagaucca

SEQ ID NO: 3866291 - RNA, 23 nt, Human
cucaaauguucuaaguuucuaag

SEQ ID NO: 3866292 - RNA, 18 nt, Human
cucaaauuguaauuaaua

SEQ ID NO: 3866293 - RNA, 14 nt, Human
cucaaauuucuaaa

SEQ ID NO: 3866294 - RNA, 14 nt, Human
cucaaauuuugagu

SEQ ID NO: 3866295 - RNA, 15 nt, Human
cucaacaagggagag

SEQ ID NO: 3866296 - RNA, 12 nt, Human
cucaacaauaaa

SEQ ID NO: 3866297 - RNA, 21 nt, Human
cucaacaccaugauuccuuua

SEQ ID NO: 3866298 - RNA, 21 nt, Human
cucaacaccucugcacaagcu

SEQ ID NO: 3866299 - RNA, 14 nt, Human
cucaacaggccuca

SEQ ID NO: 3866300 - RNA, 21 nt, Human
cucaacaggccucagggcucc

SEQ ID NO: 3866301 - RNA, 15 nt, Human
cucaacaugagucaa

SEQ ID NO: 3866302 - RNA, 14 nt, Human
cucaaccaaauggu

SEQ ID NO: 3866303 - RNA, 20 nt, Human
cucaaccaaaugguacaaaa

SEQ ID NO: 3866304 - RNA, 20 nt, Human
cucaaccauccccuccgugg

SEQ ID NO: 3866305 - RNA, 21 nt, Human
cucaacccucccucagccccu

SEQ ID NO: 3866306 - RNA, 23 nt, Human
cucaacccucccucagccccucu

SEQ ID NO: 3866307 - RNA, 14 nt, Human
cucaaccucuucug

SEQ ID NO: 3866308 - RNA, 21 nt, Human
cucaaccucuucuggcucaaa

SEQ ID NO: 3866309 - RNA, 15 nt, Human
cucaaccuguaaauu

SEQ ID NO: 3866310 - RNA, 17 nt, Human
cucaaccuguaaauuau

SEQ ID NO: 3866311 - RNA, 20 nt, Human
cucaaccuguaaauuauuuu

SEQ ID NO: 3866312 - RNA, 21 nt, Human
cucaaccugugaugaggggag

SEQ ID NO: 3866313 - RNA, 16 nt, Human
cucaacuaaauccaaa

SEQ ID NO: 3866314 - RNA, 23 nt, Human
cucaacuccgugcuuaaccaaag

SEQ ID NO: 3866315 - RNA, 16 nt, Human
cucaacucuccuccag

SEQ ID NO: 3866316 - RNA, 19 nt, Human
cucaacucuccuccagagu

SEQ ID NO: 3866317 - RNA, 21 nt, Human
cucaacugcucuuuuauacug

SEQ ID NO: 3866318 - RNA, 21 nt, Human
cucaagaaauaaaaggaagcc

SEQ ID NO: 3866319 - RNA, 22 nt, Human
cucaagaaauaaaaggaagcca

SEQ ID NO: 3866320 - RNA, 23 nt, Human
cucaagaaauaaaaggaagccaa

SEQ ID NO: 3866321 - RNA, 11 nt, Human
cucaagacaau

SEQ ID NO: 3866322 - RNA, 15 nt, Human
cucaagagcaaagua

SEQ ID NO: 3866323 - RNA, 18 nt, Human
cucaagaggaaugaaaaa

SEQ ID NO: 3866324 - RNA, 14 nt, Human
cucaagaggcugag

SEQ ID NO: 3866325 - RNA, 17 nt, Human
cucaagauacugcuacu

SEQ ID NO: 3866326 - RNA, 21 nt, Human
cucaagaugggggcagggcug

SEQ ID NO: 3866327 - RNA, 15 nt, Human
cucaagauucccagg

SEQ ID NO: 3866328 - RNA, 16 nt, Human
cucaagauucccagga

SEQ ID NO: 3866329 - RNA, 22 nt, Human
cucaagcagcgaccgcccccuc

SEQ ID NO: 3866330 - RNA, 18 nt, Human
cucaagccaagcagccaa

SEQ ID NO: 3866331 - RNA, 22 nt, Human
cucaagccaagcagccaagcuc

SEQ ID NO: 3866332 - RNA, 18 nt, Human
cucaagccaauccccucc

SEQ ID NO: 3866333 - RNA, 13 nt, Human
cucaagccaccag

SEQ ID NO: 3866334 - RNA, 21 nt, Human
cucaagccaccagaugugaca

SEQ ID NO: 3866335 - RNA, 16 nt, Human
cucaagcccaggaggg

SEQ ID NO: 3866336 - RNA, 20 nt, Human
cucaagcggguggcucuggg

SEQ ID NO: 3866337 - RNA, 20 nt, Human
cucaagcucuuccuuacucc

SEQ ID NO: 3866338 - RNA, 23 nt, Human
cucaaggaauaaugggcuuagag

SEQ ID NO: 3866339 - RNA, 21 nt, Human
cucaaggacaaagucuccagc

SEQ ID NO: 3866340 - RNA, 23 nt, Human
cucaaggacaaagucuccagccc

SEQ ID NO: 3866341 - RNA, 18 nt, Human
cucaaggacuugaaagca

SEQ ID NO: 3866342 - RNA, 19 nt, Human
cucaaggacuugaaagcau

SEQ ID NO: 3866343 - RNA, 20 nt, Human
cucaaggccucccacaguga

SEQ ID NO: 3866344 - RNA, 17 nt, Human
cucaagggacaaggaca

SEQ ID NO: 3866345 - RNA, 14 nt, Human
cucaagggcaugag

SEQ ID NO: 3866346 - RNA, 21 nt, Human
cucaagggcuagcaucccuga

SEQ ID NO: 3866347 - RNA, 23 nt, Human
cucaaggggccauccugucccac

SEQ ID NO: 3866348 - RNA, 19 nt, Human
cucaagguuuuagguucua

SEQ ID NO: 3866349 - RNA, 23 nt, Human
cucaagguuuuagguucuaaagu

SEQ ID NO: 3866350 - RNA, 18 nt, Human
cucaaguagcauuuacug

SEQ ID NO: 3866351 - RNA, 14 nt, Human
cucaaguccucuuu

SEQ ID NO: 3866352 - RNA, 21 nt, Human
cucaaguccucuuuucugaga

SEQ ID NO: 3866353 - RNA, 15 nt, Human
cucaagucuggcaga

SEQ ID NO: 3866354 - RNA, 15 nt, Human
cucaagucuuucucu

SEQ ID NO: 3866355 - RNA, 17 nt, Human
cucaagugauccuccca

SEQ ID NO: 3866356 - RNA, 18 nt, Human
cucaagugauccucccac

SEQ ID NO: 3866357 - RNA, 19 nt, Human
cucaagugauucuccugcc

SEQ ID NO: 3866358 - RNA, 15 nt, Human
cucaaguucaaggac

SEQ ID NO: 3866359 - RNA, 18 nt, Human
cucaaguucuaagauucu

SEQ ID NO: 3866360 - RNA, 19 nt, Human
cucaaguucuaagauucua

SEQ ID NO: 3866361 - RNA, 14 nt, Human
cucaaguugaaaga

SEQ ID NO: 3866362 - RNA, 18 nt, Human
cucaaguuuuucagaaag

SEQ ID NO: 3866363 - RNA, 16 nt, Human
cucaauaaaugauucu

SEQ ID NO: 3866364 - RNA, 13 nt, Human
cucaauauuuucc

SEQ ID NO: 3866365 - RNA, 22 nt, Human
cucaauauuuuccaugaaaaug

SEQ ID NO: 3866366 - RNA, 15 nt, Human
cucaaucaagaaaau

SEQ ID NO: 3866367 - RNA, 19 nt, Human
cucaauccuaauuucuccu

SEQ ID NO: 3866368 - RNA, 22 nt, Human
cucaauccuaauuucuccuccc

SEQ ID NO: 3866369 - RNA, 12 nt, Human
cucaaugagcau

SEQ ID NO: 3866370 - RNA, 14 nt, Human
cucaaugagcaugu

SEQ ID NO: 3866371 - RNA, 21 nt, Human
cucaaugagcauguuuagacu

SEQ ID NO: 3866372 - RNA, 12 nt, Human
cucaaugagcuc

SEQ ID NO: 3866373 - RNA, 13 nt, Human
cucaaugcacuga

SEQ ID NO: 3866374 - RNA, 15 nt, Human
cucaaugcacugaca

SEQ ID NO: 3866375 - RNA, 22 nt, Human
cucaaugcaguuagcugaagaa

SEQ ID NO: 3866376 - RNA, 20 nt, Human
cucaaugcuuuauuuguaaa

SEQ ID NO: 3866377 - RNA, 23 nt, Human
cucaauggccuaaaacuggccug

SEQ ID NO: 3866378 - RNA, 11 nt, Human
cucaaugugaa

SEQ ID NO: 3866379 - RNA, 13 nt, Human
cucaaugugaaaa

SEQ ID NO: 3866380 - RNA, 18 nt, Human
cucaaugugaccaggggu

SEQ ID NO: 3866381 - RNA, 12 nt, Human
cucaauguuuga

SEQ ID NO: 3866382 - RNA, 14 nt, Human
cucaauuagugugg

SEQ ID NO: 3866383 - RNA, 21 nt, Human
cucaauuccaacaguuuaaug

SEQ ID NO: 3866384 - RNA, 19 nt, Human
cucaauucccccuggccac

SEQ ID NO: 3866385 - RNA, 12 nt, Human
cucaauugugaa

SEQ ID NO: 3866386 - RNA, 13 nt, Human
cucaauugugaaa

SEQ ID NO: 3866387 - RNA, 17 nt, Human
cucacaaccugaaccua

SEQ ID NO: 3866388 - RNA, 20 nt, Human
cucacaaccugaaccuagga

SEQ ID NO: 3866389 - RNA, 13 nt, Human
cucacaagccagc

SEQ ID NO: 3866390 - RNA, 20 nt, Human
cucacaaggcagcaaggccc

SEQ ID NO: 3866391 - RNA, 21 nt, Human
cucacaaggcagcaaggcccg

SEQ ID NO: 3866392 - RNA, 19 nt, Human
cucacaaguggguaccccc

SEQ ID NO: 3866393 - RNA, 16 nt, Human
cucacacacccugagg

SEQ ID NO: 3866394 - RNA, 23 nt, Human
cucacacacccugucugccccgc

SEQ ID NO: 3866395 - RNA, 22 nt, Human
cucacacaggacccccuucccc

SEQ ID NO: 3866396 - RNA, 22 nt, Human
cucacacaggcauuuccugggu

SEQ ID NO: 3866397 - RNA, 17 nt, Human
cucacaccacuagccuc

SEQ ID NO: 3866398 - RNA, 21 nt, Human
cucacaccacuagccucaggg

SEQ ID NO: 3866399 - RNA, 12 nt, Human
cucacacccacc

SEQ ID NO: 3866400 - RNA, 23 nt, Human
cucacacccaccguccgcccugc

SEQ ID NO: 3866401 - RNA, 21 nt, Human
cucacaccgcgucuggugaca

SEQ ID NO: 3866402 - RNA, 19 nt, Human
cucacaccucacucuuuau

SEQ ID NO: 3866403 - RNA, 22 nt, Human
cucacaccuguaaucccagcac

SEQ ID NO: 3866404 - RNA, 23 nt, Human
cucacacucaugcauuguccucu

SEQ ID NO: 3866405 - RNA, 18 nt, Human
cucacacuccccuagggg

SEQ ID NO: 3866406 - RNA, 14 nt, Human
cucacacuccuuua

SEQ ID NO: 3866407 - RNA, 12 nt, Human
cucacacugaga

SEQ ID NO: 3866408 - RNA, 18 nt, Human
cucacacuggucugcugu

SEQ ID NO: 3866409 - RNA, 13 nt, Human
cucacagacagga

SEQ ID NO: 3866410 - RNA, 23 nt, Human
cucacagacaggaccccugcagu

SEQ ID NO: 3866411 - RNA, 14 nt, Human
cucacagaccugga

SEQ ID NO: 3866412 - RNA, 17 nt, Human
cucacagaccuggagcc

SEQ ID NO: 3866413 - RNA, 22 nt, Human
cucacagaccuggagccccugg

SEQ ID NO: 3866414 - RNA, 23 nt, Human
cucacagacuggagacaaugcag

SEQ ID NO: 3866415 - RNA, 17 nt, Human
cucacagagucaaggcc

SEQ ID NO: 3866416 - RNA, 19 nt, Human
cucacagagucaaggccug

SEQ ID NO: 3866417 - RNA, 22 nt, Human
cucacagagucaaggccugcuc

SEQ ID NO: 3866418 - RNA, 20 nt, Human
cucacagaugugacuguaua

SEQ ID NO: 3866419 - RNA, 19 nt, Human
cucacagauugcugccuca

SEQ ID NO: 3866420 - RNA, 17 nt, Human
cucacagcacacucagc

SEQ ID NO: 3866421 - RNA, 20 nt, Human
cucacagcacaugcuggcca

SEQ ID NO: 3866422 - RNA, 13 nt, Human
cuccuguccuccc

SEQ ID NO: 3866423 - RNA, 20 nt, Human
cuccuguccucccauccccu

SEQ ID NO: 3866424 - RNA, 17 nt, Human
cuccugucugccagcca

SEQ ID NO: 3866425 - RNA, 19 nt, Human
cuccugucugccagccagc

SEQ ID NO: 3866426 - RNA, 14 nt, Human
cuccugucuucugc

SEQ ID NO: 3866427 - RNA, 18 nt, Human
cuccugucuucugcuuug

SEQ ID NO: 3866428 - RNA, 17 nt, Human
cuccugugcaacuuucc

SEQ ID NO: 3866429 - RNA, 17 nt, Human
cuccugugcauggguga

SEQ ID NO: 3866430 - RNA, 11 nt, Human
cuccugugccc

SEQ ID NO: 3866431 - RNA, 22 nt, Human
cuccugugcccacaucccaggc

SEQ ID NO: 3866432 - RNA, 19 nt, Human
cuccugugcucagcccuga

SEQ ID NO: 3866433 - RNA, 22 nt, Human
cuccugugcucagcccugagga

SEQ ID NO: 3866434 - RNA, 16 nt, Human
cuccuguggaacccag

SEQ ID NO: 3866435 - RNA, 13 nt, Human
cuccuguggcccc

SEQ ID NO: 3866436 - RNA, 22 nt, Human
cuccuguggccccacccugggc

SEQ ID NO: 3866437 - RNA, 15 nt, Human
cuccuguggccugcc

SEQ ID NO: 3866438 - RNA, 18 nt, Human
cuccuguggccugccagu

SEQ ID NO: 3866439 - RNA, 15 nt, Human
cuccugugggagccu

SEQ ID NO: 3866440 - RNA, 16 nt, Human
cuccugugggagccuc

SEQ ID NO: 3866441 - RNA, 23 nt, Human
cuccugugucuugcaauggcagc

SEQ ID NO: 3866442 - RNA, 11 nt, Human
cuccugugugu

SEQ ID NO: 3866443 - RNA, 21 nt, Human
cuccugugugugcgccuacag

SEQ ID NO: 3866444 - RNA, 24 nt, Human
cuccugugugugcgccuacaggag

SEQ ID NO: 3866445 - RNA, 19 nt, Human
cuccuguugcacccagccc

SEQ ID NO: 3866446 - RNA, 13 nt, Human
cuccuguugggag

SEQ ID NO: 3866447 - RNA, 22 nt, Human
cuccuguugggagagggcgcag

SEQ ID NO: 3866448 - RNA, 24 nt, Human
cuccuguugggagagggcgcaggc

SEQ ID NO: 3866449 - RNA, 20 nt, Human
cuccuguuucccuucccuuc

SEQ ID NO: 3866450 - RNA, 17 nt, Human
cuccuuagaaguggaag

SEQ ID NO: 3866451 - RNA, 20 nt, Human
cuccuuagagacaucaaaau

SEQ ID NO: 3866452 - RNA, 17 nt, Human
cuccuuaucaaaggaca

SEQ ID NO: 3866453 - RNA, 23 nt, Human
cuccuucaacaaggcuugcugca

SEQ ID NO: 3866454 - RNA, 16 nt, Human
cuccuucacagauggg

SEQ ID NO: 3866455 - RNA, 17 nt, Human
cuccuucacagaugggu

SEQ ID NO: 3866456 - RNA, 19 nt, Human
cuccuucacagaugggugc

SEQ ID NO: 3866457 - RNA, 19 nt, Human
cuccuucaccuuugucccc

SEQ ID NO: 3866458 - RNA, 21 nt, Human
cuccuucaccuuuguccccac

SEQ ID NO: 3866459 - RNA, 19 nt, Human
cuccuucagacacccucaa

SEQ ID NO: 3866460 - RNA, 13 nt, Human
cuccuucagcccu

SEQ ID NO: 3866461 - RNA, 17 nt, Human
cuccuucagcccucacc

SEQ ID NO: 3866462 - RNA, 22 nt, Human
cuccuucauaugaaaggugcca

SEQ ID NO: 3866463 - RNA, 14 nt, Human
cuccuuccaacagg

SEQ ID NO: 3866464 - RNA, 18 nt, Human
cuccuuccaacaggagcu

SEQ ID NO: 3866465 - RNA, 14 nt, Human
cuccuuccaacugc

SEQ ID NO: 3866466 - RNA, 18 nt, Human
cuccuuccaacugcugcc

SEQ ID NO: 3866467 - RNA, 19 nt, Human
cuccuuccaacugcugccc

SEQ ID NO: 3866468 - RNA, 18 nt, Human
cuccuuccaccucccucc

SEQ ID NO: 3866469 - RNA, 13 nt, Human
cuccuucccaaag

SEQ ID NO: 3866470 - RNA, 23 nt, Human
cuccuucccaaaggacuccaccc

SEQ ID NO: 3866471 - RNA, 16 nt, Human
cuccuucccacucuuc

SEQ ID NO: 3866472 - RNA, 19 nt, Human
cuccuucccacucuucuca

SEQ ID NO: 3866473 - RNA, 18 nt, Human
cuccuucccagcugcccc

SEQ ID NO: 3866474 - RNA, 17 nt, Human
cuccuucccaucgcugu

SEQ ID NO: 3866475 - RNA, 20 nt, Human
cuccuuccuaguucaucccu

SEQ ID NO: 3866476 - RNA, 15 nt, Human
cuccuuccugcccca

SEQ ID NO: 3866477 - RNA, 14 nt, Human
cuccuuccuggaga

SEQ ID NO: 3866478 - RNA, 20 nt, Human
cuccuuccuggagcccagag

SEQ ID NO: 3866479 - RNA, 18 nt, Human
cuccuuccuggccugaga

SEQ ID NO: 3866480 - RNA, 17 nt, Human
cuccuuccugucuuccu

SEQ ID NO: 3866481 - RNA, 18 nt, Human
cuccuuccuugaccagca

SEQ ID NO: 3866482 - RNA, 22 nt, Human
cuccuuccuugcuguccuaggc

SEQ ID NO: 3866483 - RNA, 13 nt, Human
cuccuuccuuguu

SEQ ID NO: 3866484 - RNA, 19 nt, Human
cuccuucgcaggcaugucc

SEQ ID NO: 3866485 - RNA, 13 nt, Human
cuccuucucccuu

SEQ ID NO: 3866486 - RNA, 16 nt, Human
cuccuucucugucuca

SEQ ID NO: 3866487 - RNA, 18 nt, Human
cuccuucugagcuccugu

SEQ ID NO: 3866488 - RNA, 19 nt, Human
cuccuucugagcuccuguc

SEQ ID NO: 3866489 - RNA, 14 nt, Human
cuccuucuguccua

SEQ ID NO: 3866490 - RNA, 20 nt, Human
cuccuucuguccuacucugu

SEQ ID NO: 3866491 - RNA, 17 nt, Human
cuccuugagagaccagg

SEQ ID NO: 3866492 - RNA, 22 nt, Human
cuccuugagggcaagagccaca

SEQ ID NO: 3866493 - RNA, 12 nt, Human
cuccuugcaguu

SEQ ID NO: 3866494 - RNA, 17 nt, Human
cuccuugcuacccagaa

SEQ ID NO: 3866495 - RNA, 14 nt, Human
cuccuuggagacag

SEQ ID NO: 3866496 - RNA, 20 nt, Human
cuccuuggcuuaccugaccu

SEQ ID NO: 3866497 - RNA, 13 nt, Human
cuccuugggagga

SEQ ID NO: 3866498 - RNA, 18 nt, Human
cuccuugggaggaagcag

SEQ ID NO: 3866499 - RNA, 22 nt, Human
cuccuugggaggaagcagaaua

SEQ ID NO: 3866500 - RNA, 23 nt, Human
cuccuuggugucgggcaugacac

SEQ ID NO: 3866501 - RNA, 16 nt, Human
cuccuuguggccuggg

SEQ ID NO: 3866502 - RNA, 20 nt, Human
cuccuuguggccugggccuc

SEQ ID NO: 3866503 - RNA, 16 nt, Human
cuccuugugggccugg

SEQ ID NO: 3866504 - RNA, 14 nt, Human
cuccuuguguuacu

SEQ ID NO: 3866505 - RNA, 12 nt, Human
cuccuuguuccu

SEQ ID NO: 3866506 - RNA, 15 nt, Human
cuccuuuaauuguaa

SEQ ID NO: 3866507 - RNA, 18 nt, Human
cuccuuuacccucaucug

SEQ ID NO: 3866508 - RNA, 14 nt, Human
cuccuuuagcaggu

SEQ ID NO: 3866509 - RNA, 20 nt, Human
cuccuuuagcaggugguccu

SEQ ID NO: 3866510 - RNA, 16 nt, Human
cuccuuuagcgcccag

SEQ ID NO: 3866511 - RNA, 22 nt, Human
cuccuuuagcgcccaguugggu

SEQ ID NO: 3866512 - RNA, 13 nt, Human
cuccuuucacaac

SEQ ID NO: 3866513 - RNA, 16 nt, Human
cuccuuucacaaccuu

SEQ ID NO: 3866514 - RNA, 20 nt, Human
cuccuuucacaaccuucugu

SEQ ID NO: 3866515 - RNA, 19 nt, Human
cuccuuucaccccagggcc

SEQ ID NO: 3866516 - RNA, 17 nt, Human
cuccuuucuccagccag

SEQ ID NO: 3866517 - RNA, 19 nt, Human
cuccuuucuccagccagca

SEQ ID NO: 3866518 - RNA, 14 nt, Human
cuccuuucuccucc

SEQ ID NO: 3866519 - RNA, 13 nt, Human
cuccuuucucuuu

SEQ ID NO: 3866520 - RNA, 13 nt, Human
cuccuuucugugc

SEQ ID NO: 3866521 - RNA, 14 nt, Human
cuccuuucugugcc

SEQ ID NO: 3866522 - RNA, 14 nt, Human
cuccuuugcacuga

SEQ ID NO: 3866523 - RNA, 21 nt, Human
cuccuuugcacugagggccac

SEQ ID NO: 3866524 - RNA, 12 nt, Human
cuccuuuguaua

SEQ ID NO: 3866525 - RNA, 17 nt, Human
cuccuuugugaggaagc

SEQ ID NO: 3866526 - RNA, 17 nt, Human
cuccuuuguucccggcu

SEQ ID NO: 3866527 - RNA, 13 nt, Human
cuccuuuuaaaga

SEQ ID NO: 3866528 - RNA, 19 nt, Human
cuccuuuuccagagcauuc

SEQ ID NO: 3866529 - RNA, 16 nt, Human
cuccuuuucuuuuguu

SEQ ID NO: 3866530 - RNA, 20 nt, Human
cuccuuuucuuuuguuacug

SEQ ID NO: 3866531 - RNA, 21 nt, Human
cuccuuuucuuuuguuacugu

SEQ ID NO: 3866532 - RNA, 22 nt, Human
cuccuuuucuuuuguuacuguu

SEQ ID NO: 3866533 - RNA, 23 nt, Human
cuccuuuucuuuuguuacuguuc

SEQ ID NO: 3866534 - RNA, 24 nt, Human
cuccuuuugaccuucauuucaugu

SEQ ID NO: 3866535 - RNA, 17 nt, Human
cuccuuuuguguuccaa

SEQ ID NO: 3866536 - RNA, 13 nt, Human
cuccuuuuuccau

SEQ ID NO: 3866537 - RNA, 14 nt, Human
cucgaaacacagaa

SEQ ID NO: 3866538 - RNA, 19 nt, Human
cucgaaacacagaaaccuu

SEQ ID NO: 3866539 - RNA, 16 nt, Human
cucgaacuggcugcaa

SEQ ID NO: 3866540 - RNA, 17 nt, Human
cucgaagcgcgccacuc

SEQ ID NO: 3866541 - RNA, 15 nt, Human
cucgaaucucugugc

SEQ ID NO: 3866542 - RNA, 20 nt, Human
cucgacacgugggcuccccu

SEQ ID NO: 3866543 - RNA, 22 nt, Human
cucgacacgugggcuccccucu

SEQ ID NO: 3866544 - RNA, 19 nt, Human
cucgacaucacuguucaug

SEQ ID NO: 3866545 - RNA, 19 nt, Human
cucgagaacuuucauuuuu

SEQ ID NO: 3866546 - RNA, 22 nt, Human
cucgagaucccaacacugccag

SEQ ID NO: 3866547 - RNA, 23 nt, Human
cucgagaucccaacacugccagc

SEQ ID NO: 3866548 - RNA, 12 nt, Human
cucgagcgcccu

SEQ ID NO: 3866549 - RNA, 17 nt, Human
cucgaggacuguauuug

SEQ ID NO: 3866550 - RNA, 23 nt, Human
cucgaggacuguauuugugacua

SEQ ID NO: 3866551 - RNA, 13 nt, Human
cucgagggcaggg

SEQ ID NO: 3866552 - RNA, 18 nt, Human
cucgagggcagggaccac

SEQ ID NO: 3866553 - RNA, 23 nt, Human
cucgaggguuggguucaucugag

SEQ ID NO: 3866554 - RNA, 17 nt, Human
cucgaggucgggcagca

SEQ ID NO: 3866555 - RNA, 21 nt, Human
cucgaggucgggcagcacaag

SEQ ID NO: 3866556 - RNA, 17 nt, Human
cucgagguuucucaaag

SEQ ID NO: 3866557 - RNA, 13 nt, Human
cucgaguacugug

SEQ ID NO: 3866558 - RNA, 20 nt, Human
cucgaguacugugggcaauu

SEQ ID NO: 3866559 - RNA, 12 nt, Human
cucgagucugag

SEQ ID NO: 3866560 - RNA, 16 nt, Human
cucgaguuacagacaa

SEQ ID NO: 3866561 - RNA, 21 nt, Human
cucgauccaaauugugcuucu

SEQ ID NO: 3866562 - RNA, 14 nt, Human
cucgaugcagacag

SEQ ID NO: 3866563 - RNA, 19 nt, Human
cucgauguggucacagcug

SEQ ID NO: 3866564 - RNA, 22 nt, Human
cucgauuuuaucuuucgcacag

SEQ ID NO: 3866565 - RNA, 13 nt, Human
cucgauuuuguau

SEQ ID NO: 3866566 - RNA, 17 nt, Human
cucucaucucuuagcuc

SEQ ID NO: 3866567 - RNA, 16 nt, Human
cucucaugcugccccu

SEQ ID NO: 3866568 - RNA, 22 nt, Human
cucucaugcugccccugccuug

SEQ ID NO: 3866569 - RNA, 20 nt, Human
cucucauguuuucaacugcc

SEQ ID NO: 3866570 - RNA, 11 nt, Human
cucucauuccc

SEQ ID NO: 3866571 - RNA, 20 nt, Human
cucucauuccccagguggcu

SEQ ID NO: 3866572 - RNA, 21 nt, Human
cucucauuccccagguggcug

SEQ ID NO: 3866573 - RNA, 16 nt, Human
cucuccaaaccacuuu

SEQ ID NO: 3866574 - RNA, 14 nt, Human
cucuccaaccugga

SEQ ID NO: 3866575 - RNA, 16 nt, Human
cucuccaaccuggaca

SEQ ID NO: 3866576 - RNA, 13 nt, Human
cucuccaagggcu

SEQ ID NO: 3866577 - RNA, 23 nt, Human
cucuccaagucucaguggcuuca

SEQ ID NO: 3866578 - RNA, 14 nt, Human
cucuccaagugcca

SEQ ID NO: 3866579 - RNA, 20 nt, Human
cucuccaagugccagaggug

SEQ ID NO: 3866580 - RNA, 22 nt, Human
cucuccacacagugcucaaggc

SEQ ID NO: 3866581 - RNA, 10 nt, Human
cucuccaccu

SEQ ID NO: 3866582 - RNA, 14 nt, Human
cucuccaccuagug

SEQ ID NO: 3866583 - RNA, 19 nt, Human
cucuccacucaugugacuc

SEQ ID NO: 3866584 - RNA, 12 nt, Human
cucuccacugcc

SEQ ID NO: 3866585 - RNA, 15 nt, Human
cucuccacugccuuc

SEQ ID NO: 3866586 - RNA, 15 nt, Human
cucuccacuuucagc

SEQ ID NO: 3866587 - RNA, 18 nt, Human
cucuccacuuucagcugu

SEQ ID NO: 3866588 - RNA, 12 nt, Human
cucuccagcagg

SEQ ID NO: 3866589 - RNA, 13 nt, Human
cucuccagccccu

SEQ ID NO: 3866590 - RNA, 16 nt, Human
cucuccagcuccaaga

SEQ ID NO: 3866591 - RNA, 23 nt, Human
cucuccaggcaggucugaagcuc

SEQ ID NO: 3866592 - RNA, 17 nt, Human
cucuccaggcgccggcg

SEQ ID NO: 3866593 - RNA, 21 nt, Human
cucuccagucuuccaccugga

SEQ ID NO: 3866594 - RNA, 19 nt, Human
cucuccaguuugcaccugu

SEQ ID NO: 3866595 - RNA, 13 nt, Human
cucuccauaaccc

SEQ ID NO: 3866596 - RNA, 16 nt, Human
cucuccaucuucagcu

SEQ ID NO: 3866597 - RNA, 21 nt, Human
cucuccauucccguggaacgu

SEQ ID NO: 3866598 - RNA, 16 nt, Human
cucuccauucugcucc

SEQ ID NO: 3866599 - RNA, 20 nt, Human
cucuccauucugcuccuucc

SEQ ID NO: 3866600 - RNA, 14 nt, Human
cucucccaacucuu

SEQ ID NO: 3866601 - RNA, 13 nt, Human
cucucccacccuc

SEQ ID NO: 3866602 - RNA, 17 nt, Human
cucucccacccucuucc

SEQ ID NO: 3866603 - RNA, 12 nt, Human
cucucccaggac

SEQ ID NO: 3866604 - RNA, 13 nt, Human
cucucccaggacc

SEQ ID NO: 3866605 - RNA, 14 nt, Human
cucucccaggcagg

SEQ ID NO: 3866606 - RNA, 16 nt, Human
cucucccaggccccau

SEQ ID NO: 3866607 - RNA, 20 nt, Human
cucucccagucuacccagag

SEQ ID NO: 3866608 - RNA, 12 nt, Human
cucucccaguug

SEQ ID NO: 3866609 - RNA, 14 nt, Human
cucucccaucacuu

SEQ ID NO: 3866610 - RNA, 18 nt, Human
cucucccaucacuucccu

SEQ ID NO: 3866611 - RNA, 20 nt, Human
cucucccaucacuucccuac

SEQ ID NO: 3866612 - RNA, 20 nt, Human
cucucccaucccccugcccu

SEQ ID NO: 3866613 - RNA, 13 nt, Human
cucucccauggag

SEQ ID NO: 3866614 - RNA, 16 nt, Human
cucucccauugucccu

SEQ ID NO: 3866615 - RNA, 18 nt, Human
cucuccccaacccccauu

SEQ ID NO: 3866616 - RNA, 21 nt, Human
cucuccccaauauccucgcuc

SEQ ID NO: 3866617 - RNA, 12 nt, Human
cucuccccacac

SEQ ID NO: 3866618 - RNA, 14 nt, Human
cucuccccacacua

SEQ ID NO: 3866619 - RNA, 15 nt, Human
cucuccccacacuaa

SEQ ID NO: 3866620 - RNA, 14 nt, Human
cucuccccaccccu

SEQ ID NO: 3866621 - RNA, 21 nt, Human
cucuccccacgagggcuggcu

SEQ ID NO: 3866622 - RNA, 16 nt, Human
cucuccccagcccaga

SEQ ID NO: 3866623 - RNA, 24 nt, Human
cucuccccagggaagcagcagccu

SEQ ID NO: 3866624 - RNA, 15 nt, Human
cucuccccaggucca

SEQ ID NO: 3866625 - RNA, 13 nt, Human
cucucccccaccc

SEQ ID NO: 3866626 - RNA, 18 nt, Human
cucucccccuuaccccac

SEQ ID NO: 3866627 - RNA, 12 nt, Human
cucuccccucaa

SEQ ID NO: 3866628 - RNA, 21 nt, Human
cucuccccucaaagucugcaa

SEQ ID NO: 3866629 - RNA, 21 nt, Human
cucuccccucagagugcaagc

SEQ ID NO: 3866630 - RNA, 17 nt, Human
cucuccccuccagccuu

SEQ ID NO: 3866631 - RNA, 15 nt, Human
cucuccccugccccc

SEQ ID NO: 3866632 - RNA, 21 nt, Human
cucuccccugcccccugcagg

SEQ ID NO: 3866633 - RNA, 15 nt, Human
cucuccccugcccug

SEQ ID NO: 3866634 - RNA, 16 nt, Human
cucuccccuucucugu

SEQ ID NO: 3866635 - RNA, 16 nt, Human
cucucccgucagggcc

SEQ ID NO: 3866636 - RNA, 23 nt, Human
cucucccucaacaagggagagac

SEQ ID NO: 3866637 - RNA, 13 nt, Human
cucucccuccccu

SEQ ID NO: 3866638 - RNA, 15 nt, Human
cucucccucuaggcu

SEQ ID NO: 3866639 - RNA, 13 nt, Human
cucucccucuggc

SEQ ID NO: 3866640 - RNA, 15 nt, Human
cucucccucuggucc

SEQ ID NO: 3866641 - RNA, 14 nt, Human
cucucccugacccu

SEQ ID NO: 3866642 - RNA, 16 nt, Human
cucucccugcugcucc

SEQ ID NO: 3866643 - RNA, 19 nt, Human
cucucccugcugcuccuag

SEQ ID NO: 3866644 - RNA, 20 nt, Human
cucucccugcugcuccuagg

SEQ ID NO: 3866645 - RNA, 17 nt, Human
cucucccuugggcucug

SEQ ID NO: 3866646 - RNA, 19 nt, Human
cucucccuugggcucugau

SEQ ID NO: 3866647 - RNA, 23 nt, Human
cucucccuugggcucugaugaaa

SEQ ID NO: 3866648 - RNA, 18 nt, Human
cucuccgccccugagccc

SEQ ID NO: 3866649 - RNA, 20 nt, Human
cucuccgccccugagcccac

SEQ ID NO: 3866650 - RNA, 16 nt, Human
cucuccggggccauuu

SEQ ID NO: 3866651 - RNA, 21 nt, Human
cucuccggggccauuugcaau

SEQ ID NO: 3866652 - RNA, 22 nt, Human
cucuccuaacugccagcccccu

SEQ ID NO: 3866653 - RNA, 16 nt, Human
cucuccucacacacag

SEQ ID NO: 3866654 - RNA, 14 nt, Human
cucuccucagacug

SEQ ID NO: 3866655 - RNA, 15 nt, Human
cucuccucagacugc

SEQ ID NO: 3866656 - RNA, 12 nt, Human
cucuccucaucu

SEQ ID NO: 3866657 - RNA, 20 nt, Human
cucuccuccugcccaccugu

SEQ ID NO: 3866658 - RNA, 13 nt, Human
cucuccuccuuuu

SEQ ID NO: 3866659 - RNA, 20 nt, Human
cucuccucggcccccuccau

SEQ ID NO: 3866660 - RNA, 10 nt, Human
cucuccucug

SEQ ID NO: 3866661 - RNA, 12 nt, Human
cucuccucugcu

SEQ ID NO: 3866662 - RNA, 13 nt, Human
cucuccucugcug

SEQ ID NO: 3866663 - RNA, 14 nt, Human
cucuccucugcugc

SEQ ID NO: 3866664 - RNA, 16 nt, Human
cucuccucuugccacu

SEQ ID NO: 3866665 - RNA, 21 nt, Human
cucuccugauagucuuucagu

SEQ ID NO: 3866666 - RNA, 13 nt, Human
cucuccugccuac

SEQ ID NO: 3866667 - RNA, 12 nt, Human
cucuccuggagg

SEQ ID NO: 3866668 - RNA, 23 nt, Human
cucuccuggccuauccgcugcca

SEQ ID NO: 3866669 - RNA, 16 nt, Human
cucuccuggcuuccca

SEQ ID NO: 3866670 - RNA, 18 nt, Human
cucuccugggcagcugcc

SEQ ID NO: 3866671 - RNA, 21 nt, Human
cucuccugggcagcugccucc

SEQ ID NO: 3866672 - RNA, 13 nt, Human
cucuccugggccc

SEQ ID NO: 3866673 - RNA, 17 nt, Human
cucuccugggccccucc

SEQ ID NO: 3866674 - RNA, 15 nt, Human
cucuccuguaccucu

SEQ ID NO: 3866675 - RNA, 18 nt, Human
cucuccugucucccuccu

SEQ ID NO: 3866676 - RNA, 19 nt, Human
cucuccuguuucccuuccc

SEQ ID NO: 3866677 - RNA, 22 nt, Human
cucuccuucaugacagccucca

SEQ ID NO: 3866678 - RNA, 19 nt, Human
cucuccuuggugucgggca

SEQ ID NO: 3866679 - RNA, 16 nt, Human
cucuccuuucuuuuuc

SEQ ID NO: 3866680 - RNA, 23 nt, Human
cucuccuuucuuuuucuucuucc

SEQ ID NO: 3866681 - RNA, 21 nt, Human
cucuccuuugaaaccugcucu

SEQ ID NO: 3866682 - RNA, 19 nt, Human
cucuccuuuggccauucca

SEQ ID NO: 3866683 - RNA, 14 nt, Human
cucuccuuuguaua

SEQ ID NO: 3866684 - RNA, 20 nt, Human
cucuccuuuguauauuauuu

SEQ ID NO: 3866685 - RNA, 18 nt, Human
cucuccuuuguucccggc

SEQ ID NO: 3866686 - RNA, 22 nt, Human
cucuccuuuucuuuuguuacug

SEQ ID NO: 3866687 - RNA, 19 nt, Human
cucucgcaccuuuccaaag

SEQ ID NO: 3866688 - RNA, 22 nt, Human
cucucgcggccucuucucucag

SEQ ID NO: 3866689 - RNA, 16 nt, Human
cucucggaacugcaug

SEQ ID NO: 3866690 - RNA, 19 nt, Human
cucucggaacugcaugcug

SEQ ID NO: 3866691 - RNA, 18 nt, Human
cucucggaaggcuggcug

SEQ ID NO: 3866692 - RNA, 16 nt, Human
cucucggcuccccaug

SEQ ID NO: 3866693 - RNA, 17 nt, Human
cucucggcuccccaugu

SEQ ID NO: 3866694 - RNA, 19 nt, Human
cucucggguucaagcaauu

SEQ ID NO: 3866695 - RNA, 21 nt, Human
cucucgguuccacgucccccu

SEQ ID NO: 3866696 - RNA, 16 nt, Human
cucucgguugaaaccu

SEQ ID NO: 3866697 - RNA, 17 nt, Human
cucucguaacugguuuc

SEQ ID NO: 3866698 - RNA, 15 nt, Human
cucucuaaccuccuu

SEQ ID NO: 3866699 - RNA, 16 nt, Human
cucucuaaccuccuuu

SEQ ID NO: 3866700 - RNA, 19 nt, Human
cucucuacaaacucccacu

SEQ ID NO: 3866701 - RNA, 14 nt, Human
cucucuacagucuc

SEQ ID NO: 3866702 - RNA, 16 nt, Human
cucucuacagucucgu

SEQ ID NO: 3866703 - RNA, 16 nt, Human
cucucuacccagccca

SEQ ID NO: 3866704 - RNA, 19 nt, Human
cucucuacccagcccaucu

SEQ ID NO: 3866705 - RNA, 19 nt, Human
cucucuacuccuaccucag

SEQ ID NO: 3866706 - RNA, 23 nt, Human
cucucuaggguacauggugcugg

SEQ ID NO: 3866707 - RNA, 14 nt, Human
cucucuauccucuc

SEQ ID NO: 3866708 - RNA, 24 nt, Human
cucucuauccucucuuccucuucc

SEQ ID NO: 3866709 - RNA, 23 nt, Human
cucucuaugguaaagauauuauu

SEQ ID NO: 3866710 - RNA, 15 nt, Human
cucucucaaaauuau

SEQ ID NO: 3866711 - RNA, 15 nt, Human
cugaugacacugaga

SEQ ID NO: 3866712 - RNA, 17 nt, Human
cugaugacagagcgaga

SEQ ID NO: 3866713 - RNA, 12 nt, Human
cugaugacccag

SEQ ID NO: 3866714 - RNA, 13 nt, Human
cugaugacccagg

SEQ ID NO: 3866715 - RNA, 18 nt, Human
cugaugacucaagauucc

SEQ ID NO: 3866716 - RNA, 21 nt, Human
cugaugagcaaccgcuucccu

SEQ ID NO: 3866717 - RNA, 12 nt, Human
cugaugcagcuu

SEQ ID NO: 3866718 - RNA, 23 nt, Human
cugaugcaggauuuguucucugu

SEQ ID NO: 3866719 - RNA, 18 nt, Human
cugaugcaucagaaaggg

SEQ ID NO: 3866720 - RNA, 12 nt, Human
cugaugcucccu

SEQ ID NO: 3866721 - RNA, 18 nt, Human
cugaugcucccuccccug

SEQ ID NO: 3866722 - RNA, 14 nt, Human
cugaugcugggcug

SEQ ID NO: 3866723 - RNA, 15 nt, Human
cugaugcugggcugg

SEQ ID NO: 3866724 - RNA, 17 nt, Human
cugaugcugggcugggu

SEQ ID NO: 3866725 - RNA, 16 nt, Human
cugaugcuucuucaga

SEQ ID NO: 3866726 - RNA, 17 nt, Human
cugaugcuucuucagag

SEQ ID NO: 3866727 - RNA, 20 nt, Human
cugaugcuucuucagagacu

SEQ ID NO: 3866728 - RNA, 20 nt, Human
cugauggaaacaaaguggaa

SEQ ID NO: 3866729 - RNA, 14 nt, Human
cugauggacaagga

SEQ ID NO: 3866730 - RNA, 15 nt, Human
cugauggaccuguca

SEQ ID NO: 3866731 - RNA, 15 nt, Human
cugauggagccuucc

SEQ ID NO: 3866732 - RNA, 14 nt, Human
cugauggaguaaau

SEQ ID NO: 3866733 - RNA, 19 nt, Human
cugauggcuucuccagggu

SEQ ID NO: 3866734 - RNA, 23 nt, Human
cugaugggguggaaggcauggcg

SEQ ID NO: 3866735 - RNA, 15 nt, Human
cugauggugcaauga

SEQ ID NO: 3866736 - RNA, 16 nt, Human
cugauggugcaaugac

SEQ ID NO: 3866737 - RNA, 20 nt, Human
cugauggugcaaugaccuuu

SEQ ID NO: 3866738 - RNA, 20 nt, Human
cugauguacaauuaaaaacc

SEQ ID NO: 3866739 - RNA, 22 nt, Human
cugaugucaauuucuguguugc

SEQ ID NO: 3866740 - RNA, 19 nt, Human
cugaugucccuagaaaaca

SEQ ID NO: 3866741 - RNA, 18 nt, Human
cugaugucuccuaagcac

SEQ ID NO: 3866742 - RNA, 12 nt, Human
cugaugucucua

SEQ ID NO: 3866743 - RNA, 19 nt, Human
cugaugucucuaaagcacu

SEQ ID NO: 3866744 - RNA, 19 nt, Human
cugauguuaggcugggccc

SEQ ID NO: 3866745 - RNA, 17 nt, Human
cugauguucccuccggu

SEQ ID NO: 3866746 - RNA, 22 nt, Human
cugauguuccuuuggaagaaaa

SEQ ID NO: 3866747 - RNA, 21 nt, Human
cugauuaaguugucuaaacaa

SEQ ID NO: 3866748 - RNA, 14 nt, Human
cugauuacaccagc

SEQ ID NO: 3866749 - RNA, 14 nt, Human
cugauuacugucaa

SEQ ID NO: 3866750 - RNA, 16 nt, Human
cugauuacugucaaua

SEQ ID NO: 3866751 - RNA, 17 nt, Human
cugauuacugucaauaa

SEQ ID NO: 3866752 - RNA, 19 nt, Human
cugauuacugucaauaaac

SEQ ID NO: 3866753 - RNA, 13 nt, Human
cugauuagaaaug

SEQ ID NO: 3866754 - RNA, 19 nt, Human
cugauuagaaaugaccaau

SEQ ID NO: 3866755 - RNA, 17 nt, Human
cugauuagcuuuguguu

SEQ ID NO: 3866756 - RNA, 14 nt, Human
cugauucaacuaaa

SEQ ID NO: 3866757 - RNA, 15 nt, Human
cugauucaacuaaaa

SEQ ID NO: 3866758 - RNA, 17 nt, Human
cugauucaacuaaaaaa

SEQ ID NO: 3866759 - RNA, 17 nt, Human
cugauucaauuugaugu

SEQ ID NO: 3866760 - RNA, 18 nt, Human
cugauucacugcauggcu

SEQ ID NO: 3866761 - RNA, 17 nt, Human
cugauucccaagcucug

SEQ ID NO: 3866762 - RNA, 18 nt, Human
cugauucccaagcucugc

SEQ ID NO: 3866763 - RNA, 19 nt, Human
cugauucgaaugacacugu

SEQ ID NO: 3866764 - RNA, 23 nt, Human
cugauucggcugucucagacucu

SEQ ID NO: 3866765 - RNA, 18 nt, Human
cugauucucagggucucu

SEQ ID NO: 3866766 - RNA, 19 nt, Human
cugauucuggcuuuaagcc

SEQ ID NO: 3866767 - RNA, 13 nt, Human
cugauucugggau

SEQ ID NO: 3866768 - RNA, 19 nt, Human
cugauucugggaugcuccu

SEQ ID NO: 3866769 - RNA, 15 nt, Human
cugauucuucagcaa

SEQ ID NO: 3866770 - RNA, 15 nt, Human
cugauugaccugcuc

SEQ ID NO: 3866771 - RNA, 17 nt, Human
cugauugagaaguucau

SEQ ID NO: 3866772 - RNA, 19 nt, Human
cugauugagaaguucauug

SEQ ID NO: 3866773 - RNA, 15 nt, Human
cugauuggacauuuu

SEQ ID NO: 3866774 - RNA, 14 nt, Human
cugauuggcucacc

SEQ ID NO: 3866775 - RNA, 16 nt, Human
cugauuggcucaccca

SEQ ID NO: 3866776 - RNA, 18 nt, Human
cugauuggcuuguagaau

SEQ ID NO: 3866777 - RNA, 22 nt, Human
cugauuggcuuguagaauuguu

SEQ ID NO: 3866778 - RNA, 17 nt, Human
cugauuggugcaacccu

SEQ ID NO: 3866779 - RNA, 18 nt, Human
cugauugguuucucuucu

SEQ ID NO: 3866780 - RNA, 21 nt, Human
cugauuguaacguugcugugg

SEQ ID NO: 3866781 - RNA, 21 nt, Human
cugauuguggaucuuuucauu

SEQ ID NO: 3866782 - RNA, 23 nt, Human
cugauuguggaucuuuucauucu

SEQ ID NO: 3866783 - RNA, 17 nt, Human
cugauugugucucuugg

SEQ ID NO: 3866784 - RNA, 16 nt, Human
cugauuuagauaugca

SEQ ID NO: 3866785 - RNA, 17 nt, Human
cugauuuaggagaagcc

SEQ ID NO: 3866786 - RNA, 18 nt, Human
cugauuuauuuuguauga

SEQ ID NO: 3866787 - RNA, 23 nt, Human
cugauuuauuuuguaugaaauau

SEQ ID NO: 3866788 - RNA, 12 nt, Human
cugauuucagga

SEQ ID NO: 3866789 - RNA, 13 nt, Human
cugauuuccccuc

SEQ ID NO: 3866790 - RNA, 12 nt, Human
cugauuucuagg

SEQ ID NO: 3866791 - RNA, 16 nt, Human
cugauuugcaaaaaaa

SEQ ID NO: 3866792 - RNA, 22 nt, Human
cugauuugcaauaaaaaugaua

SEQ ID NO: 3866793 - RNA, 17 nt, Human
cugauuugcauauucau

SEQ ID NO: 3866794 - RNA, 14 nt, Human
cugauuuggaaaaa

SEQ ID NO: 3866795 - RNA, 19 nt, Human
cugauuugggcugaaugua

SEQ ID NO: 3866796 - RNA, 23 nt, Human
cugauuugggcugaauguaugua

SEQ ID NO: 3866797 - RNA, 12 nt, Human
cugauuuguaac

SEQ ID NO: 3866798 - RNA, 13 nt, Human
cugauuuuaaugg

SEQ ID NO: 3866799 - RNA, 21 nt, Human
cugauuuuaggagcuaaggcu

SEQ ID NO: 3866800 - RNA, 22 nt, Human
cugauuuuaggagcuaaggcuc

SEQ ID NO: 3866801 - RNA, 23 nt, Human
cugauuuuaggagcuaaggcucu

SEQ ID NO: 3866802 - RNA, 17 nt, Human
cugauuuuauucuugau

SEQ ID NO: 3866803 - RNA, 18 nt, Human
cugauuuuauucuugauc

SEQ ID NO: 3866804 - RNA, 18 nt, Human
cugauuuucaaagcuuuu

SEQ ID NO: 3866805 - RNA, 16 nt, Human
cugauuuuuuuuuccu

SEQ ID NO: 3866806 - RNA, 18 nt, Human
cugauuuuuuuuuccuuc

SEQ ID NO: 3866807 - RNA, 21 nt, Human
cugauuuuuuuuuccuucagu

SEQ ID NO: 3866808 - RNA, 22 nt, Human
cugauuuuuuuuuccuucagug

SEQ ID NO: 3866809 - RNA, 23 nt, Human
cugcaaaaaauacuuuuucuaau

SEQ ID NO: 3866810 - RNA, 14 nt, Human
cugcaaaaccaggu

SEQ ID NO: 3866811 - RNA, 16 nt, Human
cugcaaaaccagguuu

SEQ ID NO: 3866812 - RNA, 17 nt, Human
cugcaaaaggacucuca

SEQ ID NO: 3866813 - RNA, 21 nt, Human
cugcaaaaggccucuuguaaa

SEQ ID NO: 3866814 - RNA, 12 nt, Human
cugcaaaaugag

SEQ ID NO: 3866815 - RNA, 21 nt, Human
cugcaaaaugaggaauguaua

SEQ ID NO: 3866816 - RNA, 22 nt, Human
cugcaaaaugaggaauguauau

SEQ ID NO: 3866817 - RNA, 23 nt, Human
cugcaaaauuugaugccaggaca

SEQ ID NO: 3866818 - RNA, 15 nt, Human
cugcaaacaaacacc

SEQ ID NO: 3866819 - RNA, 16 nt, Human
cugcaaacagaacagg

SEQ ID NO: 3866820 - RNA, 19 nt, Human
cugcaaacagaacaggguc

SEQ ID NO: 3866821 - RNA, 20 nt, Human
cugcaaacagaacaggguca

SEQ ID NO: 3866822 - RNA, 20 nt, Human
cugcaaaccugaccccugcu

SEQ ID NO: 3866823 - RNA, 15 nt, Human
cugcaaacgcugccu

SEQ ID NO: 3866824 - RNA, 16 nt, Human
cugcaaacgcugccug

SEQ ID NO: 3866825 - RNA, 19 nt, Human
cugcaaacgcugccugccg

SEQ ID NO: 3866826 - RNA, 13 nt, Human
cugcaaacuggga

SEQ ID NO: 3866827 - RNA, 16 nt, Human
cugcaaacugggaacc

SEQ ID NO: 3866828 - RNA, 15 nt, Human
cugcaaaggaaauac

SEQ ID NO: 3866829 - RNA, 23 nt, Human
cugcaaaggacagauccagggac

SEQ ID NO: 3866830 - RNA, 21 nt, Human
cugcaaaggguaucaggugcu

SEQ ID NO: 3866831 - RNA, 21 nt, Human
cugcaaaguacagguacuuug

SEQ ID NO: 3866832 - RNA, 23 nt, Human
cugcaaaguacagguacuuuguc

SEQ ID NO: 3866833 - RNA, 17 nt, Human
cugcaaauagaaaacag

SEQ ID NO: 3866834 - RNA, 15 nt, Human
cugcaaaugucauca

SEQ ID NO: 3866835 - RNA, 21 nt, Human
cugcaacaaaauguagaauau

SEQ ID NO: 3866836 - RNA, 20 nt, Human
cugcaacaggaacugugaga

SEQ ID NO: 3866837 - RNA, 13 nt, Human
cugcaaccuccac

SEQ ID NO: 3866838 - RNA, 14 nt, Human
cugcaaccuccacc

SEQ ID NO: 3866839 - RNA, 13 nt, Human
cugcaaccuccgc

SEQ ID NO: 3866840 - RNA, 15 nt, Human
cugcaaccuguugau

SEQ ID NO: 3866841 - RNA, 20 nt, Human
cugcaaccuucgccaccugg

SEQ ID NO: 3866842 - RNA, 20 nt, Human
cugcaaccuuguuuauuaaa

SEQ ID NO: 3866843 - RNA, 17 nt, Human
cugcaacggcuuagacu

SEQ ID NO: 3866844 - RNA, 15 nt, Human
cugcaacuucugccu

SEQ ID NO: 3866845 - RNA, 14 nt, Human
cugcaagagccuug

SEQ ID NO: 3866846 - RNA, 21 nt, Human
cugcaagagccuuggugucca

SEQ ID NO: 3866847 - RNA, 18 nt, Human
cugcaagaggcuccuguc

SEQ ID NO: 3866848 - RNA, 14 nt, Human
cugcaagcacagcc

SEQ ID NO: 3866849 - RNA, 19 nt, Human
cugcaaggacauucuugua

SEQ ID NO: 3866850 - RNA, 19 nt, Human
cugcaaggcccacaggagg

SEQ ID NO: 3866851 - RNA, 13 nt, Human
cugcaaggccuuu

SEQ ID NO: 3866852 - RNA, 16 nt, Human
cugcaagguacucugg

SEQ ID NO: 3866853 - RNA, 17 nt, Human
cugcaaggucuuugguu

SEQ ID NO: 3866854 - RNA, 20 nt, Human
cugcaagguuuaggcuggug

SEQ ID NO: 3866855 - RNA, 13 nt, Human
cugcauuugugaa

SEQ ID NO: 3866856 - RNA, 20 nt, Human
cugcauuuuaauuuuaacca

SEQ ID NO: 3866857 - RNA, 17 nt, Human
cugcauuuuucugcaga

SEQ ID NO: 3866858 - RNA, 16 nt, Human
cugccaaaaugcucua

SEQ ID NO: 3866859 - RNA, 16 nt, Human
cugccaaaggauguga

SEQ ID NO: 3866860 - RNA, 22 nt, Human
cugccaaaggaugugauauaua

SEQ ID NO: 3866861 - RNA, 15 nt, Human
cugccaaccauaccu

SEQ ID NO: 3866862 - RNA, 21 nt, Human
cugccaaccauaccuuccuuc

SEQ ID NO: 3866863 - RNA, 22 nt, Human
cugccaaccauaccuuccuucc

SEQ ID NO: 3866864 - RNA, 21 nt, Human
cugccaacuucuucagagcug

SEQ ID NO: 3866865 - RNA, 17 nt, Human
cugccaagacugcugug

SEQ ID NO: 3866866 - RNA, 20 nt, Human
cugccaagacugcuguggcc

SEQ ID NO: 3866867 - RNA, 17 nt, Human
cugccaauaacauucuu

SEQ ID NO: 3866868 - RNA, 18 nt, Human
cugccaauauccuaauaa

SEQ ID NO: 3866869 - RNA, 19 nt, Human
cugccaauauccuaauaaa

SEQ ID NO: 3866870 - RNA, 22 nt, Human
cugccaauauccuaauaaaaag

SEQ ID NO: 3866871 - RNA, 17 nt, Human
cugccaaugggagcuca

SEQ ID NO: 3866872 - RNA, 19 nt, Human
cugccacaaggaagaaauu

SEQ ID NO: 3866873 - RNA, 13 nt, Human
cugccacacaaac

SEQ ID NO: 3866874 - RNA, 22 nt, Human
cugccacacaaacguauguaaa

SEQ ID NO: 3866875 - RNA, 15 nt, Human
cugccacacucugac

SEQ ID NO: 3866876 - RNA, 16 nt, Human
cugccacacucugacg

SEQ ID NO: 3866877 - RNA, 13 nt, Human
cugccacacuuca

SEQ ID NO: 3866878 - RNA, 15 nt, Human
cugccaccaaaggcc

SEQ ID NO: 3866879 - RNA, 18 nt, Human
cugccaccaaaggccagg

SEQ ID NO: 3866880 - RNA, 15 nt, Human
cugccaccagagacc

SEQ ID NO: 3866881 - RNA, 15 nt, Human
cugccaccaggccac

SEQ ID NO: 3866882 - RNA, 18 nt, Human
cugccaccaggccaccuc

SEQ ID NO: 3866883 - RNA, 12 nt, Human
cugccaccaguc

SEQ ID NO: 3866884 - RNA, 15 nt, Human
cugccacccaccucc

SEQ ID NO: 3866885 - RNA, 18 nt, Human
cugccacccaccucccug

SEQ ID NO: 3866886 - RNA, 20 nt, Human
cugccacccaccucccugcc

SEQ ID NO: 3866887 - RNA, 22 nt, Human
cugccacccaccucccugccuc

SEQ ID NO: 3866888 - RNA, 14 nt, Human
cugccacccaggau

SEQ ID NO: 3866889 - RNA, 12 nt, Human
cugccaccccua

SEQ ID NO: 3866890 - RNA, 19 nt, Human
cugccacccuaccuguuca

SEQ ID NO: 3866891 - RNA, 16 nt, Human
cugccacccuggggag

SEQ ID NO: 3866892 - RNA, 21 nt, Human
cugccacccuggggagaaagu

SEQ ID NO: 3866893 - RNA, 15 nt, Human
cugccacccuguagc

SEQ ID NO: 3866894 - RNA, 11 nt, Human
cugccaccucc

SEQ ID NO: 3866895 - RNA, 22 nt, Human
cugccaccuccccuauccaccc

SEQ ID NO: 3866896 - RNA, 18 nt, Human
cugccaccuccccuugcc

SEQ ID NO: 3866897 - RNA, 14 nt, Human
cugccaccuccugc

SEQ ID NO: 3866898 - RNA, 12 nt, Human
cugccaccugga

SEQ ID NO: 3866899 - RNA, 14 nt, Human
cugccaccuggacc

SEQ ID NO: 3866900 - RNA, 16 nt, Human
cugccacuaggcuggg

SEQ ID NO: 3866901 - RNA, 22 nt, Human
cugccacuaggcugggugccca

SEQ ID NO: 3866902 - RNA, 23 nt, Human
cugccacuaggcugggugcccac

SEQ ID NO: 3866903 - RNA, 13 nt, Human
cugccacucacac

SEQ ID NO: 3866904 - RNA, 15 nt, Human
cugccacucacacag

SEQ ID NO: 3866905 - RNA, 24 nt, Human
cugccacucacacagccaggugcc

SEQ ID NO: 3866906 - RNA, 14 nt, Human
cugccacugagggg

SEQ ID NO: 3866907 - RNA, 17 nt, Human
cugccagacccccugga

SEQ ID NO: 3866908 - RNA, 19 nt, Human
cugccagacccccuggaga

SEQ ID NO: 3866909 - RNA, 11 nt, Human
cugccagagaa

SEQ ID NO: 3866910 - RNA, 20 nt, Human
cugccagagaagcaucggag

SEQ ID NO: 3866911 - RNA, 10 nt, Human
cugccagagg

SEQ ID NO: 3866912 - RNA, 19 nt, Human
cugccagcagcagcaggug

SEQ ID NO: 3866913 - RNA, 12 nt, Human
cugccagccagc

SEQ ID NO: 3866914 - RNA, 16 nt, Human
cugccagccagcagcc

SEQ ID NO: 3866915 - RNA, 13 nt, Human
cugccagccuggc

SEQ ID NO: 3866916 - RNA, 19 nt, Human
cugccagccuggcuucugg

SEQ ID NO: 3866917 - RNA, 23 nt, Human
cugccagccuggcuucuggagcc

SEQ ID NO: 3866918 - RNA, 13 nt, Human
cugccagccuuga

SEQ ID NO: 3866919 - RNA, 13 nt, Human
cugccagcugcac

SEQ ID NO: 3866920 - RNA, 13 nt, Human
cugccaggaagcc

SEQ ID NO: 3866921 - RNA, 15 nt, Human
cugccaggaagccag

SEQ ID NO: 3866922 - RNA, 19 nt, Human
cugccaggaagccagcagg

SEQ ID NO: 3866923 - RNA, 21 nt, Human
cugccaggaagccagcaggcu

SEQ ID NO: 3866924 - RNA, 11 nt, Human
cugccaggaga

SEQ ID NO: 3866925 - RNA, 20 nt, Human
cugccaggagcacggcucug

SEQ ID NO: 3866926 - RNA, 15 nt, Human
cugccaggagcuuug

SEQ ID NO: 3866927 - RNA, 21 nt, Human
cugccaggaggacccagggcu

SEQ ID NO: 3866928 - RNA, 18 nt, Human
cugccaggagggacaaag

SEQ ID NO: 3866929 - RNA, 14 nt, Human
cugccaggcacagg

SEQ ID NO: 3866930 - RNA, 17 nt, Human
cugccaggcacaggcag

SEQ ID NO: 3866931 - RNA, 17 nt, Human
cugccaggcaggggugg

SEQ ID NO: 3866932 - RNA, 23 nt, Human
cugccaggccagccuccgagagg

SEQ ID NO: 3866933 - RNA, 22 nt, Human
cugccaggcccccaagccugca

SEQ ID NO: 3866934 - RNA, 20 nt, Human
cugccagggacagagggggu

SEQ ID NO: 3866935 - RNA, 16 nt, Human
cugccagggagacaga

SEQ ID NO: 3866936 - RNA, 13 nt, Human
cugccagggagcu

SEQ ID NO: 3866937 - RNA, 13 nt, Human
cugccagggcagg

SEQ ID NO: 3866938 - RNA, 19 nt, Human
cugccagggccccucuccc

SEQ ID NO: 3866939 - RNA, 20 nt, Human
cugccagggccccucucccc

SEQ ID NO: 3866940 - RNA, 16 nt, Human
cugccaguccuguccu

SEQ ID NO: 3866941 - RNA, 12 nt, Human
cugccagugaca

SEQ ID NO: 3866942 - RNA, 16 nt, Human
cugccagugacagaca

SEQ ID NO: 3866943 - RNA, 19 nt, Human
cugccagugacagacaggc

SEQ ID NO: 3866944 - RNA, 12 nt, Human
cugccagugccu

SEQ ID NO: 3866945 - RNA, 14 nt, Human
cugccagugccuua

SEQ ID NO: 3866946 - RNA, 21 nt, Human
cugccagugccuuaccuccug

SEQ ID NO: 3866947 - RNA, 20 nt, Human
cugccaguggggccugaggc

SEQ ID NO: 3866948 - RNA, 15 nt, Human
cugccaguguggaac

SEQ ID NO: 3866949 - RNA, 22 nt, Human
cugccauauucuguuggccagu

SEQ ID NO: 3866950 - RNA, 23 nt, Human
cugccauauucuguuggccagug

SEQ ID NO: 3866951 - RNA, 19 nt, Human
cugccauccagguucagcu

SEQ ID NO: 3866952 - RNA, 16 nt, Human
cugccauccuggccca

SEQ ID NO: 3866953 - RNA, 18 nt, Human
cugccauccuggcccagg

SEQ ID NO: 3866954 - RNA, 19 nt, Human
cugccauccuggcccaggg

SEQ ID NO: 3866955 - RNA, 23 nt, Human
cugccauccuggcccagggcauc

SEQ ID NO: 3866956 - RNA, 14 nt, Human
cugccaucuagcca

SEQ ID NO: 3866957 - RNA, 21 nt, Human
cugccaucucaccuccugcug

SEQ ID NO: 3866958 - RNA, 15 nt, Human
cugccaucuucccag

SEQ ID NO: 3866959 - RNA, 18 nt, Human
cugccaucuucccagcag

SEQ ID NO: 3866960 - RNA, 23 nt, Human
cugccaugaacuggaggccagga

SEQ ID NO: 3866961 - RNA, 21 nt, Human
cugccauggcgugucccucuc

SEQ ID NO: 3866962 - RNA, 22 nt, Human
cugccauggcgugucccucucg

SEQ ID NO: 3866963 - RNA, 16 nt, Human
cugccauguugccccu

SEQ ID NO: 3866964 - RNA, 23 nt, Human
cugccauuacagagguauuaaaa

SEQ ID NO: 3866965 - RNA, 15 nt, Human
cugccauuauuuucu

SEQ ID NO: 3866966 - RNA, 16 nt, Human
cugcccaauuggagga

SEQ ID NO: 3866967 - RNA, 19 nt, Human
cugcccacaccuccugggg

SEQ ID NO: 3866968 - RNA, 13 nt, Human
cugcccacccccu

SEQ ID NO: 3866969 - RNA, 15 nt, Human
cugcccacccccuca

SEQ ID NO: 3866970 - RNA, 15 nt, Human
cugcccaccugccug

SEQ ID NO: 3866971 - RNA, 18 nt, Human
cugcccaccugccuggcc

SEQ ID NO: 3866972 - RNA, 17 nt, Human
cugcccaccuggccucu

SEQ ID NO: 3866973 - RNA, 17 nt, Human
cugcccacucccaggac

SEQ ID NO: 3866974 - RNA, 14 nt, Human
cugcccacucccug

SEQ ID NO: 3866975 - RNA, 15 nt, Human
cugcccacucccugc

SEQ ID NO: 3866976 - RNA, 23 nt, Human
cugcccacuguuucucuugagcu

SEQ ID NO: 3866977 - RNA, 20 nt, Human
cugcccagaauucccagcug

SEQ ID NO: 3866978 - RNA, 22 nt, Human
cugcccagaauucccagcuguc

SEQ ID NO: 3866979 - RNA, 17 nt, Human
cugcccagacaagauuu

SEQ ID NO: 3866980 - RNA, 22 nt, Human
cugcccagaccccucuggccag

SEQ ID NO: 3866981 - RNA, 23 nt, Human
cugcccagaccccucuggccagg

SEQ ID NO: 3866982 - RNA, 20 nt, Human
cugcccagaucagccagaag

SEQ ID NO: 3866983 - RNA, 17 nt, Human
cugcccagccuccaagc

SEQ ID NO: 3866984 - RNA, 22 nt, Human
cugcccagcggacaguggcagg

SEQ ID NO: 3866985 - RNA, 14 nt, Human
cugcccagcuuggg

SEQ ID NO: 3866986 - RNA, 17 nt, Human
cugcccagcuugggccc

SEQ ID NO: 3866987 - RNA, 19 nt, Human
cugcccagcuugggcccag

SEQ ID NO: 3866988 - RNA, 22 nt, Human
cugcccagcuugggcccagcug

SEQ ID NO: 3866989 - RNA, 12 nt, Human
cugcccaggaga

SEQ ID NO: 3866990 - RNA, 18 nt, Human
cugcccaggagagccagc

SEQ ID NO: 3866991 - RNA, 19 nt, Human
cugcccaggagagccagcc

SEQ ID NO: 3866992 - RNA, 14 nt, Human
cugcccaggcacug

SEQ ID NO: 3866993 - RNA, 16 nt, Human
cugcccaggccccugc

SEQ ID NO: 3866994 - RNA, 22 nt, Human
cugcccaggccggccagccuca

SEQ ID NO: 3866995 - RNA, 18 nt, Human
cugcccaggccugccugu

SEQ ID NO: 3866996 - RNA, 19 nt, Human
cugcccaggccugccuguu

SEQ ID NO: 3866997 - RNA, 18 nt, Human
cugcccaggggugccccc

SEQ ID NO: 3866998 - RNA, 19 nt, Human
cugcccaggggugcccccu

SEQ ID NO: 3866999 - RNA, 13 nt, Human
cuggcuucucuga

SEQ ID NO: 3867000 - RNA, 16 nt, Human
cuggcuucuguggggc

SEQ ID NO: 3867001 - RNA, 19 nt, Human
cuggcuucuguggggcccc

SEQ ID NO: 3867002 - RNA, 18 nt, Human
cuggcuuggccacagcca

SEQ ID NO: 3867003 - RNA, 23 nt, Human
cuggcuugggacuaaaugcccug

SEQ ID NO: 3867004 - RNA, 17 nt, Human
cuggcuuguuguaaagc

SEQ ID NO: 3867005 - RNA, 20 nt, Human
cuggcuuguuguaaagcaau

SEQ ID NO: 3867006 - RNA, 13 nt, Human
cuggcuuguuuau

SEQ ID NO: 3867007 - RNA, 22 nt, Human
cuggcuuucaacuguuucuaga

SEQ ID NO: 3867008 - RNA, 14 nt, Human
cuggcuuuguccca

SEQ ID NO: 3867009 - RNA, 20 nt, Human
cuggcuuuucacugcuggcu

SEQ ID NO: 3867010 - RNA, 23 nt, Human
cuggcuuuucacugcuggcugcc

SEQ ID NO: 3867011 - RNA, 23 nt, Human
cugggaaaaacuuuggaaccaga

SEQ ID NO: 3867012 - RNA, 12 nt, Human
cugggaaacacu

SEQ ID NO: 3867013 - RNA, 18 nt, Human
cugggaaacacuccuugc

SEQ ID NO: 3867014 - RNA, 16 nt, Human
cugggaaacagaggcu

SEQ ID NO: 3867015 - RNA, 18 nt, Human
cugggaaagccccugccc

SEQ ID NO: 3867016 - RNA, 20 nt, Human
cugggaaagggauuuucagc

SEQ ID NO: 3867017 - RNA, 19 nt, Human
cugggaaaugagaaggcag

SEQ ID NO: 3867018 - RNA, 21 nt, Human
cugggaaaugagaaggcagcc

SEQ ID NO: 3867019 - RNA, 23 nt, Human
cugggaaaugagaaggcagccac

SEQ ID NO: 3867020 - RNA, 14 nt, Human
cugggaaaugagau

SEQ ID NO: 3867021 - RNA, 19 nt, Human
cugggaacaccauagguca

SEQ ID NO: 3867022 - RNA, 22 nt, Human
cugggaacccaaguccaagcau

SEQ ID NO: 3867023 - RNA, 13 nt, Human
cugggaaccuccc

SEQ ID NO: 3867024 - RNA, 16 nt, Human
cugggaaccucccaga

SEQ ID NO: 3867025 - RNA, 21 nt, Human
cugggaaccucccagaggucc

SEQ ID NO: 3867026 - RNA, 23 nt, Human
cugggaacucccaagaacagcag

SEQ ID NO: 3867027 - RNA, 15 nt, Human
cugggaacugcagac

SEQ ID NO: 3867028 - RNA, 18 nt, Human
cugggaacugcagaccug

SEQ ID NO: 3867029 - RNA, 20 nt, Human
cugggaacugcagaccuguc

SEQ ID NO: 3867030 - RNA, 21 nt, Human
cugggaacugcagaccugucc

SEQ ID NO: 3867031 - RNA, 23 nt, Human
cugggaacugcagaccuguccuc

SEQ ID NO: 3867032 - RNA, 18 nt, Human
cugggaagauaggcucug

SEQ ID NO: 3867033 - RNA, 21 nt, Human
cugggaagauaggcucugcac

SEQ ID NO: 3867034 - RNA, 22 nt, Human
cugggaagauaggcucugcaca

SEQ ID NO: 3867035 - RNA, 19 nt, Human
cugggaagcugagggcaaa

SEQ ID NO: 3867036 - RNA, 20 nt, Human
cugggaaggcuacucaccuu

SEQ ID NO: 3867037 - RNA, 12 nt, Human
cugggaaggggu

SEQ ID NO: 3867038 - RNA, 20 nt, Human
cugggaauggaggggcagag

SEQ ID NO: 3867039 - RNA, 19 nt, Human
cugggaauguauuauucug

SEQ ID NO: 3867040 - RNA, 21 nt, Human
cugggaccacaggugcccgcc

SEQ ID NO: 3867041 - RNA, 16 nt, Human
cugggaccacgugaga

SEQ ID NO: 3867042 - RNA, 18 nt, Human
cugggaccaggcaccagg

SEQ ID NO: 3867043 - RNA, 15 nt, Human
cugggacccuuuccu

SEQ ID NO: 3867044 - RNA, 23 nt, Human
cugggacccuuuccuuccuuccc

SEQ ID NO: 3867045 - RNA, 17 nt, Human
cugggaccgcuacacca

SEQ ID NO: 3867046 - RNA, 22 nt, Human
cugggaccgcuacaccacucug

SEQ ID NO: 3867047 - RNA, 24 nt, Human
cugggaccgcuacaccacucuggc

SEQ ID NO: 3867048 - RNA, 16 nt, Human
cugggaccuccccuga

SEQ ID NO: 3867049 - RNA, 18 nt, Human
cugggaccugccaggcag

SEQ ID NO: 3867050 - RNA, 19 nt, Human
cugggaccugccaggcagg

SEQ ID NO: 3867051 - RNA, 20 nt, Human
cugggaccugccaggcaggg

SEQ ID NO: 3867052 - RNA, 20 nt, Human
cugggaccuuuagugguggc

SEQ ID NO: 3867053 - RNA, 17 nt, Human
cugggacgcucugcugu

SEQ ID NO: 3867054 - RNA, 23 nt, Human
cugggacguggcucagccagcac

SEQ ID NO: 3867055 - RNA, 13 nt, Human
cugggacuacagg

SEQ ID NO: 3867056 - RNA, 17 nt, Human
cugggacuacaggcacc

SEQ ID NO: 3867057 - RNA, 16 nt, Human
cugggacucagccuuc

SEQ ID NO: 3867058 - RNA, 18 nt, Human
cugggacucagccuucag

SEQ ID NO: 3867059 - RNA, 14 nt, Human
cugggacuggccag

SEQ ID NO: 3867060 - RNA, 14 nt, Human
cugggacuuccaug

SEQ ID NO: 3867061 - RNA, 19 nt, Human
cugggacuuccaugccuua

SEQ ID NO: 3867062 - RNA, 18 nt, Human
cugggagaaaaucaucaa

SEQ ID NO: 3867063 - RNA, 18 nt, Human
cugggagaaauugacaga

SEQ ID NO: 3867064 - RNA, 15 nt, Human
cugggagaaccucag

SEQ ID NO: 3867065 - RNA, 18 nt, Human
cugggagaaccucaggcu

SEQ ID NO: 3867066 - RNA, 18 nt, Human
cugggagagccuuccagg

SEQ ID NO: 3867067 - RNA, 20 nt, Human
cugggagagccuuccagggg

SEQ ID NO: 3867068 - RNA, 21 nt, Human
cugggagagccuuccaggggu

SEQ ID NO: 3867069 - RNA, 23 nt, Human
cugggagaggcagagugccccac

SEQ ID NO: 3867070 - RNA, 24 nt, Human
cugggagaggcagagugccccacc

SEQ ID NO: 3867071 - RNA, 23 nt, Human
cugggagaggugccagcaacuga

SEQ ID NO: 3867072 - RNA, 17 nt, Human
cugggagcccccagccu

SEQ ID NO: 3867073 - RNA, 19 nt, Human
cugggagccgggccgcaga

SEQ ID NO: 3867074 - RNA, 20 nt, Human
cugggagcuccacucugcuu

SEQ ID NO: 3867075 - RNA, 13 nt, Human
cugggagcucugc

SEQ ID NO: 3867076 - RNA, 14 nt, Human
cugggagcucugca

SEQ ID NO: 3867077 - RNA, 22 nt, Human
cugggaggaaaagaaaagaggg

SEQ ID NO: 3867078 - RNA, 14 nt, Human
cugggaggaagcag

SEQ ID NO: 3867079 - RNA, 14 nt, Human
cugggaggaaggac

SEQ ID NO: 3867080 - RNA, 17 nt, Human
cugggaggagggagagg

SEQ ID NO: 3867081 - RNA, 23 nt, Human
cugggaggagggagagggagguc

SEQ ID NO: 3867082 - RNA, 18 nt, Human
cugggaggcaagaggggu

SEQ ID NO: 3867083 - RNA, 23 nt, Human
cugggaggcaagagggguggaga

SEQ ID NO: 3867084 - RNA, 16 nt, Human
cugggaggcagugaug

SEQ ID NO: 3867085 - RNA, 13 nt, Human
cugggaggcaugg

SEQ ID NO: 3867086 - RNA, 14 nt, Human
cugggaggccagug

SEQ ID NO: 3867087 - RNA, 22 nt, Human
cugggaggcggagaguacagug

SEQ ID NO: 3867088 - RNA, 17 nt, Human
cugggaggcgggcgcac

SEQ ID NO: 3867089 - RNA, 15 nt, Human
cugggaggcucugga

SEQ ID NO: 3867090 - RNA, 13 nt, Human
cugggagggcagc

SEQ ID NO: 3867091 - RNA, 20 nt, Human
cugggagggcccacuucagg

SEQ ID NO: 3867092 - RNA, 20 nt, Human
cugggaggucaaggcugcag

SEQ ID NO: 3867093 - RNA, 21 nt, Human
cugggaggucaaggcugcagu

SEQ ID NO: 3867094 - RNA, 21 nt, Human
cugggaguaguugucuuuccu

SEQ ID NO: 3867095 - RNA, 16 nt, Human
cugggagucacacagu

SEQ ID NO: 3867096 - RNA, 13 nt, Human
cugggaguccccu

SEQ ID NO: 3867097 - RNA, 13 nt, Human
cugggagugagcu

SEQ ID NO: 3867098 - RNA, 16 nt, Human
cugggaguguguggug

SEQ ID NO: 3867099 - RNA, 15 nt, Human
cugggauagaggggu

SEQ ID NO: 3867100 - RNA, 20 nt, Human
cugggaucccucauccucau

SEQ ID NO: 3867101 - RNA, 21 nt, Human
cugggaugaaacuaaagcaau

SEQ ID NO: 3867102 - RNA, 22 nt, Human
cugggaugagccgcugugagcc

SEQ ID NO: 3867103 - RNA, 16 nt, Human
cugggauggugggcuu

SEQ ID NO: 3867104 - RNA, 20 nt, Human
cugggauggugggcuucagg

SEQ ID NO: 3867105 - RNA, 14 nt, Human
cugggauguccaca

SEQ ID NO: 3867106 - RNA, 21 nt, Human
cugggauguccacagaugccu

SEQ ID NO: 3867107 - RNA, 15 nt, Human
cugggauguggcugc

SEQ ID NO: 3867108 - RNA, 20 nt, Human
cugggauguggcugcagcag

SEQ ID NO: 3867109 - RNA, 20 nt, Human
cugggauuacaggcaugagc

SEQ ID NO: 3867110 - RNA, 17 nt, Human
cugggauuacaggugug

SEQ ID NO: 3867111 - RNA, 18 nt, Human
cugggauuacagguguga

SEQ ID NO: 3867112 - RNA, 17 nt, Human
cugggauucccaccaag

SEQ ID NO: 3867113 - RNA, 23 nt, Human
cugggauuccuuagacucuuuuc

SEQ ID NO: 3867114 - RNA, 21 nt, Human
cugggauucuacuuuaagcac

SEQ ID NO: 3867115 - RNA, 22 nt, Human
cugggauucuacuuuaagcacu

SEQ ID NO: 3867116 - RNA, 21 nt, Human
cugggauuuaugcucaugaac

SEQ ID NO: 3867117 - RNA, 21 nt, Human
cugggauuuuaaacuagauga

SEQ ID NO: 3867118 - RNA, 23 nt, Human
cugggauuuuaaacuagaugacc

SEQ ID NO: 3867119 - RNA, 18 nt, Human
cugggcaacagagcaaga

SEQ ID NO: 3867120 - RNA, 17 nt, Human
cugggcaaggaaaaaga

SEQ ID NO: 3867121 - RNA, 15 nt, Human
cugggcaaggaggcc

SEQ ID NO: 3867122 - RNA, 19 nt, Human
cugggcaaugauggcaauu

SEQ ID NO: 3867123 - RNA, 20 nt, Human
cugggcaaugugauaaaacc

SEQ ID NO: 3867124 - RNA, 15 nt, Human
cugggcacacgcugc

SEQ ID NO: 3867125 - RNA, 22 nt, Human
cugggcacacucugccagcaaa

SEQ ID NO: 3867126 - RNA, 16 nt, Human
cugggcacccucccac

SEQ ID NO: 3867127 - RNA, 17 nt, Human
cugggcacccucccacc

SEQ ID NO: 3867128 - RNA, 18 nt, Human
cugggcacuucccugcug

SEQ ID NO: 3867129 - RNA, 17 nt, Human
cugggcagaaggaagac

SEQ ID NO: 3867130 - RNA, 12 nt, Human
cugggcagagga

SEQ ID NO: 3867131 - RNA, 18 nt, Human
cugggcagccaggcugcc

SEQ ID NO: 3867132 - RNA, 12 nt, Human
cugggcagcccg

SEQ ID NO: 3867133 - RNA, 11 nt, Human
cugggcagcua

SEQ ID NO: 3867134 - RNA, 15 nt, Human
cugggcagcugccuc

SEQ ID NO: 3867135 - RNA, 21 nt, Human
cugggcagcugccuccccucc

SEQ ID NO: 3867136 - RNA, 17 nt, Human
cugggcagcugucccuu

SEQ ID NO: 3867137 - RNA, 19 nt, Human
cugggcagcugucccuugc

SEQ ID NO: 3867138 - RNA, 13 nt, Human
cugggcaggaggg

SEQ ID NO: 3867139 - RNA, 20 nt, Human
cugggcagguuggugggggc

SEQ ID NO: 3867140 - RNA, 15 nt, Human
cugggcaucuguucu

SEQ ID NO: 3867141 - RNA, 23 nt, Human
cugggcaugagggguuccucccc

SEQ ID NO: 3867142 - RNA, 22 nt, Human
cugguuugacuccgcuggaggu

SEQ ID NO: 3867143 - RNA, 15 nt, Human
cugguuuggaaugcu

SEQ ID NO: 3867144 - RNA, 18 nt, Human
cugguuuuccuaaaugca

SEQ ID NO: 3867145 - RNA, 20 nt, Human
cugguuuucuggaugguucc

SEQ ID NO: 3867146 - RNA, 14 nt, Human
cugguuuuggcauc

SEQ ID NO: 3867147 - RNA, 15 nt, Human
cugguuuuguaagau

SEQ ID NO: 3867148 - RNA, 22 nt, Human
cugguuuuguaagaugcugggu

SEQ ID NO: 3867149 - RNA, 14 nt, Human
cugguuuuucaguu

SEQ ID NO: 3867150 - RNA, 16 nt, Human
cugguuuuucaguuuu

SEQ ID NO: 3867151 - RNA, 20 nt, Human
cuguaaaaacacugaaaaau

SEQ ID NO: 3867152 - RNA, 22 nt, Human
cuguaaaaacacugaaaaauua

SEQ ID NO: 3867153 - RNA, 12 nt, Human
cuguaaaacgcu

SEQ ID NO: 3867154 - RNA, 13 nt, Human
cuguaaaacuuua

SEQ ID NO: 3867155 - RNA, 20 nt, Human
cuguaaaagcaaguccugca

SEQ ID NO: 3867156 - RNA, 22 nt, Human
cuguaaaaucuuucuuucuuag

SEQ ID NO: 3867157 - RNA, 16 nt, Human
cuguaaaaugaaauua

SEQ ID NO: 3867158 - RNA, 14 nt, Human
cuguaaaaugcaaa

SEQ ID NO: 3867159 - RNA, 22 nt, Human
cuguaaaccccuuuaguggcuu

SEQ ID NO: 3867160 - RNA, 12 nt, Human
cuguaaacugug

SEQ ID NO: 3867161 - RNA, 14 nt, Human
cuguaaacugugua

SEQ ID NO: 3867162 - RNA, 19 nt, Human
cuguaaacuuuaucacuua

SEQ ID NO: 3867163 - RNA, 15 nt, Human
cuguaaagaaagaga

SEQ ID NO: 3867164 - RNA, 23 nt, Human
cuguaaagaaagagagaaaauaa

SEQ ID NO: 3867165 - RNA, 20 nt, Human
cuguaaagagaccuaccuca

SEQ ID NO: 3867166 - RNA, 13 nt, Human
cuguaaagcaaaa

SEQ ID NO: 3867167 - RNA, 16 nt, Human
cuguaaagcgcagaua

SEQ ID NO: 3867168 - RNA, 21 nt, Human
cuguaaauaaugugcacugaa

SEQ ID NO: 3867169 - RNA, 15 nt, Human
cuguaaauaccauug

SEQ ID NO: 3867170 - RNA, 17 nt, Human
cuguaaaucuaacauua

SEQ ID NO: 3867171 - RNA, 20 nt, Human
cuguaaauuauuuuaaauua

SEQ ID NO: 3867172 - RNA, 18 nt, Human
cuguaaauuuggcuucug

SEQ ID NO: 3867173 - RNA, 17 nt, Human
cuguaacagguauuuug

SEQ ID NO: 3867174 - RNA, 18 nt, Human
cuguaacaguucuuuuug

SEQ ID NO: 3867175 - RNA, 19 nt, Human
cuguaacauacuggccugg

SEQ ID NO: 3867176 - RNA, 20 nt, Human
cuguaaccucuucagaggcc

SEQ ID NO: 3867177 - RNA, 15 nt, Human
cuguaacgugugcug

SEQ ID NO: 3867178 - RNA, 19 nt, Human
cuguaacuacuuuauaacu

SEQ ID NO: 3867179 - RNA, 14 nt, Human
cuguaacugccagg

SEQ ID NO: 3867180 - RNA, 12 nt, Human
cuguaacugucc

SEQ ID NO: 3867181 - RNA, 17 nt, Human
cuguaacuguuacagua

SEQ ID NO: 3867182 - RNA, 15 nt, Human
cuguaacuuaaaaua

SEQ ID NO: 3867183 - RNA, 13 nt, Human
cuguaagaaaccu

SEQ ID NO: 3867184 - RNA, 22 nt, Human
cuguaagaaaccuacugcccag

SEQ ID NO: 3867185 - RNA, 23 nt, Human
cuguaagaagagacugggaagau

SEQ ID NO: 3867186 - RNA, 21 nt, Human
cuguaagacucauucccuaga

SEQ ID NO: 3867187 - RNA, 19 nt, Human
cuguaagccaaagaaauga

SEQ ID NO: 3867188 - RNA, 21 nt, Human
cuguaaggauccggaaagaag

SEQ ID NO: 3867189 - RNA, 16 nt, Human
cuguaaggcaugaagg

SEQ ID NO: 3867190 - RNA, 17 nt, Human
cuguaaggcaugaagga

SEQ ID NO: 3867191 - RNA, 15 nt, Human
cuguaaggcucuaga

SEQ ID NO: 3867192 - RNA, 16 nt, Human
cuguaaggcucuagau

SEQ ID NO: 3867193 - RNA, 18 nt, Human
cuguaaggcucuagauca

SEQ ID NO: 3867194 - RNA, 20 nt, Human
cuguaaguagaugcauuugg

SEQ ID NO: 3867195 - RNA, 22 nt, Human
cuguaaguugggcuugcuauuc

SEQ ID NO: 3867196 - RNA, 15 nt, Human
cuguaauaauaccuc

SEQ ID NO: 3867197 - RNA, 16 nt, Human
cuguaauaauaccuca

SEQ ID NO: 3867198 - RNA, 23 nt, Human
cuguaauaauaccucaauguuug

SEQ ID NO: 3867199 - RNA, 18 nt, Human
cuguaaucccagcacacu

SEQ ID NO: 3867200 - RNA, 19 nt, Human
cuguaaucccagcacuugg

SEQ ID NO: 3867201 - RNA, 20 nt, Human
cuguaaucccagcacuuugg

SEQ ID NO: 3867202 - RNA, 22 nt, Human
cuguaaucccagcuacucggga

SEQ ID NO: 3867203 - RNA, 18 nt, Human
cuguaaucccagcuacuu

SEQ ID NO: 3867204 - RNA, 20 nt, Human
cuguaauccuagcacuuugg

SEQ ID NO: 3867205 - RNA, 22 nt, Human
cuguaaucucguuucaaaaaca

SEQ ID NO: 3867206 - RNA, 15 nt, Human
cuguaaugaaucuaa

SEQ ID NO: 3867207 - RNA, 18 nt, Human
cuguaaugguacugacuu

SEQ ID NO: 3867208 - RNA, 22 nt, Human
cuguaaugugcgagggacccag

SEQ ID NO: 3867209 - RNA, 17 nt, Human
cuguaauguuaauauug

SEQ ID NO: 3867210 - RNA, 18 nt, Human
cuguaauguuaauauuga

SEQ ID NO: 3867211 - RNA, 14 nt, Human
cuguaauuauuuga

SEQ ID NO: 3867212 - RNA, 15 nt, Human
cuguaauuauuugaa

SEQ ID NO: 3867213 - RNA, 16 nt, Human
cuguaauuauuugaau

SEQ ID NO: 3867214 - RNA, 14 nt, Human
cuguaauucagugu

SEQ ID NO: 3867215 - RNA, 23 nt, Human
cuguaauucaguguauuucaguu

SEQ ID NO: 3867216 - RNA, 23 nt, Human
cuguaauuccagcacuuugggag

SEQ ID NO: 3867217 - RNA, 22 nt, Human
cuguaauuccuaccucccugca

SEQ ID NO: 3867218 - RNA, 17 nt, Human
cuguaauuugugauaca

SEQ ID NO: 3867219 - RNA, 21 nt, Human
cuguaauuugugauacaaugc

SEQ ID NO: 3867220 - RNA, 22 nt, Human
cuguacaaaagggacaugaaau

SEQ ID NO: 3867221 - RNA, 13 nt, Human
cuguacaaaguag

SEQ ID NO: 3867222 - RNA, 15 nt, Human
cuguacaaaguagaa

SEQ ID NO: 3867223 - RNA, 16 nt, Human
cuguacaaauauaaga

SEQ ID NO: 3867224 - RNA, 19 nt, Human
cuguacaaauauaagaaua

SEQ ID NO: 3867225 - RNA, 20 nt, Human
cuguacaaauauaagaauaa

SEQ ID NO: 3867226 - RNA, 15 nt, Human
cuguacaauauuuaa

SEQ ID NO: 3867227 - RNA, 16 nt, Human
cuguacacaacucacu

SEQ ID NO: 3867228 - RNA, 17 nt, Human
cuguacacaacucacuc

SEQ ID NO: 3867229 - RNA, 20 nt, Human
cuguacacaacucacuccuu

SEQ ID NO: 3867230 - RNA, 15 nt, Human
cuguacacacuuuau

SEQ ID NO: 3867231 - RNA, 13 nt, Human
cuguacacugcac

SEQ ID NO: 3867232 - RNA, 23 nt, Human
cuguacagagcccacgcccccac

SEQ ID NO: 3867233 - RNA, 21 nt, Human
cuguacagagccguaaaaacu

SEQ ID NO: 3867234 - RNA, 22 nt, Human
cuguacagagccguaaaaacug

SEQ ID NO: 3867235 - RNA, 22 nt, Human
cuguacagauugcugcuucugc

SEQ ID NO: 3867236 - RNA, 15 nt, Human
cuguacagcuggcuc

SEQ ID NO: 3867237 - RNA, 17 nt, Human
cuguacagcuggcucua

SEQ ID NO: 3867238 - RNA, 11 nt, Human
cuguacagucu

SEQ ID NO: 3867239 - RNA, 16 nt, Human
cuguacagucugucuu

SEQ ID NO: 3867240 - RNA, 20 nt, Human
cuguacagucugucuucugu

SEQ ID NO: 3867241 - RNA, 11 nt, Human
cuguacagugu

SEQ ID NO: 3867242 - RNA, 13 nt, Human
cuguacaguguua

SEQ ID NO: 3867243 - RNA, 16 nt, Human
cuguacauacuuuuug

SEQ ID NO: 3867244 - RNA, 15 nt, Human
cuguacauagccuau

SEQ ID NO: 3867245 - RNA, 16 nt, Human
cuguacauagccuaua

SEQ ID NO: 3867246 - RNA, 19 nt, Human
cuguacauagccuauauuu

SEQ ID NO: 3867247 - RNA, 17 nt, Human
cuguacaugaaaacaca

SEQ ID NO: 3867248 - RNA, 14 nt, Human
cuguacauuuaaaa

SEQ ID NO: 3867249 - RNA, 16 nt, Human
cuguacauuuaaaauu

SEQ ID NO: 3867250 - RNA, 17 nt, Human
cuguacauuuuguugua

SEQ ID NO: 3867251 - RNA, 18 nt, Human
cuguacauuuuguuguaa

SEQ ID NO: 3867252 - RNA, 19 nt, Human
cuguacauuuuguuguaaa

SEQ ID NO: 3867253 - RNA, 20 nt, Human
cuguacauuuuguuguaaaa

SEQ ID NO: 3867254 - RNA, 13 nt, Human
cuguaccucaucc

SEQ ID NO: 3867255 - RNA, 18 nt, Human
cuguaccucaucccauga

SEQ ID NO: 3867256 - RNA, 22 nt, Human
cuguaccuuuugaggagcccca

SEQ ID NO: 3867257 - RNA, 23 nt, Human
cuguaccuuuugaggagccccag

SEQ ID NO: 3867258 - RNA, 13 nt, Human
cuguacucaggag

SEQ ID NO: 3867259 - RNA, 21 nt, Human
cuguacuccucccaggcgccc

SEQ ID NO: 3867260 - RNA, 18 nt, Human
cuguacucgcuugugcag

SEQ ID NO: 3867261 - RNA, 14 nt, Human
cuguacugauucaa

SEQ ID NO: 3867262 - RNA, 14 nt, Human
cuguacugccugcu

SEQ ID NO: 3867263 - RNA, 16 nt, Human
cuguacugccugcuug

SEQ ID NO: 3867264 - RNA, 17 nt, Human
cuguacugccugcuugg

SEQ ID NO: 3867265 - RNA, 19 nt, Human
cuguacugccugcuugggg

SEQ ID NO: 3867266 - RNA, 22 nt, Human
cuguacugcucaggcugcagcu

SEQ ID NO: 3867267 - RNA, 18 nt, Human
cuguacuguuacugggcc

SEQ ID NO: 3867268 - RNA, 20 nt, Human
cuguacuguucugugucuuu

SEQ ID NO: 3867269 - RNA, 13 nt, Human
cuguacuuaauaa

SEQ ID NO: 3867270 - RNA, 18 nt, Human
cuguacuuaauaaauuca

SEQ ID NO: 3867271 - RNA, 22 nt, Human
cuguacuucacugucaggaaga

SEQ ID NO: 3867272 - RNA, 16 nt, Human
cuguacuucuugaaua

SEQ ID NO: 3867273 - RNA, 20 nt, Human
cuguacuugcucuugaugcc

SEQ ID NO: 3867274 - RNA, 21 nt, Human
cuguacuugcucuugaugccu

SEQ ID NO: 3867275 - RNA, 23 nt, Human
cuguacuugcucuugaugccugg

SEQ ID NO: 3867276 - RNA, 17 nt, Human
cuguacuugguccaacu

SEQ ID NO: 3867277 - RNA, 23 nt, Human
cuguacuugguccaacugcaacu

SEQ ID NO: 3867278 - RNA, 12 nt, Human
cuguacuuugau

SEQ ID NO: 3867279 - RNA, 15 nt, Human
cuguacuuugauuca

SEQ ID NO: 3867280 - RNA, 19 nt, Human
cuguacuuugauucacaug

SEQ ID NO: 3867281 - RNA, 19 nt, Human
cuguagaaaagggaacuga

SEQ ID NO: 3867282 - RNA, 17 nt, Human
cuguagaaaugguugua

SEQ ID NO: 3867283 - RNA, 15 nt, Human
cuguagaagagggau

SEQ ID NO: 3867284 - RNA, 19 nt, Human
cuguagaauagccuguggc

SEQ ID NO: 3867285 - RNA, 20 nt, Human
cuguagaauagccuguggcc

SEQ ID NO: 3867286 - RNA, 21 nt, Human
cugucuagcacuuccuugcca

SEQ ID NO: 3867287 - RNA, 22 nt, Human
cugucuaggucaguacccaccu

SEQ ID NO: 3867288 - RNA, 16 nt, Human
cugucuagucucuccu

SEQ ID NO: 3867289 - RNA, 14 nt, Human
cugucuauuucugc

SEQ ID NO: 3867290 - RNA, 15 nt, Human
cugucuauuucugcu

SEQ ID NO: 3867291 - RNA, 16 nt, Human
cugucuauuucugcug

SEQ ID NO: 3867292 - RNA, 17 nt, Human
cugucuauuucugcuga

SEQ ID NO: 3867293 - RNA, 23 nt, Human
cugucucaaaaaaacacaaaagu

SEQ ID NO: 3867294 - RNA, 18 nt, Human
cugucucaaaaaaagaaa

SEQ ID NO: 3867295 - RNA, 18 nt, Human
cugucucaagcucuuccu

SEQ ID NO: 3867296 - RNA, 14 nt, Human
cugucucaccugga

SEQ ID NO: 3867297 - RNA, 21 nt, Human
cugucucagacuuuuguacau

SEQ ID NO: 3867298 - RNA, 22 nt, Human
cugucucagacuuuuguacauc

SEQ ID NO: 3867299 - RNA, 16 nt, Human
cugucucaguuucacu

SEQ ID NO: 3867300 - RNA, 17 nt, Human
cugucucauccaucauc

SEQ ID NO: 3867301 - RNA, 21 nt, Human
cugucucauccaucaucaugu

SEQ ID NO: 3867302 - RNA, 15 nt, Human
cugucucauccccag

SEQ ID NO: 3867303 - RNA, 17 nt, Human
cugucucauccccaggg

SEQ ID NO: 3867304 - RNA, 21 nt, Human
cugucucauccccaggggucc

SEQ ID NO: 3867305 - RNA, 14 nt, Human
cugucucauccucc

SEQ ID NO: 3867306 - RNA, 15 nt, Human
cugucucauccuccu

SEQ ID NO: 3867307 - RNA, 18 nt, Human
cugucuccagacccccac

SEQ ID NO: 3867308 - RNA, 22 nt, Human
cugucuccagacccccaccccu

SEQ ID NO: 3867309 - RNA, 18 nt, Human
cugucuccauguuugaug

SEQ ID NO: 3867310 - RNA, 15 nt, Human
cugucuccccucugc

SEQ ID NO: 3867311 - RNA, 16 nt, Human
cugucuccccucugcu

SEQ ID NO: 3867312 - RNA, 18 nt, Human
cugucuccccucugcugg

SEQ ID NO: 3867313 - RNA, 21 nt, Human
cugucucccuccucugcccgg

SEQ ID NO: 3867314 - RNA, 22 nt, Human
cugucuccuaagcuggagugca

SEQ ID NO: 3867315 - RNA, 23 nt, Human
cugucuccuuucaccccagggcc

SEQ ID NO: 3867316 - RNA, 16 nt, Human
cugucucgagcgcccu

SEQ ID NO: 3867317 - RNA, 23 nt, Human
cugucucgagcgcccugcagacc

SEQ ID NO: 3867318 - RNA, 20 nt, Human
cugucucuaacuuauuuuau

SEQ ID NO: 3867319 - RNA, 19 nt, Human
cugucucucagggccaggc

SEQ ID NO: 3867320 - RNA, 20 nt, Human
cugucucucagggccaggcc

SEQ ID NO: 3867321 - RNA, 13 nt, Human
cugucucucauga

SEQ ID NO: 3867322 - RNA, 19 nt, Human
cugucucugaaguacuaac

SEQ ID NO: 3867323 - RNA, 13 nt, Human
cugucucugccuc

SEQ ID NO: 3867324 - RNA, 17 nt, Human
cugucucugcucgcccu

SEQ ID NO: 3867325 - RNA, 15 nt, Human
cugucucuugaaaaa

SEQ ID NO: 3867326 - RNA, 18 nt, Human
cugucucuugaaaaaugc

SEQ ID NO: 3867327 - RNA, 21 nt, Human
cugucugaaccacgcgggggc

SEQ ID NO: 3867328 - RNA, 16 nt, Human
cugucugaagccaaug

SEQ ID NO: 3867329 - RNA, 22 nt, Human
cugucugaaggacacuuccugc

SEQ ID NO: 3867330 - RNA, 20 nt, Human
cugucugacaaccucuuggu

SEQ ID NO: 3867331 - RNA, 15 nt, Human
cugucugagacucac

SEQ ID NO: 3867332 - RNA, 16 nt, Human
cugucugaucugugcu

SEQ ID NO: 3867333 - RNA, 12 nt, Human
cugucugcagcc

SEQ ID NO: 3867334 - RNA, 14 nt, Human
cugucugccagcca

SEQ ID NO: 3867335 - RNA, 15 nt, Human
cugucugccagccag

SEQ ID NO: 3867336 - RNA, 16 nt, Human
cugucugccagccagc

SEQ ID NO: 3867337 - RNA, 21 nt, Human
cugucugccagccagcagcca

SEQ ID NO: 3867338 - RNA, 14 nt, Human
cugucugccagggc

SEQ ID NO: 3867339 - RNA, 15 nt, Human
cugucugccccagcc

SEQ ID NO: 3867340 - RNA, 12 nt, Human
cugucugcucca

SEQ ID NO: 3867341 - RNA, 19 nt, Human
cugucugcuggucacuucu

SEQ ID NO: 3867342 - RNA, 19 nt, Human
cugucuggaggggagcucu

SEQ ID NO: 3867343 - RNA, 19 nt, Human
cugucuggcaaugccacag

SEQ ID NO: 3867344 - RNA, 15 nt, Human
cugucuggccaggcc

SEQ ID NO: 3867345 - RNA, 17 nt, Human
cugucugggugcuacug

SEQ ID NO: 3867346 - RNA, 22 nt, Human
cugucugggugcuacuggggaa

SEQ ID NO: 3867347 - RNA, 16 nt, Human
cugucuggguggcuca

SEQ ID NO: 3867348 - RNA, 23 nt, Human
cugucugguuucaccgaggacau

SEQ ID NO: 3867349 - RNA, 16 nt, Human
cugucugguuuuaaca

SEQ ID NO: 3867350 - RNA, 17 nt, Human
cugucugguuuuaacaa

SEQ ID NO: 3867351 - RNA, 19 nt, Human
cugucuguagagggcccug

SEQ ID NO: 3867352 - RNA, 16 nt, Human
cugucugucucuccau

SEQ ID NO: 3867353 - RNA, 14 nt, Human
cugucugucugucc

SEQ ID NO: 3867354 - RNA, 15 nt, Human
cugucugucuguccc

SEQ ID NO: 3867355 - RNA, 15 nt, Human
cugucugucugucug

SEQ ID NO: 3867356 - RNA, 17 nt, Human
cugucugugaagagcaa

SEQ ID NO: 3867357 - RNA, 16 nt, Human
cugucuguuacacugg

SEQ ID NO: 3867358 - RNA, 18 nt, Human
cugucuguuacacuggag

SEQ ID NO: 3867359 - RNA, 18 nt, Human
cugucuguuguauucauu

SEQ ID NO: 3867360 - RNA, 14 nt, Human
cugucuuaauuuuc

SEQ ID NO: 3867361 - RNA, 16 nt, Human
cugucuuauccuccac

SEQ ID NO: 3867362 - RNA, 15 nt, Human
cugucuucaagggcu

SEQ ID NO: 3867363 - RNA, 18 nt, Human
cugucuucacaacagauu

SEQ ID NO: 3867364 - RNA, 19 nt, Human
cugucuucacagcucugug

SEQ ID NO: 3867365 - RNA, 23 nt, Human
cugucuucacagcucuguguugc

SEQ ID NO: 3867366 - RNA, 18 nt, Human
cugucuucaccugauuca

SEQ ID NO: 3867367 - RNA, 14 nt, Human
cugucuuccucaaa

SEQ ID NO: 3867368 - RNA, 13 nt, Human
cugucuuccuuug

SEQ ID NO: 3867369 - RNA, 23 nt, Human
cugucuucucccugcacaagcca

SEQ ID NO: 3867370 - RNA, 13 nt, Human
cugucuucugcuu

SEQ ID NO: 3867371 - RNA, 14 nt, Human
cugucuucugcuuu

SEQ ID NO: 3867372 - RNA, 16 nt, Human
cugucuucugcuuugu

SEQ ID NO: 3867373 - RNA, 23 nt, Human
cugucuucugcuuuguugugugc

SEQ ID NO: 3867374 - RNA, 21 nt, Human
cugucuucuguauauaaaugg

SEQ ID NO: 3867375 - RNA, 21 nt, Human
cugucuugccuuuuucauuau

SEQ ID NO: 3867376 - RNA, 12 nt, Human
cugucuuguaau

SEQ ID NO: 3867377 - RNA, 14 nt, Human
cugucuuguaauau

SEQ ID NO: 3867378 - RNA, 17 nt, Human
cugucuuuaaaagagag

SEQ ID NO: 3867379 - RNA, 18 nt, Human
cugucuuuaaaagagaga

SEQ ID NO: 3867380 - RNA, 20 nt, Human
cugucuuuacuccucacacu

SEQ ID NO: 3867381 - RNA, 15 nt, Human
cugucuuucagauac

SEQ ID NO: 3867382 - RNA, 17 nt, Human
cugucuuuccacucugg

SEQ ID NO: 3867383 - RNA, 20 nt, Human
cugucuuuccuaagaccugg

SEQ ID NO: 3867384 - RNA, 13 nt, Human
cugucuuuccuag

SEQ ID NO: 3867385 - RNA, 20 nt, Human
cugucuuuccuagauggcag

SEQ ID NO: 3867386 - RNA, 18 nt, Human
cugucuuuccugaaccau

SEQ ID NO: 3867387 - RNA, 23 nt, Human
cugucuuucugagcacacuuuag

SEQ ID NO: 3867388 - RNA, 14 nt, Human
cugucuuucuugcu

SEQ ID NO: 3867389 - RNA, 18 nt, Human
cugucuuucuugcucccu

SEQ ID NO: 3867390 - RNA, 20 nt, Human
cugucuuucuugcucccuga

SEQ ID NO: 3867391 - RNA, 22 nt, Human
cugucuuucuugcucccugacu

SEQ ID NO: 3867392 - RNA, 23 nt, Human
cugucuuucuugcucccugacug

SEQ ID NO: 3867393 - RNA, 14 nt, Human
cugucuuuggaaaa

SEQ ID NO: 3867394 - RNA, 13 nt, Human
cugugaaaccugu

SEQ ID NO: 3867395 - RNA, 16 nt, Human
cugugaaaugcuggca

SEQ ID NO: 3867396 - RNA, 22 nt, Human
cugugaaauucccaacaaacau

SEQ ID NO: 3867397 - RNA, 21 nt, Human
cugugaacaagcuucaguaag

SEQ ID NO: 3867398 - RNA, 15 nt, Human
cugugaacaggcugg

SEQ ID NO: 3867399 - RNA, 18 nt, Human
cugugaacauggacucuu

SEQ ID NO: 3867400 - RNA, 14 nt, Human
cugugaacccagga

SEQ ID NO: 3867401 - RNA, 16 nt, Human
cugugaacccaggaca

SEQ ID NO: 3867402 - RNA, 19 nt, Human
cugugaacccuggggccug

SEQ ID NO: 3867403 - RNA, 16 nt, Human
cugugaacuuggggaa

SEQ ID NO: 3867404 - RNA, 15 nt, Human
cugugaagagaacca

SEQ ID NO: 3867405 - RNA, 14 nt, Human
cugugaaggacccu

SEQ ID NO: 3867406 - RNA, 18 nt, Human
cugugaaguccuucaccu

SEQ ID NO: 3867407 - RNA, 23 nt, Human
cugugaaguuuacauuguaaaua

SEQ ID NO: 3867408 - RNA, 18 nt, Human
cugugaaucaccuagggg

SEQ ID NO: 3867409 - RNA, 17 nt, Human
cugugaauccagugaaa

SEQ ID NO: 3867410 - RNA, 20 nt, Human
cugugaaugccacugccuuc

SEQ ID NO: 3867411 - RNA, 21 nt, Human
cugugaaugccacugccuucg

SEQ ID NO: 3867412 - RNA, 15 nt, Human
cugugaauucagauu

SEQ ID NO: 3867413 - RNA, 15 nt, Human
cugugaauugagcug

SEQ ID NO: 3867414 - RNA, 23 nt, Human
cugugaauugagcugcagaaacg

SEQ ID NO: 3867415 - RNA, 14 nt, Human
cugugacacacuac

SEQ ID NO: 3867416 - RNA, 15 nt, Human
cugugacaggcagca

SEQ ID NO: 3867417 - RNA, 16 nt, Human
cugugacauggugccu

SEQ ID NO: 3867418 - RNA, 19 nt, Human
cugugacauggugccugag

SEQ ID NO: 3867419 - RNA, 16 nt, Human
cugugaccacaacaug

SEQ ID NO: 3867420 - RNA, 20 nt, Human
cugugaccagcacugucuca

SEQ ID NO: 3867421 - RNA, 19 nt, Human
cugugaccauuuauaaugu

SEQ ID NO: 3867422 - RNA, 15 nt, Human
cugugacccacuucu

SEQ ID NO: 3867423 - RNA, 13 nt, Human
cugugacccccag

SEQ ID NO: 3867424 - RNA, 21 nt, Human
cugugacccccagcuccggcc

SEQ ID NO: 3867425 - RNA, 14 nt, Human
cugugaccugcauc

SEQ ID NO: 3867426 - RNA, 22 nt, Human
cugugaccugccccgcccagcu

SEQ ID NO: 3867427 - RNA, 15 nt, Human
cugugaccugcugag

SEQ ID NO: 3867428 - RNA, 16 nt, Human
cugugaccugcugagc

SEQ ID NO: 3867429 - RNA, 19 nt, Human
cugugaccugcugagcucu

SEQ ID NO: 3867430 - RNA, 17 nt, Human
cuuccuccauccuccuc

SEQ ID NO: 3867431 - RNA, 23 nt, Human
cuuccuccauccuccuccuuccu

SEQ ID NO: 3867432 - RNA, 12 nt, Human
cuuccucccaag

SEQ ID NO: 3867433 - RNA, 17 nt, Human
cuuccuccgaggccagu

SEQ ID NO: 3867434 - RNA, 15 nt, Human
cuuccuccuccacca

SEQ ID NO: 3867435 - RNA, 17 nt, Human
cuuccuccuccccacuu

SEQ ID NO: 3867436 - RNA, 16 nt, Human
cuuccuccucccuccu

SEQ ID NO: 3867437 - RNA, 21 nt, Human
cuuccuccucccuccugccga

SEQ ID NO: 3867438 - RNA, 10 nt, Human
cuuccuccug

SEQ ID NO: 3867439 - RNA, 11 nt, Human
cuuccuccuga

SEQ ID NO: 3867440 - RNA, 15 nt, Human
cuuccuccugacacc

SEQ ID NO: 3867441 - RNA, 12 nt, Human
cuuccuccugga

SEQ ID NO: 3867442 - RNA, 13 nt, Human
cuuccuccuggaa

SEQ ID NO: 3867443 - RNA, 14 nt, Human
cuuccuccugggcc

SEQ ID NO: 3867444 - RNA, 16 nt, Human
cuuccucgcagagagg

SEQ ID NO: 3867445 - RNA, 18 nt, Human
cuuccucgcagagaggcc

SEQ ID NO: 3867446 - RNA, 19 nt, Human
cuuccucgcagagaggcca

SEQ ID NO: 3867447 - RNA, 18 nt, Human
cuuccucuagaagccaag

SEQ ID NO: 3867448 - RNA, 14 nt, Human
cuuccucuccacug

SEQ ID NO: 3867449 - RNA, 21 nt, Human
cuuccucuccacugccuucga

SEQ ID NO: 3867450 - RNA, 19 nt, Human
cuuccucuccugucucccu

SEQ ID NO: 3867451 - RNA, 15 nt, Human
cuuccucucuccaga

SEQ ID NO: 3867452 - RNA, 16 nt, Human
cuuccucucuccagau

SEQ ID NO: 3867453 - RNA, 15 nt, Human
cuuccucugagccuu

SEQ ID NO: 3867454 - RNA, 14 nt, Human
cuuccucugaggcu

SEQ ID NO: 3867455 - RNA, 15 nt, Human
cuuccucugaggcug

SEQ ID NO: 3867456 - RNA, 22 nt, Human
cuuccucugcagcugaccucug

SEQ ID NO: 3867457 - RNA, 11 nt, Human
cuuccucugcu

SEQ ID NO: 3867458 - RNA, 14 nt, Human
cuuccucuggggcu

SEQ ID NO: 3867459 - RNA, 15 nt, Human
cuuccucuucggccc

SEQ ID NO: 3867460 - RNA, 14 nt, Human
cuuccucuugaccc

SEQ ID NO: 3867461 - RNA, 21 nt, Human
cuuccucuuuccaucuacccu

SEQ ID NO: 3867462 - RNA, 22 nt, Human
cuuccucuuuccaucuacccuc

SEQ ID NO: 3867463 - RNA, 18 nt, Human
cuuccugaaacuauauuu

SEQ ID NO: 3867464 - RNA, 13 nt, Human
cuuccugagggga

SEQ ID NO: 3867465 - RNA, 22 nt, Human
cuuccugauugguuucucuucu

SEQ ID NO: 3867466 - RNA, 13 nt, Human
cuuccugcaagga

SEQ ID NO: 3867467 - RNA, 15 nt, Human
cuuccugcaaggacu

SEQ ID NO: 3867468 - RNA, 15 nt, Human
cuuccugcaauuuuc

SEQ ID NO: 3867469 - RNA, 17 nt, Human
cuuccugcaauuuucua

SEQ ID NO: 3867470 - RNA, 16 nt, Human
cuuccugccaccaguc

SEQ ID NO: 3867471 - RNA, 17 nt, Human
cuuccugccaccugcug

SEQ ID NO: 3867472 - RNA, 15 nt, Human
cuuccugccagcccc

SEQ ID NO: 3867473 - RNA, 18 nt, Human
cuuccugccagccccugc

SEQ ID NO: 3867474 - RNA, 22 nt, Human
cuuccugccagccccugccauu

SEQ ID NO: 3867475 - RNA, 15 nt, Human
cuuccugccccucuu

SEQ ID NO: 3867476 - RNA, 19 nt, Human
cuuccugcccuacagaggu

SEQ ID NO: 3867477 - RNA, 16 nt, Human
cuuccugccuggucuc

SEQ ID NO: 3867478 - RNA, 21 nt, Human
cuuccugcguccuccucaccu

SEQ ID NO: 3867479 - RNA, 18 nt, Human
cuuccuggagcagaagca

SEQ ID NO: 3867480 - RNA, 19 nt, Human
cuuccuggagcagaagcag

SEQ ID NO: 3867481 - RNA, 16 nt, Human
cuuccuggagcccaga

SEQ ID NO: 3867482 - RNA, 17 nt, Human
cuuccuggagcccagag

SEQ ID NO: 3867483 - RNA, 20 nt, Human
cuuccugggcacacgcugcu

SEQ ID NO: 3867484 - RNA, 23 nt, Human
cuuccuggggcaucuggcgaauc

SEQ ID NO: 3867485 - RNA, 23 nt, Human
cuuccuguaacacaagccacaga

SEQ ID NO: 3867486 - RNA, 21 nt, Human
cuuccugucaagcaaucaaga

SEQ ID NO: 3867487 - RNA, 16 nt, Human
cuuccuguccagagag

SEQ ID NO: 3867488 - RNA, 19 nt, Human
cuuccuguccagagagaga

SEQ ID NO: 3867489 - RNA, 16 nt, Human
cuuccuguccagcucc

SEQ ID NO: 3867490 - RNA, 18 nt, Human
cuuccuguccccaucugu

SEQ ID NO: 3867491 - RNA, 17 nt, Human
cuuccuguccgcccucu

SEQ ID NO: 3867492 - RNA, 22 nt, Human
cuuccuguccgcccucuucccc

SEQ ID NO: 3867493 - RNA, 13 nt, Human
cuuccugugacuu

SEQ ID NO: 3867494 - RNA, 16 nt, Human
cuuccugugacuucag

SEQ ID NO: 3867495 - RNA, 16 nt, Human
cuuccugugggagcag

SEQ ID NO: 3867496 - RNA, 15 nt, Human
cuuccuguguccuga

SEQ ID NO: 3867497 - RNA, 14 nt, Human
cuuccuguucugaa

SEQ ID NO: 3867498 - RNA, 16 nt, Human
cuuccuguuugggccc

SEQ ID NO: 3867499 - RNA, 18 nt, Human
cuuccuguuuuucacauu

SEQ ID NO: 3867500 - RNA, 16 nt, Human
cuuccuuaccgugggc

SEQ ID NO: 3867501 - RNA, 15 nt, Human
cuuccuucaccucug

SEQ ID NO: 3867502 - RNA, 13 nt, Human
cuuccuucagaga

SEQ ID NO: 3867503 - RNA, 14 nt, Human
cuuccuucagagag

SEQ ID NO: 3867504 - RNA, 15 nt, Human
cuuccuucccuggcu

SEQ ID NO: 3867505 - RNA, 18 nt, Human
cuuccuucugccugagcu

SEQ ID NO: 3867506 - RNA, 17 nt, Human
cuuccuucuguaaauac

SEQ ID NO: 3867507 - RNA, 18 nt, Human
cuuccuucuuugcccuuu

SEQ ID NO: 3867508 - RNA, 19 nt, Human
cuuccuugcuaaugcacca

SEQ ID NO: 3867509 - RNA, 19 nt, Human
cuuccuugcuguccuaggc

SEQ ID NO: 3867510 - RNA, 17 nt, Human
cuuccuugcuuaaggua

SEQ ID NO: 3867511 - RNA, 21 nt, Human
cuuccuuguuacccaugaaaa

SEQ ID NO: 3867512 - RNA, 22 nt, Human
cuuccuuuacuuucccuugcuu

SEQ ID NO: 3867513 - RNA, 15 nt, Human
cuuccuuugcuuccc

SEQ ID NO: 3867514 - RNA, 22 nt, Human
cuuccuuuguuuuuuuuuccug

SEQ ID NO: 3867515 - RNA, 13 nt, Human
cuuccuuuuaacu

SEQ ID NO: 3867516 - RNA, 17 nt, Human
cuuccuuuuaucaguag

SEQ ID NO: 3867517 - RNA, 17 nt, Human
cuucgacacuguucuua

SEQ ID NO: 3867518 - RNA, 17 nt, Human
cuucgacagcauuuucc

SEQ ID NO: 3867519 - RNA, 21 nt, Human
cuucgacagcauuuuccucug

SEQ ID NO: 3867520 - RNA, 15 nt, Human
cuucgacucaggauc

SEQ ID NO: 3867521 - RNA, 16 nt, Human
cuucgacucaggaucc

SEQ ID NO: 3867522 - RNA, 14 nt, Human
cuucgacuguuguu

SEQ ID NO: 3867523 - RNA, 21 nt, Human
cuucgauacaccgggccugga

SEQ ID NO: 3867524 - RNA, 15 nt, Human
cuucgcaucaaaaga

SEQ ID NO: 3867525 - RNA, 22 nt, Human
cuucgcaucaaaagacaauucu

SEQ ID NO: 3867526 - RNA, 23 nt, Human
cuucgcaucaaaagacaauucuu

SEQ ID NO: 3867527 - RNA, 13 nt, Human
cuucgccaccugg

SEQ ID NO: 3867528 - RNA, 19 nt, Human
cuucgcguauuucaggauu

SEQ ID NO: 3867529 - RNA, 15 nt, Human
cuucgcuccuguguc

SEQ ID NO: 3867530 - RNA, 16 nt, Human
cuucgcuccugugucu

SEQ ID NO: 3867531 - RNA, 19 nt, Human
cuucggaaaccuuggugua

SEQ ID NO: 3867532 - RNA, 21 nt, Human
cuucggaccgcuuguggggac

SEQ ID NO: 3867533 - RNA, 22 nt, Human
cuucggagaugaggaguaaaau

SEQ ID NO: 3867534 - RNA, 16 nt, Human
cuucggaggaccaggg

SEQ ID NO: 3867535 - RNA, 13 nt, Human
cuucggcauuuga

SEQ ID NO: 3867536 - RNA, 20 nt, Human
cuucggccuccauccugagg

SEQ ID NO: 3867537 - RNA, 23 nt, Human
cuucgggaagagaggaguucaau

SEQ ID NO: 3867538 - RNA, 15 nt, Human
cuucgggaccaggau

SEQ ID NO: 3867539 - RNA, 15 nt, Human
cuucggggcugggaa

SEQ ID NO: 3867540 - RNA, 16 nt, Human
cuucgguacccaccac

SEQ ID NO: 3867541 - RNA, 22 nt, Human
cuucguaucccgagucugggac

SEQ ID NO: 3867542 - RNA, 19 nt, Human
cuucgugacaauguuuaca

SEQ ID NO: 3867543 - RNA, 17 nt, Human
cuucguuaacuguguau

SEQ ID NO: 3867544 - RNA, 13 nt, Human
cuucuaaaaacuu

SEQ ID NO: 3867545 - RNA, 21 nt, Human
cuucuaaaacuguacuuugau

SEQ ID NO: 3867546 - RNA, 18 nt, Human
cuucuaaacuuccccauc

SEQ ID NO: 3867547 - RNA, 15 nt, Human
cuucuaaagguguug

SEQ ID NO: 3867548 - RNA, 21 nt, Human
cuucuaaguaaaaccacagca

SEQ ID NO: 3867549 - RNA, 23 nt, Human
cuucuaaguaaaaccacagcagu

SEQ ID NO: 3867550 - RNA, 14 nt, Human
cuucuaaguaaaua

SEQ ID NO: 3867551 - RNA, 12 nt, Human
cuucuaauauau

SEQ ID NO: 3867552 - RNA, 16 nt, Human
cuucuaauaucauuca

SEQ ID NO: 3867553 - RNA, 14 nt, Human
cuucuaaucugcua

SEQ ID NO: 3867554 - RNA, 16 nt, Human
cuucuaaucugcuaug

SEQ ID NO: 3867555 - RNA, 14 nt, Human
cuucuacacucucc

SEQ ID NO: 3867556 - RNA, 17 nt, Human
cuucuacacucuccugg

SEQ ID NO: 3867557 - RNA, 17 nt, Human
cuucuaccaacuggaag

SEQ ID NO: 3867558 - RNA, 17 nt, Human
cuucuaccaugaacaga

SEQ ID NO: 3867559 - RNA, 17 nt, Human
cuucuaccucuuggcug

SEQ ID NO: 3867560 - RNA, 23 nt, Human
cuucuaccugccacucacacagc

SEQ ID NO: 3867561 - RNA, 13 nt, Human
cuucuaccugccc

SEQ ID NO: 3867562 - RNA, 21 nt, Human
cuucuacuucugcccuugcca

SEQ ID NO: 3867563 - RNA, 13 nt, Human
cuucuacuuuuaa

SEQ ID NO: 3867564 - RNA, 15 nt, Human
cuucuagaauuauaa

SEQ ID NO: 3867565 - RNA, 17 nt, Human
cuucuagcugacuugca

SEQ ID NO: 3867566 - RNA, 13 nt, Human
cuucuaggaagcu

SEQ ID NO: 3867567 - RNA, 16 nt, Human
cuucuaggacgccacc

SEQ ID NO: 3867568 - RNA, 19 nt, Human
cuucuaggacgccacccag

SEQ ID NO: 3867569 - RNA, 18 nt, Human
cuucuaggguaugggaaa

SEQ ID NO: 3867570 - RNA, 16 nt, Human
cuucuagucuuggcca

SEQ ID NO: 3867571 - RNA, 18 nt, Human
cuucuagugaugaugguu

SEQ ID NO: 3867572 - RNA, 18 nt, Human
cuucuaguucugccagga

SEQ ID NO: 3867573 - RNA, 14 nt, Human
cuucuaguuuccca

SEQ ID NO: 3867574 - RNA, 15 nt, Human
cuucuauaauuguau

SEQ ID NO: 3867575 - RNA, 17 nt, Human
cuucuauacccacccag

SEQ ID NO: 3867576 - RNA, 21 nt, Human
cuugaaccugugaguaaauau

SEQ ID NO: 3867577 - RNA, 16 nt, Human
cuugaacguuuucuaa

SEQ ID NO: 3867578 - RNA, 18 nt, Human
cuugaacuccugaccuca

SEQ ID NO: 3867579 - RNA, 13 nt, Human
cuugaacuccugg

SEQ ID NO: 3867580 - RNA, 18 nt, Human
cuugaacuccuggacuca

SEQ ID NO: 3867581 - RNA, 15 nt, Human
cuugaacuccuggcc

SEQ ID NO: 3867582 - RNA, 19 nt, Human
cuugaacuccuggccucaa

SEQ ID NO: 3867583 - RNA, 14 nt, Human
cuugaacucugggc

SEQ ID NO: 3867584 - RNA, 18 nt, Human
cuugaacuggguacuugu

SEQ ID NO: 3867585 - RNA, 13 nt, Human
cuugaagaucguu

SEQ ID NO: 3867586 - RNA, 13 nt, Human
cuugaagccaaag

SEQ ID NO: 3867587 - RNA, 14 nt, Human
cuugaagccaaaga

SEQ ID NO: 3867588 - RNA, 21 nt, Human
cuugaagccacugaagcuggg

SEQ ID NO: 3867589 - RNA, 20 nt, Human
cuugaagccugcuccuuccc

SEQ ID NO: 3867590 - RNA, 21 nt, Human
cuugaaggcccugcugaguca

SEQ ID NO: 3867591 - RNA, 17 nt, Human
cuugaagggccagagcc

SEQ ID NO: 3867592 - RNA, 13 nt, Human
cuugaagggccca

SEQ ID NO: 3867593 - RNA, 14 nt, Human
cuugaagggcccag

SEQ ID NO: 3867594 - RNA, 14 nt, Human
cuugaaggugcuga

SEQ ID NO: 3867595 - RNA, 20 nt, Human
cuugaagucacccggccccc

SEQ ID NO: 3867596 - RNA, 10 nt, Human
cuugaaguug

SEQ ID NO: 3867597 - RNA, 13 nt, Human
cuugaauauaaaa

SEQ ID NO: 3867598 - RNA, 16 nt, Human
cuugaauauaaaaaau

SEQ ID NO: 3867599 - RNA, 14 nt, Human
cuugaauccuaggg

SEQ ID NO: 3867600 - RNA, 23 nt, Human
cuugaaugaugccaugaggaaca

SEQ ID NO: 3867601 - RNA, 23 nt, Human
cuugaaugccauagucaaagaga

SEQ ID NO: 3867602 - RNA, 22 nt, Human
cuugaauguggcuugagaaaua

SEQ ID NO: 3867603 - RNA, 20 nt, Human
cuugaauguggucucaggau

SEQ ID NO: 3867604 - RNA, 21 nt, Human
cuugaauguggucucaggaua

SEQ ID NO: 3867605 - RNA, 21 nt, Human
cuugaauuguaacuguucuug

SEQ ID NO: 3867606 - RNA, 22 nt, Human
cuugaauuguaacuguucuuga

SEQ ID NO: 3867607 - RNA, 17 nt, Human
cuugaauuuucccacug

SEQ ID NO: 3867608 - RNA, 22 nt, Human
cuugacaaagucaagccacaug

SEQ ID NO: 3867609 - RNA, 16 nt, Human
cuugacaacuggcagg

SEQ ID NO: 3867610 - RNA, 20 nt, Human
cuugacaacuggcaggcagg

SEQ ID NO: 3867611 - RNA, 13 nt, Human
cuugacaccugcu

SEQ ID NO: 3867612 - RNA, 15 nt, Human
cuugacaccugcuga

SEQ ID NO: 3867613 - RNA, 17 nt, Human
cuugacagaacacuguc

SEQ ID NO: 3867614 - RNA, 15 nt, Human
cuugacagggcacac

SEQ ID NO: 3867615 - RNA, 20 nt, Human
cuugacagggcacaccgggc

SEQ ID NO: 3867616 - RNA, 14 nt, Human
cuugacauucaagg

SEQ ID NO: 3867617 - RNA, 15 nt, Human
cuugaccaagcagga

SEQ ID NO: 3867618 - RNA, 23 nt, Human
cuugaccagcagaucccagcuca

SEQ ID NO: 3867619 - RNA, 17 nt, Human
cuugaccaggcuuggcc

SEQ ID NO: 3867620 - RNA, 17 nt, Human
cuugaccauucuccacc

SEQ ID NO: 3867621 - RNA, 23 nt, Human
cuugaccauucuccaccugccag

SEQ ID NO: 3867622 - RNA, 13 nt, Human
cuugacccaucuc

SEQ ID NO: 3867623 - RNA, 15 nt, Human
cuugacccugagcug

SEQ ID NO: 3867624 - RNA, 14 nt, Human
cuugacccugcacc

SEQ ID NO: 3867625 - RNA, 15 nt, Human
cuugacccugcaccc

SEQ ID NO: 3867626 - RNA, 18 nt, Human
cuugaccgugaggccaga

SEQ ID NO: 3867627 - RNA, 12 nt, Human
cuugaccuccua

SEQ ID NO: 3867628 - RNA, 16 nt, Human
cuugaccugcugaagu

SEQ ID NO: 3867629 - RNA, 18 nt, Human
cuugaccuguuucucugc

SEQ ID NO: 3867630 - RNA, 12 nt, Human
cuugaccuuccu

SEQ ID NO: 3867631 - RNA, 15 nt, Human
cuugaccuuguagag

SEQ ID NO: 3867632 - RNA, 17 nt, Human
cuugaccuuuguacagc

SEQ ID NO: 3867633 - RNA, 15 nt, Human
cuugacucaggauuu

SEQ ID NO: 3867634 - RNA, 13 nt, Human
cuugacuuugcuc

SEQ ID NO: 3867635 - RNA, 15 nt, Human
cuugagaaaaaaaga

SEQ ID NO: 3867636 - RNA, 22 nt, Human
cuugagaaaaaaagaauaguug

SEQ ID NO: 3867637 - RNA, 18 nt, Human
cuugagaaaccccucgau

SEQ ID NO: 3867638 - RNA, 22 nt, Human
cuugagaaauauggacacuuaa

SEQ ID NO: 3867639 - RNA, 11 nt, Human
cuugagaacuu

SEQ ID NO: 3867640 - RNA, 17 nt, Human
cuugagaagauucuucc

SEQ ID NO: 3867641 - RNA, 17 nt, Human
cuugagacacggagccc

SEQ ID NO: 3867642 - RNA, 14 nt, Human
cuugagaccucagc

SEQ ID NO: 3867643 - RNA, 14 nt, Human
cuugagagaccagg

SEQ ID NO: 3867644 - RNA, 22 nt, Human
cuugagauguaugaaggcuuuu

SEQ ID NO: 3867645 - RNA, 21 nt, Human
cuugagcaaguuccuucuggu

SEQ ID NO: 3867646 - RNA, 14 nt, Human
cuugagcaguggcu

SEQ ID NO: 3867647 - RNA, 16 nt, Human
cuugagcauguuacug

SEQ ID NO: 3867648 - RNA, 13 nt, Human
cuugagccaguaa

SEQ ID NO: 3867649 - RNA, 14 nt, Human
cuugagcccaggag

SEQ ID NO: 3867650 - RNA, 16 nt, Human
cuugagcccuccccag

SEQ ID NO: 3867651 - RNA, 20 nt, Human
cuugagcccuccccaggaau

SEQ ID NO: 3867652 - RNA, 14 nt, Human
cuugagcccuggcu

SEQ ID NO: 3867653 - RNA, 20 nt, Human
cuugagcccuggcuguucug

SEQ ID NO: 3867654 - RNA, 19 nt, Human
cuugagccgggccccuggg

SEQ ID NO: 3867655 - RNA, 20 nt, Human
cuugagccgggccccugggc

SEQ ID NO: 3867656 - RNA, 12 nt, Human
cuugagccuggg

SEQ ID NO: 3867657 - RNA, 15 nt, Human
cuugagccugggagg

SEQ ID NO: 3867658 - RNA, 16 nt, Human
cuugagccugggaggu

SEQ ID NO: 3867659 - RNA, 19 nt, Human
cuugagccugucaagaggc

SEQ ID NO: 3867660 - RNA, 18 nt, Human
cuugagccuugaacuuug

SEQ ID NO: 3867661 - RNA, 22 nt, Human
cuugagccuugaacuuugaccu

SEQ ID NO: 3867662 - RNA, 14 nt, Human
cuugagcuccccaa

SEQ ID NO: 3867663 - RNA, 11 nt, Human
cuugagcucua

SEQ ID NO: 3867664 - RNA, 10 nt, Human
cuugagcuga

SEQ ID NO: 3867665 - RNA, 12 nt, Human
cuugaggacaca

SEQ ID NO: 3867666 - RNA, 16 nt, Human
cuugaggacacauguc

SEQ ID NO: 3867667 - RNA, 22 nt, Human
cuugaggagugugagaaucaaa

SEQ ID NO: 3867668 - RNA, 16 nt, Human
cuugaggauuuugagu

SEQ ID NO: 3867669 - RNA, 17 nt, Human
cuugaggauuuugagua

SEQ ID NO: 3867670 - RNA, 17 nt, Human
cuugaggccugaucugc

SEQ ID NO: 3867671 - RNA, 16 nt, Human
cuugaggggaccagga

SEQ ID NO: 3867672 - RNA, 16 nt, Human
cuugaggggagccagg

SEQ ID NO: 3867673 - RNA, 17 nt, Human
cuugaggggagccagga

SEQ ID NO: 3867674 - RNA, 20 nt, Human
cuugaggggagccaggaggg

SEQ ID NO: 3867675 - RNA, 20 nt, Human
cuugagggggaaggauucug

SEQ ID NO: 3867676 - RNA, 17 nt, Human
cuugaggguugggcugg

SEQ ID NO: 3867677 - RNA, 20 nt, Human
cuugaggguugggcuggugu

SEQ ID NO: 3867678 - RNA, 18 nt, Human
cuugaggucucagccccu

SEQ ID NO: 3867679 - RNA, 14 nt, Human
cuugaggucuuuug

SEQ ID NO: 3867680 - RNA, 22 nt, Human
cuugaggucuuuugacaugugg

SEQ ID NO: 3867681 - RNA, 22 nt, Human
cuugagguggccuccuugcuug

SEQ ID NO: 3867682 - RNA, 22 nt, Human
cuugaguaaaauacucuuuuua

SEQ ID NO: 3867683 - RNA, 18 nt, Human
cuugaguauaagaaaugc

SEQ ID NO: 3867684 - RNA, 23 nt, Human
cuugagugggguuaucucugugu

SEQ ID NO: 3867685 - RNA, 16 nt, Human
cuugaguguaauguuu

SEQ ID NO: 3867686 - RNA, 18 nt, Human
cuugaguucucaacugag

SEQ ID NO: 3867687 - RNA, 18 nt, Human
cuugaguugauucagcuc

SEQ ID NO: 3867688 - RNA, 20 nt, Human
cuugaguugauucagcucug

SEQ ID NO: 3867689 - RNA, 21 nt, Human
cuugaguuggggccauugcuu

SEQ ID NO: 3867690 - RNA, 20 nt, Human
cuugaguuguuuuuguauau

SEQ ID NO: 3867691 - RNA, 12 nt, Human
cuugaguuuguc

SEQ ID NO: 3867692 - RNA, 21 nt, Human
cuugaguuugucgcucaugug

SEQ ID NO: 3867693 - RNA, 16 nt, Human
cuugaguuuuauuuau

SEQ ID NO: 3867694 - RNA, 13 nt, Human
cuugauaacagcu

SEQ ID NO: 3867695 - RNA, 17 nt, Human
cuugauaauguuguggu

SEQ ID NO: 3867696 - RNA, 21 nt, Human
cuugauaauguugugguuugu

SEQ ID NO: 3867697 - RNA, 18 nt, Human
cuugauacauucaaauuu

SEQ ID NO: 3867698 - RNA, 16 nt, Human
cuugauaccccccucu

SEQ ID NO: 3867699 - RNA, 17 nt, Human
cuugauaccccccucug

SEQ ID NO: 3867700 - RNA, 20 nt, Human
cuugauaccccccucugucu

SEQ ID NO: 3867701 - RNA, 14 nt, Human
cuugauagaaaugc

SEQ ID NO: 3867702 - RNA, 18 nt, Human
cuugauauuuguauuuau

SEQ ID NO: 3867703 - RNA, 13 nt, Human
cuugauauuuucu

SEQ ID NO: 3867704 - RNA, 23 nt, Human
cuugaucaacaucuuuucuugcc

SEQ ID NO: 3867705 - RNA, 23 nt, Human
cuugaucagccccacccuggccu

SEQ ID NO: 3867706 - RNA, 18 nt, Human
cuugaucaguaguuugca

SEQ ID NO: 3867707 - RNA, 22 nt, Human
cuugaucaguuaagaaauuuca

SEQ ID NO: 3867708 - RNA, 19 nt, Human
cuugauccauuucuaauua

SEQ ID NO: 3867709 - RNA, 20 nt, Human
cuugauccauuucuaauuau

SEQ ID NO: 3867710 - RNA, 16 nt, Human
cuugaucugcucagcc

SEQ ID NO: 3867711 - RNA, 15 nt, Human
cuugaucuguauaua

SEQ ID NO: 3867712 - RNA, 21 nt, Human
cuugaugaccaaaguccuuuu

SEQ ID NO: 3867713 - RNA, 20 nt, Human
cuugaugacuggaauuuuua

SEQ ID NO: 3867714 - RNA, 13 nt, Human
cuugaugagugua

SEQ ID NO: 3867715 - RNA, 19 nt, Human
cuugaugaguguaacaaga

SEQ ID NO: 3867716 - RNA, 21 nt, Human
cuugaugaguguaacaagaaa

SEQ ID NO: 3867717 - RNA, 14 nt, Human
cuugaugcacagag

SEQ ID NO: 3867718 - RNA, 19 nt, Human
cuugaugccaguaggcuca

SEQ ID NO: 3867719 - RNA, 17 nt, Human
cuugaugggauucugga

SEQ ID NO: 3867720 - RNA, 16 nt, Human
cuugauggucagacac

SEQ ID NO: 3867721 - RNA, 23 nt, Human
cuuuugacggaaggaccuauguu

SEQ ID NO: 3867722 - RNA, 18 nt, Human
cuuuugacuuucauugga

SEQ ID NO: 3867723 - RNA, 20 nt, Human
cuuuugagugugugugugca

SEQ ID NO: 3867724 - RNA, 14 nt, Human
cuuuugauaagaaa

SEQ ID NO: 3867725 - RNA, 15 nt, Human
cuuuugauaugcaua

SEQ ID NO: 3867726 - RNA, 24 nt, Human
cuuuugcaaccaggaacagcaaau

SEQ ID NO: 3867727 - RNA, 20 nt, Human
cuuuugcaagguuccacaga

SEQ ID NO: 3867728 - RNA, 15 nt, Human
cuuuugcaccccucc

SEQ ID NO: 3867729 - RNA, 17 nt, Human
cuuuugcaccccuccca

SEQ ID NO: 3867730 - RNA, 19 nt, Human
cuuuugcaccccucccauu

SEQ ID NO: 3867731 - RNA, 15 nt, Human
cuuuugcauucuccc

SEQ ID NO: 3867732 - RNA, 17 nt, Human
cuuuugccauuaaacuu

SEQ ID NO: 3867733 - RNA, 23 nt, Human
cuuuugcccacacuugggagcaa

SEQ ID NO: 3867734 - RNA, 21 nt, Human
cuuuugcccuucacaguguuu

SEQ ID NO: 3867735 - RNA, 15 nt, Human
cuuuugcccuuugau

SEQ ID NO: 3867736 - RNA, 20 nt, Human
cuuuugccuuuugcaaccag

SEQ ID NO: 3867737 - RNA, 15 nt, Human
cuuuugcuacuaagu

SEQ ID NO: 3867738 - RNA, 23 nt, Human
cuuuugcuacuaaguucacauua

SEQ ID NO: 3867739 - RNA, 11 nt, Human
cuuuugcuuuu

SEQ ID NO: 3867740 - RNA, 18 nt, Human
cuuuugcuuuugcccauu

SEQ ID NO: 3867741 - RNA, 17 nt, Human
cuuuugcuuuuggcaaa

SEQ ID NO: 3867742 - RNA, 16 nt, Human
cuuuuggaaucuagaa

SEQ ID NO: 3867743 - RNA, 12 nt, Human
cuuuuggaggac

SEQ ID NO: 3867744 - RNA, 13 nt, Human
cuuuuggagucag

SEQ ID NO: 3867745 - RNA, 13 nt, Human
cuuuuggcccccg

SEQ ID NO: 3867746 - RNA, 14 nt, Human
cuuuuggcuuccau

SEQ ID NO: 3867747 - RNA, 15 nt, Human
cuuuugggggaaacu

SEQ ID NO: 3867748 - RNA, 14 nt, Human
cuuuugggggaggg

SEQ ID NO: 3867749 - RNA, 18 nt, Human
cuuuugggggucaacagu

SEQ ID NO: 3867750 - RNA, 19 nt, Human
cuuuuggguuucugcccug

SEQ ID NO: 3867751 - RNA, 20 nt, Human
cuuuuggguuucugcccugc

SEQ ID NO: 3867752 - RNA, 20 nt, Human
cuuuugguaaagacuggcuu

SEQ ID NO: 3867753 - RNA, 15 nt, Human
cuuuuggucugugug

SEQ ID NO: 3867754 - RNA, 16 nt, Human
cuuuuggucuguguga

SEQ ID NO: 3867755 - RNA, 13 nt, Human
cuuuugguuaagu

SEQ ID NO: 3867756 - RNA, 16 nt, Human
cuuuugguuaagucug

SEQ ID NO: 3867757 - RNA, 13 nt, Human
cuuuuguaaaugu

SEQ ID NO: 3867758 - RNA, 10 nt, Human
cuuuuguaag

SEQ ID NO: 3867759 - RNA, 20 nt, Human
cuuuuguaagacaaagguuu

SEQ ID NO: 3867760 - RNA, 12 nt, Human
cuuuuguacauc

SEQ ID NO: 3867761 - RNA, 17 nt, Human
cuuuuguacaucuggcu

SEQ ID NO: 3867762 - RNA, 18 nt, Human
cuuuuguauguaaaugug

SEQ ID NO: 3867763 - RNA, 11 nt, Human
cuuuuguauua

SEQ ID NO: 3867764 - RNA, 12 nt, Human
cuuuuguauuaa

SEQ ID NO: 3867765 - RNA, 13 nt, Human
cuuuuguccugca

SEQ ID NO: 3867766 - RNA, 21 nt, Human
cuuuugugaagaacuauuuua

SEQ ID NO: 3867767 - RNA, 20 nt, Human
cuuuugugauggagugcugu

SEQ ID NO: 3867768 - RNA, 17 nt, Human
cuuuuguguaaugaaaa

SEQ ID NO: 3867769 - RNA, 23 nt, Human
cuuuuguguacaguguguaaagu

SEQ ID NO: 3867770 - RNA, 17 nt, Human
cuuuugugugaauugac

SEQ ID NO: 3867771 - RNA, 11 nt, Human
cuuuuguuacu

SEQ ID NO: 3867772 - RNA, 13 nt, Human
cuuuuguuacugu

SEQ ID NO: 3867773 - RNA, 14 nt, Human
cuuuuguuacuguu

SEQ ID NO: 3867774 - RNA, 17 nt, Human
cuuuuguuacuguucuu

SEQ ID NO: 3867775 - RNA, 19 nt, Human
cuuuuguuacuguucuugc

SEQ ID NO: 3867776 - RNA, 21 nt, Human
cuuuuguuacuguucuugcug

SEQ ID NO: 3867777 - RNA, 19 nt, Human
cuuuuguucauuucauccu

SEQ ID NO: 3867778 - RNA, 13 nt, Human
cuuuuguuuuuug

SEQ ID NO: 3867779 - RNA, 18 nt, Human
cuuuuuaaaaauuguuau

SEQ ID NO: 3867780 - RNA, 22 nt, Human
cuuuuuaaaauggugcuuaagu

SEQ ID NO: 3867781 - RNA, 15 nt, Human
cuuuuuaaagcuuau

SEQ ID NO: 3867782 - RNA, 23 nt, Human
cuuuuuaaaguguuucuguuauu

SEQ ID NO: 3867783 - RNA, 23 nt, Human
cuuuuuaaauucaguccuaagaa

SEQ ID NO: 3867784 - RNA, 15 nt, Human
cuuuuuaaccucugu

SEQ ID NO: 3867785 - RNA, 16 nt, Human
cuuuuuaaccucuguu

SEQ ID NO: 3867786 - RNA, 20 nt, Human
cuuuuuaaggucuuucagua

SEQ ID NO: 3867787 - RNA, 15 nt, Human
cuuuuuaauaaaaag

SEQ ID NO: 3867788 - RNA, 14 nt, Human
cuuuuuaauaugcu

SEQ ID NO: 3867789 - RNA, 18 nt, Human
cuuuuuaaucaugaauau

SEQ ID NO: 3867790 - RNA, 21 nt, Human
cuuuuuacauaacugccuuga

SEQ ID NO: 3867791 - RNA, 22 nt, Human
cuuuuuacauaacugccuugaa

SEQ ID NO: 3867792 - RNA, 17 nt, Human
cuuuuuaccuuucauac

SEQ ID NO: 3867793 - RNA, 19 nt, Human
cuuuuuacuccccuugagc

SEQ ID NO: 3867794 - RNA, 16 nt, Human
cuuuuuaguaauuucu

SEQ ID NO: 3867795 - RNA, 12 nt, Human
cuuuuuaguuua

SEQ ID NO: 3867796 - RNA, 13 nt, Human
cuuuuuauaaaaa

SEQ ID NO: 3867797 - RNA, 18 nt, Human
cuuuuuauauucucagca

SEQ ID NO: 3867798 - RNA, 15 nt, Human
cuuuuuaugcuauuu

SEQ ID NO: 3867799 - RNA, 18 nt, Human
cuuuuuauuaaaauauuu

SEQ ID NO: 3867800 - RNA, 19 nt, Human
cuuuuuauugaugugcaaa

SEQ ID NO: 3867801 - RNA, 23 nt, Human
cuuuuuauugccuucucaccagc

SEQ ID NO: 3867802 - RNA, 14 nt, Human
cuuuuuauuuauau

SEQ ID NO: 3867803 - RNA, 19 nt, Human
cuuuuuauuuauauguacu

SEQ ID NO: 3867804 - RNA, 16 nt, Human
cuuuuuauuucugcau

SEQ ID NO: 3867805 - RNA, 15 nt, Human
cuuuuuauuugcaug

SEQ ID NO: 3867806 - RNA, 15 nt, Human
cuuuuucaauaacug

SEQ ID NO: 3867807 - RNA, 18 nt, Human
cuuuuucauaaauuauuu

SEQ ID NO: 3867808 - RNA, 17 nt, Human
cuuuuucauauguugcu

SEQ ID NO: 3867809 - RNA, 15 nt, Human
cuuuuucauuuaucu

SEQ ID NO: 3867810 - RNA, 12 nt, Human
cuuuuucauuug

SEQ ID NO: 3867811 - RNA, 15 nt, Human
cuuuuucauuugccu

SEQ ID NO: 3867812 - RNA, 13 nt, Human
cuuuuuccagagg

SEQ ID NO: 3867813 - RNA, 17 nt, Human
cuuuuuccccaaagucu

SEQ ID NO: 3867814 - RNA, 23 nt, Human
cuuuuuccuagccuguuucuucc

SEQ ID NO: 3867815 - RNA, 17 nt, Human
cuuuuuccuugucccca

SEQ ID NO: 3867816 - RNA, 22 nt, Human
cuuuuucuaaugaggagagaaa

SEQ ID NO: 3867817 - RNA, 11 nt, Human
cuuuuucuacc

SEQ ID NO: 3867818 - RNA, 14 nt, Human
cuuuuucucccucu

SEQ ID NO: 3867819 - RNA, 13 nt, Human
cuuuuucugauua

SEQ ID NO: 3867820 - RNA, 14 nt, Human
cuuuuucugcacua

SEQ ID NO: 3867821 - RNA, 20 nt, Human
cuuuuucugcacuauaugca

SEQ ID NO: 3867822 - RNA, 15 nt, Human
cuuuuucuuaaucau

SEQ ID NO: 3867823 - RNA, 13 nt, Human
cuuuuucuuccuc

SEQ ID NO: 3867824 - RNA, 12 nt, Human
cuuuuucuuuau

SEQ ID NO: 3867825 - RNA, 16 nt, Human
cuuuuucuuuuguaag

SEQ ID NO: 3867826 - RNA, 17 nt, Human
cuuuuucuuuuguaagu

SEQ ID NO: 3867827 - RNA, 18 nt, Human
cuuuuucuuuuguaagug

SEQ ID NO: 3867828 - RNA, 16 nt, Human
cuuuuugaaaguaauu

SEQ ID NO: 3867829 - RNA, 18 nt, Human
cuuuuugaaaucagcaua

SEQ ID NO: 3867830 - RNA, 12 nt, Human
cuuuuugaagug

SEQ ID NO: 3867831 - RNA, 13 nt, Human
cuuuuugaagugu

SEQ ID NO: 3867832 - RNA, 22 nt, Human
cuuuuugaaguguaggcagaca

SEQ ID NO: 3867833 - RNA, 11 nt, Human
cuuuuugaaug

SEQ ID NO: 3867834 - RNA, 13 nt, Human
cuuuuugacacug

SEQ ID NO: 3867835 - RNA, 14 nt, Human
cuuuuugaggcaaa

SEQ ID NO: 3867836 - RNA, 13 nt, Human
cuuuuugcagcuu

SEQ ID NO: 3867837 - RNA, 14 nt, Human
cuuuuugcucuaaa

SEQ ID NO: 3867838 - RNA, 15 nt, Human
cuuuuugcucuaaaa

SEQ ID NO: 3867839 - RNA, 15 nt, Human
cuuuuuggaggugcu

SEQ ID NO: 3867840 - RNA, 21 nt, Human
cuuuuuggguuuauuuggaaa

SEQ ID NO: 3867841 - RNA, 23 nt, Human
cuuuuuggucgaggaguaacaau

SEQ ID NO: 3867842 - RNA, 23 nt, Human
cuuuuugguguauagaaguuugu

SEQ ID NO: 3867843 - RNA, 11 nt, Human
cuuuuuguagg

SEQ ID NO: 3867844 - RNA, 18 nt, Human
cuuuuugugaaguuaggu

SEQ ID NO: 3867845 - RNA, 22 nt, Human
cuuuuugugauaugcacaaugu

SEQ ID NO: 3867846 - RNA, 15 nt, Human
cuuuuuguguuuuuu

SEQ ID NO: 3867847 - RNA, 17 nt, Human
cuuuuuuaaaaaagcaa

SEQ ID NO: 3867848 - RNA, 18 nt, Human
cuuuuuuaaaaucaacuu

SEQ ID NO: 3867849 - RNA, 18 nt, Human
cuuuuuuaaauaaacuuu

SEQ ID NO: 3867850 - RNA, 15 nt, Human
cuuuuuuaaauuuuc

SEQ ID NO: 3867851 - RNA, 18 nt, Human
cuuuuuuaaauuuucuuc

SEQ ID NO: 3867852 - RNA, 20 nt, Human
cuuuuuuaagauuuuucuca

SEQ ID NO: 3867853 - RNA, 13 nt, Human
cuuuuuuacaaag

SEQ ID NO: 3867854 - RNA, 15 nt, Human
cuuuuuuacacaaau

SEQ ID NO: 3867855 - RNA, 11 nt, Human
cuuuuuuacuc

SEQ ID NO: 3867856 - RNA, 20 nt, Human
cuuuuuuacucauugaaaug

SEQ ID NO: 3867857 - RNA, 21 nt, Human
cuuuuuuacucauugaaaugu

SEQ ID NO: 3867858 - RNA, 19 nt, Human
cuuuuuuauacacauaauu

SEQ ID NO: 3867859 - RNA, 18 nt, Human
cuuuuuuauacauaaaca

SEQ ID NO: 3867860 - RNA, 23 nt, Human
cuuuuuuaugugccguguuauug

SEQ ID NO: 3867861 - RNA, 14 nt, Human
cuuuuuuauuaauc

SEQ ID NO: 3867862 - RNA, 17 nt, Human
cuuuuuuauuaaucacu

SEQ ID NO: 3867863 - RNA, 19 nt, Human
cuuuuuuauuaaucacugu

SEQ ID NO: 3867864 - RNA, 21 nt, Human
cuuuuuuauuaaucacugugu

SEQ ID NO: 3867865 - RNA, 14 nt, Human
cuuuuuucaaaauc

SEQ ID NO: 3867866 - RNA, 15 nt, Human
cuuuuuucacuacau

SEQ ID NO: 3867867 - RNA, 16 nt, Human
gaaacuuuauacauua

SEQ ID NO: 3867868 - RNA, 22 nt, Human
gaaacuuuauucaaguaaaaau

SEQ ID NO: 3867869 - RNA, 16 nt, Human
gaaacuuucuuucuca

SEQ ID NO: 3867870 - RNA, 17 nt, Human
gaaacuuugggaaaaca

SEQ ID NO: 3867871 - RNA, 14 nt, Human
gaaacuuuuaacug

SEQ ID NO: 3867872 - RNA, 13 nt, Human
gaaacuuuuggaa

SEQ ID NO: 3867873 - RNA, 17 nt, Human
gaaacuuuuuuauuuaa

SEQ ID NO: 3867874 - RNA, 18 nt, Human
gaaacuuuuuuauuuaaa

SEQ ID NO: 3867875 - RNA, 16 nt, Human
gaaagaaaauaugcau

SEQ ID NO: 3867876 - RNA, 18 nt, Human
gaaagaaaaucaggcugg

SEQ ID NO: 3867877 - RNA, 21 nt, Human
gaaagaaacccgacagaggga

SEQ ID NO: 3867878 - RNA, 13 nt, Human
gaaagaaagagga

SEQ ID NO: 3867879 - RNA, 23 nt, Human
gaaagaaaguugcacggcugcug

SEQ ID NO: 3867880 - RNA, 11 nt, Human
gaaagaaauca

SEQ ID NO: 3867881 - RNA, 16 nt, Human
gaaagaaaucauguua

SEQ ID NO: 3867882 - RNA, 17 nt, Human
gaaagaaaucauguuau

SEQ ID NO: 3867883 - RNA, 20 nt, Human
gaaagaacgcugauuuaaag

SEQ ID NO: 3867884 - RNA, 16 nt, Human
gaaagaacggaagaag

SEQ ID NO: 3867885 - RNA, 22 nt, Human
gaaagaacugucauguaaacau

SEQ ID NO: 3867886 - RNA, 15 nt, Human
gaaagaagaaggugg

SEQ ID NO: 3867887 - RNA, 11 nt, Human
gaaagaagaga

SEQ ID NO: 3867888 - RNA, 11 nt, Human
gaaagaaggaa

SEQ ID NO: 3867889 - RNA, 18 nt, Human
gaaagaaguggggacaga

SEQ ID NO: 3867890 - RNA, 20 nt, Human
gaaagaaguguggggauuuu

SEQ ID NO: 3867891 - RNA, 19 nt, Human
gaaagaauagaaagaaagu

SEQ ID NO: 3867892 - RNA, 15 nt, Human
gaaagaauauauuua

SEQ ID NO: 3867893 - RNA, 18 nt, Human
gaaagaauauauuuauuu

SEQ ID NO: 3867894 - RNA, 16 nt, Human
gaaagaaugaaagagu

SEQ ID NO: 3867895 - RNA, 14 nt, Human
gaaagaauguaaag

SEQ ID NO: 3867896 - RNA, 15 nt, Human
gaaagaauguaaagc

SEQ ID NO: 3867897 - RNA, 22 nt, Human
gaaagaauguuacugccuuaau

SEQ ID NO: 3867898 - RNA, 19 nt, Human
gaaagacacugccugggcu

SEQ ID NO: 3867899 - RNA, 16 nt, Human
gaaagacagagcuggg

SEQ ID NO: 3867900 - RNA, 19 nt, Human
gaaagaccaggccaauguc

SEQ ID NO: 3867901 - RNA, 19 nt, Human
gaaagacgcacuuuggcuu

SEQ ID NO: 3867902 - RNA, 20 nt, Human
gaaagacuaucuaaauguug

SEQ ID NO: 3867903 - RNA, 17 nt, Human
gaaagacuauucaaaca

SEQ ID NO: 3867904 - RNA, 16 nt, Human
gaaagacuuccaaaga

SEQ ID NO: 3867905 - RNA, 20 nt, Human
gaaagacuuccaaagaaugu

SEQ ID NO: 3867906 - RNA, 15 nt, Human
gaaagagaagguggg

SEQ ID NO: 3867907 - RNA, 19 nt, Human
gaaagagagagaauucuuu

SEQ ID NO: 3867908 - RNA, 16 nt, Human
gaaagagauacagagg

SEQ ID NO: 3867909 - RNA, 23 nt, Human
gaaagagauaccaagaugccauc

SEQ ID NO: 3867910 - RNA, 21 nt, Human
gaaagagcacuuaagagaaua

SEQ ID NO: 3867911 - RNA, 22 nt, Human
gaaagagcacuuaagagaauau

SEQ ID NO: 3867912 - RNA, 13 nt, Human
gaaagaggaagca

SEQ ID NO: 3867913 - RNA, 21 nt, Human
gaaagaggcaccaggaagccg

SEQ ID NO: 3867914 - RNA, 20 nt, Human
gaaagaggcugaggccugga

SEQ ID NO: 3867915 - RNA, 14 nt, Human
gaaagaggugaccc

SEQ ID NO: 3867916 - RNA, 21 nt, Human
gaaagaggugaccccagggca

SEQ ID NO: 3867917 - RNA, 23 nt, Human
gaaagauggcugugccucugccu

SEQ ID NO: 3867918 - RNA, 13 nt, Human
gaaagcaaaaaug

SEQ ID NO: 3867919 - RNA, 15 nt, Human
gaaagcaaaaaugcu

SEQ ID NO: 3867920 - RNA, 12 nt, Human
gaaagcaaagca

SEQ ID NO: 3867921 - RNA, 11 nt, Human
gaaagcacaca

SEQ ID NO: 3867922 - RNA, 23 nt, Human
gaaagcacuccucccugauguac

SEQ ID NO: 3867923 - RNA, 13 nt, Human
gaaagcagaacag

SEQ ID NO: 3867924 - RNA, 14 nt, Human
gaaagcagaggcug

SEQ ID NO: 3867925 - RNA, 14 nt, Human
gaaagcagggacuu

SEQ ID NO: 3867926 - RNA, 18 nt, Human
gaaagcaguugagacaag

SEQ ID NO: 3867927 - RNA, 14 nt, Human
gaaagcauauugac

SEQ ID NO: 3867928 - RNA, 16 nt, Human
gaaagcaucaccucag

SEQ ID NO: 3867929 - RNA, 17 nt, Human
gaaagcaucaccucagg

SEQ ID NO: 3867930 - RNA, 17 nt, Human
gaaagcauccaugugug

SEQ ID NO: 3867931 - RNA, 22 nt, Human
gaaagcauguggcauguucauc

SEQ ID NO: 3867932 - RNA, 14 nt, Human
gaaagcauuugaau

SEQ ID NO: 3867933 - RNA, 17 nt, Human
gaaagcauuugaaugca

SEQ ID NO: 3867934 - RNA, 14 nt, Human
gaaagccaccucuc

SEQ ID NO: 3867935 - RNA, 19 nt, Human
gaaagccaccucucccuca

SEQ ID NO: 3867936 - RNA, 20 nt, Human
gaaagccaccucucccucaa

SEQ ID NO: 3867937 - RNA, 16 nt, Human
gaaagccagugacucc

SEQ ID NO: 3867938 - RNA, 19 nt, Human
gaaagccagugacuccagg

SEQ ID NO: 3867939 - RNA, 14 nt, Human
gaaagccauuuguu

SEQ ID NO: 3867940 - RNA, 14 nt, Human
gaaagccccugccc

SEQ ID NO: 3867941 - RNA, 22 nt, Human
gaaagcccugagcuuucugcua

SEQ ID NO: 3867942 - RNA, 17 nt, Human
gaaagcccugugcucca

SEQ ID NO: 3867943 - RNA, 16 nt, Human
gaaagccuaucaaaga

SEQ ID NO: 3867944 - RNA, 18 nt, Human
gaaagccucacugauaua

SEQ ID NO: 3867945 - RNA, 16 nt, Human
gaaagccucugcugcc

SEQ ID NO: 3867946 - RNA, 20 nt, Human
gaaagccuguuccccucacu

SEQ ID NO: 3867947 - RNA, 14 nt, Human
gaaagcgcagaugc

SEQ ID NO: 3867948 - RNA, 13 nt, Human
gaaagcuagagau

SEQ ID NO: 3867949 - RNA, 16 nt, Human
gaaagcugacuuggcu

SEQ ID NO: 3867950 - RNA, 21 nt, Human
gaaagcugacuuggcuggugu

SEQ ID NO: 3867951 - RNA, 22 nt, Human
gaaagcugacuuggcuggugug

SEQ ID NO: 3867952 - RNA, 22 nt, Human
gaaagcugagaacuccugacug

SEQ ID NO: 3867953 - RNA, 22 nt, Human
gaaagcugauuacugucaauaa

SEQ ID NO: 3867954 - RNA, 17 nt, Human
gaaagcugccugguaua

SEQ ID NO: 3867955 - RNA, 17 nt, Human
gaaagcugugaacaggc

SEQ ID NO: 3867956 - RNA, 18 nt, Human
gaaaggaaaaccugaaga

SEQ ID NO: 3867957 - RNA, 12 nt, Human
gaaaggaaaaga

SEQ ID NO: 3867958 - RNA, 14 nt, Human
gaaaggaaaagaaa

SEQ ID NO: 3867959 - RNA, 18 nt, Human
gaaaggaagcuccacugu

SEQ ID NO: 3867960 - RNA, 22 nt, Human
gaaaggaagcuccacugucacc

SEQ ID NO: 3867961 - RNA, 21 nt, Human
gaaaggaagugggacuggcac

SEQ ID NO: 3867962 - RNA, 20 nt, Human
gaaaggaaugcaaagaugaa

SEQ ID NO: 3867963 - RNA, 16 nt, Human
gaaaggaccugcaaac

SEQ ID NO: 3867964 - RNA, 21 nt, Human
gaaaggacucugggguuuuua

SEQ ID NO: 3867965 - RNA, 11 nt, Human
gaaaggagacu

SEQ ID NO: 3867966 - RNA, 12 nt, Human
gaaaggagaugu

SEQ ID NO: 3867967 - RNA, 20 nt, Human
gaaaggaggcaugccucuga

SEQ ID NO: 3867968 - RNA, 20 nt, Human
gaaaggauauuuaagaaaau

SEQ ID NO: 3867969 - RNA, 20 nt, Human
gaaaggauguaaacagugcc

SEQ ID NO: 3867970 - RNA, 16 nt, Human
gaaaggccagcacucg

SEQ ID NO: 3867971 - RNA, 13 nt, Human
gaaaggccugcac

SEQ ID NO: 3867972 - RNA, 18 nt, Human
gaaaggcuccaggagcag

SEQ ID NO: 3867973 - RNA, 18 nt, Human
gaaaggcugcuguacuga

SEQ ID NO: 3867974 - RNA, 20 nt, Human
gaaaggcugcuguacugaag

SEQ ID NO: 3867975 - RNA, 14 nt, Human
gaaaggcuuuuaaa

SEQ ID NO: 3867976 - RNA, 22 nt, Human
gaaagggagcuaucaggaacag

SEQ ID NO: 3867977 - RNA, 13 nt, Human
gaaagggagggcu

SEQ ID NO: 3867978 - RNA, 20 nt, Human
gaaagggagggcucugaggc

SEQ ID NO: 3867979 - RNA, 21 nt, Human
gaaagggagggcucugaggcg

SEQ ID NO: 3867980 - RNA, 20 nt, Human
gaaagggauuuucagcccuc

SEQ ID NO: 3867981 - RNA, 15 nt, Human
gaaagggccaggaga

SEQ ID NO: 3867982 - RNA, 13 nt, Human
gaaagggcccaga

SEQ ID NO: 3867983 - RNA, 15 nt, Human
gaaagggcccagaga

SEQ ID NO: 3867984 - RNA, 13 nt, Human
gaaaggggagccc

SEQ ID NO: 3867985 - RNA, 17 nt, Human
gaaagggggucccagug

SEQ ID NO: 3867986 - RNA, 16 nt, Human
gaaagggguuggggug

SEQ ID NO: 3867987 - RNA, 17 nt, Human
gaaaggguucuguaaaa

SEQ ID NO: 3867988 - RNA, 16 nt, Human
gaaaggucaccucacu

SEQ ID NO: 3867989 - RNA, 22 nt, Human
gaaaggugaguuugagcugccu

SEQ ID NO: 3867990 - RNA, 18 nt, Human
gaaaggugccauggaaga

SEQ ID NO: 3867991 - RNA, 22 nt, Human
gaaaggugccauggaagaggcu

SEQ ID NO: 3867992 - RNA, 17 nt, Human
gaaaggugguguuucug

SEQ ID NO: 3867993 - RNA, 20 nt, Human
gaaaggugugagacugggaa

SEQ ID NO: 3867994 - RNA, 15 nt, Human
gaaagguucugcccg

SEQ ID NO: 3867995 - RNA, 16 nt, Human
gaaagguuuacauugu

SEQ ID NO: 3867996 - RNA, 20 nt, Human
gaaagguuugagaagcacug

SEQ ID NO: 3867997 - RNA, 18 nt, Human
gaaaguacacucugcugu

SEQ ID NO: 3867998 - RNA, 21 nt, Human
gaaaguagggggcuuucuggg

SEQ ID NO: 3867999 - RNA, 17 nt, Human
gaaagucagaugcccag

SEQ ID NO: 3868000 - RNA, 19 nt, Human
gaaagucaugaacacauca

SEQ ID NO: 3868001 - RNA, 15 nt, Human
gaaagucuguccuug

SEQ ID NO: 3868002 - RNA, 19 nt, Human
gaaagucuugugacuagug

SEQ ID NO: 3868003 - RNA, 20 nt, Human
gaaagucuugugacuagugc

SEQ ID NO: 3868004 - RNA, 22 nt, Human
gaaagucuugugacuagugcug

SEQ ID NO: 3868005 - RNA, 16 nt, Human
gaaagugaaaguccag

SEQ ID NO: 3868006 - RNA, 21 nt, Human
gaaagugaauaaacuucagca

SEQ ID NO: 3868007 - RNA, 16 nt, Human
gaaagugaauuugaau

SEQ ID NO: 3868008 - RNA, 17 nt, Human
gaaagugaauuugaaug

SEQ ID NO: 3868009 - RNA, 15 nt, Human
gaaagugagcagugu

SEQ ID NO: 3868010 - RNA, 14 nt, Human
gaaagugcauuuuu

SEQ ID NO: 3868011 - RNA, 15 nt, Human
gaaagugccuuucag

SEQ ID NO: 3868012 - RNA, 13 nt, Human
gaaugaugaagcu

SEQ ID NO: 3868013 - RNA, 14 nt, Human
gaaugaugccauga

SEQ ID NO: 3868014 - RNA, 14 nt, Human
gaaugauuaugaau

SEQ ID NO: 3868015 - RNA, 22 nt, Human
gaaugauuaugaauuacauuug

SEQ ID NO: 3868016 - RNA, 23 nt, Human
gaaugauucuaauuuuuaagcaa

SEQ ID NO: 3868017 - RNA, 22 nt, Human
gaaugauuuccaaagagaaaaa

SEQ ID NO: 3868018 - RNA, 16 nt, Human
gaaugauuuuuagaug

SEQ ID NO: 3868019 - RNA, 14 nt, Human
gaaugauuuuucuu

SEQ ID NO: 3868020 - RNA, 18 nt, Human
gaaugcacaaacagaggc

SEQ ID NO: 3868021 - RNA, 19 nt, Human
gaaugcacaaacagaggcc

SEQ ID NO: 3868022 - RNA, 15 nt, Human
gaaugcacagauaua

SEQ ID NO: 3868023 - RNA, 20 nt, Human
gaaugcagucuguccaggcu

SEQ ID NO: 3868024 - RNA, 22 nt, Human
gaaugcagucuguccaggcucg

SEQ ID NO: 3868025 - RNA, 21 nt, Human
gaaugcaugcuuuccauauuu

SEQ ID NO: 3868026 - RNA, 14 nt, Human
gaaugcauuuuguu

SEQ ID NO: 3868027 - RNA, 17 nt, Human
gaaugccacccacaucu

SEQ ID NO: 3868028 - RNA, 21 nt, Human
gaaugccacugccuucgcuuc

SEQ ID NO: 3868029 - RNA, 22 nt, Human
gaaugcccacaggcaaaugcau

SEQ ID NO: 3868030 - RNA, 18 nt, Human
gaaugcccccagcuggcc

SEQ ID NO: 3868031 - RNA, 21 nt, Human
gaaugccucaaugugaccagg

SEQ ID NO: 3868032 - RNA, 14 nt, Human
gaaugccuccugca

SEQ ID NO: 3868033 - RNA, 16 nt, Human
gaaugccuccuguggg

SEQ ID NO: 3868034 - RNA, 11 nt, Human
gaaugcucccc

SEQ ID NO: 3868035 - RNA, 20 nt, Human
gaaugcucccccauccuccc

SEQ ID NO: 3868036 - RNA, 21 nt, Human
gaaugcucccccauccucccc

SEQ ID NO: 3868037 - RNA, 13 nt, Human
gaaugcugccagu

SEQ ID NO: 3868038 - RNA, 15 nt, Human
gaaugcugccagugu

SEQ ID NO: 3868039 - RNA, 21 nt, Human
gaaugcugcccgcucugcaga

SEQ ID NO: 3868040 - RNA, 23 nt, Human
gaaugcuggacuggaggccccug

SEQ ID NO: 3868041 - RNA, 13 nt, Human
gaaugcugggacu

SEQ ID NO: 3868042 - RNA, 22 nt, Human
gaaugcugguuuuccuaaaugc

SEQ ID NO: 3868043 - RNA, 22 nt, Human
gaaugcuucuaaguaaauacaa

SEQ ID NO: 3868044 - RNA, 14 nt, Human
gaaugcuuggaaua

SEQ ID NO: 3868045 - RNA, 21 nt, Human
gaaugcuuuuagugugugcau

SEQ ID NO: 3868046 - RNA, 22 nt, Human
gaauggaaggguucuggcugcc

SEQ ID NO: 3868047 - RNA, 21 nt, Human
gaauggaggggcagagccagg

SEQ ID NO: 3868048 - RNA, 13 nt, Human
gaauggcauuugc

SEQ ID NO: 3868049 - RNA, 17 nt, Human
gaauggccugccuugaa

SEQ ID NO: 3868050 - RNA, 16 nt, Human
gaauggcuuuguauag

SEQ ID NO: 3868051 - RNA, 21 nt, Human
gaaugggaucaugaaaguaga

SEQ ID NO: 3868052 - RNA, 18 nt, Human
gaauggggaucacagaga

SEQ ID NO: 3868053 - RNA, 22 nt, Human
gaaugguccgugcuaaggacuu

SEQ ID NO: 3868054 - RNA, 17 nt, Human
gaauggugcauuguaua

SEQ ID NO: 3868055 - RNA, 13 nt, Human
gaaugguggugga

SEQ ID NO: 3868056 - RNA, 16 nt, Human
gaaugguuccaugccu

SEQ ID NO: 3868057 - RNA, 13 nt, Human
gaauguaaagcaa

SEQ ID NO: 3868058 - RNA, 15 nt, Human
gaauguaaagcuugu

SEQ ID NO: 3868059 - RNA, 14 nt, Human
gaauguaaauuugu

SEQ ID NO: 3868060 - RNA, 11 nt, Human
gaauguaauca

SEQ ID NO: 3868061 - RNA, 18 nt, Human
gaauguaaucaauguuuc

SEQ ID NO: 3868062 - RNA, 14 nt, Human
gaauguaauuugug

SEQ ID NO: 3868063 - RNA, 23 nt, Human
gaauguaauuuguguaauaaagu

SEQ ID NO: 3868064 - RNA, 15 nt, Human
gaauguagcugguuu

SEQ ID NO: 3868065 - RNA, 20 nt, Human
gaauguagcugguuuccuca

SEQ ID NO: 3868066 - RNA, 14 nt, Human
gaauguaguuugag

SEQ ID NO: 3868067 - RNA, 22 nt, Human
gaauguaguuugaggaaauuug

SEQ ID NO: 3868068 - RNA, 15 nt, Human
gaauguauaguauuu

SEQ ID NO: 3868069 - RNA, 15 nt, Human
gaauguaucugugaa

SEQ ID NO: 3868070 - RNA, 16 nt, Human
gaauguaucugugaag

SEQ ID NO: 3868071 - RNA, 16 nt, Human
gaauguaugcuucaua

SEQ ID NO: 3868072 - RNA, 14 nt, Human
gaauguauguaaug

SEQ ID NO: 3868073 - RNA, 19 nt, Human
gaauguauuauucugcagc

SEQ ID NO: 3868074 - RNA, 21 nt, Human
gaauguauuauucugcagcau

SEQ ID NO: 3868075 - RNA, 13 nt, Human
gaauguauuguac

SEQ ID NO: 3868076 - RNA, 21 nt, Human
gaauguauuguaccuuuuaac

SEQ ID NO: 3868077 - RNA, 15 nt, Human
gaaugucacuucugg

SEQ ID NO: 3868078 - RNA, 14 nt, Human
gaaugucagauucc

SEQ ID NO: 3868079 - RNA, 18 nt, Human
gaaugucaguauguggaa

SEQ ID NO: 3868080 - RNA, 19 nt, Human
gaaugucaguauguggaag

SEQ ID NO: 3868081 - RNA, 17 nt, Human
gaaugucaguuguuauu

SEQ ID NO: 3868082 - RNA, 22 nt, Human
gaaugucaguuguuauuuauug

SEQ ID NO: 3868083 - RNA, 16 nt, Human
gaaugugaagccuucc

SEQ ID NO: 3868084 - RNA, 22 nt, Human
gaauguggccccugaacaagaa

SEQ ID NO: 3868085 - RNA, 18 nt, Human
gaauguggcuugagaaau

SEQ ID NO: 3868086 - RNA, 16 nt, Human
gaauguggucucagga

SEQ ID NO: 3868087 - RNA, 17 nt, Human
gaauguggucucaggau

SEQ ID NO: 3868088 - RNA, 12 nt, Human
gaaugugucagg

SEQ ID NO: 3868089 - RNA, 12 nt, Human
gaaugugucuuu

SEQ ID NO: 3868090 - RNA, 13 nt, Human
gaaugugucuuua

SEQ ID NO: 3868091 - RNA, 15 nt, Human
gaaugugucuuuaga

SEQ ID NO: 3868092 - RNA, 13 nt, Human
gaauguguuucac

SEQ ID NO: 3868093 - RNA, 22 nt, Human
gaauguguuucacaguuugaaa

SEQ ID NO: 3868094 - RNA, 13 nt, Human
gaauguuaaauaa

SEQ ID NO: 3868095 - RNA, 14 nt, Human
gaauguuaaauaaa

SEQ ID NO: 3868096 - RNA, 16 nt, Human
gaauguuaaauaaauu

SEQ ID NO: 3868097 - RNA, 21 nt, Human
gaauguuaaauaaauuguaua

SEQ ID NO: 3868098 - RNA, 13 nt, Human
gaauguuaauuuu

SEQ ID NO: 3868099 - RNA, 22 nt, Human
gaauguuaauuuuuugguacaa

SEQ ID NO: 3868100 - RNA, 20 nt, Human
gaauguugcaaugugaaaaa

SEQ ID NO: 3868101 - RNA, 20 nt, Human
gaauguuggauaaggaauua

SEQ ID NO: 3868102 - RNA, 14 nt, Human
gaauguugggacug

SEQ ID NO: 3868103 - RNA, 23 nt, Human
gaauguugggacugcuaaauaaa

SEQ ID NO: 3868104 - RNA, 22 nt, Human
gaauguugguuuacuuucaaau

SEQ ID NO: 3868105 - RNA, 21 nt, Human
gaauguuuaaagaucaugaca

SEQ ID NO: 3868106 - RNA, 20 nt, Human
gaauguuuacacucuuugua

SEQ ID NO: 3868107 - RNA, 21 nt, Human
gaauguuuacacucuuuguaa

SEQ ID NO: 3868108 - RNA, 14 nt, Human
gaauguuuauuccu

SEQ ID NO: 3868109 - RNA, 17 nt, Human
gaauguuugccucugcc

SEQ ID NO: 3868110 - RNA, 17 nt, Human
gaauguuuuagcacagc

SEQ ID NO: 3868111 - RNA, 12 nt, Human
gaauuaaaacaa

SEQ ID NO: 3868112 - RNA, 13 nt, Human
gaauuaaaacaau

SEQ ID NO: 3868113 - RNA, 15 nt, Human
gaauuaaaacaaugu

SEQ ID NO: 3868114 - RNA, 11 nt, Human
gaauuaaaacu

SEQ ID NO: 3868115 - RNA, 16 nt, Human
gaauuaaaacuucuua

SEQ ID NO: 3868116 - RNA, 18 nt, Human
gaauuaaaacuucuuaaa

SEQ ID NO: 3868117 - RNA, 20 nt, Human
gaauuaaaaggauaguauuu

SEQ ID NO: 3868118 - RNA, 14 nt, Human
gaauuaaaguacuu

SEQ ID NO: 3868119 - RNA, 22 nt, Human
gaauuaaaguggaccaauaggg

SEQ ID NO: 3868120 - RNA, 16 nt, Human
gaauuaaccuggugcu

SEQ ID NO: 3868121 - RNA, 17 nt, Human
gaauuaacuccauucca

SEQ ID NO: 3868122 - RNA, 19 nt, Human
gaauuaaugacagagccag

SEQ ID NO: 3868123 - RNA, 21 nt, Human
gaauuacauguaaaacauuau

SEQ ID NO: 3868124 - RNA, 22 nt, Human
gaauuacauguaaaacauuauc

SEQ ID NO: 3868125 - RNA, 19 nt, Human
gaauuacgugcucuguggg

SEQ ID NO: 3868126 - RNA, 18 nt, Human
gaauuagaaacauaaaua

SEQ ID NO: 3868127 - RNA, 15 nt, Human
gaauuagauuauauu

SEQ ID NO: 3868128 - RNA, 17 nt, Human
gaauuagauuucuauag

SEQ ID NO: 3868129 - RNA, 15 nt, Human
gaauuagcugcuucu

SEQ ID NO: 3868130 - RNA, 17 nt, Human
gaauuaggcuguaacua

SEQ ID NO: 3868131 - RNA, 18 nt, Human
gaauuaggcuguaacuac

SEQ ID NO: 3868132 - RNA, 16 nt, Human
gaauuaguaaaguuag

SEQ ID NO: 3868133 - RNA, 11 nt, Human
gaauuaguuuu

SEQ ID NO: 3868134 - RNA, 21 nt, Human
gaauuauaacuguaaagaugu

SEQ ID NO: 3868135 - RNA, 18 nt, Human
gaauuaucccuuuucuug

SEQ ID NO: 3868136 - RNA, 21 nt, Human
gaauuaugcuuuguagaguuu

SEQ ID NO: 3868137 - RNA, 16 nt, Human
gaauuauucaauuuau

SEQ ID NO: 3868138 - RNA, 16 nt, Human
gaauuauugacacuga

SEQ ID NO: 3868139 - RNA, 17 nt, Human
gaauuauugacacugaa

SEQ ID NO: 3868140 - RNA, 12 nt, Human
gaauuauuuugu

SEQ ID NO: 3868141 - RNA, 16 nt, Human
gaauuauuuuuuuucu

SEQ ID NO: 3868142 - RNA, 16 nt, Human
gaauucaaacuggggc

SEQ ID NO: 3868143 - RNA, 18 nt, Human
gaauucaaauuuuaucug

SEQ ID NO: 3868144 - RNA, 12 nt, Human
gaauuccaaagc

SEQ ID NO: 3868145 - RNA, 14 nt, Human
gaauuccaaagcaa

SEQ ID NO: 3868146 - RNA, 13 nt, Human
gaauuccaaggag

SEQ ID NO: 3868147 - RNA, 12 nt, Human
gaauucccucac

SEQ ID NO: 3868148 - RNA, 21 nt, Human
gaauucuguauagauuagaau

SEQ ID NO: 3868149 - RNA, 22 nt, Human
gaauucuguauagauuagaauu

SEQ ID NO: 3868150 - RNA, 22 nt, Human
gaauucuuacauguuuucuuug

SEQ ID NO: 3868151 - RNA, 11 nt, Human
gaauucuuccu

SEQ ID NO: 3868152 - RNA, 20 nt, Human
gaauucuugguugaggaaac

SEQ ID NO: 3868153 - RNA, 16 nt, Human
gaauugaacccaggag

SEQ ID NO: 3868154 - RNA, 21 nt, Human
gaauugacccacaagaaauga

SEQ ID NO: 3868155 - RNA, 19 nt, Human
gaauugagccuaaaaauaa

SEQ ID NO: 3868156 - RNA, 14 nt, Human
gaauugauaauaaa

SEQ ID NO: 3868157 - RNA, 14 nt, Human
gacaguuucuuagc

SEQ ID NO: 3868158 - RNA, 21 nt, Human
gacaguuucuuagcuuuuuaa

SEQ ID NO: 3868159 - RNA, 16 nt, Human
gacaguuuguaaaugu

SEQ ID NO: 3868160 - RNA, 19 nt, Human
gacaguuuguaaauguuau

SEQ ID NO: 3868161 - RNA, 14 nt, Human
gacaguuuuucugu

SEQ ID NO: 3868162 - RNA, 21 nt, Human
gacauaaaggaaaagacacau

SEQ ID NO: 3868163 - RNA, 17 nt, Human
gacauaaaguugauaaa

SEQ ID NO: 3868164 - RNA, 20 nt, Human
gacauaaaguugauaaagau

SEQ ID NO: 3868165 - RNA, 14 nt, Human
gacauaacguuuuu

SEQ ID NO: 3868166 - RNA, 23 nt, Human
gacauaauauauucuauuuuuau

SEQ ID NO: 3868167 - RNA, 17 nt, Human
gacauacccccuccccc

SEQ ID NO: 3868168 - RNA, 19 nt, Human
gacauacuugaagggccag

SEQ ID NO: 3868169 - RNA, 15 nt, Human
gacauagagguauau

SEQ ID NO: 3868170 - RNA, 14 nt, Human
gacauagauauuuu

SEQ ID NO: 3868171 - RNA, 18 nt, Human
gacauagcccaucccugc

SEQ ID NO: 3868172 - RNA, 22 nt, Human
gacauagcccaucccugccugg

SEQ ID NO: 3868173 - RNA, 17 nt, Human
gacauauauuuuuuaaa

SEQ ID NO: 3868174 - RNA, 21 nt, Human
gacauauauuuuuuaaaauaa

SEQ ID NO: 3868175 - RNA, 15 nt, Human
gacauaucaucugug

SEQ ID NO: 3868176 - RNA, 14 nt, Human
gacauaucuacacu

SEQ ID NO: 3868177 - RNA, 14 nt, Human
gacauauuuaacug

SEQ ID NO: 3868178 - RNA, 16 nt, Human
gacauauuuaauguuu

SEQ ID NO: 3868179 - RNA, 14 nt, Human
gacaucaacagaua

SEQ ID NO: 3868180 - RNA, 23 nt, Human
gacaucaacugcaucaagaugug

SEQ ID NO: 3868181 - RNA, 19 nt, Human
gacaucaagcacagaagga

SEQ ID NO: 3868182 - RNA, 13 nt, Human
gacaucacagcag

SEQ ID NO: 3868183 - RNA, 15 nt, Human
gacaucacagcagcc

SEQ ID NO: 3868184 - RNA, 13 nt, Human
gacaucagcauca

SEQ ID NO: 3868185 - RNA, 18 nt, Human
gacaucagcaucaccuag

SEQ ID NO: 3868186 - RNA, 13 nt, Human
gacaucagccagc

SEQ ID NO: 3868187 - RNA, 16 nt, Human
gacauccaagcuuccu

SEQ ID NO: 3868188 - RNA, 17 nt, Human
gacauccaagcuuccuu

SEQ ID NO: 3868189 - RNA, 17 nt, Human
gacauccauaaagaagc

SEQ ID NO: 3868190 - RNA, 18 nt, Human
gacauccauaaagaagca

SEQ ID NO: 3868191 - RNA, 22 nt, Human
gacauccauguuuguaaaacua

SEQ ID NO: 3868192 - RNA, 20 nt, Human
gacauccugucaucugagaa

SEQ ID NO: 3868193 - RNA, 13 nt, Human
gacaucucagggg

SEQ ID NO: 3868194 - RNA, 18 nt, Human
gacaucucaggggccaga

SEQ ID NO: 3868195 - RNA, 16 nt, Human
gacaucucugacuuuc

SEQ ID NO: 3868196 - RNA, 20 nt, Human
gacaucuucaaagcuugaag

SEQ ID NO: 3868197 - RNA, 13 nt, Human
gacaucuuuuuaa

SEQ ID NO: 3868198 - RNA, 19 nt, Human
gacaucuuuuuaaagcuua

SEQ ID NO: 3868199 - RNA, 11 nt, Human
gacaugaauuu

SEQ ID NO: 3868200 - RNA, 17 nt, Human
gacaugaauuuuagcuu

SEQ ID NO: 3868201 - RNA, 20 nt, Human
gacaugauuagcagaagaaa

SEQ ID NO: 3868202 - RNA, 14 nt, Human
gacaugauuccuuc

SEQ ID NO: 3868203 - RNA, 22 nt, Human
gacaugauuccuuccuguucug

SEQ ID NO: 3868204 - RNA, 14 nt, Human
gacaugauuuccuu

SEQ ID NO: 3868205 - RNA, 16 nt, Human
gacaugcacugacccu

SEQ ID NO: 3868206 - RNA, 22 nt, Human
gacaugcccucccuucucccug

SEQ ID NO: 3868207 - RNA, 14 nt, Human
gacaugcgggcugg

SEQ ID NO: 3868208 - RNA, 23 nt, Human
gacaugcgguagccagcacacag

SEQ ID NO: 3868209 - RNA, 18 nt, Human
gacaugcugaagccaaag

SEQ ID NO: 3868210 - RNA, 19 nt, Human
gacaugcugaagccaaagc

SEQ ID NO: 3868211 - RNA, 21 nt, Human
gacaugcugacuguccucucc

SEQ ID NO: 3868212 - RNA, 17 nt, Human
gacauggagacuccugc

SEQ ID NO: 3868213 - RNA, 19 nt, Human
gacauggagacuccugccc

SEQ ID NO: 3868214 - RNA, 15 nt, Human
gacauggagguucua

SEQ ID NO: 3868215 - RNA, 21 nt, Human
gacauggagguucuaaggccu

SEQ ID NO: 3868216 - RNA, 18 nt, Human
gacauggcuucugaaccu

SEQ ID NO: 3868217 - RNA, 19 nt, Human
gacauggcuuucagaaaac

SEQ ID NO: 3868218 - RNA, 14 nt, Human
gacaugggaaaggg

SEQ ID NO: 3868219 - RNA, 18 nt, Human
gacaugggaaaggggaag

SEQ ID NO: 3868220 - RNA, 17 nt, Human
gacauggugaaaauauu

SEQ ID NO: 3868221 - RNA, 14 nt, Human
gacauggugccuga

SEQ ID NO: 3868222 - RNA, 16 nt, Human
gacauggugccugaga

SEQ ID NO: 3868223 - RNA, 17 nt, Human
gacauggugccugagag

SEQ ID NO: 3868224 - RNA, 19 nt, Human
gacauggugccugagaggc

SEQ ID NO: 3868225 - RNA, 20 nt, Human
gacauggugccugagaggca

SEQ ID NO: 3868226 - RNA, 21 nt, Human
gacaugucuuuucuugcauga

SEQ ID NO: 3868227 - RNA, 12 nt, Human
gacaugugaaac

SEQ ID NO: 3868228 - RNA, 15 nt, Human
gacaugugaaaccuu

SEQ ID NO: 3868229 - RNA, 18 nt, Human
gacaugugaaaccuuuuu

SEQ ID NO: 3868230 - RNA, 13 nt, Human
gacauguggaaag

SEQ ID NO: 3868231 - RNA, 15 nt, Human
gacauguucccuucu

SEQ ID NO: 3868232 - RNA, 18 nt, Human
gacauguuuuuguuuucu

SEQ ID NO: 3868233 - RNA, 23 nt, Human
gacauuaaaucuaugaaguauau

SEQ ID NO: 3868234 - RNA, 19 nt, Human
gacauuaacaaauaaaaaa

SEQ ID NO: 3868235 - RNA, 12 nt, Human
gacauuaacagu

SEQ ID NO: 3868236 - RNA, 21 nt, Human
gacauuaacucauuagacugg

SEQ ID NO: 3868237 - RNA, 22 nt, Human
gacauuaacucauuagacugga

SEQ ID NO: 3868238 - RNA, 16 nt, Human
gacauuaagaauguug

SEQ ID NO: 3868239 - RNA, 21 nt, Human
gacauuaagcaucacaaauga

SEQ ID NO: 3868240 - RNA, 23 nt, Human
gacauuaugugguuuuagauuuu

SEQ ID NO: 3868241 - RNA, 20 nt, Human
gacauuaugugugcaugugu

SEQ ID NO: 3868242 - RNA, 15 nt, Human
gacauucaccugccc

SEQ ID NO: 3868243 - RNA, 23 nt, Human
gacauucaguauauaaaauaugu

SEQ ID NO: 3868244 - RNA, 18 nt, Human
gacauucaugccuggcuu

SEQ ID NO: 3868245 - RNA, 14 nt, Human
gacauucugaaugc

SEQ ID NO: 3868246 - RNA, 20 nt, Human
gacauucugaaugcuucuaa

SEQ ID NO: 3868247 - RNA, 22 nt, Human
gacauucugauucgaaugacac

SEQ ID NO: 3868248 - RNA, 17 nt, Human
gacauucugccaggccc

SEQ ID NO: 3868249 - RNA, 23 nt, Human
gacauucugucgccuuagcaugu

SEQ ID NO: 3868250 - RNA, 18 nt, Human
gacauugccaaaaaggau

SEQ ID NO: 3868251 - RNA, 14 nt, Human
gacauugcguuuga

SEQ ID NO: 3868252 - RNA, 18 nt, Human
gacauugcuaagaugcuc

SEQ ID NO: 3868253 - RNA, 23 nt, Human
gacauuggcaccuaauccaggca

SEQ ID NO: 3868254 - RNA, 21 nt, Human
gacauugggucuauuccagcu

SEQ ID NO: 3868255 - RNA, 23 nt, Human
gacauugggucuauuccagcuca

SEQ ID NO: 3868256 - RNA, 19 nt, Human
gacauuguagagcuucugg

SEQ ID NO: 3868257 - RNA, 13 nt, Human
gacauugucaaua

SEQ ID NO: 3868258 - RNA, 18 nt, Human
gacauuguggcacauucu

SEQ ID NO: 3868259 - RNA, 17 nt, Human
gacauuguuggcagcau

SEQ ID NO: 3868260 - RNA, 15 nt, Human
gacauuuagaagaaa

SEQ ID NO: 3868261 - RNA, 11 nt, Human
gacauuuccca

SEQ ID NO: 3868262 - RNA, 17 nt, Human
gacauuucuaauuccug

SEQ ID NO: 3868263 - RNA, 19 nt, Human
gacauuucucuuacugcaa

SEQ ID NO: 3868264 - RNA, 19 nt, Human
gacauuucuuuucuuuuua

SEQ ID NO: 3868265 - RNA, 15 nt, Human
gacauuugccuugcu

SEQ ID NO: 3868266 - RNA, 16 nt, Human
gacauuugcucaugga

SEQ ID NO: 3868267 - RNA, 22 nt, Human
gacauuugggagacaugugaca

SEQ ID NO: 3868268 - RNA, 23 nt, Human
gacauuugggagacaugugacau

SEQ ID NO: 3868269 - RNA, 15 nt, Human
gacauuugucauuuu

SEQ ID NO: 3868270 - RNA, 20 nt, Human
gacauuugucauuuucauua

SEQ ID NO: 3868271 - RNA, 20 nt, Human
gacauuuuaaaaaaugguca

SEQ ID NO: 3868272 - RNA, 14 nt, Human
gacauuuuaacaag

SEQ ID NO: 3868273 - RNA, 19 nt, Human
gaccaaaaaccaguauugu

SEQ ID NO: 3868274 - RNA, 17 nt, Human
gaccaaaauccccuucu

SEQ ID NO: 3868275 - RNA, 19 nt, Human
gaccaaaauccccuucuca

SEQ ID NO: 3868276 - RNA, 21 nt, Human
gaccaaauggaaacagaggac

SEQ ID NO: 3868277 - RNA, 17 nt, Human
gaccaacaagggcagug

SEQ ID NO: 3868278 - RNA, 20 nt, Human
gaccaacccuggggaaggag

SEQ ID NO: 3868279 - RNA, 14 nt, Human
gaccaaccugacca

SEQ ID NO: 3868280 - RNA, 20 nt, Human
gaccaacuagacauucuguc

SEQ ID NO: 3868281 - RNA, 14 nt, Human
gaccaacugucacu

SEQ ID NO: 3868282 - RNA, 12 nt, Human
gaccaacugugu

SEQ ID NO: 3868283 - RNA, 14 nt, Human
gaccaagagagaaa

SEQ ID NO: 3868284 - RNA, 15 nt, Human
gaccaagagagaaag

SEQ ID NO: 3868285 - RNA, 16 nt, Human
gaccaagagagaaaga

SEQ ID NO: 3868286 - RNA, 12 nt, Human
gaccaagcagga

SEQ ID NO: 3868287 - RNA, 15 nt, Human
gaccaagcaggaagc

SEQ ID NO: 3868288 - RNA, 19 nt, Human
gaccaagcaggaagcucag

SEQ ID NO: 3868289 - RNA, 15 nt, Human
gaccaagcaucuugg

SEQ ID NO: 3868290 - RNA, 11 nt, Human
gaccaaggaac

SEQ ID NO: 3868291 - RNA, 23 nt, Human
gaccaaggaacaaaaaaaccaca

SEQ ID NO: 3868292 - RNA, 17 nt, Human
gaccaaggcaaggcagg

SEQ ID NO: 3868293 - RNA, 19 nt, Human
gaccaaggcaaggcaggug

SEQ ID NO: 3868294 - RNA, 14 nt, Human
gaccaaguuauaaa

SEQ ID NO: 3868295 - RNA, 21 nt, Human
gaccaaguuauaaaucaaugu

SEQ ID NO: 3868296 - RNA, 16 nt, Human
gaccaauagcccacag

SEQ ID NO: 3868297 - RNA, 20 nt, Human
gaccaauauuauacuaagaa

SEQ ID NO: 3868298 - RNA, 21 nt, Human
gaccaauauuguacaguuuuu

SEQ ID NO: 3868299 - RNA, 13 nt, Human
gaccaauucaacc

SEQ ID NO: 3868300 - RNA, 17 nt, Human
gaccaauugugcugcca

SEQ ID NO: 3868301 - RNA, 21 nt, Human
gaccucaggugauccacccac

SEQ ID NO: 3868302 - RNA, 19 nt, Human
gaccucaggugauccgccc

SEQ ID NO: 3868303 - RNA, 20 nt, Human
gaccucaguuuuaucauuuu

SEQ ID NO: 3868304 - RNA, 19 nt, Human
gaccucaucaggaugaacc

SEQ ID NO: 3868305 - RNA, 20 nt, Human
gaccuccacacccgugagaa

SEQ ID NO: 3868306 - RNA, 18 nt, Human
gaccuccagcuuuccugu

SEQ ID NO: 3868307 - RNA, 16 nt, Human
gaccuccccagccccu

SEQ ID NO: 3868308 - RNA, 15 nt, Human
gaccucccccuccuu

SEQ ID NO: 3868309 - RNA, 19 nt, Human
gaccucccccuccuuccca

SEQ ID NO: 3868310 - RNA, 21 nt, Human
gaccucccuuccgacccucug

SEQ ID NO: 3868311 - RNA, 22 nt, Human
gaccucccuuccgacccucugg

SEQ ID NO: 3868312 - RNA, 23 nt, Human
gaccucccuuccgacccucuggg

SEQ ID NO: 3868313 - RNA, 19 nt, Human
gaccuccucccuguuauuu

SEQ ID NO: 3868314 - RNA, 21 nt, Human
gaccucgagcagaugaugcca

SEQ ID NO: 3868315 - RNA, 16 nt, Human
gaccucguccuccccc

SEQ ID NO: 3868316 - RNA, 22 nt, Human
gaccucguccucccccugccag

SEQ ID NO: 3868317 - RNA, 18 nt, Human
gaccucgugccaccccga

SEQ ID NO: 3868318 - RNA, 21 nt, Human
gaccucuacuuuccaggcuag

SEQ ID NO: 3868319 - RNA, 15 nt, Human
gaccucugacagcag

SEQ ID NO: 3868320 - RNA, 14 nt, Human
gaccucugcagcaa

SEQ ID NO: 3868321 - RNA, 16 nt, Human
gaccucugcagcaaua

SEQ ID NO: 3868322 - RNA, 18 nt, Human
gaccucugcagcaauaaa

SEQ ID NO: 3868323 - RNA, 22 nt, Human
gaccucugcagcaauaaagcag

SEQ ID NO: 3868324 - RNA, 15 nt, Human
gaccucugcucugag

SEQ ID NO: 3868325 - RNA, 23 nt, Human
gaccucuggauuaggucucuguu

SEQ ID NO: 3868326 - RNA, 10 nt, Human
gaccucuggg

SEQ ID NO: 3868327 - RNA, 22 nt, Human
gaccucuugcugucucugcucg

SEQ ID NO: 3868328 - RNA, 19 nt, Human
gaccugaaauuccaaaguc

SEQ ID NO: 3868329 - RNA, 16 nt, Human
gaccugaagagugguc

SEQ ID NO: 3868330 - RNA, 15 nt, Human
gaccugacuauugaa

SEQ ID NO: 3868331 - RNA, 16 nt, Human
gaccugagaccugaag

SEQ ID NO: 3868332 - RNA, 12 nt, Human
gaccugagccug

SEQ ID NO: 3868333 - RNA, 13 nt, Human
gaccugagccugc

SEQ ID NO: 3868334 - RNA, 17 nt, Human
gaccugagccugccgag

SEQ ID NO: 3868335 - RNA, 13 nt, Human
gaccugaggaagc

SEQ ID NO: 3868336 - RNA, 21 nt, Human
gaccugaggcccuucucucca

SEQ ID NO: 3868337 - RNA, 15 nt, Human
gaccugaggcugugg

SEQ ID NO: 3868338 - RNA, 16 nt, Human
gaccugcacuggggag

SEQ ID NO: 3868339 - RNA, 15 nt, Human
gaccugccaggcagg

SEQ ID NO: 3868340 - RNA, 21 nt, Human
gaccugccaggcagggguggg

SEQ ID NO: 3868341 - RNA, 11 nt, Human
gaccugccucc

SEQ ID NO: 3868342 - RNA, 19 nt, Human
gaccugccuccugccugcc

SEQ ID NO: 3868343 - RNA, 23 nt, Human
gaccugccuccugccugccccuc

SEQ ID NO: 3868344 - RNA, 19 nt, Human
gaccugccucggccuccca

SEQ ID NO: 3868345 - RNA, 18 nt, Human
gaccugccucucacacac

SEQ ID NO: 3868346 - RNA, 18 nt, Human
gaccugccucuucccccu

SEQ ID NO: 3868347 - RNA, 15 nt, Human
gaccugcuaggccag

SEQ ID NO: 3868348 - RNA, 18 nt, Human
gaccugcuaggccagagc

SEQ ID NO: 3868349 - RNA, 23 nt, Human
gaccugcuaggccagagcccacu

SEQ ID NO: 3868350 - RNA, 17 nt, Human
gaccugcugagcucuga

SEQ ID NO: 3868351 - RNA, 19 nt, Human
gaccugcugagggaccagc

SEQ ID NO: 3868352 - RNA, 17 nt, Human
gaccugcuuuuugaaau

SEQ ID NO: 3868353 - RNA, 15 nt, Human
gaccuggagccccug

SEQ ID NO: 3868354 - RNA, 15 nt, Human
gaccuggauaacuua

SEQ ID NO: 3868355 - RNA, 10 nt, Human
gaccuggcag

SEQ ID NO: 3868356 - RNA, 16 nt, Human
gaccuggcagcucugg

SEQ ID NO: 3868357 - RNA, 20 nt, Human
gaccuggcaucuaauucuga

SEQ ID NO: 3868358 - RNA, 15 nt, Human
gaccuggccugucug

SEQ ID NO: 3868359 - RNA, 16 nt, Human
gaccuggccugucugu

SEQ ID NO: 3868360 - RNA, 13 nt, Human
gaccuggggcaca

SEQ ID NO: 3868361 - RNA, 21 nt, Human
gaccuggggcacaguccagga

SEQ ID NO: 3868362 - RNA, 19 nt, Human
gaccuggggcugcugugaa

SEQ ID NO: 3868363 - RNA, 21 nt, Human
gaccugggguugucagcucuc

SEQ ID NO: 3868364 - RNA, 19 nt, Human
gaccugguacccuccuggc

SEQ ID NO: 3868365 - RNA, 21 nt, Human
gaccugguacccuccuggcuc

SEQ ID NO: 3868366 - RNA, 13 nt, Human
gaccuggucaggg

SEQ ID NO: 3868367 - RNA, 18 nt, Human
gaccugguccacagggca

SEQ ID NO: 3868368 - RNA, 19 nt, Human
gaccugguccacagggcac

SEQ ID NO: 3868369 - RNA, 23 nt, Human
gaccuguauauuuguaaagcuau

SEQ ID NO: 3868370 - RNA, 13 nt, Human
gaccuguauuuaa

SEQ ID NO: 3868371 - RNA, 16 nt, Human
gaccuguauuuaagca

SEQ ID NO: 3868372 - RNA, 15 nt, Human
gaccugucaugcccc

SEQ ID NO: 3868373 - RNA, 19 nt, Human
gaccugucaugccccccuc

SEQ ID NO: 3868374 - RNA, 21 nt, Human
gaccugucaugccccccucaa

SEQ ID NO: 3868375 - RNA, 15 nt, Human
gaccugucuccuggc

SEQ ID NO: 3868376 - RNA, 12 nt, Human
gaccugugacca

SEQ ID NO: 3868377 - RNA, 15 nt, Human
gaccugugaccagca

SEQ ID NO: 3868378 - RNA, 19 nt, Human
gaccuguggccaaguucuu

SEQ ID NO: 3868379 - RNA, 19 nt, Human
gaccuguggugcaaaagca

SEQ ID NO: 3868380 - RNA, 18 nt, Human
gaccuguuaaaauuauac

SEQ ID NO: 3868381 - RNA, 15 nt, Human
gaccuguugguucca

SEQ ID NO: 3868382 - RNA, 19 nt, Human
gaccuuacgaucaggcaca

SEQ ID NO: 3868383 - RNA, 13 nt, Human
gaccuuaggccuu

SEQ ID NO: 3868384 - RNA, 15 nt, Human
gaccuuaggccuucc

SEQ ID NO: 3868385 - RNA, 16 nt, Human
gaccuuaggccuuccu

SEQ ID NO: 3868386 - RNA, 18 nt, Human
gaccuuaggccuuccucu

SEQ ID NO: 3868387 - RNA, 21 nt, Human
gaccuuaggccuuccucucuc

SEQ ID NO: 3868388 - RNA, 20 nt, Human
gaccuuaguguuucugugca

SEQ ID NO: 3868389 - RNA, 16 nt, Human
gaccuucaccaaacau

SEQ ID NO: 3868390 - RNA, 22 nt, Human
gaccuucacucuaagauguuau

SEQ ID NO: 3868391 - RNA, 17 nt, Human
gaccuucauuucaugua

SEQ ID NO: 3868392 - RNA, 16 nt, Human
gaccuuccaagagccu

SEQ ID NO: 3868393 - RNA, 23 nt, Human
gaccuuccucauccaccccaucc

SEQ ID NO: 3868394 - RNA, 18 nt, Human
gaccuuccucgcagagag

SEQ ID NO: 3868395 - RNA, 18 nt, Human
gaccuuccucuggggcuc

SEQ ID NO: 3868396 - RNA, 19 nt, Human
gaccuuccugccaccaguc

SEQ ID NO: 3868397 - RNA, 18 nt, Human
gaccuucuccaaaugaga

SEQ ID NO: 3868398 - RNA, 14 nt, Human
gaccuucuccuuca

SEQ ID NO: 3868399 - RNA, 16 nt, Human
gaccuucuccuucacc

SEQ ID NO: 3868400 - RNA, 12 nt, Human
gaccuucuggga

SEQ ID NO: 3868401 - RNA, 19 nt, Human
gaccuugaaggguaaagaa

SEQ ID NO: 3868402 - RNA, 13 nt, Human
gaccuugaugagc

SEQ ID NO: 3868403 - RNA, 15 nt, Human
gaccuugaugagcug

SEQ ID NO: 3868404 - RNA, 16 nt, Human
gaccuugcaacuucau

SEQ ID NO: 3868405 - RNA, 18 nt, Human
gaccuuguaaaagacagu

SEQ ID NO: 3868406 - RNA, 20 nt, Human
gaccuuguaauguaacugcu

SEQ ID NO: 3868407 - RNA, 16 nt, Human
gaccuuguuacuucug

SEQ ID NO: 3868408 - RNA, 17 nt, Human
gaccuuucagcugugaa

SEQ ID NO: 3868409 - RNA, 17 nt, Human
gaccuuuccaccacagc

SEQ ID NO: 3868410 - RNA, 21 nt, Human
gaccuuuccaccacagccagc

SEQ ID NO: 3868411 - RNA, 20 nt, Human
gaccuuuuaaaguguuucag

SEQ ID NO: 3868412 - RNA, 22 nt, Human
gaccuuuuaaaguguuucagcu

SEQ ID NO: 3868413 - RNA, 16 nt, Human
gacgaagaagagccac

SEQ ID NO: 3868414 - RNA, 18 nt, Human
gacgaagaagagccacag

SEQ ID NO: 3868415 - RNA, 21 nt, Human
gacgacaagugcugaacagug

SEQ ID NO: 3868416 - RNA, 21 nt, Human
gacgaggcccucgggcccagc

SEQ ID NO: 3868417 - RNA, 22 nt, Human
gacgaggcccucgggcccagcc

SEQ ID NO: 3868418 - RNA, 17 nt, Human
gacgaguugauuuccuc

SEQ ID NO: 3868419 - RNA, 17 nt, Human
gacgcaccagcccagaa

SEQ ID NO: 3868420 - RNA, 15 nt, Human
gacgcacugagcaac

SEQ ID NO: 3868421 - RNA, 22 nt, Human
gacgcaugcccucaaucccagc

SEQ ID NO: 3868422 - RNA, 15 nt, Human
gacgccacagcccag

SEQ ID NO: 3868423 - RNA, 15 nt, Human
gacgccaccauuccu

SEQ ID NO: 3868424 - RNA, 16 nt, Human
gacgccaccauuccug

SEQ ID NO: 3868425 - RNA, 13 nt, Human
gacgccacccagc

SEQ ID NO: 3868426 - RNA, 21 nt, Human
gacgccacucauuucaucuca

SEQ ID NO: 3868427 - RNA, 23 nt, Human
gacgccacucauuucaucucauu

SEQ ID NO: 3868428 - RNA, 16 nt, Human
gacgccaucccagccc

SEQ ID NO: 3868429 - RNA, 19 nt, Human
gacgccaucccagccccaa

SEQ ID NO: 3868430 - RNA, 16 nt, Human
gacgccuggcugcuga

SEQ ID NO: 3868431 - RNA, 21 nt, Human
gacgccugggggugccaggac

SEQ ID NO: 3868432 - RNA, 14 nt, Human
gacgcgucuccugu

SEQ ID NO: 3868433 - RNA, 15 nt, Human
gacgcucucuggccu

SEQ ID NO: 3868434 - RNA, 16 nt, Human
gacgcucucuggccuu

SEQ ID NO: 3868435 - RNA, 16 nt, Human
gacgcugaauaaaugu

SEQ ID NO: 3868436 - RNA, 15 nt, Human
gacgcugauacauaa

SEQ ID NO: 3868437 - RNA, 21 nt, Human
gacgcugguagagauggagga

SEQ ID NO: 3868438 - RNA, 17 nt, Human
gacgcugugcugcccug

SEQ ID NO: 3868439 - RNA, 22 nt, Human
gacgcugugcugcccugcccac

SEQ ID NO: 3868440 - RNA, 18 nt, Human
gacgcuucacaggacagg

SEQ ID NO: 3868441 - RNA, 13 nt, Human
gacgcuuugucug

SEQ ID NO: 3868442 - RNA, 15 nt, Human
gacggagagaaaaaa

SEQ ID NO: 3868443 - RNA, 13 nt, Human
gacggagucccac

SEQ ID NO: 3868444 - RNA, 14 nt, Human
gacggagucccacc

SEQ ID NO: 3868445 - RNA, 14 nt, Human
gaggccagccuggc

SEQ ID NO: 3868446 - RNA, 19 nt, Human
gaggccagccuggccuccu

SEQ ID NO: 3868447 - RNA, 12 nt, Human
gaggccagccuu

SEQ ID NO: 3868448 - RNA, 22 nt, Human
gaggccaggaguuugagaccag

SEQ ID NO: 3868449 - RNA, 16 nt, Human
gaggccagugagccac

SEQ ID NO: 3868450 - RNA, 18 nt, Human
gaggccaucuggagagcc

SEQ ID NO: 3868451 - RNA, 23 nt, Human
gaggccaugauucgcccaaagcc

SEQ ID NO: 3868452 - RNA, 22 nt, Human
gaggccauggacucuguccuga

SEQ ID NO: 3868453 - RNA, 23 nt, Human
gaggccaugggccuccugugugu

SEQ ID NO: 3868454 - RNA, 22 nt, Human
gaggccaugugcauaguuucuu

SEQ ID NO: 3868455 - RNA, 19 nt, Human
gaggccauugugugagccu

SEQ ID NO: 3868456 - RNA, 18 nt, Human
gaggcccacauuggaaga

SEQ ID NO: 3868457 - RNA, 11 nt, Human
gaggcccagag

SEQ ID NO: 3868458 - RNA, 19 nt, Human
gaggcccagagggccugca

SEQ ID NO: 3868459 - RNA, 23 nt, Human
gaggcccaggcugggaacucauc

SEQ ID NO: 3868460 - RNA, 14 nt, Human
gaggccccaaagga

SEQ ID NO: 3868461 - RNA, 19 nt, Human
gaggccccaaaggaaaaag

SEQ ID NO: 3868462 - RNA, 19 nt, Human
gaggccccaauaccccaug

SEQ ID NO: 3868463 - RNA, 14 nt, Human
gaggccccacuggg

SEQ ID NO: 3868464 - RNA, 12 nt, Human
gaggccccaggg

SEQ ID NO: 3868465 - RNA, 15 nt, Human
gaggcccccagccca

SEQ ID NO: 3868466 - RNA, 16 nt, Human
gaggcccccagcccag

SEQ ID NO: 3868467 - RNA, 21 nt, Human
gaggcccccagcccagggcuc

SEQ ID NO: 3868468 - RNA, 22 nt, Human
gaggccccuauguaguccgugc

SEQ ID NO: 3868469 - RNA, 24 nt, Human
gaggccccuauguaguccgugcug

SEQ ID NO: 3868470 - RNA, 23 nt, Human
gaggccccuucucucccugccag

SEQ ID NO: 3868471 - RNA, 17 nt, Human
gaggcccuccacaccug

SEQ ID NO: 3868472 - RNA, 21 nt, Human
gaggcccuccacaccugcggc

SEQ ID NO: 3868473 - RNA, 22 nt, Human
gaggcccuccacaccugcggcc

SEQ ID NO: 3868474 - RNA, 17 nt, Human
gaggcccuccugugcug

SEQ ID NO: 3868475 - RNA, 17 nt, Human
gaggcccucgcugccag

SEQ ID NO: 3868476 - RNA, 16 nt, Human
gaggcccucgggccca

SEQ ID NO: 3868477 - RNA, 17 nt, Human
gaggcccucgggcccag

SEQ ID NO: 3868478 - RNA, 19 nt, Human
gaggcccucgggcccagcc

SEQ ID NO: 3868479 - RNA, 19 nt, Human
gaggcccucuggaguggcc

SEQ ID NO: 3868480 - RNA, 19 nt, Human
gaggcccugcaugggccag

SEQ ID NO: 3868481 - RNA, 12 nt, Human
gaggcccuggau

SEQ ID NO: 3868482 - RNA, 20 nt, Human
gaggcccuucucuccagccc

SEQ ID NO: 3868483 - RNA, 21 nt, Human
gaggcccuucucuccagcccc

SEQ ID NO: 3868484 - RNA, 23 nt, Human
gaggcccuucucuccagccccug

SEQ ID NO: 3868485 - RNA, 16 nt, Human
gaggcccuuugcuguc

SEQ ID NO: 3868486 - RNA, 17 nt, Human
gaggcccuuugcugucc

SEQ ID NO: 3868487 - RNA, 14 nt, Human
gaggccgaggccau

SEQ ID NO: 3868488 - RNA, 18 nt, Human
gaggccuaggaggguccu

SEQ ID NO: 3868489 - RNA, 21 nt, Human
gaggccuagucagccacaugg

SEQ ID NO: 3868490 - RNA, 23 nt, Human
gaggccuauaaugaagcuuuaua

SEQ ID NO: 3868491 - RNA, 16 nt, Human
gaggccucaggugcug

SEQ ID NO: 3868492 - RNA, 13 nt, Human
gaggccucugggc

SEQ ID NO: 3868493 - RNA, 19 nt, Human
gaggccucuuggaccucug

SEQ ID NO: 3868494 - RNA, 21 nt, Human
gaggccucuuggaccucugcu

SEQ ID NO: 3868495 - RNA, 9 nt, Human
gaggccuga

SEQ ID NO: 3868496 - RNA, 22 nt, Human
gaggccugaaauccugguuccu

SEQ ID NO: 3868497 - RNA, 13 nt, Human
gaggccugaagcc

SEQ ID NO: 3868498 - RNA, 18 nt, Human
gaggccugaagccagcug

SEQ ID NO: 3868499 - RNA, 23 nt, Human
gaggccugaagccagcugcccua

SEQ ID NO: 3868500 - RNA, 19 nt, Human
gaggccugacugccaagcc

SEQ ID NO: 3868501 - RNA, 12 nt, Human
gaggccugcccg

SEQ ID NO: 3868502 - RNA, 16 nt, Human
gaggccugcccgggcg

SEQ ID NO: 3868503 - RNA, 23 nt, Human
gaggccugcccucagggaucuug

SEQ ID NO: 3868504 - RNA, 19 nt, Human
gaggccugccuccagggcu

SEQ ID NO: 3868505 - RNA, 21 nt, Human
gaggccugccuccagggcugg

SEQ ID NO: 3868506 - RNA, 18 nt, Human
gaggccuggaguaacaca

SEQ ID NO: 3868507 - RNA, 14 nt, Human
gaggccuggccagg

SEQ ID NO: 3868508 - RNA, 16 nt, Human
gaggccugggccgcug

SEQ ID NO: 3868509 - RNA, 21 nt, Human
gaggccugggccgcugccacg

SEQ ID NO: 3868510 - RNA, 13 nt, Human
gaggccugggcug

SEQ ID NO: 3868511 - RNA, 18 nt, Human
gaggccugggcugggaaa

SEQ ID NO: 3868512 - RNA, 19 nt, Human
gaggccugucugugaccug

SEQ ID NO: 3868513 - RNA, 19 nt, Human
gaggccuucucugaaggac

SEQ ID NO: 3868514 - RNA, 12 nt, Human
gaggccuugcuc

SEQ ID NO: 3868515 - RNA, 14 nt, Human
gaggccuuuaacca

SEQ ID NO: 3868516 - RNA, 22 nt, Human
gaggcgcacuuuccuccuggca

SEQ ID NO: 3868517 - RNA, 22 nt, Human
gaggcgcccuuggcuucuguga

SEQ ID NO: 3868518 - RNA, 14 nt, Human
gaggcgcggaguga

SEQ ID NO: 3868519 - RNA, 20 nt, Human
gaggcggaccuuguagugag

SEQ ID NO: 3868520 - RNA, 19 nt, Human
gaggcggagaguacaguga

SEQ ID NO: 3868521 - RNA, 21 nt, Human
gaggcggagagugcugacugu

SEQ ID NO: 3868522 - RNA, 20 nt, Human
gaggcggccccggccggggu

SEQ ID NO: 3868523 - RNA, 15 nt, Human
gaggcgggagaauca

SEQ ID NO: 3868524 - RNA, 13 nt, Human
gaggcgggccagc

SEQ ID NO: 3868525 - RNA, 18 nt, Human
gaggcuaaguugggaucu

SEQ ID NO: 3868526 - RNA, 18 nt, Human
gaggcuacuguaaggcaa

SEQ ID NO: 3868527 - RNA, 22 nt, Human
gaggcuagugugguguuuccug

SEQ ID NO: 3868528 - RNA, 17 nt, Human
gaggcuaugcucagggg

SEQ ID NO: 3868529 - RNA, 20 nt, Human
gaggcuaugcucaggggccc

SEQ ID NO: 3868530 - RNA, 15 nt, Human
gaggcucaaauuuug

SEQ ID NO: 3868531 - RNA, 10 nt, Human
gaggcucagg

SEQ ID NO: 3868532 - RNA, 12 nt, Human
gaggcucagguc

SEQ ID NO: 3868533 - RNA, 15 nt, Human
gaggcuccacuuggu

SEQ ID NO: 3868534 - RNA, 16 nt, Human
gaggcuccaggcagca

SEQ ID NO: 3868535 - RNA, 13 nt, Human
gaggcuccugucc

SEQ ID NO: 3868536 - RNA, 14 nt, Human
gaggcucugcccuu

SEQ ID NO: 3868537 - RNA, 19 nt, Human
gaggcucuggagcccacug

SEQ ID NO: 3868538 - RNA, 20 nt, Human
gaggcucuggagcccacugu

SEQ ID NO: 3868539 - RNA, 20 nt, Human
gaggcugaaagaggccaaug

SEQ ID NO: 3868540 - RNA, 15 nt, Human
gaggcugacuccugg

SEQ ID NO: 3868541 - RNA, 16 nt, Human
gaggcugagacaggag

SEQ ID NO: 3868542 - RNA, 18 nt, Human
gaggcugagaugggagaa

SEQ ID NO: 3868543 - RNA, 16 nt, Human
gaggcugaggcaagag

SEQ ID NO: 3868544 - RNA, 13 nt, Human
gaggcugaggcac

SEQ ID NO: 3868545 - RNA, 14 nt, Human
gaggcugaggcaca

SEQ ID NO: 3868546 - RNA, 18 nt, Human
gaggcugaggcaggagaa

SEQ ID NO: 3868547 - RNA, 18 nt, Human
gaggcugaggcaggagac

SEQ ID NO: 3868548 - RNA, 16 nt, Human
gaggcugaggccugga

SEQ ID NO: 3868549 - RNA, 18 nt, Human
gaggcugaggccuggacu

SEQ ID NO: 3868550 - RNA, 15 nt, Human
gaggcugaggcuggc

SEQ ID NO: 3868551 - RNA, 20 nt, Human
gaggcugcagaaggccaaga

SEQ ID NO: 3868552 - RNA, 9 nt, Human
gaggcugcc

SEQ ID NO: 3868553 - RNA, 17 nt, Human
gaggcugcccccggccc

SEQ ID NO: 3868554 - RNA, 22 nt, Human
gaggcugcccccggcccccugg

SEQ ID NO: 3868555 - RNA, 23 nt, Human
gaggcugcccccggcccccuggu

SEQ ID NO: 3868556 - RNA, 14 nt, Human
gaggcugccccucu

SEQ ID NO: 3868557 - RNA, 19 nt, Human
gaggcugccccucucacca

SEQ ID NO: 3868558 - RNA, 13 nt, Human
gaggcugcccucc

SEQ ID NO: 3868559 - RNA, 15 nt, Human
gaggcugcccuccug

SEQ ID NO: 3868560 - RNA, 13 nt, Human
gaggcugcucggg

SEQ ID NO: 3868561 - RNA, 22 nt, Human
gaggcugcucggggugcacagg

SEQ ID NO: 3868562 - RNA, 19 nt, Human
gaggcuggacuccagaucu

SEQ ID NO: 3868563 - RNA, 20 nt, Human
gaggcuggacuccagaucug

SEQ ID NO: 3868564 - RNA, 14 nt, Human
gaggcuggaggcag

SEQ ID NO: 3868565 - RNA, 17 nt, Human
gaggcuggaggcagggc

SEQ ID NO: 3868566 - RNA, 17 nt, Human
gaggcugggccaagcca

SEQ ID NO: 3868567 - RNA, 21 nt, Human
gaggcugggccaagccaggga

SEQ ID NO: 3868568 - RNA, 13 nt, Human
gaggcugggcucc

SEQ ID NO: 3868569 - RNA, 20 nt, Human
gaggcugggcucccuuccca

SEQ ID NO: 3868570 - RNA, 20 nt, Human
gaggcugggggagagccgug

SEQ ID NO: 3868571 - RNA, 14 nt, Human
gaggcuguccugua

SEQ ID NO: 3868572 - RNA, 22 nt, Human
gaggcugucuucucaggcucug

SEQ ID NO: 3868573 - RNA, 15 nt, Human
gaggcuguggcuggu

SEQ ID NO: 3868574 - RNA, 17 nt, Human
gaggcugugugccuggg

SEQ ID NO: 3868575 - RNA, 22 nt, Human
gaggcuuagcuuugcucugcca

SEQ ID NO: 3868576 - RNA, 17 nt, Human
gaggcuuauauuugugu

SEQ ID NO: 3868577 - RNA, 23 nt, Human
gaggcuuccagagaguccucugg

SEQ ID NO: 3868578 - RNA, 13 nt, Human
gaggcuuccugcg

SEQ ID NO: 3868579 - RNA, 20 nt, Human
gaggcuucuccgccagccuc

SEQ ID NO: 3868580 - RNA, 15 nt, Human
gaggcuuggaaagca

SEQ ID NO: 3868581 - RNA, 18 nt, Human
gaggcuugggaccgccag

SEQ ID NO: 3868582 - RNA, 14 nt, Human
gaggcuugguuccu

SEQ ID NO: 3868583 - RNA, 18 nt, Human
gaggcuugucagagcugg

SEQ ID NO: 3868584 - RNA, 21 nt, Human
gaggcuugucagagcugggag

SEQ ID NO: 3868585 - RNA, 23 nt, Human
gaggcuuguuuaccuuucucucu

SEQ ID NO: 3868586 - RNA, 14 nt, Human
gaggcuuuguguug

SEQ ID NO: 3868587 - RNA, 10 nt, Human
gagggaaaag

SEQ ID NO: 3868588 - RNA, 15 nt, Human
gagggaaaagggaag

SEQ ID NO: 3868589 - RNA, 13 nt, Human
gaguacugugggc

SEQ ID NO: 3868590 - RNA, 22 nt, Human
gaguacugugggcaauuuagaa

SEQ ID NO: 3868591 - RNA, 15 nt, Human
gaguagaaaggccuu

SEQ ID NO: 3868592 - RNA, 17 nt, Human
gaguagaaaggccuuua

SEQ ID NO: 3868593 - RNA, 12 nt, Human
gaguagaaugua

SEQ ID NO: 3868594 - RNA, 14 nt, Human
gaguagaauugcau

SEQ ID NO: 3868595 - RNA, 17 nt, Human
gaguagaugcgcagccc

SEQ ID NO: 3868596 - RNA, 22 nt, Human
gaguagcaaguucuagagaaga

SEQ ID NO: 3868597 - RNA, 19 nt, Human
gaguagccgagagccugcu

SEQ ID NO: 3868598 - RNA, 13 nt, Human
gaguagcugagcu

SEQ ID NO: 3868599 - RNA, 22 nt, Human
gaguagcugggacuacaggcac

SEQ ID NO: 3868600 - RNA, 12 nt, Human
gaguaggaagac

SEQ ID NO: 3868601 - RNA, 21 nt, Human
gaguaguugauguugcauuuu

SEQ ID NO: 3868602 - RNA, 18 nt, Human
gaguauacaauauauaaa

SEQ ID NO: 3868603 - RNA, 19 nt, Human
gaguauacaauauauaaaa

SEQ ID NO: 3868604 - RNA, 16 nt, Human
gaguauaggccggucu

SEQ ID NO: 3868605 - RNA, 12 nt, Human
gaguauaugcac

SEQ ID NO: 3868606 - RNA, 15 nt, Human
gaguaucagaauuga

SEQ ID NO: 3868607 - RNA, 17 nt, Human
gaguaucaggucuccca

SEQ ID NO: 3868608 - RNA, 16 nt, Human
gaguaucugggaacug

SEQ ID NO: 3868609 - RNA, 14 nt, Human
gaguauuaaaaugu

SEQ ID NO: 3868610 - RNA, 12 nt, Human
gaguauucuaau

SEQ ID NO: 3868611 - RNA, 20 nt, Human
gaguauucuaauaagcuagu

SEQ ID NO: 3868612 - RNA, 18 nt, Human
gaguauugaaugguggug

SEQ ID NO: 3868613 - RNA, 23 nt, Human
gaguauuuucugguaaaaagaaa

SEQ ID NO: 3868614 - RNA, 19 nt, Human
gagucaaaacucaaaugcu

SEQ ID NO: 3868615 - RNA, 15 nt, Human
gagucaaggccugcu

SEQ ID NO: 3868616 - RNA, 13 nt, Human
gagucaauacaua

SEQ ID NO: 3868617 - RNA, 15 nt, Human
gagucacaagccucg

SEQ ID NO: 3868618 - RNA, 22 nt, Human
gagucaccuucccuugccacuu

SEQ ID NO: 3868619 - RNA, 15 nt, Human
gagucacuacaacug

SEQ ID NO: 3868620 - RNA, 17 nt, Human
gagucacuacgccuggc

SEQ ID NO: 3868621 - RNA, 14 nt, Human
gagucacugagacc

SEQ ID NO: 3868622 - RNA, 14 nt, Human
gagucagccaggag

SEQ ID NO: 3868623 - RNA, 11 nt, Human
gagucagccuu

SEQ ID NO: 3868624 - RNA, 22 nt, Human
gagucagggaccccugcccuug

SEQ ID NO: 3868625 - RNA, 18 nt, Human
gagucagggagagcugaa

SEQ ID NO: 3868626 - RNA, 15 nt, Human
gagucagggcccaga

SEQ ID NO: 3868627 - RNA, 16 nt, Human
gagucagggcccagag

SEQ ID NO: 3868628 - RNA, 18 nt, Human
gagucagguuugggguuc

SEQ ID NO: 3868629 - RNA, 15 nt, Human
gagucagucgccuuu

SEQ ID NO: 3868630 - RNA, 16 nt, Human
gagucauaaaccuuaa

SEQ ID NO: 3868631 - RNA, 14 nt, Human
gagucauauuuuga

SEQ ID NO: 3868632 - RNA, 13 nt, Human
gagucaucuccau

SEQ ID NO: 3868633 - RNA, 14 nt, Human
gagucauugcugua

SEQ ID NO: 3868634 - RNA, 13 nt, Human
gagucauuuaaau

SEQ ID NO: 3868635 - RNA, 18 nt, Human
gagucauuugagucucuu

SEQ ID NO: 3868636 - RNA, 19 nt, Human
gaguccaaacuggaaugag

SEQ ID NO: 3868637 - RNA, 20 nt, Human
gaguccaacguggggcagca

SEQ ID NO: 3868638 - RNA, 12 nt, Human
gaguccaagcug

SEQ ID NO: 3868639 - RNA, 13 nt, Human
gaguccaggcccc

SEQ ID NO: 3868640 - RNA, 14 nt, Human
gaguccaucagccu

SEQ ID NO: 3868641 - RNA, 16 nt, Human
gaguccaucagccucc

SEQ ID NO: 3868642 - RNA, 15 nt, Human
gaguccauucuccca

SEQ ID NO: 3868643 - RNA, 16 nt, Human
gagucccaccuuggcu

SEQ ID NO: 3868644 - RNA, 21 nt, Human
gagucccaccuuggcugcagg

SEQ ID NO: 3868645 - RNA, 13 nt, Human
gagucccacugcc

SEQ ID NO: 3868646 - RNA, 17 nt, Human
gagucccacugccucag

SEQ ID NO: 3868647 - RNA, 19 nt, Human
gagucccaggagcugccca

SEQ ID NO: 3868648 - RNA, 18 nt, Human
gagucccaggcugagccu

SEQ ID NO: 3868649 - RNA, 23 nt, Human
gagucccagguuggcucugccag

SEQ ID NO: 3868650 - RNA, 14 nt, Human
gagucccaguggga

SEQ ID NO: 3868651 - RNA, 22 nt, Human
gaguccccccacucccagcauc

SEQ ID NO: 3868652 - RNA, 20 nt, Human
gaguccccgggcaucuuugg

SEQ ID NO: 3868653 - RNA, 18 nt, Human
gaguccccucaccuccuc

SEQ ID NO: 3868654 - RNA, 18 nt, Human
gaguccccuccccggccc

SEQ ID NO: 3868655 - RNA, 22 nt, Human
gagucccuuccaggccaucaga

SEQ ID NO: 3868656 - RNA, 19 nt, Human
gaguccgaaagggacuugg

SEQ ID NO: 3868657 - RNA, 17 nt, Human
gaguccuagagcuacag

SEQ ID NO: 3868658 - RNA, 16 nt, Human
gaguccucacucccag

SEQ ID NO: 3868659 - RNA, 15 nt, Human
gaguccuccagaacu

SEQ ID NO: 3868660 - RNA, 21 nt, Human
gaguccuccagaacucuuccu

SEQ ID NO: 3868661 - RNA, 22 nt, Human
gaguccuccagaacucuuccuc

SEQ ID NO: 3868662 - RNA, 14 nt, Human
gagucgaggacagg

SEQ ID NO: 3868663 - RNA, 16 nt, Human
gagucgcaucucagug

SEQ ID NO: 3868664 - RNA, 19 nt, Human
gagucgucaucacuuuuca

SEQ ID NO: 3868665 - RNA, 18 nt, Human
gagucguggggugugcug

SEQ ID NO: 3868666 - RNA, 11 nt, Human
gagucuaaaga

SEQ ID NO: 3868667 - RNA, 18 nt, Human
gagucuaauagucuuugc

SEQ ID NO: 3868668 - RNA, 16 nt, Human
gagucuagauguuuau

SEQ ID NO: 3868669 - RNA, 11 nt, Human
gagucuagauu

SEQ ID NO: 3868670 - RNA, 13 nt, Human
gagucuagauuca

SEQ ID NO: 3868671 - RNA, 23 nt, Human
gagucuagauucaaagguucuag

SEQ ID NO: 3868672 - RNA, 16 nt, Human
gagucuagcacucauu

SEQ ID NO: 3868673 - RNA, 19 nt, Human
gagucucacuguugcccag

SEQ ID NO: 3868674 - RNA, 22 nt, Human
gagucucacuguugcccaggcu

SEQ ID NO: 3868675 - RNA, 23 nt, Human
gagucucacuguugcccaggcug

SEQ ID NO: 3868676 - RNA, 13 nt, Human
gagucucccaagg

SEQ ID NO: 3868677 - RNA, 13 nt, Human
gagucucccaggg

SEQ ID NO: 3868678 - RNA, 15 nt, Human
gagucucccagggag

SEQ ID NO: 3868679 - RNA, 12 nt, Human
gagucuccugug

SEQ ID NO: 3868680 - RNA, 23 nt, Human
gagucucgcuauugucaccaggg

SEQ ID NO: 3868681 - RNA, 16 nt, Human
gagucucuucuccacu

SEQ ID NO: 3868682 - RNA, 18 nt, Human
gagucucuucuccacugg

SEQ ID NO: 3868683 - RNA, 15 nt, Human
gagucugaagcagau

SEQ ID NO: 3868684 - RNA, 13 nt, Human
gagucugaaggcu

SEQ ID NO: 3868685 - RNA, 14 nt, Human
gagucugaaggcug

SEQ ID NO: 3868686 - RNA, 15 nt, Human
gagucugaaggcugg

SEQ ID NO: 3868687 - RNA, 12 nt, Human
gagucugaggcc

SEQ ID NO: 3868688 - RNA, 17 nt, Human
gagucugagguccugag

SEQ ID NO: 3868689 - RNA, 12 nt, Human
gagucugaugau

SEQ ID NO: 3868690 - RNA, 16 nt, Human
gagucugccacccagg

SEQ ID NO: 3868691 - RNA, 14 nt, Human
gagucuggaguggg

SEQ ID NO: 3868692 - RNA, 18 nt, Human
gagucuggcccuagacuc

SEQ ID NO: 3868693 - RNA, 11 nt, Human
gagucugggac

SEQ ID NO: 3868694 - RNA, 16 nt, Human
gagucuguucugguaa

SEQ ID NO: 3868695 - RNA, 22 nt, Human
gagucuguugugugucaugcca

SEQ ID NO: 3868696 - RNA, 16 nt, Human
gagucuguuuuguaaa

SEQ ID NO: 3868697 - RNA, 11 nt, Human
gagucuucaug

SEQ ID NO: 3868698 - RNA, 20 nt, Human
gagucuugcuauauugccca

SEQ ID NO: 3868699 - RNA, 14 nt, Human
gagucuuugguucu

SEQ ID NO: 3868700 - RNA, 16 nt, Human
gagucuuugguucuaa

SEQ ID NO: 3868701 - RNA, 15 nt, Human
gagugaaaaagagaa

SEQ ID NO: 3868702 - RNA, 22 nt, Human
gagugaacaaauuuacagagac

SEQ ID NO: 3868703 - RNA, 21 nt, Human
gagugaacuggucuuccuuuu

SEQ ID NO: 3868704 - RNA, 19 nt, Human
gagugaagaggggcagccc

SEQ ID NO: 3868705 - RNA, 17 nt, Human
gagugaagcugggagaa

SEQ ID NO: 3868706 - RNA, 15 nt, Human
gagugaauucccuca

SEQ ID NO: 3868707 - RNA, 18 nt, Human
gagugaauucccucacuc

SEQ ID NO: 3868708 - RNA, 14 nt, Human
gagugacagaggca

SEQ ID NO: 3868709 - RNA, 14 nt, Human
gagugagacagacu

SEQ ID NO: 3868710 - RNA, 22 nt, Human
gagugagacccagcccucaucc

SEQ ID NO: 3868711 - RNA, 13 nt, Human
gagugagacccug

SEQ ID NO: 3868712 - RNA, 19 nt, Human
gagugagaggggaggccaa

SEQ ID NO: 3868713 - RNA, 20 nt, Human
gagugagaggggaggccaag

SEQ ID NO: 3868714 - RNA, 13 nt, Human
gagugagccuggc

SEQ ID NO: 3868715 - RNA, 12 nt, Human
gagugagcuggu

SEQ ID NO: 3868716 - RNA, 21 nt, Human
gagugagggguaaaagcugau

SEQ ID NO: 3868717 - RNA, 22 nt, Human
gagugaggguuucugagcugcu

SEQ ID NO: 3868718 - RNA, 21 nt, Human
gagugaguuggguguauugug

SEQ ID NO: 3868719 - RNA, 15 nt, Human
gagugauauggagca

SEQ ID NO: 3868720 - RNA, 12 nt, Human
gagugauugcag

SEQ ID NO: 3868721 - RNA, 12 nt, Human
gagugcacagcu

SEQ ID NO: 3868722 - RNA, 15 nt, Human
gagugcaggcccacc

SEQ ID NO: 3868723 - RNA, 18 nt, Human
gagugcaggcccacccug

SEQ ID NO: 3868724 - RNA, 22 nt, Human
gagugcaguccugaucagagcc

SEQ ID NO: 3868725 - RNA, 18 nt, Human
gagugcagugagccgaga

SEQ ID NO: 3868726 - RNA, 18 nt, Human
gagugccaacuucuuuca

SEQ ID NO: 3868727 - RNA, 15 nt, Human
gagugccccaccugc

SEQ ID NO: 3868728 - RNA, 18 nt, Human
gagugccuuacacaaugg

SEQ ID NO: 3868729 - RNA, 14 nt, Human
gagugccuuuugca

SEQ ID NO: 3868730 - RNA, 18 nt, Human
gagugcggaccacccuca

SEQ ID NO: 3868731 - RNA, 15 nt, Human
gagugcguggugcga

SEQ ID NO: 3868732 - RNA, 15 nt, Human
gagugcuaaguguag

SEQ ID NO: 3868733 - RNA, 21 nt, Human
gagugcucaguagucagacug

SEQ ID NO: 3868734 - RNA, 19 nt, Human
gagugcuugcuuuucaugc

SEQ ID NO: 3868735 - RNA, 19 nt, Human
gaguggaauaguauccucc

SEQ ID NO: 3868736 - RNA, 18 nt, Human
gcaaaccaagagauugcu

SEQ ID NO: 3868737 - RNA, 21 nt, Human
gcaaaccaagagauugcuaau

SEQ ID NO: 3868738 - RNA, 22 nt, Human
gcaaaccacacuggacuccggc

SEQ ID NO: 3868739 - RNA, 12 nt, Human
gcaaaccaucau

SEQ ID NO: 3868740 - RNA, 17 nt, Human
gcaaaccaucauugaaa

SEQ ID NO: 3868741 - RNA, 16 nt, Human
gcaaaccauuuuuaaa

SEQ ID NO: 3868742 - RNA, 20 nt, Human
gcaaacccugucaaacauua

SEQ ID NO: 3868743 - RNA, 14 nt, Human
gcaaacgcuaaaga

SEQ ID NO: 3868744 - RNA, 14 nt, Human
gcaaacgcugccug

SEQ ID NO: 3868745 - RNA, 15 nt, Human
gcaaacgcugccugc

SEQ ID NO: 3868746 - RNA, 18 nt, Human
gcaaacgcugccugcccg

SEQ ID NO: 3868747 - RNA, 17 nt, Human
gcaaacucacugcucaa

SEQ ID NO: 3868748 - RNA, 19 nt, Human
gcaaacucacugcucaaga

SEQ ID NO: 3868749 - RNA, 14 nt, Human
gcaaacucugcugu

SEQ ID NO: 3868750 - RNA, 13 nt, Human
gcaaacugcaugc

SEQ ID NO: 3868751 - RNA, 17 nt, Human
gcaaacugggaaccccu

SEQ ID NO: 3868752 - RNA, 20 nt, Human
gcaaacugggaaccccuuuc

SEQ ID NO: 3868753 - RNA, 23 nt, Human
gcaaacugggaaccccuuuccca

SEQ ID NO: 3868754 - RNA, 15 nt, Human
gcaaacuucagaguu

SEQ ID NO: 3868755 - RNA, 18 nt, Human
gcaaacuuuauuuugugu

SEQ ID NO: 3868756 - RNA, 22 nt, Human
gcaaagaaagugggaggucagg

SEQ ID NO: 3868757 - RNA, 22 nt, Human
gcaaagaacucuuacccuggca

SEQ ID NO: 3868758 - RNA, 14 nt, Human
gcaaagaauugacu

SEQ ID NO: 3868759 - RNA, 21 nt, Human
gcaaagacuauucccuucuaa

SEQ ID NO: 3868760 - RNA, 22 nt, Human
gcaaagacuauucccuucuaac

SEQ ID NO: 3868761 - RNA, 18 nt, Human
gcaaagaucaaaauaaaa

SEQ ID NO: 3868762 - RNA, 19 nt, Human
gcaaagaucuguccucagc

SEQ ID NO: 3868763 - RNA, 21 nt, Human
gcaaagaucuguccucagccu

SEQ ID NO: 3868764 - RNA, 22 nt, Human
gcaaagaucuguccucagccuu

SEQ ID NO: 3868765 - RNA, 14 nt, Human
gcaaagaugaaggu

SEQ ID NO: 3868766 - RNA, 13 nt, Human
gcaaagcacagag

SEQ ID NO: 3868767 - RNA, 22 nt, Human
gcaaagcaccagcuucuccagg

SEQ ID NO: 3868768 - RNA, 19 nt, Human
gcaaagccccaugcuggag

SEQ ID NO: 3868769 - RNA, 19 nt, Human
gcaaagccuguucauggca

SEQ ID NO: 3868770 - RNA, 21 nt, Human
gcaaagccuguucauggcaga

SEQ ID NO: 3868771 - RNA, 14 nt, Human
gcaaagcgacguua

SEQ ID NO: 3868772 - RNA, 19 nt, Human
gcaaagcucuguggccaca

SEQ ID NO: 3868773 - RNA, 21 nt, Human
gcaaagcugaugacaacuucc

SEQ ID NO: 3868774 - RNA, 17 nt, Human
gcaaagcuguucuuccu

SEQ ID NO: 3868775 - RNA, 19 nt, Human
gcaaagcuguucuuccugg

SEQ ID NO: 3868776 - RNA, 23 nt, Human
gcaaaggacuguuuuuuccugag

SEQ ID NO: 3868777 - RNA, 20 nt, Human
gcaaagggagcacuggguug

SEQ ID NO: 3868778 - RNA, 18 nt, Human
gcaaaggguccagaagga

SEQ ID NO: 3868779 - RNA, 19 nt, Human
gcaaagguuccaacuguau

SEQ ID NO: 3868780 - RNA, 21 nt, Human
gcaaagguuccaacuguauau

SEQ ID NO: 3868781 - RNA, 12 nt, Human
gcaaaguacaau

SEQ ID NO: 3868782 - RNA, 19 nt, Human
gcaaaguacaauguguuuu

SEQ ID NO: 3868783 - RNA, 22 nt, Human
gcaaaguacuguaagaauaauu

SEQ ID NO: 3868784 - RNA, 15 nt, Human
gcaaaguauuguaaa

SEQ ID NO: 3868785 - RNA, 12 nt, Human
gcaaaguguuuu

SEQ ID NO: 3868786 - RNA, 17 nt, Human
gcaaaguguuuuguacc

SEQ ID NO: 3868787 - RNA, 19 nt, Human
gcaaauaacaaaugccaaa

SEQ ID NO: 3868788 - RNA, 17 nt, Human
gcaaauaaguguauuuu

SEQ ID NO: 3868789 - RNA, 17 nt, Human
gcaaauagaaaacagga

SEQ ID NO: 3868790 - RNA, 16 nt, Human
gcaaauauaaacaucu

SEQ ID NO: 3868791 - RNA, 21 nt, Human
gcaaaucaccacaaacuguaa

SEQ ID NO: 3868792 - RNA, 18 nt, Human
gcaaaucaguuacuaaga

SEQ ID NO: 3868793 - RNA, 16 nt, Human
gcaaauccgaaaucag

SEQ ID NO: 3868794 - RNA, 20 nt, Human
gcaaauccuugugggaaaag

SEQ ID NO: 3868795 - RNA, 12 nt, Human
gcaaaucuugaa

SEQ ID NO: 3868796 - RNA, 19 nt, Human
gcaaaugacaugcacugac

SEQ ID NO: 3868797 - RNA, 17 nt, Human
gcaaaugccagggcccg

SEQ ID NO: 3868798 - RNA, 23 nt, Human
gcaaauggugguuguuucuucca

SEQ ID NO: 3868799 - RNA, 23 nt, Human
gcaaauguaguauggccuguguc

SEQ ID NO: 3868800 - RNA, 18 nt, Human
gcaaaugucaucagaacu

SEQ ID NO: 3868801 - RNA, 23 nt, Human
gcaaaugugaaucauuuuaccuu

SEQ ID NO: 3868802 - RNA, 12 nt, Human
gcaaauguguac

SEQ ID NO: 3868803 - RNA, 21 nt, Human
gcaaauguuacauaguguagg

SEQ ID NO: 3868804 - RNA, 17 nt, Human
gcaaauguuuauuuaaa

SEQ ID NO: 3868805 - RNA, 12 nt, Human
gcaaauuucaaa

SEQ ID NO: 3868806 - RNA, 16 nt, Human
gcaaauuucaaaagac

SEQ ID NO: 3868807 - RNA, 23 nt, Human
gcaaauuucaaaagacauguugu

SEQ ID NO: 3868808 - RNA, 22 nt, Human
gcaacaaacugcacaugauuuc

SEQ ID NO: 3868809 - RNA, 22 nt, Human
gcaacaagaccaccacuucgaa

SEQ ID NO: 3868810 - RNA, 15 nt, Human
gcaacaauuuucaga

SEQ ID NO: 3868811 - RNA, 19 nt, Human
gcaacacaagcuggaagca

SEQ ID NO: 3868812 - RNA, 15 nt, Human
gcaacacagaggaau

SEQ ID NO: 3868813 - RNA, 18 nt, Human
gcaacacagccugggccc

SEQ ID NO: 3868814 - RNA, 17 nt, Human
gcaacacucuauauuua

SEQ ID NO: 3868815 - RNA, 13 nt, Human
gcaacagaaaaaa

SEQ ID NO: 3868816 - RNA, 17 nt, Human
gcaacagaaaaauggag

SEQ ID NO: 3868817 - RNA, 14 nt, Human
gcaacagagugaga

SEQ ID NO: 3868818 - RNA, 13 nt, Human
gcaacagaucugg

SEQ ID NO: 3868819 - RNA, 16 nt, Human
gcaacagaucuggaac

SEQ ID NO: 3868820 - RNA, 22 nt, Human
gcaacagaucuggaaccucagc

SEQ ID NO: 3868821 - RNA, 13 nt, Human
gcaacagcacugg

SEQ ID NO: 3868822 - RNA, 18 nt, Human
gcaacagcacuggcucuc

SEQ ID NO: 3868823 - RNA, 20 nt, Human
gcaacagcacuggcucucuc

SEQ ID NO: 3868824 - RNA, 19 nt, Human
gcaacaggccauugugaac

SEQ ID NO: 3868825 - RNA, 13 nt, Human
gcaacaggcuggg

SEQ ID NO: 3868826 - RNA, 14 nt, Human
gcaacaggcugggc

SEQ ID NO: 3868827 - RNA, 16 nt, Human
gcaacaggcugggcuu

SEQ ID NO: 3868828 - RNA, 22 nt, Human
gcaacaggguauggacuaucug

SEQ ID NO: 3868829 - RNA, 20 nt, Human
gcaacagguuuuauaauuuu

SEQ ID NO: 3868830 - RNA, 13 nt, Human
gcaacaucuuuuu

SEQ ID NO: 3868831 - RNA, 23 nt, Human
gcaacaugcuucaugaaaauccu

SEQ ID NO: 3868832 - RNA, 14 nt, Human
gcaacauuccaaga

SEQ ID NO: 3868833 - RNA, 15 nt, Human
gcaaccaagucacac

SEQ ID NO: 3868834 - RNA, 15 nt, Human
gcaaccacacaccuc

SEQ ID NO: 3868835 - RNA, 16 nt, Human
gcaaccaccaccaacc

SEQ ID NO: 3868836 - RNA, 15 nt, Human
gcaaccagagcacug

SEQ ID NO: 3868837 - RNA, 19 nt, Human
gcaaccagagcacuguaua

SEQ ID NO: 3868838 - RNA, 15 nt, Human
gcaaccaggaacagc

SEQ ID NO: 3868839 - RNA, 14 nt, Human
gcaaccauuugaaa

SEQ ID NO: 3868840 - RNA, 19 nt, Human
gcaaccccaggcugaagca

SEQ ID NO: 3868841 - RNA, 21 nt, Human
gcaaccccaguucugcuccuc

SEQ ID NO: 3868842 - RNA, 18 nt, Human
gcaacccccagccugcua

SEQ ID NO: 3868843 - RNA, 13 nt, Human
gcaaccccuggac

SEQ ID NO: 3868844 - RNA, 18 nt, Human
gcaaccgccucaaaaugu

SEQ ID NO: 3868845 - RNA, 23 nt, Human
gcaaccgucuguuaugcugugac

SEQ ID NO: 3868846 - RNA, 18 nt, Human
gcaaccguggcccuuccu

SEQ ID NO: 3868847 - RNA, 19 nt, Human
gcaaccucaguaauuuaga

SEQ ID NO: 3868848 - RNA, 16 nt, Human
gcaaccuccaccuccu

SEQ ID NO: 3868849 - RNA, 17 nt, Human
gcaaccucccaacccag

SEQ ID NO: 3868850 - RNA, 18 nt, Human
gcaaccuccgccucuugg

SEQ ID NO: 3868851 - RNA, 19 nt, Human
gcaaccuccgccucuuggg

SEQ ID NO: 3868852 - RNA, 23 nt, Human
gcaaccucugccuccuggguuca

SEQ ID NO: 3868853 - RNA, 17 nt, Human
gcaaccugauuguaaac

SEQ ID NO: 3868854 - RNA, 18 nt, Human
gcaaccugauuguaaacu

SEQ ID NO: 3868855 - RNA, 14 nt, Human
gcaaccugcuucca

SEQ ID NO: 3868856 - RNA, 14 nt, Human
gcaaccugggucca

SEQ ID NO: 3868857 - RNA, 18 nt, Human
gcaacggggaggccaagu

SEQ ID NO: 3868858 - RNA, 22 nt, Human
gcaacguuuacaccgacuagcc

SEQ ID NO: 3868859 - RNA, 13 nt, Human
gcaacucugaagg

SEQ ID NO: 3868860 - RNA, 19 nt, Human
gcaacugaauaaauaccuc

SEQ ID NO: 3868861 - RNA, 19 nt, Human
gcaacugacacucccaccc

SEQ ID NO: 3868862 - RNA, 19 nt, Human
gcaacugaggcagacagca

SEQ ID NO: 3868863 - RNA, 22 nt, Human
gcaacugaggcagacagcagcu

SEQ ID NO: 3868864 - RNA, 21 nt, Human
gcaacugcugaugcucauggu

SEQ ID NO: 3868865 - RNA, 11 nt, Human
gcaacugggac

SEQ ID NO: 3868866 - RNA, 23 nt, Human
gcaacugucuauuucugcugaau

SEQ ID NO: 3868867 - RNA, 20 nt, Human
gcaacuguuaugaaauaaag

SEQ ID NO: 3868868 - RNA, 19 nt, Human
gcaacuucaguccugggag

SEQ ID NO: 3868869 - RNA, 21 nt, Human
gcaacuugucuuuuucuggac

SEQ ID NO: 3868870 - RNA, 17 nt, Human
gcaagaaaaaaaaaugc

SEQ ID NO: 3868871 - RNA, 18 nt, Human
gcaagaaaaaaaaaugcc

SEQ ID NO: 3868872 - RNA, 20 nt, Human
gcaagaaggcaaaaauaguu

SEQ ID NO: 3868873 - RNA, 21 nt, Human
gcaagaaugguggcuucuuuu

SEQ ID NO: 3868874 - RNA, 14 nt, Human
gcaagacgcccucu

SEQ ID NO: 3868875 - RNA, 20 nt, Human
gcaagacgcugugcugcccu

SEQ ID NO: 3868876 - RNA, 19 nt, Human
gcaagacuucucuuugccu

SEQ ID NO: 3868877 - RNA, 21 nt, Human
gcaagacuucucuuugccuca

SEQ ID NO: 3868878 - RNA, 22 nt, Human
gcaagacuucucuuugccucaa

SEQ ID NO: 3868879 - RNA, 15 nt, Human
gcaccucagccugca

SEQ ID NO: 3868880 - RNA, 18 nt, Human
gcaccuccacauccucca

SEQ ID NO: 3868881 - RNA, 11 nt, Human
gcaccucccau

SEQ ID NO: 3868882 - RNA, 17 nt, Human
gcaccuccccccacugc

SEQ ID NO: 3868883 - RNA, 16 nt, Human
gcaccuccucagccug

SEQ ID NO: 3868884 - RNA, 17 nt, Human
gcaccuccuugucacuu

SEQ ID NO: 3868885 - RNA, 19 nt, Human
gcaccucugaccuaucacu

SEQ ID NO: 3868886 - RNA, 20 nt, Human
gcaccucuuccuugauguuu

SEQ ID NO: 3868887 - RNA, 21 nt, Human
gcaccugauggaaaagauaua

SEQ ID NO: 3868888 - RNA, 15 nt, Human
gcaccugcagguugg

SEQ ID NO: 3868889 - RNA, 13 nt, Human
gcaccugccagcc

SEQ ID NO: 3868890 - RNA, 14 nt, Human
gcaccugccagccu

SEQ ID NO: 3868891 - RNA, 15 nt, Human
gcaccugccagccug

SEQ ID NO: 3868892 - RNA, 16 nt, Human
gcaccugcccccuggu

SEQ ID NO: 3868893 - RNA, 18 nt, Human
gcaccugcccccuggugg

SEQ ID NO: 3868894 - RNA, 23 nt, Human
gcaccugcugucuggguggcuca

SEQ ID NO: 3868895 - RNA, 18 nt, Human
gcaccuggaauauauaac

SEQ ID NO: 3868896 - RNA, 19 nt, Human
gcaccugggcccuggggcc

SEQ ID NO: 3868897 - RNA, 21 nt, Human
gcaccuguaaucccagcuacu

SEQ ID NO: 3868898 - RNA, 22 nt, Human
gcaccuguacaguggaaccguu

SEQ ID NO: 3868899 - RNA, 23 nt, Human
gcaccuguacaguggaaccguug

SEQ ID NO: 3868900 - RNA, 16 nt, Human
gcaccuguagucccag

SEQ ID NO: 3868901 - RNA, 18 nt, Human
gcaccuguagucccagcu

SEQ ID NO: 3868902 - RNA, 15 nt, Human
gcaccugucccagaa

SEQ ID NO: 3868903 - RNA, 19 nt, Human
gcaccugucccagaaaaag

SEQ ID NO: 3868904 - RNA, 22 nt, Human
gcaccugucccagaaaaagcau

SEQ ID NO: 3868905 - RNA, 15 nt, Human
gcaccuguccccacc

SEQ ID NO: 3868906 - RNA, 16 nt, Human
gcaccugucugcucca

SEQ ID NO: 3868907 - RNA, 21 nt, Human
gcaccugucugcuccagcucu

SEQ ID NO: 3868908 - RNA, 19 nt, Human
gcaccuuaccaacuuucug

SEQ ID NO: 3868909 - RNA, 20 nt, Human
gcaccuuaccaacuuucugu

SEQ ID NO: 3868910 - RNA, 17 nt, Human
gcaccuuagacaguccc

SEQ ID NO: 3868911 - RNA, 20 nt, Human
gcaccuuagacagucccugc

SEQ ID NO: 3868912 - RNA, 16 nt, Human
gcaccuuaguggcuuu

SEQ ID NO: 3868913 - RNA, 18 nt, Human
gcaccuugugccuggggu

SEQ ID NO: 3868914 - RNA, 22 nt, Human
gcaccuugugucuguacacgug

SEQ ID NO: 3868915 - RNA, 17 nt, Human
gcaccuuucuaguugaa

SEQ ID NO: 3868916 - RNA, 16 nt, Human
gcaccuuugcacagga

SEQ ID NO: 3868917 - RNA, 15 nt, Human
gcacgaaauguuauu

SEQ ID NO: 3868918 - RNA, 15 nt, Human
gcacgaacccaccug

SEQ ID NO: 3868919 - RNA, 19 nt, Human
gcacgaacccaccugcuga

SEQ ID NO: 3868920 - RNA, 16 nt, Human
gcacgaccgccccagu

SEQ ID NO: 3868921 - RNA, 21 nt, Human
gcacgacgcccucuccccacc

SEQ ID NO: 3868922 - RNA, 20 nt, Human
gcacgagugggaaggacuug

SEQ ID NO: 3868923 - RNA, 23 nt, Human
gcacgauguggaaaaaugagaga

SEQ ID NO: 3868924 - RNA, 15 nt, Human
gcacgauuucuguuu

SEQ ID NO: 3868925 - RNA, 10 nt, Human
gcacgcacac

SEQ ID NO: 3868926 - RNA, 11 nt, Human
gcacgcacaca

SEQ ID NO: 3868927 - RNA, 12 nt, Human
gcacgcacacac

SEQ ID NO: 3868928 - RNA, 15 nt, Human
gcacgcacacugucu

SEQ ID NO: 3868929 - RNA, 20 nt, Human
gcacgcgcccuuucuaccau

SEQ ID NO: 3868930 - RNA, 20 nt, Human
gcacgcggagugaguuuuuu

SEQ ID NO: 3868931 - RNA, 23 nt, Human
gcacgcggauuaauuugcaucug

SEQ ID NO: 3868932 - RNA, 16 nt, Human
gcacgcugugggcagg

SEQ ID NO: 3868933 - RNA, 19 nt, Human
gcacgcuugcguaugucug

SEQ ID NO: 3868934 - RNA, 15 nt, Human
gcacggacaauaaac

SEQ ID NO: 3868935 - RNA, 18 nt, Human
gcacggacaauaaaccuc

SEQ ID NO: 3868936 - RNA, 22 nt, Human
gcacggcucuguccccagccug

SEQ ID NO: 3868937 - RNA, 13 nt, Human
gcacggcugcuga

SEQ ID NO: 3868938 - RNA, 18 nt, Human
gcacggugaauggcuuug

SEQ ID NO: 3868939 - RNA, 14 nt, Human
gcacggugggccuu

SEQ ID NO: 3868940 - RNA, 17 nt, Human
gcacggugggccuugcu

SEQ ID NO: 3868941 - RNA, 18 nt, Human
gcacggugggccuugcug

SEQ ID NO: 3868942 - RNA, 19 nt, Human
gcacggugggccuugcugg

SEQ ID NO: 3868943 - RNA, 20 nt, Human
gcacggugggccuugcuggg

SEQ ID NO: 3868944 - RNA, 17 nt, Human
gcacguaaaguacuugu

SEQ ID NO: 3868945 - RNA, 15 nt, Human
gcacguggagagcug

SEQ ID NO: 3868946 - RNA, 18 nt, Human
gcacguggagagcuggug

SEQ ID NO: 3868947 - RNA, 15 nt, Human
gcacguggccucuug

SEQ ID NO: 3868948 - RNA, 17 nt, Human
gcacguggcuucugaug

SEQ ID NO: 3868949 - RNA, 23 nt, Human
gcacguguguuuuucuauuaaaa

SEQ ID NO: 3868950 - RNA, 19 nt, Human
gcacguuuaaaguucugug

SEQ ID NO: 3868951 - RNA, 14 nt, Human
gcacuaaagcagug

SEQ ID NO: 3868952 - RNA, 15 nt, Human
gcacuaaagccagcc

SEQ ID NO: 3868953 - RNA, 14 nt, Human
gcacuaaauaugaa

SEQ ID NO: 3868954 - RNA, 15 nt, Human
gcacuaaauaugaac

SEQ ID NO: 3868955 - RNA, 19 nt, Human
gcacuaacguugagccccu

SEQ ID NO: 3868956 - RNA, 15 nt, Human
gcacuaagauauuuc

SEQ ID NO: 3868957 - RNA, 23 nt, Human
gcacuaaggggcccggccagcca

SEQ ID NO: 3868958 - RNA, 20 nt, Human
gcacuaaggugugcucugau

SEQ ID NO: 3868959 - RNA, 16 nt, Human
gcacuaccgauucuuu

SEQ ID NO: 3868960 - RNA, 12 nt, Human
gcacuacugggu

SEQ ID NO: 3868961 - RNA, 16 nt, Human
gcacuacuggguguca

SEQ ID NO: 3868962 - RNA, 18 nt, Human
gcacuacugggugucauu

SEQ ID NO: 3868963 - RNA, 24 nt, Human
gcacuagacugguggcaggggcuu

SEQ ID NO: 3868964 - RNA, 18 nt, Human
gcacuagagaaugcacag

SEQ ID NO: 3868965 - RNA, 15 nt, Human
gcacuagccaaaccu

SEQ ID NO: 3868966 - RNA, 18 nt, Human
gcacuagccaaaccucac

SEQ ID NO: 3868967 - RNA, 20 nt, Human
gcacuagccaaaccucacca

SEQ ID NO: 3868968 - RNA, 16 nt, Human
gcacuagccuuuggcu

SEQ ID NO: 3868969 - RNA, 17 nt, Human
gcacuaggcacccagcu

SEQ ID NO: 3868970 - RNA, 22 nt, Human
gcacuauaauguaagcucuacu

SEQ ID NO: 3868971 - RNA, 14 nt, Human
gcacuauaugcaaa

SEQ ID NO: 3868972 - RNA, 18 nt, Human
gcacuaucuuucagcucc

SEQ ID NO: 3868973 - RNA, 22 nt, Human
gcacuaugaggaauaauuauuu

SEQ ID NO: 3868974 - RNA, 15 nt, Human
gcacuauugagucuu

SEQ ID NO: 3868975 - RNA, 17 nt, Human
gcacuauuuauuuacaa

SEQ ID NO: 3868976 - RNA, 21 nt, Human
gcacuauuuauuuacaaaugu

SEQ ID NO: 3868977 - RNA, 22 nt, Human
gcacucacacaggacccccuuc

SEQ ID NO: 3868978 - RNA, 20 nt, Human
gcacucacagaccuggagcc

SEQ ID NO: 3868979 - RNA, 19 nt, Human
gcacucacccaugugccaa

SEQ ID NO: 3868980 - RNA, 20 nt, Human
gcacucacccaugugccaag

SEQ ID NO: 3868981 - RNA, 17 nt, Human
gcacucagaagacacug

SEQ ID NO: 3868982 - RNA, 20 nt, Human
gcacucagaagacacugaug

SEQ ID NO: 3868983 - RNA, 20 nt, Human
gcacucauuuucuauaacag

SEQ ID NO: 3868984 - RNA, 13 nt, Human
gcacuccagccug

SEQ ID NO: 3868985 - RNA, 16 nt, Human
gcacuccagccugggc

SEQ ID NO: 3868986 - RNA, 21 nt, Human
gcacuccagccugggcgacag

SEQ ID NO: 3868987 - RNA, 15 nt, Human
gcacuccaugcuuag

SEQ ID NO: 3868988 - RNA, 12 nt, Human
gcacuccccugc

SEQ ID NO: 3868989 - RNA, 13 nt, Human
gcacuccccugcu

SEQ ID NO: 3868990 - RNA, 14 nt, Human
gcacuccccugcug

SEQ ID NO: 3868991 - RNA, 23 nt, Human
gcacucccuugguggcaagagcc

SEQ ID NO: 3868992 - RNA, 19 nt, Human
gcacuccucgguacuccca

SEQ ID NO: 3868993 - RNA, 17 nt, Human
gcacucgcuagcagugg

SEQ ID NO: 3868994 - RNA, 12 nt, Human
gcacucuagauu

SEQ ID NO: 3868995 - RNA, 13 nt, Human
gcacucuagauuc

SEQ ID NO: 3868996 - RNA, 15 nt, Human
gcacucuagauucca

SEQ ID NO: 3868997 - RNA, 23 nt, Human
gcacucugaguuuaccauuugua

SEQ ID NO: 3868998 - RNA, 19 nt, Human
gcacucugugcccaugggc

SEQ ID NO: 3868999 - RNA, 19 nt, Human
gcacucuguuauuuagacu

SEQ ID NO: 3869000 - RNA, 14 nt, Human
gcacugaaaagguu

SEQ ID NO: 3869001 - RNA, 14 nt, Human
gcacugaaguuuga

SEQ ID NO: 3869002 - RNA, 22 nt, Human
gcacugacauuguuggccaaag

SEQ ID NO: 3869003 - RNA, 14 nt, Human
gcacugacccuucc

SEQ ID NO: 3869004 - RNA, 15 nt, Human
gcacugacccuucca

SEQ ID NO: 3869005 - RNA, 20 nt, Human
gcacugacccuuccagacau

SEQ ID NO: 3869006 - RNA, 21 nt, Human
gcacugacccuuccagacaua

SEQ ID NO: 3869007 - RNA, 15 nt, Human
gcacugacuucuaag

SEQ ID NO: 3869008 - RNA, 21 nt, Human
gcacugagauaccagcgagga

SEQ ID NO: 3869009 - RNA, 15 nt, Human
gcacugagauauuua

SEQ ID NO: 3869010 - RNA, 12 nt, Human
gcacugagcccc

SEQ ID NO: 3869011 - RNA, 11 nt, Human
gcacugagggc

SEQ ID NO: 3869012 - RNA, 12 nt, Human
gcacugagggcc

SEQ ID NO: 3869013 - RNA, 19 nt, Human
gcacugaugcugccccuca

SEQ ID NO: 3869014 - RNA, 22 nt, Human
gcacugaugcugccccucaucu

SEQ ID NO: 3869015 - RNA, 18 nt, Human
gcacugauguuguguuuu

SEQ ID NO: 3869016 - RNA, 12 nt, Human
gcacugauuuca

SEQ ID NO: 3869017 - RNA, 19 nt, Human
gcacugauuucacaacaga

SEQ ID NO: 3869018 - RNA, 13 nt, Human
gcacugccaggag

SEQ ID NO: 3869019 - RNA, 14 nt, Human
gcacugccaggagg

SEQ ID NO: 3869020 - RNA, 16 nt, Human
gcacugccaggaggga

SEQ ID NO: 3869021 - RNA, 15 nt, Human
gcacugccaugcagg

SEQ ID NO: 3869022 - RNA, 21 nt, Human
gcacugccucucacagcugag

SEQ ID NO: 3869023 - RNA, 18 nt, Human
gcacugccugauggaccu

SEQ ID NO: 3869024 - RNA, 17 nt, Human
gccaccucuaacagcac

SEQ ID NO: 3869025 - RNA, 19 nt, Human
gccaccucuaacagcacca

SEQ ID NO: 3869026 - RNA, 12 nt, Human
gccaccucucca

SEQ ID NO: 3869027 - RNA, 13 nt, Human
gccaccucuccaa

SEQ ID NO: 3869028 - RNA, 15 nt, Human
gccaccucuccaagg

SEQ ID NO: 3869029 - RNA, 18 nt, Human
gccaccucuccaagggcu

SEQ ID NO: 3869030 - RNA, 13 nt, Human
gccaccucucucc

SEQ ID NO: 3869031 - RNA, 23 nt, Human
gccaccucugcggaccccagcug

SEQ ID NO: 3869032 - RNA, 16 nt, Human
gccaccucugucauuu

SEQ ID NO: 3869033 - RNA, 22 nt, Human
gccaccugaggugggcccagga

SEQ ID NO: 3869034 - RNA, 10 nt, Human
gccaccugcc

SEQ ID NO: 3869035 - RNA, 14 nt, Human
gccaccugcccccu

SEQ ID NO: 3869036 - RNA, 20 nt, Human
gccaccugcccccuucuccc

SEQ ID NO: 3869037 - RNA, 21 nt, Human
gccaccugcccccuucuccca

SEQ ID NO: 3869038 - RNA, 23 nt, Human
gccaccugcccccuucucccaca

SEQ ID NO: 3869039 - RNA, 11 nt, Human
gccaccugccu

SEQ ID NO: 3869040 - RNA, 12 nt, Human
gccaccuggacc

SEQ ID NO: 3869041 - RNA, 13 nt, Human
gccaccuggaccc

SEQ ID NO: 3869042 - RNA, 13 nt, Human
gccaccuguccca

SEQ ID NO: 3869043 - RNA, 13 nt, Human
gccaccugucugu

SEQ ID NO: 3869044 - RNA, 14 nt, Human
gccaccugucuguc

SEQ ID NO: 3869045 - RNA, 20 nt, Human
gccacgcccaacuaauuuuu

SEQ ID NO: 3869046 - RNA, 21 nt, Human
gccacgcgguacaaaggaaaa

SEQ ID NO: 3869047 - RNA, 19 nt, Human
gccacggccaggccagagg

SEQ ID NO: 3869048 - RNA, 17 nt, Human
gccacgugccaggcccg

SEQ ID NO: 3869049 - RNA, 21 nt, Human
gccacgugggcaaacaggcag

SEQ ID NO: 3869050 - RNA, 15 nt, Human
gccacguuccacagu

SEQ ID NO: 3869051 - RNA, 22 nt, Human
gccacguuccuuacugcagaau

SEQ ID NO: 3869052 - RNA, 19 nt, Human
gccacuaaccuugccuggu

SEQ ID NO: 3869053 - RNA, 23 nt, Human
gccacuaacuagagcagcccugg

SEQ ID NO: 3869054 - RNA, 20 nt, Human
gccacuaagaaccccucugc

SEQ ID NO: 3869055 - RNA, 13 nt, Human
gccacuaagcaga

SEQ ID NO: 3869056 - RNA, 16 nt, Human
gccacuaagcagagga

SEQ ID NO: 3869057 - RNA, 21 nt, Human
gccacuagacucuucacuguu

SEQ ID NO: 3869058 - RNA, 14 nt, Human
gccacuaggcuggg

SEQ ID NO: 3869059 - RNA, 16 nt, Human
gccacuaggcugggug

SEQ ID NO: 3869060 - RNA, 17 nt, Human
gccacuaggcugggugc

SEQ ID NO: 3869061 - RNA, 16 nt, Human
gccacucaccgaagcc

SEQ ID NO: 3869062 - RNA, 15 nt, Human
gccacucacuaggcc

SEQ ID NO: 3869063 - RNA, 18 nt, Human
gccacucacuaggccccc

SEQ ID NO: 3869064 - RNA, 22 nt, Human
gccacucaggcccaaagccucg

SEQ ID NO: 3869065 - RNA, 20 nt, Human
gccacucauuucaucucauu

SEQ ID NO: 3869066 - RNA, 22 nt, Human
gccacuccagaccccuggcuuu

SEQ ID NO: 3869067 - RNA, 13 nt, Human
gccacuccccagc

SEQ ID NO: 3869068 - RNA, 21 nt, Human
gccacuccgagaggugggcca

SEQ ID NO: 3869069 - RNA, 13 nt, Human
gccacuccucuga

SEQ ID NO: 3869070 - RNA, 17 nt, Human
gccacuccucugacuca

SEQ ID NO: 3869071 - RNA, 21 nt, Human
gccacuccucugacucagggc

SEQ ID NO: 3869072 - RNA, 14 nt, Human
gccacucgcuuccc

SEQ ID NO: 3869073 - RNA, 18 nt, Human
gccacucgcuucccccau

SEQ ID NO: 3869074 - RNA, 18 nt, Human
gccacucucuucccuuuc

SEQ ID NO: 3869075 - RNA, 15 nt, Human
gccacucugccucug

SEQ ID NO: 3869076 - RNA, 22 nt, Human
gccacucugccucugccugcau

SEQ ID NO: 3869077 - RNA, 13 nt, Human
gccacucuguucc

SEQ ID NO: 3869078 - RNA, 13 nt, Human
gccacucuuccaa

SEQ ID NO: 3869079 - RNA, 14 nt, Human
gccacugaagcugg

SEQ ID NO: 3869080 - RNA, 20 nt, Human
gccacugaggggggauccag

SEQ ID NO: 3869081 - RNA, 16 nt, Human
gccacugauauucaga

SEQ ID NO: 3869082 - RNA, 16 nt, Human
gccacugcacagagcu

SEQ ID NO: 3869083 - RNA, 17 nt, Human
gccacugcaccgggcca

SEQ ID NO: 3869084 - RNA, 19 nt, Human
gccacugcaccgggccaca

SEQ ID NO: 3869085 - RNA, 20 nt, Human
gccacugcaccgggccacag

SEQ ID NO: 3869086 - RNA, 21 nt, Human
gccacugcaccgggccacaga

SEQ ID NO: 3869087 - RNA, 21 nt, Human
gccacugcacuauagccuagg

SEQ ID NO: 3869088 - RNA, 18 nt, Human
gccacugcacuccagccu

SEQ ID NO: 3869089 - RNA, 21 nt, Human
gccacugcacuccagccuggg

SEQ ID NO: 3869090 - RNA, 19 nt, Human
gccacugcauaccaaccug

SEQ ID NO: 3869091 - RNA, 13 nt, Human
gccacugccucuc

SEQ ID NO: 3869092 - RNA, 16 nt, Human
gccacugccucucccu

SEQ ID NO: 3869093 - RNA, 17 nt, Human
gccacugccucuuccuc

SEQ ID NO: 3869094 - RNA, 18 nt, Human
gccacugccuucgcuucu

SEQ ID NO: 3869095 - RNA, 23 nt, Human
gccacugccuucgcuucuugccu

SEQ ID NO: 3869096 - RNA, 22 nt, Human
gccacugcucccuaagccagcc

SEQ ID NO: 3869097 - RNA, 23 nt, Human
gccacugcucccuaagccagccu

SEQ ID NO: 3869098 - RNA, 16 nt, Human
gccacugcuccgugga

SEQ ID NO: 3869099 - RNA, 22 nt, Human
gccacuggagugugcguggugg

SEQ ID NO: 3869100 - RNA, 20 nt, Human
gccacuguguuccuuccgcu

SEQ ID NO: 3869101 - RNA, 21 nt, Human
gccacuguuuugaaucucaua

SEQ ID NO: 3869102 - RNA, 16 nt, Human
gccacuuaauguaugu

SEQ ID NO: 3869103 - RNA, 21 nt, Human
gccacuuaccuucaauaaagu

SEQ ID NO: 3869104 - RNA, 16 nt, Human
gccacuucggccaggu

SEQ ID NO: 3869105 - RNA, 21 nt, Human
gccacuugaacaaaaucuguu

SEQ ID NO: 3869106 - RNA, 13 nt, Human
gccacuuggagug

SEQ ID NO: 3869107 - RNA, 15 nt, Human
gccacuuuaagagag

SEQ ID NO: 3869108 - RNA, 20 nt, Human
gccacuuuaagagagaaauc

SEQ ID NO: 3869109 - RNA, 19 nt, Human
gccacuuuacccaccuaga

SEQ ID NO: 3869110 - RNA, 13 nt, Human
gccacuuuccaag

SEQ ID NO: 3869111 - RNA, 19 nt, Human
gccacuuugcaaaggagcu

SEQ ID NO: 3869112 - RNA, 14 nt, Human
gccacuuugcacga

SEQ ID NO: 3869113 - RNA, 23 nt, Human
gccacuuugcacgacgcccucuc

SEQ ID NO: 3869114 - RNA, 21 nt, Human
gccacuuugguacauggccag

SEQ ID NO: 3869115 - RNA, 23 nt, Human
gccacuuuugacuagggauucag

SEQ ID NO: 3869116 - RNA, 20 nt, Human
gccagaaaccuuccugcuga

SEQ ID NO: 3869117 - RNA, 22 nt, Human
gccagaacguggcucugcuggc

SEQ ID NO: 3869118 - RNA, 14 nt, Human
gccagaagcuacug

SEQ ID NO: 3869119 - RNA, 12 nt, Human
gccagaagcuga

SEQ ID NO: 3869120 - RNA, 16 nt, Human
gccagaagucaaggcu

SEQ ID NO: 3869121 - RNA, 23 nt, Human
gccagaagucaaggcuuagaccc

SEQ ID NO: 3869122 - RNA, 15 nt, Human
gccagaaucagcaca

SEQ ID NO: 3869123 - RNA, 19 nt, Human
gccagacacucugcucugc

SEQ ID NO: 3869124 - RNA, 14 nt, Human
gccagacauguggu

SEQ ID NO: 3869125 - RNA, 23 nt, Human
gccagaccaacguuacucagggc

SEQ ID NO: 3869126 - RNA, 15 nt, Human
gccagaccagagcuc

SEQ ID NO: 3869127 - RNA, 16 nt, Human
gccagaccagcaggcu

SEQ ID NO: 3869128 - RNA, 17 nt, Human
gccagacccccuggaga

SEQ ID NO: 3869129 - RNA, 13 nt, Human
gccagacucuggu

SEQ ID NO: 3869130 - RNA, 15 nt, Human
gccagacucuggucu

SEQ ID NO: 3869131 - RNA, 17 nt, Human
gccagagaacccagccc

SEQ ID NO: 3869132 - RNA, 18 nt, Human
gccagagaacccagccca

SEQ ID NO: 3869133 - RNA, 14 nt, Human
gccagagaagugac

SEQ ID NO: 3869134 - RNA, 16 nt, Human
gccagagaagugacag

SEQ ID NO: 3869135 - RNA, 12 nt, Human
gccagagacaca

SEQ ID NO: 3869136 - RNA, 15 nt, Human
gccagagacacaagc

SEQ ID NO: 3869137 - RNA, 19 nt, Human
gccagagacacaagccuuc

SEQ ID NO: 3869138 - RNA, 20 nt, Human
gccagagacacaagccuucg

SEQ ID NO: 3869139 - RNA, 15 nt, Human
gccagagagccuggu

SEQ ID NO: 3869140 - RNA, 21 nt, Human
gccagagauccaaaagaagcc

SEQ ID NO: 3869141 - RNA, 22 nt, Human
gccagagauccaaaagaagccc

SEQ ID NO: 3869142 - RNA, 23 nt, Human
gccagagcccacuccaucuggua

SEQ ID NO: 3869143 - RNA, 14 nt, Human
gccagagccugggg

SEQ ID NO: 3869144 - RNA, 16 nt, Human
gccagagccuggggcu

SEQ ID NO: 3869145 - RNA, 14 nt, Human
gccagaggaacugu

SEQ ID NO: 3869146 - RNA, 21 nt, Human
gccagaggaacuguccagaga

SEQ ID NO: 3869147 - RNA, 24 nt, Human
gccagaggaacuguccagagagca

SEQ ID NO: 3869148 - RNA, 12 nt, Human
gccagaggagag

SEQ ID NO: 3869149 - RNA, 17 nt, Human
gccagaggagagaggac

SEQ ID NO: 3869150 - RNA, 19 nt, Human
gccagaggagagaggaccc

SEQ ID NO: 3869151 - RNA, 13 nt, Human
gccagaggcaccu

SEQ ID NO: 3869152 - RNA, 20 nt, Human
gccagaggcagaacccuggu

SEQ ID NO: 3869153 - RNA, 23 nt, Human
gccagaggcagaacccuggugag

SEQ ID NO: 3869154 - RNA, 13 nt, Human
gccagaggcuggg

SEQ ID NO: 3869155 - RNA, 18 nt, Human
gccagagggagugacaga

SEQ ID NO: 3869156 - RNA, 21 nt, Human
gccagagggagugacagaggc

SEQ ID NO: 3869157 - RNA, 13 nt, Human
gccagaggugcuu

SEQ ID NO: 3869158 - RNA, 15 nt, Human
gccagaggugcuuca

SEQ ID NO: 3869159 - RNA, 16 nt, Human
gccagaggugcuucac

SEQ ID NO: 3869160 - RNA, 19 nt, Human
gccagaggugcuucacccu

SEQ ID NO: 3869161 - RNA, 15 nt, Human
gccagaggugggcag

SEQ ID NO: 3869162 - RNA, 17 nt, Human
gccagaggugggcaggu

SEQ ID NO: 3869163 - RNA, 19 nt, Human
gccagaguggccuggccag

SEQ ID NO: 3869164 - RNA, 22 nt, Human
gccagaguggccuggccaggag

SEQ ID NO: 3869165 - RNA, 14 nt, Human
gccagaucuuaggu

SEQ ID NO: 3869166 - RNA, 22 nt, Human
gccagauggacuccagccugcc

SEQ ID NO: 3869167 - RNA, 17 nt, Human
gccagauggggccucug

SEQ ID NO: 3869168 - RNA, 22 nt, Human
gcccaccugucaaacaaagcca

SEQ ID NO: 3869169 - RNA, 15 nt, Human
gcccacgacacugca

SEQ ID NO: 3869170 - RNA, 15 nt, Human
gcccacgcccccacu

SEQ ID NO: 3869171 - RNA, 17 nt, Human
gcccacgcccccacugg

SEQ ID NO: 3869172 - RNA, 15 nt, Human
gcccacgcugacuac

SEQ ID NO: 3869173 - RNA, 15 nt, Human
gcccacggcuaagag

SEQ ID NO: 3869174 - RNA, 18 nt, Human
gcccacggcuaagaggcu

SEQ ID NO: 3869175 - RNA, 21 nt, Human
gcccacggcuaagaggcugcu

SEQ ID NO: 3869176 - RNA, 15 nt, Human
gcccacguagggcgg

SEQ ID NO: 3869177 - RNA, 15 nt, Human
gcccacgucacgugu

SEQ ID NO: 3869178 - RNA, 13 nt, Human
gcccacguccugu

SEQ ID NO: 3869179 - RNA, 18 nt, Human
gcccacuauggucaucuu

SEQ ID NO: 3869180 - RNA, 19 nt, Human
gcccacuccaucugguaga

SEQ ID NO: 3869181 - RNA, 19 nt, Human
gcccacucccugcaaccug

SEQ ID NO: 3869182 - RNA, 13 nt, Human
gcccacuccugcu

SEQ ID NO: 3869183 - RNA, 17 nt, Human
gcccacucugcucgccu

SEQ ID NO: 3869184 - RNA, 20 nt, Human
gcccacugcccacccccuca

SEQ ID NO: 3869185 - RNA, 13 nt, Human
gcccacuguccug

SEQ ID NO: 3869186 - RNA, 14 nt, Human
gcccacuguccugg

SEQ ID NO: 3869187 - RNA, 23 nt, Human
gcccacuguccugggccugcaga

SEQ ID NO: 3869188 - RNA, 17 nt, Human
gcccacuguccugggcg

SEQ ID NO: 3869189 - RNA, 23 nt, Human
gcccacuguccugggcgcccugg

SEQ ID NO: 3869190 - RNA, 15 nt, Human
gcccacuucccuggg

SEQ ID NO: 3869191 - RNA, 13 nt, Human
gcccacuucugcc

SEQ ID NO: 3869192 - RNA, 16 nt, Human
gcccagaaaaggacag

SEQ ID NO: 3869193 - RNA, 15 nt, Human
gcccagaacuucccu

SEQ ID NO: 3869194 - RNA, 16 nt, Human
gcccagaacuucccug

SEQ ID NO: 3869195 - RNA, 18 nt, Human
gcccagaagaaaauucuc

SEQ ID NO: 3869196 - RNA, 23 nt, Human
gcccagaauaaacuggcagcuca

SEQ ID NO: 3869197 - RNA, 16 nt, Human
gcccagaauaaguuau

SEQ ID NO: 3869198 - RNA, 18 nt, Human
gcccagaauucccagcug

SEQ ID NO: 3869199 - RNA, 16 nt, Human
gcccagaccccucugg

SEQ ID NO: 3869200 - RNA, 19 nt, Human
gcccagaccccucuggcca

SEQ ID NO: 3869201 - RNA, 20 nt, Human
gcccagaccccucuggccag

SEQ ID NO: 3869202 - RNA, 14 nt, Human
gcccagacccugga

SEQ ID NO: 3869203 - RNA, 17 nt, Human
gcccagacccuggagga

SEQ ID NO: 3869204 - RNA, 13 nt, Human
gcccagagaagcc

SEQ ID NO: 3869205 - RNA, 10 nt, Human
gcccagagac

SEQ ID NO: 3869206 - RNA, 19 nt, Human
gcccagagacccaagcugc

SEQ ID NO: 3869207 - RNA, 17 nt, Human
gcccagagagaagagcc

SEQ ID NO: 3869208 - RNA, 21 nt, Human
gcccagagagaagagccccac

SEQ ID NO: 3869209 - RNA, 22 nt, Human
gcccagagagaagagccccacu

SEQ ID NO: 3869210 - RNA, 15 nt, Human
gcccagagagggugg

SEQ ID NO: 3869211 - RNA, 16 nt, Human
gcccagagaugccucc

SEQ ID NO: 3869212 - RNA, 18 nt, Human
gcccagagaugccuccac

SEQ ID NO: 3869213 - RNA, 22 nt, Human
gcccagagaugccuccaccgcu

SEQ ID NO: 3869214 - RNA, 22 nt, Human
gcccagagaugggacugggagg

SEQ ID NO: 3869215 - RNA, 18 nt, Human
gcccagagcaggaagcau

SEQ ID NO: 3869216 - RNA, 18 nt, Human
gcccagagcccagcucca

SEQ ID NO: 3869217 - RNA, 15 nt, Human
gcccagagcugggug

SEQ ID NO: 3869218 - RNA, 16 nt, Human
gcccagagcuggguga

SEQ ID NO: 3869219 - RNA, 16 nt, Human
gcccagaggagggcag

SEQ ID NO: 3869220 - RNA, 12 nt, Human
gcccagagggcc

SEQ ID NO: 3869221 - RNA, 13 nt, Human
gcccagagggccc

SEQ ID NO: 3869222 - RNA, 16 nt, Human
gcccagagggcccagg

SEQ ID NO: 3869223 - RNA, 21 nt, Human
gcccagagggcccaggcaggc

SEQ ID NO: 3869224 - RNA, 14 nt, Human
gcccagagggccug

SEQ ID NO: 3869225 - RNA, 15 nt, Human
gcccagagggucugg

SEQ ID NO: 3869226 - RNA, 12 nt, Human
gcccagagguaa

SEQ ID NO: 3869227 - RNA, 16 nt, Human
gcccagagguaacaga

SEQ ID NO: 3869228 - RNA, 22 nt, Human
gcccagagguaacagaacagcu

SEQ ID NO: 3869229 - RNA, 19 nt, Human
gcccagauuaugagacaca

SEQ ID NO: 3869230 - RNA, 22 nt, Human
gcccagauuaugagacacagga

SEQ ID NO: 3869231 - RNA, 20 nt, Human
gcccagauuccccuguguca

SEQ ID NO: 3869232 - RNA, 21 nt, Human
gcccagcacugcuugaggaaa

SEQ ID NO: 3869233 - RNA, 21 nt, Human
gcccagccaaacccugucuga

SEQ ID NO: 3869234 - RNA, 15 nt, Human
gcccagccaggcccc

SEQ ID NO: 3869235 - RNA, 16 nt, Human
gcccagccaggcccca

SEQ ID NO: 3869236 - RNA, 20 nt, Human
gcccagccauuaccauggag

SEQ ID NO: 3869237 - RNA, 23 nt, Human
gcccagccauuaccauggagaca

SEQ ID NO: 3869238 - RNA, 16 nt, Human
gcccagcccaccccau

SEQ ID NO: 3869239 - RNA, 13 nt, Human
gcccagcccagcu

SEQ ID NO: 3869240 - RNA, 15 nt, Human
gcccagcccagcugg

SEQ ID NO: 3869241 - RNA, 16 nt, Human
gcccagcccagcuggu

SEQ ID NO: 3869242 - RNA, 23 nt, Human
gcccagccccacuccucugcuga

SEQ ID NO: 3869243 - RNA, 21 nt, Human
gcccagcccccacagugcugu

SEQ ID NO: 3869244 - RNA, 11 nt, Human
gcccagccccu

SEQ ID NO: 3869245 - RNA, 19 nt, Human
gcccagccccuacugcugu

SEQ ID NO: 3869246 - RNA, 14 nt, Human
gcccagccccuaga

SEQ ID NO: 3869247 - RNA, 13 nt, Human
gcccagccccuuc

SEQ ID NO: 3869248 - RNA, 14 nt, Human
gcccagccccuucu

SEQ ID NO: 3869249 - RNA, 14 nt, Human
gcccagcccggcuc

SEQ ID NO: 3869250 - RNA, 12 nt, Human
gcccagcccucc

SEQ ID NO: 3869251 - RNA, 17 nt, Human
gcccagcccugcuggcc

SEQ ID NO: 3869252 - RNA, 16 nt, Human
gcccagcccuguucug

SEQ ID NO: 3869253 - RNA, 19 nt, Human
gcccagccgacccccucuc

SEQ ID NO: 3869254 - RNA, 19 nt, Human
gcccagccggccucucugg

SEQ ID NO: 3869255 - RNA, 21 nt, Human
gcccagccggccucucuggcc

SEQ ID NO: 3869256 - RNA, 23 nt, Human
gcccagccggccucucuggccuc

SEQ ID NO: 3869257 - RNA, 21 nt, Human
gcccagccucuuucccuucca

SEQ ID NO: 3869258 - RNA, 23 nt, Human
gcccagccuuuguuccccacugg

SEQ ID NO: 3869259 - RNA, 17 nt, Human
gcccagcgcggacaucc

SEQ ID NO: 3869260 - RNA, 19 nt, Human
gcccagcgcggacaucccc

SEQ ID NO: 3869261 - RNA, 15 nt, Human
gcccagcgcucugcc

SEQ ID NO: 3869262 - RNA, 16 nt, Human
gcccagcgcucugccu

SEQ ID NO: 3869263 - RNA, 19 nt, Human
gcccagcggacaguggcag

SEQ ID NO: 3869264 - RNA, 21 nt, Human
gcccagcggacaguggcagga

SEQ ID NO: 3869265 - RNA, 16 nt, Human
gcccagcggccccucc

SEQ ID NO: 3869266 - RNA, 18 nt, Human
gcccagcggccccuccca

SEQ ID NO: 3869267 - RNA, 15 nt, Human
gcccagcucagaggg

SEQ ID NO: 3869268 - RNA, 14 nt, Human
gcccagcucagucu

SEQ ID NO: 3869269 - RNA, 15 nt, Human
gcccagcuccaaggg

SEQ ID NO: 3869270 - RNA, 14 nt, Human
gcccagcuccaggg

SEQ ID NO: 3869271 - RNA, 15 nt, Human
gcccagcuccagggc

SEQ ID NO: 3869272 - RNA, 18 nt, Human
gcccagcuccagggccag

SEQ ID NO: 3869273 - RNA, 11 nt, Human
gcccagcuccc

SEQ ID NO: 3869274 - RNA, 12 nt, Human
gcccagcucccc

SEQ ID NO: 3869275 - RNA, 12 nt, Human
gcccagcuccug

SEQ ID NO: 3869276 - RNA, 14 nt, Human
gcccagcuccugac

SEQ ID NO: 3869277 - RNA, 15 nt, Human
gcccagcugcaccug

SEQ ID NO: 3869278 - RNA, 18 nt, Human
gcccagcugcaccugcca

SEQ ID NO: 3869279 - RNA, 18 nt, Human
gcccagcugcucugccca

SEQ ID NO: 3869280 - RNA, 20 nt, Human
gcccagcugcucugcccaga

SEQ ID NO: 3869281 - RNA, 21 nt, Human
gcccagcugcucugcccagag

SEQ ID NO: 3869282 - RNA, 13 nt, Human
gcccagcugggcu

SEQ ID NO: 3869283 - RNA, 16 nt, Human
gcccagcugggcucug

SEQ ID NO: 3869284 - RNA, 13 nt, Human
gcccagcuggguc

SEQ ID NO: 3869285 - RNA, 14 nt, Human
gcccagcuggguca

SEQ ID NO: 3869286 - RNA, 20 nt, Human
gcccagcugggucaggcagg

SEQ ID NO: 3869287 - RNA, 13 nt, Human
gcccagcuugggc

SEQ ID NO: 3869288 - RNA, 15 nt, Human
gcccagcuugggccc

SEQ ID NO: 3869289 - RNA, 18 nt, Human
gcccagcuugggcccagc

SEQ ID NO: 3869290 - RNA, 23 nt, Human
gcccagcuugggcccagcugggc

SEQ ID NO: 3869291 - RNA, 16 nt, Human
gcccaggaaaggcucc

SEQ ID NO: 3869292 - RNA, 24 nt, Human
gcccaggaaaggcuccaggagcag

SEQ ID NO: 3869293 - RNA, 20 nt, Human
gcccaggaagucucaucugg

SEQ ID NO: 3869294 - RNA, 21 nt, Human
gcccaggaagucucaucuggg

SEQ ID NO: 3869295 - RNA, 17 nt, Human
gcccaggaccagcuggg

SEQ ID NO: 3869296 - RNA, 19 nt, Human
gcccaggaccagcuggggc

SEQ ID NO: 3869297 - RNA, 13 nt, Human
gcccaggacccca

SEQ ID NO: 3869298 - RNA, 18 nt, Human
gcccaggacggggccggc

SEQ ID NO: 3869299 - RNA, 14 nt, Human
gcccaggagagaga

SEQ ID NO: 3869300 - RNA, 23 nt, Human
gcccaggagagagaaagccaggc

SEQ ID NO: 3869301 - RNA, 14 nt, Human
gcccaggagagcca

SEQ ID NO: 3869302 - RNA, 15 nt, Human
gcccaggagccucac

SEQ ID NO: 3869303 - RNA, 18 nt, Human
gcccaggagccucacugg

SEQ ID NO: 3869304 - RNA, 20 nt, Human
gcccaggagcuccccucccc

SEQ ID NO: 3869305 - RNA, 13 nt, Human
gcccaggaguuug

SEQ ID NO: 3869306 - RNA, 15 nt, Human
gcccaggaguuuggc

SEQ ID NO: 3869307 - RNA, 19 nt, Human
gcccaggaguuuggccaga

SEQ ID NO: 3869308 - RNA, 22 nt, Human
gcccaggauacuggcacagagg

SEQ ID NO: 3869309 - RNA, 23 nt, Human
gcccaggauacuggcacagaggu

SEQ ID NO: 3869310 - RNA, 14 nt, Human
gcccaggaugcugc

SEQ ID NO: 3869311 - RNA, 14 nt, Human
gcccaggcaggcca

SEQ ID NO: 3869312 - RNA, 12 nt, Human
gcccaggcaggu

SEQ ID NO: 3869313 - RNA, 13 nt, Human
gcccaggcagguc

SEQ ID NO: 3869314 - RNA, 14 nt, Human
gccugucugucucu

SEQ ID NO: 3869315 - RNA, 20 nt, Human
gccugucugucucuccaucu

SEQ ID NO: 3869316 - RNA, 19 nt, Human
gccugucugugaagagcaa

SEQ ID NO: 3869317 - RNA, 16 nt, Human
gccugucugugaccug

SEQ ID NO: 3869318 - RNA, 16 nt, Human
gccugucuuaauuuuc

SEQ ID NO: 3869319 - RNA, 17 nt, Human
gccugugaacugaacuc

SEQ ID NO: 3869320 - RNA, 21 nt, Human
gccugugacauacccccuccc

SEQ ID NO: 3869321 - RNA, 15 nt, Human
gccugugcaaugcau

SEQ ID NO: 3869322 - RNA, 13 nt, Human
gccugugccaggu

SEQ ID NO: 3869323 - RNA, 14 nt, Human
gccugugccaggug

SEQ ID NO: 3869324 - RNA, 17 nt, Human
gccugugccucugggac

SEQ ID NO: 3869325 - RNA, 19 nt, Human
gccugugccucugggacug

SEQ ID NO: 3869326 - RNA, 15 nt, Human
gccugugcugcccgu

SEQ ID NO: 3869327 - RNA, 16 nt, Human
gccugugcugcccguc

SEQ ID NO: 3869328 - RNA, 13 nt, Human
gccugugcuguga

SEQ ID NO: 3869329 - RNA, 19 nt, Human
gccuguggaaucuggagug

SEQ ID NO: 3869330 - RNA, 17 nt, Human
gccuguggaaugagugu

SEQ ID NO: 3869331 - RNA, 18 nt, Human
gccuguggcaguaaagag

SEQ ID NO: 3869332 - RNA, 19 nt, Human
gccuguggcaguaaagaga

SEQ ID NO: 3869333 - RNA, 22 nt, Human
gccuguggccaugacccugccu

SEQ ID NO: 3869334 - RNA, 14 nt, Human
gccuguggcccugu

SEQ ID NO: 3869335 - RNA, 16 nt, Human
gccuguggccuuugca

SEQ ID NO: 3869336 - RNA, 14 nt, Human
gccuguggcugugg

SEQ ID NO: 3869337 - RNA, 16 nt, Human
gccuguggcuguggag

SEQ ID NO: 3869338 - RNA, 17 nt, Human
gccuguguaacagcucc

SEQ ID NO: 3869339 - RNA, 21 nt, Human
gccuguguagcugugaccugc

SEQ ID NO: 3869340 - RNA, 22 nt, Human
gccuguguagcugugaccugcu

SEQ ID NO: 3869341 - RNA, 19 nt, Human
gccuguguccaugcgcuca

SEQ ID NO: 3869342 - RNA, 20 nt, Human
gccuguguccaugcgcucag

SEQ ID NO: 3869343 - RNA, 12 nt, Human
gccuguucaguu

SEQ ID NO: 3869344 - RNA, 15 nt, Human
gccuguucaguuaca

SEQ ID NO: 3869345 - RNA, 16 nt, Human
gccuguucaguuacag

SEQ ID NO: 3869346 - RNA, 22 nt, Human
gccuguucaguuacagaaagug

SEQ ID NO: 3869347 - RNA, 15 nt, Human
gccuguucauggcag

SEQ ID NO: 3869348 - RNA, 20 nt, Human
gccuguucccccgccgcuuu

SEQ ID NO: 3869349 - RNA, 20 nt, Human
gccuguugcuauagagccua

SEQ ID NO: 3869350 - RNA, 20 nt, Human
gccuguugggccaggagccu

SEQ ID NO: 3869351 - RNA, 21 nt, Human
gccuguugggccaggagccuc

SEQ ID NO: 3869352 - RNA, 12 nt, Human
gccuguuuaaga

SEQ ID NO: 3869353 - RNA, 19 nt, Human
gccuguuucccaggcccac

SEQ ID NO: 3869354 - RNA, 13 nt, Human
gccuguuucuucc

SEQ ID NO: 3869355 - RNA, 13 nt, Human
gccuguuuuaugu

SEQ ID NO: 3869356 - RNA, 17 nt, Human
gccuuaaaaccaaagag

SEQ ID NO: 3869357 - RNA, 14 nt, Human
gccuuaaaauggaa

SEQ ID NO: 3869358 - RNA, 13 nt, Human
gccuuaaagacaa

SEQ ID NO: 3869359 - RNA, 21 nt, Human
gccuuaagugaggaaaucaaa

SEQ ID NO: 3869360 - RNA, 23 nt, Human
gccuuaauacuuuuuuauuuugu

SEQ ID NO: 3869361 - RNA, 17 nt, Human
gccuuaauuuccuuuuu

SEQ ID NO: 3869362 - RNA, 17 nt, Human
gccuuaauuuucaguau

SEQ ID NO: 3869363 - RNA, 15 nt, Human
gccuuacauuuguga

SEQ ID NO: 3869364 - RNA, 13 nt, Human
gccuuaccccugc

SEQ ID NO: 3869365 - RNA, 20 nt, Human
gccuuaccuccugcccagga

SEQ ID NO: 3869366 - RNA, 22 nt, Human
gccuuaccuccugcccaggaga

SEQ ID NO: 3869367 - RNA, 16 nt, Human
gccuuagaaccuuucu

SEQ ID NO: 3869368 - RNA, 17 nt, Human
gccuuagaagucacaca

SEQ ID NO: 3869369 - RNA, 19 nt, Human
gccuuagaagucacacagu

SEQ ID NO: 3869370 - RNA, 15 nt, Human
gccuuagcauguuug

SEQ ID NO: 3869371 - RNA, 17 nt, Human
gccuuagggcacugggc

SEQ ID NO: 3869372 - RNA, 19 nt, Human
gccuuagggcacugggcug

SEQ ID NO: 3869373 - RNA, 18 nt, Human
gccuuagucucaguuugu

SEQ ID NO: 3869374 - RNA, 12 nt, Human
gccuuagugggc

SEQ ID NO: 3869375 - RNA, 20 nt, Human
gccuuagugggccagggcug

SEQ ID NO: 3869376 - RNA, 13 nt, Human
gccuuauccucug

SEQ ID NO: 3869377 - RNA, 15 nt, Human
gccuuauccucugau

SEQ ID NO: 3869378 - RNA, 19 nt, Human
gccuuaucgggcuccagcc

SEQ ID NO: 3869379 - RNA, 23 nt, Human
gccuuaucuccaagaccagagau

SEQ ID NO: 3869380 - RNA, 23 nt, Human
gccuuaugaggguccucuacuuc

SEQ ID NO: 3869381 - RNA, 14 nt, Human
gccuuauggaacac

SEQ ID NO: 3869382 - RNA, 19 nt, Human
gccuuauggaacacucuga

SEQ ID NO: 3869383 - RNA, 20 nt, Human
gccuuauggaacacucugag

SEQ ID NO: 3869384 - RNA, 21 nt, Human
gccuuauggaacacucugaga

SEQ ID NO: 3869385 - RNA, 23 nt, Human
gccuuauggaacacucugagacu

SEQ ID NO: 3869386 - RNA, 18 nt, Human
gccuuauucagggaagga

SEQ ID NO: 3869387 - RNA, 11 nt, Human
gccuucaagcu

SEQ ID NO: 3869388 - RNA, 15 nt, Human
gccuucaagcucuga

SEQ ID NO: 3869389 - RNA, 15 nt, Human
gccuucaauaaaugg

SEQ ID NO: 3869390 - RNA, 22 nt, Human
gccuucacauuccccuggggac

SEQ ID NO: 3869391 - RNA, 16 nt, Human
gccuucagauguucuc

SEQ ID NO: 3869392 - RNA, 13 nt, Human
gccuucagcucca

SEQ ID NO: 3869393 - RNA, 21 nt, Human
gccuucauaucauccacacau

SEQ ID NO: 3869394 - RNA, 14 nt, Human
gccuuccacccagg

SEQ ID NO: 3869395 - RNA, 19 nt, Human
gccuuccacgcugucucca

SEQ ID NO: 3869396 - RNA, 22 nt, Human
gccuuccacgcugucuccagac

SEQ ID NO: 3869397 - RNA, 18 nt, Human
gccuuccagcacccugca

SEQ ID NO: 3869398 - RNA, 13 nt, Human
gccuuccagcugc

SEQ ID NO: 3869399 - RNA, 12 nt, Human
gccuuccagggg

SEQ ID NO: 3869400 - RNA, 15 nt, Human
gccuuccaggggugg

SEQ ID NO: 3869401 - RNA, 14 nt, Human
gccuuccauaauua

SEQ ID NO: 3869402 - RNA, 19 nt, Human
gccuucccaaguugugcuu

SEQ ID NO: 3869403 - RNA, 12 nt, Human
gccuuccccacc

SEQ ID NO: 3869404 - RNA, 20 nt, Human
gccuuccccuuauccucccu

SEQ ID NO: 3869405 - RNA, 23 nt, Human
gccuucccuagcuuuagacccug

SEQ ID NO: 3869406 - RNA, 17 nt, Human
gccuucccuccugcuuu

SEQ ID NO: 3869407 - RNA, 15 nt, Human
gccuuccuaagccug

SEQ ID NO: 3869408 - RNA, 19 nt, Human
gccuuccuaagccuguggc

SEQ ID NO: 3869409 - RNA, 18 nt, Human
gccuuccuccacauccuu

SEQ ID NO: 3869410 - RNA, 16 nt, Human
gccuuccuccugggcc

SEQ ID NO: 3869411 - RNA, 18 nt, Human
gccuuccucucuccagau

SEQ ID NO: 3869412 - RNA, 16 nt, Human
gccuuccucugcagcu

SEQ ID NO: 3869413 - RNA, 23 nt, Human
gccuuccuucccgccagagggcu

SEQ ID NO: 3869414 - RNA, 11 nt, Human
gccuuccuugc

SEQ ID NO: 3869415 - RNA, 13 nt, Human
gccuuccuugcua

SEQ ID NO: 3869416 - RNA, 19 nt, Human
gccuuccuuucuccaggac

SEQ ID NO: 3869417 - RNA, 23 nt, Human
gccuucggccuccauccugaggc

SEQ ID NO: 3869418 - RNA, 18 nt, Human
gccuucgguacccaccac

SEQ ID NO: 3869419 - RNA, 15 nt, Human
gccuucuaaaggugu

SEQ ID NO: 3869420 - RNA, 15 nt, Human
gccuucucaccagcu

SEQ ID NO: 3869421 - RNA, 18 nt, Human
gccuucucaccagcugca

SEQ ID NO: 3869422 - RNA, 19 nt, Human
gccuucucaccagcugcaa

SEQ ID NO: 3869423 - RNA, 15 nt, Human
gccuucucagaagca

SEQ ID NO: 3869424 - RNA, 17 nt, Human
gccuucucccccccggg

SEQ ID NO: 3869425 - RNA, 23 nt, Human
gccuucucccccccggggcuggg

SEQ ID NO: 3869426 - RNA, 17 nt, Human
gccuucugacggcccug

SEQ ID NO: 3869427 - RNA, 20 nt, Human
gccuucugacggcccugcaa

SEQ ID NO: 3869428 - RNA, 14 nt, Human
gccuucugaugucu

SEQ ID NO: 3869429 - RNA, 23 nt, Human
gccuucugaugucucuaaagcac

SEQ ID NO: 3869430 - RNA, 14 nt, Human
gccuucuggccuug

SEQ ID NO: 3869431 - RNA, 20 nt, Human
gccuucuuauucucacucca

SEQ ID NO: 3869432 - RNA, 21 nt, Human
gccuucuuauucucacuccac

SEQ ID NO: 3869433 - RNA, 23 nt, Human
gccuucuuauucucacuccacca

SEQ ID NO: 3869434 - RNA, 15 nt, Human
gccuucuucagggcc

SEQ ID NO: 3869435 - RNA, 17 nt, Human
gccuucuucuuuuugcu

SEQ ID NO: 3869436 - RNA, 20 nt, Human
gccuucuucuuuuugcuguu

SEQ ID NO: 3869437 - RNA, 21 nt, Human
gccuucuugugaucuugcucu

SEQ ID NO: 3869438 - RNA, 22 nt, Human
gccuucuuugcuugccucucug

SEQ ID NO: 3869439 - RNA, 15 nt, Human
gccuucuuuuucugg

SEQ ID NO: 3869440 - RNA, 23 nt, Human
gccuugaacuuugaccucugcag

SEQ ID NO: 3869441 - RNA, 14 nt, Human
gccuugaauaauaa

SEQ ID NO: 3869442 - RNA, 21 nt, Human
gccuugaauauccccucccag

SEQ ID NO: 3869443 - RNA, 17 nt, Human
gccuugaccauucucca

SEQ ID NO: 3869444 - RNA, 20 nt, Human
gccuugaccauucuccaccu

SEQ ID NO: 3869445 - RNA, 16 nt, Human
gccuugagcccuggcu

SEQ ID NO: 3869446 - RNA, 18 nt, Human
gccuugcagaacugccau

SEQ ID NO: 3869447 - RNA, 17 nt, Human
gccuugccagagaucca

SEQ ID NO: 3869448 - RNA, 18 nt, Human
gccuugcccacuccugcu

SEQ ID NO: 3869449 - RNA, 15 nt, Human
gccuugcccagagau

SEQ ID NO: 3869450 - RNA, 22 nt, Human
gccuugcccagagaugccucca

SEQ ID NO: 3869451 - RNA, 13 nt, Human
gccuugcccagcc

SEQ ID NO: 3869452 - RNA, 15 nt, Human
gccuugcccagccug

SEQ ID NO: 3869453 - RNA, 22 nt, Human
gccuugcccggauucugggagg

SEQ ID NO: 3869454 - RNA, 20 nt, Human
gccuugcggcuccucaggga

SEQ ID NO: 3869455 - RNA, 19 nt, Human
gccuugcuaccucaagggg

SEQ ID NO: 3869456 - RNA, 11 nt, Human
gccuugcuugu

SEQ ID NO: 3869457 - RNA, 20 nt, Human
gccuuggagggucccaagcu

SEQ ID NO: 3869458 - RNA, 18 nt, Human
gcgggcagguucugccug

SEQ ID NO: 3869459 - RNA, 15 nt, Human
gcgggccaaggacug

SEQ ID NO: 3869460 - RNA, 17 nt, Human
gcgggccaaggacugcc

SEQ ID NO: 3869461 - RNA, 15 nt, Human
gcgggccagccaggc

SEQ ID NO: 3869462 - RNA, 14 nt, Human
gcgggcccagcacu

SEQ ID NO: 3869463 - RNA, 23 nt, Human
gcgggcgcacugccucucacagc

SEQ ID NO: 3869464 - RNA, 15 nt, Human
gcgggcgcgugagug

SEQ ID NO: 3869465 - RNA, 14 nt, Human
gcggggacagcucc

SEQ ID NO: 3869466 - RNA, 14 nt, Human
gcggggaggaggaa

SEQ ID NO: 3869467 - RNA, 23 nt, Human
gcggggguuccguguccaccccc

SEQ ID NO: 3869468 - RNA, 13 nt, Human
gcgggucacagga

SEQ ID NO: 3869469 - RNA, 15 nt, Human
gcgggucacaggagg

SEQ ID NO: 3869470 - RNA, 17 nt, Human
gcgggucugcucccaag

SEQ ID NO: 3869471 - RNA, 21 nt, Human
gcgggugaacaaagcagccac

SEQ ID NO: 3869472 - RNA, 22 nt, Human
gcgggugaacaaagcagccacg

SEQ ID NO: 3869473 - RNA, 19 nt, Human
gcggguggaucaccugagg

SEQ ID NO: 3869474 - RNA, 14 nt, Human
gcgggugggggugg

SEQ ID NO: 3869475 - RNA, 15 nt, Human
gcgggugggggugga

SEQ ID NO: 3869476 - RNA, 17 nt, Human
gcggguuccgcaggcag

SEQ ID NO: 3869477 - RNA, 23 nt, Human
gcgguagccagcacacagggcag

SEQ ID NO: 3869478 - RNA, 18 nt, Human
gcgguccacccaggagcc

SEQ ID NO: 3869479 - RNA, 20 nt, Human
gcgguccacccaggagcccc

SEQ ID NO: 3869480 - RNA, 23 nt, Human
gcgguccacccaggagccccgag

SEQ ID NO: 3869481 - RNA, 18 nt, Human
gcggucccagcucccugg

SEQ ID NO: 3869482 - RNA, 15 nt, Human
gcggugccaugucug

SEQ ID NO: 3869483 - RNA, 21 nt, Human
gcggugccaugucugcagugu

SEQ ID NO: 3869484 - RNA, 15 nt, Human
gcggugcggcaggga

SEQ ID NO: 3869485 - RNA, 22 nt, Human
gcggugcuaucucccccagccc

SEQ ID NO: 3869486 - RNA, 14 nt, Human
gcgguggcccuguc

SEQ ID NO: 3869487 - RNA, 18 nt, Human
gcgguggcucacgccugu

SEQ ID NO: 3869488 - RNA, 18 nt, Human
gcgguuauaaaaaauggu

SEQ ID NO: 3869489 - RNA, 12 nt, Human
gcgguucaggaa

SEQ ID NO: 3869490 - RNA, 14 nt, Human
gcguaaguacagag

SEQ ID NO: 3869491 - RNA, 17 nt, Human
gcguaaguacagagaag

SEQ ID NO: 3869492 - RNA, 23 nt, Human
gcguaaguacagagaagccauca

SEQ ID NO: 3869493 - RNA, 15 nt, Human
gcguagaaguuuuug

SEQ ID NO: 3869494 - RNA, 16 nt, Human
gcguaggcuacagaga

SEQ ID NO: 3869495 - RNA, 18 nt, Human
gcguaggcuacagagaag

SEQ ID NO: 3869496 - RNA, 19 nt, Human
gcguauuauaccaaaaugu

SEQ ID NO: 3869497 - RNA, 11 nt, Human
gcgucagccuc

SEQ ID NO: 3869498 - RNA, 16 nt, Human
gcgucagccuccagcc

SEQ ID NO: 3869499 - RNA, 14 nt, Human
gcgucagcugcucc

SEQ ID NO: 3869500 - RNA, 22 nt, Human
gcgucagcugcucccuggcauu

SEQ ID NO: 3869501 - RNA, 23 nt, Human
gcgucagucuuuuucuguuguaa

SEQ ID NO: 3869502 - RNA, 22 nt, Human
gcgucauuacagggcacaggcc

SEQ ID NO: 3869503 - RNA, 14 nt, Human
gcgucccaagaugu

SEQ ID NO: 3869504 - RNA, 19 nt, Human
gcgucccagucucuggcag

SEQ ID NO: 3869505 - RNA, 14 nt, Human
gcgucccuggcgca

SEQ ID NO: 3869506 - RNA, 14 nt, Human
gcguccuccucugu

SEQ ID NO: 3869507 - RNA, 15 nt, Human
gcguccuccucugug

SEQ ID NO: 3869508 - RNA, 24 nt, Human
gcguccuguccacacccagcucag

SEQ ID NO: 3869509 - RNA, 22 nt, Human
gcguccugucggagcccugucu

SEQ ID NO: 3869510 - RNA, 17 nt, Human
gcgucgcccucccaggc

SEQ ID NO: 3869511 - RNA, 17 nt, Human
gcgucuggaggggcccc

SEQ ID NO: 3869512 - RNA, 18 nt, Human
gcgucuggaggggccccu

SEQ ID NO: 3869513 - RNA, 16 nt, Human
gcgucuuccgccccug

SEQ ID NO: 3869514 - RNA, 20 nt, Human
gcgucuuccgccccugccug

SEQ ID NO: 3869515 - RNA, 21 nt, Human
gcgucuuccgccccugccugc

SEQ ID NO: 3869516 - RNA, 22 nt, Human
gcgucuuccgccccugccugcc

SEQ ID NO: 3869517 - RNA, 11 nt, Human
gcgugaaacac

SEQ ID NO: 3869518 - RNA, 20 nt, Human
gcgugaaacacaccaggcug

SEQ ID NO: 3869519 - RNA, 15 nt, Human
gcgugagacgccacc

SEQ ID NO: 3869520 - RNA, 22 nt, Human
gcgugagccacugcaccgggcc

SEQ ID NO: 3869521 - RNA, 23 nt, Human
gcgugagccacugcaccgggcca

SEQ ID NO: 3869522 - RNA, 15 nt, Human
gcgugaucaaagcca

SEQ ID NO: 3869523 - RNA, 20 nt, Human
gcgugcacacaccagagccc

SEQ ID NO: 3869524 - RNA, 11 nt, Human
gcgugcagaug

SEQ ID NO: 3869525 - RNA, 18 nt, Human
gcgugcagggacaaagag

SEQ ID NO: 3869526 - RNA, 19 nt, Human
gcgugcagggacaaagagg

SEQ ID NO: 3869527 - RNA, 16 nt, Human
gcgugcccggggcagc

SEQ ID NO: 3869528 - RNA, 14 nt, Human
gcgugcccucgcug

SEQ ID NO: 3869529 - RNA, 17 nt, Human
gcgugccguggcaccag

SEQ ID NO: 3869530 - RNA, 21 nt, Human
gcgugccgugugagugugaca

SEQ ID NO: 3869531 - RNA, 18 nt, Human
gcgugcuccagccuggcu

SEQ ID NO: 3869532 - RNA, 15 nt, Human
gcguggacugguugg

SEQ ID NO: 3869533 - RNA, 12 nt, Human
gcguggagcugc

SEQ ID NO: 3869534 - RNA, 16 nt, Human
gcguggagcugccuga

SEQ ID NO: 3869535 - RNA, 16 nt, Human
gcguggagggaggccc

SEQ ID NO: 3869536 - RNA, 18 nt, Human
gcguggagggcguggagg

SEQ ID NO: 3869537 - RNA, 23 nt, Human
gcguggauuaaacuuaugaaugu

SEQ ID NO: 3869538 - RNA, 17 nt, Human
gcguggcccaccaggcc

SEQ ID NO: 3869539 - RNA, 21 nt, Human
gcguggcgcaguggcccugag

SEQ ID NO: 3869540 - RNA, 12 nt, Human
gcguggcugacu

SEQ ID NO: 3869541 - RNA, 15 nt, Human
gcgugggagccagcc

SEQ ID NO: 3869542 - RNA, 17 nt, Human
gcguggggacagggcuc

SEQ ID NO: 3869543 - RNA, 12 nt, Human
gcgugggucaga

SEQ ID NO: 3869544 - RNA, 14 nt, Human
gcgugggucagaag

SEQ ID NO: 3869545 - RNA, 18 nt, Human
gcguggucacugcuguca

SEQ ID NO: 3869546 - RNA, 17 nt, Human
gcgugguggucccuggg

SEQ ID NO: 3869547 - RNA, 15 nt, Human
gcgugguuccuuucu

SEQ ID NO: 3869548 - RNA, 19 nt, Human
gcgugucgugggugugugu

SEQ ID NO: 3869549 - RNA, 18 nt, Human
gcgugugcgugcaugugc

SEQ ID NO: 3869550 - RNA, 19 nt, Human
gcguguggcucacgugugu

SEQ ID NO: 3869551 - RNA, 20 nt, Human
gcguguguagaguuaagaag

SEQ ID NO: 3869552 - RNA, 22 nt, Human
gcguuaaaggcucgauuuugua

SEQ ID NO: 3869553 - RNA, 17 nt, Human
gcguuacacccuuucuu

SEQ ID NO: 3869554 - RNA, 22 nt, Human
gcguuagaaugaggaggaagga

SEQ ID NO: 3869555 - RNA, 18 nt, Human
gcguuaugaagagcuaau

SEQ ID NO: 3869556 - RNA, 18 nt, Human
gcguuccaugaugcuggg

SEQ ID NO: 3869557 - RNA, 15 nt, Human
gcguucuuguaauuu

SEQ ID NO: 3869558 - RNA, 18 nt, Human
gcguugaaauuguaauua

SEQ ID NO: 3869559 - RNA, 22 nt, Human
gcguugggagggggagaaaagg

SEQ ID NO: 3869560 - RNA, 14 nt, Human
gcguuggucucugc

SEQ ID NO: 3869561 - RNA, 15 nt, Human
gcguuguuacaggaa

SEQ ID NO: 3869562 - RNA, 19 nt, Human
gcguuguugcauguuugaa

SEQ ID NO: 3869563 - RNA, 17 nt, Human
gcguuucuaugacacau

SEQ ID NO: 3869564 - RNA, 20 nt, Human
gcguuugcccaaaucugccu

SEQ ID NO: 3869565 - RNA, 19 nt, Human
gcguuuuuuaaauguauac

SEQ ID NO: 3869566 - RNA, 14 nt, Human
gcuaaaaccugagc

SEQ ID NO: 3869567 - RNA, 15 nt, Human
gcuaaaagaaacuuu

SEQ ID NO: 3869568 - RNA, 14 nt, Human
gcuaaaauguuuuc

SEQ ID NO: 3869569 - RNA, 18 nt, Human
gcuaaacguguauguuuu

SEQ ID NO: 3869570 - RNA, 13 nt, Human
gcuaaacuuuucu

SEQ ID NO: 3869571 - RNA, 15 nt, Human
gcuaaagaaguuuga

SEQ ID NO: 3869572 - RNA, 18 nt, Human
gcuaaagaaguuugaaca

SEQ ID NO: 3869573 - RNA, 23 nt, Human
gcuaaagagcccuugccucccca

SEQ ID NO: 3869574 - RNA, 21 nt, Human
gcuaaagauaauugcuauuua

SEQ ID NO: 3869575 - RNA, 14 nt, Human
gcuaaagccuuccu

SEQ ID NO: 3869576 - RNA, 22 nt, Human
gcuaaagguuaccgauuucaaa

SEQ ID NO: 3869577 - RNA, 21 nt, Human
gcuaaauaaaauuuguugcau

SEQ ID NO: 3869578 - RNA, 19 nt, Human
gcuaaauggucgcccagga

SEQ ID NO: 3869579 - RNA, 23 nt, Human
gcuaaauggucgcccaggagaca

SEQ ID NO: 3869580 - RNA, 14 nt, Human
gcuaaauguaacag

SEQ ID NO: 3869581 - RNA, 17 nt, Human
gcuaaauugauguugau

SEQ ID NO: 3869582 - RNA, 16 nt, Human
gcuaacaccagacaga

SEQ ID NO: 3869583 - RNA, 15 nt, Human
gcuaacacuggcccc

SEQ ID NO: 3869584 - RNA, 16 nt, Human
gcuaacagggaaggca

SEQ ID NO: 3869585 - RNA, 20 nt, Human
gcuaacagggaaggcaggca

SEQ ID NO: 3869586 - RNA, 22 nt, Human
gcuaacccccuucuacugagcc

SEQ ID NO: 3869587 - RNA, 19 nt, Human
gcuaacuugcuuaaaugug

SEQ ID NO: 3869588 - RNA, 22 nt, Human
gcuaacuugcuuaaaugugaau

SEQ ID NO: 3869589 - RNA, 23 nt, Human
gcuaagaaccuggaacuugggga

SEQ ID NO: 3869590 - RNA, 14 nt, Human
gcuaagaauuuuuu

SEQ ID NO: 3869591 - RNA, 14 nt, Human
gcuaagacuuccua

SEQ ID NO: 3869592 - RNA, 14 nt, Human
gcuaagagaaguag

SEQ ID NO: 3869593 - RNA, 18 nt, Human
gcuaagagcuagcgcugc

SEQ ID NO: 3869594 - RNA, 19 nt, Human
gcuaagaguguccuaggag

SEQ ID NO: 3869595 - RNA, 18 nt, Human
gcuaagccccagcaagca

SEQ ID NO: 3869596 - RNA, 20 nt, Human
gcuaagccccagcaagcaau

SEQ ID NO: 3869597 - RNA, 17 nt, Human
gcuaaggcguggagcug

SEQ ID NO: 3869598 - RNA, 20 nt, Human
gcuaaggcguggagcugccu

SEQ ID NO: 3869599 - RNA, 21 nt, Human
gcuaaggcguggagcugccug

SEQ ID NO: 3869600 - RNA, 11 nt, Human
gcuaaggcucu

SEQ ID NO: 3869601 - RNA, 18 nt, Human
gcuaagggaagacauuuc

SEQ ID NO: 3869602 - RNA, 20 nt, Human
gcucagagagggugggagug

SEQ ID NO: 3869603 - RNA, 22 nt, Human
gcucagagagggugggaguggg

SEQ ID NO: 3869604 - RNA, 18 nt, Human
gcucagagaugugcaccc

SEQ ID NO: 3869605 - RNA, 18 nt, Human
gcucagaggcgcacugug

SEQ ID NO: 3869606 - RNA, 23 nt, Human
gcucagaggguuguucuccuaga

SEQ ID NO: 3869607 - RNA, 15 nt, Human
gcucagauagaauga

SEQ ID NO: 3869608 - RNA, 19 nt, Human
gcucagauagaaugacagu

SEQ ID NO: 3869609 - RNA, 14 nt, Human
gcucagcaaggcca

SEQ ID NO: 3869610 - RNA, 18 nt, Human
gcucagcaaggccaccuc

SEQ ID NO: 3869611 - RNA, 17 nt, Human
gcucagcacugccugcu

SEQ ID NO: 3869612 - RNA, 18 nt, Human
gcucagcacugccugcuc

SEQ ID NO: 3869613 - RNA, 11 nt, Human
gcucagcagcu

SEQ ID NO: 3869614 - RNA, 17 nt, Human
gcucagcagugacugug

SEQ ID NO: 3869615 - RNA, 18 nt, Human
gcucagcagugagagcag

SEQ ID NO: 3869616 - RNA, 12 nt, Human
gcucagccagca

SEQ ID NO: 3869617 - RNA, 14 nt, Human
gcucagccagcacu

SEQ ID NO: 3869618 - RNA, 16 nt, Human
gcucagcccacccccc

SEQ ID NO: 3869619 - RNA, 21 nt, Human
gcucagccccaccccagggca

SEQ ID NO: 3869620 - RNA, 22 nt, Human
gcucagccccaccccagggcag

SEQ ID NO: 3869621 - RNA, 17 nt, Human
gcucagccccagcccag

SEQ ID NO: 3869622 - RNA, 18 nt, Human
gcucagccccagcccagc

SEQ ID NO: 3869623 - RNA, 20 nt, Human
gcucagccccgagcuguccc

SEQ ID NO: 3869624 - RNA, 12 nt, Human
gcucagcccucc

SEQ ID NO: 3869625 - RNA, 19 nt, Human
gcucagcccucccugcccc

SEQ ID NO: 3869626 - RNA, 11 nt, Human
gcucagcccug

SEQ ID NO: 3869627 - RNA, 15 nt, Human
gcucagcccuggagg

SEQ ID NO: 3869628 - RNA, 17 nt, Human
gcucagccuggugggcc

SEQ ID NO: 3869629 - RNA, 18 nt, Human
gcucagccuggugggccu

SEQ ID NO: 3869630 - RNA, 19 nt, Human
gcucagccuggugggccuc

SEQ ID NO: 3869631 - RNA, 15 nt, Human
gcucagcgccagccu

SEQ ID NO: 3869632 - RNA, 15 nt, Human
gcucagcggggacag

SEQ ID NO: 3869633 - RNA, 18 nt, Human
gcucagcggggacagcuc

SEQ ID NO: 3869634 - RNA, 19 nt, Human
gcucagcggggacagcucc

SEQ ID NO: 3869635 - RNA, 20 nt, Human
gcucagcggggacagcuccu

SEQ ID NO: 3869636 - RNA, 16 nt, Human
gcucagcucuggcuca

SEQ ID NO: 3869637 - RNA, 18 nt, Human
gcucagcucuggcucaca

SEQ ID NO: 3869638 - RNA, 21 nt, Human
gcucagcucuggcucacagac

SEQ ID NO: 3869639 - RNA, 19 nt, Human
gcucagcugcauuccgcag

SEQ ID NO: 3869640 - RNA, 19 nt, Human
gcucagcugucaaggcuca

SEQ ID NO: 3869641 - RNA, 16 nt, Human
gcucagcuucuccugu

SEQ ID NO: 3869642 - RNA, 15 nt, Human
gcucaggaccaggca

SEQ ID NO: 3869643 - RNA, 19 nt, Human
gcucaggacucagaagccu

SEQ ID NO: 3869644 - RNA, 18 nt, Human
gcucaggagcccugggag

SEQ ID NO: 3869645 - RNA, 22 nt, Human
gcucaggagcccugggaggcuc

SEQ ID NO: 3869646 - RNA, 18 nt, Human
gcucaggaucucuuagca

SEQ ID NO: 3869647 - RNA, 20 nt, Human
gcucaggaugagggaaaaga

SEQ ID NO: 3869648 - RNA, 22 nt, Human
gcucaggcaggggccuccaugg

SEQ ID NO: 3869649 - RNA, 20 nt, Human
gcucaggccuauaaccccag

SEQ ID NO: 3869650 - RNA, 22 nt, Human
gcucaggcgauccaccugucuc

SEQ ID NO: 3869651 - RNA, 24 nt, Human
gcucaggcgauccaccugucucag

SEQ ID NO: 3869652 - RNA, 21 nt, Human
gcucaggcugcagcuggacag

SEQ ID NO: 3869653 - RNA, 23 nt, Human
gcucaggcugcagcuggacagag

SEQ ID NO: 3869654 - RNA, 15 nt, Human
gcucagggaaaagca

SEQ ID NO: 3869655 - RNA, 17 nt, Human
gcucagggaaaagcagc

SEQ ID NO: 3869656 - RNA, 16 nt, Human
gcucagggaccacagc

SEQ ID NO: 3869657 - RNA, 23 nt, Human
gcucagggccaugcugaggccug

SEQ ID NO: 3869658 - RNA, 19 nt, Human
gcucagggccuggcucagg

SEQ ID NO: 3869659 - RNA, 16 nt, Human
gcucaggggcagcuca

SEQ ID NO: 3869660 - RNA, 18 nt, Human
gcucaggggcguguggcu

SEQ ID NO: 3869661 - RNA, 20 nt, Human
gcucaggggcguguggcuca

SEQ ID NO: 3869662 - RNA, 17 nt, Human
gcucagguacagagaag

SEQ ID NO: 3869663 - RNA, 21 nt, Human
gcucagguacagagaaggaau

SEQ ID NO: 3869664 - RNA, 19 nt, Human
gcucaggucccuggggcua

SEQ ID NO: 3869665 - RNA, 16 nt, Human
gcucaggugucccugc

SEQ ID NO: 3869666 - RNA, 18 nt, Human
gcucaggugucccugcac

SEQ ID NO: 3869667 - RNA, 19 nt, Human
gcucaggugucccugcacu

SEQ ID NO: 3869668 - RNA, 18 nt, Human
gcucaguaaacgggaaca

SEQ ID NO: 3869669 - RNA, 21 nt, Human
gcucaguaauuugaggacaac

SEQ ID NO: 3869670 - RNA, 12 nt, Human
gcucagucccau

SEQ ID NO: 3869671 - RNA, 20 nt, Human
gcucagucucaggagcaugg

SEQ ID NO: 3869672 - RNA, 20 nt, Human
gcucagugaaguugcugcuu

SEQ ID NO: 3869673 - RNA, 21 nt, Human
gcucagugcaaccucugcuuc

SEQ ID NO: 3869674 - RNA, 15 nt, Human
gcucagugccuggac

SEQ ID NO: 3869675 - RNA, 22 nt, Human
gcucagugucuggcugcagagc

SEQ ID NO: 3869676 - RNA, 19 nt, Human
gcucaguguuuuugugaau

SEQ ID NO: 3869677 - RNA, 18 nt, Human
gcucauaacggaucagaa

SEQ ID NO: 3869678 - RNA, 22 nt, Human
gcucaucagaaacaauuucugu

SEQ ID NO: 3869679 - RNA, 16 nt, Human
gcucaucauucucugu

SEQ ID NO: 3869680 - RNA, 18 nt, Human
gcucaucauucucugucu

SEQ ID NO: 3869681 - RNA, 20 nt, Human
gcucaucauucucugucuca

SEQ ID NO: 3869682 - RNA, 16 nt, Human
gcucaucucuguccca

SEQ ID NO: 3869683 - RNA, 21 nt, Human
gcucaucugcugguccguggg

SEQ ID NO: 3869684 - RNA, 15 nt, Human
gcucaugguccccau

SEQ ID NO: 3869685 - RNA, 18 nt, Human
gcucaugguccccauggc

SEQ ID NO: 3869686 - RNA, 17 nt, Human
gcucaugugugcaacag

SEQ ID NO: 3869687 - RNA, 16 nt, Human
gcucauucagcaucug

SEQ ID NO: 3869688 - RNA, 18 nt, Human
gcucauucagcaucugac

SEQ ID NO: 3869689 - RNA, 14 nt, Human
gcucauucuaauga

SEQ ID NO: 3869690 - RNA, 11 nt, Human
gcucauuuaag

SEQ ID NO: 3869691 - RNA, 17 nt, Human
gcucauuuacuguuuua

SEQ ID NO: 3869692 - RNA, 17 nt, Human
gcuccaaacccucgagg

SEQ ID NO: 3869693 - RNA, 14 nt, Human
gcuccaaaccuuca

SEQ ID NO: 3869694 - RNA, 22 nt, Human
gcuccaaaccuucacacacaga

SEQ ID NO: 3869695 - RNA, 21 nt, Human
gcuccaaccugcaaagaucug

SEQ ID NO: 3869696 - RNA, 16 nt, Human
gcuccaagauucuaga

SEQ ID NO: 3869697 - RNA, 19 nt, Human
gcuccaagccccaucuucu

SEQ ID NO: 3869698 - RNA, 14 nt, Human
gcuccaagcuccca

SEQ ID NO: 3869699 - RNA, 16 nt, Human
gcuccaagcucccagg

SEQ ID NO: 3869700 - RNA, 18 nt, Human
gcuccaagcucccaggca

SEQ ID NO: 3869701 - RNA, 21 nt, Human
gcuccaaggggaaucagaacu

SEQ ID NO: 3869702 - RNA, 15 nt, Human
gcuccaccacauccu

SEQ ID NO: 3869703 - RNA, 13 nt, Human
gcuccaccccacu

SEQ ID NO: 3869704 - RNA, 16 nt, Human
gcuccacccuggccga

SEQ ID NO: 3869705 - RNA, 19 nt, Human
gcuccacccuuggccuguc

SEQ ID NO: 3869706 - RNA, 14 nt, Human
gcuccaccuuucag

SEQ ID NO: 3869707 - RNA, 15 nt, Human
gcuccacucugcuuc

SEQ ID NO: 3869708 - RNA, 21 nt, Human
gcuccacucugcuucucugac

SEQ ID NO: 3869709 - RNA, 18 nt, Human
gcuccacugucacccucc

SEQ ID NO: 3869710 - RNA, 9 nt, Human
gcuccagac

SEQ ID NO: 3869711 - RNA, 23 nt, Human
gcuccagacacauguccaagaag

SEQ ID NO: 3869712 - RNA, 14 nt, Human
gcuccagaccccca

SEQ ID NO: 3869713 - RNA, 23 nt, Human
gcuccagacccccagcaacccuc

SEQ ID NO: 3869714 - RNA, 12 nt, Human
gcuccagaccug

SEQ ID NO: 3869715 - RNA, 22 nt, Human
gcuccagacguaggggaggggu

SEQ ID NO: 3869716 - RNA, 20 nt, Human
gcuccagagggcacucugcu

SEQ ID NO: 3869717 - RNA, 21 nt, Human
gcuccagagggcacucugcuu

SEQ ID NO: 3869718 - RNA, 19 nt, Human
gcuccagaugcagggcagu

SEQ ID NO: 3869719 - RNA, 19 nt, Human
gcuccagcaacacagccug

SEQ ID NO: 3869720 - RNA, 14 nt, Human
gcuccagccaaccc

SEQ ID NO: 3869721 - RNA, 17 nt, Human
gcuccagccaaccccug

SEQ ID NO: 3869722 - RNA, 18 nt, Human
gcuccagccaaccccugu

SEQ ID NO: 3869723 - RNA, 13 nt, Human
gcuccagccaucu

SEQ ID NO: 3869724 - RNA, 16 nt, Human
gcuccagccccucuug

SEQ ID NO: 3869725 - RNA, 19 nt, Human
gcuccagccccuuuccaaa

SEQ ID NO: 3869726 - RNA, 11 nt, Human
gcuccagccug

SEQ ID NO: 3869727 - RNA, 21 nt, Human
gcuccagcucaccagccccag

SEQ ID NO: 3869728 - RNA, 21 nt, Human
gcuccagcugccccggccccu

SEQ ID NO: 3869729 - RNA, 16 nt, Human
gcuccaggagcagcca

SEQ ID NO: 3869730 - RNA, 16 nt, Human
gcuccaggcuccuuua

SEQ ID NO: 3869731 - RNA, 23 nt, Human
gcuccagggaugauucaagccau

SEQ ID NO: 3869732 - RNA, 15 nt, Human
gcuccagguggcucu

SEQ ID NO: 3869733 - RNA, 16 nt, Human
gcuccagguggcucug

SEQ ID NO: 3869734 - RNA, 18 nt, Human
gcuccaguccccagaacu

SEQ ID NO: 3869735 - RNA, 15 nt, Human
gcuccaguguccuga

SEQ ID NO: 3869736 - RNA, 17 nt, Human
gcuccaguguccugagc

SEQ ID NO: 3869737 - RNA, 21 nt, Human
gcuccauccgugccucuuuuu

SEQ ID NO: 3869738 - RNA, 18 nt, Human
gcuccaugugcccccucu

SEQ ID NO: 3869739 - RNA, 20 nt, Human
gcuccaugugcccccucuac

SEQ ID NO: 3869740 - RNA, 16 nt, Human
gcuccaugugccucuu

SEQ ID NO: 3869741 - RNA, 23 nt, Human
gcucccaagggauggugcccugu

SEQ ID NO: 3869742 - RNA, 21 nt, Human
gcucccaaggggccugagcag

SEQ ID NO: 3869743 - RNA, 18 nt, Human
gcucccacaagccugagg

SEQ ID NO: 3869744 - RNA, 16 nt, Human
gcucccacaggcagcu

SEQ ID NO: 3869745 - RNA, 18 nt, Human
gcuuuaaagggccugccu

SEQ ID NO: 3869746 - RNA, 21 nt, Human
gcuuuaaagggccugccuggc

SEQ ID NO: 3869747 - RNA, 18 nt, Human
gcuuuaacuuaaauagua

SEQ ID NO: 3869748 - RNA, 13 nt, Human
gcuuuaagccuuc

SEQ ID NO: 3869749 - RNA, 12 nt, Human
gcuuuaauauaa

SEQ ID NO: 3869750 - RNA, 17 nt, Human
gcuuuaauauaaaugca

SEQ ID NO: 3869751 - RNA, 23 nt, Human
gcuuuaauaucaucaguauugaa

SEQ ID NO: 3869752 - RNA, 21 nt, Human
gcuuuaauuuuuuuaaccaaa

SEQ ID NO: 3869753 - RNA, 12 nt, Human
gcuuuacaugca

SEQ ID NO: 3869754 - RNA, 16 nt, Human
gcuuuaccaaacagca

SEQ ID NO: 3869755 - RNA, 15 nt, Human
gcuuuacuuagcuua

SEQ ID NO: 3869756 - RNA, 21 nt, Human
gcuuuagaaucccagcccccu

SEQ ID NO: 3869757 - RNA, 18 nt, Human
gcuuuagaauguuuuccu

SEQ ID NO: 3869758 - RNA, 16 nt, Human
gcuuuagacccugggu

SEQ ID NO: 3869759 - RNA, 17 nt, Human
gcuuuagacccugggug

SEQ ID NO: 3869760 - RNA, 21 nt, Human
gcuuuagacuugaaaagagac

SEQ ID NO: 3869761 - RNA, 20 nt, Human
gcuuuauacguguagcuaua

SEQ ID NO: 3869762 - RNA, 16 nt, Human
gcuuuauccucuuuag

SEQ ID NO: 3869763 - RNA, 20 nt, Human
gcuuuaugauaauagauucu

SEQ ID NO: 3869764 - RNA, 12 nt, Human
gcuuuaugauuu

SEQ ID NO: 3869765 - RNA, 14 nt, Human
gcuuuaugcugaaa

SEQ ID NO: 3869766 - RNA, 16 nt, Human
gcuuuauuuguaaauu

SEQ ID NO: 3869767 - RNA, 21 nt, Human
gcuuuauuuguuuuuuuuguu

SEQ ID NO: 3869768 - RNA, 20 nt, Human
gcuuuauuuugagauguaaa

SEQ ID NO: 3869769 - RNA, 13 nt, Human
gcuuuauuuuuua

SEQ ID NO: 3869770 - RNA, 23 nt, Human
gcuuuauuuuuuaaguauuuaua

SEQ ID NO: 3869771 - RNA, 16 nt, Human
gcuuuauuuuuuugaa

SEQ ID NO: 3869772 - RNA, 11 nt, Human
gcuuucaagug

SEQ ID NO: 3869773 - RNA, 21 nt, Human
gcuuucaauuccguagccagc

SEQ ID NO: 3869774 - RNA, 23 nt, Human
gcuuucagauacuggauuguacu

SEQ ID NO: 3869775 - RNA, 13 nt, Human
gcuuucagggagg

SEQ ID NO: 3869776 - RNA, 21 nt, Human
gcuuucagggccaugguucac

SEQ ID NO: 3869777 - RNA, 18 nt, Human
gcuuucagggccuccagc

SEQ ID NO: 3869778 - RNA, 18 nt, Human
gcuuucauuuucucucag

SEQ ID NO: 3869779 - RNA, 14 nt, Human
gcuuuccauauuuu

SEQ ID NO: 3869780 - RNA, 19 nt, Human
gcuuuccauucgugaaaac

SEQ ID NO: 3869781 - RNA, 15 nt, Human
gcuuuccccuguggg

SEQ ID NO: 3869782 - RNA, 22 nt, Human
gcuuuccugaauccaaacuaau

SEQ ID NO: 3869783 - RNA, 19 nt, Human
gcuuuccugccccaggccu

SEQ ID NO: 3869784 - RNA, 18 nt, Human
gcuuuccuguuucucagu

SEQ ID NO: 3869785 - RNA, 18 nt, Human
gcuuuccuuguggcagag

SEQ ID NO: 3869786 - RNA, 21 nt, Human
gcuuucguccacagcuuccug

SEQ ID NO: 3869787 - RNA, 19 nt, Human
gcuuucgucuccagccccu

SEQ ID NO: 3869788 - RNA, 17 nt, Human
gcuuucuauuguacaga

SEQ ID NO: 3869789 - RNA, 16 nt, Human
gcuuucuccaggagga

SEQ ID NO: 3869790 - RNA, 18 nt, Human
gcuuucuccccaaugaga

SEQ ID NO: 3869791 - RNA, 21 nt, Human
gcuuucuccccaaugagacuu

SEQ ID NO: 3869792 - RNA, 19 nt, Human
gcuuucucuuuucucuuuu

SEQ ID NO: 3869793 - RNA, 19 nt, Human
gcuuucugaagcuuuacca

SEQ ID NO: 3869794 - RNA, 18 nt, Human
gcuuucugcucagcuucu

SEQ ID NO: 3869795 - RNA, 13 nt, Human
gcuuucuguucca

SEQ ID NO: 3869796 - RNA, 14 nt, Human
gcuuucuguuccaa

SEQ ID NO: 3869797 - RNA, 16 nt, Human
gcuuucuguugucauu

SEQ ID NO: 3869798 - RNA, 15 nt, Human
gcuuucuugcucccu

SEQ ID NO: 3869799 - RNA, 21 nt, Human
gcuuucuugcucccuucagcc

SEQ ID NO: 3869800 - RNA, 12 nt, Human
gcuuucuugcug

SEQ ID NO: 3869801 - RNA, 15 nt, Human
gcuuugaaacagaaa

SEQ ID NO: 3869802 - RNA, 11 nt, Human
gcuuugaaugu

SEQ ID NO: 3869803 - RNA, 20 nt, Human
gcuuugacucaccuguuacu

SEQ ID NO: 3869804 - RNA, 15 nt, Human
gcuuugacucaggag

SEQ ID NO: 3869805 - RNA, 19 nt, Human
gcuuugacucuauaagcaa

SEQ ID NO: 3869806 - RNA, 20 nt, Human
gcuuugacucuauaagcaaa

SEQ ID NO: 3869807 - RNA, 16 nt, Human
gcuuugagaagccuuc

SEQ ID NO: 3869808 - RNA, 22 nt, Human
gcuuugagaagccuucagcucc

SEQ ID NO: 3869809 - RNA, 22 nt, Human
gcuuugagagagaaaggacucc

SEQ ID NO: 3869810 - RNA, 22 nt, Human
gcuuugagguggaagagggcug

SEQ ID NO: 3869811 - RNA, 18 nt, Human
gcuuugauuaauccagaa

SEQ ID NO: 3869812 - RNA, 20 nt, Human
gcuuugauucauaguaacuu

SEQ ID NO: 3869813 - RNA, 19 nt, Human
gcuuugcaaccauuuucau

SEQ ID NO: 3869814 - RNA, 17 nt, Human
gcuuugcauguuccacu

SEQ ID NO: 3869815 - RNA, 20 nt, Human
gcuuugcauuccuacaaaga

SEQ ID NO: 3869816 - RNA, 16 nt, Human
gcuuugccauugugaa

SEQ ID NO: 3869817 - RNA, 18 nt, Human
gcuuugcccugcugcccu

SEQ ID NO: 3869818 - RNA, 19 nt, Human
gcuuugcccugcugcccuc

SEQ ID NO: 3869819 - RNA, 20 nt, Human
gcuuugccugguuuugucuu

SEQ ID NO: 3869820 - RNA, 24 nt, Human
gcuuugccuuccacgcugucucca

SEQ ID NO: 3869821 - RNA, 16 nt, Human
gcuuugcgugcccggg

SEQ ID NO: 3869822 - RNA, 15 nt, Human
gcuuugcugcuacag

SEQ ID NO: 3869823 - RNA, 12 nt, Human
gcuuugcugcug

SEQ ID NO: 3869824 - RNA, 21 nt, Human
gcuuugcuuaugguaauaaaa

SEQ ID NO: 3869825 - RNA, 18 nt, Human
gcuuuggacacacacagc

SEQ ID NO: 3869826 - RNA, 19 nt, Human
gcuuuggacacacacagcu

SEQ ID NO: 3869827 - RNA, 22 nt, Human
gcuuuggacacacacagcuucu

SEQ ID NO: 3869828 - RNA, 22 nt, Human
gcuuuggaccuaaauggccuca

SEQ ID NO: 3869829 - RNA, 15 nt, Human
gcuuuggagaagagu

SEQ ID NO: 3869830 - RNA, 15 nt, Human
gcuuuggcagugcca

SEQ ID NO: 3869831 - RNA, 16 nt, Human
gcuuuggcagugccau

SEQ ID NO: 3869832 - RNA, 14 nt, Human
gcuuuggccugagu

SEQ ID NO: 3869833 - RNA, 13 nt, Human
gcuuuggcuucuu

SEQ ID NO: 3869834 - RNA, 15 nt, Human
gcuuugggagaaugu

SEQ ID NO: 3869835 - RNA, 17 nt, Human
gcuuuggucucuugcuu

SEQ ID NO: 3869836 - RNA, 16 nt, Human
gcuuugguuuaaaaga

SEQ ID NO: 3869837 - RNA, 20 nt, Human
gcuuuguagaguuuugucau

SEQ ID NO: 3869838 - RNA, 13 nt, Human
gcuuuguauagaa

SEQ ID NO: 3869839 - RNA, 15 nt, Human
gcuuuguaugcacuu

SEQ ID NO: 3869840 - RNA, 16 nt, Human
gcuuuguauuuuuaau

SEQ ID NO: 3869841 - RNA, 14 nt, Human
gcuuuguccccugc

SEQ ID NO: 3869842 - RNA, 15 nt, Human
gcuuugugauuuuug

SEQ ID NO: 3869843 - RNA, 14 nt, Human
gcuuuguggcacug

SEQ ID NO: 3869844 - RNA, 19 nt, Human
gcuuugugugaaggcagag

SEQ ID NO: 3869845 - RNA, 23 nt, Human
gcuuuguguuugguuuacauuua

SEQ ID NO: 3869846 - RNA, 17 nt, Human
gcuuuguuaccuuaaaa

SEQ ID NO: 3869847 - RNA, 19 nt, Human
gcuuuguuaccuuaaaacu

SEQ ID NO: 3869848 - RNA, 15 nt, Human
gcuuuguugcacuga

SEQ ID NO: 3869849 - RNA, 21 nt, Human
gcuuuguugugugccucuagc

SEQ ID NO: 3869850 - RNA, 22 nt, Human
gcuuuguugugugccucuagcu

SEQ ID NO: 3869851 - RNA, 14 nt, Human
gcuuuguuuguucu

SEQ ID NO: 3869852 - RNA, 22 nt, Human
gcuuuguuuugggggucaggca

SEQ ID NO: 3869853 - RNA, 12 nt, Human
gcuuuuaaaauu

SEQ ID NO: 3869854 - RNA, 19 nt, Human
gcuuuuaacagagucugaa

SEQ ID NO: 3869855 - RNA, 17 nt, Human
gcuuuuaaccaucugau

SEQ ID NO: 3869856 - RNA, 15 nt, Human
gcuuuuaccaugccc

SEQ ID NO: 3869857 - RNA, 13 nt, Human
gcuuuuacccuuu

SEQ ID NO: 3869858 - RNA, 22 nt, Human
gcuuuuacccuuuuucuugaau

SEQ ID NO: 3869859 - RNA, 13 nt, Human
gcuuuuagaaaag

SEQ ID NO: 3869860 - RNA, 14 nt, Human
gcuuuuaguaccca

SEQ ID NO: 3869861 - RNA, 19 nt, Human
gcuuuuaguacccaccuga

SEQ ID NO: 3869862 - RNA, 15 nt, Human
gcuuuuaguuuuucu

SEQ ID NO: 3869863 - RNA, 20 nt, Human
gcuuuuaguuuuucuguccc

SEQ ID NO: 3869864 - RNA, 16 nt, Human
gcuuuuauaucuguau

SEQ ID NO: 3869865 - RNA, 15 nt, Human
gcuuuuaugugaaac

SEQ ID NO: 3869866 - RNA, 17 nt, Human
gcuuuuauuaaauuugu

SEQ ID NO: 3869867 - RNA, 15 nt, Human
gcuuuuauuguauaa

SEQ ID NO: 3869868 - RNA, 12 nt, Human
gcuuuucacugc

SEQ ID NO: 3869869 - RNA, 16 nt, Human
gcuuuucccaaaagcc

SEQ ID NO: 3869870 - RNA, 21 nt, Human
gcuuuucccuuuuuuuaagua

SEQ ID NO: 3869871 - RNA, 21 nt, Human
gcuuuuccuuggggcaggcag

SEQ ID NO: 3869872 - RNA, 22 nt, Human
gcuuuuccuuuguuuuuaugaa

SEQ ID NO: 3869873 - RNA, 14 nt, Human
gcuuuucucagcug

SEQ ID NO: 3869874 - RNA, 16 nt, Human
gcuuuucuccucuuuc

SEQ ID NO: 3869875 - RNA, 14 nt, Human
gcuuuucugcccug

SEQ ID NO: 3869876 - RNA, 17 nt, Human
gcuuuucugcccuggcu

SEQ ID NO: 3869877 - RNA, 22 nt, Human
gcuuuucugcccuggcugcugc

SEQ ID NO: 3869878 - RNA, 18 nt, Human
gcuuuucugucucugccu

SEQ ID NO: 3869879 - RNA, 17 nt, Human
gcuuuucuguuuccugu

SEQ ID NO: 3869880 - RNA, 13 nt, Human
gcuuuugcuucua

SEQ ID NO: 3869881 - RNA, 18 nt, Human
gcuuuuggauuggacaaa

SEQ ID NO: 3869882 - RNA, 18 nt, Human
gcuuuuggggagccagaa

SEQ ID NO: 3869883 - RNA, 21 nt, Human
gcuuuugucuaauuaaaacac

SEQ ID NO: 3869884 - RNA, 18 nt, Human
gcuuuugucuaugggacu

SEQ ID NO: 3869885 - RNA, 12 nt, Human
gcuuuugugcau

SEQ ID NO: 3869886 - RNA, 13 nt, Human
gcuuuugugcauu

SEQ ID NO: 3869887 - RNA, 17 nt, Human
gcuuuugugucuuacau

SEQ ID NO: 3869888 - RNA, 23 nt, Human
gcuuuuguuuccuuuuucagaua

SEQ ID NO: 3869889 - RNA, 16 nt, Human
gcuuuuguuuugcuuu

SEQ ID NO: 3869890 - RNA, 13 nt, Human
ggaagcccccacc

SEQ ID NO: 3869891 - RNA, 22 nt, Human
ggaagcccccaccgugggcagg

SEQ ID NO: 3869892 - RNA, 15 nt, Human
ggaagcccuggagac

SEQ ID NO: 3869893 - RNA, 18 nt, Human
ggaagccgcuggggccag

SEQ ID NO: 3869894 - RNA, 20 nt, Human
ggaagccgugcucgccccag

SEQ ID NO: 3869895 - RNA, 20 nt, Human
ggaagccuuuacugacccug

SEQ ID NO: 3869896 - RNA, 20 nt, Human
ggaagcgcgagggccucaaa

SEQ ID NO: 3869897 - RNA, 22 nt, Human
ggaagcggagguugcagggagc

SEQ ID NO: 3869898 - RNA, 22 nt, Human
ggaagcgugaaggccgagaagc

SEQ ID NO: 3869899 - RNA, 13 nt, Human
ggaagcuacaggu

SEQ ID NO: 3869900 - RNA, 17 nt, Human
ggaagcucagggccugg

SEQ ID NO: 3869901 - RNA, 23 nt, Human
ggaagcucagggccuggcucagg

SEQ ID NO: 3869902 - RNA, 18 nt, Human
ggaagcucugaagucaca

SEQ ID NO: 3869903 - RNA, 20 nt, Human
ggaagcucuuggagcuguga

SEQ ID NO: 3869904 - RNA, 21 nt, Human
ggaagcucuuggagcugugag

SEQ ID NO: 3869905 - RNA, 11 nt, Human
ggaagcugcag

SEQ ID NO: 3869906 - RNA, 14 nt, Human
ggaagcugcagcuu

SEQ ID NO: 3869907 - RNA, 16 nt, Human
ggaagcugcagcuugg

SEQ ID NO: 3869908 - RNA, 15 nt, Human
ggaagcugcuccgug

SEQ ID NO: 3869909 - RNA, 18 nt, Human
ggaagcuggccgaggguc

SEQ ID NO: 3869910 - RNA, 17 nt, Human
ggaagcuguguccuugc

SEQ ID NO: 3869911 - RNA, 21 nt, Human
ggaagcuuuguccccugcuuc

SEQ ID NO: 3869912 - RNA, 16 nt, Human
ggaaggaaacccagcu

SEQ ID NO: 3869913 - RNA, 19 nt, Human
ggaaggaaacccagcucug

SEQ ID NO: 3869914 - RNA, 20 nt, Human
ggaaggaaacccagcucugg

SEQ ID NO: 3869915 - RNA, 18 nt, Human
ggaaggaacucuggcuuc

SEQ ID NO: 3869916 - RNA, 20 nt, Human
ggaaggagacucaccucugc

SEQ ID NO: 3869917 - RNA, 14 nt, Human
ggaaggagagccug

SEQ ID NO: 3869918 - RNA, 17 nt, Human
ggaaggagagccugcug

SEQ ID NO: 3869919 - RNA, 12 nt, Human
ggaaggagccag

SEQ ID NO: 3869920 - RNA, 13 nt, Human
ggaaggagcugcc

SEQ ID NO: 3869921 - RNA, 18 nt, Human
ggaaggagcugccuggac

SEQ ID NO: 3869922 - RNA, 19 nt, Human
ggaaggagcugccuggacc

SEQ ID NO: 3869923 - RNA, 13 nt, Human
ggaaggaggagcc

SEQ ID NO: 3869924 - RNA, 20 nt, Human
ggaaggaggguacagcuggg

SEQ ID NO: 3869925 - RNA, 17 nt, Human
ggaaggaucccaugagc

SEQ ID NO: 3869926 - RNA, 22 nt, Human
ggaaggaucccaugagcuccuu

SEQ ID NO: 3869927 - RNA, 17 nt, Human
ggaaggcaggcagggcu

SEQ ID NO: 3869928 - RNA, 22 nt, Human
ggaaggcaggcagggcucuccu

SEQ ID NO: 3869929 - RNA, 14 nt, Human
ggaaggccaccugc

SEQ ID NO: 3869930 - RNA, 17 nt, Human
ggaaggccaccugcagg

SEQ ID NO: 3869931 - RNA, 20 nt, Human
ggaaggccugacuucugcug

SEQ ID NO: 3869932 - RNA, 14 nt, Human
ggaaggccugggug

SEQ ID NO: 3869933 - RNA, 22 nt, Human
ggaaggcuacuucggggcuggg

SEQ ID NO: 3869934 - RNA, 23 nt, Human
ggaagggaccaaggcaaggcagg

SEQ ID NO: 3869935 - RNA, 17 nt, Human
ggaagggagccaaggga

SEQ ID NO: 3869936 - RNA, 14 nt, Human
ggaagggcaaaacc

SEQ ID NO: 3869937 - RNA, 21 nt, Human
ggaagggcaggaaggagagcc

SEQ ID NO: 3869938 - RNA, 11 nt, Human
ggaagggccag

SEQ ID NO: 3869939 - RNA, 17 nt, Human
ggaaggggacccccgcc

SEQ ID NO: 3869940 - RNA, 14 nt, Human
ggaaggggacccuc

SEQ ID NO: 3869941 - RNA, 17 nt, Human
ggaaggggccagaggcu

SEQ ID NO: 3869942 - RNA, 18 nt, Human
ggaaggggcccgugggag

SEQ ID NO: 3869943 - RNA, 17 nt, Human
ggaaggggggucagaag

SEQ ID NO: 3869944 - RNA, 16 nt, Human
ggaaggggguccaccc

SEQ ID NO: 3869945 - RNA, 13 nt, Human
ggaaggguggugg

SEQ ID NO: 3869946 - RNA, 13 nt, Human
ggaaggucucauu

SEQ ID NO: 3869947 - RNA, 18 nt, Human
ggaaguacuggagaaaau

SEQ ID NO: 3869948 - RNA, 16 nt, Human
ggaaguaggaaguaaa

SEQ ID NO: 3869949 - RNA, 14 nt, Human
ggaaguaguccuug

SEQ ID NO: 3869950 - RNA, 16 nt, Human
ggaaguaguccuuggc

SEQ ID NO: 3869951 - RNA, 19 nt, Human
ggaaguaguuaucauguua

SEQ ID NO: 3869952 - RNA, 22 nt, Human
ggaagucguccuuacuccugug

SEQ ID NO: 3869953 - RNA, 20 nt, Human
ggaagugaagacuggaagcu

SEQ ID NO: 3869954 - RNA, 23 nt, Human
ggaagugaagagggagaagggau

SEQ ID NO: 3869955 - RNA, 21 nt, Human
ggaagugacaaggccccagag

SEQ ID NO: 3869956 - RNA, 22 nt, Human
ggaagugacaaggccccagaga

SEQ ID NO: 3869957 - RNA, 16 nt, Human
ggaagugaggaagcca

SEQ ID NO: 3869958 - RNA, 20 nt, Human
ggaagugguggcuguggaag

SEQ ID NO: 3869959 - RNA, 19 nt, Human
ggaaguguaacagcugagg

SEQ ID NO: 3869960 - RNA, 22 nt, Human
ggaaguuaaagggaagaaaaca

SEQ ID NO: 3869961 - RNA, 23 nt, Human
ggaaguucauaccuaaguacugu

SEQ ID NO: 3869962 - RNA, 18 nt, Human
ggaaguugacuuauagua

SEQ ID NO: 3869963 - RNA, 15 nt, Human
ggaaguuuagcucug

SEQ ID NO: 3869964 - RNA, 17 nt, Human
ggaaguuuagcucugag

SEQ ID NO: 3869965 - RNA, 17 nt, Human
ggaaguuuguguucugu

SEQ ID NO: 3869966 - RNA, 15 nt, Human
ggaauaaaaggcuug

SEQ ID NO: 3869967 - RNA, 12 nt, Human
ggaauaaaauac

SEQ ID NO: 3869968 - RNA, 19 nt, Human
ggaauaaaauacuauuuuu

SEQ ID NO: 3869969 - RNA, 21 nt, Human
ggaauaaaauccuaagacaca

SEQ ID NO: 3869970 - RNA, 23 nt, Human
ggaauaaauaugccucuccuuug

SEQ ID NO: 3869971 - RNA, 21 nt, Human
ggaauaagaagcaaauaaaua

SEQ ID NO: 3869972 - RNA, 21 nt, Human
ggaauaauuauuuauuuaaua

SEQ ID NO: 3869973 - RNA, 12 nt, Human
ggaauacagugu

SEQ ID NO: 3869974 - RNA, 15 nt, Human
ggaauaccugucccc

SEQ ID NO: 3869975 - RNA, 18 nt, Human
ggaauacuagggagaagg

SEQ ID NO: 3869976 - RNA, 16 nt, Human
ggaauagaagcaaauu

SEQ ID NO: 3869977 - RNA, 17 nt, Human
ggaauaguugagcccca

SEQ ID NO: 3869978 - RNA, 20 nt, Human
ggaauaguugagccccaagu

SEQ ID NO: 3869979 - RNA, 18 nt, Human
ggaauauaugugugccua

SEQ ID NO: 3869980 - RNA, 15 nt, Human
ggaauauuauauuug

SEQ ID NO: 3869981 - RNA, 11 nt, Human
ggaauauuuga

SEQ ID NO: 3869982 - RNA, 14 nt, Human
ggaauauuugaauc

SEQ ID NO: 3869983 - RNA, 18 nt, Human
ggaaucaacagggcagca

SEQ ID NO: 3869984 - RNA, 19 nt, Human
ggaaucaagagcugcccuc

SEQ ID NO: 3869985 - RNA, 18 nt, Human
ggaaucacucuuguggau

SEQ ID NO: 3869986 - RNA, 21 nt, Human
ggaaucagacuucacacugca

SEQ ID NO: 3869987 - RNA, 18 nt, Human
ggaaucaugucaggccug

SEQ ID NO: 3869988 - RNA, 20 nt, Human
ggaauccaagccuccacagc

SEQ ID NO: 3869989 - RNA, 21 nt, Human
ggaauccaagccuccacagcg

SEQ ID NO: 3869990 - RNA, 16 nt, Human
ggaauccacucccagg

SEQ ID NO: 3869991 - RNA, 20 nt, Human
ggaaucccacuaaugcaaac

SEQ ID NO: 3869992 - RNA, 22 nt, Human
ggaauccuauauagaaugcugc

SEQ ID NO: 3869993 - RNA, 13 nt, Human
ggaauccuggcag

SEQ ID NO: 3869994 - RNA, 21 nt, Human
ggaauccuggcagcccagaga

SEQ ID NO: 3869995 - RNA, 19 nt, Human
ggaauccuguccucagcuu

SEQ ID NO: 3869996 - RNA, 15 nt, Human
ggaaucuagaagaaa

SEQ ID NO: 3869997 - RNA, 19 nt, Human
ggaaucuagaagaaaugaa

SEQ ID NO: 3869998 - RNA, 17 nt, Human
ggaaucuuucugcuuug

SEQ ID NO: 3869999 - RNA, 21 nt, Human
ggaaucuuuguaccaaaauuu

SEQ ID NO: 3870000 - RNA, 18 nt, Human
ggaaugaaaaaagcuuua

SEQ ID NO: 3870001 - RNA, 20 nt, Human
ggaaugagaaguagccacag

SEQ ID NO: 3870002 - RNA, 13 nt, Human
ggaaugagcccag

SEQ ID NO: 3870003 - RNA, 17 nt, Human
ggaaugaggaaaauucu

SEQ ID NO: 3870004 - RNA, 17 nt, Human
ggaaugagggggcucag

SEQ ID NO: 3870005 - RNA, 21 nt, Human
ggaaugaggugggagguggaa

SEQ ID NO: 3870006 - RNA, 24 nt, Human
ggaaugauuaauuaaaacacaaca

SEQ ID NO: 3870007 - RNA, 13 nt, Human
ggaaugcaaagau

SEQ ID NO: 3870008 - RNA, 14 nt, Human
ggaaugcggcaaga

SEQ ID NO: 3870009 - RNA, 23 nt, Human
ggaaugcucccccauccuccccu

SEQ ID NO: 3870010 - RNA, 23 nt, Human
ggaaugcugcccgcucugcagac

SEQ ID NO: 3870011 - RNA, 14 nt, Human
ggaaugcuguguua

SEQ ID NO: 3870012 - RNA, 16 nt, Human
ggaaugcuuccuagaa

SEQ ID NO: 3870013 - RNA, 15 nt, Human
ggaaugcuuggaaua

SEQ ID NO: 3870014 - RNA, 19 nt, Human
ggaauggauuuuucuuuaa

SEQ ID NO: 3870015 - RNA, 20 nt, Human
ggaauggauuuuucuuuaac

SEQ ID NO: 3870016 - RNA, 18 nt, Human
ggaauguacaugucaaua

SEQ ID NO: 3870017 - RNA, 23 nt, Human
ggaauguauaguauuugaaaaca

SEQ ID NO: 3870018 - RNA, 14 nt, Human
ggaaugucuuuggu

SEQ ID NO: 3870019 - RNA, 19 nt, Human
ggaauguuugccucugccu

SEQ ID NO: 3870020 - RNA, 21 nt, Human
ggaauguuugggcagaaggga

SEQ ID NO: 3870021 - RNA, 17 nt, Human
ggaauuaaaacaauguc

SEQ ID NO: 3870022 - RNA, 16 nt, Human
ggaauuaaccuggugc

SEQ ID NO: 3870023 - RNA, 19 nt, Human
ggaauuagcuuggggccag

SEQ ID NO: 3870024 - RNA, 14 nt, Human
ggaauuauuuuaaa

SEQ ID NO: 3870025 - RNA, 12 nt, Human
ggaauucuguau

SEQ ID NO: 3870026 - RNA, 15 nt, Human
ggaauucuguauaga

SEQ ID NO: 3870027 - RNA, 17 nt, Human
ggaauugauuugcauug

SEQ ID NO: 3870028 - RNA, 19 nt, Human
ggaauugauuugcauugaa

SEQ ID NO: 3870029 - RNA, 16 nt, Human
ggaauuggagcucgug

SEQ ID NO: 3870030 - RNA, 23 nt, Human
ggaauuggguggggggcuucaua

SEQ ID NO: 3870031 - RNA, 23 nt, Human
ggaauugguggcagauuuuacaa

SEQ ID NO: 3870032 - RNA, 21 nt, Human
ggaauuguggcuauccugauu

SEQ ID NO: 3870033 - RNA, 12 nt, Human
ggccaaguucuu

SEQ ID NO: 3870034 - RNA, 22 nt, Human
ggccaaugcaccuaaagaaaaa

SEQ ID NO: 3870035 - RNA, 14 nt, Human
ggccacacagcugc

SEQ ID NO: 3870036 - RNA, 15 nt, Human
ggccacacagcugcc

SEQ ID NO: 3870037 - RNA, 16 nt, Human
ggccacacagcugccg

SEQ ID NO: 3870038 - RNA, 21 nt, Human
ggccacacucagcacaaggcc

SEQ ID NO: 3870039 - RNA, 11 nt, Human
ggccacagcca

SEQ ID NO: 3870040 - RNA, 13 nt, Human
ggccacagccaga

SEQ ID NO: 3870041 - RNA, 17 nt, Human
ggccacagccagaaccc

SEQ ID NO: 3870042 - RNA, 17 nt, Human
ggccacagcgccagccu

SEQ ID NO: 3870043 - RNA, 14 nt, Human
ggccacaguuguuu

SEQ ID NO: 3870044 - RNA, 16 nt, Human
ggccacaguuguuuga

SEQ ID NO: 3870045 - RNA, 16 nt, Human
ggccacauagaugcug

SEQ ID NO: 3870046 - RNA, 16 nt, Human
ggccacaucaaagagg

SEQ ID NO: 3870047 - RNA, 16 nt, Human
ggccacaugaguccca

SEQ ID NO: 3870048 - RNA, 11 nt, Human
ggccaccagga

SEQ ID NO: 3870049 - RNA, 18 nt, Human
ggccaccaggugccuuuc

SEQ ID NO: 3870050 - RNA, 23 nt, Human
ggccacccguucugcuggccugg

SEQ ID NO: 3870051 - RNA, 22 nt, Human
ggccaccuccuaaaaggcccag

SEQ ID NO: 3870052 - RNA, 15 nt, Human
ggccaccucuccaag

SEQ ID NO: 3870053 - RNA, 23 nt, Human
ggccaccucugcggaccccagcu

SEQ ID NO: 3870054 - RNA, 15 nt, Human
ggccaccucuuccug

SEQ ID NO: 3870055 - RNA, 22 nt, Human
ggccaccucuuccuggccggug

SEQ ID NO: 3870056 - RNA, 21 nt, Human
ggccaccugaggugggcccag

SEQ ID NO: 3870057 - RNA, 11 nt, Human
ggccaccugca

SEQ ID NO: 3870058 - RNA, 22 nt, Human
ggccaccugcccccuucuccca

SEQ ID NO: 3870059 - RNA, 14 nt, Human
ggccaccugccugc

SEQ ID NO: 3870060 - RNA, 16 nt, Human
ggccaccugcggugcu

SEQ ID NO: 3870061 - RNA, 16 nt, Human
ggccaccuggcucuca

SEQ ID NO: 3870062 - RNA, 14 nt, Human
ggccaccuuuucag

SEQ ID NO: 3870063 - RNA, 13 nt, Human
ggccacgcagcca

SEQ ID NO: 3870064 - RNA, 19 nt, Human
ggccacgcagccaggacac

SEQ ID NO: 3870065 - RNA, 18 nt, Human
ggccacgugauguggagg

SEQ ID NO: 3870066 - RNA, 12 nt, Human
ggccacgugcca

SEQ ID NO: 3870067 - RNA, 17 nt, Human
ggccacgugccaggccc

SEQ ID NO: 3870068 - RNA, 18 nt, Human
ggccacgugccaggcccg

SEQ ID NO: 3870069 - RNA, 23 nt, Human
ggccacucccggcacuccaugcu

SEQ ID NO: 3870070 - RNA, 13 nt, Human
ggccacuccgaga

SEQ ID NO: 3870071 - RNA, 15 nt, Human
ggccacucugccucu

SEQ ID NO: 3870072 - RNA, 16 nt, Human
ggccacucugccucug

SEQ ID NO: 3870073 - RNA, 14 nt, Human
ggccacugaagagg

SEQ ID NO: 3870074 - RNA, 15 nt, Human
ggccacugaagagga

SEQ ID NO: 3870075 - RNA, 18 nt, Human
ggccacugcacagagcuc

SEQ ID NO: 3870076 - RNA, 19 nt, Human
ggccacugcacagagcucu

SEQ ID NO: 3870077 - RNA, 13 nt, Human
ggccacugcuccc

SEQ ID NO: 3870078 - RNA, 18 nt, Human
ggccacuggccaucucca

SEQ ID NO: 3870079 - RNA, 15 nt, Human
ggccacuucugggug

SEQ ID NO: 3870080 - RNA, 13 nt, Human
ggccacuucuguc

SEQ ID NO: 3870081 - RNA, 22 nt, Human
ggccacuuggauccauuuccag

SEQ ID NO: 3870082 - RNA, 15 nt, Human
ggccacuuuugacua

SEQ ID NO: 3870083 - RNA, 12 nt, Human
ggccagaaguac

SEQ ID NO: 3870084 - RNA, 15 nt, Human
ggccagacaugccac

SEQ ID NO: 3870085 - RNA, 18 nt, Human
ggccagaccagagcucug

SEQ ID NO: 3870086 - RNA, 19 nt, Human
ggccagaccagagcucugg

SEQ ID NO: 3870087 - RNA, 12 nt, Human
ggccagagccca

SEQ ID NO: 3870088 - RNA, 14 nt, Human
ggccagagcuggga

SEQ ID NO: 3870089 - RNA, 21 nt, Human
ggccagagcugggaggcaugg

SEQ ID NO: 3870090 - RNA, 21 nt, Human
ggccagaggcccccagcccag

SEQ ID NO: 3870091 - RNA, 23 nt, Human
ggccagagggagugacagaggca

SEQ ID NO: 3870092 - RNA, 15 nt, Human
ggccagaguggccug

SEQ ID NO: 3870093 - RNA, 16 nt, Human
ggccagaguggccugg

SEQ ID NO: 3870094 - RNA, 18 nt, Human
ggccagaguggccuggcc

SEQ ID NO: 3870095 - RNA, 16 nt, Human
ggccagauccagccug

SEQ ID NO: 3870096 - RNA, 17 nt, Human
ggccagauccagccugg

SEQ ID NO: 3870097 - RNA, 15 nt, Human
ggccagaugcaccag

SEQ ID NO: 3870098 - RNA, 19 nt, Human
ggccagaugcaccagcccu

SEQ ID NO: 3870099 - RNA, 23 nt, Human
ggccagcaagguggaguggaugc

SEQ ID NO: 3870100 - RNA, 19 nt, Human
ggccagcagcaccugcccu

SEQ ID NO: 3870101 - RNA, 13 nt, Human
ggccagcagcuug

SEQ ID NO: 3870102 - RNA, 13 nt, Human
ggccagccagcca

SEQ ID NO: 3870103 - RNA, 17 nt, Human
ggccagccagccacucu

SEQ ID NO: 3870104 - RNA, 15 nt, Human
ggccagccccacagc

SEQ ID NO: 3870105 - RNA, 23 nt, Human
ggccagccccacagcccacgucc

SEQ ID NO: 3870106 - RNA, 15 nt, Human
ggccagccccaccca

SEQ ID NO: 3870107 - RNA, 16 nt, Human
ggccagccccacccag

SEQ ID NO: 3870108 - RNA, 21 nt, Human
ggccagccccacccaggaggg

SEQ ID NO: 3870109 - RNA, 17 nt, Human
ggccagccccggcccug

SEQ ID NO: 3870110 - RNA, 12 nt, Human
ggccagccccuc

SEQ ID NO: 3870111 - RNA, 18 nt, Human
ggccagccccucccacca

SEQ ID NO: 3870112 - RNA, 23 nt, Human
ggccagccccucccaccacagca

SEQ ID NO: 3870113 - RNA, 15 nt, Human
ggccagcccggcugg

SEQ ID NO: 3870114 - RNA, 16 nt, Human
ggccagcccggcuggu

SEQ ID NO: 3870115 - RNA, 18 nt, Human
ggccagcccggcugguuu

SEQ ID NO: 3870116 - RNA, 16 nt, Human
ggccagccucacccuu

SEQ ID NO: 3870117 - RNA, 13 nt, Human
ggccagccuggcc

SEQ ID NO: 3870118 - RNA, 18 nt, Human
ggccagccuggggccugg

SEQ ID NO: 3870119 - RNA, 19 nt, Human
ggccagccuggggccuggc

SEQ ID NO: 3870120 - RNA, 20 nt, Human
ggccagccuggggccuggca

SEQ ID NO: 3870121 - RNA, 21 nt, Human
ggccagccuggggccuggcag

SEQ ID NO: 3870122 - RNA, 22 nt, Human
ggccagccuugaccauucucca

SEQ ID NO: 3870123 - RNA, 22 nt, Human
ggccagcgagcgcccagcuccu

SEQ ID NO: 3870124 - RNA, 20 nt, Human
ggccagcugcaucuacucag

SEQ ID NO: 3870125 - RNA, 23 nt, Human
ggccagcugcaucuacucaggcc

SEQ ID NO: 3870126 - RNA, 15 nt, Human
ggccagcuuuucaaa

SEQ ID NO: 3870127 - RNA, 18 nt, Human
ggccaggaaguagcacag

SEQ ID NO: 3870128 - RNA, 23 nt, Human
ggccaggaaguagcacaggcuga

SEQ ID NO: 3870129 - RNA, 23 nt, Human
ggccaggacagagcugacaaaau

SEQ ID NO: 3870130 - RNA, 16 nt, Human
ggccaggacaggcccg

SEQ ID NO: 3870131 - RNA, 14 nt, Human
ggccaggacucugc

SEQ ID NO: 3870132 - RNA, 16 nt, Human
ggccaggacucugcag

SEQ ID NO: 3870133 - RNA, 20 nt, Human
ggccaggacucugcagccuc

SEQ ID NO: 3870134 - RNA, 13 nt, Human
ggccaggacugag

SEQ ID NO: 3870135 - RNA, 20 nt, Human
ggccaggacugagccccgca

SEQ ID NO: 3870136 - RNA, 14 nt, Human
ggccaggagccucc

SEQ ID NO: 3870137 - RNA, 15 nt, Human
ggccaggagcucuuc

SEQ ID NO: 3870138 - RNA, 14 nt, Human
ggccaggaggugcc

SEQ ID NO: 3870139 - RNA, 19 nt, Human
ggccaggaguuugagacca

SEQ ID NO: 3870140 - RNA, 20 nt, Human
ggccaggaguuugagaccag

SEQ ID NO: 3870141 - RNA, 11 nt, Human
ggccaggccac

SEQ ID NO: 3870142 - RNA, 15 nt, Human
ggccaggcccucugc

SEQ ID NO: 3870143 - RNA, 19 nt, Human
ggccaggccgggccuguac

SEQ ID NO: 3870144 - RNA, 14 nt, Human
ggccaggccucucc

SEQ ID NO: 3870145 - RNA, 11 nt, Human
ggccaggcucc

SEQ ID NO: 3870146 - RNA, 16 nt, Human
ggccaggcuccuuccu

SEQ ID NO: 3870147 - RNA, 11 nt, Human
ggccaggcugc

SEQ ID NO: 3870148 - RNA, 14 nt, Human
ggccaggcugcucu

SEQ ID NO: 3870149 - RNA, 16 nt, Human
ggccaggcugcucuug

SEQ ID NO: 3870150 - RNA, 12 nt, Human
ggccaggcuggu

SEQ ID NO: 3870151 - RNA, 19 nt, Human
ggccaggcuggucuaaaac

SEQ ID NO: 3870152 - RNA, 16 nt, Human
ggccagggagaagcuc

SEQ ID NO: 3870153 - RNA, 20 nt, Human
ggccagggccacgcuccagc

SEQ ID NO: 3870154 - RNA, 17 nt, Human
ggccagggccuggaaga

SEQ ID NO: 3870155 - RNA, 23 nt, Human
ggccagggccuggaagacagaga

SEQ ID NO: 3870156 - RNA, 14 nt, Human
ggccagggcugccc

SEQ ID NO: 3870157 - RNA, 19 nt, Human
ggccagggcugcccugaga

SEQ ID NO: 3870158 - RNA, 17 nt, Human
ggccaggggucucccug

SEQ ID NO: 3870159 - RNA, 20 nt, Human
ggccaguaagggaaauagaa

SEQ ID NO: 3870160 - RNA, 20 nt, Human
ggccaguccacccugccugc

SEQ ID NO: 3870161 - RNA, 16 nt, Human
ggccaguccaggcugc

SEQ ID NO: 3870162 - RNA, 21 nt, Human
ggccaguccaggcugccgugg

SEQ ID NO: 3870163 - RNA, 20 nt, Human
ggccaguccugccuggccag

SEQ ID NO: 3870164 - RNA, 21 nt, Human
ggccaguccugccuggccagg

SEQ ID NO: 3870165 - RNA, 19 nt, Human
ggccagugcccugauccca

SEQ ID NO: 3870166 - RNA, 19 nt, Human
ggccaguggccuuccccag

SEQ ID NO: 3870167 - RNA, 22 nt, Human
ggccaguggccuuccccagcau

SEQ ID NO: 3870168 - RNA, 19 nt, Human
ggccaguggcuggaucugu

SEQ ID NO: 3870169 - RNA, 14 nt, Human
ggccaguggggccu

SEQ ID NO: 3870170 - RNA, 13 nt, Human
ggccagugucugu

SEQ ID NO: 3870171 - RNA, 22 nt, Human
ggccagugucugucccgggguc

SEQ ID NO: 3870172 - RNA, 20 nt, Human
ggccagugugacaaggauug

SEQ ID NO: 3870173 - RNA, 19 nt, Human
ggccaguguuuaaaacuuc

SEQ ID NO: 3870174 - RNA, 15 nt, Human
ggccauacuggccuc

SEQ ID NO: 3870175 - RNA, 18 nt, Human
ggccauauuuaccucagc

SEQ ID NO: 3870176 - RNA, 19 nt, Human
ggccauauuuaccucagcc

SEQ ID NO: 3870177 - RNA, 22 nt, Human
ggccauauuuaccucagccugg

SEQ ID NO: 3870178 - RNA, 12 nt, Human
ggccgaggcggg

SEQ ID NO: 3870179 - RNA, 16 nt, Human
ggccgaggguccuggc

SEQ ID NO: 3870180 - RNA, 22 nt, Human
ggccgauuugggaaccaagcua

SEQ ID NO: 3870181 - RNA, 21 nt, Human
ggccgcaccuaaagcagccag

SEQ ID NO: 3870182 - RNA, 18 nt, Human
ggccgcagcucuugcccu

SEQ ID NO: 3870183 - RNA, 22 nt, Human
ggccgcccccugccccccagcc

SEQ ID NO: 3870184 - RNA, 17 nt, Human
ggccgcccgggcccaga

SEQ ID NO: 3870185 - RNA, 21 nt, Human
ggccgcccgggcccagaggag

SEQ ID NO: 3870186 - RNA, 13 nt, Human
ggccgccuggguc

SEQ ID NO: 3870187 - RNA, 16 nt, Human
ggccgcgcccuuuccc

SEQ ID NO: 3870188 - RNA, 18 nt, Human
ggccgcgcguccagcugc

SEQ ID NO: 3870189 - RNA, 15 nt, Human
ggccgcuagaggccu

SEQ ID NO: 3870190 - RNA, 18 nt, Human
ggccgcuagaggccugag

SEQ ID NO: 3870191 - RNA, 13 nt, Human
ggccgcugccacc

SEQ ID NO: 3870192 - RNA, 23 nt, Human
ggccgcugccacccaccucccug

SEQ ID NO: 3870193 - RNA, 18 nt, Human
ggccggcagccccagccu

SEQ ID NO: 3870194 - RNA, 21 nt, Human
ggccggcagccccagccugcu

SEQ ID NO: 3870195 - RNA, 16 nt, Human
ggccggccagccagcc

SEQ ID NO: 3870196 - RNA, 15 nt, Human
ggccggccagguggg

SEQ ID NO: 3870197 - RNA, 17 nt, Human
ggccggcgagcccugug

SEQ ID NO: 3870198 - RNA, 14 nt, Human
ggccgggcagaggg

SEQ ID NO: 3870199 - RNA, 23 nt, Human
ggccgggccuguacagucugucu

SEQ ID NO: 3870200 - RNA, 13 nt, Human
ggccggggccggg

SEQ ID NO: 3870201 - RNA, 21 nt, Human
ggccggucugcaagucagagg

SEQ ID NO: 3870202 - RNA, 16 nt, Human
ggccguaucuccggcu

SEQ ID NO: 3870203 - RNA, 19 nt, Human
ggccgucacuugugggggu

SEQ ID NO: 3870204 - RNA, 12 nt, Human
ggccgucaggac

SEQ ID NO: 3870205 - RNA, 13 nt, Human
ggccguccucccg

SEQ ID NO: 3870206 - RNA, 20 nt, Human
ggccguccucccgggcccuc

SEQ ID NO: 3870207 - RNA, 20 nt, Human
ggccgugacgucuggguggc

SEQ ID NO: 3870208 - RNA, 17 nt, Human
ggccgugggccuggggu

SEQ ID NO: 3870209 - RNA, 16 nt, Human
ggccguggggguugag

SEQ ID NO: 3870210 - RNA, 19 nt, Human
ggccguugauguuggcugg

SEQ ID NO: 3870211 - RNA, 21 nt, Human
ggccguugauguuggcuggga

SEQ ID NO: 3870212 - RNA, 14 nt, Human
ggccuaaaaucuug

SEQ ID NO: 3870213 - RNA, 21 nt, Human
ggccuaaccugccgagagucc

SEQ ID NO: 3870214 - RNA, 15 nt, Human
ggccuaagaggcugc

SEQ ID NO: 3870215 - RNA, 13 nt, Human
ggccuaauaaaac

SEQ ID NO: 3870216 - RNA, 23 nt, Human
ggccuaauaaaacugaugugaaa

SEQ ID NO: 3870217 - RNA, 23 nt, Human
ggccuaaucucauaccucugacc

SEQ ID NO: 3870218 - RNA, 23 nt, Human
ggccuacagcuuugaucccugac

SEQ ID NO: 3870219 - RNA, 23 nt, Human
ggccuacaugcuuugugaacaag

SEQ ID NO: 3870220 - RNA, 20 nt, Human
ggccuaccccgcagacaccu

SEQ ID NO: 3870221 - RNA, 12 nt, Human
ggccuacuccug

SEQ ID NO: 3870222 - RNA, 20 nt, Human
ggccuacuccugucuucugc

SEQ ID NO: 3870223 - RNA, 13 nt, Human
ggccuagaccagc

SEQ ID NO: 3870224 - RNA, 14 nt, Human
ggccuagaggccug

SEQ ID NO: 3870225 - RNA, 17 nt, Human
ggccuagauccacacac

SEQ ID NO: 3870226 - RNA, 23 nt, Human
ggccuagauccacacacagagga

SEQ ID NO: 3870227 - RNA, 23 nt, Human
ggccuagcauacguacacauuuu

SEQ ID NO: 3870228 - RNA, 17 nt, Human
ggccuaggaggguccuc

SEQ ID NO: 3870229 - RNA, 21 nt, Human
ggccuaggaggguccucugag

SEQ ID NO: 3870230 - RNA, 14 nt, Human
ggccuaggcugcau

SEQ ID NO: 3870231 - RNA, 15 nt, Human
ggccuagucccuucc

SEQ ID NO: 3870232 - RNA, 23 nt, Human
ggccuaucagugugccccccauc

SEQ ID NO: 3870233 - RNA, 18 nt, Human
ggccuaugacuugggcac

SEQ ID NO: 3870234 - RNA, 17 nt, Human
ggccuauggagagcccu

SEQ ID NO: 3870235 - RNA, 14 nt, Human
ggccuauguggucu

SEQ ID NO: 3870236 - RNA, 22 nt, Human
ggccucaaaguuggggcaggcu

SEQ ID NO: 3870237 - RNA, 15 nt, Human
ggccucaacccuccc

SEQ ID NO: 3870238 - RNA, 17 nt, Human
ggccucaacccucccuc

SEQ ID NO: 3870239 - RNA, 23 nt, Human
ggccucaacccucccucagcccc

SEQ ID NO: 3870240 - RNA, 18 nt, Human
ggccucaacuccucccau

SEQ ID NO: 3870241 - RNA, 18 nt, Human
ggccucaagaucaaugaa

SEQ ID NO: 3870242 - RNA, 15 nt, Human
ggccucaaggacuug

SEQ ID NO: 3870243 - RNA, 13 nt, Human
ggccucacccacc

SEQ ID NO: 3870244 - RNA, 18 nt, Human
ggccucacccaccccugc

SEQ ID NO: 3870245 - RNA, 18 nt, Human
ggccucaccgaguggggg

SEQ ID NO: 3870246 - RNA, 15 nt, Human
ggccucaccucuacc

SEQ ID NO: 3870247 - RNA, 21 nt, Human
ggccucagacugcacccagga

SEQ ID NO: 3870248 - RNA, 22 nt, Human
ggccucagacugcacccaggag

SEQ ID NO: 3870249 - RNA, 23 nt, Human
ggccucagacugcacccaggagg

SEQ ID NO: 3870250 - RNA, 17 nt, Human
ggccucagcaccccugu

SEQ ID NO: 3870251 - RNA, 15 nt, Human
ggccucagccagaga

SEQ ID NO: 3870252 - RNA, 17 nt, Human
ggccucagccagagaag

SEQ ID NO: 3870253 - RNA, 16 nt, Human
ggccucagggcuccuu

SEQ ID NO: 3870254 - RNA, 17 nt, Human
ggccucaggugcugucc

SEQ ID NO: 3870255 - RNA, 18 nt, Human
ggccucaggugcugucca

SEQ ID NO: 3870256 - RNA, 17 nt, Human
ggccucagguuugccug

SEQ ID NO: 3870257 - RNA, 11 nt, Human
ggccucagucu

SEQ ID NO: 3870258 - RNA, 14 nt, Human
ggccucauguggcu

SEQ ID NO: 3870259 - RNA, 15 nt, Human
ggccucauguggcug

SEQ ID NO: 3870260 - RNA, 17 nt, Human
ggccucauguggcugga

SEQ ID NO: 3870261 - RNA, 17 nt, Human
ggccucauuacuuuacc

SEQ ID NO: 3870262 - RNA, 15 nt, Human
ggccuccagaacuca

SEQ ID NO: 3870263 - RNA, 10 nt, Human
ggccuccagg

SEQ ID NO: 3870264 - RNA, 14 nt, Human
ggccuccauccuga

SEQ ID NO: 3870265 - RNA, 15 nt, Human
ggccuccauccugag

SEQ ID NO: 3870266 - RNA, 19 nt, Human
ggccuccauccugaggcuc

SEQ ID NO: 3870267 - RNA, 17 nt, Human
ggccuccauuccuggag

SEQ ID NO: 3870268 - RNA, 17 nt, Human
ggccucccaacucaccc

SEQ ID NO: 3870269 - RNA, 22 nt, Human
ggccucccaacucaccccagcc

SEQ ID NO: 3870270 - RNA, 11 nt, Human
ggccucccaca

SEQ ID NO: 3870271 - RNA, 12 nt, Human
ggccucccaccc

SEQ ID NO: 3870272 - RNA, 13 nt, Human
ggccucccacccg

SEQ ID NO: 3870273 - RNA, 12 nt, Human
ggccucccccac

SEQ ID NO: 3870274 - RNA, 19 nt, Human
ggccuccccugccaccagg

SEQ ID NO: 3870275 - RNA, 22 nt, Human
ggccuccccugccaccaggcca

SEQ ID NO: 3870276 - RNA, 15 nt, Human
ggccucccugccagu

SEQ ID NO: 3870277 - RNA, 21 nt, Human
ggccuccggcgucagccucca

SEQ ID NO: 3870278 - RNA, 21 nt, Human
ggccuccgucacuaccuggcu

SEQ ID NO: 3870279 - RNA, 21 nt, Human
ggccuccucuaacaggggcug

SEQ ID NO: 3870280 - RNA, 18 nt, Human
ggccuccucuguccaggg

SEQ ID NO: 3870281 - RNA, 23 nt, Human
ggccuccucuucaccccggcagg

SEQ ID NO: 3870282 - RNA, 14 nt, Human
ggccuccuucugag

SEQ ID NO: 3870283 - RNA, 16 nt, Human
ggccuccuugcuuguu

SEQ ID NO: 3870284 - RNA, 19 nt, Human
ggccucgcaggaagaccca

SEQ ID NO: 3870285 - RNA, 16 nt, Human
ggccucgccuggccug

SEQ ID NO: 3870286 - RNA, 22 nt, Human
ggccucgggacaccugcccugc

SEQ ID NO: 3870287 - RNA, 16 nt, Human
ggccucuaaccccagg

SEQ ID NO: 3870288 - RNA, 22 nt, Human
ggccucuaaccccaggccccga

SEQ ID NO: 3870289 - RNA, 19 nt, Human
ggccucuaccacaagggcu

SEQ ID NO: 3870290 - RNA, 15 nt, Human
ggccucuccauuugc

SEQ ID NO: 3870291 - RNA, 13 nt, Human
ggccucucuaucc

SEQ ID NO: 3870292 - RNA, 23 nt, Human
ggccucucuauccucucuuccuc

SEQ ID NO: 3870293 - RNA, 14 nt, Human
ggccucucucuagg

SEQ ID NO: 3870294 - RNA, 15 nt, Human
ggccucucuggccuc

SEQ ID NO: 3870295 - RNA, 17 nt, Human
ggccucucuggccuccc

SEQ ID NO: 3870296 - RNA, 21 nt, Human
ggccucugcaaaggaaauacc

SEQ ID NO: 3870297 - RNA, 16 nt, Human
ggccucugcacucccc

SEQ ID NO: 3870298 - RNA, 22 nt, Human
ggccucugcacuccccugcugg

SEQ ID NO: 3870299 - RNA, 20 nt, Human
ggccucugcggagcacacug

SEQ ID NO: 3870300 - RNA, 18 nt, Human
ggccucuuaugggcuggg

SEQ ID NO: 3870301 - RNA, 16 nt, Human
ggccucuugagcagug

SEQ ID NO: 3870302 - RNA, 13 nt, Human
ggccucuuggcag

SEQ ID NO: 3870303 - RNA, 23 nt, Human
ggccucuuugucuaaaacaauaa

SEQ ID NO: 3870304 - RNA, 23 nt, Human
ggccugaagaguccucugaauga

SEQ ID NO: 3870305 - RNA, 20 nt, Human
ggccugaagccagcugcccu

SEQ ID NO: 3870306 - RNA, 19 nt, Human
ggccugaaucaugagccug

SEQ ID NO: 3870307 - RNA, 19 nt, Human
ggccugaccucccccuccu

SEQ ID NO: 3870308 - RNA, 20 nt, Human
ggccugaccucccccuccuu

SEQ ID NO: 3870309 - RNA, 16 nt, Human
ggccugacucucagca

SEQ ID NO: 3870310 - RNA, 13 nt, Human
ggccugacugcuc

SEQ ID NO: 3870311 - RNA, 15 nt, Human
ggccugagacccagg

SEQ ID NO: 3870312 - RNA, 21 nt, Human
ggccugagagaauuggcucaa

SEQ ID NO: 3870313 - RNA, 18 nt, Human
ggccugagagucagcucu

SEQ ID NO: 3870314 - RNA, 22 nt, Human
ggccugagauuucaucugcucu

SEQ ID NO: 3870315 - RNA, 17 nt, Human
ggccugagcaguccuug

SEQ ID NO: 3870316 - RNA, 19 nt, Human
ggccugagcaguccuuggc

SEQ ID NO: 3870317 - RNA, 15 nt, Human
ggccugagccuggcc

SEQ ID NO: 3870318 - RNA, 18 nt, Human
ggccugaggaugagcugg

SEQ ID NO: 3870319 - RNA, 22 nt, Human
ggccugagugagaggggaggcc

SEQ ID NO: 3870320 - RNA, 20 nt, Human
ggccugaucagaccacggcu

SEQ ID NO: 3870321 - RNA, 14 nt, Human
ggccugaugcuccc

SEQ ID NO: 3870322 - RNA, 19 nt, Human
ggggccacuuuugacuagg

SEQ ID NO: 3870323 - RNA, 17 nt, Human
ggggccagauccagccu

SEQ ID NO: 3870324 - RNA, 20 nt, Human
ggggccaggcugggucgccc

SEQ ID NO: 3870325 - RNA, 20 nt, Human
ggggccaugagcuccagacc

SEQ ID NO: 3870326 - RNA, 21 nt, Human
ggggccaugagcuccagaccc

SEQ ID NO: 3870327 - RNA, 22 nt, Human
ggggccaugagcuccagacccc

SEQ ID NO: 3870328 - RNA, 14 nt, Human
ggggccaugaggcc

SEQ ID NO: 3870329 - RNA, 14 nt, Human
ggggccaugccucc

SEQ ID NO: 3870330 - RNA, 19 nt, Human
ggggccccagucagccucu

SEQ ID NO: 3870331 - RNA, 16 nt, Human
ggggccccgucucagg

SEQ ID NO: 3870332 - RNA, 20 nt, Human
ggggccccgucucaggucug

SEQ ID NO: 3870333 - RNA, 19 nt, Human
ggggccccucucagcccuc

SEQ ID NO: 3870334 - RNA, 21 nt, Human
ggggcccgccuggcagaacug

SEQ ID NO: 3870335 - RNA, 21 nt, Human
ggggcccgcgauguggaacug

SEQ ID NO: 3870336 - RNA, 15 nt, Human
ggggcccggccagcc

SEQ ID NO: 3870337 - RNA, 22 nt, Human
ggggccgcugccacccaccucc

SEQ ID NO: 3870338 - RNA, 16 nt, Human
ggggccggccaguggc

SEQ ID NO: 3870339 - RNA, 21 nt, Human
ggggccgggcgcgguggcuca

SEQ ID NO: 3870340 - RNA, 17 nt, Human
ggggccgggggcagucu

SEQ ID NO: 3870341 - RNA, 23 nt, Human
ggggccuacagcuuugaucccug

SEQ ID NO: 3870342 - RNA, 20 nt, Human
ggggccuaggccucagccag

SEQ ID NO: 3870343 - RNA, 15 nt, Human
ggggccucagugcca

SEQ ID NO: 3870344 - RNA, 21 nt, Human
ggggccuccaugggccccagg

SEQ ID NO: 3870345 - RNA, 16 nt, Human
ggggccugaggcuccu

SEQ ID NO: 3870346 - RNA, 18 nt, Human
ggggccugccaccuggac

SEQ ID NO: 3870347 - RNA, 19 nt, Human
ggggccuggagauccuccu

SEQ ID NO: 3870348 - RNA, 11 nt, Human
ggggccuggca

SEQ ID NO: 3870349 - RNA, 22 nt, Human
ggggccuggcgggaugggccac

SEQ ID NO: 3870350 - RNA, 22 nt, Human
ggggccuggcuggcugagggca

SEQ ID NO: 3870351 - RNA, 16 nt, Human
ggggccugggacuucc

SEQ ID NO: 3870352 - RNA, 12 nt, Human
ggggccugggca

SEQ ID NO: 3870353 - RNA, 15 nt, Human
ggggccugggcagga

SEQ ID NO: 3870354 - RNA, 17 nt, Human
ggggccuguacugccug

SEQ ID NO: 3870355 - RNA, 13 nt, Human
ggggcgaggcaga

SEQ ID NO: 3870356 - RNA, 21 nt, Human
ggggcgaucgcggcggagcug

SEQ ID NO: 3870357 - RNA, 16 nt, Human
ggggcgcggcugggag

SEQ ID NO: 3870358 - RNA, 21 nt, Human
ggggcgcucgcuuccgcaucc

SEQ ID NO: 3870359 - RNA, 14 nt, Human
ggggcgcuggccca

SEQ ID NO: 3870360 - RNA, 17 nt, Human
ggggcgcuggcccagcc

SEQ ID NO: 3870361 - RNA, 17 nt, Human
ggggcgugaggucccag

SEQ ID NO: 3870362 - RNA, 19 nt, Human
ggggcguggagggaggccc

SEQ ID NO: 3870363 - RNA, 15 nt, Human
ggggcguggggaggg

SEQ ID NO: 3870364 - RNA, 16 nt, Human
ggggcuacaagaggga

SEQ ID NO: 3870365 - RNA, 14 nt, Human
ggggcuagaaccua

SEQ ID NO: 3870366 - RNA, 15 nt, Human
ggggcucagcaaggc

SEQ ID NO: 3870367 - RNA, 21 nt, Human
ggggcucagcaaggccaccuc

SEQ ID NO: 3870368 - RNA, 16 nt, Human
ggggcucccagccagg

SEQ ID NO: 3870369 - RNA, 11 nt, Human
ggggcuccugg

SEQ ID NO: 3870370 - RNA, 21 nt, Human
ggggcuccuuucuccagccag

SEQ ID NO: 3870371 - RNA, 22 nt, Human
ggggcuccuuucuccagccagc

SEQ ID NO: 3870372 - RNA, 20 nt, Human
ggggcucuaacgccugagcc

SEQ ID NO: 3870373 - RNA, 20 nt, Human
ggggcucucagcucagcgcc

SEQ ID NO: 3870374 - RNA, 14 nt, Human
ggggcucuucucau

SEQ ID NO: 3870375 - RNA, 18 nt, Human
ggggcugaacggggagaa

SEQ ID NO: 3870376 - RNA, 20 nt, Human
ggggcugaccuuccucgcag

SEQ ID NO: 3870377 - RNA, 15 nt, Human
ggggcugaggagcag

SEQ ID NO: 3870378 - RNA, 17 nt, Human
ggggcugaggugggagg

SEQ ID NO: 3870379 - RNA, 22 nt, Human
ggggcugcaccggcuggccugg

SEQ ID NO: 3870380 - RNA, 14 nt, Human
ggggcugccagggg

SEQ ID NO: 3870381 - RNA, 13 nt, Human
ggggcugcccgcu

SEQ ID NO: 3870382 - RNA, 16 nt, Human
ggggcugcccgcuccc

SEQ ID NO: 3870383 - RNA, 15 nt, Human
ggggcugcuccucca

SEQ ID NO: 3870384 - RNA, 16 nt, Human
ggggcugcuccuccag

SEQ ID NO: 3870385 - RNA, 15 nt, Human
ggggcugcuggccug

SEQ ID NO: 3870386 - RNA, 16 nt, Human
ggggcuggaggagccc

SEQ ID NO: 3870387 - RNA, 17 nt, Human
ggggcuggaggagccca

SEQ ID NO: 3870388 - RNA, 17 nt, Human
ggggcugggcagaggaa

SEQ ID NO: 3870389 - RNA, 17 nt, Human
ggggcuggggcaggagg

SEQ ID NO: 3870390 - RNA, 10 nt, Human
ggggcugggu

SEQ ID NO: 3870391 - RNA, 13 nt, Human
ggggcuggguugg

SEQ ID NO: 3870392 - RNA, 23 nt, Human
ggggcuggguuggcgcacccucc

SEQ ID NO: 3870393 - RNA, 23 nt, Human
ggggcuguccugccacccagccc

SEQ ID NO: 3870394 - RNA, 20 nt, Human
ggggcuuauaauaaaggacu

SEQ ID NO: 3870395 - RNA, 20 nt, Human
gggggaacgcccacuucccu

SEQ ID NO: 3870396 - RNA, 17 nt, Human
gggggaacucagaucca

SEQ ID NO: 3870397 - RNA, 17 nt, Human
gggggaagagcacagcc

SEQ ID NO: 3870398 - RNA, 15 nt, Human
gggggagagggcugc

SEQ ID NO: 3870399 - RNA, 12 nt, Human
gggggauaugaa

SEQ ID NO: 3870400 - RNA, 17 nt, Human
gggggaucacagccucu

SEQ ID NO: 3870401 - RNA, 21 nt, Human
gggggaugccacuccucccuc

SEQ ID NO: 3870402 - RNA, 13 nt, Human
gggggcagggcug

SEQ ID NO: 3870403 - RNA, 22 nt, Human
gggggcagucugagagaggcca

SEQ ID NO: 3870404 - RNA, 21 nt, Human
gggggcagugcucacccacac

SEQ ID NO: 3870405 - RNA, 15 nt, Human
gggggccaacaccag

SEQ ID NO: 3870406 - RNA, 12 nt, Human
gggggccaccug

SEQ ID NO: 3870407 - RNA, 16 nt, Human
gggggccaccugccug

SEQ ID NO: 3870408 - RNA, 20 nt, Human
gggggccccagucagccucu

SEQ ID NO: 3870409 - RNA, 18 nt, Human
gggggccucagugccacu

SEQ ID NO: 3870410 - RNA, 18 nt, Human
gggggccugaccuccccc

SEQ ID NO: 3870411 - RNA, 11 nt, Human
gggggccuggc

SEQ ID NO: 3870412 - RNA, 13 nt, Human
gggggccuggcug

SEQ ID NO: 3870413 - RNA, 14 nt, Human
gggggccuggcugg

SEQ ID NO: 3870414 - RNA, 18 nt, Human
gggggcuagggagacgcc

SEQ ID NO: 3870415 - RNA, 19 nt, Human
gggggcucagcaaggccac

SEQ ID NO: 3870416 - RNA, 20 nt, Human
gggggcugccuggcccccag

SEQ ID NO: 3870417 - RNA, 12 nt, Human
gggggcuggccu

SEQ ID NO: 3870418 - RNA, 11 nt, Human
gggggcuggga

SEQ ID NO: 3870419 - RNA, 23 nt, Human
ggggggcccgccuggcagaacug

SEQ ID NO: 3870420 - RNA, 21 nt, Human
gggggucaccggccgauggag

SEQ ID NO: 3870421 - RNA, 20 nt, Human
gggggucaggcagccaguga

SEQ ID NO: 3870422 - RNA, 18 nt, Human
ggggguccuccuccaggg

SEQ ID NO: 3870423 - RNA, 22 nt, Human
gggggucuggcugguguuaaca

SEQ ID NO: 3870424 - RNA, 13 nt, Human
ggggguggaggcu

SEQ ID NO: 3870425 - RNA, 13 nt, Human
ggggguggccgcu

SEQ ID NO: 3870426 - RNA, 19 nt, Human
ggggguuccguguccaccc

SEQ ID NO: 3870427 - RNA, 22 nt, Human
gggguaaaauuccuuagcuuag

SEQ ID NO: 3870428 - RNA, 17 nt, Human
gggguaggcagagccuu

SEQ ID NO: 3870429 - RNA, 15 nt, Human
gggguaguuggcaga

SEQ ID NO: 3870430 - RNA, 14 nt, Human
gggguaugaagagc

SEQ ID NO: 3870431 - RNA, 21 nt, Human
ggggucacucuggcagcucag

SEQ ID NO: 3870432 - RNA, 15 nt, Human
ggggucaggcuccau

SEQ ID NO: 3870433 - RNA, 22 nt, Human
ggggucagggaccaaggacccc

SEQ ID NO: 3870434 - RNA, 13 nt, Human
ggggucagugcug

SEQ ID NO: 3870435 - RNA, 13 nt, Human
ggggucccagugg

SEQ ID NO: 3870436 - RNA, 18 nt, Human
gggguccccuccaggagu

SEQ ID NO: 3870437 - RNA, 22 nt, Human
ggggucccuagcagcccacccu

SEQ ID NO: 3870438 - RNA, 22 nt, Human
gggguccuucaaguuagcucag

SEQ ID NO: 3870439 - RNA, 22 nt, Human
ggggucgacuucgggcuggcca

SEQ ID NO: 3870440 - RNA, 15 nt, Human
ggggucuccaggagg

SEQ ID NO: 3870441 - RNA, 20 nt, Human
ggggucucccucuccugccu

SEQ ID NO: 3870442 - RNA, 19 nt, Human
ggggucucucacagacagg

SEQ ID NO: 3870443 - RNA, 21 nt, Human
ggggucuggcugguguuaaca

SEQ ID NO: 3870444 - RNA, 23 nt, Human
ggggucuguguguuuaugugugu

SEQ ID NO: 3870445 - RNA, 12 nt, Human
ggggucuuugug

SEQ ID NO: 3870446 - RNA, 12 nt, Human
ggggugacacag

SEQ ID NO: 3870447 - RNA, 21 nt, Human
ggggugacagucaucaucagg

SEQ ID NO: 3870448 - RNA, 22 nt, Human
ggggugaccuccggccaggugc

SEQ ID NO: 3870449 - RNA, 18 nt, Human
ggggugacgccugcccuc

SEQ ID NO: 3870450 - RNA, 18 nt, Human
ggggugauuucagagagg

SEQ ID NO: 3870451 - RNA, 16 nt, Human
ggggugcacaggaggg

SEQ ID NO: 3870452 - RNA, 16 nt, Human
ggggugcccacaggcc

SEQ ID NO: 3870453 - RNA, 18 nt, Human
ggggugcugggccccugc

SEQ ID NO: 3870454 - RNA, 14 nt, Human
ggggugcuuccuug

SEQ ID NO: 3870455 - RNA, 17 nt, Human
gggguggaggcuuccug

SEQ ID NO: 3870456 - RNA, 13 nt, Human
gggguggccaggc

SEQ ID NO: 3870457 - RNA, 22 nt, Human
gggguggcccgaaagggucucc

SEQ ID NO: 3870458 - RNA, 12 nt, Human
gggguggccucc

SEQ ID NO: 3870459 - RNA, 17 nt, Human
gggguggccugcaguga

SEQ ID NO: 3870460 - RNA, 18 nt, Human
gggguggggguggaggcu

SEQ ID NO: 3870461 - RNA, 11 nt, Human
gggguggguca

SEQ ID NO: 3870462 - RNA, 18 nt, Human
gggguguuaguggcaccg

SEQ ID NO: 3870463 - RNA, 20 nt, Human
gggguguuugggaggcugcg

SEQ ID NO: 3870464 - RNA, 17 nt, Human
gggguuacaaacugcaa

SEQ ID NO: 3870465 - RNA, 13 nt, Human
gggguuaugugga

SEQ ID NO: 3870466 - RNA, 23 nt, Human
gggguucagccccuccucugcca

SEQ ID NO: 3870467 - RNA, 14 nt, Human
gguauaccucacuu

SEQ ID NO: 3870468 - RNA, 16 nt, Human
gguauauccaaaagcu

SEQ ID NO: 3870469 - RNA, 19 nt, Human
gguauauccuuuucugugu

SEQ ID NO: 3870470 - RNA, 21 nt, Human
gguauauccuuuucuguguuu

SEQ ID NO: 3870471 - RNA, 21 nt, Human
gguauaucuagguuuaugaca

SEQ ID NO: 3870472 - RNA, 15 nt, Human
gguaucaagaaaguc

SEQ ID NO: 3870473 - RNA, 12 nt, Human
gguaucauauau

SEQ ID NO: 3870474 - RNA, 19 nt, Human
gguaucauuuucugcauuu

SEQ ID NO: 3870475 - RNA, 12 nt, Human
gguauccugccc

SEQ ID NO: 3870476 - RNA, 17 nt, Human
gguauccugcccagugu

SEQ ID NO: 3870477 - RNA, 17 nt, Human
gguaucuaauucuuuaa

SEQ ID NO: 3870478 - RNA, 20 nt, Human
gguaucucagaaagugccug

SEQ ID NO: 3870479 - RNA, 23 nt, Human
gguaucuccaggauugaagagca

SEQ ID NO: 3870480 - RNA, 19 nt, Human
gguaugaacuugaggacac

SEQ ID NO: 3870481 - RNA, 15 nt, Human
gguauggaacucucu

SEQ ID NO: 3870482 - RNA, 12 nt, Human
gguauguuuaau

SEQ ID NO: 3870483 - RNA, 18 nt, Human
gguauguuuaaucuguua

SEQ ID NO: 3870484 - RNA, 16 nt, Human
gguauuaauaaaaaga

SEQ ID NO: 3870485 - RNA, 14 nt, Human
gguauuccugccuc

SEQ ID NO: 3870486 - RNA, 21 nt, Human
gguauuuaucuauuguaagau

SEQ ID NO: 3870487 - RNA, 22 nt, Human
gguauuuuaggcagggauuuga

SEQ ID NO: 3870488 - RNA, 12 nt, Human
gguauuuucaau

SEQ ID NO: 3870489 - RNA, 21 nt, Human
gguauuuuuuuguaauugcuu

SEQ ID NO: 3870490 - RNA, 20 nt, Human
ggucaacagaaugaaaaaug

SEQ ID NO: 3870491 - RNA, 21 nt, Human
ggucaacagaaugaaaaauga

SEQ ID NO: 3870492 - RNA, 20 nt, Human
ggucaacagagaaggcagga

SEQ ID NO: 3870493 - RNA, 22 nt, Human
ggucaacaguuuuccuaugcuu

SEQ ID NO: 3870494 - RNA, 18 nt, Human
ggucaagaaacagccagc

SEQ ID NO: 3870495 - RNA, 19 nt, Human
ggucaagaaacagccagca

SEQ ID NO: 3870496 - RNA, 21 nt, Human
ggucaagaaacagccagcaag

SEQ ID NO: 3870497 - RNA, 17 nt, Human
ggucaagcccaggagga

SEQ ID NO: 3870498 - RNA, 23 nt, Human
ggucaaggcaguagaacuccagg

SEQ ID NO: 3870499 - RNA, 20 nt, Human
ggucaaguaagaagacauga

SEQ ID NO: 3870500 - RNA, 17 nt, Human
ggucaauccugugggug

SEQ ID NO: 3870501 - RNA, 12 nt, Human
ggucaaugcuau

SEQ ID NO: 3870502 - RNA, 22 nt, Human
ggucacaaauccuaaaagaagc

SEQ ID NO: 3870503 - RNA, 16 nt, Human
ggucacagccuccucu

SEQ ID NO: 3870504 - RNA, 17 nt, Human
ggucacagccuccucug

SEQ ID NO: 3870505 - RNA, 21 nt, Human
ggucacagcggagguguggag

SEQ ID NO: 3870506 - RNA, 12 nt, Human
ggucacagcugu

SEQ ID NO: 3870507 - RNA, 20 nt, Human
ggucaccuaggaagccucag

SEQ ID NO: 3870508 - RNA, 16 nt, Human
ggucacucuggcagcu

SEQ ID NO: 3870509 - RNA, 21 nt, Human
ggucacucuuccugcaaggac

SEQ ID NO: 3870510 - RNA, 24 nt, Human
ggucacugaggccugagacccagg

SEQ ID NO: 3870511 - RNA, 17 nt, Human
ggucacuggcucuccaa

SEQ ID NO: 3870512 - RNA, 15 nt, Human
ggucacuucuucugu

SEQ ID NO: 3870513 - RNA, 20 nt, Human
ggucagagacugcuguguuu

SEQ ID NO: 3870514 - RNA, 14 nt, Human
ggucagagccugca

SEQ ID NO: 3870515 - RNA, 20 nt, Human
ggucagaggaccuguauuua

SEQ ID NO: 3870516 - RNA, 13 nt, Human
ggucagccagggc

SEQ ID NO: 3870517 - RNA, 15 nt, Human
ggucagccagggcca

SEQ ID NO: 3870518 - RNA, 14 nt, Human
ggucagcucagagc

SEQ ID NO: 3870519 - RNA, 15 nt, Human
ggucaggaggcaggg

SEQ ID NO: 3870520 - RNA, 17 nt, Human
ggucaggcagccaguga

SEQ ID NO: 3870521 - RNA, 14 nt, Human
ggucaggcccugga

SEQ ID NO: 3870522 - RNA, 17 nt, Human
ggucagggaccaaggac

SEQ ID NO: 3870523 - RNA, 17 nt, Human
ggucaggggugacacag

SEQ ID NO: 3870524 - RNA, 14 nt, Human
ggucagguuuaaca

SEQ ID NO: 3870525 - RNA, 18 nt, Human
ggucagguuuaacauuug

SEQ ID NO: 3870526 - RNA, 19 nt, Human
ggucagguuuaacauuugc

SEQ ID NO: 3870527 - RNA, 21 nt, Human
ggucaguaguuuaaaaguucu

SEQ ID NO: 3870528 - RNA, 19 nt, Human
ggucagugaggcccaggga

SEQ ID NO: 3870529 - RNA, 14 nt, Human
ggucagugcaaaua

SEQ ID NO: 3870530 - RNA, 22 nt, Human
ggucauaaagaggcguugcuuu

SEQ ID NO: 3870531 - RNA, 22 nt, Human
ggucauacuaucuacucuccuc

SEQ ID NO: 3870532 - RNA, 23 nt, Human
ggucauagcccagaucagcuccu

SEQ ID NO: 3870533 - RNA, 15 nt, Human
ggucaugcccuccuc

SEQ ID NO: 3870534 - RNA, 16 nt, Human
ggucaugcccuccucu

SEQ ID NO: 3870535 - RNA, 20 nt, Human
ggucaugcccuccucuccca

SEQ ID NO: 3870536 - RNA, 15 nt, Human
ggucauggccacacu

SEQ ID NO: 3870537 - RNA, 16 nt, Human
ggucaugggccacugc

SEQ ID NO: 3870538 - RNA, 15 nt, Human
ggucaugguggugca

SEQ ID NO: 3870539 - RNA, 20 nt, Human
ggucauuuccauguaugcau

SEQ ID NO: 3870540 - RNA, 14 nt, Human
ggucauuucuucag

SEQ ID NO: 3870541 - RNA, 17 nt, Human
gguccaaauaaaaacua

SEQ ID NO: 3870542 - RNA, 20 nt, Human
gguccaaccagaccuggaag

SEQ ID NO: 3870543 - RNA, 21 nt, Human
gguccaaugcucaggugcugg

SEQ ID NO: 3870544 - RNA, 17 nt, Human
gguccaauuaguuuccu

SEQ ID NO: 3870545 - RNA, 13 nt, Human
gguccacagggca

SEQ ID NO: 3870546 - RNA, 15 nt, Human
gguccacagggcacc

SEQ ID NO: 3870547 - RNA, 18 nt, Human
gguccacaggucuagacu

SEQ ID NO: 3870548 - RNA, 19 nt, Human
gguccacccaggagccccg

SEQ ID NO: 3870549 - RNA, 17 nt, Human
gguccagcccuggcuga

SEQ ID NO: 3870550 - RNA, 20 nt, Human
gguccagcccuggcugaagg

SEQ ID NO: 3870551 - RNA, 22 nt, Human
gguccagcccuggcugaaggac

SEQ ID NO: 3870552 - RNA, 15 nt, Human
gguccagcucuggag

SEQ ID NO: 3870553 - RNA, 20 nt, Human
gguccaggccuacuccuguc

SEQ ID NO: 3870554 - RNA, 12 nt, Human
gguccagggagc

SEQ ID NO: 3870555 - RNA, 16 nt, Human
gguccagggagcaggc

SEQ ID NO: 3870556 - RNA, 12 nt, Human
gguccagggcua

SEQ ID NO: 3870557 - RNA, 18 nt, Human
gguccaguggaugccaca

SEQ ID NO: 3870558 - RNA, 15 nt, Human
gguccauagagagca

SEQ ID NO: 3870559 - RNA, 14 nt, Human
gguccaugggcaga

SEQ ID NO: 3870560 - RNA, 16 nt, Human
gguccaugggcagagc

SEQ ID NO: 3870561 - RNA, 18 nt, Human
gguccaugggcagagccc

SEQ ID NO: 3870562 - RNA, 20 nt, Human
ggucccaaacagcugccucu

SEQ ID NO: 3870563 - RNA, 22 nt, Human
ggucccaacaggaggacaauuc

SEQ ID NO: 3870564 - RNA, 16 nt, Human
ggucccaagcugggcc

SEQ ID NO: 3870565 - RNA, 13 nt, Human
ggucccacacugg

SEQ ID NO: 3870566 - RNA, 23 nt, Human
ggucccacaucccugggccugcu

SEQ ID NO: 3870567 - RNA, 12 nt, Human
ggucccacccca

SEQ ID NO: 3870568 - RNA, 15 nt, Human
ggucccaccccacac

SEQ ID NO: 3870569 - RNA, 12 nt, Human
ggucccaccccu

SEQ ID NO: 3870570 - RNA, 12 nt, Human
ggucccacucag

SEQ ID NO: 3870571 - RNA, 12 nt, Human
ggucccagcagc

SEQ ID NO: 3870572 - RNA, 15 nt, Human
ggucccagccacccc

SEQ ID NO: 3870573 - RNA, 14 nt, Human
ggucccagcucccu

SEQ ID NO: 3870574 - RNA, 14 nt, Human
ggucccaggcagag

SEQ ID NO: 3870575 - RNA, 19 nt, Human
ggucccagugggaggggca

SEQ ID NO: 3870576 - RNA, 20 nt, Human
ggucccagugggaggggcag

SEQ ID NO: 3870577 - RNA, 14 nt, Human
ggucccauccaggc

SEQ ID NO: 3870578 - RNA, 16 nt, Human
ggucccauccaggcag

SEQ ID NO: 3870579 - RNA, 20 nt, Human
ggucccaucugcagggcccc

SEQ ID NO: 3870580 - RNA, 17 nt, Human
ggucccauuucucacug

SEQ ID NO: 3870581 - RNA, 18 nt, Human
gguccccagacuccacca

SEQ ID NO: 3870582 - RNA, 19 nt, Human
gguccccagcccuuccucu

SEQ ID NO: 3870583 - RNA, 12 nt, Human
gguccccagggc

SEQ ID NO: 3870584 - RNA, 16 nt, Human
gguccccaucauccca

SEQ ID NO: 3870585 - RNA, 23 nt, Human
ggucccccuuccauggacuuugu

SEQ ID NO: 3870586 - RNA, 22 nt, Human
gguccccguuccaccccaagag

SEQ ID NO: 3870587 - RNA, 17 nt, Human
ggucccuaauaaagcug

SEQ ID NO: 3870588 - RNA, 20 nt, Human
ggucccugauaacaaccugg

SEQ ID NO: 3870589 - RNA, 13 nt, Human
ggucccugcaggg

SEQ ID NO: 3870590 - RNA, 23 nt, Human
ggucccugggaggaaauuugaau

SEQ ID NO: 3870591 - RNA, 11 nt, Human
ggucccugggu

SEQ ID NO: 3870592 - RNA, 14 nt, Human
ggucccugguggca

SEQ ID NO: 3870593 - RNA, 23 nt, Human
ggucccuugcagcuaguuuucua

SEQ ID NO: 3870594 - RNA, 17 nt, Human
gguccgguguccuuuuc

SEQ ID NO: 3870595 - RNA, 17 nt, Human
gguccgguguucuaaga

SEQ ID NO: 3870596 - RNA, 16 nt, Human
gguccuaaaagcaaaa

SEQ ID NO: 3870597 - RNA, 21 nt, Human
gguccuaaggcaucuaucugu

SEQ ID NO: 3870598 - RNA, 19 nt, Human
gguccuaagucccugcccc

SEQ ID NO: 3870599 - RNA, 22 nt, Human
gguccuaauuaccagucuuuaa

SEQ ID NO: 3870600 - RNA, 20 nt, Human
gguccuaggcuggaaggagg

SEQ ID NO: 3870601 - RNA, 15 nt, Human
gguccuaguaagaag

SEQ ID NO: 3870602 - RNA, 16 nt, Human
gguccucauucaaagg

SEQ ID NO: 3870603 - RNA, 14 nt, Human
gguccuccuccagg

SEQ ID NO: 3870604 - RNA, 21 nt, Human
gguccucugauacccagagca

SEQ ID NO: 3870605 - RNA, 13 nt, Human
gguccucuggagc

SEQ ID NO: 3870606 - RNA, 23 nt, Human
gguccucugucagucacagccac

SEQ ID NO: 3870607 - RNA, 22 nt, Human
gguccucuucugggccugacca

SEQ ID NO: 3870608 - RNA, 18 nt, Human
gguccugaagaauuaaga

SEQ ID NO: 3870609 - RNA, 15 nt, Human
gguccugcagccugc

SEQ ID NO: 3870610 - RNA, 22 nt, Human
gguccugcuauuucccaagcug

SEQ ID NO: 3870611 - RNA, 17 nt, Human
gguucagccccuccucu

SEQ ID NO: 3870612 - RNA, 12 nt, Human
gguucaguuucu

SEQ ID NO: 3870613 - RNA, 15 nt, Human
gguucaucugagcaa

SEQ ID NO: 3870614 - RNA, 21 nt, Human
gguucauguagagaaaagcac

SEQ ID NO: 3870615 - RNA, 16 nt, Human
gguucauuauuggaau

SEQ ID NO: 3870616 - RNA, 18 nt, Human
gguucauuauuggaauua

SEQ ID NO: 3870617 - RNA, 19 nt, Human
gguucauuauuggaauuaa

SEQ ID NO: 3870618 - RNA, 23 nt, Human
gguucauuucaaauacaucuuug

SEQ ID NO: 3870619 - RNA, 21 nt, Human
gguucauuuucagauucaggc

SEQ ID NO: 3870620 - RNA, 21 nt, Human
gguuccagcaauucuccugcc

SEQ ID NO: 3870621 - RNA, 15 nt, Human
gguuccagccugcca

SEQ ID NO: 3870622 - RNA, 13 nt, Human
gguuccaugccug

SEQ ID NO: 3870623 - RNA, 14 nt, Human
gguuccaugccuga

SEQ ID NO: 3870624 - RNA, 16 nt, Human
gguuccaugccugagg

SEQ ID NO: 3870625 - RNA, 12 nt, Human
gguuccccaccg

SEQ ID NO: 3870626 - RNA, 16 nt, Human
gguucccccagcccug

SEQ ID NO: 3870627 - RNA, 15 nt, Human
gguuccccuguucac

SEQ ID NO: 3870628 - RNA, 17 nt, Human
gguucccguuucuccac

SEQ ID NO: 3870629 - RNA, 16 nt, Human
gguucccucugagaau

SEQ ID NO: 3870630 - RNA, 21 nt, Human
gguucccuugagggcugcagu

SEQ ID NO: 3870631 - RNA, 22 nt, Human
gguucccuuuccuuccaucccu

SEQ ID NO: 3870632 - RNA, 21 nt, Human
gguuccgcacuuuccacuucu

SEQ ID NO: 3870633 - RNA, 23 nt, Human
gguuccgcuuggagcagaggggc

SEQ ID NO: 3870634 - RNA, 22 nt, Human
gguuccuaggggaaugaggggg

SEQ ID NO: 3870635 - RNA, 18 nt, Human
gguuccuauggcuggcca

SEQ ID NO: 3870636 - RNA, 22 nt, Human
gguuccuauggcuggccacugc

SEQ ID NO: 3870637 - RNA, 19 nt, Human
gguuccucaaauuuuuuga

SEQ ID NO: 3870638 - RNA, 16 nt, Human
gguuccuccccuccuc

SEQ ID NO: 3870639 - RNA, 19 nt, Human
gguuccucguucucccugg

SEQ ID NO: 3870640 - RNA, 11 nt, Human
gguuccucucu

SEQ ID NO: 3870641 - RNA, 13 nt, Human
gguuccucucugg

SEQ ID NO: 3870642 - RNA, 15 nt, Human
gguuccucugccugc

SEQ ID NO: 3870643 - RNA, 22 nt, Human
gguuccuggggcauccaugggg

SEQ ID NO: 3870644 - RNA, 20 nt, Human
gguuccuuccucugagccuu

SEQ ID NO: 3870645 - RNA, 15 nt, Human
gguuccuuuuauuag

SEQ ID NO: 3870646 - RNA, 20 nt, Human
gguucggauuugggguggau

SEQ ID NO: 3870647 - RNA, 13 nt, Human
gguucuaaaguuc

SEQ ID NO: 3870648 - RNA, 11 nt, Human
gguucuaaggc

SEQ ID NO: 3870649 - RNA, 18 nt, Human
gguucuacaaucuauuua

SEQ ID NO: 3870650 - RNA, 20 nt, Human
gguucuagcauggcauauuu

SEQ ID NO: 3870651 - RNA, 23 nt, Human
gguucuaggcaucucuguacuuu

SEQ ID NO: 3870652 - RNA, 13 nt, Human
gguucucaaugaa

SEQ ID NO: 3870653 - RNA, 23 nt, Human
gguucucacagugggagccaggg

SEQ ID NO: 3870654 - RNA, 19 nt, Human
gguucuccguuagcuccug

SEQ ID NO: 3870655 - RNA, 21 nt, Human
gguucuccguuagcuccugug

SEQ ID NO: 3870656 - RNA, 18 nt, Human
gguucugagauggcuccc

SEQ ID NO: 3870657 - RNA, 19 nt, Human
gguucugcuucaaggcuuc

SEQ ID NO: 3870658 - RNA, 18 nt, Human
gguucuuaguucucacug

SEQ ID NO: 3870659 - RNA, 14 nt, Human
gguucuuguauuaa

SEQ ID NO: 3870660 - RNA, 14 nt, Human
gguucuuguuggug

SEQ ID NO: 3870661 - RNA, 15 nt, Human
gguucuuuguuuuaa

SEQ ID NO: 3870662 - RNA, 22 nt, Human
gguugaacucugguggcacagg

SEQ ID NO: 3870663 - RNA, 16 nt, Human
gguugaagccaugucu

SEQ ID NO: 3870664 - RNA, 23 nt, Human
gguugaagggcaguguucccugg

SEQ ID NO: 3870665 - RNA, 15 nt, Human
gguugacuuuaccca

SEQ ID NO: 3870666 - RNA, 19 nt, Human
gguugaggggcuccuggaa

SEQ ID NO: 3870667 - RNA, 21 nt, Human
gguugagguccagcccuggcu

SEQ ID NO: 3870668 - RNA, 13 nt, Human
gguugauuaaggc

SEQ ID NO: 3870669 - RNA, 14 nt, Human
gguugcaaccacug

SEQ ID NO: 3870670 - RNA, 15 nt, Human
gguugcacuuuguag

SEQ ID NO: 3870671 - RNA, 13 nt, Human
gguugcagggagc

SEQ ID NO: 3870672 - RNA, 18 nt, Human
gguugcagugagccaaga

SEQ ID NO: 3870673 - RNA, 20 nt, Human
gguugccacaggccucccug

SEQ ID NO: 3870674 - RNA, 16 nt, Human
gguugcuccgccuggc

SEQ ID NO: 3870675 - RNA, 17 nt, Human
gguuggagcccagggca

SEQ ID NO: 3870676 - RNA, 21 nt, Human
gguuggagcccagggcaucuu

SEQ ID NO: 3870677 - RNA, 14 nt, Human
gguuggcaguaagg

SEQ ID NO: 3870678 - RNA, 16 nt, Human
gguuggcucugccagu

SEQ ID NO: 3870679 - RNA, 19 nt, Human
gguuggcugggaaaucgag

SEQ ID NO: 3870680 - RNA, 19 nt, Human
gguugggacccaguggcag

SEQ ID NO: 3870681 - RNA, 16 nt, Human
gguugguaggguggga

SEQ ID NO: 3870682 - RNA, 16 nt, Human
gguuggugcacaguga

SEQ ID NO: 3870683 - RNA, 17 nt, Human
gguuggugcacagugau

SEQ ID NO: 3870684 - RNA, 18 nt, Human
gguuguauuagauguucu

SEQ ID NO: 3870685 - RNA, 19 nt, Human
gguuguauuagauguucuc

SEQ ID NO: 3870686 - RNA, 16 nt, Human
gguuguauucuuugau

SEQ ID NO: 3870687 - RNA, 18 nt, Human
gguuguuagaaaaaugga

SEQ ID NO: 3870688 - RNA, 19 nt, Human
gguuguuucuguuccaaau

SEQ ID NO: 3870689 - RNA, 20 nt, Human
gguuguuuuuuccuuugcuc

SEQ ID NO: 3870690 - RNA, 15 nt, Human
gguuuaaagagucua

SEQ ID NO: 3870691 - RNA, 12 nt, Human
gguuuaaaugaa

SEQ ID NO: 3870692 - RNA, 22 nt, Human
gguuuaaaugaacaagagaagc

SEQ ID NO: 3870693 - RNA, 13 nt, Human
gguuuaagcuguu

SEQ ID NO: 3870694 - RNA, 22 nt, Human
gguuuaauccccaguaaaauug

SEQ ID NO: 3870695 - RNA, 19 nt, Human
gguuuaauguuuuggccaa

SEQ ID NO: 3870696 - RNA, 18 nt, Human
gguuuacauuuaaagcau

SEQ ID NO: 3870697 - RNA, 17 nt, Human
gguuuaccuagagaaca

SEQ ID NO: 3870698 - RNA, 23 nt, Human
gguuuacucuguggccaaaggag

SEQ ID NO: 3870699 - RNA, 17 nt, Human
gguuuaggcugguggcc

SEQ ID NO: 3870700 - RNA, 16 nt, Human
gguuuaguguaaaaau

SEQ ID NO: 3870701 - RNA, 20 nt, Human
gguuucaaagaugcugugag

SEQ ID NO: 3870702 - RNA, 20 nt, Human
gguuucaccauguuggccag

SEQ ID NO: 3870703 - RNA, 15 nt, Human
gguuucagaaaugug

SEQ ID NO: 3870704 - RNA, 17 nt, Human
gguuucagcacuagcca

SEQ ID NO: 3870705 - RNA, 20 nt, Human
gguuuccaacaauucagcau

SEQ ID NO: 3870706 - RNA, 14 nt, Human
gguuuccacaugcu

SEQ ID NO: 3870707 - RNA, 12 nt, Human
gguuuccaggga

SEQ ID NO: 3870708 - RNA, 15 nt, Human
gguuucccaauggug

SEQ ID NO: 3870709 - RNA, 19 nt, Human
gguuuccugcccugggagg

SEQ ID NO: 3870710 - RNA, 20 nt, Human
gguuuccuggcacuggaccc

SEQ ID NO: 3870711 - RNA, 17 nt, Human
gguuucguuucuguaua

SEQ ID NO: 3870712 - RNA, 21 nt, Human
gguuucuaagcauaaaagaug

SEQ ID NO: 3870713 - RNA, 22 nt, Human
gguuucucuguggcuccaggcc

SEQ ID NO: 3870714 - RNA, 22 nt, Human
gguuucucuucuccccuuccau

SEQ ID NO: 3870715 - RNA, 14 nt, Human
gguuucugagcugc

SEQ ID NO: 3870716 - RNA, 18 nt, Human
gguuugaauauaaacacu

SEQ ID NO: 3870717 - RNA, 20 nt, Human
gguuugagagagcagccagg

SEQ ID NO: 3870718 - RNA, 21 nt, Human
gguuugccaaaauucauuucu

SEQ ID NO: 3870719 - RNA, 16 nt, Human
gguuuggaauauuaaa

SEQ ID NO: 3870720 - RNA, 20 nt, Human
gguuuggacaaaauggaaua

SEQ ID NO: 3870721 - RNA, 13 nt, Human
gguuuggagcuga

SEQ ID NO: 3870722 - RNA, 23 nt, Human
gguuuggccaucucuggaugccu

SEQ ID NO: 3870723 - RNA, 14 nt, Human
gguuuggcgggcca

SEQ ID NO: 3870724 - RNA, 14 nt, Human
gguuuggcuccugc

SEQ ID NO: 3870725 - RNA, 15 nt, Human
gguuuggcugugucu

SEQ ID NO: 3870726 - RNA, 21 nt, Human
gguuuggcugugucuaaacug

SEQ ID NO: 3870727 - RNA, 15 nt, Human
gguuugguguauggu

SEQ ID NO: 3870728 - RNA, 20 nt, Human
gguuuguaaauuaacuuuua

SEQ ID NO: 3870729 - RNA, 23 nt, Human
gguuugucgggcaccagccagcg

SEQ ID NO: 3870730 - RNA, 17 nt, Human
gguuuguggggggaggc

SEQ ID NO: 3870731 - RNA, 14 nt, Human
gguuuuaacuuugu

SEQ ID NO: 3870732 - RNA, 18 nt, Human
gguuuuaauugaaggaaa

SEQ ID NO: 3870733 - RNA, 18 nt, Human
gguuuuagguagaaaaac

SEQ ID NO: 3870734 - RNA, 22 nt, Human
gguuuuaucugagugaaauacu

SEQ ID NO: 3870735 - RNA, 23 nt, Human
gguuuuaugguuacuucuucucu

SEQ ID NO: 3870736 - RNA, 20 nt, Human
gguuuuauuuuguaauuauu

SEQ ID NO: 3870737 - RNA, 21 nt, Human
gguuuucacauaaaugcagcc

SEQ ID NO: 3870738 - RNA, 19 nt, Human
gguuuucgaagcucagccc

SEQ ID NO: 3870739 - RNA, 12 nt, Human
gguuuucuguuc

SEQ ID NO: 3870740 - RNA, 16 nt, Human
gguuuucuuuuaagaa

SEQ ID NO: 3870741 - RNA, 15 nt, Human
gguuuuggcaucucu

SEQ ID NO: 3870742 - RNA, 19 nt, Human
gguuuuguaagaugcuggg

SEQ ID NO: 3870743 - RNA, 20 nt, Human
gguuuuguaagaugcugggu

SEQ ID NO: 3870744 - RNA, 15 nt, Human
gguuuuguagguacu

SEQ ID NO: 3870745 - RNA, 12 nt, Human
gguuuuguuugc

SEQ ID NO: 3870746 - RNA, 15 nt, Human
gguuuuguuugcuau

SEQ ID NO: 3870747 - RNA, 16 nt, Human
gguuuuuaaaacccag

SEQ ID NO: 3870748 - RNA, 19 nt, Human
gguuuuuaaauuuuguaau

SEQ ID NO: 3870749 - RNA, 15 nt, Human
gguuuuucaauuaaa

SEQ ID NO: 3870750 - RNA, 16 nt, Human
gguuuuucaauuaaac

SEQ ID NO: 3870751 - RNA, 17 nt, Human
gguuuuucaauuaaacg

SEQ ID NO: 3870752 - RNA, 20 nt, Human
gguuuuucaauuaaacggau

SEQ ID NO: 3870753 - RNA, 14 nt, Human
gguuuuuuaauaua

SEQ ID NO: 3870754 - RNA, 19 nt, Human
gguuuuuuuccuguuucug

SEQ ID NO: 3870755 - RNA, 16 nt, Human
guccaauuaguuuccu

SEQ ID NO: 3870756 - RNA, 19 nt, Human
guccaauuuguaaaaacag

SEQ ID NO: 3870757 - RNA, 16 nt, Human
guccaauuuuaauuua

SEQ ID NO: 3870758 - RNA, 15 nt, Human
guccacagaugccuc

SEQ ID NO: 3870759 - RNA, 13 nt, Human
guccacagcuucc

SEQ ID NO: 3870760 - RNA, 17 nt, Human
guccaccaauagaauga

SEQ ID NO: 3870761 - RNA, 15 nt, Human
guccacccugccugc

SEQ ID NO: 3870762 - RNA, 16 nt, Human
guccacgcgugccgug

SEQ ID NO: 3870763 - RNA, 16 nt, Human
guccacgugcguguuu

SEQ ID NO: 3870764 - RNA, 23 nt, Human
guccacgugcguguuuucugacu

SEQ ID NO: 3870765 - RNA, 12 nt, Human
guccacucccag

SEQ ID NO: 3870766 - RNA, 15 nt, Human
guccacucccagugc

SEQ ID NO: 3870767 - RNA, 21 nt, Human
guccacugggguggccugacu

SEQ ID NO: 3870768 - RNA, 20 nt, Human
guccacugucacuguuucuc

SEQ ID NO: 3870769 - RNA, 14 nt, Human
guccacuguguaua

SEQ ID NO: 3870770 - RNA, 16 nt, Human
guccacuucugacagc

SEQ ID NO: 3870771 - RNA, 18 nt, Human
guccacuucugacagccu

SEQ ID NO: 3870772 - RNA, 20 nt, Human
guccacuuuuccaguauuuu

SEQ ID NO: 3870773 - RNA, 22 nt, Human
guccacuuuuccaguauuuuag

SEQ ID NO: 3870774 - RNA, 17 nt, Human
guccagaagaauauuca

SEQ ID NO: 3870775 - RNA, 14 nt, Human
guccagaaggagac

SEQ ID NO: 3870776 - RNA, 19 nt, Human
guccagaaggagacaggca

SEQ ID NO: 3870777 - RNA, 11 nt, Human
guccagacagc

SEQ ID NO: 3870778 - RNA, 21 nt, Human
guccagaccuuguucacacuc

SEQ ID NO: 3870779 - RNA, 22 nt, Human
guccagagagagaagugccccu

SEQ ID NO: 3870780 - RNA, 13 nt, Human
guccagagcugcu

SEQ ID NO: 3870781 - RNA, 16 nt, Human
guccagagcugcuucc

SEQ ID NO: 3870782 - RNA, 19 nt, Human
guccagauuuacacuggga

SEQ ID NO: 3870783 - RNA, 22 nt, Human
guccagauuuacacugggagag

SEQ ID NO: 3870784 - RNA, 18 nt, Human
guccagcauugcuggacu

SEQ ID NO: 3870785 - RNA, 19 nt, Human
guccagcauugcuggacuc

SEQ ID NO: 3870786 - RNA, 17 nt, Human
guccagcccuggcugaa

SEQ ID NO: 3870787 - RNA, 19 nt, Human
guccagcccuggcugaagg

SEQ ID NO: 3870788 - RNA, 23 nt, Human
guccagccugccccggagcugga

SEQ ID NO: 3870789 - RNA, 11 nt, Human
guccagccugg

SEQ ID NO: 3870790 - RNA, 13 nt, Human
guccagccugggc

SEQ ID NO: 3870791 - RNA, 13 nt, Human
guccagcucugga

SEQ ID NO: 3870792 - RNA, 16 nt, Human
guccagcucuggaggg

SEQ ID NO: 3870793 - RNA, 12 nt, Human
guccagcuggcc

SEQ ID NO: 3870794 - RNA, 22 nt, Human
guccaggacaggagaugcugug

SEQ ID NO: 3870795 - RNA, 21 nt, Human
guccaggaugcuaacaucuaa

SEQ ID NO: 3870796 - RNA, 17 nt, Human
guccaggauuccucuuu

SEQ ID NO: 3870797 - RNA, 15 nt, Human
guccaggcacaggau

SEQ ID NO: 3870798 - RNA, 15 nt, Human
guccaggcacugaga

SEQ ID NO: 3870799 - RNA, 22 nt, Human
guccaggcacugcugcccagcc

SEQ ID NO: 3870800 - RNA, 21 nt, Human
guccaggccuacuccugucuu

SEQ ID NO: 3870801 - RNA, 20 nt, Human
guccaggcugccguggggcc

SEQ ID NO: 3870802 - RNA, 23 nt, Human
guccagggaagagaaagugauuu

SEQ ID NO: 3870803 - RNA, 20 nt, Human
guccagggaagcuggccgag

SEQ ID NO: 3870804 - RNA, 21 nt, Human
guccagggagcauuuuccucc

SEQ ID NO: 3870805 - RNA, 16 nt, Human
guccagggcccugagc

SEQ ID NO: 3870806 - RNA, 21 nt, Human
guccaggggccccuccagcuu

SEQ ID NO: 3870807 - RNA, 21 nt, Human
guccagguccugguggggcag

SEQ ID NO: 3870808 - RNA, 17 nt, Human
guccaggucgggcucag

SEQ ID NO: 3870809 - RNA, 18 nt, Human
guccaguaagaucacugu

SEQ ID NO: 3870810 - RNA, 23 nt, Human
guccaguaagaucacuguuuaga

SEQ ID NO: 3870811 - RNA, 17 nt, Human
guccaguccaguccuau

SEQ ID NO: 3870812 - RNA, 17 nt, Human
guccagugaccugcugg

SEQ ID NO: 3870813 - RNA, 17 nt, Human
guccauaauguucugcu

SEQ ID NO: 3870814 - RNA, 13 nt, Human
guccauagagagc

SEQ ID NO: 3870815 - RNA, 16 nt, Human
guccauagcuguggug

SEQ ID NO: 3870816 - RNA, 15 nt, Human
guccauaucacacac

SEQ ID NO: 3870817 - RNA, 16 nt, Human
guccauaucacacaca

SEQ ID NO: 3870818 - RNA, 18 nt, Human
guccauaucacacacauu

SEQ ID NO: 3870819 - RNA, 16 nt, Human
guccauauuuucacag

SEQ ID NO: 3870820 - RNA, 15 nt, Human
guccaucagccucca

SEQ ID NO: 3870821 - RNA, 13 nt, Human
guccaucugcccg

SEQ ID NO: 3870822 - RNA, 22 nt, Human
guccaugaagauguagaggaga

SEQ ID NO: 3870823 - RNA, 19 nt, Human
guccaugcuaacaaagaca

SEQ ID NO: 3870824 - RNA, 14 nt, Human
guccauuuguaaaa

SEQ ID NO: 3870825 - RNA, 16 nt, Human
guccauuuguaaaacu

SEQ ID NO: 3870826 - RNA, 17 nt, Human
guccauuuugugaagcc

SEQ ID NO: 3870827 - RNA, 21 nt, Human
guccauuuugugaagcccugu

SEQ ID NO: 3870828 - RNA, 22 nt, Human
guccauuuugugaagcccuguu

SEQ ID NO: 3870829 - RNA, 16 nt, Human
guccauuuuuacaagu

SEQ ID NO: 3870830 - RNA, 18 nt, Human
guccauuuuucuuccagg

SEQ ID NO: 3870831 - RNA, 19 nt, Human
gucccaaacagcugccucu

SEQ ID NO: 3870832 - RNA, 20 nt, Human
gucccaacaggaggacaauu

SEQ ID NO: 3870833 - RNA, 13 nt, Human
gucccaagcuggg

SEQ ID NO: 3870834 - RNA, 16 nt, Human
gucccaagcugggccc

SEQ ID NO: 3870835 - RNA, 22 nt, Human
gucccaagcugggccccagccc

SEQ ID NO: 3870836 - RNA, 23 nt, Human
gucccaaggaaagccccagcacu

SEQ ID NO: 3870837 - RNA, 21 nt, Human
gucccacaucccugggccugc

SEQ ID NO: 3870838 - RNA, 20 nt, Human
gucccaccccacacacgcca

SEQ ID NO: 3870839 - RNA, 14 nt, Human
gucccacccccacc

SEQ ID NO: 3870840 - RNA, 15 nt, Human
gucccacccccaccc

SEQ ID NO: 3870841 - RNA, 22 nt, Human
gucccacccccacccccagcuc

SEQ ID NO: 3870842 - RNA, 23 nt, Human
gucccacccccacccccagcuca

SEQ ID NO: 3870843 - RNA, 16 nt, Human
gucccaccccucccuc

SEQ ID NO: 3870844 - RNA, 19 nt, Human
gucccaccgguugcuucug

SEQ ID NO: 3870845 - RNA, 20 nt, Human
gucccaccgguugcuucugg

SEQ ID NO: 3870846 - RNA, 23 nt, Human
gucccaccgguugcuucugggaa

SEQ ID NO: 3870847 - RNA, 22 nt, Human
gucccaccuccagcccgggagc

SEQ ID NO: 3870848 - RNA, 12 nt, Human
gucccaccucuu

SEQ ID NO: 3870849 - RNA, 15 nt, Human
gucccaccuuggcug

SEQ ID NO: 3870850 - RNA, 19 nt, Human
gucccaccuuggcugcagg

SEQ ID NO: 3870851 - RNA, 20 nt, Human
gucccaccuuggcugcaggg

SEQ ID NO: 3870852 - RNA, 21 nt, Human
gucccaccuuggcugcaggga

SEQ ID NO: 3870853 - RNA, 16 nt, Human
gucccacgugucuucc

SEQ ID NO: 3870854 - RNA, 21 nt, Human
gucccacgugucuuccacuuu

SEQ ID NO: 3870855 - RNA, 18 nt, Human
gucccacucaagccaagc

SEQ ID NO: 3870856 - RNA, 11 nt, Human
gucccacugcc

SEQ ID NO: 3870857 - RNA, 19 nt, Human
gucccacugccucagguuc

SEQ ID NO: 3870858 - RNA, 14 nt, Human
gucccacugugcag

SEQ ID NO: 3870859 - RNA, 22 nt, Human
gucccagaaaaagcaucauggc

SEQ ID NO: 3870860 - RNA, 21 nt, Human
gucccagaagaugacugaggg

SEQ ID NO: 3870861 - RNA, 20 nt, Human
gucccagaaugccuccugca

SEQ ID NO: 3870862 - RNA, 17 nt, Human
gucccagauuggcucac

SEQ ID NO: 3870863 - RNA, 11 nt, Human
gucccagcagc

SEQ ID NO: 3870864 - RNA, 14 nt, Human
gucccagcagccag

SEQ ID NO: 3870865 - RNA, 16 nt, Human
gucccagcagccagcc

SEQ ID NO: 3870866 - RNA, 14 nt, Human
gucccagccacccc

SEQ ID NO: 3870867 - RNA, 20 nt, Human
gucccagccagcaguucaga

SEQ ID NO: 3870868 - RNA, 19 nt, Human
gucccaggagcugcccaga

SEQ ID NO: 3870869 - RNA, 16 nt, Human
gucccaggcagggaga

SEQ ID NO: 3870870 - RNA, 18 nt, Human
gucccagguuggcucugc

SEQ ID NO: 3870871 - RNA, 12 nt, Human
gucccagugccg

SEQ ID NO: 3870872 - RNA, 19 nt, Human
gucccagugggaggggcag

SEQ ID NO: 3870873 - RNA, 21 nt, Human
gucccagugggaggggcaggc

SEQ ID NO: 3870874 - RNA, 22 nt, Human
gucccagugggaggggcaggcu

SEQ ID NO: 3870875 - RNA, 14 nt, Human
gucccauauccugc

SEQ ID NO: 3870876 - RNA, 15 nt, Human
gucccauauccugcc

SEQ ID NO: 3870877 - RNA, 16 nt, Human
gucccauauccugccu

SEQ ID NO: 3870878 - RNA, 15 nt, Human
gucccauccaggcag

SEQ ID NO: 3870879 - RNA, 17 nt, Human
gucccaugaucccugug

SEQ ID NO: 3870880 - RNA, 16 nt, Human
gucccaugcaggcccu

SEQ ID NO: 3870881 - RNA, 21 nt, Human
gucccauggacacuccagugc

SEQ ID NO: 3870882 - RNA, 13 nt, Human
gucccauguggug

SEQ ID NO: 3870883 - RNA, 23 nt, Human
gucccauucccccagugcggcca

SEQ ID NO: 3870884 - RNA, 16 nt, Human
gucccauucccuggga

SEQ ID NO: 3870885 - RNA, 17 nt, Human
gucccauucccugggau

SEQ ID NO: 3870886 - RNA, 22 nt, Human
guccccaaauccgaaccuccuc

SEQ ID NO: 3870887 - RNA, 16 nt, Human
guccccaacagcgccc

SEQ ID NO: 3870888 - RNA, 22 nt, Human
guccccaaccgugucugucugg

SEQ ID NO: 3870889 - RNA, 24 nt, Human
guccccacacuccuacaccuaacu

SEQ ID NO: 3870890 - RNA, 16 nt, Human
guccccaccccugccc

SEQ ID NO: 3870891 - RNA, 18 nt, Human
guccccaccgcagacagg

SEQ ID NO: 3870892 - RNA, 22 nt, Human
guccccaccgcagacaggacca

SEQ ID NO: 3870893 - RNA, 14 nt, Human
guccccaccuggga

SEQ ID NO: 3870894 - RNA, 15 nt, Human
guccccaccugggac

SEQ ID NO: 3870895 - RNA, 12 nt, Human
guccccagcaga

SEQ ID NO: 3870896 - RNA, 15 nt, Human
guccccagcccacug

SEQ ID NO: 3870897 - RNA, 20 nt, Human
guccccaggccccaggaagc

SEQ ID NO: 3870898 - RNA, 16 nt, Human
guccccauacuccuau

SEQ ID NO: 3870899 - RNA, 16 nt, Human
gucuccgaaaugcugu

SEQ ID NO: 3870900 - RNA, 20 nt, Human
gucuccgaaaugcugucuuu

SEQ ID NO: 3870901 - RNA, 16 nt, Human
gucuccuaagcaccug

SEQ ID NO: 3870902 - RNA, 17 nt, Human
gucuccuaagcaccugu

SEQ ID NO: 3870903 - RNA, 20 nt, Human
gucuccuaagcuggagugca

SEQ ID NO: 3870904 - RNA, 15 nt, Human
gucuccuacuccuga

SEQ ID NO: 3870905 - RNA, 17 nt, Human
gucuccuacuccugacu

SEQ ID NO: 3870906 - RNA, 16 nt, Human
gucuccuacugaggau

SEQ ID NO: 3870907 - RNA, 14 nt, Human
gucuccucacuccc

SEQ ID NO: 3870908 - RNA, 14 nt, Human
gucuccucagccuc

SEQ ID NO: 3870909 - RNA, 15 nt, Human
gucuccucaggacca

SEQ ID NO: 3870910 - RNA, 14 nt, Human
gucuccuccaccgc

SEQ ID NO: 3870911 - RNA, 21 nt, Human
gucuccuccaccgccauggcu

SEQ ID NO: 3870912 - RNA, 15 nt, Human
gucuccucucagccc

SEQ ID NO: 3870913 - RNA, 14 nt, Human
gucuccugccccca

SEQ ID NO: 3870914 - RNA, 22 nt, Human
gucuccugugcccacaucccag

SEQ ID NO: 3870915 - RNA, 18 nt, Human
gucucgaacuccugaccu

SEQ ID NO: 3870916 - RNA, 21 nt, Human
gucucgagcgcccugcagacc

SEQ ID NO: 3870917 - RNA, 22 nt, Human
gucucgcucuguugcccaggcu

SEQ ID NO: 3870918 - RNA, 20 nt, Human
gucucgcugaugcugggcug

SEQ ID NO: 3870919 - RNA, 21 nt, Human
gucucgcugaugcugggcugg

SEQ ID NO: 3870920 - RNA, 17 nt, Human
gucucgcuuuguugccc

SEQ ID NO: 3870921 - RNA, 19 nt, Human
gucucgcuuuguugcccag

SEQ ID NO: 3870922 - RNA, 16 nt, Human
gucucggacuaagccu

SEQ ID NO: 3870923 - RNA, 22 nt, Human
gucucggugguaccaggucucc

SEQ ID NO: 3870924 - RNA, 14 nt, Human
gucucgucucuuuu

SEQ ID NO: 3870925 - RNA, 21 nt, Human
gucucgucuuccgucuccccc

SEQ ID NO: 3870926 - RNA, 19 nt, Human
gucucgugguaggacugua

SEQ ID NO: 3870927 - RNA, 13 nt, Human
gucucuaaagcac

SEQ ID NO: 3870928 - RNA, 22 nt, Human
gucucuaaucugugcuguuuca

SEQ ID NO: 3870929 - RNA, 14 nt, Human
gucucuaggcuggg

SEQ ID NO: 3870930 - RNA, 17 nt, Human
gucucuagugcugugaa

SEQ ID NO: 3870931 - RNA, 19 nt, Human
gucucuauaccaauaaagu

SEQ ID NO: 3870932 - RNA, 18 nt, Human
gucucuaucauuaaaguu

SEQ ID NO: 3870933 - RNA, 20 nt, Human
gucucuaucauuaaaguucu

SEQ ID NO: 3870934 - RNA, 23 nt, Human
gucucuaugccagcucaguccca

SEQ ID NO: 3870935 - RNA, 11 nt, Human
gucucuauuua

SEQ ID NO: 3870936 - RNA, 14 nt, Human
gucucuauuuaaau

SEQ ID NO: 3870937 - RNA, 21 nt, Human
gucucuauuuaaauucuuuuu

SEQ ID NO: 3870938 - RNA, 16 nt, Human
gucucuauuucauuuu

SEQ ID NO: 3870939 - RNA, 15 nt, Human
gucucucaugaaccu

SEQ ID NO: 3870940 - RNA, 14 nt, Human
gucucucccucagg

SEQ ID NO: 3870941 - RNA, 11 nt, Human
gucucuccuuu

SEQ ID NO: 3870942 - RNA, 14 nt, Human
gucucuccuuuucu

SEQ ID NO: 3870943 - RNA, 20 nt, Human
gucucuccuuuucuuuuguu

SEQ ID NO: 3870944 - RNA, 22 nt, Human
gucucucguaguguuaaguuau

SEQ ID NO: 3870945 - RNA, 17 nt, Human
gucucucuaugccucuc

SEQ ID NO: 3870946 - RNA, 16 nt, Human
gucucucuuuggacuc

SEQ ID NO: 3870947 - RNA, 12 nt, Human
gucucugcaaac

SEQ ID NO: 3870948 - RNA, 22 nt, Human
gucucugccaugaacuggaggc

SEQ ID NO: 3870949 - RNA, 12 nt, Human
gucucugcucca

SEQ ID NO: 3870950 - RNA, 21 nt, Human
gucucugcuccaccuuucagc

SEQ ID NO: 3870951 - RNA, 22 nt, Human
gucucugcucgcccuccuuucu

SEQ ID NO: 3870952 - RNA, 14 nt, Human
gucucugcugccgc

SEQ ID NO: 3870953 - RNA, 17 nt, Human
gucucuggaauuugaaa

SEQ ID NO: 3870954 - RNA, 16 nt, Human
gucucuggcaguucug

SEQ ID NO: 3870955 - RNA, 21 nt, Human
gucucuggcaguucuggaaug

SEQ ID NO: 3870956 - RNA, 21 nt, Human
gucucuggggcaggcugcuuc

SEQ ID NO: 3870957 - RNA, 16 nt, Human
gucucugguuccuccc

SEQ ID NO: 3870958 - RNA, 17 nt, Human
gucucugguuccucccc

SEQ ID NO: 3870959 - RNA, 12 nt, Human
gucucugugagg

SEQ ID NO: 3870960 - RNA, 22 nt, Human
gucucuguuuuacaaguuggag

SEQ ID NO: 3870961 - RNA, 17 nt, Human
gucucuuaaaaaaauaa

SEQ ID NO: 3870962 - RNA, 15 nt, Human
gucucuuauggaugu

SEQ ID NO: 3870963 - RNA, 23 nt, Human
gucucuuauggauguccccagca

SEQ ID NO: 3870964 - RNA, 11 nt, Human
gucucuucucc

SEQ ID NO: 3870965 - RNA, 16 nt, Human
gucucuucuccacugg

SEQ ID NO: 3870966 - RNA, 14 nt, Human
gucucuucuccuua

SEQ ID NO: 3870967 - RNA, 21 nt, Human
gucucuucugaauaaagcaau

SEQ ID NO: 3870968 - RNA, 23 nt, Human
gucucuucugaauaaagcaauua

SEQ ID NO: 3870969 - RNA, 14 nt, Human
gucucuucugagcu

SEQ ID NO: 3870970 - RNA, 19 nt, Human
gucucuucugggcacccuc

SEQ ID NO: 3870971 - RNA, 17 nt, Human
gucucuugguccugcug

SEQ ID NO: 3870972 - RNA, 19 nt, Human
gucucuuguauuaaacucu

SEQ ID NO: 3870973 - RNA, 23 nt, Human
gucucuuuaagggcaugccuugu

SEQ ID NO: 3870974 - RNA, 18 nt, Human
gucucuuuaaucuucagu

SEQ ID NO: 3870975 - RNA, 18 nt, Human
gucucuuuaaugucacag

SEQ ID NO: 3870976 - RNA, 21 nt, Human
gucucuuuaaugucacaggca

SEQ ID NO: 3870977 - RNA, 16 nt, Human
gucucuuuauuccuag

SEQ ID NO: 3870978 - RNA, 17 nt, Human
gucucuuuauuccuagu

SEQ ID NO: 3870979 - RNA, 22 nt, Human
gucucuuuauuccuaguuggug

SEQ ID NO: 3870980 - RNA, 18 nt, Human
gucucuuuuacccuggcc

SEQ ID NO: 3870981 - RNA, 22 nt, Human
gucucuuuuacccuggccccuc

SEQ ID NO: 3870982 - RNA, 23 nt, Human
gucucuuuuacccuggccccucu

SEQ ID NO: 3870983 - RNA, 18 nt, Human
gucucuuuuguaaauuaa

SEQ ID NO: 3870984 - RNA, 17 nt, Human
gucugaaacauuucaua

SEQ ID NO: 3870985 - RNA, 15 nt, Human
gucugaacagcugua

SEQ ID NO: 3870986 - RNA, 21 nt, Human
gucugaaggacacuuccugcc

SEQ ID NO: 3870987 - RNA, 13 nt, Human
gucugaauguucu

SEQ ID NO: 3870988 - RNA, 23 nt, Human
gucugacaagguggucaacaaca

SEQ ID NO: 3870989 - RNA, 23 nt, Human
gucugacaggcaaugcuggcugu

SEQ ID NO: 3870990 - RNA, 15 nt, Human
gucugacccacugcu

SEQ ID NO: 3870991 - RNA, 19 nt, Human
gucugagagcaaagugacc

SEQ ID NO: 3870992 - RNA, 16 nt, Human
gucugagccacagcag

SEQ ID NO: 3870993 - RNA, 22 nt, Human
gucugagccacagcagcauuuu

SEQ ID NO: 3870994 - RNA, 22 nt, Human
gucugaggccguugcugacuua

SEQ ID NO: 3870995 - RNA, 22 nt, Human
gucugaggggcaacugagucug

SEQ ID NO: 3870996 - RNA, 15 nt, Human
gucugagguccugag

SEQ ID NO: 3870997 - RNA, 15 nt, Human
gucugaguggcuuca

SEQ ID NO: 3870998 - RNA, 21 nt, Human
gucugaguuguuaccccaagc

SEQ ID NO: 3870999 - RNA, 15 nt, Human
gucugaucugugcuu

SEQ ID NO: 3871000 - RNA, 22 nt, Human
gucugaucugugcuuuccagcu

SEQ ID NO: 3871001 - RNA, 14 nt, Human
gucugauuggcuug

SEQ ID NO: 3871002 - RNA, 22 nt, Human
gucugauuggcuuguagaauug

SEQ ID NO: 3871003 - RNA, 22 nt, Human
gucugauuucaggauacucugu

SEQ ID NO: 3871004 - RNA, 15 nt, Human
gucugcaacuuuaag

SEQ ID NO: 3871005 - RNA, 15 nt, Human
gucugcaagaaccug

SEQ ID NO: 3871006 - RNA, 13 nt, Human
gucugcaagucag

SEQ ID NO: 3871007 - RNA, 16 nt, Human
gucugcaagucagagg

SEQ ID NO: 3871008 - RNA, 17 nt, Human
gucugcaagucagagga

SEQ ID NO: 3871009 - RNA, 18 nt, Human
gucugcaagucagaggau

SEQ ID NO: 3871010 - RNA, 13 nt, Human
gucugcacccagg

SEQ ID NO: 3871011 - RNA, 14 nt, Human
gucugcacuuaaau

SEQ ID NO: 3871012 - RNA, 11 nt, Human
gucugcagccc

SEQ ID NO: 3871013 - RNA, 13 nt, Human
gucugcagcccug

SEQ ID NO: 3871014 - RNA, 13 nt, Human
gucugcaggcagg

SEQ ID NO: 3871015 - RNA, 20 nt, Human
gucugcauuucgguggcuag

SEQ ID NO: 3871016 - RNA, 20 nt, Human
gucugcauuuucugaaacua

SEQ ID NO: 3871017 - RNA, 21 nt, Human
gucugcauuuucugaaacuaa

SEQ ID NO: 3871018 - RNA, 21 nt, Human
gucugccaaccuaaaacucuu

SEQ ID NO: 3871019 - RNA, 23 nt, Human
gucugccaggcccccaccacaca

SEQ ID NO: 3871020 - RNA, 19 nt, Human
gucugccccaaguuuugug

SEQ ID NO: 3871021 - RNA, 22 nt, Human
gucugccccaaguuuugugaaa

SEQ ID NO: 3871022 - RNA, 21 nt, Human
gucugcccucugcauccucug

SEQ ID NO: 3871023 - RNA, 22 nt, Human
gucugccuguugcgugacacuc

SEQ ID NO: 3871024 - RNA, 21 nt, Human
gucugcgaaguccuauggaaa

SEQ ID NO: 3871025 - RNA, 16 nt, Human
gucugcgugggucaga

SEQ ID NO: 3871026 - RNA, 18 nt, Human
gucugcuauauuuucaug

SEQ ID NO: 3871027 - RNA, 23 nt, Human
gucugcucagacagaaccccuac

SEQ ID NO: 3871028 - RNA, 12 nt, Human
gucugcucccaa

SEQ ID NO: 3871029 - RNA, 21 nt, Human
gucugcucccaaggggccuga

SEQ ID NO: 3871030 - RNA, 17 nt, Human
gucugcucgggcccagg

SEQ ID NO: 3871031 - RNA, 21 nt, Human
gucugcucgggcccaggccau

SEQ ID NO: 3871032 - RNA, 13 nt, Human
gucugcugaggag

SEQ ID NO: 3871033 - RNA, 16 nt, Human
gucugcugcccuccau

SEQ ID NO: 3871034 - RNA, 13 nt, Human
gucugcuuagaaa

SEQ ID NO: 3871035 - RNA, 23 nt, Human
gucugcuuuaaagggccugccug

SEQ ID NO: 3871036 - RNA, 18 nt, Human
gucuggaaugcaguggua

SEQ ID NO: 3871037 - RNA, 19 nt, Human
gucuggacauucagaacac

SEQ ID NO: 3871038 - RNA, 23 nt, Human
gucuggaggggagcucugucugu

SEQ ID NO: 3871039 - RNA, 17 nt, Human
gucuggaggggccccug

SEQ ID NO: 3871040 - RNA, 23 nt, Human
gucuggaggggccccugcuucuc

SEQ ID NO: 3871041 - RNA, 16 nt, Human
gucuggauaacuucca

SEQ ID NO: 3871042 - RNA, 16 nt, Human
gugucaccccagagcc

SEQ ID NO: 3871043 - RNA, 21 nt, Human
gugucacucaaggcggugcuu

SEQ ID NO: 3871044 - RNA, 20 nt, Human
gugucacugucccuccuggu

SEQ ID NO: 3871045 - RNA, 17 nt, Human
gugucacuuacuguuuc

SEQ ID NO: 3871046 - RNA, 15 nt, Human
gugucacuugugcuu

SEQ ID NO: 3871047 - RNA, 16 nt, Human
gugucagcauagaagu

SEQ ID NO: 3871048 - RNA, 23 nt, Human
gugucagcgccuggccuacccag

SEQ ID NO: 3871049 - RNA, 14 nt, Human
gugucagcugaggc

SEQ ID NO: 3871050 - RNA, 23 nt, Human
gugucaggaugguaauucuuauu

SEQ ID NO: 3871051 - RNA, 19 nt, Human
gugucaggcugcuggcgcc

SEQ ID NO: 3871052 - RNA, 16 nt, Human
gugucaguauccaggc

SEQ ID NO: 3871053 - RNA, 19 nt, Human
gugucaguuuauguuuugg

SEQ ID NO: 3871054 - RNA, 23 nt, Human
gugucauaaacagaugaauaaac

SEQ ID NO: 3871055 - RNA, 13 nt, Human
gugucauuucaaa

SEQ ID NO: 3871056 - RNA, 17 nt, Human
gugucauuucauuccau

SEQ ID NO: 3871057 - RNA, 22 nt, Human
guguccaaaaccgccagcucug

SEQ ID NO: 3871058 - RNA, 24 nt, Human
guguccaaaaccgccagcucuguu

SEQ ID NO: 3871059 - RNA, 15 nt, Human
guguccaccuguggg

SEQ ID NO: 3871060 - RNA, 17 nt, Human
guguccaccugugggug

SEQ ID NO: 3871061 - RNA, 16 nt, Human
guguccaugugugugc

SEQ ID NO: 3871062 - RNA, 20 nt, Human
guguccauugacauguacag

SEQ ID NO: 3871063 - RNA, 17 nt, Human
guguccauuuugugaag

SEQ ID NO: 3871064 - RNA, 22 nt, Human
guguccauuuugugaagcccug

SEQ ID NO: 3871065 - RNA, 18 nt, Human
gugucccagaagaugacu

SEQ ID NO: 3871066 - RNA, 22 nt, Human
gugucccagaagaugacugagg

SEQ ID NO: 3871067 - RNA, 13 nt, Human
gugucccaggcag

SEQ ID NO: 3871068 - RNA, 19 nt, Human
gugucccaggcagggagac

SEQ ID NO: 3871069 - RNA, 22 nt, Human
gugucccaugacccaccccugu

SEQ ID NO: 3871070 - RNA, 21 nt, Human
gugucccauucccccagugcg

SEQ ID NO: 3871071 - RNA, 19 nt, Human
gugucccauugguguuguc

SEQ ID NO: 3871072 - RNA, 19 nt, Human
guguccccaacagcgccca

SEQ ID NO: 3871073 - RNA, 12 nt, Human
guguccccacca

SEQ ID NO: 3871074 - RNA, 13 nt, Human
guguccccaccau

SEQ ID NO: 3871075 - RNA, 18 nt, Human
guguccccggggcccagg

SEQ ID NO: 3871076 - RNA, 19 nt, Human
guguccccggggcccaggg

SEQ ID NO: 3871077 - RNA, 13 nt, Human
guguccccuccac

SEQ ID NO: 3871078 - RNA, 18 nt, Human
guguccccugacagggcc

SEQ ID NO: 3871079 - RNA, 16 nt, Human
gugucccugcacuugc

SEQ ID NO: 3871080 - RNA, 18 nt, Human
gugucccugcacuugcag

SEQ ID NO: 3871081 - RNA, 14 nt, Human
guguccuaggagua

SEQ ID NO: 3871082 - RNA, 20 nt, Human
guguccuccugggguucuuu

SEQ ID NO: 3871083 - RNA, 20 nt, Human
guguccugaaacgcuccuuu

SEQ ID NO: 3871084 - RNA, 17 nt, Human
guguccugaccacccuc

SEQ ID NO: 3871085 - RNA, 17 nt, Human
guguccugccugucugc

SEQ ID NO: 3871086 - RNA, 20 nt, Human
guguccugccugucugcccc

SEQ ID NO: 3871087 - RNA, 13 nt, Human
guguccuggugcu

SEQ ID NO: 3871088 - RNA, 21 nt, Human
guguccuguaguugcguggac

SEQ ID NO: 3871089 - RNA, 20 nt, Human
guguccuugugcaugagcua

SEQ ID NO: 3871090 - RNA, 23 nt, Human
gugucgcucugcuggccuggccg

SEQ ID NO: 3871091 - RNA, 15 nt, Human
gugucgggcaugaca

SEQ ID NO: 3871092 - RNA, 13 nt, Human
gugucuaaacugc

SEQ ID NO: 3871093 - RNA, 16 nt, Human
gugucuaagauucuag

SEQ ID NO: 3871094 - RNA, 17 nt, Human
gugucuaagauucuaga

SEQ ID NO: 3871095 - RNA, 20 nt, Human
gugucuaagauucuagauca

SEQ ID NO: 3871096 - RNA, 23 nt, Human
gugucucaaucugaucugaguga

SEQ ID NO: 3871097 - RNA, 11 nt, Human
gugucucaggc

SEQ ID NO: 3871098 - RNA, 16 nt, Human
gugucucaggcugccu

SEQ ID NO: 3871099 - RNA, 23 nt, Human
gugucucagggugcagaggucag

SEQ ID NO: 3871100 - RNA, 22 nt, Human
gugucucaguccaccugagcug

SEQ ID NO: 3871101 - RNA, 17 nt, Human
gugucucccuucauccu

SEQ ID NO: 3871102 - RNA, 16 nt, Human
gugucuccugcaugca

SEQ ID NO: 3871103 - RNA, 23 nt, Human
gugucuccugcaugcagaaaggg

SEQ ID NO: 3871104 - RNA, 14 nt, Human
gugucucuuggucc

SEQ ID NO: 3871105 - RNA, 20 nt, Human
gugucucuugguccugcugc

SEQ ID NO: 3871106 - RNA, 22 nt, Human
gugucucuuuucucuuucuccu

SEQ ID NO: 3871107 - RNA, 22 nt, Human
gugucugagcccucaaagugag

SEQ ID NO: 3871108 - RNA, 17 nt, Human
gugucugaguggcuuca

SEQ ID NO: 3871109 - RNA, 17 nt, Human
gugucuggauucccagg

SEQ ID NO: 3871110 - RNA, 17 nt, Human
gugucuggcacagccug

SEQ ID NO: 3871111 - RNA, 12 nt, Human
gugucugggcug

SEQ ID NO: 3871112 - RNA, 22 nt, Human
gugucuuaauuaaaagaauauu

SEQ ID NO: 3871113 - RNA, 14 nt, Human
gugucuuaauuauu

SEQ ID NO: 3871114 - RNA, 15 nt, Human
gugucuuaauuauua

SEQ ID NO: 3871115 - RNA, 12 nt, Human
gugucuuagcau

SEQ ID NO: 3871116 - RNA, 15 nt, Human
gugucuuccauaaug

SEQ ID NO: 3871117 - RNA, 14 nt, Human
gugucuuccuccca

SEQ ID NO: 3871118 - RNA, 20 nt, Human
gugucuucuccaccacgcug

SEQ ID NO: 3871119 - RNA, 17 nt, Human
gugucuugggcagagcu

SEQ ID NO: 3871120 - RNA, 23 nt, Human
gugucuugggcagagcuggcucu

SEQ ID NO: 3871121 - RNA, 18 nt, Human
gugucuuguucugucacu

SEQ ID NO: 3871122 - RNA, 19 nt, Human
gugucuuuagauagcccug

SEQ ID NO: 3871123 - RNA, 21 nt, Human
gugucuuucuaagaaaucaag

SEQ ID NO: 3871124 - RNA, 22 nt, Human
gugucuuucuuuggugccuuuc

SEQ ID NO: 3871125 - RNA, 18 nt, Human
gugucuuuuuucacuaca

SEQ ID NO: 3871126 - RNA, 17 nt, Human
gugugaaaaugugugug

SEQ ID NO: 3871127 - RNA, 14 nt, Human
gugugaacuggacc

SEQ ID NO: 3871128 - RNA, 22 nt, Human
gugugaacuggacccuguugcu

SEQ ID NO: 3871129 - RNA, 17 nt, Human
gugugaacuuggaagca

SEQ ID NO: 3871130 - RNA, 20 nt, Human
gugugaaguacaauaauuca

SEQ ID NO: 3871131 - RNA, 20 nt, Human
gugugacaucaguggcaugg

SEQ ID NO: 3871132 - RNA, 14 nt, Human
gugugaccaacugu

SEQ ID NO: 3871133 - RNA, 16 nt, Human
gugugaccaacugugu

SEQ ID NO: 3871134 - RNA, 13 nt, Human
gugugaccugagg

SEQ ID NO: 3871135 - RNA, 18 nt, Human
gugugagucaccaagccc

SEQ ID NO: 3871136 - RNA, 17 nt, Human
gugugagugcauguacu

SEQ ID NO: 3871137 - RNA, 15 nt, Human
gugugagugugacag

SEQ ID NO: 3871138 - RNA, 18 nt, Human
gugugagugugacagggc

SEQ ID NO: 3871139 - RNA, 14 nt, Human
gugugagugugugc

SEQ ID NO: 3871140 - RNA, 15 nt, Human
gugugauauuucaga

SEQ ID NO: 3871141 - RNA, 14 nt, Human
gugugaucgucuga

SEQ ID NO: 3871142 - RNA, 17 nt, Human
gugugaugaacuuucuc

SEQ ID NO: 3871143 - RNA, 21 nt, Human
gugugauugacagcuuugcug

SEQ ID NO: 3871144 - RNA, 23 nt, Human
gugugauugacagcuuugcugcu

SEQ ID NO: 3871145 - RNA, 15 nt, Human
gugugcaacagacaa

SEQ ID NO: 3871146 - RNA, 16 nt, Human
gugugcaagugugugc

SEQ ID NO: 3871147 - RNA, 16 nt, Human
gugugcaccaggguug

SEQ ID NO: 3871148 - RNA, 16 nt, Human
gugugcauguguguau

SEQ ID NO: 3871149 - RNA, 17 nt, Human
gugugcauguguguaua

SEQ ID NO: 3871150 - RNA, 16 nt, Human
gugugcauugcuguga

SEQ ID NO: 3871151 - RNA, 19 nt, Human
gugugccccccauccuggc

SEQ ID NO: 3871152 - RNA, 22 nt, Human
gugugccucaguauauuuaaac

SEQ ID NO: 3871153 - RNA, 14 nt, Human
gugugccucuagcu

SEQ ID NO: 3871154 - RNA, 16 nt, Human
gugugccucuagcuga

SEQ ID NO: 3871155 - RNA, 13 nt, Human
gugugccugcagc

SEQ ID NO: 3871156 - RNA, 15 nt, Human
gugugccugcagccc

SEQ ID NO: 3871157 - RNA, 16 nt, Human
gugugccugcagcccc

SEQ ID NO: 3871158 - RNA, 23 nt, Human
gugugccugggggaguuuuccuc

SEQ ID NO: 3871159 - RNA, 23 nt, Human
gugugccuuccagauccucucug

SEQ ID NO: 3871160 - RNA, 16 nt, Human
gugugcggcugugugu

SEQ ID NO: 3871161 - RNA, 15 nt, Human
gugugcuaaaaauga

SEQ ID NO: 3871162 - RNA, 12 nt, Human
gugugcucugau

SEQ ID NO: 3871163 - RNA, 17 nt, Human
gugugcucuucuucuuu

SEQ ID NO: 3871164 - RNA, 12 nt, Human
gugugcugggag

SEQ ID NO: 3871165 - RNA, 17 nt, Human
gugugcuuuuuuugugu

SEQ ID NO: 3871166 - RNA, 18 nt, Human
guguggacucaaguccuu

SEQ ID NO: 3871167 - RNA, 13 nt, Human
guguggagaagcg

SEQ ID NO: 3871168 - RNA, 21 nt, Human
guguggagagggaaugugaaa

SEQ ID NO: 3871169 - RNA, 17 nt, Human
guguggagucauuucug

SEQ ID NO: 3871170 - RNA, 16 nt, Human
guguggcagcaggcag

SEQ ID NO: 3871171 - RNA, 15 nt, Human
guguggccacuucug

SEQ ID NO: 3871172 - RNA, 13 nt, Human
guguggccaggcu

SEQ ID NO: 3871173 - RNA, 13 nt, Human
guguggcugagga

SEQ ID NO: 3871174 - RNA, 19 nt, Human
guguggcuuucagagccuc

SEQ ID NO: 3871175 - RNA, 17 nt, Human
gugugggacuguacaca

SEQ ID NO: 3871176 - RNA, 14 nt, Human
gugugggcuguguc

SEQ ID NO: 3871177 - RNA, 21 nt, Human
guguggggccaugccuccuca

SEQ ID NO: 3871178 - RNA, 16 nt, Human
guguggguaccuguau

SEQ ID NO: 3871179 - RNA, 14 nt, Human
guguggguguccug

SEQ ID NO: 3871180 - RNA, 15 nt, Human
guguggguucuacag

SEQ ID NO: 3871181 - RNA, 18 nt, Human
gugugguacagagaagcc

SEQ ID NO: 3871182 - RNA, 19 nt, Human
gugugguacagagaagcca

SEQ ID NO: 3871183 - RNA, 20 nt, Human
gugugguacagagaagccag

SEQ ID NO: 3871184 - RNA, 13 nt, Human
guguggugcagug

SEQ ID NO: 3871185 - RNA, 12 nt, Human
gugugguggccu

SEQ ID NO: 3871186 - RNA, 15 nt, Human
gugugguuaugaacu

SEQ ID NO: 3871187 - RNA, 18 nt, Human
guucaaggucacuguuuc

SEQ ID NO: 3871188 - RNA, 20 nt, Human
guucaauaaacuuaacuuua

SEQ ID NO: 3871189 - RNA, 21 nt, Human
guucaauauaagcuuuucuuu

SEQ ID NO: 3871190 - RNA, 12 nt, Human
guucaauauuuu

SEQ ID NO: 3871191 - RNA, 18 nt, Human
guucaaucucccgcugcu

SEQ ID NO: 3871192 - RNA, 10 nt, Human
guucaaugau

SEQ ID NO: 3871193 - RNA, 14 nt, Human
guucaaugaucuag

SEQ ID NO: 3871194 - RNA, 17 nt, Human
guucaaugaucuagguu

SEQ ID NO: 3871195 - RNA, 20 nt, Human
guucaaugaucuagguuuaa

SEQ ID NO: 3871196 - RNA, 17 nt, Human
guucaaugguucugaaa

SEQ ID NO: 3871197 - RNA, 17 nt, Human
guucaauuauuuccccc

SEQ ID NO: 3871198 - RNA, 15 nt, Human
guucaauucccugaa

SEQ ID NO: 3871199 - RNA, 17 nt, Human
guucaauucccugaagg

SEQ ID NO: 3871200 - RNA, 17 nt, Human
guucacacccugcaagg

SEQ ID NO: 3871201 - RNA, 12 nt, Human
guucacauuuuu

SEQ ID NO: 3871202 - RNA, 17 nt, Human
guucaccauuauaauga

SEQ ID NO: 3871203 - RNA, 22 nt, Human
guucaccuugaagaaccucuca

SEQ ID NO: 3871204 - RNA, 24 nt, Human
guucacucuuggagccugcagagc

SEQ ID NO: 3871205 - RNA, 24 nt, Human
guucacuggacacuucacgcccuu

SEQ ID NO: 3871206 - RNA, 21 nt, Human
guucagaaaaaagguucuuug

SEQ ID NO: 3871207 - RNA, 13 nt, Human
guucagaacaacu

SEQ ID NO: 3871208 - RNA, 20 nt, Human
guucagaauuaaacuuuuaa

SEQ ID NO: 3871209 - RNA, 22 nt, Human
guucagaauuuaguguauccau

SEQ ID NO: 3871210 - RNA, 17 nt, Human
guucagagacucagggc

SEQ ID NO: 3871211 - RNA, 22 nt, Human
guucagagacucagggccccag

SEQ ID NO: 3871212 - RNA, 15 nt, Human
guucagagcugcccu

SEQ ID NO: 3871213 - RNA, 19 nt, Human
guucagauaauugaauaag

SEQ ID NO: 3871214 - RNA, 16 nt, Human
guucagauugcuuuga

SEQ ID NO: 3871215 - RNA, 16 nt, Human
guucagcaccacccua

SEQ ID NO: 3871216 - RNA, 15 nt, Human
guucagcacuguccc

SEQ ID NO: 3871217 - RNA, 14 nt, Human
guucagcaguacag

SEQ ID NO: 3871218 - RNA, 22 nt, Human
guucagcauucuuagccugugg

SEQ ID NO: 3871219 - RNA, 17 nt, Human
guucagccacugaggga

SEQ ID NO: 3871220 - RNA, 15 nt, Human
guucagccccuccuc

SEQ ID NO: 3871221 - RNA, 16 nt, Human
guucagccccuccucu

SEQ ID NO: 3871222 - RNA, 18 nt, Human
guucagccccuccucugc

SEQ ID NO: 3871223 - RNA, 21 nt, Human
guucagccccuccucugccac

SEQ ID NO: 3871224 - RNA, 13 nt, Human
guucagccugggu

SEQ ID NO: 3871225 - RNA, 22 nt, Human
guucagcgcugucaggauugcg

SEQ ID NO: 3871226 - RNA, 15 nt, Human
guucagcugccccac

SEQ ID NO: 3871227 - RNA, 15 nt, Human
guucagcugcuucuc

SEQ ID NO: 3871228 - RNA, 18 nt, Human
guucaggagucccaagga

SEQ ID NO: 3871229 - RNA, 18 nt, Human
guucaggggacucagccc

SEQ ID NO: 3871230 - RNA, 19 nt, Human
guucaggggacucagcccu

SEQ ID NO: 3871231 - RNA, 20 nt, Human
guucaggguuggccccugcc

SEQ ID NO: 3871232 - RNA, 22 nt, Human
guucaguaacagggccuugcua

SEQ ID NO: 3871233 - RNA, 14 nt, Human
guucaguaccugga

SEQ ID NO: 3871234 - RNA, 18 nt, Human
guucaguggcagggcuca

SEQ ID NO: 3871235 - RNA, 22 nt, Human
guucaguggcagggcucaggau

SEQ ID NO: 3871236 - RNA, 13 nt, Human
guucaguguaauu

SEQ ID NO: 3871237 - RNA, 16 nt, Human
guucaguguaauuucu

SEQ ID NO: 3871238 - RNA, 17 nt, Human
guucaguguuucugggg

SEQ ID NO: 3871239 - RNA, 11 nt, Human
guucaguuaca

SEQ ID NO: 3871240 - RNA, 14 nt, Human
guucaguuacagaa

SEQ ID NO: 3871241 - RNA, 15 nt, Human
guucaguuacagaaa

SEQ ID NO: 3871242 - RNA, 12 nt, Human
guucauaaauga

SEQ ID NO: 3871243 - RNA, 13 nt, Human
guucauaaaugaa

SEQ ID NO: 3871244 - RNA, 23 nt, Human
guucauaacagugccauugucuu

SEQ ID NO: 3871245 - RNA, 14 nt, Human
guucauacauauuu

SEQ ID NO: 3871246 - RNA, 14 nt, Human
guucauacauugua

SEQ ID NO: 3871247 - RNA, 16 nt, Human
guucauacauuugagg

SEQ ID NO: 3871248 - RNA, 21 nt, Human
guucauaccuaaguacuguaa

SEQ ID NO: 3871249 - RNA, 17 nt, Human
guucauagacccucuca

SEQ ID NO: 3871250 - RNA, 18 nt, Human
guucauauuaagaaugau

SEQ ID NO: 3871251 - RNA, 21 nt, Human
guucaucauccagauguggcu

SEQ ID NO: 3871252 - RNA, 17 nt, Human
guucaucauccuaagcu

SEQ ID NO: 3871253 - RNA, 20 nt, Human
guucauccaauccucacugg

SEQ ID NO: 3871254 - RNA, 22 nt, Human
guucauccaauccucacugggu

SEQ ID NO: 3871255 - RNA, 20 nt, Human
guucauccuauucuuucgaa

SEQ ID NO: 3871256 - RNA, 12 nt, Human
guucaucuugaa

SEQ ID NO: 3871257 - RNA, 13 nt, Human
guucaucuugaau

SEQ ID NO: 3871258 - RNA, 19 nt, Human
guucaugagaaucuauauu

SEQ ID NO: 3871259 - RNA, 16 nt, Human
guucaugcagcugugg

SEQ ID NO: 3871260 - RNA, 22 nt, Human
guucauggcagauguaggaggg

SEQ ID NO: 3871261 - RNA, 12 nt, Human
guucauguagag

SEQ ID NO: 3871262 - RNA, 19 nt, Human
guucauguagagaaaagca

SEQ ID NO: 3871263 - RNA, 18 nt, Human
guucauuagaaauauuuu

SEQ ID NO: 3871264 - RNA, 13 nt, Human
guucauuccucca

SEQ ID NO: 3871265 - RNA, 16 nt, Human
guucauugcacuuuga

SEQ ID NO: 3871266 - RNA, 14 nt, Human
guucauuguaaugu

SEQ ID NO: 3871267 - RNA, 18 nt, Human
guucauuguaauguuacu

SEQ ID NO: 3871268 - RNA, 20 nt, Human
guucauuucaaauacaucuu

SEQ ID NO: 3871269 - RNA, 19 nt, Human
guuccaagacauugucaau

SEQ ID NO: 3871270 - RNA, 14 nt, Human
guuccaagagucua

SEQ ID NO: 3871271 - RNA, 18 nt, Human
guuccaagagucuaaaga

SEQ ID NO: 3871272 - RNA, 17 nt, Human
guuccaaguccaauaag

SEQ ID NO: 3871273 - RNA, 15 nt, Human
guuccaauaaacagg

SEQ ID NO: 3871274 - RNA, 15 nt, Human
guuccaauccuggcu

SEQ ID NO: 3871275 - RNA, 20 nt, Human
guuccaccaucaagccacca

SEQ ID NO: 3871276 - RNA, 20 nt, Human
guuccacgucccccuggggc

SEQ ID NO: 3871277 - RNA, 13 nt, Human
guuccacugagac

SEQ ID NO: 3871278 - RNA, 14 nt, Human
guuccacugagacc

SEQ ID NO: 3871279 - RNA, 18 nt, Human
guuccacugagcuccaug

SEQ ID NO: 3871280 - RNA, 14 nt, Human
guuccagacauucu

SEQ ID NO: 3871281 - RNA, 14 nt, Human
guuccagccugcca

SEQ ID NO: 3871282 - RNA, 14 nt, Human
guuccagcucuuug

SEQ ID NO: 3871283 - RNA, 21 nt, Human
guuccagggucccucugugua

SEQ ID NO: 3871284 - RNA, 21 nt, Human
guuccaucuccuauaaucugu

SEQ ID NO: 3871285 - RNA, 17 nt, Human
guuccaugccugagggu

SEQ ID NO: 3871286 - RNA, 20 nt, Human
guuccaugccugagggugga

SEQ ID NO: 3871287 - RNA, 17 nt, Human
guuccauuaaacgauuu

SEQ ID NO: 3871288 - RNA, 22 nt, Human
guuccauugaagccgacucugg

SEQ ID NO: 3871289 - RNA, 19 nt, Human
guucccaagcucagaggcg

SEQ ID NO: 3871290 - RNA, 18 nt, Human
guucccacauuaaagaag

SEQ ID NO: 3871291 - RNA, 15 nt, Human
guucccagaaucaaa

SEQ ID NO: 3871292 - RNA, 21 nt, Human
guucccagauggcuggaaggg

SEQ ID NO: 3871293 - RNA, 21 nt, Human
guucccauccucuucuuuuag

SEQ ID NO: 3871294 - RNA, 16 nt, Human
guucccauuucagcug

SEQ ID NO: 3871295 - RNA, 18 nt, Human
guuccccaucuggguccu

SEQ ID NO: 3871296 - RNA, 16 nt, Human
guucccccagcccugu

SEQ ID NO: 3871297 - RNA, 20 nt, Human
guucccccagcccuguggaa

SEQ ID NO: 3871298 - RNA, 23 nt, Human
guuccccucucccuucccuccuc

SEQ ID NO: 3871299 - RNA, 18 nt, Human
guuccccucuugucuccc

SEQ ID NO: 3871300 - RNA, 20 nt, Human
guuccccucuugucuccccu

SEQ ID NO: 3871301 - RNA, 18 nt, Human
guuccccuguuuauucau

SEQ ID NO: 3871302 - RNA, 17 nt, Human
guuccccuuugcuucau

SEQ ID NO: 3871303 - RNA, 14 nt, Human
guucccguuucucc

SEQ ID NO: 3871304 - RNA, 19 nt, Human
guucccguuucuccaccua

SEQ ID NO: 3871305 - RNA, 21 nt, Human
guucccuaggggacacuuccc

SEQ ID NO: 3871306 - RNA, 22 nt, Human
guucccuauuuuucucuccugu

SEQ ID NO: 3871307 - RNA, 12 nt, Human
guucccucugag

SEQ ID NO: 3871308 - RNA, 15 nt, Human
guucccucugcucag

SEQ ID NO: 3871309 - RNA, 16 nt, Human
guucccucugcucagc

SEQ ID NO: 3871310 - RNA, 16 nt, Human
guucccucugcuccug

SEQ ID NO: 3871311 - RNA, 18 nt, Human
guucccugaaaacccaga

SEQ ID NO: 3871312 - RNA, 15 nt, Human
guucccuguucuucc

SEQ ID NO: 3871313 - RNA, 16 nt, Human
guucccuguucuuccu

SEQ ID NO: 3871314 - RNA, 18 nt, Human
guucccuugaugaagaag

SEQ ID NO: 3871315 - RNA, 12 nt, Human
guucccuuggcc

SEQ ID NO: 3871316 - RNA, 13 nt, Human
guucccuuggccu

SEQ ID NO: 3871317 - RNA, 22 nt, Human
guucccuuuccuuccaucccua

SEQ ID NO: 3871318 - RNA, 18 nt, Human
guucccuuugcuccaccc

SEQ ID NO: 3871319 - RNA, 22 nt, Human
guucccuuuuuuggcugcugaa

SEQ ID NO: 3871320 - RNA, 18 nt, Human
guuccgggcaaaugccag

SEQ ID NO: 3871321 - RNA, 22 nt, Human
guuccgggcaaaugccagggcc

SEQ ID NO: 3871322 - RNA, 18 nt, Human
guuccuaagaagcuucua

SEQ ID NO: 3871323 - RNA, 19 nt, Human
guuccuaagagugcugggc

SEQ ID NO: 3871324 - RNA, 14 nt, Human
guuccuaaguucuu

SEQ ID NO: 3871325 - RNA, 15 nt, Human
guuccuagaguagag

SEQ ID NO: 3871326 - RNA, 16 nt, Human
guuccuagccaccgcc

SEQ ID NO: 3871327 - RNA, 23 nt, Human
guuccuagugauggcuuaugaua

SEQ ID NO: 3871328 - RNA, 15 nt, Human
guuccucaaauuuuu

SEQ ID NO: 3871329 - RNA, 20 nt, Human
guuccucaaauuuuuugacu

SEQ ID NO: 3871330 - RNA, 22 nt, Human
guuccucccccaguuccuccca

SEQ ID NO: 3871331 - RNA, 15 nt, Human
guuccucgcccuggg

SEQ ID NO: 3871332 - RNA, 18 nt, Human
uaaaauugcuauguuacu

SEQ ID NO: 3871333 - RNA, 15 nt, Human
uaaaauuguaaaauu

SEQ ID NO: 3871334 - RNA, 16 nt, Human
uaaaauuguaaaauug

SEQ ID NO: 3871335 - RNA, 19 nt, Human
uaaaauuguacaugaacau

SEQ ID NO: 3871336 - RNA, 15 nt, Human
uaaaauugugaugug

SEQ ID NO: 3871337 - RNA, 16 nt, Human
uaaaauuguuaucaaa

SEQ ID NO: 3871338 - RNA, 17 nt, Human
uaaaauuuaaguaucuu

SEQ ID NO: 3871339 - RNA, 14 nt, Human
uaaaauuuauauug

SEQ ID NO: 3871340 - RNA, 15 nt, Human
uaaaauuuauuucau

SEQ ID NO: 3871341 - RNA, 15 nt, Human
uaaaauuugaaacau

SEQ ID NO: 3871342 - RNA, 16 nt, Human
uaaaauuugaaacauu

SEQ ID NO: 3871343 - RNA, 21 nt, Human
uaaaauuugcccucccauccc

SEQ ID NO: 3871344 - RNA, 21 nt, Human
uaaaauuuugcuuuuaauuaa

SEQ ID NO: 3871345 - RNA, 16 nt, Human
uaaaauuuuguauguu

SEQ ID NO: 3871346 - RNA, 19 nt, Human
uaaaauuuuguauguuaaa

SEQ ID NO: 3871347 - RNA, 23 nt, Human
uaaaauuuuguauguuaaagaga

SEQ ID NO: 3871348 - RNA, 18 nt, Human
uaaaauuuuuuuagaaag

SEQ ID NO: 3871349 - RNA, 16 nt, Human
uaaaauuuuuuuucau

SEQ ID NO: 3871350 - RNA, 17 nt, Human
uaaacaaaauagaaagu

SEQ ID NO: 3871351 - RNA, 22 nt, Human
uaaacaaaauagaaaguugcaa

SEQ ID NO: 3871352 - RNA, 18 nt, Human
uaaacaaaauagaagcug

SEQ ID NO: 3871353 - RNA, 23 nt, Human
uaaacaaaauagaagcuguagua

SEQ ID NO: 3871354 - RNA, 13 nt, Human
uaaacaaacauug

SEQ ID NO: 3871355 - RNA, 17 nt, Human
uaaacaaaguuacuagg

SEQ ID NO: 3871356 - RNA, 12 nt, Human
uaaacaaaugua

SEQ ID NO: 3871357 - RNA, 17 nt, Human
uaaacaaauucauauuc

SEQ ID NO: 3871358 - RNA, 22 nt, Human
uaaacaaauucauauucugucu

SEQ ID NO: 3871359 - RNA, 18 nt, Human
uaaacaacagcugaagca

SEQ ID NO: 3871360 - RNA, 13 nt, Human
uaaacaagaaaaa

SEQ ID NO: 3871361 - RNA, 18 nt, Human
uaaacaagaccacguuuc

SEQ ID NO: 3871362 - RNA, 19 nt, Human
uaaacaagaccacguuucu

SEQ ID NO: 3871363 - RNA, 20 nt, Human
uaaacaagauuuuaaagaca

SEQ ID NO: 3871364 - RNA, 21 nt, Human
uaaacaagauuuuaaagacau

SEQ ID NO: 3871365 - RNA, 13 nt, Human
uaaacaaguauuu

SEQ ID NO: 3871366 - RNA, 23 nt, Human
uaaacaaguauuuguuaauuuag

SEQ ID NO: 3871367 - RNA, 22 nt, Human
uaaacaaguucgagucaaaguu

SEQ ID NO: 3871368 - RNA, 21 nt, Human
uaaacaaugcugauuugguga

SEQ ID NO: 3871369 - RNA, 16 nt, Human
uaaacaauucaaguga

SEQ ID NO: 3871370 - RNA, 12 nt, Human
uaaacacauuaa

SEQ ID NO: 3871371 - RNA, 11 nt, Human
uaaacacuaca

SEQ ID NO: 3871372 - RNA, 16 nt, Human
uaaacacucaccuucu

SEQ ID NO: 3871373 - RNA, 17 nt, Human
uaaacacucagcuguuc

SEQ ID NO: 3871374 - RNA, 11 nt, Human
uaaacacuguu

SEQ ID NO: 3871375 - RNA, 21 nt, Human
uaaacagauauaaauggcugg

SEQ ID NO: 3871376 - RNA, 20 nt, Human
uaaacagaugaugagaauuu

SEQ ID NO: 3871377 - RNA, 16 nt, Human
uaaacagauguccauc

SEQ ID NO: 3871378 - RNA, 22 nt, Human
uaaacagauguccaucagauga

SEQ ID NO: 3871379 - RNA, 18 nt, Human
uaaacagauuuuuacaaa

SEQ ID NO: 3871380 - RNA, 20 nt, Human
uaaacagauuuuuacaaaug

SEQ ID NO: 3871381 - RNA, 17 nt, Human
uaaacagcaguguuccc

SEQ ID NO: 3871382 - RNA, 23 nt, Human
uaaacaggcccagcauugcuggu

SEQ ID NO: 3871383 - RNA, 23 nt, Human
uaaacagguggugagaaauuucu

SEQ ID NO: 3871384 - RNA, 15 nt, Human
uaaacaguauuucau

SEQ ID NO: 3871385 - RNA, 23 nt, Human
uaaacagugagccugaauuuugu

SEQ ID NO: 3871386 - RNA, 12 nt, Human
uaaacagugccu

SEQ ID NO: 3871387 - RNA, 14 nt, Human
uaaacauaaaacaa

SEQ ID NO: 3871388 - RNA, 15 nt, Human
uaaacauaaugaaaa

SEQ ID NO: 3871389 - RNA, 16 nt, Human
uaaacauaaugaaaau

SEQ ID NO: 3871390 - RNA, 16 nt, Human
uaaacauaugauuuca

SEQ ID NO: 3871391 - RNA, 18 nt, Human
uaaacauaugauuucacu

SEQ ID NO: 3871392 - RNA, 15 nt, Human
uaaacaucaaucuuu

SEQ ID NO: 3871393 - RNA, 18 nt, Human
uaaacaucaaucuuuaaa

SEQ ID NO: 3871394 - RNA, 17 nt, Human
uaaacaucagguuaggc

SEQ ID NO: 3871395 - RNA, 17 nt, Human
uaaacaucauucauuuu

SEQ ID NO: 3871396 - RNA, 20 nt, Human
uaaacauccaauauuuucuu

SEQ ID NO: 3871397 - RNA, 17 nt, Human
uaaacauccuucaagaa

SEQ ID NO: 3871398 - RNA, 21 nt, Human
uaaacaugcuguacauacuuu

SEQ ID NO: 3871399 - RNA, 13 nt, Human
uaaacauguguuu

SEQ ID NO: 3871400 - RNA, 17 nt, Human
uaaacauuaaaugucuu

SEQ ID NO: 3871401 - RNA, 21 nt, Human
uaaacauuaauagcagccuuu

SEQ ID NO: 3871402 - RNA, 20 nt, Human
uaaacauuaguguucauagc

SEQ ID NO: 3871403 - RNA, 13 nt, Human
uaaacauuaguuc

SEQ ID NO: 3871404 - RNA, 23 nt, Human
uaaacauuauuaaguaacuuauu

SEQ ID NO: 3871405 - RNA, 18 nt, Human
uaaacauugaaguaauga

SEQ ID NO: 3871406 - RNA, 23 nt, Human
uaaacauuuauuuuuuuuaaaga

SEQ ID NO: 3871407 - RNA, 14 nt, Human
uaaaccaaaggaca

SEQ ID NO: 3871408 - RNA, 20 nt, Human
uaaaccaaaggacauuaugu

SEQ ID NO: 3871409 - RNA, 17 nt, Human
uaaaccaaggacugagc

SEQ ID NO: 3871410 - RNA, 19 nt, Human
uaaaccaaggcuagaacca

SEQ ID NO: 3871411 - RNA, 12 nt, Human
uaaaccaauuuu

SEQ ID NO: 3871412 - RNA, 19 nt, Human
uaaaccauaaaaagcugac

SEQ ID NO: 3871413 - RNA, 18 nt, Human
uaaaccauuuuuguuacu

SEQ ID NO: 3871414 - RNA, 13 nt, Human
uaaacccucagag

SEQ ID NO: 3871415 - RNA, 20 nt, Human
uaaaccgcuuuggccugagu

SEQ ID NO: 3871416 - RNA, 16 nt, Human
uaaaccggaccaucuc

SEQ ID NO: 3871417 - RNA, 18 nt, Human
uaaaccuaaaaaagauau

SEQ ID NO: 3871418 - RNA, 21 nt, Human
uaaaccuaggacuuccgagcu

SEQ ID NO: 3871419 - RNA, 19 nt, Human
uaaaccucaaaaugucuaa

SEQ ID NO: 3871420 - RNA, 21 nt, Human
uaaaccuguuuuuuuuucauu

SEQ ID NO: 3871421 - RNA, 19 nt, Human
uaaaccuuaauauuucuuc

SEQ ID NO: 3871422 - RNA, 13 nt, Human
uaaaccuuuuuug

SEQ ID NO: 3871423 - RNA, 15 nt, Human
uaaacgaaacaaaga

SEQ ID NO: 3871424 - RNA, 17 nt, Human
uaaacgauuuuuaaaau

SEQ ID NO: 3871425 - RNA, 19 nt, Human
uaaacgauuuuuaaaaugu

SEQ ID NO: 3871426 - RNA, 13 nt, Human
uaaacggauuauu

SEQ ID NO: 3871427 - RNA, 15 nt, Human
uaaacggauuauuuu

SEQ ID NO: 3871428 - RNA, 20 nt, Human
uaaacggauuauuuuuucag

SEQ ID NO: 3871429 - RNA, 22 nt, Human
uaaacggauuauuuuuucagac

SEQ ID NO: 3871430 - RNA, 20 nt, Human
uaaacgguucaguuucuucu

SEQ ID NO: 3871431 - RNA, 20 nt, Human
uaaacguaugcaugugaaga

SEQ ID NO: 3871432 - RNA, 17 nt, Human
uaaacgugcagacuaug

SEQ ID NO: 3871433 - RNA, 22 nt, Human
uaaacguguauguuuuucaguu

SEQ ID NO: 3871434 - RNA, 23 nt, Human
uaaacguguauguuuuucaguuc

SEQ ID NO: 3871435 - RNA, 22 nt, Human
uaaacguuucaguaauaaaaca

SEQ ID NO: 3871436 - RNA, 13 nt, Human
uaaacuaaaugug

SEQ ID NO: 3871437 - RNA, 16 nt, Human
uaaacuacucuuugau

SEQ ID NO: 3871438 - RNA, 18 nt, Human
uaaacuacucuuugauuu

SEQ ID NO: 3871439 - RNA, 16 nt, Human
uaaacuagaugaccuc

SEQ ID NO: 3871440 - RNA, 23 nt, Human
uaaacuagcauaucugccuuuau

SEQ ID NO: 3871441 - RNA, 22 nt, Human
uaaacuauaaaacaaaaauuug

SEQ ID NO: 3871442 - RNA, 17 nt, Human
uaaacuaucaguuuguc

SEQ ID NO: 3871443 - RNA, 17 nt, Human
uaaacuauuggaaagua

SEQ ID NO: 3871444 - RNA, 15 nt, Human
uaaacuauuugucuu

SEQ ID NO: 3871445 - RNA, 19 nt, Human
uaaacucagggacagagcc

SEQ ID NO: 3871446 - RNA, 20 nt, Human
uaaacucagggacagagcca

SEQ ID NO: 3871447 - RNA, 14 nt, Human
uaaacucauuuaua

SEQ ID NO: 3871448 - RNA, 15 nt, Human
uaaacucuaaacauu

SEQ ID NO: 3871449 - RNA, 18 nt, Human
uaaacucucuuugggaau

SEQ ID NO: 3871450 - RNA, 19 nt, Human
uaaacucugaauaagcacu

SEQ ID NO: 3871451 - RNA, 17 nt, Human
uaaacucugaauuuauc

SEQ ID NO: 3871452 - RNA, 21 nt, Human
uaaacucugaauuuaucuuug

SEQ ID NO: 3871453 - RNA, 22 nt, Human
uaaacugaaaacucccauuuac

SEQ ID NO: 3871454 - RNA, 14 nt, Human
uaaacugacuuuau

SEQ ID NO: 3871455 - RNA, 16 nt, Human
uaaacugacuuuaucc

SEQ ID NO: 3871456 - RNA, 11 nt, Human
uaaacugccau

SEQ ID NO: 3871457 - RNA, 20 nt, Human
uaaacugcccccucugcccu

SEQ ID NO: 3871458 - RNA, 23 nt, Human
uaaacuggagacugugugugccc

SEQ ID NO: 3871459 - RNA, 14 nt, Human
uaaacuguacagug

SEQ ID NO: 3871460 - RNA, 18 nt, Human
uaaacuguguacauaacu

SEQ ID NO: 3871461 - RNA, 13 nt, Human
uaaacugugugca

SEQ ID NO: 3871462 - RNA, 22 nt, Human
uaaacuguguggacugugaugc

SEQ ID NO: 3871463 - RNA, 13 nt, Human
uaaacuguguuua

SEQ ID NO: 3871464 - RNA, 18 nt, Human
uaaacuguuagcacuguu

SEQ ID NO: 3871465 - RNA, 19 nt, Human
uaaacuguuagcacuguug

SEQ ID NO: 3871466 - RNA, 18 nt, Human
uaaacuguuucuuuaaaa

SEQ ID NO: 3871467 - RNA, 14 nt, Human
uaaacuuaacuuua

SEQ ID NO: 3871468 - RNA, 14 nt, Human
uaaacuuaaucuaa

SEQ ID NO: 3871469 - RNA, 18 nt, Human
uaaacuuauaaaucauau

SEQ ID NO: 3871470 - RNA, 14 nt, Human
uaaacuuaugaaug

SEQ ID NO: 3871471 - RNA, 16 nt, Human
uaaacuuaugaauguu

SEQ ID NO: 3871472 - RNA, 17 nt, Human
uaaacuuaugaauguuu

SEQ ID NO: 3871473 - RNA, 22 nt, Human
uaaacuuggugcuuauugauau

SEQ ID NO: 3871474 - RNA, 17 nt, Human
uaaacuuguuugcugug

SEQ ID NO: 3871475 - RNA, 15 nt, Human
uaaacuuuaauaugu

SEQ ID NO: 3871476 - RNA, 23 nt, Human
uaaauaugaacccuuuguuucuu

SEQ ID NO: 3871477 - RNA, 23 nt, Human
uaaauaugaaucugcucacuuua

SEQ ID NO: 3871478 - RNA, 17 nt, Human
uaaauaugcagugauau

SEQ ID NO: 3871479 - RNA, 23 nt, Human
uaaauaugccucuccuuuguaua

SEQ ID NO: 3871480 - RNA, 23 nt, Human
uaaauauggacugcucaggaaac

SEQ ID NO: 3871481 - RNA, 18 nt, Human
uaaauauguuagcaaaga

SEQ ID NO: 3871482 - RNA, 18 nt, Human
uaaauauguuuuuuagau

SEQ ID NO: 3871483 - RNA, 19 nt, Human
uaaauauuaguuaauggau

SEQ ID NO: 3871484 - RNA, 19 nt, Human
uaaauauucacacuugaac

SEQ ID NO: 3871485 - RNA, 23 nt, Human
uaaauauugguugggaugacuug

SEQ ID NO: 3871486 - RNA, 16 nt, Human
uaaauauugucuuuuu

SEQ ID NO: 3871487 - RNA, 17 nt, Human
uaaauauugucuuuuug

SEQ ID NO: 3871488 - RNA, 10 nt, Human
uaaauauuua

SEQ ID NO: 3871489 - RNA, 17 nt, Human
uaaauauuuacauauga

SEQ ID NO: 3871490 - RNA, 21 nt, Human
uaaauauuuacauaugaaauu

SEQ ID NO: 3871491 - RNA, 23 nt, Human
uaaauauuuacauaugaaauuua

SEQ ID NO: 3871492 - RNA, 17 nt, Human
uaaauauuuauuuaugu

SEQ ID NO: 3871493 - RNA, 15 nt, Human
uaaauauuuccuuaa

SEQ ID NO: 3871494 - RNA, 15 nt, Human
uaaauauuuugacuu

SEQ ID NO: 3871495 - RNA, 22 nt, Human
uaaaucaaccaccuauuuuuga

SEQ ID NO: 3871496 - RNA, 16 nt, Human
uaaaucacgcuuuuug

SEQ ID NO: 3871497 - RNA, 19 nt, Human
uaaaucacgcuuuuugaaa

SEQ ID NO: 3871498 - RNA, 20 nt, Human
uaaaucagacuaugaaguuu

SEQ ID NO: 3871499 - RNA, 19 nt, Human
uaaaucagccguguaacca

SEQ ID NO: 3871500 - RNA, 18 nt, Human
uaaaucaguaagaggugu

SEQ ID NO: 3871501 - RNA, 22 nt, Human
uaaaucagucaagcuguugaag

SEQ ID NO: 3871502 - RNA, 11 nt, Human
uaaaucagugg

SEQ ID NO: 3871503 - RNA, 15 nt, Human
uaaaucauaaaguca

SEQ ID NO: 3871504 - RNA, 14 nt, Human
uaaaucauauugau

SEQ ID NO: 3871505 - RNA, 19 nt, Human
uaaaucauauugaugaaaa

SEQ ID NO: 3871506 - RNA, 20 nt, Human
uaaaucauauugaugaaaag

SEQ ID NO: 3871507 - RNA, 16 nt, Human
uaaaucaugaugcuag

SEQ ID NO: 3871508 - RNA, 19 nt, Human
uaaaucauuuuaggaaagg

SEQ ID NO: 3871509 - RNA, 19 nt, Human
uaaauccacccauguuauc

SEQ ID NO: 3871510 - RNA, 15 nt, Human
uaaauccauuuggaa

SEQ ID NO: 3871511 - RNA, 18 nt, Human
uaaauccauuuggaaauc

SEQ ID NO: 3871512 - RNA, 18 nt, Human
uaaauccugaagagcauu

SEQ ID NO: 3871513 - RNA, 17 nt, Human
uaaauccugccauuuaa

SEQ ID NO: 3871514 - RNA, 18 nt, Human
uaaauccugccauuuaaa

SEQ ID NO: 3871515 - RNA, 15 nt, Human
uaaaucuaaaucuau

SEQ ID NO: 3871516 - RNA, 15 nt, Human
uaaaucuagacucaa

SEQ ID NO: 3871517 - RNA, 19 nt, Human
uaaaucuaguauacauugu

SEQ ID NO: 3871518 - RNA, 14 nt, Human
uaaaucuccaaaau

SEQ ID NO: 3871519 - RNA, 21 nt, Human
uaaaucuccaaaauaaaacuu

SEQ ID NO: 3871520 - RNA, 17 nt, Human
uaaaucuccuauuuuuu

SEQ ID NO: 3871521 - RNA, 14 nt, Human
uaaaucucuaauau

SEQ ID NO: 3871522 - RNA, 15 nt, Human
uaaaucugacccagu

SEQ ID NO: 3871523 - RNA, 16 nt, Human
uaaaucugacccagug

SEQ ID NO: 3871524 - RNA, 22 nt, Human
uaaaucugugaacuugaaauuu

SEQ ID NO: 3871525 - RNA, 17 nt, Human
uaaaucuguucaaggaa

SEQ ID NO: 3871526 - RNA, 18 nt, Human
uaaaucuguugccaagcu

SEQ ID NO: 3871527 - RNA, 13 nt, Human
uaaaucuuuuaua

SEQ ID NO: 3871528 - RNA, 22 nt, Human
uaaaugaaagaaaauugaguug

SEQ ID NO: 3871529 - RNA, 15 nt, Human
uaaaugaaauuguaa

SEQ ID NO: 3871530 - RNA, 16 nt, Human
uaaaugaagcagcuuu

SEQ ID NO: 3871531 - RNA, 17 nt, Human
uaaaugaagcagcuuua

SEQ ID NO: 3871532 - RNA, 21 nt, Human
uaaaugaaguaacuugucuua

SEQ ID NO: 3871533 - RNA, 18 nt, Human
uaaaugaaguuuauacag

SEQ ID NO: 3871534 - RNA, 20 nt, Human
uaaaugaaguuuauacagua

SEQ ID NO: 3871535 - RNA, 13 nt, Human
uaaaugaauguuu

SEQ ID NO: 3871536 - RNA, 14 nt, Human
uaaaugaucugccu

SEQ ID NO: 3871537 - RNA, 14 nt, Human
uaaaugauucaaaa

SEQ ID NO: 3871538 - RNA, 15 nt, Human
uaaaugcaaauaaca

SEQ ID NO: 3871539 - RNA, 16 nt, Human
uaaaugcaaauaacaa

SEQ ID NO: 3871540 - RNA, 17 nt, Human
uaaaugcaaauaacaaa

SEQ ID NO: 3871541 - RNA, 19 nt, Human
uaaaugcaaccauuugaaa

SEQ ID NO: 3871542 - RNA, 14 nt, Human
uaaaugcaauaugu

SEQ ID NO: 3871543 - RNA, 19 nt, Human
uaaaugcaauauuaaugcc

SEQ ID NO: 3871544 - RNA, 12 nt, Human
uaaaugcagccc

SEQ ID NO: 3871545 - RNA, 23 nt, Human
uaaaugcagcccauuucuccaga

SEQ ID NO: 3871546 - RNA, 22 nt, Human
uaaaugcagcgaaccaauauuu

SEQ ID NO: 3871547 - RNA, 17 nt, Human
uaaaugcaguuacaaau

SEQ ID NO: 3871548 - RNA, 21 nt, Human
uaaaugcaguuacaaauuaua

SEQ ID NO: 3871549 - RNA, 16 nt, Human
uaaaugcauaaaugca

SEQ ID NO: 3871550 - RNA, 12 nt, Human
uaaaugccacac

SEQ ID NO: 3871551 - RNA, 16 nt, Human
uaaaugccaucaauaa

SEQ ID NO: 3871552 - RNA, 22 nt, Human
uaaaugcccucuucucgugccu

SEQ ID NO: 3871553 - RNA, 20 nt, Human
uaaaugccuaguuuuuagua

SEQ ID NO: 3871554 - RNA, 13 nt, Human
uaaaugcuauuuu

SEQ ID NO: 3871555 - RNA, 14 nt, Human
uaaaugcuauuuuu

SEQ ID NO: 3871556 - RNA, 23 nt, Human
uaaaugcuauuuuuuauuuuacu

SEQ ID NO: 3871557 - RNA, 17 nt, Human
uaaaugcuuuaugcaaa

SEQ ID NO: 3871558 - RNA, 17 nt, Human
uaaauggaaaaaaugau

SEQ ID NO: 3871559 - RNA, 18 nt, Human
uaaauggaaacugaaacu

SEQ ID NO: 3871560 - RNA, 22 nt, Human
uaaauggaaacugaaacuacug

SEQ ID NO: 3871561 - RNA, 11 nt, Human
uaaauggaaau

SEQ ID NO: 3871562 - RNA, 16 nt, Human
uaaauggaaccacucu

SEQ ID NO: 3871563 - RNA, 23 nt, Human
uaaauggccucauguggcuggaa

SEQ ID NO: 3871564 - RNA, 11 nt, Human
uaaauggcugc

SEQ ID NO: 3871565 - RNA, 16 nt, Human
uaaaugggaacauuua

SEQ ID NO: 3871566 - RNA, 17 nt, Human
uaaaugggaacauuuau

SEQ ID NO: 3871567 - RNA, 23 nt, Human
uaaaugggaacauuuauuuuaug

SEQ ID NO: 3871568 - RNA, 19 nt, Human
uaaaugggggugcauuuga

SEQ ID NO: 3871569 - RNA, 16 nt, Human
uaaauggguagagaaa

SEQ ID NO: 3871570 - RNA, 18 nt, Human
uaaaugguaauaagcacu

SEQ ID NO: 3871571 - RNA, 21 nt, Human
uaaaugguguacauaauguau

SEQ ID NO: 3871572 - RNA, 17 nt, Human
uaaauguagaguuuuua

SEQ ID NO: 3871573 - RNA, 21 nt, Human
uaaauguaguucugcuccaga

SEQ ID NO: 3871574 - RNA, 15 nt, Human
uaaauguauauacac

SEQ ID NO: 3871575 - RNA, 17 nt, Human
uaaaugucacuuuuuga

SEQ ID NO: 3871576 - RNA, 23 nt, Human
uaaaugucacuuuuugaggcaaa

SEQ ID NO: 3871577 - RNA, 15 nt, Human
uaaauguccauucuu

SEQ ID NO: 3871578 - RNA, 12 nt, Human
uaaaugucuaau

SEQ ID NO: 3871579 - RNA, 16 nt, Human
uaaaugucuaauguau

SEQ ID NO: 3871580 - RNA, 19 nt, Human
uaaaugucuuuaaugcaau

SEQ ID NO: 3871581 - RNA, 13 nt, Human
uaaaugucuuugu

SEQ ID NO: 3871582 - RNA, 14 nt, Human
uaaaugucuuugua

SEQ ID NO: 3871583 - RNA, 16 nt, Human
uaaaugucuuuguaag

SEQ ID NO: 3871584 - RNA, 21 nt, Human
uaaaugucuuuguaagucagu

SEQ ID NO: 3871585 - RNA, 22 nt, Human
uaaaugucuuuuuuuuaaugug

SEQ ID NO: 3871586 - RNA, 22 nt, Human
uaaaugugaauuacuaacuucu

SEQ ID NO: 3871587 - RNA, 23 nt, Human
uaaaugugauaugauuggcaaua

SEQ ID NO: 3871588 - RNA, 19 nt, Human
uaaaugugaugaauacugu

SEQ ID NO: 3871589 - RNA, 16 nt, Human
uaaaugugcuuuuaaa

SEQ ID NO: 3871590 - RNA, 13 nt, Human
uaaaugugguaaa

SEQ ID NO: 3871591 - RNA, 11 nt, Human
uaaaugugugu

SEQ ID NO: 3871592 - RNA, 14 nt, Human
uaaauguguguaug

SEQ ID NO: 3871593 - RNA, 19 nt, Human
uaaauguguuggacaaaug

SEQ ID NO: 3871594 - RNA, 22 nt, Human
uaaauguguuggacaaauguga

SEQ ID NO: 3871595 - RNA, 16 nt, Human
uaaauguuaaagaugu

SEQ ID NO: 3871596 - RNA, 18 nt, Human
uaaauguuaccucugaau

SEQ ID NO: 3871597 - RNA, 22 nt, Human
uaaauguuaguuucuugguaaa

SEQ ID NO: 3871598 - RNA, 18 nt, Human
uaaauguuauagcugcau

SEQ ID NO: 3871599 - RNA, 19 nt, Human
uaaauguuaugacuaugua

SEQ ID NO: 3871600 - RNA, 23 nt, Human
uaaauguuaugacuauguaaacu

SEQ ID NO: 3871601 - RNA, 21 nt, Human
uaaauguuauuucugcaaaca

SEQ ID NO: 3871602 - RNA, 22 nt, Human
uaaauguuugacacaauuggaa

SEQ ID NO: 3871603 - RNA, 20 nt, Human
uaaauguuuggcauguaaau

SEQ ID NO: 3871604 - RNA, 11 nt, Human
uaaauguuuug

SEQ ID NO: 3871605 - RNA, 15 nt, Human
uaaauguuuuguaaa

SEQ ID NO: 3871606 - RNA, 23 nt, Human
uaaauguuuuguaaacuuugaaa

SEQ ID NO: 3871607 - RNA, 20 nt, Human
uaaauguuuuucuauguagu

SEQ ID NO: 3871608 - RNA, 20 nt, Human
uaaauguuuuuuuuuaaaga

SEQ ID NO: 3871609 - RNA, 24 nt, Human
uaaauguuuuuuuuuaaagacuuu

SEQ ID NO: 3871610 - RNA, 14 nt, Human
uaaauuaaacaauu

SEQ ID NO: 3871611 - RNA, 15 nt, Human
uaaauuaaacaauuu

SEQ ID NO: 3871612 - RNA, 20 nt, Human
uaaauuaaagccuuuaguau

SEQ ID NO: 3871613 - RNA, 16 nt, Human
uaaauuaacuuuuaua

SEQ ID NO: 3871614 - RNA, 17 nt, Human
uaaauuaacuuuuauaa

SEQ ID NO: 3871615 - RNA, 12 nt, Human
uaaauuaagaca

SEQ ID NO: 3871616 - RNA, 11 nt, Human
uaaauuaauau

SEQ ID NO: 3871617 - RNA, 15 nt, Human
uaaauuaauaucuuu

SEQ ID NO: 3871618 - RNA, 17 nt, Human
uaaauuaauaucuuucu

SEQ ID NO: 3871619 - RNA, 19 nt, Human
uaaauuacaauugucauuu

SEQ ID NO: 3871620 - RNA, 21 nt, Human
uaacuuccuuggacucauuuu

SEQ ID NO: 3871621 - RNA, 15 nt, Human
uaacuucuaaaacug

SEQ ID NO: 3871622 - RNA, 19 nt, Human
uaacuucuuauggaauuga

SEQ ID NO: 3871623 - RNA, 22 nt, Human
uaacuugaaccuaugaagcaau

SEQ ID NO: 3871624 - RNA, 13 nt, Human
uaacuugaugcau

SEQ ID NO: 3871625 - RNA, 16 nt, Human
uaacuugaugcaugug

SEQ ID NO: 3871626 - RNA, 19 nt, Human
uaacuugcuuaaaugugaa

SEQ ID NO: 3871627 - RNA, 15 nt, Human
uaacuugguuauaca

SEQ ID NO: 3871628 - RNA, 16 nt, Human
uaacuugguuauacau

SEQ ID NO: 3871629 - RNA, 14 nt, Human
uaacuuguaauaaa

SEQ ID NO: 3871630 - RNA, 15 nt, Human
uaacuuguaauaaac

SEQ ID NO: 3871631 - RNA, 17 nt, Human
uaacuugucuaaauaag

SEQ ID NO: 3871632 - RNA, 14 nt, Human
uaacuugucuuaaa

SEQ ID NO: 3871633 - RNA, 17 nt, Human
uaacuuguuuccaaugu

SEQ ID NO: 3871634 - RNA, 16 nt, Human
uaacuuuaauguuuuu

SEQ ID NO: 3871635 - RNA, 22 nt, Human
uaacuuuagaagugcauuucug

SEQ ID NO: 3871636 - RNA, 15 nt, Human
uaacuuuaucacauu

SEQ ID NO: 3871637 - RNA, 21 nt, Human
uaacuuuaucacauuauuugc

SEQ ID NO: 3871638 - RNA, 16 nt, Human
uaacuuuauguguaaa

SEQ ID NO: 3871639 - RNA, 23 nt, Human
uaacuuuauucuugaaagaagaa

SEQ ID NO: 3871640 - RNA, 22 nt, Human
uaacuuugcuuucaugaccauc

SEQ ID NO: 3871641 - RNA, 12 nt, Human
uaacuuuguuuu

SEQ ID NO: 3871642 - RNA, 18 nt, Human
uaacuuuguuuuauuuuc

SEQ ID NO: 3871643 - RNA, 20 nt, Human
uaacuuuuauaaacuuuacc

SEQ ID NO: 3871644 - RNA, 22 nt, Human
uaacuuuuauaaacuuuaccuu

SEQ ID NO: 3871645 - RNA, 13 nt, Human
uaacuuuuuauau

SEQ ID NO: 3871646 - RNA, 15 nt, Human
uaacuuuuuauauuc

SEQ ID NO: 3871647 - RNA, 21 nt, Human
uaacuuuuuuucuucuacuuu

SEQ ID NO: 3871648 - RNA, 20 nt, Human
uaagaaaaaauaacacacau

SEQ ID NO: 3871649 - RNA, 15 nt, Human
uaagaaaaacuuuuu

SEQ ID NO: 3871650 - RNA, 19 nt, Human
uaagaaaaacuuuuuuggu

SEQ ID NO: 3871651 - RNA, 14 nt, Human
uaagaaaaaucaug

SEQ ID NO: 3871652 - RNA, 16 nt, Human
uaagaaaaaucauguu

SEQ ID NO: 3871653 - RNA, 20 nt, Human
uaagaaaacaaucacacuca

SEQ ID NO: 3871654 - RNA, 16 nt, Human
uaagaaaacaucacug

SEQ ID NO: 3871655 - RNA, 18 nt, Human
uaagaaaagagauauuuu

SEQ ID NO: 3871656 - RNA, 22 nt, Human
uaagaaaagagauauuuuaaaa

SEQ ID NO: 3871657 - RNA, 16 nt, Human
uaagaaaagauguaga

SEQ ID NO: 3871658 - RNA, 12 nt, Human
uaagaaaagauu

SEQ ID NO: 3871659 - RNA, 19 nt, Human
uaagaaaagauuuuaauca

SEQ ID NO: 3871660 - RNA, 20 nt, Human
uaagaaaaguauuuugaagu

SEQ ID NO: 3871661 - RNA, 21 nt, Human
uaagaaaaguauuuugaaguu

SEQ ID NO: 3871662 - RNA, 19 nt, Human
uaagaaaauagagaugagc

SEQ ID NO: 3871663 - RNA, 21 nt, Human
uaagaaaauagagaugagcuu

SEQ ID NO: 3871664 - RNA, 23 nt, Human
uaagaaaauauauucuuucaaag

SEQ ID NO: 3871665 - RNA, 21 nt, Human
uaagaaaauaucacuugucaa

SEQ ID NO: 3871666 - RNA, 17 nt, Human
uaagaaaauauuuuguc

SEQ ID NO: 3871667 - RNA, 20 nt, Human
uaagaaaauauuuugucuaa

SEQ ID NO: 3871668 - RNA, 23 nt, Human
uaagaaaaugcuagaagaaaaca

SEQ ID NO: 3871669 - RNA, 13 nt, Human
uaagaaacauugg

SEQ ID NO: 3871670 - RNA, 24 nt, Human
uaagaaacuuauuucucauaucaa

SEQ ID NO: 3871671 - RNA, 14 nt, Human
uaagaaacuuuugu

SEQ ID NO: 3871672 - RNA, 15 nt, Human
uaagaaacuuuugua

SEQ ID NO: 3871673 - RNA, 21 nt, Human
uaagaaacuuuuuuauuuaaa

SEQ ID NO: 3871674 - RNA, 14 nt, Human
uaagaaagacaucu

SEQ ID NO: 3871675 - RNA, 16 nt, Human
uaagaaagacaucuuu

SEQ ID NO: 3871676 - RNA, 17 nt, Human
uaagaaagccugaguac

SEQ ID NO: 3871677 - RNA, 22 nt, Human
uaagaaaggaagcauuguaaaa

SEQ ID NO: 3871678 - RNA, 18 nt, Human
uaagaaagugaagcaaau

SEQ ID NO: 3871679 - RNA, 16 nt, Human
uaagaaauaaaacugu

SEQ ID NO: 3871680 - RNA, 15 nt, Human
uaagaaauacagacu

SEQ ID NO: 3871681 - RNA, 19 nt, Human
uaagaaauaucugugaaau

SEQ ID NO: 3871682 - RNA, 16 nt, Human
uaagaaauaugugaga

SEQ ID NO: 3871683 - RNA, 17 nt, Human
uaagaaauaugugagau

SEQ ID NO: 3871684 - RNA, 17 nt, Human
uaagaaauugaauacuu

SEQ ID NO: 3871685 - RNA, 22 nt, Human
uaagaaauugaauacuuugaau

SEQ ID NO: 3871686 - RNA, 23 nt, Human
uaagaaauugaauacuuugaaug

SEQ ID NO: 3871687 - RNA, 17 nt, Human
uaagaaauuuugccuuu

SEQ ID NO: 3871688 - RNA, 17 nt, Human
uaagaacaaaagaagca

SEQ ID NO: 3871689 - RNA, 22 nt, Human
uaagaacaaagagaaaaaauac

SEQ ID NO: 3871690 - RNA, 15 nt, Human
uaagaacaccugcau

SEQ ID NO: 3871691 - RNA, 19 nt, Human
uaagaaccuuuugagugcc

SEQ ID NO: 3871692 - RNA, 16 nt, Human
uaagaacuaaaauguu

SEQ ID NO: 3871693 - RNA, 21 nt, Human
uaagaagaaaauugcugugcc

SEQ ID NO: 3871694 - RNA, 19 nt, Human
uaagaagagacugggaaga

SEQ ID NO: 3871695 - RNA, 23 nt, Human
uaagaagcacgugguaaaacacu

SEQ ID NO: 3871696 - RNA, 18 nt, Human
uaagaagcuguuguacau

SEQ ID NO: 3871697 - RNA, 18 nt, Human
uaagaaggcaaaaaugua

SEQ ID NO: 3871698 - RNA, 19 nt, Human
uaagaagggauggauucca

SEQ ID NO: 3871699 - RNA, 19 nt, Human
uaagaauaaaauguugaaa

SEQ ID NO: 3871700 - RNA, 20 nt, Human
uaagaauaaaauguugaaaa

SEQ ID NO: 3871701 - RNA, 15 nt, Human
uaagaauaaacauuu

SEQ ID NO: 3871702 - RNA, 17 nt, Human
uaagaauaauaaaauca

SEQ ID NO: 3871703 - RNA, 15 nt, Human
uaagaauaauuuaua

SEQ ID NO: 3871704 - RNA, 16 nt, Human
uaagaauacagcuuuc

SEQ ID NO: 3871705 - RNA, 19 nt, Human
uaagaauaucuguaauggu

SEQ ID NO: 3871706 - RNA, 21 nt, Human
uaagaaucagaguagaaauaa

SEQ ID NO: 3871707 - RNA, 21 nt, Human
uaagaaucauuguaaacauua

SEQ ID NO: 3871708 - RNA, 13 nt, Human
uaagaaugaaaua

SEQ ID NO: 3871709 - RNA, 13 nt, Human
uaagaaugaguuu

SEQ ID NO: 3871710 - RNA, 13 nt, Human
uaagaaugaucug

SEQ ID NO: 3871711 - RNA, 15 nt, Human
uaagaaugcugguuu

SEQ ID NO: 3871712 - RNA, 21 nt, Human
uaagaaugcugguuuuccuaa

SEQ ID NO: 3871713 - RNA, 19 nt, Human
uaagaauguugguuuacuu

SEQ ID NO: 3871714 - RNA, 15 nt, Human
uaagaauucagacau

SEQ ID NO: 3871715 - RNA, 20 nt, Human
uaagaauucugauugauuug

SEQ ID NO: 3871716 - RNA, 22 nt, Human
uaagaauugaccaucugcuuuu

SEQ ID NO: 3871717 - RNA, 16 nt, Human
uaagaauuugguaaau

SEQ ID NO: 3871718 - RNA, 15 nt, Human
uaagaauuuuuuauu

SEQ ID NO: 3871719 - RNA, 23 nt, Human
uaagaauuuuuuauuuuuuggua

SEQ ID NO: 3871720 - RNA, 13 nt, Human
uaagacaaauaug

SEQ ID NO: 3871721 - RNA, 14 nt, Human
uaagacacaaaugc

SEQ ID NO: 3871722 - RNA, 23 nt, Human
uaagacacugaaaaaucuaagug

SEQ ID NO: 3871723 - RNA, 14 nt, Human
uaagacacuuccgu

SEQ ID NO: 3871724 - RNA, 14 nt, Human
uaagacacuuuuug

SEQ ID NO: 3871725 - RNA, 17 nt, Human
uaagacagaguauccug

SEQ ID NO: 3871726 - RNA, 14 nt, Human
uaagacagcaugug

SEQ ID NO: 3871727 - RNA, 17 nt, Human
uaagacauaacguuuuu

SEQ ID NO: 3871728 - RNA, 20 nt, Human
uaagacauaacguuuuuccu

SEQ ID NO: 3871729 - RNA, 17 nt, Human
uaagacaugauuuccuu

SEQ ID NO: 3871730 - RNA, 18 nt, Human
uaagaccaccaccucaga

SEQ ID NO: 3871731 - RNA, 22 nt, Human
uaagaccaccucaaauuuaaag

SEQ ID NO: 3871732 - RNA, 22 nt, Human
uaagacccuuauugcuguccug

SEQ ID NO: 3871733 - RNA, 16 nt, Human
uaagaccggaagcucc

SEQ ID NO: 3871734 - RNA, 14 nt, Human
uaagaccuacuguu

SEQ ID NO: 3871735 - RNA, 18 nt, Human
uaagaccuacuguucuaa

SEQ ID NO: 3871736 - RNA, 20 nt, Human
uaagaccuacuguucuaaag

SEQ ID NO: 3871737 - RNA, 22 nt, Human
uaagaccuacuguucuaaagcu

SEQ ID NO: 3871738 - RNA, 15 nt, Human
uaagacguguuugug

SEQ ID NO: 3871739 - RNA, 20 nt, Human
uaagacuauauauauaaaug

SEQ ID NO: 3871740 - RNA, 23 nt, Human
uaagacuauauauauaaauguau

SEQ ID NO: 3871741 - RNA, 15 nt, Human
uaagacucaaauguu

SEQ ID NO: 3871742 - RNA, 19 nt, Human
uaagacucaaauguucuaa

SEQ ID NO: 3871743 - RNA, 21 nt, Human
uaagacucaaauguucuaagu

SEQ ID NO: 3871744 - RNA, 18 nt, Human
uaagacucauucccuaga

SEQ ID NO: 3871745 - RNA, 22 nt, Human
uaagacuccucggccuggcucc

SEQ ID NO: 3871746 - RNA, 21 nt, Human
uaagacucugucucaaaaaua

SEQ ID NO: 3871747 - RNA, 17 nt, Human
uaagacuguagauaugu

SEQ ID NO: 3871748 - RNA, 17 nt, Human
uaagacuugacagugga

SEQ ID NO: 3871749 - RNA, 20 nt, Human
uaagagaaaagagagaaaca

SEQ ID NO: 3871750 - RNA, 15 nt, Human
uaagagaaacuuuau

SEQ ID NO: 3871751 - RNA, 20 nt, Human
uaagagaaacuuuauacauu

SEQ ID NO: 3871752 - RNA, 15 nt, Human
uaagagaaauggcaa

SEQ ID NO: 3871753 - RNA, 18 nt, Human
uaagagaagcuacuuugu

SEQ ID NO: 3871754 - RNA, 12 nt, Human
uaagagaaguag

SEQ ID NO: 3871755 - RNA, 20 nt, Human
uaagagaaguagaaaucaua

SEQ ID NO: 3871756 - RNA, 23 nt, Human
uaagagacagaauguaucuguga

SEQ ID NO: 3871757 - RNA, 14 nt, Human
uaagagacucagcc

SEQ ID NO: 3871758 - RNA, 14 nt, Human
uaagagagaaaucu

SEQ ID NO: 3871759 - RNA, 13 nt, Human
uaagagagaauga

SEQ ID NO: 3871760 - RNA, 14 nt, Human
uaagagagaaugag

SEQ ID NO: 3871761 - RNA, 15 nt, Human
uaagagagagagaca

SEQ ID NO: 3871762 - RNA, 20 nt, Human
uaagagcaaaagaauggcag

SEQ ID NO: 3871763 - RNA, 16 nt, Human
uacaugccuaccaaua

SEQ ID NO: 3871764 - RNA, 18 nt, Human
uacaugcuaagagaagua

SEQ ID NO: 3871765 - RNA, 19 nt, Human
uacaugcuaagagaaguag

SEQ ID NO: 3871766 - RNA, 14 nt, Human
uacaugcugcuaau

SEQ ID NO: 3871767 - RNA, 15 nt, Human
uacaugcuuauucca

SEQ ID NO: 3871768 - RNA, 23 nt, Human
uacaugcuuauuccaugacugcu

SEQ ID NO: 3871769 - RNA, 16 nt, Human
uacaugcuuugugaac

SEQ ID NO: 3871770 - RNA, 22 nt, Human
uacauggaauaacauguaauua

SEQ ID NO: 3871771 - RNA, 22 nt, Human
uacauggcagaguuuguguguu

SEQ ID NO: 3871772 - RNA, 16 nt, Human
uacauggccaguguga

SEQ ID NO: 3871773 - RNA, 21 nt, Human
uacauggcuggagcuagaauu

SEQ ID NO: 3871774 - RNA, 17 nt, Human
uacauggugcugggaga

SEQ ID NO: 3871775 - RNA, 23 nt, Human
uacauggugcugggagaggcagc

SEQ ID NO: 3871776 - RNA, 13 nt, Human
uacauguaauuug

SEQ ID NO: 3871777 - RNA, 14 nt, Human
uacauguaauuuga

SEQ ID NO: 3871778 - RNA, 13 nt, Human
uacauguaguagu

SEQ ID NO: 3871779 - RNA, 20 nt, Human
uacauguauuaaauuacauu

SEQ ID NO: 3871780 - RNA, 23 nt, Human
uacauguauuaaauuacauuugu

SEQ ID NO: 3871781 - RNA, 21 nt, Human
uacauguauugcacauuguaa

SEQ ID NO: 3871782 - RNA, 13 nt, Human
uacauguauuugu

SEQ ID NO: 3871783 - RNA, 17 nt, Human
uacaugugauacauuuu

SEQ ID NO: 3871784 - RNA, 20 nt, Human
uacaugugcacauugugcag

SEQ ID NO: 3871785 - RNA, 17 nt, Human
uacaugugccgaaugug

SEQ ID NO: 3871786 - RNA, 14 nt, Human
uacauguguagccu

SEQ ID NO: 3871787 - RNA, 12 nt, Human
uacaugugugua

SEQ ID NO: 3871788 - RNA, 13 nt, Human
uacauguguguau

SEQ ID NO: 3871789 - RNA, 19 nt, Human
uacauguguguauauaugu

SEQ ID NO: 3871790 - RNA, 16 nt, Human
uacauguguguauaug

SEQ ID NO: 3871791 - RNA, 12 nt, Human
uacauuaaacau

SEQ ID NO: 3871792 - RNA, 15 nt, Human
uacauuaauguuaau

SEQ ID NO: 3871793 - RNA, 23 nt, Human
uacauuaauguuaauucagcacu

SEQ ID NO: 3871794 - RNA, 14 nt, Human
uacauuaguaaaug

SEQ ID NO: 3871795 - RNA, 20 nt, Human
uacauuaguaaaugucuuug

SEQ ID NO: 3871796 - RNA, 21 nt, Human
uacauuaguaaaugucuuugu

SEQ ID NO: 3871797 - RNA, 23 nt, Human
uacauuaguaaaugucuuuguaa

SEQ ID NO: 3871798 - RNA, 13 nt, Human
uacauuauaaacg

SEQ ID NO: 3871799 - RNA, 24 nt, Human
uacauuaucuaacugugcucaaga

SEQ ID NO: 3871800 - RNA, 13 nt, Human
uacauucaaauuu

SEQ ID NO: 3871801 - RNA, 18 nt, Human
uacauucaaauuugucug

SEQ ID NO: 3871802 - RNA, 15 nt, Human
uacauucauuuagcu

SEQ ID NO: 3871803 - RNA, 22 nt, Human
uacauugccguggcaucuuaaa

SEQ ID NO: 3871804 - RNA, 17 nt, Human
uacauugcuggucuugu

SEQ ID NO: 3871805 - RNA, 22 nt, Human
uacauugcuggucuuguaagag

SEQ ID NO: 3871806 - RNA, 17 nt, Human
uacauuguaaauaguau

SEQ ID NO: 3871807 - RNA, 22 nt, Human
uacauuguacgaagaguauuuu

SEQ ID NO: 3871808 - RNA, 18 nt, Human
uacauugucauuuauaua

SEQ ID NO: 3871809 - RNA, 23 nt, Human
uacauugugggauguucagcacu

SEQ ID NO: 3871810 - RNA, 13 nt, Human
uacauuguugagc

SEQ ID NO: 3871811 - RNA, 23 nt, Human
uacauuguuugucugucuucaua

SEQ ID NO: 3871812 - RNA, 13 nt, Human
uacauuuaaaauu

SEQ ID NO: 3871813 - RNA, 18 nt, Human
uacauuuaaaauugcuau

SEQ ID NO: 3871814 - RNA, 23 nt, Human
uacauuuaaaccuuuuauuauaa

SEQ ID NO: 3871815 - RNA, 18 nt, Human
uacauuuaaagcauugcu

SEQ ID NO: 3871816 - RNA, 20 nt, Human
uacauuuaaagcauugcugu

SEQ ID NO: 3871817 - RNA, 15 nt, Human
uacauuuaauacagc

SEQ ID NO: 3871818 - RNA, 17 nt, Human
uacauuuaauugagaag

SEQ ID NO: 3871819 - RNA, 18 nt, Human
uacauuuacaaacugaag

SEQ ID NO: 3871820 - RNA, 12 nt, Human
uacauuuauaau

SEQ ID NO: 3871821 - RNA, 20 nt, Human
uacauuuauaguuguaacua

SEQ ID NO: 3871822 - RNA, 12 nt, Human
uacauuuaugau

SEQ ID NO: 3871823 - RNA, 16 nt, Human
uacauuuaugauuuaa

SEQ ID NO: 3871824 - RNA, 17 nt, Human
uacauuuaugauuuaau

SEQ ID NO: 3871825 - RNA, 18 nt, Human
uacauuucacauuauucu

SEQ ID NO: 3871826 - RNA, 18 nt, Human
uacauuucuccuuugaua

SEQ ID NO: 3871827 - RNA, 14 nt, Human
uacauuucugaaau

SEQ ID NO: 3871828 - RNA, 21 nt, Human
uacauuugcuccauccuccug

SEQ ID NO: 3871829 - RNA, 19 nt, Human
uacauuugggaguuuuuau

SEQ ID NO: 3871830 - RNA, 16 nt, Human
uacauuuguauaaaau

SEQ ID NO: 3871831 - RNA, 23 nt, Human
uacauuuguauguugugaagaug

SEQ ID NO: 3871832 - RNA, 16 nt, Human
uacauuugugagauuc

SEQ ID NO: 3871833 - RNA, 13 nt, Human
uacauuuuacaca

SEQ ID NO: 3871834 - RNA, 18 nt, Human
uacauuuuacacacugua

SEQ ID NO: 3871835 - RNA, 12 nt, Human
uacauuuuaugg

SEQ ID NO: 3871836 - RNA, 15 nt, Human
uacauuuucuaagaa

SEQ ID NO: 3871837 - RNA, 19 nt, Human
uacauuuucuaagaaacau

SEQ ID NO: 3871838 - RNA, 14 nt, Human
uacauuuuguacca

SEQ ID NO: 3871839 - RNA, 21 nt, Human
uacauuuuguauauuuguauu

SEQ ID NO: 3871840 - RNA, 18 nt, Human
uacauuuuguuguaaaaa

SEQ ID NO: 3871841 - RNA, 22 nt, Human
uacauuuuguuguaaaaagaaa

SEQ ID NO: 3871842 - RNA, 14 nt, Human
uacauuuuuaagug

SEQ ID NO: 3871843 - RNA, 23 nt, Human
uacauuuuuaagugcugcauuua

SEQ ID NO: 3871844 - RNA, 19 nt, Human
uacauuuuuacaauaaaua

SEQ ID NO: 3871845 - RNA, 20 nt, Human
uacauuuuuugggcagcaau

SEQ ID NO: 3871846 - RNA, 22 nt, Human
uaccaaaaaucucaauauuuca

SEQ ID NO: 3871847 - RNA, 13 nt, Human
uaccaaaauuuua

SEQ ID NO: 3871848 - RNA, 12 nt, Human
uaccaaacagca

SEQ ID NO: 3871849 - RNA, 18 nt, Human
uaccaaaccgccagcgaa

SEQ ID NO: 3871850 - RNA, 19 nt, Human
uaccaaagugaccuaccca

SEQ ID NO: 3871851 - RNA, 15 nt, Human
uaccaaaguuuuauc

SEQ ID NO: 3871852 - RNA, 17 nt, Human
uaccaaaguuuuaucaa

SEQ ID NO: 3871853 - RNA, 18 nt, Human
uaccaaauagcuucuguu

SEQ ID NO: 3871854 - RNA, 23 nt, Human
uaccaaauuaaaaaaaaauugua

SEQ ID NO: 3871855 - RNA, 14 nt, Human
uaccaacuggaagc

SEQ ID NO: 3871856 - RNA, 12 nt, Human
uaccaacuuuac

SEQ ID NO: 3871857 - RNA, 12 nt, Human
uaccaacuuuca

SEQ ID NO: 3871858 - RNA, 17 nt, Human
uaccaacuuucuguaaa

SEQ ID NO: 3871859 - RNA, 18 nt, Human
uaccaaggucuucuuaau

SEQ ID NO: 3871860 - RNA, 14 nt, Human
uaccaagucaaacu

SEQ ID NO: 3871861 - RNA, 14 nt, Human
uaccaagugaaauu

SEQ ID NO: 3871862 - RNA, 21 nt, Human
uaccaaguuucagguauuaag

SEQ ID NO: 3871863 - RNA, 22 nt, Human
uaccaauagauuccccauugcc

SEQ ID NO: 3871864 - RNA, 23 nt, Human
uaccaauauuuaaucuuuuauga

SEQ ID NO: 3871865 - RNA, 13 nt, Human
uaccaaucauauu

SEQ ID NO: 3871866 - RNA, 22 nt, Human
uaccaaucauauuaauacaaug

SEQ ID NO: 3871867 - RNA, 19 nt, Human
uaccaaucauuuuaauuau

SEQ ID NO: 3871868 - RNA, 22 nt, Human
uaccaaucauuuuaauuauuau

SEQ ID NO: 3871869 - RNA, 14 nt, Human
uaccacagugucug

SEQ ID NO: 3871870 - RNA, 14 nt, Human
uaccaccccuuccu

SEQ ID NO: 3871871 - RNA, 14 nt, Human
uaccaccugacauu

SEQ ID NO: 3871872 - RNA, 16 nt, Human
uaccacgaaauacuua

SEQ ID NO: 3871873 - RNA, 18 nt, Human
uaccacggccuccuuucc

SEQ ID NO: 3871874 - RNA, 13 nt, Human
uaccacucuguaa

SEQ ID NO: 3871875 - RNA, 15 nt, Human
uaccacucuguaauu

SEQ ID NO: 3871876 - RNA, 16 nt, Human
uaccacugaaucugua

SEQ ID NO: 3871877 - RNA, 18 nt, Human
uaccacugaaucuguaca

SEQ ID NO: 3871878 - RNA, 22 nt, Human
uaccacugcugauauuuucucu

SEQ ID NO: 3871879 - RNA, 13 nt, Human
uaccagaaagcag

SEQ ID NO: 3871880 - RNA, 22 nt, Human
uaccagacgguucaccagccuc

SEQ ID NO: 3871881 - RNA, 23 nt, Human
uaccagacgguucaccagccucu

SEQ ID NO: 3871882 - RNA, 23 nt, Human
uaccagacuguguauucauugaa

SEQ ID NO: 3871883 - RNA, 15 nt, Human
uaccagauaaaauua

SEQ ID NO: 3871884 - RNA, 14 nt, Human
uaccagauaacuuu

SEQ ID NO: 3871885 - RNA, 18 nt, Human
uaccagaugaugggggag

SEQ ID NO: 3871886 - RNA, 21 nt, Human
uaccagcaagaauaaaaaaga

SEQ ID NO: 3871887 - RNA, 20 nt, Human
uaccagcagaaggauuuuuu

SEQ ID NO: 3871888 - RNA, 19 nt, Human
uaccagcccuggggcuggg

SEQ ID NO: 3871889 - RNA, 20 nt, Human
uaccagcccuggggcugggc

SEQ ID NO: 3871890 - RNA, 21 nt, Human
uaccagccuccguauuucaga

SEQ ID NO: 3871891 - RNA, 20 nt, Human
uaccagcgaggaggcuccag

SEQ ID NO: 3871892 - RNA, 17 nt, Human
uaccagcgcccgcuggg

SEQ ID NO: 3871893 - RNA, 13 nt, Human
uaccagcugcgcu

SEQ ID NO: 3871894 - RNA, 14 nt, Human
uaccagcugcgcuu

SEQ ID NO: 3871895 - RNA, 22 nt, Human
uaccaggccgccccagccucug

SEQ ID NO: 3871896 - RNA, 19 nt, Human
uaccagggacugaggggag

SEQ ID NO: 3871897 - RNA, 18 nt, Human
uaccaggucuccuccacc

SEQ ID NO: 3871898 - RNA, 15 nt, Human
uaccaguauuuagaa

SEQ ID NO: 3871899 - RNA, 18 nt, Human
uaccaguauuuagaagcc

SEQ ID NO: 3871900 - RNA, 14 nt, Human
uaccagucucacau

SEQ ID NO: 3871901 - RNA, 16 nt, Human
uaccagugaaccaaag

SEQ ID NO: 3871902 - RNA, 13 nt, Human
uaccagugaauuu

SEQ ID NO: 3871903 - RNA, 14 nt, Human
uaccagugaauuuu

SEQ ID NO: 3871904 - RNA, 14 nt, Human
uaccagugcaggcu

SEQ ID NO: 3871905 - RNA, 20 nt, Human
uaccagugcaggcuggccag

SEQ ID NO: 3871906 - RNA, 21 nt, Human
uaccagugcaggcuggccagc

SEQ ID NO: 3871907 - RNA, 13 nt, Human
uaguuuucuuguu

SEQ ID NO: 3871908 - RNA, 14 nt, Human
uaguuuucuuguug

SEQ ID NO: 3871909 - RNA, 18 nt, Human
uaguuuugugaaggugau

SEQ ID NO: 3871910 - RNA, 14 nt, Human
uaguuuuucauuaa

SEQ ID NO: 3871911 - RNA, 21 nt, Human
uaguuuuucauuaaauaaauu

SEQ ID NO: 3871912 - RNA, 10 nt, Human
uaguuuuugu

SEQ ID NO: 3871913 - RNA, 17 nt, Human
uaguuuuuucaucuuca

SEQ ID NO: 3871914 - RNA, 21 nt, Human
uaguuuuuucaucuucaguug

SEQ ID NO: 3871915 - RNA, 18 nt, Human
uaguuuuuucuuccuuuu

SEQ ID NO: 3871916 - RNA, 23 nt, Human
uaguuuuuucuuccuuuucacug

SEQ ID NO: 3871917 - RNA, 14 nt, Human
uauaaaaaaaauag

SEQ ID NO: 3871918 - RNA, 19 nt, Human
uauaaaaaaaaugaaaugu

SEQ ID NO: 3871919 - RNA, 22 nt, Human
uauaaaaaaucaugccaguauu

SEQ ID NO: 3871920 - RNA, 13 nt, Human
uauaaaaaauggu

SEQ ID NO: 3871921 - RNA, 16 nt, Human
uauaaaaaaugguuca

SEQ ID NO: 3871922 - RNA, 17 nt, Human
uauaaaaaaugguucag

SEQ ID NO: 3871923 - RNA, 20 nt, Human
uauaaaaaccccaaacuguu

SEQ ID NO: 3871924 - RNA, 23 nt, Human
uauaaaaagaaaagauaaagaug

SEQ ID NO: 3871925 - RNA, 18 nt, Human
uauaaaaagcuuccauga

SEQ ID NO: 3871926 - RNA, 19 nt, Human
uauaaaaauaaaaaacacu

SEQ ID NO: 3871927 - RNA, 21 nt, Human
uauaaaaauagauaauuaaaa

SEQ ID NO: 3871928 - RNA, 17 nt, Human
uauaaaacaggucaaua

SEQ ID NO: 3871929 - RNA, 22 nt, Human
uauaaaacugcguuaaaggcuc

SEQ ID NO: 3871930 - RNA, 16 nt, Human
uauaaaacuguacuuc

SEQ ID NO: 3871931 - RNA, 14 nt, Human
uauaaaagaaacac

SEQ ID NO: 3871932 - RNA, 18 nt, Human
uauaaaagacugucuuaa

SEQ ID NO: 3871933 - RNA, 11 nt, Human
uauaaaagaug

SEQ ID NO: 3871934 - RNA, 14 nt, Human
uauaaaagccuguu

SEQ ID NO: 3871935 - RNA, 19 nt, Human
uauaaaagccuguuuaaga

SEQ ID NO: 3871936 - RNA, 20 nt, Human
uauaaaagccuguuuaagag

SEQ ID NO: 3871937 - RNA, 18 nt, Human
uauaaaagcuauggugag

SEQ ID NO: 3871938 - RNA, 20 nt, Human
uauaaaaggcaaauguguac

SEQ ID NO: 3871939 - RNA, 22 nt, Human
uauaaaagugauuguuggcaca

SEQ ID NO: 3871940 - RNA, 12 nt, Human
uauaaaauacag

SEQ ID NO: 3871941 - RNA, 15 nt, Human
uauaaaauacauagu

SEQ ID NO: 3871942 - RNA, 12 nt, Human
uauaaaauagac

SEQ ID NO: 3871943 - RNA, 19 nt, Human
uauaaaauaguuguccaua

SEQ ID NO: 3871944 - RNA, 23 nt, Human
uauaaaauaugaagacauaaacc

SEQ ID NO: 3871945 - RNA, 15 nt, Human
uauaaaauauuuuca

SEQ ID NO: 3871946 - RNA, 20 nt, Human
uauaaaauggcaacaaacug

SEQ ID NO: 3871947 - RNA, 18 nt, Human
uauaaaauguaucaacac

SEQ ID NO: 3871948 - RNA, 16 nt, Human
uauaaaauuaaagaaa

SEQ ID NO: 3871949 - RNA, 15 nt, Human
uauaaaauuagaaag

SEQ ID NO: 3871950 - RNA, 18 nt, Human
uauaaaauuagaaagcaa

SEQ ID NO: 3871951 - RNA, 20 nt, Human
uauaaaauuaugagauuggu

SEQ ID NO: 3871952 - RNA, 15 nt, Human
uauaaacaagaaaaa

SEQ ID NO: 3871953 - RNA, 20 nt, Human
uauaaacaagaaaaauaaag

SEQ ID NO: 3871954 - RNA, 21 nt, Human
uauaaacaagaaaaauaaaga

SEQ ID NO: 3871955 - RNA, 22 nt, Human
uauaaacaagaaugaagguuuu

SEQ ID NO: 3871956 - RNA, 12 nt, Human
uauaaacacugu

SEQ ID NO: 3871957 - RNA, 13 nt, Human
uauaaacacuguu

SEQ ID NO: 3871958 - RNA, 17 nt, Human
uauaaacagaaauggaa

SEQ ID NO: 3871959 - RNA, 20 nt, Human
uauaaacagacaauauguga

SEQ ID NO: 3871960 - RNA, 14 nt, Human
uauaaacaucacac

SEQ ID NO: 3871961 - RNA, 22 nt, Human
uauaaacaugcuugcauuauau

SEQ ID NO: 3871962 - RNA, 18 nt, Human
uauaaaccgaacugaugu

SEQ ID NO: 3871963 - RNA, 15 nt, Human
uauaaaccuaaaaaa

SEQ ID NO: 3871964 - RNA, 20 nt, Human
uauaaaccuaaaaaagauau

SEQ ID NO: 3871965 - RNA, 23 nt, Human
uauaaacuuagugcggacaaguu

SEQ ID NO: 3871966 - RNA, 11 nt, Human
uauaaacuuua

SEQ ID NO: 3871967 - RNA, 15 nt, Human
uauaaacuuuaccuu

SEQ ID NO: 3871968 - RNA, 21 nt, Human
uauaaacuuuagaguagcaug

SEQ ID NO: 3871969 - RNA, 18 nt, Human
uauaaagaagaacuugca

SEQ ID NO: 3871970 - RNA, 12 nt, Human
uauaaagaauag

SEQ ID NO: 3871971 - RNA, 17 nt, Human
uauaaagagaaaauuga

SEQ ID NO: 3871972 - RNA, 18 nt, Human
uauaaagagaaaauugaa

SEQ ID NO: 3871973 - RNA, 21 nt, Human
uauaaagagaaaauugaauuu

SEQ ID NO: 3871974 - RNA, 19 nt, Human
uauaaagcaucuaaacuuu

SEQ ID NO: 3871975 - RNA, 12 nt, Human
uauaaagcauuu

SEQ ID NO: 3871976 - RNA, 22 nt, Human
uauaaagcgauauacagaugaa

SEQ ID NO: 3871977 - RNA, 21 nt, Human
uauaaaggaaaaaagagaagu

SEQ ID NO: 3871978 - RNA, 19 nt, Human
uauaaagggggagggaaau

SEQ ID NO: 3871979 - RNA, 21 nt, Human
uauaaagggggagggaaauag

SEQ ID NO: 3871980 - RNA, 15 nt, Human
uauaaaguauucuuu

SEQ ID NO: 3871981 - RNA, 18 nt, Human
uauaaaguauucuuuuuc

SEQ ID NO: 3871982 - RNA, 13 nt, Human
uauaaagugcuug

SEQ ID NO: 3871983 - RNA, 18 nt, Human
uauaaagugcuuguguaa

SEQ ID NO: 3871984 - RNA, 18 nt, Human
uauaaaguuuuauauauu

SEQ ID NO: 3871985 - RNA, 21 nt, Human
uauaaaguuuuauauauuaua

SEQ ID NO: 3871986 - RNA, 13 nt, Human
uauaaauaaauau

SEQ ID NO: 3871987 - RNA, 14 nt, Human
uauaaauaaauaua

SEQ ID NO: 3871988 - RNA, 16 nt, Human
uauaaauagaauguaa

SEQ ID NO: 3871989 - RNA, 19 nt, Human
uauaaauagaauguaaaug

SEQ ID NO: 3871990 - RNA, 10 nt, Human
uauaaauaua

SEQ ID NO: 3871991 - RNA, 13 nt, Human
uauaaauauauau

SEQ ID NO: 3871992 - RNA, 14 nt, Human
uauaaauauauaua

SEQ ID NO: 3871993 - RNA, 17 nt, Human
uauaaauauauauaaau

SEQ ID NO: 3871994 - RNA, 19 nt, Human
uauaaauauauauaaauau

SEQ ID NO: 3871995 - RNA, 15 nt, Human
uauaaauauauuuaa

SEQ ID NO: 3871996 - RNA, 15 nt, Human
uauaaaucaauguca

SEQ ID NO: 3871997 - RNA, 23 nt, Human
uauaaaucgcuuuugauaaucaa

SEQ ID NO: 3871998 - RNA, 13 nt, Human
uauaaaugagcaa

SEQ ID NO: 3871999 - RNA, 18 nt, Human
uauaaaugccaaagucuu

SEQ ID NO: 3872000 - RNA, 16 nt, Human
uauaaaugguguuuuu

SEQ ID NO: 3872001 - RNA, 19 nt, Human
uauaaauguauauacacau

SEQ ID NO: 3872002 - RNA, 11 nt, Human
uauaaaugucu

SEQ ID NO: 3872003 - RNA, 19 nt, Human
uauaaaugucuuuaaugca

SEQ ID NO: 3872004 - RNA, 12 nt, Human
uauaaaugugug

SEQ ID NO: 3872005 - RNA, 12 nt, Human
uauaaauuaaau

SEQ ID NO: 3872006 - RNA, 23 nt, Human
uauaaauuaaauauauguaugua

SEQ ID NO: 3872007 - RNA, 15 nt, Human
uauaaauuauauucc

SEQ ID NO: 3872008 - RNA, 14 nt, Human
uauaaauuauguuu

SEQ ID NO: 3872009 - RNA, 16 nt, Human
uauaaauuauguuuau

SEQ ID NO: 3872010 - RNA, 13 nt, Human
uauaaauucacuu

SEQ ID NO: 3872011 - RNA, 13 nt, Human
uauaaauucugug

SEQ ID NO: 3872012 - RNA, 17 nt, Human
uauaaauucuguggguc

SEQ ID NO: 3872013 - RNA, 22 nt, Human
uauaaauugucuuuaaaaacug

SEQ ID NO: 3872014 - RNA, 15 nt, Human
uauaaauuuauuuac

SEQ ID NO: 3872015 - RNA, 17 nt, Human
uauaaauuuuuuuuguu

SEQ ID NO: 3872016 - RNA, 21 nt, Human
uauaaauuuuuuuuguuucau

SEQ ID NO: 3872017 - RNA, 20 nt, Human
uauaacagauacauuucccu

SEQ ID NO: 3872018 - RNA, 12 nt, Human
uauaacagguua

SEQ ID NO: 3872019 - RNA, 13 nt, Human
uauaacagguuau

SEQ ID NO: 3872020 - RNA, 15 nt, Human
uauaacagguuauuu

SEQ ID NO: 3872021 - RNA, 16 nt, Human
uauaacaguguuuaaa

SEQ ID NO: 3872022 - RNA, 16 nt, Human
uauaaccaauguuuaa

SEQ ID NO: 3872023 - RNA, 20 nt, Human
uauaaccacaaagcacaguu

SEQ ID NO: 3872024 - RNA, 16 nt, Human
uauaaccagacacaua

SEQ ID NO: 3872025 - RNA, 20 nt, Human
uauaaccaguguuguggauu

SEQ ID NO: 3872026 - RNA, 16 nt, Human
uauaacccuguuacaa

SEQ ID NO: 3872027 - RNA, 19 nt, Human
uauaacccuguuacaaagc

SEQ ID NO: 3872028 - RNA, 17 nt, Human
uauaaccuaguuaaaga

SEQ ID NO: 3872029 - RNA, 22 nt, Human
uauaaccuaguuaaagaaagga

SEQ ID NO: 3872030 - RNA, 17 nt, Human
uauaacgugauacauuu

SEQ ID NO: 3872031 - RNA, 19 nt, Human
uauaacguguucaauauuu

SEQ ID NO: 3872032 - RNA, 14 nt, Human
uauaacuaacaugu

SEQ ID NO: 3872033 - RNA, 19 nt, Human
uauaacuauguugauaaaa

SEQ ID NO: 3872034 - RNA, 16 nt, Human
uauaacucaucauaaa

SEQ ID NO: 3872035 - RNA, 17 nt, Human
uauaacucaucauaaaa

SEQ ID NO: 3872036 - RNA, 18 nt, Human
uauaacucaucauaaaau

SEQ ID NO: 3872037 - RNA, 23 nt, Human
uauaacucugcacuacuccucug

SEQ ID NO: 3872038 - RNA, 20 nt, Human
uauaacugccuuaaaacuuu

SEQ ID NO: 3872039 - RNA, 17 nt, Human
uauaacuuauauuguaa

SEQ ID NO: 3872040 - RNA, 19 nt, Human
uauaacuuauauuguaaga

SEQ ID NO: 3872041 - RNA, 24 nt, Human
uauaacuuauauuguaagaaauac

SEQ ID NO: 3872042 - RNA, 13 nt, Human
uauaacuugucua

SEQ ID NO: 3872043 - RNA, 12 nt, Human
uauaacuuuuua

SEQ ID NO: 3872044 - RNA, 12 nt, Human
uauaagaaaaac

SEQ ID NO: 3872045 - RNA, 14 nt, Human
uauaagaaagacau

SEQ ID NO: 3872046 - RNA, 15 nt, Human
uauaagaaagccuga

SEQ ID NO: 3872047 - RNA, 17 nt, Human
uauaagaaaugcauaug

SEQ ID NO: 3872048 - RNA, 12 nt, Human
uauaagacucuc

SEQ ID NO: 3872049 - RNA, 22 nt, Human
uauaagagcuuccaauuuuccu

SEQ ID NO: 3872050 - RNA, 19 nt, Human
uauaagauccuagauccua

SEQ ID NO: 3872051 - RNA, 21 nt, Human
uauaagauccuagauccuaag

SEQ ID NO: 3872052 - RNA, 23 nt, Human
uauauaaaggaaaaaagagaagu

SEQ ID NO: 3872053 - RNA, 22 nt, Human
uauauaaauauauuauuacuug

SEQ ID NO: 3872054 - RNA, 12 nt, Human
uauauaaaugcu

SEQ ID NO: 3872055 - RNA, 15 nt, Human
uauauaaaugcuuuu

SEQ ID NO: 3872056 - RNA, 18 nt, Human
uauauaaaugguuaaaag

SEQ ID NO: 3872057 - RNA, 22 nt, Human
uauauaaauguaaaaauaauaa

SEQ ID NO: 3872058 - RNA, 17 nt, Human
uauauaacagauacauu

SEQ ID NO: 3872059 - RNA, 17 nt, Human
uauauaacauauaugga

SEQ ID NO: 3872060 - RNA, 13 nt, Human
uauauaagaaaga

SEQ ID NO: 3872061 - RNA, 14 nt, Human
uauauaagaaagac

SEQ ID NO: 3872062 - RNA, 18 nt, Human
uauauaagauggaagcuu

SEQ ID NO: 3872063 - RNA, 19 nt, Human
uauauaaguguacauaugu

SEQ ID NO: 3872064 - RNA, 23 nt, Human
uauauaaguguacauaugugcug

SEQ ID NO: 3872065 - RNA, 15 nt, Human
uauauaaugguuuca

SEQ ID NO: 3872066 - RNA, 19 nt, Human
uauauaaugguuucaaaga

SEQ ID NO: 3872067 - RNA, 17 nt, Human
uauauaauuauguuauu

SEQ ID NO: 3872068 - RNA, 16 nt, Human
uauauaauucuguaca

SEQ ID NO: 3872069 - RNA, 13 nt, Human
uauauaauugcca

SEQ ID NO: 3872070 - RNA, 14 nt, Human
uauauaauugccaa

SEQ ID NO: 3872071 - RNA, 16 nt, Human
uauauacaauaacaua

SEQ ID NO: 3872072 - RNA, 13 nt, Human
uauauacacacac

SEQ ID NO: 3872073 - RNA, 14 nt, Human
uauauacacauaua

SEQ ID NO: 3872074 - RNA, 18 nt, Human
uauauacacauauaccua

SEQ ID NO: 3872075 - RNA, 22 nt, Human
uauauacaguaacuuuaugugu

SEQ ID NO: 3872076 - RNA, 15 nt, Human
uauauacauauauau

SEQ ID NO: 3872077 - RNA, 16 nt, Human
uauauacauauguaga

SEQ ID NO: 3872078 - RNA, 13 nt, Human
uauauacaugugu

SEQ ID NO: 3872079 - RNA, 19 nt, Human
uauauaccugcgcuuguuu

SEQ ID NO: 3872080 - RNA, 18 nt, Human
uauauacgcaucuauaaa

SEQ ID NO: 3872081 - RNA, 21 nt, Human
uauauacuugugguuuucaaa

SEQ ID NO: 3872082 - RNA, 17 nt, Human
uauauagaaauauauac

SEQ ID NO: 3872083 - RNA, 13 nt, Human
uauauagagaugu

SEQ ID NO: 3872084 - RNA, 20 nt, Human
uauauagcaagacauuauau

SEQ ID NO: 3872085 - RNA, 18 nt, Human
uauauagcagcaaaaaua

SEQ ID NO: 3872086 - RNA, 21 nt, Human
uauauagcaucuggaagauca

SEQ ID NO: 3872087 - RNA, 21 nt, Human
uauauagccaauauaacuauc

SEQ ID NO: 3872088 - RNA, 23 nt, Human
uauauaggcuauuuucuaaagac

SEQ ID NO: 3872089 - RNA, 17 nt, Human
uauauagguugugcaaa

SEQ ID NO: 3872090 - RNA, 12 nt, Human
uauauagguuuu

SEQ ID NO: 3872091 - RNA, 20 nt, Human
uauauagguuuuguuugcua

SEQ ID NO: 3872092 - RNA, 12 nt, Human
uauauauaaaga

SEQ ID NO: 3872093 - RNA, 13 nt, Human
uauauauaaauaa

SEQ ID NO: 3872094 - RNA, 14 nt, Human
uauauauaaauaaa

SEQ ID NO: 3872095 - RNA, 13 nt, Human
uauauauaaaugu

SEQ ID NO: 3872096 - RNA, 15 nt, Human
uauauauaagaaaga

SEQ ID NO: 3872097 - RNA, 20 nt, Human
uauauauaaucaucaaguaa

SEQ ID NO: 3872098 - RNA, 16 nt, Human
uauauauaauucugua

SEQ ID NO: 3872099 - RNA, 19 nt, Human
uauauauaauucuguacau

SEQ ID NO: 3872100 - RNA, 19 nt, Human
uauauauacauaacagggu

SEQ ID NO: 3872101 - RNA, 14 nt, Human
uauauauacauaca

SEQ ID NO: 3872102 - RNA, 15 nt, Human
uauauauacauauau

SEQ ID NO: 3872103 - RNA, 15 nt, Human
uauauauacauaugu

SEQ ID NO: 3872104 - RNA, 16 nt, Human
uauauauagcagcuuu

SEQ ID NO: 3872105 - RNA, 11 nt, Human
uauauauauaa

SEQ ID NO: 3872106 - RNA, 14 nt, Human
uauauauauaaaca

SEQ ID NO: 3872107 - RNA, 14 nt, Human
uauauauauaaaug

SEQ ID NO: 3872108 - RNA, 15 nt, Human
uauauauauacacac

SEQ ID NO: 3872109 - RNA, 11 nt, Human
uauauauauau

SEQ ID NO: 3872110 - RNA, 13 nt, Human
uauauauauauaa

SEQ ID NO: 3872111 - RNA, 14 nt, Human
uauauauauauaaa

SEQ ID NO: 3872112 - RNA, 15 nt, Human
uauauauauauacuu

SEQ ID NO: 3872113 - RNA, 13 nt, Human
uauauauauauau

SEQ ID NO: 3872114 - RNA, 11 nt, Human
uauauauauca

SEQ ID NO: 3872115 - RNA, 14 nt, Human
uauauauaugcaua

SEQ ID NO: 3872116 - RNA, 14 nt, Human
uauauaucaguuug

SEQ ID NO: 3872117 - RNA, 18 nt, Human
uauauaucugcuguccag

SEQ ID NO: 3872118 - RNA, 21 nt, Human
uauauaucugcuguccagaca

SEQ ID NO: 3872119 - RNA, 13 nt, Human
uauauaugaaaac

SEQ ID NO: 3872120 - RNA, 15 nt, Human
uauauaugaaaacua

SEQ ID NO: 3872121 - RNA, 16 nt, Human
uauauaugaaaacuau

SEQ ID NO: 3872122 - RNA, 15 nt, Human
uauauaugccuuuuu

SEQ ID NO: 3872123 - RNA, 16 nt, Human
uauauauguguauaua

SEQ ID NO: 3872124 - RNA, 19 nt, Human
uauauauguguauauauac

SEQ ID NO: 3872125 - RNA, 16 nt, Human
uauauauguguaugua

SEQ ID NO: 3872126 - RNA, 18 nt, Human
uauauauguguguuuaaa

SEQ ID NO: 3872127 - RNA, 19 nt, Human
uauauauguugauuucuug

SEQ ID NO: 3872128 - RNA, 17 nt, Human
uauauauuauauggaaa

SEQ ID NO: 3872129 - RNA, 22 nt, Human
uauauauugguaacauccuuuc

SEQ ID NO: 3872130 - RNA, 15 nt, Human
uauauauuuauaacu

SEQ ID NO: 3872131 - RNA, 17 nt, Human
uauauauuucuauuauu

SEQ ID NO: 3872132 - RNA, 19 nt, Human
uauauauuuuuuucugaaa

SEQ ID NO: 3872133 - RNA, 22 nt, Human
uauaucaacagauaguuguguu

SEQ ID NO: 3872134 - RNA, 13 nt, Human
uauaucacccaga

SEQ ID NO: 3872135 - RNA, 18 nt, Human
uauaucagaaaagggaag

SEQ ID NO: 3872136 - RNA, 15 nt, Human
uauaucagacugcuu

SEQ ID NO: 3872137 - RNA, 21 nt, Human
uauaucagacugcuuugagaa

SEQ ID NO: 3872138 - RNA, 15 nt, Human
uauaucagccugagu

SEQ ID NO: 3872139 - RNA, 17 nt, Human
uauaucauucuaaagau

SEQ ID NO: 3872140 - RNA, 16 nt, Human
uauauccauguacugu

SEQ ID NO: 3872141 - RNA, 14 nt, Human
uauauccugugacu

SEQ ID NO: 3872142 - RNA, 18 nt, Human
uauauccugugacugucu

SEQ ID NO: 3872143 - RNA, 16 nt, Human
uauauccuuucuaaca

SEQ ID NO: 3872144 - RNA, 20 nt, Human
uauaucuauaaacacuguuu

SEQ ID NO: 3872145 - RNA, 19 nt, Human
uauaucuaucuauuugagg

SEQ ID NO: 3872146 - RNA, 19 nt, Human
uauaucucaaauuguaauu

SEQ ID NO: 3872147 - RNA, 12 nt, Human
uauaucuccuuu

SEQ ID NO: 3872148 - RNA, 16 nt, Human
uauaucuccuuuguau

SEQ ID NO: 3872149 - RNA, 15 nt, Human
uauaucucuauuuga

SEQ ID NO: 3872150 - RNA, 12 nt, Human
uauaucugaaaa

SEQ ID NO: 3872151 - RNA, 17 nt, Human
uauaucugaaaacugga

SEQ ID NO: 3872152 - RNA, 18 nt, Human
uauaucugaaaacuggaa

SEQ ID NO: 3872153 - RNA, 13 nt, Human
uauaucugcaaaa

SEQ ID NO: 3872154 - RNA, 17 nt, Human
uauaucugcuguccaga

SEQ ID NO: 3872155 - RNA, 16 nt, Human
uauaucugcuucagug

SEQ ID NO: 3872156 - RNA, 13 nt, Human
uauaucuggccuc

SEQ ID NO: 3872157 - RNA, 15 nt, Human
uauaucuguauguau

SEQ ID NO: 3872158 - RNA, 12 nt, Human
uauaugaaaacu

SEQ ID NO: 3872159 - RNA, 13 nt, Human
uauaugaacauag

SEQ ID NO: 3872160 - RNA, 18 nt, Human
uauaugaagaaaaucacu

SEQ ID NO: 3872161 - RNA, 16 nt, Human
uauaugaauaaagugu

SEQ ID NO: 3872162 - RNA, 21 nt, Human
uauaugauuuauaguuuguac

SEQ ID NO: 3872163 - RNA, 17 nt, Human
uauaugauuuuuaucca

SEQ ID NO: 3872164 - RNA, 21 nt, Human
uauaugcacuuauaauuuucc

SEQ ID NO: 3872165 - RNA, 18 nt, Human
uauaugccuuuuuccuag

SEQ ID NO: 3872166 - RNA, 14 nt, Human
uauaugcuuacuga

SEQ ID NO: 3872167 - RNA, 14 nt, Human
uauauggaaauaua

SEQ ID NO: 3872168 - RNA, 19 nt, Human
uauauggaaauauauauua

SEQ ID NO: 3872169 - RNA, 15 nt, Human
uauauggacauggca

SEQ ID NO: 3872170 - RNA, 13 nt, Human
uauauggauaaug

SEQ ID NO: 3872171 - RNA, 19 nt, Human
uauauggaugauucagaaa

SEQ ID NO: 3872172 - RNA, 18 nt, Human
uauauggcagaguuguaa

SEQ ID NO: 3872173 - RNA, 15 nt, Human
uauauggcauuugca

SEQ ID NO: 3872174 - RNA, 21 nt, Human
uauauggggaugguaguuuuu

SEQ ID NO: 3872175 - RNA, 15 nt, Human
uauaugguauauaua

SEQ ID NO: 3872176 - RNA, 18 nt, Human
uauaugguauauauacau

SEQ ID NO: 3872177 - RNA, 15 nt, Human
uauauggucuaaugu

SEQ ID NO: 3872178 - RNA, 12 nt, Human
uauauguacaug

SEQ ID NO: 3872179 - RNA, 18 nt, Human
uauauguacccucugaaa

SEQ ID NO: 3872180 - RNA, 19 nt, Human
uauauguaccguaggcuuu

SEQ ID NO: 3872181 - RNA, 15 nt, Human
uauauguagauguau

SEQ ID NO: 3872182 - RNA, 18 nt, Human
uauauguagauguaugca

SEQ ID NO: 3872183 - RNA, 20 nt, Human
uauauguagauguaugcaca

SEQ ID NO: 3872184 - RNA, 12 nt, Human
uauauguaugua

SEQ ID NO: 3872185 - RNA, 16 nt, Human
uauauguauguaaaaa

SEQ ID NO: 3872186 - RNA, 16 nt, Human
uauauguauguguuua

SEQ ID NO: 3872187 - RNA, 22 nt, Human
uauauguauguguuuagaauug

SEQ ID NO: 3872188 - RNA, 11 nt, Human
uauauguauuu

SEQ ID NO: 3872189 - RNA, 20 nt, Human
uauauguauuuaaaaaaauc

SEQ ID NO: 3872190 - RNA, 12 nt, Human
uauaugugagga

SEQ ID NO: 3872191 - RNA, 16 nt, Human
uauaugugaugaucua

SEQ ID NO: 3872192 - RNA, 17 nt, Human
uauauguguauauauac

SEQ ID NO: 3872193 - RNA, 14 nt, Human
uauaugugugccua

SEQ ID NO: 3872194 - RNA, 16 nt, Human
uauauguguguuuaaa

SEQ ID NO: 3872195 - RNA, 22 nt, Human
uauauguguguuuaaauaaagu

SEQ ID NO: 3872196 - RNA, 23 nt, Human
uauauguguguuuaaauaaagua

SEQ ID NO: 3872197 - RNA, 15 nt, Human
uauauguguugaaaa

SEQ ID NO: 3872198 - RNA, 16 nt, Human
uauauguguugaaaac

SEQ ID NO: 3872199 - RNA, 13 nt, Human
uaucuacucuccu

SEQ ID NO: 3872200 - RNA, 21 nt, Human
uaucuacucuccucaucucua

SEQ ID NO: 3872201 - RNA, 15 nt, Human
uaucuagauacugua

SEQ ID NO: 3872202 - RNA, 17 nt, Human
uaucuagguuuaugaca

SEQ ID NO: 3872203 - RNA, 23 nt, Human
uaucuaguaauauauuuaaaggg

SEQ ID NO: 3872204 - RNA, 16 nt, Human
uaucuaguaugaaauu

SEQ ID NO: 3872205 - RNA, 23 nt, Human
uaucuagugcagcugauuuuaac

SEQ ID NO: 3872206 - RNA, 18 nt, Human
uaucuaguucuaacagug

SEQ ID NO: 3872207 - RNA, 17 nt, Human
uaucuaguuuaauuaau

SEQ ID NO: 3872208 - RNA, 22 nt, Human
uaucuauaaaauagauauaaau

SEQ ID NO: 3872209 - RNA, 13 nt, Human
uaucuauaauuua

SEQ ID NO: 3872210 - RNA, 18 nt, Human
uaucuauacauaucuuua

SEQ ID NO: 3872211 - RNA, 23 nt, Human
uaucuauauaguaccuuugcucu

SEQ ID NO: 3872212 - RNA, 20 nt, Human
uaucuauauauaauucugua

SEQ ID NO: 3872213 - RNA, 15 nt, Human
uaucuauauaugugu

SEQ ID NO: 3872214 - RNA, 23 nt, Human
uaucuauauuuuacauaaauuua

SEQ ID NO: 3872215 - RNA, 23 nt, Human
uaucuaucuuccaaaugcaauuu

SEQ ID NO: 3872216 - RNA, 16 nt, Human
uaucuauguuuuacca

SEQ ID NO: 3872217 - RNA, 17 nt, Human
uaucuauuaauauaugu

SEQ ID NO: 3872218 - RNA, 15 nt, Human
uaucuauuguaagau

SEQ ID NO: 3872219 - RNA, 12 nt, Human
uaucuauuugag

SEQ ID NO: 3872220 - RNA, 10 nt, Human
uaucucagaa

SEQ ID NO: 3872221 - RNA, 13 nt, Human
uaucucagaaagu

SEQ ID NO: 3872222 - RNA, 19 nt, Human
uaucucagaaagugccuga

SEQ ID NO: 3872223 - RNA, 19 nt, Human
uaucucagauauuugcacc

SEQ ID NO: 3872224 - RNA, 16 nt, Human
uaucucagauguuaaa

SEQ ID NO: 3872225 - RNA, 19 nt, Human
uaucucagauguuaaaaua

SEQ ID NO: 3872226 - RNA, 13 nt, Human
uaucucagggccu

SEQ ID NO: 3872227 - RNA, 22 nt, Human
uaucucagucaugcauaaauau

SEQ ID NO: 3872228 - RNA, 23 nt, Human
uaucuccaggauugaagagcauu

SEQ ID NO: 3872229 - RNA, 14 nt, Human
uaucuccggcuccc

SEQ ID NO: 3872230 - RNA, 19 nt, Human
uaucuccggcucccagccu

SEQ ID NO: 3872231 - RNA, 16 nt, Human
uaucuccuagggcuau

SEQ ID NO: 3872232 - RNA, 16 nt, Human
uaucucgugggagagc

SEQ ID NO: 3872233 - RNA, 18 nt, Human
uaucucuauuuaauauuu

SEQ ID NO: 3872234 - RNA, 20 nt, Human
uaucucuauuuaauauuuau

SEQ ID NO: 3872235 - RNA, 18 nt, Human
uaucucugugugcacaaa

SEQ ID NO: 3872236 - RNA, 13 nt, Human
uaucucuucaguc

SEQ ID NO: 3872237 - RNA, 22 nt, Human
uaucucuuuugaauccaugcuu

SEQ ID NO: 3872238 - RNA, 23 nt, Human
uaucucuuuugaauccaugcuug

SEQ ID NO: 3872239 - RNA, 12 nt, Human
uaucugaaaacu

SEQ ID NO: 3872240 - RNA, 14 nt, Human
uaucugaaaaugua

SEQ ID NO: 3872241 - RNA, 17 nt, Human
uaucugaagucagaucu

SEQ ID NO: 3872242 - RNA, 20 nt, Human
uaucugaauuuuuaaacaag

SEQ ID NO: 3872243 - RNA, 15 nt, Human
uaucugaggaauucu

SEQ ID NO: 3872244 - RNA, 22 nt, Human
uaucugaggaauucuguauaga

SEQ ID NO: 3872245 - RNA, 17 nt, Human
uaucugcaggcagacac

SEQ ID NO: 3872246 - RNA, 16 nt, Human
uaucugccucucuugu

SEQ ID NO: 3872247 - RNA, 21 nt, Human
uaucugccucucuuguaauuu

SEQ ID NO: 3872248 - RNA, 13 nt, Human
uaucugcugucca

SEQ ID NO: 3872249 - RNA, 17 nt, Human
uaucugcuguccagaca

SEQ ID NO: 3872250 - RNA, 19 nt, Human
uaucuggaaguaaccauuu

SEQ ID NO: 3872251 - RNA, 18 nt, Human
uaucuggacaagccaacu

SEQ ID NO: 3872252 - RNA, 18 nt, Human
uaucuggauucaaauuua

SEQ ID NO: 3872253 - RNA, 14 nt, Human
uaucugggccuggg

SEQ ID NO: 3872254 - RNA, 16 nt, Human
uaucugggccugggcu

SEQ ID NO: 3872255 - RNA, 23 nt, Human
uaucuguagugagauagcauugu

SEQ ID NO: 3872256 - RNA, 15 nt, Human
uaucuguauuuaauu

SEQ ID NO: 3872257 - RNA, 17 nt, Human
uaucuguauuuaauuuu

SEQ ID NO: 3872258 - RNA, 20 nt, Human
uaucugucauuugagcaggg

SEQ ID NO: 3872259 - RNA, 21 nt, Human
uaucugucauuugagcagggc

SEQ ID NO: 3872260 - RNA, 23 nt, Human
uaucugucauuugagcagggcuc

SEQ ID NO: 3872261 - RNA, 12 nt, Human
uaucugucuuuc

SEQ ID NO: 3872262 - RNA, 15 nt, Human
uaucugucuuuccac

SEQ ID NO: 3872263 - RNA, 18 nt, Human
uaucugugcgugaaacac

SEQ ID NO: 3872264 - RNA, 19 nt, Human
uaucugugcgugaaacaca

SEQ ID NO: 3872265 - RNA, 20 nt, Human
uaucugugcgugaaacacac

SEQ ID NO: 3872266 - RNA, 14 nt, Human
uaucuguucuuuaa

SEQ ID NO: 3872267 - RNA, 22 nt, Human
uaucuguuuccugacauugucu

SEQ ID NO: 3872268 - RNA, 14 nt, Human
uaucuguuuuacug

SEQ ID NO: 3872269 - RNA, 18 nt, Human
uaucuguuuuacugcuuu

SEQ ID NO: 3872270 - RNA, 18 nt, Human
uaucuuaaagaaacagcu

SEQ ID NO: 3872271 - RNA, 23 nt, Human
uaucuuaaagaaacagcuuucaa

SEQ ID NO: 3872272 - RNA, 13 nt, Human
uaucuuaauuuug

SEQ ID NO: 3872273 - RNA, 19 nt, Human
uaucuuacaaaguguauuu

SEQ ID NO: 3872274 - RNA, 13 nt, Human
uaucuuacgaaaa

SEQ ID NO: 3872275 - RNA, 22 nt, Human
uaucuuauaaaguggaaguaug

SEQ ID NO: 3872276 - RNA, 18 nt, Human
uaucuuauacuguacaau

SEQ ID NO: 3872277 - RNA, 12 nt, Human
uaucuucacaua

SEQ ID NO: 3872278 - RNA, 10 nt, Human
uaucuucauc

SEQ ID NO: 3872279 - RNA, 23 nt, Human
uaucuucauguaaauugacugua

SEQ ID NO: 3872280 - RNA, 20 nt, Human
uaucuucguuaguaaucugu

SEQ ID NO: 3872281 - RNA, 17 nt, Human
uaucuucguucuuguua

SEQ ID NO: 3872282 - RNA, 15 nt, Human
uaucuucucaaguuc

SEQ ID NO: 3872283 - RNA, 22 nt, Human
uaucuucucaaguucuaagauu

SEQ ID NO: 3872284 - RNA, 14 nt, Human
uaucuugaagacuu

SEQ ID NO: 3872285 - RNA, 15 nt, Human
uaucuugaagacuuu

SEQ ID NO: 3872286 - RNA, 17 nt, Human
uaucuuggacugacauu

SEQ ID NO: 3872287 - RNA, 16 nt, Human
uaucuuggcagguagg

SEQ ID NO: 3872288 - RNA, 11 nt, Human
uaucuuggccu

SEQ ID NO: 3872289 - RNA, 15 nt, Human
uaucuugucucuggg

SEQ ID NO: 3872290 - RNA, 13 nt, Human
uaucuuguguugu

SEQ ID NO: 3872291 - RNA, 16 nt, Human
uaucuuguguuguccu

SEQ ID NO: 3872292 - RNA, 19 nt, Human
uaucuuucgcacagcaguu

SEQ ID NO: 3872293 - RNA, 23 nt, Human
uaucuuucgugauaaacuuugcu

SEQ ID NO: 3872294 - RNA, 15 nt, Human
uaucuuugaauaugu

SEQ ID NO: 3872295 - RNA, 22 nt, Human
uaucuuugauucuccuucagcc

SEQ ID NO: 3872296 - RNA, 11 nt, Human
uaucuuugcca

SEQ ID NO: 3872297 - RNA, 18 nt, Human
uaucuuugugauaauuua

SEQ ID NO: 3872298 - RNA, 14 nt, Human
uaucuuuuauguuu

SEQ ID NO: 3872299 - RNA, 19 nt, Human
uaucuuuuauguuugaaua

SEQ ID NO: 3872300 - RNA, 13 nt, Human
uaucuuuucuaca

SEQ ID NO: 3872301 - RNA, 14 nt, Human
uaucuuuucuacag

SEQ ID NO: 3872302 - RNA, 19 nt, Human
uaucuuuucuacagcaaau

SEQ ID NO: 3872303 - RNA, 13 nt, Human
uaucuuuucuuua

SEQ ID NO: 3872304 - RNA, 14 nt, Human
uaucuuuucuuuag

SEQ ID NO: 3872305 - RNA, 20 nt, Human
uaucuuuucuuuagagaacu

SEQ ID NO: 3872306 - RNA, 17 nt, Human
uaucuuuuguuuccuuu

SEQ ID NO: 3872307 - RNA, 22 nt, Human
uaucuuuuguuuccuuuuuucc

SEQ ID NO: 3872308 - RNA, 18 nt, Human
uaucuuuuuauugaugug

SEQ ID NO: 3872309 - RNA, 19 nt, Human
uaucuuuuuauugaugugc

SEQ ID NO: 3872310 - RNA, 15 nt, Human
uaucuuuuuucaaaa

SEQ ID NO: 3872311 - RNA, 18 nt, Human
uaugaaaaacaaaaauaa

SEQ ID NO: 3872312 - RNA, 18 nt, Human
uaugaaaaauaugauauu

SEQ ID NO: 3872313 - RNA, 19 nt, Human
uaugaaaaauuggggagga

SEQ ID NO: 3872314 - RNA, 16 nt, Human
uaugaaaacuauacaa

SEQ ID NO: 3872315 - RNA, 15 nt, Human
uaugaaaacuuauga

SEQ ID NO: 3872316 - RNA, 19 nt, Human
uaugaaaagcuagaauuga

SEQ ID NO: 3872317 - RNA, 14 nt, Human
uaugaaaauggaaa

SEQ ID NO: 3872318 - RNA, 22 nt, Human
uaugaaagauggcugugccucu

SEQ ID NO: 3872319 - RNA, 23 nt, Human
uaugaaagauggcugugccucug

SEQ ID NO: 3872320 - RNA, 14 nt, Human
uaugaaagauugug

SEQ ID NO: 3872321 - RNA, 13 nt, Human
uaugaaauaaaga

SEQ ID NO: 3872322 - RNA, 17 nt, Human
uaugaaaugugcacuuu

SEQ ID NO: 3872323 - RNA, 19 nt, Human
uaugaaauuauauaaguau

SEQ ID NO: 3872324 - RNA, 17 nt, Human
uaugaacacuuaaauua

SEQ ID NO: 3872325 - RNA, 18 nt, Human
uaugaacccuuuguuucu

SEQ ID NO: 3872326 - RNA, 19 nt, Human
uaugaacccuuuguuucuu

SEQ ID NO: 3872327 - RNA, 22 nt, Human
uaugaacuugaggacacauguc

SEQ ID NO: 3872328 - RNA, 13 nt, Human
uaugaagaaaaaa

SEQ ID NO: 3872329 - RNA, 20 nt, Human
uaugaagaaaaaauacauuu

SEQ ID NO: 3872330 - RNA, 16 nt, Human
uaugaagaacugagga

SEQ ID NO: 3872331 - RNA, 17 nt, Human
uaugaagaacugaggag

SEQ ID NO: 3872332 - RNA, 15 nt, Human
uaugaagaagagagu

SEQ ID NO: 3872333 - RNA, 21 nt, Human
uaugaagaaggugaauagcca

SEQ ID NO: 3872334 - RNA, 14 nt, Human
uaugaagacauaaa

SEQ ID NO: 3872335 - RNA, 21 nt, Human
uaugaagcuaccucaaacuuc

SEQ ID NO: 3872336 - RNA, 14 nt, Human
uaugaaguaaagaa

SEQ ID NO: 3872337 - RNA, 22 nt, Human
uaugaaguuuaaaacaguauuu

SEQ ID NO: 3872338 - RNA, 20 nt, Human
uaugaaguuuuuuuuauaca

SEQ ID NO: 3872339 - RNA, 18 nt, Human
uaugaauaaagacaccua

SEQ ID NO: 3872340 - RNA, 15 nt, Human
uaugaauacagcagc

SEQ ID NO: 3872341 - RNA, 22 nt, Human
uaugaauacagcagcaagaaaa

SEQ ID NO: 3872342 - RNA, 12 nt, Human
uaugaauacagg

SEQ ID NO: 3872343 - RNA, 16 nt, Human
uaugaauacagggcau

SEQ ID NO: 3872344 - RNA, 17 nt, Human
ucaacauuuacauguau

SEQ ID NO: 3872345 - RNA, 17 nt, Human
ucaacauuucucauguu

SEQ ID NO: 3872346 - RNA, 17 nt, Human
ucaaccaaaugguacaa

SEQ ID NO: 3872347 - RNA, 17 nt, Human
ucaaccaaugccaaaaa

SEQ ID NO: 3872348 - RNA, 12 nt, Human
ucaaccacaaaa

SEQ ID NO: 3872349 - RNA, 13 nt, Human
ucaaccagacaga

SEQ ID NO: 3872350 - RNA, 22 nt, Human
ucaaccagacagagggucacag

SEQ ID NO: 3872351 - RNA, 15 nt, Human
ucaaccauggacuuu

SEQ ID NO: 3872352 - RNA, 15 nt, Human
ucaaccauuccccau

SEQ ID NO: 3872353 - RNA, 14 nt, Human
ucaacccagaaaca

SEQ ID NO: 3872354 - RNA, 15 nt, Human
ucaacccagaaacac

SEQ ID NO: 3872355 - RNA, 23 nt, Human
ucaacccaggagcauccaccucc

SEQ ID NO: 3872356 - RNA, 13 nt, Human
ucaaccccacccu

SEQ ID NO: 3872357 - RNA, 20 nt, Human
ucaaccccuucgcuccugug

SEQ ID NO: 3872358 - RNA, 23 nt, Human
ucaaccccuucgcuccugugucu

SEQ ID NO: 3872359 - RNA, 17 nt, Human
ucaacccucccucagcc

SEQ ID NO: 3872360 - RNA, 20 nt, Human
ucaacccucccucagccccu

SEQ ID NO: 3872361 - RNA, 16 nt, Human
ucaacccuucuggaaa

SEQ ID NO: 3872362 - RNA, 20 nt, Human
ucaacccuuugccccaccuu

SEQ ID NO: 3872363 - RNA, 20 nt, Human
ucaaccuacuuucauacuga

SEQ ID NO: 3872364 - RNA, 11 nt, Human
ucaaccucauc

SEQ ID NO: 3872365 - RNA, 14 nt, Human
ucaaccuccugggc

SEQ ID NO: 3872366 - RNA, 15 nt, Human
ucaaccuccugggcu

SEQ ID NO: 3872367 - RNA, 21 nt, Human
ucaaccucgcgcuugcuggcc

SEQ ID NO: 3872368 - RNA, 17 nt, Human
ucaaccucuucuggcuc

SEQ ID NO: 3872369 - RNA, 13 nt, Human
ucaaccugccuga

SEQ ID NO: 3872370 - RNA, 17 nt, Human
ucaaccugggcaaagcc

SEQ ID NO: 3872371 - RNA, 17 nt, Human
ucaaccuguaaauuauu

SEQ ID NO: 3872372 - RNA, 18 nt, Human
ucaaccuguaaauuauuu

SEQ ID NO: 3872373 - RNA, 20 nt, Human
ucaaccugugaugaggggag

SEQ ID NO: 3872374 - RNA, 23 nt, Human
ucaaccuuaagaccuacuguucu

SEQ ID NO: 3872375 - RNA, 16 nt, Human
ucaaccuugagacagc

SEQ ID NO: 3872376 - RNA, 17 nt, Human
ucaaccuugagacagcu

SEQ ID NO: 3872377 - RNA, 18 nt, Human
ucaaccuugagacagcuu

SEQ ID NO: 3872378 - RNA, 18 nt, Human
ucaacgcagcccugcuuu

SEQ ID NO: 3872379 - RNA, 22 nt, Human
ucaacgcuuaaaggugucuucc

SEQ ID NO: 3872380 - RNA, 15 nt, Human
ucaacguauuguuuc

SEQ ID NO: 3872381 - RNA, 22 nt, Human
ucaacuaaaguuguacuuuaaa

SEQ ID NO: 3872382 - RNA, 15 nt, Human
ucaacuaaauccaaa

SEQ ID NO: 3872383 - RNA, 12 nt, Human
ucaacuauuuua

SEQ ID NO: 3872384 - RNA, 16 nt, Human
ucaacucaccuaaugu

SEQ ID NO: 3872385 - RNA, 15 nt, Human
ucaacucauggagau

SEQ ID NO: 3872386 - RNA, 18 nt, Human
ucaacucccuccuuuagu

SEQ ID NO: 3872387 - RNA, 14 nt, Human
ucaacucccugccc

SEQ ID NO: 3872388 - RNA, 15 nt, Human
ucaacucugcugagg

SEQ ID NO: 3872389 - RNA, 17 nt, Human
ucaacucugcugagggu

SEQ ID NO: 3872390 - RNA, 22 nt, Human
ucaacucugcugaggguccaga

SEQ ID NO: 3872391 - RNA, 16 nt, Human
ucaacucuuuguuauu

SEQ ID NO: 3872392 - RNA, 18 nt, Human
ucaacugaccagccucca

SEQ ID NO: 3872393 - RNA, 20 nt, Human
ucaacugccaaaaugcucua

SEQ ID NO: 3872394 - RNA, 18 nt, Human
ucaacugggcucuguccc

SEQ ID NO: 3872395 - RNA, 16 nt, Human
ucaacuggguccagaa

SEQ ID NO: 3872396 - RNA, 13 nt, Human
ucaacuuaacaug

SEQ ID NO: 3872397 - RNA, 16 nt, Human
ucaacuucuggcuccu

SEQ ID NO: 3872398 - RNA, 18 nt, Human
ucaacuucuggcuccuca

SEQ ID NO: 3872399 - RNA, 19 nt, Human
ucaacuucuggcuccucaa

SEQ ID NO: 3872400 - RNA, 16 nt, Human
ucaacuugagcauguu

SEQ ID NO: 3872401 - RNA, 20 nt, Human
ucaacuugagcauguuacug

SEQ ID NO: 3872402 - RNA, 19 nt, Human
ucaacuugcauccaacucc

SEQ ID NO: 3872403 - RNA, 23 nt, Human
ucaacuuucuguuggauuccaug

SEQ ID NO: 3872404 - RNA, 22 nt, Human
ucaacuuucuuuugauuagugu

SEQ ID NO: 3872405 - RNA, 12 nt, Human
ucaacuuugaau

SEQ ID NO: 3872406 - RNA, 14 nt, Human
ucaacuuugaauaa

SEQ ID NO: 3872407 - RNA, 16 nt, Human
ucaacuuugaauaaag

SEQ ID NO: 3872408 - RNA, 18 nt, Human
ucaacuuugaauaaagaa

SEQ ID NO: 3872409 - RNA, 13 nt, Human
ucaacuuuguaaa

SEQ ID NO: 3872410 - RNA, 19 nt, Human
ucaacuuuguaaaaaucuu

SEQ ID NO: 3872411 - RNA, 15 nt, Human
ucaacuuuuccuuug

SEQ ID NO: 3872412 - RNA, 21 nt, Human
ucaacuuuuuauugccuucuc

SEQ ID NO: 3872413 - RNA, 22 nt, Human
ucaacuuuuuauugccuucuca

SEQ ID NO: 3872414 - RNA, 17 nt, Human
ucaagaaaacaacuuca

SEQ ID NO: 3872415 - RNA, 19 nt, Human
ucaagaaaacaggcacugc

SEQ ID NO: 3872416 - RNA, 22 nt, Human
ucaagaaaacaggcacugcccu

SEQ ID NO: 3872417 - RNA, 12 nt, Human
ucaagaaacagc

SEQ ID NO: 3872418 - RNA, 13 nt, Human
ucaagaaacagcc

SEQ ID NO: 3872419 - RNA, 17 nt, Human
ucaagaaagccagucuu

SEQ ID NO: 3872420 - RNA, 20 nt, Human
ucaagaaagccagucuuaac

SEQ ID NO: 3872421 - RNA, 21 nt, Human
ucaagaaagcuucaaacugca

SEQ ID NO: 3872422 - RNA, 20 nt, Human
ucaagaaauaaaaggaagcc

SEQ ID NO: 3872423 - RNA, 14 nt, Human
ucaagaaauaaguu

SEQ ID NO: 3872424 - RNA, 10 nt, Human
ucaagaaaug

SEQ ID NO: 3872425 - RNA, 23 nt, Human
ucaagaagaagauggauuggugu

SEQ ID NO: 3872426 - RNA, 19 nt, Human
ucaagaagacauggagacu

SEQ ID NO: 3872427 - RNA, 22 nt, Human
ucaagaagugaagaaugcacaa

SEQ ID NO: 3872428 - RNA, 14 nt, Human
ucaagaaguucuuu

SEQ ID NO: 3872429 - RNA, 16 nt, Human
ucaagaaugcaguacu

SEQ ID NO: 3872430 - RNA, 16 nt, Human
ucaagaccccugucuu

SEQ ID NO: 3872431 - RNA, 22 nt, Human
ucaagacccuuuuggguuucug

SEQ ID NO: 3872432 - RNA, 17 nt, Human
ucaagacugaauuccaa

SEQ ID NO: 3872433 - RNA, 19 nt, Human
ucaagacuggaaggugggg

SEQ ID NO: 3872434 - RNA, 15 nt, Human
ucaagagacugaguc

SEQ ID NO: 3872435 - RNA, 15 nt, Human
ucaagagcacacuug

SEQ ID NO: 3872436 - RNA, 22 nt, Human
ucaagagcccugucaguagagu

SEQ ID NO: 3872437 - RNA, 16 nt, Human
ucaagagccuuaaaac

SEQ ID NO: 3872438 - RNA, 13 nt, Human
ucaagaggagccc

SEQ ID NO: 3872439 - RNA, 21 nt, Human
ucaagagugaauucccucacu

SEQ ID NO: 3872440 - RNA, 13 nt, Human
ucaagauaaagga

SEQ ID NO: 3872441 - RNA, 17 nt, Human
ucaagauaaaggacagu

SEQ ID NO: 3872442 - RNA, 22 nt, Human
ucaagauacugcuacuguaauu

SEQ ID NO: 3872443 - RNA, 15 nt, Human
ucaagaucauguacc

SEQ ID NO: 3872444 - RNA, 19 nt, Human
ucaagaucuaaaucauaua

SEQ ID NO: 3872445 - RNA, 15 nt, Human
ucaagauucccagga

SEQ ID NO: 3872446 - RNA, 16 nt, Human
ucaagauucccaggag

SEQ ID NO: 3872447 - RNA, 22 nt, Human
ucaagauucccaggaguucugc

SEQ ID NO: 3872448 - RNA, 16 nt, Human
ucaagauuguuccugc

SEQ ID NO: 3872449 - RNA, 13 nt, Human
ucaagauuuugaa

SEQ ID NO: 3872450 - RNA, 18 nt, Human
ucaagauuuugaaugcuu

SEQ ID NO: 3872451 - RNA, 21 nt, Human
ucaagcaaacagcuucacaaa

SEQ ID NO: 3872452 - RNA, 19 nt, Human
ucaagcaauccuccugagu

SEQ ID NO: 3872453 - RNA, 16 nt, Human
ucaagcagauuggaga

SEQ ID NO: 3872454 - RNA, 18 nt, Human
ucaagcagcgaccgcccc

SEQ ID NO: 3872455 - RNA, 21 nt, Human
ucaagcagcgaccgcccccuc

SEQ ID NO: 3872456 - RNA, 19 nt, Human
ucaagcagucgugccugug

SEQ ID NO: 3872457 - RNA, 20 nt, Human
ucaagcagucgugccugugu

SEQ ID NO: 3872458 - RNA, 23 nt, Human
ucaagcagucgugccugugucca

SEQ ID NO: 3872459 - RNA, 19 nt, Human
ucaagcagucuacccaccu

SEQ ID NO: 3872460 - RNA, 14 nt, Human
ucaagccaagcagc

SEQ ID NO: 3872461 - RNA, 16 nt, Human
ucaagccaagcagcca

SEQ ID NO: 3872462 - RNA, 20 nt, Human
ucaagccaccaacauacucc

SEQ ID NO: 3872463 - RNA, 16 nt, Human
ucaagccagacucugc

SEQ ID NO: 3872464 - RNA, 22 nt, Human
ucaagccauguauaaaugugau

SEQ ID NO: 3872465 - RNA, 22 nt, Human
ucaagcccagccacguggagcc

SEQ ID NO: 3872466 - RNA, 15 nt, Human
ucaagcccaggaggg

SEQ ID NO: 3872467 - RNA, 16 nt, Human
ucaagccccggacuca

SEQ ID NO: 3872468 - RNA, 12 nt, Human
ucaagcccugca

SEQ ID NO: 3872469 - RNA, 22 nt, Human
ucaagccuagauguuuuauaca

SEQ ID NO: 3872470 - RNA, 18 nt, Human
ucaagccugugcaaaaaa

SEQ ID NO: 3872471 - RNA, 17 nt, Human
ucaagcgauucuccugc

SEQ ID NO: 3872472 - RNA, 15 nt, Human
ucaagcgauucucuu

SEQ ID NO: 3872473 - RNA, 15 nt, Human
ucaagcgauucuucu

SEQ ID NO: 3872474 - RNA, 15 nt, Human
ucaagcuccuccucc

SEQ ID NO: 3872475 - RNA, 20 nt, Human
ucaagcuccuccucccugca

SEQ ID NO: 3872476 - RNA, 11 nt, Human
ucaagcucuga

SEQ ID NO: 3872477 - RNA, 18 nt, Human
ucaagcugaccuugcuga

SEQ ID NO: 3872478 - RNA, 14 nt, Human
ucaagcugcucuga

SEQ ID NO: 3872479 - RNA, 14 nt, Human
ucaagcuuauuuug

SEQ ID NO: 3872480 - RNA, 20 nt, Human
ucaaggaaagggggucccag

SEQ ID NO: 3872481 - RNA, 17 nt, Human
ucaaggaacuugaaaaa

SEQ ID NO: 3872482 - RNA, 20 nt, Human
ucaaggaacuugaaaaauac

SEQ ID NO: 3872483 - RNA, 21 nt, Human
ucaaggaauuucuuaacuucu

SEQ ID NO: 3872484 - RNA, 23 nt, Human
ucaaggaccaacaagggcagugg

SEQ ID NO: 3872485 - RNA, 15 nt, Human
ucaaggauccugagc

SEQ ID NO: 3872486 - RNA, 16 nt, Human
ucaaggauccugagcc

SEQ ID NO: 3872487 - RNA, 18 nt, Human
ucaaggauccugagccag

SEQ ID NO: 3872488 - RNA, 20 nt, Human
ucaaggauccugagccagau

SEQ ID NO: 3872489 - RNA, 19 nt, Human
ucacagggcagagccggga

SEQ ID NO: 3872490 - RNA, 12 nt, Human
ucacagggcagu

SEQ ID NO: 3872491 - RNA, 20 nt, Human
ucacagggcaguaccugagg

SEQ ID NO: 3872492 - RNA, 22 nt, Human
ucacagggcaguaccugagggu

SEQ ID NO: 3872493 - RNA, 12 nt, Human
ucacagggccaa

SEQ ID NO: 3872494 - RNA, 17 nt, Human
ucacaggguugggccca

SEQ ID NO: 3872495 - RNA, 19 nt, Human
ucacaggguugggcccaga

SEQ ID NO: 3872496 - RNA, 23 nt, Human
ucacaggguugggcccagaucug

SEQ ID NO: 3872497 - RNA, 16 nt, Human
ucacaggugacucuaa

SEQ ID NO: 3872498 - RNA, 20 nt, Human
ucacaggugucagccauugc

SEQ ID NO: 3872499 - RNA, 18 nt, Human
ucacaggugugguguaau

SEQ ID NO: 3872500 - RNA, 19 nt, Human
ucacaggugugguguaauu

SEQ ID NO: 3872501 - RNA, 21 nt, Human
ucacaggugugguguaauuua

SEQ ID NO: 3872502 - RNA, 18 nt, Human
ucacagguuggaagagaa

SEQ ID NO: 3872503 - RNA, 15 nt, Human
ucacaguaaaaauaa

SEQ ID NO: 3872504 - RNA, 18 nt, Human
ucacaguaaaaauaaaau

SEQ ID NO: 3872505 - RNA, 21 nt, Human
ucacaguaaaaauaaaauacu

SEQ ID NO: 3872506 - RNA, 19 nt, Human
ucacaguacagcaugugcc

SEQ ID NO: 3872507 - RNA, 16 nt, Human
ucacaguagagccagc

SEQ ID NO: 3872508 - RNA, 21 nt, Human
ucacaguagagccagcuuggg

SEQ ID NO: 3872509 - RNA, 16 nt, Human
ucacagucacauucca

SEQ ID NO: 3872510 - RNA, 22 nt, Human
ucacagucccacugugcaggug

SEQ ID NO: 3872511 - RNA, 19 nt, Human
ucacaguccuuaccagcag

SEQ ID NO: 3872512 - RNA, 16 nt, Human
ucacagugaacacuca

SEQ ID NO: 3872513 - RNA, 17 nt, Human
ucacagugacccuuccc

SEQ ID NO: 3872514 - RNA, 20 nt, Human
ucacagugcucuuuucuccu

SEQ ID NO: 3872515 - RNA, 13 nt, Human
ucacagugcugag

SEQ ID NO: 3872516 - RNA, 16 nt, Human
ucacagugcuuuuaag

SEQ ID NO: 3872517 - RNA, 17 nt, Human
ucacagugggagccagg

SEQ ID NO: 3872518 - RNA, 17 nt, Human
ucacagugugauuuuga

SEQ ID NO: 3872519 - RNA, 14 nt, Human
ucacaguguuucga

SEQ ID NO: 3872520 - RNA, 23 nt, Human
ucacaguguuugcaaugguguug

SEQ ID NO: 3872521 - RNA, 16 nt, Human
ucacaguucaaaauuc

SEQ ID NO: 3872522 - RNA, 19 nt, Human
ucacaguucaaaauucuaa

SEQ ID NO: 3872523 - RNA, 13 nt, Human
ucacaguuccucg

SEQ ID NO: 3872524 - RNA, 17 nt, Human
ucacaguuccucgcccu

SEQ ID NO: 3872525 - RNA, 21 nt, Human
ucacaguuccucgcccugggu

SEQ ID NO: 3872526 - RNA, 22 nt, Human
ucacaguuggcuggaugaaauu

SEQ ID NO: 3872527 - RNA, 15 nt, Human
ucacaguuugaaaua

SEQ ID NO: 3872528 - RNA, 20 nt, Human
ucacaguuuugguugcuuua

SEQ ID NO: 3872529 - RNA, 21 nt, Human
ucacaguuuugguugcuuuaa

SEQ ID NO: 3872530 - RNA, 23 nt, Human
ucacaguuuugguugcuuuaaua

SEQ ID NO: 3872531 - RNA, 13 nt, Human
ucacauaaaugca

SEQ ID NO: 3872532 - RNA, 15 nt, Human
ucacauaacagaaug

SEQ ID NO: 3872533 - RNA, 17 nt, Human
ucacauaagcucagaau

SEQ ID NO: 3872534 - RNA, 20 nt, Human
ucacauaagcucagaaucca

SEQ ID NO: 3872535 - RNA, 18 nt, Human
ucacauacaauuauuuuu

SEQ ID NO: 3872536 - RNA, 14 nt, Human
ucacauacccuccc

SEQ ID NO: 3872537 - RNA, 20 nt, Human
ucacauagcccacuuacauu

SEQ ID NO: 3872538 - RNA, 21 nt, Human
ucacauaucuaguaugaaauu

SEQ ID NO: 3872539 - RNA, 12 nt, Human
ucacauaucugu

SEQ ID NO: 3872540 - RNA, 15 nt, Human
ucacauaucugucau

SEQ ID NO: 3872541 - RNA, 16 nt, Human
ucacauauugauuucc

SEQ ID NO: 3872542 - RNA, 18 nt, Human
ucacauauugauuuccgu

SEQ ID NO: 3872543 - RNA, 22 nt, Human
ucacauauuuuaaaauuuguuc

SEQ ID NO: 3872544 - RNA, 18 nt, Human
ucacaucagauaagacau

SEQ ID NO: 3872545 - RNA, 15 nt, Human
ucacaucccacccca

SEQ ID NO: 3872546 - RNA, 19 nt, Human
ucacauccuggccuggcac

SEQ ID NO: 3872547 - RNA, 23 nt, Human
ucacauccuggccuggcacauca

SEQ ID NO: 3872548 - RNA, 18 nt, Human
ucacauccuguguuucua

SEQ ID NO: 3872549 - RNA, 21 nt, Human
ucacauccuugacuuuuuaga

SEQ ID NO: 3872550 - RNA, 15 nt, Human
ucacaugaauuauua

SEQ ID NO: 3872551 - RNA, 18 nt, Human
ucacaugaccacauagca

SEQ ID NO: 3872552 - RNA, 23 nt, Human
ucacaugagcuauuuccauucca

SEQ ID NO: 3872553 - RNA, 21 nt, Human
ucacaugauuccagccaucac

SEQ ID NO: 3872554 - RNA, 21 nt, Human
ucacauggccuaugcacauau

SEQ ID NO: 3872555 - RNA, 16 nt, Human
ucacaugguuuacauc

SEQ ID NO: 3872556 - RNA, 16 nt, Human
ucacauguauguuuug

SEQ ID NO: 3872557 - RNA, 14 nt, Human
ucacauguuuucaa

SEQ ID NO: 3872558 - RNA, 19 nt, Human
ucacauuaauauuugcuga

SEQ ID NO: 3872559 - RNA, 20 nt, Human
ucacauuaauauuugcugac

SEQ ID NO: 3872560 - RNA, 16 nt, Human
ucacauuaauggucua

SEQ ID NO: 3872561 - RNA, 22 nt, Human
ucacauuaauggucuaaaaaua

SEQ ID NO: 3872562 - RNA, 22 nt, Human
ucacauuagaagacaauugaca

SEQ ID NO: 3872563 - RNA, 13 nt, Human
ucacauuagaauu

SEQ ID NO: 3872564 - RNA, 15 nt, Human
ucacauuagaauuag

SEQ ID NO: 3872565 - RNA, 13 nt, Human
ucacauuagaucu

SEQ ID NO: 3872566 - RNA, 17 nt, Human
ucacauuccccugggga

SEQ ID NO: 3872567 - RNA, 18 nt, Human
ucacauuccccuggggac

SEQ ID NO: 3872568 - RNA, 13 nt, Human
ucacauuccugaa

SEQ ID NO: 3872569 - RNA, 17 nt, Human
ucacauuccugaacagg

SEQ ID NO: 3872570 - RNA, 13 nt, Human
ucacauucuuaua

SEQ ID NO: 3872571 - RNA, 17 nt, Human
ucacauucuuauaaaua

SEQ ID NO: 3872572 - RNA, 20 nt, Human
ucacauugagcugauauaaa

SEQ ID NO: 3872573 - RNA, 23 nt, Human
ucacauugagcugauauaaauuc

SEQ ID NO: 3872574 - RNA, 20 nt, Human
ucacauuggagucacugcca

SEQ ID NO: 3872575 - RNA, 12 nt, Human
ucacauuuaaau

SEQ ID NO: 3872576 - RNA, 19 nt, Human
ucacauuuagaaaagugaa

SEQ ID NO: 3872577 - RNA, 18 nt, Human
ucacauuuauucugcuca

SEQ ID NO: 3872578 - RNA, 19 nt, Human
ucacauuuauucugcucac

SEQ ID NO: 3872579 - RNA, 17 nt, Human
ucacauuuuccuuuuca

SEQ ID NO: 3872580 - RNA, 14 nt, Human
ucacauuuuuuucu

SEQ ID NO: 3872581 - RNA, 15 nt, Human
ucacauuuuuuucua

SEQ ID NO: 3872582 - RNA, 17 nt, Human
ucacauuuuuuucuacc

SEQ ID NO: 3872583 - RNA, 21 nt, Human
ucaccaaaucagcugcuacua

SEQ ID NO: 3872584 - RNA, 21 nt, Human
ucaccaagcucacaguuccuc

SEQ ID NO: 3872585 - RNA, 12 nt, Human
ucaccacaaacu

SEQ ID NO: 3872586 - RNA, 21 nt, Human
ucaccacaguaaguuccuacu

SEQ ID NO: 3872587 - RNA, 12 nt, Human
ucaccaccaccc

SEQ ID NO: 3872588 - RNA, 18 nt, Human
ucaccaccaccccuacca

SEQ ID NO: 3872589 - RNA, 13 nt, Human
ucaccaccucucc

SEQ ID NO: 3872590 - RNA, 18 nt, Human
ucaccaccuucccagcuc

SEQ ID NO: 3872591 - RNA, 16 nt, Human
ucaccacugcccccug

SEQ ID NO: 3872592 - RNA, 18 nt, Human
ucaccagaggaaucacuc

SEQ ID NO: 3872593 - RNA, 18 nt, Human
ucaccagaucugauuugu

SEQ ID NO: 3872594 - RNA, 21 nt, Human
ucaccagcccaucgccacaaa

SEQ ID NO: 3872595 - RNA, 21 nt, Human
ucaccagccccacugccagca

SEQ ID NO: 3872596 - RNA, 22 nt, Human
ucaccagccccagugcccacag

SEQ ID NO: 3872597 - RNA, 16 nt, Human
ucaccagcccuggcaa

SEQ ID NO: 3872598 - RNA, 13 nt, Human
ucaccagcuccuc

SEQ ID NO: 3872599 - RNA, 15 nt, Human
ucaccagcuccuccc

SEQ ID NO: 3872600 - RNA, 14 nt, Human
ucaccagcugcaaa

SEQ ID NO: 3872601 - RNA, 15 nt, Human
ucaccagcugcaaag

SEQ ID NO: 3872602 - RNA, 19 nt, Human
ucaccagcugcaaaguguu

SEQ ID NO: 3872603 - RNA, 14 nt, Human
ucaccagcugccuc

SEQ ID NO: 3872604 - RNA, 17 nt, Human
ucaccagcugccucuuc

SEQ ID NO: 3872605 - RNA, 21 nt, Human
ucaccaguacauucucaguuu

SEQ ID NO: 3872606 - RNA, 20 nt, Human
ucaccaucaauccugauucc

SEQ ID NO: 3872607 - RNA, 14 nt, Human
ucaccaucucaggc

SEQ ID NO: 3872608 - RNA, 14 nt, Human
ucaccaucugugca

SEQ ID NO: 3872609 - RNA, 14 nt, Human
ucaccaugaugggg

SEQ ID NO: 3872610 - RNA, 19 nt, Human
ucaccauguaaaacaaaaa

SEQ ID NO: 3872611 - RNA, 15 nt, Human
ucaccauguaagcac

SEQ ID NO: 3872612 - RNA, 17 nt, Human
ucaccauguaagcacuc

SEQ ID NO: 3872613 - RNA, 18 nt, Human
ucaccaugugagcucuuc

SEQ ID NO: 3872614 - RNA, 19 nt, Human
ucaccauguuggccaggcu

SEQ ID NO: 3872615 - RNA, 23 nt, Human
ucaccauuauaaugaauuuagug

SEQ ID NO: 3872616 - RNA, 21 nt, Human
ucaccauucguacauaauacu

SEQ ID NO: 3872617 - RNA, 17 nt, Human
ucaccauuugauuaugu

SEQ ID NO: 3872618 - RNA, 23 nt, Human
ucaccauuuggcaaugccaucau

SEQ ID NO: 3872619 - RNA, 16 nt, Human
ucacccacagaaagag

SEQ ID NO: 3872620 - RNA, 16 nt, Human
ucacccaccagacuuu

SEQ ID NO: 3872621 - RNA, 16 nt, Human
ucacccagacagcucc

SEQ ID NO: 3872622 - RNA, 20 nt, Human
ucacccagacauaaaggaaa

SEQ ID NO: 3872623 - RNA, 22 nt, Human
ucacccagacauaaaggaaaag

SEQ ID NO: 3872624 - RNA, 21 nt, Human
ucacccagcuaaucuguaggg

SEQ ID NO: 3872625 - RNA, 19 nt, Human
ucacccaguccugcccgcc

SEQ ID NO: 3872626 - RNA, 13 nt, Human
ucaccccacccuu

SEQ ID NO: 3872627 - RNA, 17 nt, Human
ucaccccagagccacac

SEQ ID NO: 3872628 - RNA, 20 nt, Human
ucaccccagccccaaaacuc

SEQ ID NO: 3872629 - RNA, 13 nt, Human
ucaccccagggcc

SEQ ID NO: 3872630 - RNA, 16 nt, Human
ucaccccagggccuga

SEQ ID NO: 3872631 - RNA, 19 nt, Human
ucaccccagggccugagcc

SEQ ID NO: 3872632 - RNA, 17 nt, Human
ucacccccucccacccc

SEQ ID NO: 3872633 - RNA, 17 nt, Human
ucauguguuugaacuuc

SEQ ID NO: 3872634 - RNA, 15 nt, Human
ucauguuaaccucug

SEQ ID NO: 3872635 - RNA, 21 nt, Human
ucauguuaauccuagcugugu

SEQ ID NO: 3872636 - RNA, 14 nt, Human
ucauguuaguaaua

SEQ ID NO: 3872637 - RNA, 15 nt, Human
ucauguuaguuaccu

SEQ ID NO: 3872638 - RNA, 23 nt, Human
ucauguuaguuaccuuauaguua

SEQ ID NO: 3872639 - RNA, 20 nt, Human
ucauguuauauuuaaugcau

SEQ ID NO: 3872640 - RNA, 13 nt, Human
ucauguuccaaau

SEQ ID NO: 3872641 - RNA, 23 nt, Human
ucauguucccacuucaaaacaaa

SEQ ID NO: 3872642 - RNA, 22 nt, Human
ucauguugguguuggcaucagu

SEQ ID NO: 3872643 - RNA, 12 nt, Human
ucauguuucuuu

SEQ ID NO: 3872644 - RNA, 15 nt, Human
ucauguuugcucucc

SEQ ID NO: 3872645 - RNA, 22 nt, Human
ucauguuuggugcauagaacug

SEQ ID NO: 3872646 - RNA, 14 nt, Human
ucauguuuugguga

SEQ ID NO: 3872647 - RNA, 14 nt, Human
ucauguuuugugac

SEQ ID NO: 3872648 - RNA, 21 nt, Human
ucauguuuuugaaacagaacc

SEQ ID NO: 3872649 - RNA, 13 nt, Human
ucauuaaauaaau

SEQ ID NO: 3872650 - RNA, 23 nt, Human
ucauuaagguauuauuuuuucca

SEQ ID NO: 3872651 - RNA, 17 nt, Human
ucauuaaucugccuccc

SEQ ID NO: 3872652 - RNA, 21 nt, Human
ucauuaaugacacuugucccc

SEQ ID NO: 3872653 - RNA, 22 nt, Human
ucauuaaugacacuugucccca

SEQ ID NO: 3872654 - RNA, 23 nt, Human
ucauuaccuuuuaccagcuuuua

SEQ ID NO: 3872655 - RNA, 20 nt, Human
ucauuaccuuuuuugauaaa

SEQ ID NO: 3872656 - RNA, 15 nt, Human
ucauuacugggccuu

SEQ ID NO: 3872657 - RNA, 12 nt, Human
ucauuacuuguu

SEQ ID NO: 3872658 - RNA, 20 nt, Human
ucauuacuuuaccaccccca

SEQ ID NO: 3872659 - RNA, 17 nt, Human
ucauuagaauuaccauu

SEQ ID NO: 3872660 - RNA, 12 nt, Human
ucauuagagcag

SEQ ID NO: 3872661 - RNA, 12 nt, Human
ucauuagcaaaa

SEQ ID NO: 3872662 - RNA, 16 nt, Human
ucauuagcaaaaaaag

SEQ ID NO: 3872663 - RNA, 17 nt, Human
ucauuagcaaaaaaagu

SEQ ID NO: 3872664 - RNA, 18 nt, Human
ucauuagcugugauuuuu

SEQ ID NO: 3872665 - RNA, 21 nt, Human
ucauuaggugugacugaauuu

SEQ ID NO: 3872666 - RNA, 13 nt, Human
ucauuauaaacgu

SEQ ID NO: 3872667 - RNA, 15 nt, Human
ucauuauaaacguga

SEQ ID NO: 3872668 - RNA, 19 nt, Human
ucauuaucucaaaacugca

SEQ ID NO: 3872669 - RNA, 13 nt, Human
ucauuauguaaaa

SEQ ID NO: 3872670 - RNA, 18 nt, Human
ucauuaugucaaccaggu

SEQ ID NO: 3872671 - RNA, 16 nt, Human
ucauuauguuaauauu

SEQ ID NO: 3872672 - RNA, 12 nt, Human
ucauuauuauua

SEQ ID NO: 3872673 - RNA, 14 nt, Human
ucauuauucucugc

SEQ ID NO: 3872674 - RNA, 17 nt, Human
ucauuauucucugcuau

SEQ ID NO: 3872675 - RNA, 17 nt, Human
ucauuauuggaauuaac

SEQ ID NO: 3872676 - RNA, 19 nt, Human
ucauuauuggaauuaaccu

SEQ ID NO: 3872677 - RNA, 13 nt, Human
ucauuauuuguca

SEQ ID NO: 3872678 - RNA, 15 nt, Human
ucauuauuugucaaa

SEQ ID NO: 3872679 - RNA, 14 nt, Human
ucauuauuuuauua

SEQ ID NO: 3872680 - RNA, 18 nt, Human
ucauuauuuuauuaugaa

SEQ ID NO: 3872681 - RNA, 16 nt, Human
ucauucaauacaagug

SEQ ID NO: 3872682 - RNA, 15 nt, Human
ucauucaauauugac

SEQ ID NO: 3872683 - RNA, 21 nt, Human
ucauucaauauugacauuugu

SEQ ID NO: 3872684 - RNA, 16 nt, Human
ucauucacuagcuuug

SEQ ID NO: 3872685 - RNA, 16 nt, Human
ucauucacuucacugu

SEQ ID NO: 3872686 - RNA, 19 nt, Human
ucauucacuucacugugcu

SEQ ID NO: 3872687 - RNA, 16 nt, Human
ucauucacuucucuua

SEQ ID NO: 3872688 - RNA, 22 nt, Human
ucauucagagucagccaggacc

SEQ ID NO: 3872689 - RNA, 22 nt, Human
ucauucagauaugauucaaaug

SEQ ID NO: 3872690 - RNA, 12 nt, Human
ucauucaggaaa

SEQ ID NO: 3872691 - RNA, 12 nt, Human
ucauucauauua

SEQ ID NO: 3872692 - RNA, 15 nt, Human
ucauucauauuacaa

SEQ ID NO: 3872693 - RNA, 22 nt, Human
ucauucauauuacaauauuugu

SEQ ID NO: 3872694 - RNA, 15 nt, Human
ucauucauucuuagc

SEQ ID NO: 3872695 - RNA, 19 nt, Human
ucauucauuuuauauugaa

SEQ ID NO: 3872696 - RNA, 12 nt, Human
ucauuccaaaua

SEQ ID NO: 3872697 - RNA, 20 nt, Human
ucauuccauugccuagcucu

SEQ ID NO: 3872698 - RNA, 23 nt, Human
ucauuccccagguggcugaccca

SEQ ID NO: 3872699 - RNA, 18 nt, Human
ucauucccucucaucuca

SEQ ID NO: 3872700 - RNA, 23 nt, Human
ucauucccuucgacagcauuuuc

SEQ ID NO: 3872701 - RNA, 17 nt, Human
ucauuccuaacacagca

SEQ ID NO: 3872702 - RNA, 14 nt, Human
ucauuccugaaaga

SEQ ID NO: 3872703 - RNA, 17 nt, Human
ucauuccugccugucuc

SEQ ID NO: 3872704 - RNA, 14 nt, Human
ucauuccuguauuc

SEQ ID NO: 3872705 - RNA, 17 nt, Human
ucauuccuucagauuug

SEQ ID NO: 3872706 - RNA, 20 nt, Human
ucauuccuuuuuauuuauau

SEQ ID NO: 3872707 - RNA, 18 nt, Human
ucauucucauaauuccua

SEQ ID NO: 3872708 - RNA, 21 nt, Human
ucauucucauaauuccuacag

SEQ ID NO: 3872709 - RNA, 23 nt, Human
ucauucucauaauuccuacagca

SEQ ID NO: 3872710 - RNA, 13 nt, Human
ucauucuccugcc

SEQ ID NO: 3872711 - RNA, 14 nt, Human
ucauucuccugccu

SEQ ID NO: 3872712 - RNA, 18 nt, Human
ucauucucugucucaucc

SEQ ID NO: 3872713 - RNA, 14 nt, Human
ucauucugaauuaa

SEQ ID NO: 3872714 - RNA, 13 nt, Human
ucauucugcauug

SEQ ID NO: 3872715 - RNA, 16 nt, Human
ucauucugugaucauu

SEQ ID NO: 3872716 - RNA, 20 nt, Human
ucauucuuacuaaaaaguau

SEQ ID NO: 3872717 - RNA, 13 nt, Human
ucauucuucucua

SEQ ID NO: 3872718 - RNA, 15 nt, Human
ucauucuuguuuucu

SEQ ID NO: 3872719 - RNA, 21 nt, Human
ucauucuuuuugaaaugucaa

SEQ ID NO: 3872720 - RNA, 12 nt, Human
ucauugaaaucu

SEQ ID NO: 3872721 - RNA, 22 nt, Human
ucauugaaaucuuuuugcuuug

SEQ ID NO: 3872722 - RNA, 12 nt, Human
ucauugaaaugu

SEQ ID NO: 3872723 - RNA, 20 nt, Human
ucauugaauuauaaaagcca

SEQ ID NO: 3872724 - RNA, 21 nt, Human
ucauugacuaucaaacugaag

SEQ ID NO: 3872725 - RNA, 16 nt, Human
ucauugacuuuuauaa

SEQ ID NO: 3872726 - RNA, 16 nt, Human
ucauugauaugaaaaa

SEQ ID NO: 3872727 - RNA, 18 nt, Human
ucauugauugucagcuac

SEQ ID NO: 3872728 - RNA, 17 nt, Human
ucauugauuuccugugu

SEQ ID NO: 3872729 - RNA, 19 nt, Human
ucauugauuuccuguguca

SEQ ID NO: 3872730 - RNA, 17 nt, Human
ucauugcacauaagcuu

SEQ ID NO: 3872731 - RNA, 21 nt, Human
ucauugccagugucuuucuuu

SEQ ID NO: 3872732 - RNA, 23 nt, Human
ucauugccuguguauggaaaaac

SEQ ID NO: 3872733 - RNA, 17 nt, Human
ucauugcugaaaauggu

SEQ ID NO: 3872734 - RNA, 17 nt, Human
ucauugcugagccucug

SEQ ID NO: 3872735 - RNA, 14 nt, Human
ucauugcugucugc

SEQ ID NO: 3872736 - RNA, 13 nt, Human
ucauugcuuacaa

SEQ ID NO: 3872737 - RNA, 16 nt, Human
ucauugcuuaugacau

SEQ ID NO: 3872738 - RNA, 21 nt, Human
ucauugcuucacaacccaucu

SEQ ID NO: 3872739 - RNA, 12 nt, Human
ucauugcuuuac

SEQ ID NO: 3872740 - RNA, 14 nt, Human
ucauuggaaauuua

SEQ ID NO: 3872741 - RNA, 15 nt, Human
ucauuggaaauuuag

SEQ ID NO: 3872742 - RNA, 19 nt, Human
ucauuggaaauuuagcauu

SEQ ID NO: 3872743 - RNA, 17 nt, Human
ucauuggcuuuauccuc

SEQ ID NO: 3872744 - RNA, 19 nt, Human
ucauugggcuguuuucuca

SEQ ID NO: 3872745 - RNA, 19 nt, Human
ucauuguaaacaaacucuu

SEQ ID NO: 3872746 - RNA, 17 nt, Human
ucauuguaauguuacug

SEQ ID NO: 3872747 - RNA, 19 nt, Human
ucauuguaauguuacugau

SEQ ID NO: 3872748 - RNA, 17 nt, Human
ucauuguauaaaaauag

SEQ ID NO: 3872749 - RNA, 23 nt, Human
ucauuguaugauguguugugaua

SEQ ID NO: 3872750 - RNA, 16 nt, Human
ucauugucccucuuca

SEQ ID NO: 3872751 - RNA, 18 nt, Human
ucauugucuguguagagu

SEQ ID NO: 3872752 - RNA, 12 nt, Human
ucauugugaaau

SEQ ID NO: 3872753 - RNA, 17 nt, Human
ucauugugaaauuauuc

SEQ ID NO: 3872754 - RNA, 18 nt, Human
ucauugugaaauuauuca

SEQ ID NO: 3872755 - RNA, 15 nt, Human
ucauuguuaaaguaa

SEQ ID NO: 3872756 - RNA, 16 nt, Human
ucauuguuuggcauug

SEQ ID NO: 3872757 - RNA, 16 nt, Human
ucauuuaaaaugauua

SEQ ID NO: 3872758 - RNA, 14 nt, Human
ucauuuaagggaaa

SEQ ID NO: 3872759 - RNA, 17 nt, Human
ucauuuaagggaaaaau

SEQ ID NO: 3872760 - RNA, 19 nt, Human
ucauuuaagggaaagaaaa

SEQ ID NO: 3872761 - RNA, 23 nt, Human
ucauuuaaguuucaaacuuacua

SEQ ID NO: 3872762 - RNA, 18 nt, Human
ucauuuaauaauauacuu

SEQ ID NO: 3872763 - RNA, 22 nt, Human
ucauuuaauccucccuuccucc

SEQ ID NO: 3872764 - RNA, 16 nt, Human
ucauuuacuaaacaua

SEQ ID NO: 3872765 - RNA, 11 nt, Human
ucauuuacugu

SEQ ID NO: 3872766 - RNA, 20 nt, Human
ucauuuacuguggcuucuua

SEQ ID NO: 3872767 - RNA, 15 nt, Human
ucauuuacuguuuua

SEQ ID NO: 3872768 - RNA, 12 nt, Human
ucauuuagaacu

SEQ ID NO: 3872769 - RNA, 19 nt, Human
ucauuuagauugaaaacuu

SEQ ID NO: 3872770 - RNA, 15 nt, Human
ucauuuagccugucc

SEQ ID NO: 3872771 - RNA, 17 nt, Human
ucauuuagccuguccug

SEQ ID NO: 3872772 - RNA, 23 nt, Human
ucauuuagugaguuauuccuuga

SEQ ID NO: 3872773 - RNA, 19 nt, Human
ucauuuaguuugauuauuc

SEQ ID NO: 3872774 - RNA, 17 nt, Human
ucauuuauauagauuau

SEQ ID NO: 3872775 - RNA, 22 nt, Human
ucauuuauauagauuauaacuu

SEQ ID NO: 3872776 - RNA, 15 nt, Human
ucauuuaucccucaa

SEQ ID NO: 3872777 - RNA, 16 nt, Human
ucauuuaucuauaauu

SEQ ID NO: 3872778 - RNA, 14 nt, Human
uccagaagugugac

SEQ ID NO: 3872779 - RNA, 15 nt, Human
uccagaagugugacu

SEQ ID NO: 3872780 - RNA, 22 nt, Human
uccagaauaaaacgcaaagggc

SEQ ID NO: 3872781 - RNA, 23 nt, Human
uccagaauaucugggauucuacu

SEQ ID NO: 3872782 - RNA, 18 nt, Human
uccagaaucuaaagccag

SEQ ID NO: 3872783 - RNA, 18 nt, Human
uccagaaugcuguacauc

SEQ ID NO: 3872784 - RNA, 14 nt, Human
uccagaauuuccca

SEQ ID NO: 3872785 - RNA, 20 nt, Human
uccagaauuucccaaagcag

SEQ ID NO: 3872786 - RNA, 24 nt, Human
uccagacaaaccagaagcaacaga

SEQ ID NO: 3872787 - RNA, 13 nt, Human
uccagacacuuuu

SEQ ID NO: 3872788 - RNA, 13 nt, Human
uccagacagccug

SEQ ID NO: 3872789 - RNA, 14 nt, Human
uccagacagccugu

SEQ ID NO: 3872790 - RNA, 16 nt, Human
uccagacagccuguau

SEQ ID NO: 3872791 - RNA, 22 nt, Human
uccagacagugugcuguuugaa

SEQ ID NO: 3872792 - RNA, 19 nt, Human
uccagacauacgaaacaca

SEQ ID NO: 3872793 - RNA, 12 nt, Human
uccagaccccca

SEQ ID NO: 3872794 - RNA, 20 nt, Human
uccagacccccaccccuucc

SEQ ID NO: 3872795 - RNA, 21 nt, Human
uccagacccccagcaacccuc

SEQ ID NO: 3872796 - RNA, 13 nt, Human
uccagaccccugg

SEQ ID NO: 3872797 - RNA, 15 nt, Human
uccagaccugaggcg

SEQ ID NO: 3872798 - RNA, 13 nt, Human
uccagaccugauc

SEQ ID NO: 3872799 - RNA, 18 nt, Human
uccagaccugauccugga

SEQ ID NO: 3872800 - RNA, 18 nt, Human
uccagacguaggggaggg

SEQ ID NO: 3872801 - RNA, 14 nt, Human
uccagacucagagc

SEQ ID NO: 3872802 - RNA, 14 nt, Human
uccagacucucugu

SEQ ID NO: 3872803 - RNA, 23 nt, Human
uccagacugcuuccaauuuucug

SEQ ID NO: 3872804 - RNA, 15 nt, Human
uccagagacaacagg

SEQ ID NO: 3872805 - RNA, 16 nt, Human
uccagagacaacaggu

SEQ ID NO: 3872806 - RNA, 19 nt, Human
uccagagaguggcuccucc

SEQ ID NO: 3872807 - RNA, 20 nt, Human
uccagagauucauuuucuag

SEQ ID NO: 3872808 - RNA, 21 nt, Human
uccagagauucauuuucuaga

SEQ ID NO: 3872809 - RNA, 17 nt, Human
uccagagcacugcucca

SEQ ID NO: 3872810 - RNA, 15 nt, Human
uccagauaguguagc

SEQ ID NO: 3872811 - RNA, 22 nt, Human
uccagauaguguagcugaggag

SEQ ID NO: 3872812 - RNA, 16 nt, Human
uccagaucagauucuu

SEQ ID NO: 3872813 - RNA, 13 nt, Human
uccagaucccagg

SEQ ID NO: 3872814 - RNA, 16 nt, Human
uccagaucccaggccc

SEQ ID NO: 3872815 - RNA, 19 nt, Human
uccagaucccaggccccug

SEQ ID NO: 3872816 - RNA, 16 nt, Human
uccagauccucucugg

SEQ ID NO: 3872817 - RNA, 18 nt, Human
uccagaucugcagucacu

SEQ ID NO: 3872818 - RNA, 15 nt, Human
uccagaugccacaau

SEQ ID NO: 3872819 - RNA, 14 nt, Human
uccagaugugaugc

SEQ ID NO: 3872820 - RNA, 13 nt, Human
uccagauguggcu

SEQ ID NO: 3872821 - RNA, 14 nt, Human
uccagauguggcua

SEQ ID NO: 3872822 - RNA, 17 nt, Human
uccagauugacgacaag

SEQ ID NO: 3872823 - RNA, 18 nt, Human
uccagauuuacacuggga

SEQ ID NO: 3872824 - RNA, 16 nt, Human
uccagcaacacagccu

SEQ ID NO: 3872825 - RNA, 20 nt, Human
uccagcaacuucuucuccau

SEQ ID NO: 3872826 - RNA, 18 nt, Human
uccagcaauucuccugcc

SEQ ID NO: 3872827 - RNA, 17 nt, Human
uccagcacaaacacaag

SEQ ID NO: 3872828 - RNA, 19 nt, Human
uccagcacaaacacaaggu

SEQ ID NO: 3872829 - RNA, 23 nt, Human
uccagcaccauccgccagggccc

SEQ ID NO: 3872830 - RNA, 19 nt, Human
uccagcaccuugugccugg

SEQ ID NO: 3872831 - RNA, 21 nt, Human
uccagcaccuugugccugggg

SEQ ID NO: 3872832 - RNA, 22 nt, Human
uccagcaccuugugccuggggu

SEQ ID NO: 3872833 - RNA, 17 nt, Human
uccagcagaagacaaaa

SEQ ID NO: 3872834 - RNA, 15 nt, Human
uccagcagauuauuc

SEQ ID NO: 3872835 - RNA, 17 nt, Human
uccagcagauuauucac

SEQ ID NO: 3872836 - RNA, 20 nt, Human
uccagcagauuauucacuga

SEQ ID NO: 3872837 - RNA, 22 nt, Human
uccagcagauuauucacugauu

SEQ ID NO: 3872838 - RNA, 14 nt, Human
uccagcagucacuu

SEQ ID NO: 3872839 - RNA, 20 nt, Human
uccagcagucucugccuugc

SEQ ID NO: 3872840 - RNA, 21 nt, Human
uccagcauuuagcuggccaca

SEQ ID NO: 3872841 - RNA, 20 nt, Human
uccagccacuggcugcuaac

SEQ ID NO: 3872842 - RNA, 11 nt, Human
uccagccagcg

SEQ ID NO: 3872843 - RNA, 18 nt, Human
uccagccagcgccucccu

SEQ ID NO: 3872844 - RNA, 22 nt, Human
uccagccagcgccucccuccac

SEQ ID NO: 3872845 - RNA, 23 nt, Human
uccagccagcgccucccuccacc

SEQ ID NO: 3872846 - RNA, 23 nt, Human
uccagccccgcgaccauguggcc

SEQ ID NO: 3872847 - RNA, 20 nt, Human
uccagccccucuuggagaag

SEQ ID NO: 3872848 - RNA, 15 nt, Human
uccagccccuggaug

SEQ ID NO: 3872849 - RNA, 16 nt, Human
uccagccccuggaugc

SEQ ID NO: 3872850 - RNA, 21 nt, Human
uccagccccuggaugcagccu

SEQ ID NO: 3872851 - RNA, 12 nt, Human
uccagccccugu

SEQ ID NO: 3872852 - RNA, 15 nt, Human
uccagccccuguccc

SEQ ID NO: 3872853 - RNA, 20 nt, Human
uccagccccugucccacccc

SEQ ID NO: 3872854 - RNA, 22 nt, Human
uccagccccuucucagaaucua

SEQ ID NO: 3872855 - RNA, 23 nt, Human
uccagcccgggagccuaggacca

SEQ ID NO: 3872856 - RNA, 16 nt, Human
uccagccgccauugcc

SEQ ID NO: 3872857 - RNA, 18 nt, Human
uccagccgccauugccac

SEQ ID NO: 3872858 - RNA, 19 nt, Human
uccagccgccauugccacc

SEQ ID NO: 3872859 - RNA, 20 nt, Human
uccagccgccauugccacca

SEQ ID NO: 3872860 - RNA, 20 nt, Human
uccagccggcauggcuggga

SEQ ID NO: 3872861 - RNA, 16 nt, Human
uccagccugccccgga

SEQ ID NO: 3872862 - RNA, 20 nt, Human
uccagccugcugccugcuuu

SEQ ID NO: 3872863 - RNA, 22 nt, Human
uccagccuggaaaccugucuga

SEQ ID NO: 3872864 - RNA, 20 nt, Human
uccagccuggacccccagcu

SEQ ID NO: 3872865 - RNA, 21 nt, Human
uccagccuggacccccagcuu

SEQ ID NO: 3872866 - RNA, 12 nt, Human
uccagccuggcu

SEQ ID NO: 3872867 - RNA, 13 nt, Human
uccagccugggag

SEQ ID NO: 3872868 - RNA, 19 nt, Human
uccagccugggcagccagg

SEQ ID NO: 3872869 - RNA, 22 nt, Human
uccagccugggcagccaggcug

SEQ ID NO: 3872870 - RNA, 20 nt, Human
uccagccugguuuagccugg

SEQ ID NO: 3872871 - RNA, 20 nt, Human
uccagcuagugacccacaug

SEQ ID NO: 3872872 - RNA, 21 nt, Human
uccagcuauuuuuauuuguuu

SEQ ID NO: 3872873 - RNA, 20 nt, Human
uccagcucaccccccacacu

SEQ ID NO: 3872874 - RNA, 15 nt, Human
uccagcucagaaccc

SEQ ID NO: 3872875 - RNA, 19 nt, Human
uccagcucagaacccaggg

SEQ ID NO: 3872876 - RNA, 13 nt, Human
uccagcucagcag

SEQ ID NO: 3872877 - RNA, 20 nt, Human
uccagcucauucauuuuaua

SEQ ID NO: 3872878 - RNA, 12 nt, Human
uccagcuccaac

SEQ ID NO: 3872879 - RNA, 18 nt, Human
uccagcuccucauccagg

SEQ ID NO: 3872880 - RNA, 21 nt, Human
uccagcuccuccgugcuuccu

SEQ ID NO: 3872881 - RNA, 16 nt, Human
uccagcuccuuugggc

SEQ ID NO: 3872882 - RNA, 15 nt, Human
uccagcucuggaggg

SEQ ID NO: 3872883 - RNA, 15 nt, Human
uccagcucuuuccuc

SEQ ID NO: 3872884 - RNA, 21 nt, Human
uccagcucuuuccuccuucca

SEQ ID NO: 3872885 - RNA, 21 nt, Human
uccagcugacuaaacuuuuuu

SEQ ID NO: 3872886 - RNA, 12 nt, Human
uccagcugcccc

SEQ ID NO: 3872887 - RNA, 14 nt, Human
uccagcugcugaga

SEQ ID NO: 3872888 - RNA, 12 nt, Human
uccagcugcugu

SEQ ID NO: 3872889 - RNA, 14 nt, Human
uccagcugcugucu

SEQ ID NO: 3872890 - RNA, 15 nt, Human
uccagcugcugucuu

SEQ ID NO: 3872891 - RNA, 15 nt, Human
uccagcuggccggga

SEQ ID NO: 3872892 - RNA, 22 nt, Human
uccagcuggccgggagccugau

SEQ ID NO: 3872893 - RNA, 18 nt, Human
uccagcuggccuggacag

SEQ ID NO: 3872894 - RNA, 14 nt, Human
uccagcuguccccc

SEQ ID NO: 3872895 - RNA, 21 nt, Human
uccagcuguccccccacuccc

SEQ ID NO: 3872896 - RNA, 17 nt, Human
uccagcuguucagcugg

SEQ ID NO: 3872897 - RNA, 20 nt, Human
uccagcuucugguacucucc

SEQ ID NO: 3872898 - RNA, 18 nt, Human
uccagcuuguggagcccc

SEQ ID NO: 3872899 - RNA, 21 nt, Human
uccagcuuuguucuucuuaaa

SEQ ID NO: 3872900 - RNA, 21 nt, Human
uccaggaagaaagaauguuac

SEQ ID NO: 3872901 - RNA, 19 nt, Human
uccaggacaggagaugcug

SEQ ID NO: 3872902 - RNA, 14 nt, Human
uccaggacccugcc

SEQ ID NO: 3872903 - RNA, 20 nt, Human
uccaggacuauauuugggcc

SEQ ID NO: 3872904 - RNA, 23 nt, Human
uccaggacuauauuugggccugc

SEQ ID NO: 3872905 - RNA, 16 nt, Human
uccaggagaaggccaa

SEQ ID NO: 3872906 - RNA, 14 nt, Human
uccaggagccuggc

SEQ ID NO: 3872907 - RNA, 13 nt, Human
uccaggagcucca

SEQ ID NO: 3872908 - RNA, 15 nt, Human
uccaggagcuccagu

SEQ ID NO: 3872909 - RNA, 17 nt, Human
uccaggagcuccagugu

SEQ ID NO: 3872910 - RNA, 23 nt, Human
uccaggagcuucuuguuuccuug

SEQ ID NO: 3872911 - RNA, 15 nt, Human
uccaggauccagaag

SEQ ID NO: 3872912 - RNA, 20 nt, Human
uccaggaugguguuacugca

SEQ ID NO: 3872913 - RNA, 23 nt, Human
uccaggaugguguuacugcaguu

SEQ ID NO: 3872914 - RNA, 18 nt, Human
uccaggauuccucuuuuc

SEQ ID NO: 3872915 - RNA, 16 nt, Human
uccaggcacagcugag

SEQ ID NO: 3872916 - RNA, 13 nt, Human
uccaggcacagga

SEQ ID NO: 3872917 - RNA, 19 nt, Human
uccaggcacccuucuuucc

SEQ ID NO: 3872918 - RNA, 13 nt, Human
uccaggcagaucc

SEQ ID NO: 3872919 - RNA, 16 nt, Human
uccaggcagauccagg

SEQ ID NO: 3872920 - RNA, 19 nt, Human
uccaggcagauccaggacu

SEQ ID NO: 3872921 - RNA, 21 nt, Human
uccaggcagauccaggacuau

SEQ ID NO: 3872922 - RNA, 20 nt, Human
ucccaaugcacauccauucc

SEQ ID NO: 3872923 - RNA, 22 nt, Human
ucccaaugcacauccauuccca

SEQ ID NO: 3872924 - RNA, 21 nt, Human
ucccaaugguguuuuucuugu

SEQ ID NO: 3872925 - RNA, 14 nt, Human
ucccaauuaggaag

SEQ ID NO: 3872926 - RNA, 20 nt, Human
ucccaauuaggaaguguaac

SEQ ID NO: 3872927 - RNA, 15 nt, Human
ucccaauucacaucu

SEQ ID NO: 3872928 - RNA, 17 nt, Human
ucccaauuucagacucc

SEQ ID NO: 3872929 - RNA, 14 nt, Human
ucccacaaaggaga

SEQ ID NO: 3872930 - RNA, 23 nt, Human
ucccacaauauaaaacuguacuu

SEQ ID NO: 3872931 - RNA, 18 nt, Human
ucccacacuggugacugc

SEQ ID NO: 3872932 - RNA, 13 nt, Human
ucccacagcgcug

SEQ ID NO: 3872933 - RNA, 17 nt, Human
ucccacaggacauuucu

SEQ ID NO: 3872934 - RNA, 21 nt, Human
ucccacaggacauuucucuaa

SEQ ID NO: 3872935 - RNA, 13 nt, Human
ucccacaggcagc

SEQ ID NO: 3872936 - RNA, 15 nt, Human
ucccacaggcagcuu

SEQ ID NO: 3872937 - RNA, 23 nt, Human
ucccacauccaacuccagcaacu

SEQ ID NO: 3872938 - RNA, 16 nt, Human
ucccacaucccugggc

SEQ ID NO: 3872939 - RNA, 13 nt, Human
ucccacaugggcc

SEQ ID NO: 3872940 - RNA, 16 nt, Human
ucccacaugggcccag

SEQ ID NO: 3872941 - RNA, 18 nt, Human
ucccaccaaggucuucag

SEQ ID NO: 3872942 - RNA, 17 nt, Human
ucccaccaggcugcuca

SEQ ID NO: 3872943 - RNA, 15 nt, Human
ucccacccacaugug

SEQ ID NO: 3872944 - RNA, 16 nt, Human
ucccacccacauguga

SEQ ID NO: 3872945 - RNA, 19 nt, Human
ucccaccccaaccugcucu

SEQ ID NO: 3872946 - RNA, 13 nt, Human
ucccaccccaccc

SEQ ID NO: 3872947 - RNA, 20 nt, Human
ucccaccccacccccuucag

SEQ ID NO: 3872948 - RNA, 19 nt, Human
ucccaccccauccuccagg

SEQ ID NO: 3872949 - RNA, 20 nt, Human
ucccacccccacccccagcu

SEQ ID NO: 3872950 - RNA, 23 nt, Human
ucccacccccacccccagcucaa

SEQ ID NO: 3872951 - RNA, 23 nt, Human
ucccacccccagccccgacucca

SEQ ID NO: 3872952 - RNA, 20 nt, Human
ucccacccccaucucucccu

SEQ ID NO: 3872953 - RNA, 17 nt, Human
ucccacccccuucucug

SEQ ID NO: 3872954 - RNA, 21 nt, Human
ucccacccccuucucugcucc

SEQ ID NO: 3872955 - RNA, 15 nt, Human
ucccacccgaugcug

SEQ ID NO: 3872956 - RNA, 18 nt, Human
ucccacccgaugcugcuu

SEQ ID NO: 3872957 - RNA, 20 nt, Human
ucccacccgaugcugcuuuc

SEQ ID NO: 3872958 - RNA, 15 nt, Human
ucccacccucuuccu

SEQ ID NO: 3872959 - RNA, 12 nt, Human
ucccacccugua

SEQ ID NO: 3872960 - RNA, 24 nt, Human
ucccaccgcccagcggcuugccug

SEQ ID NO: 3872961 - RNA, 19 nt, Human
ucccaccgguugcuucugg

SEQ ID NO: 3872962 - RNA, 20 nt, Human
ucccaccgguugcuucuggg

SEQ ID NO: 3872963 - RNA, 21 nt, Human
ucccaccgguugcuucuggga

SEQ ID NO: 3872964 - RNA, 17 nt, Human
ucccaccuagcagcacc

SEQ ID NO: 3872965 - RNA, 15 nt, Human
ucccaccuccagccc

SEQ ID NO: 3872966 - RNA, 14 nt, Human
ucccaccuccaguc

SEQ ID NO: 3872967 - RNA, 17 nt, Human
ucccaccuccagucccc

SEQ ID NO: 3872968 - RNA, 15 nt, Human
ucccaccuccccuug

SEQ ID NO: 3872969 - RNA, 17 nt, Human
ucccaccuccccuuggg

SEQ ID NO: 3872970 - RNA, 18 nt, Human
ucccaccuccccuugggc

SEQ ID NO: 3872971 - RNA, 15 nt, Human
ucccaccucccugcc

SEQ ID NO: 3872972 - RNA, 16 nt, Human
ucccaccucccugccc

SEQ ID NO: 3872973 - RNA, 19 nt, Human
ucccaccucccugcccagg

SEQ ID NO: 3872974 - RNA, 17 nt, Human
ucccaccucucucacuc

SEQ ID NO: 3872975 - RNA, 21 nt, Human
ucccaccucugugaccucagg

SEQ ID NO: 3872976 - RNA, 22 nt, Human
ucccaccucuucucuuccugua

SEQ ID NO: 3872977 - RNA, 13 nt, Human
ucccaccugacac

SEQ ID NO: 3872978 - RNA, 19 nt, Human
ucccaccugcaucuggggc

SEQ ID NO: 3872979 - RNA, 17 nt, Human
ucccaccuuggcugcag

SEQ ID NO: 3872980 - RNA, 18 nt, Human
ucccaccuuggcugcagg

SEQ ID NO: 3872981 - RNA, 20 nt, Human
ucccacgaauuugcugggga

SEQ ID NO: 3872982 - RNA, 21 nt, Human
ucccacgaauuugcuggggaa

SEQ ID NO: 3872983 - RNA, 20 nt, Human
ucccacgcacuccaugagca

SEQ ID NO: 3872984 - RNA, 18 nt, Human
ucccacgcuucucuuugg

SEQ ID NO: 3872985 - RNA, 17 nt, Human
ucccacggccuuucuag

SEQ ID NO: 3872986 - RNA, 17 nt, Human
ucccacgugucuuccac

SEQ ID NO: 3872987 - RNA, 14 nt, Human
ucccacuaucuggg

SEQ ID NO: 3872988 - RNA, 17 nt, Human
ucccacucaagccaagc

SEQ ID NO: 3872989 - RNA, 15 nt, Human
ucccacucaccccgg

SEQ ID NO: 3872990 - RNA, 22 nt, Human
ucccacuccaagcccagcccau

SEQ ID NO: 3872991 - RNA, 17 nt, Human
ucccacucuagggcagu

SEQ ID NO: 3872992 - RNA, 13 nt, Human
ucccacucuccua

SEQ ID NO: 3872993 - RNA, 13 nt, Human
ucccacugcaccc

SEQ ID NO: 3872994 - RNA, 16 nt, Human
ucccacugcacccccu

SEQ ID NO: 3872995 - RNA, 18 nt, Human
ucccacugccucagguuc

SEQ ID NO: 3872996 - RNA, 21 nt, Human
ucccacuucagccucccaagc

SEQ ID NO: 3872997 - RNA, 15 nt, Human
ucccacuuccccucc

SEQ ID NO: 3872998 - RNA, 20 nt, Human
ucccacuuccccuccuaccc

SEQ ID NO: 3872999 - RNA, 13 nt, Human
ucccagaagauga

SEQ ID NO: 3873000 - RNA, 17 nt, Human
ucccagaagaugacuga

SEQ ID NO: 3873001 - RNA, 20 nt, Human
ucccagaaggaccuccugag

SEQ ID NO: 3873002 - RNA, 12 nt, Human
ucccagaaucaa

SEQ ID NO: 3873003 - RNA, 18 nt, Human
ucccagaaucccagccgg

SEQ ID NO: 3873004 - RNA, 19 nt, Human
ucccagaaucccagccggc

SEQ ID NO: 3873005 - RNA, 17 nt, Human
ucccagaccccgacacc

SEQ ID NO: 3873006 - RNA, 17 nt, Human
ucccagagacaggaaaa

SEQ ID NO: 3873007 - RNA, 14 nt, Human
ucccagagagcccg

SEQ ID NO: 3873008 - RNA, 16 nt, Human
ucccagagcaaaauaa

SEQ ID NO: 3873009 - RNA, 13 nt, Human
ucccagagcaccu

SEQ ID NO: 3873010 - RNA, 15 nt, Human
ucccagagcaccugc

SEQ ID NO: 3873011 - RNA, 20 nt, Human
ucccagagcucccucugccc

SEQ ID NO: 3873012 - RNA, 19 nt, Human
ucccagagcugguggaccc

SEQ ID NO: 3873013 - RNA, 23 nt, Human
ucccagaggggccugccaccugg

SEQ ID NO: 3873014 - RNA, 21 nt, Human
ucccagaggguuuccaugggg

SEQ ID NO: 3873015 - RNA, 17 nt, Human
ucccagaucggaucugu

SEQ ID NO: 3873016 - RNA, 20 nt, Human
ucccagauuggcucacacug

SEQ ID NO: 3873017 - RNA, 20 nt, Human
ucccagauuucagucuuuuc

SEQ ID NO: 3873018 - RNA, 15 nt, Human
ucccagcaccugccu

SEQ ID NO: 3873019 - RNA, 16 nt, Human
ucccagcacuuuggga

SEQ ID NO: 3873020 - RNA, 18 nt, Human
ucccagcacuuugggagg

SEQ ID NO: 3873021 - RNA, 21 nt, Human
ucccagcacuuugggaggcca

SEQ ID NO: 3873022 - RNA, 23 nt, Human
ucccagcacuuugggaggccaag

SEQ ID NO: 3873023 - RNA, 23 nt, Human
ucccagcacuuugggaggcugag

SEQ ID NO: 3873024 - RNA, 14 nt, Human
ucccagcagccagc

SEQ ID NO: 3873025 - RNA, 13 nt, Human
ucccagccacccc

SEQ ID NO: 3873026 - RNA, 22 nt, Human
ucccagccacucgggaggcuga

SEQ ID NO: 3873027 - RNA, 18 nt, Human
ucccagccagcaguucag

SEQ ID NO: 3873028 - RNA, 15 nt, Human
ucccagccaggcccu

SEQ ID NO: 3873029 - RNA, 16 nt, Human
ucccagcccccugacc

SEQ ID NO: 3873030 - RNA, 18 nt, Human
ucccagcccccugaccac

SEQ ID NO: 3873031 - RNA, 16 nt, Human
ucccagcccuauggau

SEQ ID NO: 3873032 - RNA, 17 nt, Human
ucccagcccuauggaug

SEQ ID NO: 3873033 - RNA, 18 nt, Human
ucccagcccuauggaugu

SEQ ID NO: 3873034 - RNA, 14 nt, Human
ucccagccuuggca

SEQ ID NO: 3873035 - RNA, 14 nt, Human
ucccagcuacucag

SEQ ID NO: 3873036 - RNA, 16 nt, Human
ucccagcuacucagaa

SEQ ID NO: 3873037 - RNA, 19 nt, Human
ucccagcuacucagaagcc

SEQ ID NO: 3873038 - RNA, 16 nt, Human
ucccagcuacucagga

SEQ ID NO: 3873039 - RNA, 19 nt, Human
ucccagcuacuugggaggc

SEQ ID NO: 3873040 - RNA, 20 nt, Human
ucccagcuaggaagagcagg

SEQ ID NO: 3873041 - RNA, 17 nt, Human
ucccagcucacgucaca

SEQ ID NO: 3873042 - RNA, 15 nt, Human
ucccagcuccacccc

SEQ ID NO: 3873043 - RNA, 18 nt, Human
ucccagcucucccucugg

SEQ ID NO: 3873044 - RNA, 12 nt, Human
ucccagcugccu

SEQ ID NO: 3873045 - RNA, 14 nt, Human
ucccagcugccuag

SEQ ID NO: 3873046 - RNA, 15 nt, Human
ucccaggacaccaca

SEQ ID NO: 3873047 - RNA, 18 nt, Human
ucccaggaccacaggcuc

SEQ ID NO: 3873048 - RNA, 14 nt, Human
ucccaggacccuga

SEQ ID NO: 3873049 - RNA, 17 nt, Human
ucccaggagccugccca

SEQ ID NO: 3873050 - RNA, 18 nt, Human
ucccaggagccugcccag

SEQ ID NO: 3873051 - RNA, 22 nt, Human
ucccaggaguggaggaggccug

SEQ ID NO: 3873052 - RNA, 15 nt, Human
ucccaggaguucugc

SEQ ID NO: 3873053 - RNA, 15 nt, Human
ucccaggaugcuggg

SEQ ID NO: 3873054 - RNA, 16 nt, Human
ucccaggauguacaag

SEQ ID NO: 3873055 - RNA, 20 nt, Human
ucccaggcaaggcuguggac

SEQ ID NO: 3873056 - RNA, 17 nt, Human
ucccaggcauuccccag

SEQ ID NO: 3873057 - RNA, 19 nt, Human
ucccaggcauuccccagga

SEQ ID NO: 3873058 - RNA, 21 nt, Human
ucccaggcauuccccaggagg

SEQ ID NO: 3873059 - RNA, 19 nt, Human
ucccaggcccacugugccu

SEQ ID NO: 3873060 - RNA, 21 nt, Human
ucccaggccccaugaccucca

SEQ ID NO: 3873061 - RNA, 23 nt, Human
ucccaggccccaugaccuccagc

SEQ ID NO: 3873062 - RNA, 18 nt, Human
ucccaggcugagccucag

SEQ ID NO: 3873063 - RNA, 19 nt, Human
ucccaggcugagccucagu

SEQ ID NO: 3873064 - RNA, 18 nt, Human
ucccaggcuucacccuga

SEQ ID NO: 3873065 - RNA, 22 nt, Human
ucccaggcuucacccugaaugg

SEQ ID NO: 3873066 - RNA, 20 nt, Human
uccuggucuugagaugucuu

SEQ ID NO: 3873067 - RNA, 13 nt, Human
uccuggugccacc

SEQ ID NO: 3873068 - RNA, 14 nt, Human
uccuggugccaccu

SEQ ID NO: 3873069 - RNA, 22 nt, Human
uccuggugcccuggaugcccag

SEQ ID NO: 3873070 - RNA, 15 nt, Human
uccuggugcucucug

SEQ ID NO: 3873071 - RNA, 17 nt, Human
uccugguggggcagcuc

SEQ ID NO: 3873072 - RNA, 17 nt, Human
uccugguggguccaggg

SEQ ID NO: 3873073 - RNA, 18 nt, Human
uccuggugguauuuucaa

SEQ ID NO: 3873074 - RNA, 15 nt, Human
uccuggugucacccc

SEQ ID NO: 3873075 - RNA, 18 nt, Human
uccuggugucaccccaga

SEQ ID NO: 3873076 - RNA, 21 nt, Human
uccuggugucacuuacuguuu

SEQ ID NO: 3873077 - RNA, 14 nt, Human
uccuggugugaagg

SEQ ID NO: 3873078 - RNA, 15 nt, Human
uccugguguggaaga

SEQ ID NO: 3873079 - RNA, 15 nt, Human
uccugguucccguuu

SEQ ID NO: 3873080 - RNA, 20 nt, Human
uccuguaaacacucagcugu

SEQ ID NO: 3873081 - RNA, 21 nt, Human
uccuguaaacacucagcuguu

SEQ ID NO: 3873082 - RNA, 19 nt, Human
uccuguaaaugguguacau

SEQ ID NO: 3873083 - RNA, 17 nt, Human
uccuguacacugaauau

SEQ ID NO: 3873084 - RNA, 20 nt, Human
uccuguagaccuagggagga

SEQ ID NO: 3873085 - RNA, 15 nt, Human
uccuguagcaucuuc

SEQ ID NO: 3873086 - RNA, 22 nt, Human
uccuguagcaucuucuggaguc

SEQ ID NO: 3873087 - RNA, 21 nt, Human
uccuguagccuucuguaggaa

SEQ ID NO: 3873088 - RNA, 22 nt, Human
uccuguagccuucuguaggaau

SEQ ID NO: 3873089 - RNA, 19 nt, Human
uccuguaggaguucuauuu

SEQ ID NO: 3873090 - RNA, 15 nt, Human
uccuguaguuuuauu

SEQ ID NO: 3873091 - RNA, 14 nt, Human
uccuguauaagcac

SEQ ID NO: 3873092 - RNA, 14 nt, Human
uccugucagugccg

SEQ ID NO: 3873093 - RNA, 15 nt, Human
uccugucaucugaga

SEQ ID NO: 3873094 - RNA, 17 nt, Human
uccuguccacacccagc

SEQ ID NO: 3873095 - RNA, 15 nt, Human
uccuguccagcucca

SEQ ID NO: 3873096 - RNA, 14 nt, Human
uccugucccugcgc

SEQ ID NO: 3873097 - RNA, 21 nt, Human
uccugucccuucucuuaauuu

SEQ ID NO: 3873098 - RNA, 13 nt, Human
uccuguccgcccu

SEQ ID NO: 3873099 - RNA, 10 nt, Human
uccuguccuc

SEQ ID NO: 3873100 - RNA, 21 nt, Human
uccuguccucccauccccugg

SEQ ID NO: 3873101 - RNA, 13 nt, Human
uccuguccugcuc

SEQ ID NO: 3873102 - RNA, 23 nt, Human
uccuguccuuuacacauucggcu

SEQ ID NO: 3873103 - RNA, 19 nt, Human
uccugucggagcccugucu

SEQ ID NO: 3873104 - RNA, 11 nt, Human
uccugucuccc

SEQ ID NO: 3873105 - RNA, 13 nt, Human
uccugucuccccu

SEQ ID NO: 3873106 - RNA, 21 nt, Human
uccugucugccagccagcagc

SEQ ID NO: 3873107 - RNA, 17 nt, Human
uccugucuucccagggu

SEQ ID NO: 3873108 - RNA, 13 nt, Human
uccugucuucugc

SEQ ID NO: 3873109 - RNA, 18 nt, Human
uccugucuuuaaggaaaa

SEQ ID NO: 3873110 - RNA, 16 nt, Human
uccugucuuuacaaau

SEQ ID NO: 3873111 - RNA, 22 nt, Human
uccugugaaugccacugccuuc

SEQ ID NO: 3873112 - RNA, 18 nt, Human
uccugugacuucagcucu

SEQ ID NO: 3873113 - RNA, 18 nt, Human
uccugugagguuucccaa

SEQ ID NO: 3873114 - RNA, 19 nt, Human
uccugugagguuucccaau

SEQ ID NO: 3873115 - RNA, 17 nt, Human
uccugugaucuuauuuu

SEQ ID NO: 3873116 - RNA, 14 nt, Human
uccugugcacagcc

SEQ ID NO: 3873117 - RNA, 13 nt, Human
uccugugccaggu

SEQ ID NO: 3873118 - RNA, 18 nt, Human
uccugugcuacuuugccu

SEQ ID NO: 3873119 - RNA, 12 nt, Human
uccugugcuggg

SEQ ID NO: 3873120 - RNA, 18 nt, Human
uccuguggaacccagcag

SEQ ID NO: 3873121 - RNA, 23 nt, Human
uccuguggaaggcagagaaaucu

SEQ ID NO: 3873122 - RNA, 14 nt, Human
uccuguggcaggca

SEQ ID NO: 3873123 - RNA, 16 nt, Human
uccuguggcaggcagc

SEQ ID NO: 3873124 - RNA, 20 nt, Human
uccuguggcaggcagcgcca

SEQ ID NO: 3873125 - RNA, 16 nt, Human
uccuguggcauaaauu

SEQ ID NO: 3873126 - RNA, 14 nt, Human
uccugugggagccu

SEQ ID NO: 3873127 - RNA, 15 nt, Human
uccugugggagccuc

SEQ ID NO: 3873128 - RNA, 13 nt, Human
uccuguggggaaa

SEQ ID NO: 3873129 - RNA, 23 nt, Human
uccuguguaaucauuucuugggc

SEQ ID NO: 3873130 - RNA, 16 nt, Human
uccuguguacuguguc

SEQ ID NO: 3873131 - RNA, 16 nt, Human
uccugugucaauccag

SEQ ID NO: 3873132 - RNA, 18 nt, Human
uccuguguggagagggaa

SEQ ID NO: 3873133 - RNA, 21 nt, Human
uccuguguggagagggaaugu

SEQ ID NO: 3873134 - RNA, 19 nt, Human
uccuguguguuaagcucug

SEQ ID NO: 3873135 - RNA, 16 nt, Human
uccuguuagcuccuca

SEQ ID NO: 3873136 - RNA, 23 nt, Human
uccuguuagcuguuauuucuauu

SEQ ID NO: 3873137 - RNA, 15 nt, Human
uccuguucacaccag

SEQ ID NO: 3873138 - RNA, 16 nt, Human
uccuguucagcauucu

SEQ ID NO: 3873139 - RNA, 19 nt, Human
uccuguucuuaagacguga

SEQ ID NO: 3873140 - RNA, 22 nt, Human
uccuguugcacccagcccuggu

SEQ ID NO: 3873141 - RNA, 21 nt, Human
uccuguuggauuuguuuaaaa

SEQ ID NO: 3873142 - RNA, 21 nt, Human
uccuguugggagagggcgcag

SEQ ID NO: 3873143 - RNA, 17 nt, Human
uccuguugucaagaaua

SEQ ID NO: 3873144 - RNA, 20 nt, Human
uccuguuguuauggaaacug

SEQ ID NO: 3873145 - RNA, 19 nt, Human
uccuguuguuguuaaugaa

SEQ ID NO: 3873146 - RNA, 21 nt, Human
uccuguuguuguuaaugaaaa

SEQ ID NO: 3873147 - RNA, 13 nt, Human
uccuguuucugaa

SEQ ID NO: 3873148 - RNA, 21 nt, Human
uccuguuucugaaaagaaaua

SEQ ID NO: 3873149 - RNA, 13 nt, Human
uccuguuugucua

SEQ ID NO: 3873150 - RNA, 17 nt, Human
uccuguuuugcacagcc

SEQ ID NO: 3873151 - RNA, 14 nt, Human
uccuguuuuucaca

SEQ ID NO: 3873152 - RNA, 20 nt, Human
uccuguuuuucuggguggcc

SEQ ID NO: 3873153 - RNA, 13 nt, Human
uccuguuuuuguu

SEQ ID NO: 3873154 - RNA, 19 nt, Human
uccuguuuuuguuaacuuu

SEQ ID NO: 3873155 - RNA, 19 nt, Human
uccuuaaaaaucacacugu

SEQ ID NO: 3873156 - RNA, 23 nt, Human
uccuuaaaggcaccaucuaauag

SEQ ID NO: 3873157 - RNA, 23 nt, Human
uccuuaaauaaacucaaugagcu

SEQ ID NO: 3873158 - RNA, 13 nt, Human
uccuuaagaacac

SEQ ID NO: 3873159 - RNA, 19 nt, Human
uccuuaaggcucuuuugua

SEQ ID NO: 3873160 - RNA, 11 nt, Human
uccuuaaguau

SEQ ID NO: 3873161 - RNA, 17 nt, Human
uccuuaauucacuccca

SEQ ID NO: 3873162 - RNA, 16 nt, Human
uccuuaccagcagagc

SEQ ID NO: 3873163 - RNA, 20 nt, Human
uccuuaccagcagagcaccu

SEQ ID NO: 3873164 - RNA, 14 nt, Human
uccuuaccucuucc

SEQ ID NO: 3873165 - RNA, 17 nt, Human
uccuuaccucuuccgga

SEQ ID NO: 3873166 - RNA, 14 nt, Human
uccuuacuccugug

SEQ ID NO: 3873167 - RNA, 17 nt, Human
uccuuacuccuguggga

SEQ ID NO: 3873168 - RNA, 23 nt, Human
uccuuacuccugugggagccucg

SEQ ID NO: 3873169 - RNA, 20 nt, Human
uccuuacuuuuuauauauau

SEQ ID NO: 3873170 - RNA, 17 nt, Human
uccuuagaccuuccaua

SEQ ID NO: 3873171 - RNA, 13 nt, Human
uccuuagcugcca

SEQ ID NO: 3873172 - RNA, 14 nt, Human
uccuuagcugccaa

SEQ ID NO: 3873173 - RNA, 22 nt, Human
uccuuagucuucucauagcauu

SEQ ID NO: 3873174 - RNA, 21 nt, Human
uccuuauggguagggcucuga

SEQ ID NO: 3873175 - RNA, 15 nt, Human
uccuucaaaauccuu

SEQ ID NO: 3873176 - RNA, 16 nt, Human
uccuucaaagcaaaug

SEQ ID NO: 3873177 - RNA, 18 nt, Human
uccuucaaagucucaaug

SEQ ID NO: 3873178 - RNA, 21 nt, Human
uccuucaaaguuuaauaaauu

SEQ ID NO: 3873179 - RNA, 20 nt, Human
uccuucaacaaggcuugcug

SEQ ID NO: 3873180 - RNA, 21 nt, Human
uccuucaacaaggcuugcugc

SEQ ID NO: 3873181 - RNA, 20 nt, Human
uccuucaacaauucuaaaau

SEQ ID NO: 3873182 - RNA, 20 nt, Human
uccuucaagaacucugggcu

SEQ ID NO: 3873183 - RNA, 21 nt, Human
uccuucaagaacucugggcug

SEQ ID NO: 3873184 - RNA, 19 nt, Human
uccuucaaguuagcucagg

SEQ ID NO: 3873185 - RNA, 14 nt, Human
uccuucacauccug

SEQ ID NO: 3873186 - RNA, 20 nt, Human
uccuucaccuuuguccccac

SEQ ID NO: 3873187 - RNA, 13 nt, Human
uccuucagacacc

SEQ ID NO: 3873188 - RNA, 18 nt, Human
uccuucagcacuuuagaa

SEQ ID NO: 3873189 - RNA, 15 nt, Human
uccuucagcccucac

SEQ ID NO: 3873190 - RNA, 11 nt, Human
uccuucagugc

SEQ ID NO: 3873191 - RNA, 12 nt, Human
uccuucagugcc

SEQ ID NO: 3873192 - RNA, 13 nt, Human
uccuucagugccu

SEQ ID NO: 3873193 - RNA, 15 nt, Human
uccuucagugccuua

SEQ ID NO: 3873194 - RNA, 20 nt, Human
uccuucaucuuuuaaagaaa

SEQ ID NO: 3873195 - RNA, 22 nt, Human
uccuucauuucugauauagaau

SEQ ID NO: 3873196 - RNA, 14 nt, Human
uccuuccaacagga

SEQ ID NO: 3873197 - RNA, 15 nt, Human
uccuuccaccaaguu

SEQ ID NO: 3873198 - RNA, 14 nt, Human
uccuuccaccuccc

SEQ ID NO: 3873199 - RNA, 17 nt, Human
uccuuccaccucccucc

SEQ ID NO: 3873200 - RNA, 22 nt, Human
uccuuccagcuagugacccaca

SEQ ID NO: 3873201 - RNA, 21 nt, Human
uccuuccaggcccccaccacu

SEQ ID NO: 3873202 - RNA, 15 nt, Human
uccuuccaguauaac

SEQ ID NO: 3873203 - RNA, 21 nt, Human
uccuuccaguguccuuagaac

SEQ ID NO: 3873204 - RNA, 15 nt, Human
uccuucccacucugu

SEQ ID NO: 3873205 - RNA, 17 nt, Human
uccuucccacucuucuc

SEQ ID NO: 3873206 - RNA, 19 nt, Human
uccuucccacucuucucau

SEQ ID NO: 3873207 - RNA, 16 nt, Human
uccuucccagcugccc

SEQ ID NO: 3873208 - RNA, 21 nt, Human
uccuucccagcugccccuccc

SEQ ID NO: 3873209 - RNA, 20 nt, Human
uccuucccaggaguggagga

SEQ ID NO: 3873210 - RNA, 14 nt, Human
uccuucccauggag

SEQ ID NO: 3873211 - RNA, 22 nt, Human
ucgcuucuguguaucucuuuca

SEQ ID NO: 3873212 - RNA, 12 nt, Human
ucgcuuguaaau

SEQ ID NO: 3873213 - RNA, 20 nt, Human
ucgcuugugcagaaaacauu

SEQ ID NO: 3873214 - RNA, 20 nt, Human
ucggaaccugugagcugcac

SEQ ID NO: 3873215 - RNA, 22 nt, Human
ucggaacugcaugcugcuggac

SEQ ID NO: 3873216 - RNA, 16 nt, Human
ucggaagcagugccuu

SEQ ID NO: 3873217 - RNA, 23 nt, Human
ucggaccgcuuguggggacccag

SEQ ID NO: 3873218 - RNA, 23 nt, Human
ucggacuaagccuaccugcucuc

SEQ ID NO: 3873219 - RNA, 18 nt, Human
ucggacuuagcugggaga

SEQ ID NO: 3873220 - RNA, 21 nt, Human
ucggagaagagcgcaguguuu

SEQ ID NO: 3873221 - RNA, 23 nt, Human
ucggagccucauccgaggcaggg

SEQ ID NO: 3873222 - RNA, 13 nt, Human
ucggaggaagccc

SEQ ID NO: 3873223 - RNA, 20 nt, Human
ucggaggccccaaaggaaaa

SEQ ID NO: 3873224 - RNA, 19 nt, Human
ucggaggccccacugaugc

SEQ ID NO: 3873225 - RNA, 22 nt, Human
ucggaggcuugucagagcuggg

SEQ ID NO: 3873226 - RNA, 12 nt, Human
ucggaguucuuc

SEQ ID NO: 3873227 - RNA, 16 nt, Human
ucggauuuuuuccaaa

SEQ ID NO: 3873228 - RNA, 17 nt, Human
ucggauuuuuuccaaaa

SEQ ID NO: 3873229 - RNA, 18 nt, Human
ucggcaacuaagcagucc

SEQ ID NO: 3873230 - RNA, 12 nt, Human
ucggcccacagc

SEQ ID NO: 3873231 - RNA, 19 nt, Human
ucggcccacagcucccacc

SEQ ID NO: 3873232 - RNA, 18 nt, Human
ucggccuccauccugagg

SEQ ID NO: 3873233 - RNA, 19 nt, Human
ucggccucccaaagugcug

SEQ ID NO: 3873234 - RNA, 22 nt, Human
ucggccucccaaagugcuggga

SEQ ID NO: 3873235 - RNA, 17 nt, Human
ucggccucuaaccccag

SEQ ID NO: 3873236 - RNA, 14 nt, Human
ucggccugccccca

SEQ ID NO: 3873237 - RNA, 17 nt, Human
ucggcguggcccaaggc

SEQ ID NO: 3873238 - RNA, 22 nt, Human
ucggcguggcccaaggcuggca

SEQ ID NO: 3873239 - RNA, 14 nt, Human
ucggcucagcucgg

SEQ ID NO: 3873240 - RNA, 12 nt, Human
ucggcucccugg

SEQ ID NO: 3873241 - RNA, 11 nt, Human
ucggcuccugc

SEQ ID NO: 3873242 - RNA, 13 nt, Human
ucggcuccugcug

SEQ ID NO: 3873243 - RNA, 14 nt, Human
ucggcuccugcugc

SEQ ID NO: 3873244 - RNA, 18 nt, Human
ucggcuccugcugcacca

SEQ ID NO: 3873245 - RNA, 15 nt, Human
ucgggaaccucacuc

SEQ ID NO: 3873246 - RNA, 15 nt, Human
ucgggaagagaggag

SEQ ID NO: 3873247 - RNA, 16 nt, Human
ucgggaagagaggagu

SEQ ID NO: 3873248 - RNA, 21 nt, Human
ucgggaagagaggaguucaau

SEQ ID NO: 3873249 - RNA, 22 nt, Human
ucgggaagagaggaguucaaug

SEQ ID NO: 3873250 - RNA, 21 nt, Human
ucgggagacagcaucaggguu

SEQ ID NO: 3873251 - RNA, 13 nt, Human
ucgggagcagugu

SEQ ID NO: 3873252 - RNA, 19 nt, Human
ucgggagcagugucuucca

SEQ ID NO: 3873253 - RNA, 22 nt, Human
ucgggagcagugucuuccauaa

SEQ ID NO: 3873254 - RNA, 16 nt, Human
ucgggaggcugagaca

SEQ ID NO: 3873255 - RNA, 17 nt, Human
ucgggaggucgaggcag

SEQ ID NO: 3873256 - RNA, 17 nt, Human
ucgggcaccagccagcg

SEQ ID NO: 3873257 - RNA, 14 nt, Human
ucgggcccaccugg

SEQ ID NO: 3873258 - RNA, 17 nt, Human
ucgggcccaccuggcca

SEQ ID NO: 3873259 - RNA, 18 nt, Human
ucgggcccaccuggccac

SEQ ID NO: 3873260 - RNA, 11 nt, Human
ucgggcccagc

SEQ ID NO: 3873261 - RNA, 12 nt, Human
ucgggcccagcc

SEQ ID NO: 3873262 - RNA, 17 nt, Human
ucgggcccaggccaucu

SEQ ID NO: 3873263 - RNA, 17 nt, Human
ucgggccccaccugcag

SEQ ID NO: 3873264 - RNA, 21 nt, Human
ucgggcccuucuugcugcccu

SEQ ID NO: 3873265 - RNA, 12 nt, Human
ucgggcucagcu

SEQ ID NO: 3873266 - RNA, 15 nt, Human
ucgggcucagcucug

SEQ ID NO: 3873267 - RNA, 14 nt, Human
ucgggcucccgggu

SEQ ID NO: 3873268 - RNA, 12 nt, Human
ucgggcuccugu

SEQ ID NO: 3873269 - RNA, 16 nt, Human
ucgggcuccugugccc

SEQ ID NO: 3873270 - RNA, 17 nt, Human
ucgggcuccugugcccu

SEQ ID NO: 3873271 - RNA, 17 nt, Human
ucggggauguguccuga

SEQ ID NO: 3873272 - RNA, 15 nt, Human
ucggggcaucuggcc

SEQ ID NO: 3873273 - RNA, 18 nt, Human
ucggggcaugcuggggca

SEQ ID NO: 3873274 - RNA, 16 nt, Human
ucgggggcuggccuag

SEQ ID NO: 3873275 - RNA, 14 nt, Human
ucgggggcuggggc

SEQ ID NO: 3873276 - RNA, 17 nt, Human
ucggggugcacaggagg

SEQ ID NO: 3873277 - RNA, 22 nt, Human
ucggggugcacaggaggggguc

SEQ ID NO: 3873278 - RNA, 12 nt, Human
ucggucaccuug

SEQ ID NO: 3873279 - RNA, 13 nt, Human
ucggucaccuugu

SEQ ID NO: 3873280 - RNA, 16 nt, Human
ucgguguccccaccau

SEQ ID NO: 3873281 - RNA, 19 nt, Human
ucgguguccccaccaucug

SEQ ID NO: 3873282 - RNA, 20 nt, Human
ucgguguccccaccaucugc

SEQ ID NO: 3873283 - RNA, 21 nt, Human
ucgguguccccaccaucugcu

SEQ ID NO: 3873284 - RNA, 23 nt, Human
ucgguuccacgucccccuggggc

SEQ ID NO: 3873285 - RNA, 19 nt, Human
ucgguuucuaacuuggagc

SEQ ID NO: 3873286 - RNA, 13 nt, Human
ucgguuucuccaa

SEQ ID NO: 3873287 - RNA, 19 nt, Human
ucgguuuuuuuccuguuuc

SEQ ID NO: 3873288 - RNA, 16 nt, Human
ucguaaaauuaagaaa

SEQ ID NO: 3873289 - RNA, 15 nt, Human
ucguacaguucuucg

SEQ ID NO: 3873290 - RNA, 22 nt, Human
ucguacauaauacugaaccacu

SEQ ID NO: 3873291 - RNA, 22 nt, Human
ucguauagaagucuucaugaaa

SEQ ID NO: 3873292 - RNA, 21 nt, Human
ucgucauguuggccaggcugg

SEQ ID NO: 3873293 - RNA, 16 nt, Human
ucgucugacugugugu

SEQ ID NO: 3873294 - RNA, 18 nt, Human
ucgucuguuuauaaacau

SEQ ID NO: 3873295 - RNA, 12 nt, Human
ucgucuucacuc

SEQ ID NO: 3873296 - RNA, 17 nt, Human
ucgucuuccgucucccc

SEQ ID NO: 3873297 - RNA, 10 nt, Human
ucgucuuugc

SEQ ID NO: 3873298 - RNA, 21 nt, Human
ucgugaagaagccuguaacac

SEQ ID NO: 3873299 - RNA, 17 nt, Human
ucgugaaguauacugua

SEQ ID NO: 3873300 - RNA, 17 nt, Human
ucgugaccugcuaggcc

SEQ ID NO: 3873301 - RNA, 18 nt, Human
ucgugacgcugaauaaau

SEQ ID NO: 3873302 - RNA, 21 nt, Human
ucgugacgcugaauaaauguc

SEQ ID NO: 3873303 - RNA, 22 nt, Human
ucgugacgcugaauaaaugucu

SEQ ID NO: 3873304 - RNA, 22 nt, Human
ucgugccagucgcgcugccugu

SEQ ID NO: 3873305 - RNA, 20 nt, Human
ucgugccguuacucuccaac

SEQ ID NO: 3873306 - RNA, 23 nt, Human
ucgugccguuacucuccaaccug

SEQ ID NO: 3873307 - RNA, 14 nt, Human
ucgugccugugucc

SEQ ID NO: 3873308 - RNA, 18 nt, Human
ucgugcggaaucagcuuc

SEQ ID NO: 3873309 - RNA, 23 nt, Human
ucguggaaagggugcugcuuccc

SEQ ID NO: 3873310 - RNA, 18 nt, Human
ucguggacacacacagac

SEQ ID NO: 3873311 - RNA, 20 nt, Human
ucguggacaccugcccugcc

SEQ ID NO: 3873312 - RNA, 10 nt, Human
ucguggagag

SEQ ID NO: 3873313 - RNA, 12 nt, Human
ucguggagagcu

SEQ ID NO: 3873314 - RNA, 16 nt, Human
ucguggagagcuagga

SEQ ID NO: 3873315 - RNA, 17 nt, Human
ucguggagaugucuucg

SEQ ID NO: 3873316 - RNA, 19 nt, Human
ucguggagaugucuucgua

SEQ ID NO: 3873317 - RNA, 13 nt, Human
ucguggccagccc

SEQ ID NO: 3873318 - RNA, 17 nt, Human
ucguggccagcccggcu

SEQ ID NO: 3873319 - RNA, 20 nt, Human
ucguggccuuccccagccuc

SEQ ID NO: 3873320 - RNA, 13 nt, Human
ucguggcugucaa

SEQ ID NO: 3873321 - RNA, 23 nt, Human
ucgugggagagagacguguacau

SEQ ID NO: 3873322 - RNA, 20 nt, Human
ucgugggaucugccccuccc

SEQ ID NO: 3873323 - RNA, 15 nt, Human
ucgugggugugugua

SEQ ID NO: 3873324 - RNA, 16 nt, Human
ucguguauccuggggc

SEQ ID NO: 3873325 - RNA, 15 nt, Human
ucguguguagaaaaa

SEQ ID NO: 3873326 - RNA, 21 nt, Human
ucguguguuucuauuuuuuga

SEQ ID NO: 3873327 - RNA, 14 nt, Human
ucguuaacugugua

SEQ ID NO: 3873328 - RNA, 21 nt, Human
ucguuaacuguguauguacau

SEQ ID NO: 3873329 - RNA, 22 nt, Human
ucguuaacuguguauguacaua

SEQ ID NO: 3873330 - RNA, 13 nt, Human
ucguuaauuugua

SEQ ID NO: 3873331 - RNA, 23 nt, Human
ucguuagaccgcucucuuuucug

SEQ ID NO: 3873332 - RNA, 21 nt, Human
ucguuagggaagagaaacagg

SEQ ID NO: 3873333 - RNA, 18 nt, Human
ucguuaguaaucuguaua

SEQ ID NO: 3873334 - RNA, 22 nt, Human
ucguucgcagagcuuuucagau

SEQ ID NO: 3873335 - RNA, 11 nt, Human
ucguucugugg

SEQ ID NO: 3873336 - RNA, 15 nt, Human
ucguucuguuuacau

SEQ ID NO: 3873337 - RNA, 19 nt, Human
ucguucuguuuacaucagu

SEQ ID NO: 3873338 - RNA, 15 nt, Human
ucguucuuguuagua

SEQ ID NO: 3873339 - RNA, 18 nt, Human
ucguucuuuuuaaguuaa

SEQ ID NO: 3873340 - RNA, 16 nt, Human
ucguugacuuuaggga

SEQ ID NO: 3873341 - RNA, 22 nt, Human
ucguugguuauacaaguucuug

SEQ ID NO: 3873342 - RNA, 14 nt, Human
ucguuuaaugaaug

SEQ ID NO: 3873343 - RNA, 15 nt, Human
ucguuuacuaugccu

SEQ ID NO: 3873344 - RNA, 16 nt, Human
ucguuucaaaaacaca

SEQ ID NO: 3873345 - RNA, 19 nt, Human
ucguuucaaaaacacagug

SEQ ID NO: 3873346 - RNA, 13 nt, Human
ucguuucuguaua

SEQ ID NO: 3873347 - RNA, 14 nt, Human
ucguuuguguucug

SEQ ID NO: 3873348 - RNA, 14 nt, Human
ucguuuguuuguuu

SEQ ID NO: 3873349 - RNA, 13 nt, Human
ucguuuucuuaaa

SEQ ID NO: 3873350 - RNA, 17 nt, Human
ucguuuuuuucauucca

SEQ ID NO: 3873351 - RNA, 14 nt, Human
ucuaaaaauauaca

SEQ ID NO: 3873352 - RNA, 11 nt, Human
ucuaaaacaau

SEQ ID NO: 3873353 - RNA, 17 nt, Human
ucuaaaacuaaauagca

SEQ ID NO: 3873354 - RNA, 20 nt, Human
ucuaaaacuaaauagcaugu

SEQ ID NO: 3873355 - RNA, 12 nt, Human
ucuaaaacugua

SEQ ID NO: 3873356 - RNA, 18 nt, Human
ucugcaggucccuaauaa

SEQ ID NO: 3873357 - RNA, 21 nt, Human
ucugcaguagucucugugcuu

SEQ ID NO: 3873358 - RNA, 19 nt, Human
ucugcaguccuacucaagc

SEQ ID NO: 3873359 - RNA, 16 nt, Human
ucugcauauguugaau

SEQ ID NO: 3873360 - RNA, 21 nt, Human
ucugcauauguugaauacuuu

SEQ ID NO: 3873361 - RNA, 22 nt, Human
ucugcauccagagauucauuuu

SEQ ID NO: 3873362 - RNA, 14 nt, Human
ucugcaucccagca

SEQ ID NO: 3873363 - RNA, 21 nt, Human
ucugcaucccagcaccugccu

SEQ ID NO: 3873364 - RNA, 24 nt, Human
ucugcaucccagcaccugccuccu

SEQ ID NO: 3873365 - RNA, 18 nt, Human
ucugcaucuccugucuuu

SEQ ID NO: 3873366 - RNA, 15 nt, Human
ucugcaucugaccac

SEQ ID NO: 3873367 - RNA, 22 nt, Human
ucugcaucuuggggacaucucu

SEQ ID NO: 3873368 - RNA, 16 nt, Human
ucugcauucauuuuua

SEQ ID NO: 3873369 - RNA, 14 nt, Human
ucugcauugcccag

SEQ ID NO: 3873370 - RNA, 18 nt, Human
ucugcauugcccagucuu

SEQ ID NO: 3873371 - RNA, 18 nt, Human
ucugcauugcuagauaaa

SEQ ID NO: 3873372 - RNA, 10 nt, Human
ucugcauuua

SEQ ID NO: 3873373 - RNA, 15 nt, Human
ucugcauuuaaaaaa

SEQ ID NO: 3873374 - RNA, 15 nt, Human
ucugcauuugucuau

SEQ ID NO: 3873375 - RNA, 17 nt, Human
ucugcauuuucacccca

SEQ ID NO: 3873376 - RNA, 21 nt, Human
ucugcauuuucaccccacccu

SEQ ID NO: 3873377 - RNA, 19 nt, Human
ucugcauuuucugaaacua

SEQ ID NO: 3873378 - RNA, 20 nt, Human
ucugcauuuucugaaacuaa

SEQ ID NO: 3873379 - RNA, 20 nt, Human
ucugcauuuuucagagaaua

SEQ ID NO: 3873380 - RNA, 15 nt, Human
ucugcauuuuucugc

SEQ ID NO: 3873381 - RNA, 18 nt, Human
ucugcauuuuucugcaga

SEQ ID NO: 3873382 - RNA, 13 nt, Human
ucugccaccccua

SEQ ID NO: 3873383 - RNA, 20 nt, Human
ucugccaccuccccuaucca

SEQ ID NO: 3873384 - RNA, 23 nt, Human
ucugccaccuccccuauccaccc

SEQ ID NO: 3873385 - RNA, 14 nt, Human
ucugccacuggaag

SEQ ID NO: 3873386 - RNA, 17 nt, Human
ucugccacuucccaggu

SEQ ID NO: 3873387 - RNA, 23 nt, Human
ucugccagaagauccccucagga

SEQ ID NO: 3873388 - RNA, 22 nt, Human
ucugccagauguccuaauggug

SEQ ID NO: 3873389 - RNA, 13 nt, Human
ucugccagccagc

SEQ ID NO: 3873390 - RNA, 15 nt, Human
ucugccagccagcag

SEQ ID NO: 3873391 - RNA, 23 nt, Human
ucugccaggcccccaccacacau

SEQ ID NO: 3873392 - RNA, 12 nt, Human
ucugccagggca

SEQ ID NO: 3873393 - RNA, 17 nt, Human
ucugccagggcagugcu

SEQ ID NO: 3873394 - RNA, 23 nt, Human
ucugccagggccccucuccccag

SEQ ID NO: 3873395 - RNA, 18 nt, Human
ucugcccaauuggaggaa

SEQ ID NO: 3873396 - RNA, 17 nt, Human
ucugcccaccucggccu

SEQ ID NO: 3873397 - RNA, 12 nt, Human
ucugcccacucc

SEQ ID NO: 3873398 - RNA, 16 nt, Human
ucugcccagagcuggg

SEQ ID NO: 3873399 - RNA, 18 nt, Human
ucugcccagagcugggug

SEQ ID NO: 3873400 - RNA, 16 nt, Human
ucugcccagcuugggc

SEQ ID NO: 3873401 - RNA, 14 nt, Human
ucugcccaggggug

SEQ ID NO: 3873402 - RNA, 23 nt, Human
ucugcccaggggugcccccuccu

SEQ ID NO: 3873403 - RNA, 14 nt, Human
ucugcccauucccc

SEQ ID NO: 3873404 - RNA, 15 nt, Human
ucugccccagcccag

SEQ ID NO: 3873405 - RNA, 17 nt, Human
ucugccccagcccagau

SEQ ID NO: 3873406 - RNA, 20 nt, Human
ucugccccagcucuggcuuc

SEQ ID NO: 3873407 - RNA, 18 nt, Human
ucugccccauccuccagc

SEQ ID NO: 3873408 - RNA, 18 nt, Human
ucugcccccagcccaaag

SEQ ID NO: 3873409 - RNA, 14 nt, Human
ucugcccccugcug

SEQ ID NO: 3873410 - RNA, 13 nt, Human
ucugccccucccc

SEQ ID NO: 3873411 - RNA, 14 nt, Human
ucugccccuccccc

SEQ ID NO: 3873412 - RNA, 16 nt, Human
ucugccccucccccaa

SEQ ID NO: 3873413 - RNA, 22 nt, Human
ucugccccucccccaaccccca

SEQ ID NO: 3873414 - RNA, 18 nt, Human
ucugccccucccugcuuc

SEQ ID NO: 3873415 - RNA, 21 nt, Human
ucugcccucauuacugggccu

SEQ ID NO: 3873416 - RNA, 14 nt, Human
ucugcccugcccac

SEQ ID NO: 3873417 - RNA, 11 nt, Human
ucugcccugcg

SEQ ID NO: 3873418 - RNA, 21 nt, Human
ucugcccugugggaccccagg

SEQ ID NO: 3873419 - RNA, 18 nt, Human
ucugccgcaauacaggaa

SEQ ID NO: 3873420 - RNA, 18 nt, Human
ucugccgcccccuccuga

SEQ ID NO: 3873421 - RNA, 20 nt, Human
ucugccgcuaccucccuccc

SEQ ID NO: 3873422 - RNA, 22 nt, Human
ucugccggacccggaggccgag

SEQ ID NO: 3873423 - RNA, 16 nt, Human
ucugccggcccugggg

SEQ ID NO: 3873424 - RNA, 23 nt, Human
ucugccggcucuuuccuugcuca

SEQ ID NO: 3873425 - RNA, 16 nt, Human
ucugccggugcucgga

SEQ ID NO: 3873426 - RNA, 14 nt, Human
ucugccgucucugg

SEQ ID NO: 3873427 - RNA, 21 nt, Human
ucugccuaaggacuucuuuaa

SEQ ID NO: 3873428 - RNA, 16 nt, Human
ucugccuauugcagcu

SEQ ID NO: 3873429 - RNA, 20 nt, Human
ucugccuccaugcugcagug

SEQ ID NO: 3873430 - RNA, 20 nt, Human
ucugccucccaucacccgcu

SEQ ID NO: 3873431 - RNA, 15 nt, Human
ucugccuccucuuca

SEQ ID NO: 3873432 - RNA, 13 nt, Human
ucugccuccuuua

SEQ ID NO: 3873433 - RNA, 13 nt, Human
ucugccucuccag

SEQ ID NO: 3873434 - RNA, 14 nt, Human
ucugccucugccug

SEQ ID NO: 3873435 - RNA, 15 nt, Human
ucugccucuucuggg

SEQ ID NO: 3873436 - RNA, 18 nt, Human
ucugccugccagcugcac

SEQ ID NO: 3873437 - RNA, 15 nt, Human
ucugccugcccaggc

SEQ ID NO: 3873438 - RNA, 20 nt, Human
ucugccugcccaggccccug

SEQ ID NO: 3873439 - RNA, 22 nt, Human
ucugccugcccaggccccugcc

SEQ ID NO: 3873440 - RNA, 12 nt, Human
ucugccugcccc

SEQ ID NO: 3873441 - RNA, 13 nt, Human
ucugccuggagug

SEQ ID NO: 3873442 - RNA, 21 nt, Human
ucugccugucccucucaggca

SEQ ID NO: 3873443 - RNA, 14 nt, Human
ucugccugucuccc

SEQ ID NO: 3873444 - RNA, 14 nt, Human
ucugccugugagcc

SEQ ID NO: 3873445 - RNA, 19 nt, Human
ucugccuguuauaacucug

SEQ ID NO: 3873446 - RNA, 16 nt, Human
ucugccuuaaaaccaa

SEQ ID NO: 3873447 - RNA, 17 nt, Human
ucugccuuaaaaccaaa

SEQ ID NO: 3873448 - RNA, 14 nt, Human
ucugccuuccuugc

SEQ ID NO: 3873449 - RNA, 16 nt, Human
ucugccuuccuugcua

SEQ ID NO: 3873450 - RNA, 21 nt, Human
ucugccuucgaggucagagga

SEQ ID NO: 3873451 - RNA, 20 nt, Human
ucugccuucucaugauccaa

SEQ ID NO: 3873452 - RNA, 12 nt, Human
ucugccuugccu

SEQ ID NO: 3873453 - RNA, 11 nt, Human
ucugccuuuau

SEQ ID NO: 3873454 - RNA, 10 nt, Human
ucugccuuug

SEQ ID NO: 3873455 - RNA, 23 nt, Human
ucugccuuugacauuuaauuuag

SEQ ID NO: 3873456 - RNA, 13 nt, Human
ucugccuuugcag

SEQ ID NO: 3873457 - RNA, 11 nt, Human
ucugccuuuuc

SEQ ID NO: 3873458 - RNA, 22 nt, Human
ucugcgaaguccuauggaaacc

SEQ ID NO: 3873459 - RNA, 14 nt, Human
ucugcgccucaggc

SEQ ID NO: 3873460 - RNA, 16 nt, Human
ucugcggaccccagcu

SEQ ID NO: 3873461 - RNA, 14 nt, Human
ucugcggagcacac

SEQ ID NO: 3873462 - RNA, 17 nt, Human
ucugcgucaugcuugug

SEQ ID NO: 3873463 - RNA, 15 nt, Human
ucugcuaaauugaug

SEQ ID NO: 3873464 - RNA, 17 nt, Human
ucugcuaaauugauguu

SEQ ID NO: 3873465 - RNA, 22 nt, Human
ucugcuaagcucaaggcgugag

SEQ ID NO: 3873466 - RNA, 15 nt, Human
ucugcuaccuugccc

SEQ ID NO: 3873467 - RNA, 13 nt, Human
ucugcuagagagu

SEQ ID NO: 3873468 - RNA, 15 nt, Human
ucugcuauauauaaa

SEQ ID NO: 3873469 - RNA, 17 nt, Human
ucugcuauauuuucaug

SEQ ID NO: 3873470 - RNA, 15 nt, Human
ucugcuaugcuugaa

SEQ ID NO: 3873471 - RNA, 17 nt, Human
ucugcucacaguaaccc

SEQ ID NO: 3873472 - RNA, 15 nt, Human
ucugcucaccgccca

SEQ ID NO: 3873473 - RNA, 20 nt, Human
ucugcucaccgcccaucagg

SEQ ID NO: 3873474 - RNA, 18 nt, Human
ucugcucagauagaauga

SEQ ID NO: 3873475 - RNA, 16 nt, Human
ucugcucagcagcuau

SEQ ID NO: 3873476 - RNA, 15 nt, Human
ucugcucagcccugg

SEQ ID NO: 3873477 - RNA, 22 nt, Human
ucugcucaucauucucugucuc

SEQ ID NO: 3873478 - RNA, 14 nt, Human
ucugcuccacccuu

SEQ ID NO: 3873479 - RNA, 16 nt, Human
ucugcuccacccuugg

SEQ ID NO: 3873480 - RNA, 18 nt, Human
ucugcuccacccuuggcc

SEQ ID NO: 3873481 - RNA, 19 nt, Human
ucugcuccacccuuggccu

SEQ ID NO: 3873482 - RNA, 21 nt, Human
ucugcuccacccuuggccugu

SEQ ID NO: 3873483 - RNA, 15 nt, Human
ucugcuccagacagg

SEQ ID NO: 3873484 - RNA, 14 nt, Human
ucugcuccagcucu

SEQ ID NO: 3873485 - RNA, 13 nt, Human
ucugcucccaagg

SEQ ID NO: 3873486 - RNA, 19 nt, Human
ucugcucccaaggggccug

SEQ ID NO: 3873487 - RNA, 16 nt, Human
ucugcuccccagggga

SEQ ID NO: 3873488 - RNA, 16 nt, Human
ucugcuccucuccagg

SEQ ID NO: 3873489 - RNA, 22 nt, Human
ucugcuccuggagccuuugaau

SEQ ID NO: 3873490 - RNA, 16 nt, Human
ucugcucgggcccagg

SEQ ID NO: 3873491 - RNA, 18 nt, Human
ucugcucgggcccaggcc

SEQ ID NO: 3873492 - RNA, 22 nt, Human
ucugcucgggcccaggccaucu

SEQ ID NO: 3873493 - RNA, 18 nt, Human
ucugcucuauuauauaaa

SEQ ID NO: 3873494 - RNA, 13 nt, Human
ucugcucugaugc

SEQ ID NO: 3873495 - RNA, 16 nt, Human
ucugcucugcguguca

SEQ ID NO: 3873496 - RNA, 14 nt, Human
ucugcucuuucucu

SEQ ID NO: 3873497 - RNA, 15 nt, Human
ucugcucuuucucug

SEQ ID NO: 3873498 - RNA, 16 nt, Human
ucugcucuuucucugc

SEQ ID NO: 3873499 - RNA, 19 nt, Human
ucugcucuuucucugccag

SEQ ID NO: 3873500 - RNA, 13 nt, Human
ucugcugaaggaa

SEQ ID NO: 3873501 - RNA, 14 nt, Human
ucugcugaauuuuc

SEQ ID NO: 3873502 - RNA, 23 nt, Human
ucuguacuguuacugggcccuga

SEQ ID NO: 3873503 - RNA, 12 nt, Human
ucuguagaaaug

SEQ ID NO: 3873504 - RNA, 22 nt, Human
ucuguagaaaugguuguauuag

SEQ ID NO: 3873505 - RNA, 16 nt, Human
ucuguagagggcccug

SEQ ID NO: 3873506 - RNA, 17 nt, Human
ucuguagagggcccugg

SEQ ID NO: 3873507 - RNA, 16 nt, Human
ucuguagauucugugg

SEQ ID NO: 3873508 - RNA, 23 nt, Human
ucuguagauucuguggaacaagc

SEQ ID NO: 3873509 - RNA, 22 nt, Human
ucuguaggccaguaguucucaa

SEQ ID NO: 3873510 - RNA, 15 nt, Human
ucuguagguugcaca

SEQ ID NO: 3873511 - RNA, 16 nt, Human
ucuguagguugcacac

SEQ ID NO: 3873512 - RNA, 18 nt, Human
ucuguagguugcacacuu

SEQ ID NO: 3873513 - RNA, 21 nt, Human
ucuguagguugcacacuuugg

SEQ ID NO: 3873514 - RNA, 23 nt, Human
ucuguaguacuccuuaagaacac

SEQ ID NO: 3873515 - RNA, 15 nt, Human
ucuguagucauuuac

SEQ ID NO: 3873516 - RNA, 22 nt, Human
ucuguaguuuuaucacauguau

SEQ ID NO: 3873517 - RNA, 23 nt, Human
ucuguaguuuuaucacauguaug

SEQ ID NO: 3873518 - RNA, 15 nt, Human
ucuguauaaaugucu

SEQ ID NO: 3873519 - RNA, 18 nt, Human
ucuguauaaguaagaaaa

SEQ ID NO: 3873520 - RNA, 21 nt, Human
ucuguauaaguaagaaaauau

SEQ ID NO: 3873521 - RNA, 22 nt, Human
ucuguauaauacuuuguauaca

SEQ ID NO: 3873522 - RNA, 20 nt, Human
ucuguauagacaggagaaga

SEQ ID NO: 3873523 - RNA, 23 nt, Human
ucuguauagacaggagaagaaag

SEQ ID NO: 3873524 - RNA, 14 nt, Human
ucuguauauaaaau

SEQ ID NO: 3873525 - RNA, 14 nt, Human
ucuguauauaaaug

SEQ ID NO: 3873526 - RNA, 17 nt, Human
ucuguauauaaauggga

SEQ ID NO: 3873527 - RNA, 15 nt, Human
ucuguauauacuuuu

SEQ ID NO: 3873528 - RNA, 16 nt, Human
ucuguauauauauaua

SEQ ID NO: 3873529 - RNA, 15 nt, Human
ucuguauauuuuggg

SEQ ID NO: 3873530 - RNA, 21 nt, Human
ucuguaucggagacagugauc

SEQ ID NO: 3873531 - RNA, 22 nt, Human
ucuguauguauuagugauauuu

SEQ ID NO: 3873532 - RNA, 12 nt, Human
ucuguauguguu

SEQ ID NO: 3873533 - RNA, 20 nt, Human
ucuguauuuccccaacaugu

SEQ ID NO: 3873534 - RNA, 23 nt, Human
ucuguauuuuuucuugcauugac

SEQ ID NO: 3873535 - RNA, 17 nt, Human
ucugucacccaggcugg

SEQ ID NO: 3873536 - RNA, 12 nt, Human
ucugucacucag

SEQ ID NO: 3873537 - RNA, 19 nt, Human
ucugucagaugagaacaaa

SEQ ID NO: 3873538 - RNA, 19 nt, Human
ucugucagaugggaagaca

SEQ ID NO: 3873539 - RNA, 21 nt, Human
ucugucagcgcagguuuaguu

SEQ ID NO: 3873540 - RNA, 13 nt, Human
ucugucagcugca

SEQ ID NO: 3873541 - RNA, 14 nt, Human
ucugucagcugcaa

SEQ ID NO: 3873542 - RNA, 17 nt, Human
ucugucagucacagcca

SEQ ID NO: 3873543 - RNA, 12 nt, Human
ucugucaguucu

SEQ ID NO: 3873544 - RNA, 21 nt, Human
ucugucaucuaccuuuucucu

SEQ ID NO: 3873545 - RNA, 17 nt, Human
ucugucauuguacccuu

SEQ ID NO: 3873546 - RNA, 24 nt, Human
ucuguccaggcacugcugcccagc

SEQ ID NO: 3873547 - RNA, 17 nt, Human
ucuguccagggcccuga

SEQ ID NO: 3873548 - RNA, 20 nt, Human
ucuguccagggcccugagcu

SEQ ID NO: 3873549 - RNA, 16 nt, Human
ucuguccaucugcccg

SEQ ID NO: 3873550 - RNA, 17 nt, Human
ucuguccaucugcccgc

SEQ ID NO: 3873551 - RNA, 18 nt, Human
ucuguccaucugcccgcc

SEQ ID NO: 3873552 - RNA, 18 nt, Human
ucugucccaguuaacugu

SEQ ID NO: 3873553 - RNA, 22 nt, Human
ucuguccccuucucucaucucu

SEQ ID NO: 3873554 - RNA, 19 nt, Human
ucugucccuucugucccuc

SEQ ID NO: 3873555 - RNA, 20 nt, Human
ucugucccuucugucccuca

SEQ ID NO: 3873556 - RNA, 22 nt, Human
ucugucccuucugucccucaca

SEQ ID NO: 3873557 - RNA, 19 nt, Human
ucugucccuugccccccug

SEQ ID NO: 3873558 - RNA, 20 nt, Human
ucuguccguuuacuccaagg

SEQ ID NO: 3873559 - RNA, 19 nt, Human
ucuguccucagccuugcca

SEQ ID NO: 3873560 - RNA, 16 nt, Human
ucuguccugagaagca

SEQ ID NO: 3873561 - RNA, 12 nt, Human
ucuguccugcug

SEQ ID NO: 3873562 - RNA, 15 nt, Human
ucuguccugcuucug

SEQ ID NO: 3873563 - RNA, 17 nt, Human
ucuguccuggugucacu

SEQ ID NO: 3873564 - RNA, 17 nt, Human
ucugucgcccagucugg

SEQ ID NO: 3873565 - RNA, 17 nt, Human
ucugucgcccaugcugg

SEQ ID NO: 3873566 - RNA, 17 nt, Human
ucugucuaaaaaccaga

SEQ ID NO: 3873567 - RNA, 15 nt, Human
ucugucuaaagauag

SEQ ID NO: 3873568 - RNA, 14 nt, Human
ucugucuacaaaua

SEQ ID NO: 3873569 - RNA, 23 nt, Human
ucugucuacuugcucagguacuu

SEQ ID NO: 3873570 - RNA, 19 nt, Human
ucugucuagcaugccaaca

SEQ ID NO: 3873571 - RNA, 13 nt, Human
ucugucuaggaau

SEQ ID NO: 3873572 - RNA, 15 nt, Human
ucugucucagacuuu

SEQ ID NO: 3873573 - RNA, 14 nt, Human
ucugucucagucca

SEQ ID NO: 3873574 - RNA, 15 nt, Human
ucugucucauaugau

SEQ ID NO: 3873575 - RNA, 12 nt, Human
ucugucucaucc

SEQ ID NO: 3873576 - RNA, 21 nt, Human
ucugucucauccaucaucaug

SEQ ID NO: 3873577 - RNA, 19 nt, Human
ucugucucauccuccugga

SEQ ID NO: 3873578 - RNA, 20 nt, Human
ucugucucauccuccuggaa

SEQ ID NO: 3873579 - RNA, 17 nt, Human
ucugucuccagcuuccc

SEQ ID NO: 3873580 - RNA, 22 nt, Human
ucugucucccaguuaugaauca

SEQ ID NO: 3873581 - RNA, 22 nt, Human
ucugucuccuuaacacugagcu

SEQ ID NO: 3873582 - RNA, 13 nt, Human
ucugucucugaag

SEQ ID NO: 3873583 - RNA, 18 nt, Human
ucugucugccaaccuaaa

SEQ ID NO: 3873584 - RNA, 18 nt, Human
ucugucuggagugacaga

SEQ ID NO: 3873585 - RNA, 14 nt, Human
ucugucuggcaaug

SEQ ID NO: 3873586 - RNA, 14 nt, Human
ucugucugucccaa

SEQ ID NO: 3873587 - RNA, 15 nt, Human
ucugucugucccaaa

SEQ ID NO: 3873588 - RNA, 15 nt, Human
ucugucuucacagcu

SEQ ID NO: 3873589 - RNA, 22 nt, Human
ucugucuucacagcucuguguu

SEQ ID NO: 3873590 - RNA, 14 nt, Human
ucugucuuccuuug

SEQ ID NO: 3873591 - RNA, 12 nt, Human
ucugucuugaag

SEQ ID NO: 3873592 - RNA, 20 nt, Human
ucugucuuguaauauuuugu

SEQ ID NO: 3873593 - RNA, 11 nt, Human
ucugucuuucc

SEQ ID NO: 3873594 - RNA, 13 nt, Human
ucugugaaaccug

SEQ ID NO: 3873595 - RNA, 22 nt, Human
ucugugaaaccugugaagcuga

SEQ ID NO: 3873596 - RNA, 21 nt, Human
ucugugaaaggaaagagggag

SEQ ID NO: 3873597 - RNA, 16 nt, Human
ucugugaaaguacauu

SEQ ID NO: 3873598 - RNA, 15 nt, Human
ucugugaaauaucau

SEQ ID NO: 3873599 - RNA, 19 nt, Human
ucugugaacuugaaauuug

SEQ ID NO: 3873600 - RNA, 22 nt, Human
ucugugaacuugaaauuugaau

SEQ ID NO: 3873601 - RNA, 16 nt, Human
ucugugaauaagccau

SEQ ID NO: 3873602 - RNA, 15 nt, Human
ucugugaauucagau

SEQ ID NO: 3873603 - RNA, 16 nt, Human
ucugugacccacuucu

SEQ ID NO: 3873604 - RNA, 17 nt, Human
ucugugauacagaacuc

SEQ ID NO: 3873605 - RNA, 17 nt, Human
ucugugcaugguggcac

SEQ ID NO: 3873606 - RNA, 12 nt, Human
ucugugcauucu

SEQ ID NO: 3873607 - RNA, 15 nt, Human
ucugugccagagccu

SEQ ID NO: 3873608 - RNA, 16 nt, Human
ucugugccagagccug

SEQ ID NO: 3873609 - RNA, 17 nt, Human
ucugugccagagccugg

SEQ ID NO: 3873610 - RNA, 18 nt, Human
ucugugccccuuccgcca

SEQ ID NO: 3873611 - RNA, 20 nt, Human
ucugugccccuuccgccacu

SEQ ID NO: 3873612 - RNA, 15 nt, Human
ucugugccugaauau

SEQ ID NO: 3873613 - RNA, 14 nt, Human
ucugugccuggagc

SEQ ID NO: 3873614 - RNA, 20 nt, Human
ucugugccuggagcuccugg

SEQ ID NO: 3873615 - RNA, 16 nt, Human
ucugugcguagaaguu

SEQ ID NO: 3873616 - RNA, 22 nt, Human
ucugugcuagggaaacuucccg

SEQ ID NO: 3873617 - RNA, 13 nt, Human
ucugugcucagga

SEQ ID NO: 3873618 - RNA, 14 nt, Human
ucugugcuccuccu

SEQ ID NO: 3873619 - RNA, 14 nt, Human
ucugugcugacaug

SEQ ID NO: 3873620 - RNA, 23 nt, Human
ucugugcugacccuccuguugca

SEQ ID NO: 3873621 - RNA, 19 nt, Human
ucugugcuggagauguuuu

SEQ ID NO: 3873622 - RNA, 14 nt, Human
ucugugcuuuccag

SEQ ID NO: 3873623 - RNA, 17 nt, Human
ucugugcuuuccagcuc

SEQ ID NO: 3873624 - RNA, 22 nt, Human
ucugugcuuugacucaccuguu

SEQ ID NO: 3873625 - RNA, 22 nt, Human
ucuguggaaaguguaaagcauu

SEQ ID NO: 3873626 - RNA, 19 nt, Human
ucuguggaugccagggccg

SEQ ID NO: 3873627 - RNA, 23 nt, Human
ucugugggaugggaugguggagg

SEQ ID NO: 3873628 - RNA, 20 nt, Human
ucugugggcugcacucugug

SEQ ID NO: 3873629 - RNA, 21 nt, Human
ucugugggcugcacucugugc

SEQ ID NO: 3873630 - RNA, 23 nt, Human
ucugugggcugcacucugugccc

SEQ ID NO: 3873631 - RNA, 23 nt, Human
ucuguggguuucuaaagcugcca

SEQ ID NO: 3873632 - RNA, 13 nt, Human
ucugugguuggcu

SEQ ID NO: 3873633 - RNA, 19 nt, Human
ucugugguuggcugggaaa

SEQ ID NO: 3873634 - RNA, 21 nt, Human
ucugugguuuuccccucccug

SEQ ID NO: 3873635 - RNA, 23 nt, Human
ucugugguuuuccccucccuggg

SEQ ID NO: 3873636 - RNA, 15 nt, Human
ucuguguacaaagaa

SEQ ID NO: 3873637 - RNA, 16 nt, Human
ucuguguacaaagaaa

SEQ ID NO: 3873638 - RNA, 14 nt, Human
ucugugucacuggc

SEQ ID NO: 3873639 - RNA, 22 nt, Human
ucugugucacuggcugccucca

SEQ ID NO: 3873640 - RNA, 23 nt, Human
ucugugucacuggcugccuccac

SEQ ID NO: 3873641 - RNA, 23 nt, Human
ucugugucuaagauucuagauca

SEQ ID NO: 3873642 - RNA, 11 nt, Human
ucugugucucu

SEQ ID NO: 3873643 - RNA, 12 nt, Human
ucugugucugug

SEQ ID NO: 3873644 - RNA, 16 nt, Human
ucugugugaaacuuuc

SEQ ID NO: 3873645 - RNA, 21 nt, Human
ucugugugaaacuuucauucc

SEQ ID NO: 3873646 - RNA, 15 nt, Human
ucuugaacugagcuu

SEQ ID NO: 3873647 - RNA, 19 nt, Human
ucuugaagcccccagcccu

SEQ ID NO: 3873648 - RNA, 16 nt, Human
ucuugaaggaaaaauu

SEQ ID NO: 3873649 - RNA, 17 nt, Human
ucuugaaggaaaaauuc

SEQ ID NO: 3873650 - RNA, 19 nt, Human
ucuugaaggaaaaauucaa

SEQ ID NO: 3873651 - RNA, 13 nt, Human
ucuugaaggugcu

SEQ ID NO: 3873652 - RNA, 12 nt, Human
ucuugaaguccu

SEQ ID NO: 3873653 - RNA, 13 nt, Human
ucuugaaguccug

SEQ ID NO: 3873654 - RNA, 19 nt, Human
ucuugaaguccuggcuuca

SEQ ID NO: 3873655 - RNA, 16 nt, Human
ucuugaauaauguaag

SEQ ID NO: 3873656 - RNA, 19 nt, Human
ucuugaauguggucucagg

SEQ ID NO: 3873657 - RNA, 21 nt, Human
ucuugaauuuaauaaucugua

SEQ ID NO: 3873658 - RNA, 20 nt, Human
ucuugacaccagcuguucug

SEQ ID NO: 3873659 - RNA, 21 nt, Human
ucuugacaccagcuguucugu

SEQ ID NO: 3873660 - RNA, 20 nt, Human
ucuugacagagccugcccca

SEQ ID NO: 3873661 - RNA, 11 nt, Human
ucuugacccua

SEQ ID NO: 3873662 - RNA, 14 nt, Human
ucuugacccugcac

SEQ ID NO: 3873663 - RNA, 15 nt, Human
ucuugacccugcacc

SEQ ID NO: 3873664 - RNA, 19 nt, Human
ucuugacccugcacccucc

SEQ ID NO: 3873665 - RNA, 15 nt, Human
ucuugaccucugccu

SEQ ID NO: 3873666 - RNA, 22 nt, Human
ucuugagcaguggcugguccag

SEQ ID NO: 3873667 - RNA, 13 nt, Human
ucuugagccuggg

SEQ ID NO: 3873668 - RNA, 18 nt, Human
ucuugagccuugaacuuu

SEQ ID NO: 3873669 - RNA, 20 nt, Human
ucuugagccuugaacuuuga

SEQ ID NO: 3873670 - RNA, 16 nt, Human
ucuugagcucuauuau

SEQ ID NO: 3873671 - RNA, 13 nt, Human
ucuugagcuggcc

SEQ ID NO: 3873672 - RNA, 16 nt, Human
ucuugaggccaggagu

SEQ ID NO: 3873673 - RNA, 20 nt, Human
ucuugagguacucugcacau

SEQ ID NO: 3873674 - RNA, 19 nt, Human
ucuugaguauaagaaaugc

SEQ ID NO: 3873675 - RNA, 21 nt, Human
ucuugaguuugucgcucaugu

SEQ ID NO: 3873676 - RNA, 21 nt, Human
ucuugauaauuuuccuuuaau

SEQ ID NO: 3873677 - RNA, 17 nt, Human
ucuugauaccccccucu

SEQ ID NO: 3873678 - RNA, 21 nt, Human
ucuugauaccccccucugucu

SEQ ID NO: 3873679 - RNA, 17 nt, Human
ucuugaucaacaucuuu

SEQ ID NO: 3873680 - RNA, 18 nt, Human
ucuugaucaguuaagaaa

SEQ ID NO: 3873681 - RNA, 14 nt, Human
ucuugaucugcuca

SEQ ID NO: 3873682 - RNA, 16 nt, Human
ucuugaugaaaagcuu

SEQ ID NO: 3873683 - RNA, 19 nt, Human
ucuugaugacuggaauuuu

SEQ ID NO: 3873684 - RNA, 16 nt, Human
ucuugauguaaaaucu

SEQ ID NO: 3873685 - RNA, 15 nt, Human
ucuugauuaaaaguu

SEQ ID NO: 3873686 - RNA, 15 nt, Human
ucuugauucagucac

SEQ ID NO: 3873687 - RNA, 18 nt, Human
ucuugauuuauuugcuuc

SEQ ID NO: 3873688 - RNA, 16 nt, Human
ucuugcaagcaugcuu

SEQ ID NO: 3873689 - RNA, 19 nt, Human
ucuugcaauggcagccuug

SEQ ID NO: 3873690 - RNA, 21 nt, Human
ucuugcaccaaauuaucuuga

SEQ ID NO: 3873691 - RNA, 23 nt, Human
ucuugcaccccaaagcuuuccug

SEQ ID NO: 3873692 - RNA, 13 nt, Human
ucuugcaggucuc

SEQ ID NO: 3873693 - RNA, 14 nt, Human
ucuugcaggucuca

SEQ ID NO: 3873694 - RNA, 21 nt, Human
ucuugcaguaucggcacugua

SEQ ID NO: 3873695 - RNA, 16 nt, Human
ucuugcauccuuccua

SEQ ID NO: 3873696 - RNA, 15 nt, Human
ucuugcaugguuugg

SEQ ID NO: 3873697 - RNA, 20 nt, Human
ucuugcaugguuuggagcug

SEQ ID NO: 3873698 - RNA, 23 nt, Human
ucuugcauuuaaaagacagcuuu

SEQ ID NO: 3873699 - RNA, 22 nt, Human
ucuugccaaccuguaauaaaua

SEQ ID NO: 3873700 - RNA, 14 nt, Human
ucuugcccauccug

SEQ ID NO: 3873701 - RNA, 18 nt, Human
ucuugcccauccugacug

SEQ ID NO: 3873702 - RNA, 23 nt, Human
ucuugccccaacccccagcaccc

SEQ ID NO: 3873703 - RNA, 14 nt, Human
ucuugccccaucac

SEQ ID NO: 3873704 - RNA, 13 nt, Human
ucuugcccuuccc

SEQ ID NO: 3873705 - RNA, 16 nt, Human
ucuugcccuucccugu

SEQ ID NO: 3873706 - RNA, 19 nt, Human
ucuugccgaggagccaggc

SEQ ID NO: 3873707 - RNA, 20 nt, Human
ucuugccuaaguauuccuuu

SEQ ID NO: 3873708 - RNA, 19 nt, Human
ucuugccuauauuuuccug

SEQ ID NO: 3873709 - RNA, 16 nt, Human
ucuugccucaaccucc

SEQ ID NO: 3873710 - RNA, 15 nt, Human
ucuugccuccaggug

SEQ ID NO: 3873711 - RNA, 17 nt, Human
ucuugccuccaggugca

SEQ ID NO: 3873712 - RNA, 18 nt, Human
ucuugccuccaggugcag

SEQ ID NO: 3873713 - RNA, 13 nt, Human
ucuugccucugug

SEQ ID NO: 3873714 - RNA, 19 nt, Human
ucuugccucugugcugugu

SEQ ID NO: 3873715 - RNA, 16 nt, Human
ucuugccuuuuucauu

SEQ ID NO: 3873716 - RNA, 17 nt, Human
ucuugcgaauccaagcu

SEQ ID NO: 3873717 - RNA, 21 nt, Human
ucuugcgaauccaagcucccu

SEQ ID NO: 3873718 - RNA, 23 nt, Human
ucuugcgaauccaagcucccugc

SEQ ID NO: 3873719 - RNA, 16 nt, Human
ucuugcuaaucagugu

SEQ ID NO: 3873720 - RNA, 23 nt, Human
ucuugcuaaucagugucucacac

SEQ ID NO: 3873721 - RNA, 13 nt, Human
ucuugcuaccagu

SEQ ID NO: 3873722 - RNA, 17 nt, Human
ucuugcuaccucaguca

SEQ ID NO: 3873723 - RNA, 18 nt, Human
ucuugcuauauugcccag

SEQ ID NO: 3873724 - RNA, 20 nt, Human
ucuugcuaucggggaagcca

SEQ ID NO: 3873725 - RNA, 19 nt, Human
ucuugcucccuucagcccc

SEQ ID NO: 3873726 - RNA, 22 nt, Human
ucuugcucccuucagcccccag

SEQ ID NO: 3873727 - RNA, 18 nt, Human
ucuugcucuaucucacag

SEQ ID NO: 3873728 - RNA, 17 nt, Human
ucuugcucuaucucuca

SEQ ID NO: 3873729 - RNA, 12 nt, Human
ucuugcucugcu

SEQ ID NO: 3873730 - RNA, 15 nt, Human
ucuugcucugcugac

SEQ ID NO: 3873731 - RNA, 20 nt, Human
ucuugcugcuagaacuuuuu

SEQ ID NO: 3873732 - RNA, 22 nt, Human
ucuugcuggucuagucacgcau

SEQ ID NO: 3873733 - RNA, 18 nt, Human
ucuugcuguugacauauu

SEQ ID NO: 3873734 - RNA, 19 nt, Human
ucuugcuguugacauauuu

SEQ ID NO: 3873735 - RNA, 19 nt, Human
ucuugcuuaccuugacugu

SEQ ID NO: 3873736 - RNA, 21 nt, Human
ucuugcuuaccuugacuguug

SEQ ID NO: 3873737 - RNA, 13 nt, Human
ucuugcuuguacc

SEQ ID NO: 3873738 - RNA, 14 nt, Human
ucuugcuuguaccu

SEQ ID NO: 3873739 - RNA, 13 nt, Human
ucuugcuuucuau

SEQ ID NO: 3873740 - RNA, 15 nt, Human
ucuuggaacuugccu

SEQ ID NO: 3873741 - RNA, 19 nt, Human
ucuuggaagcuguuuggaa

SEQ ID NO: 3873742 - RNA, 20 nt, Human
ucuuggaagcuguuuggaaa

SEQ ID NO: 3873743 - RNA, 18 nt, Human
ucuuggaaguacaugaau

SEQ ID NO: 3873744 - RNA, 16 nt, Human
ucuuggacacuguaca

SEQ ID NO: 3873745 - RNA, 12 nt, Human
ucuuggagaagu

SEQ ID NO: 3873746 - RNA, 19 nt, Human
ucuuggagaagucucagcu

SEQ ID NO: 3873747 - RNA, 20 nt, Human
ucuuggagaagucucagcua

SEQ ID NO: 3873748 - RNA, 17 nt, Human
ucuuggagacccugcaa

SEQ ID NO: 3873749 - RNA, 13 nt, Human
ucuuggagccugc

SEQ ID NO: 3873750 - RNA, 19 nt, Human
ucuuggcaauaaauuuuga

SEQ ID NO: 3873751 - RNA, 20 nt, Human
ucuuggcaauaaauuuugaa

SEQ ID NO: 3873752 - RNA, 16 nt, Human
ucuuggccaugggagg

SEQ ID NO: 3873753 - RNA, 19 nt, Human
ucuuggcggcagcagccau

SEQ ID NO: 3873754 - RNA, 14 nt, Human
ucuuggcuggaccc

SEQ ID NO: 3873755 - RNA, 16 nt, Human
ucuuggcuuaaucauu

SEQ ID NO: 3873756 - RNA, 19 nt, Human
ucuuggcuuaaucauuuuc

SEQ ID NO: 3873757 - RNA, 20 nt, Human
ucuuggcuuaaucauuuuca

SEQ ID NO: 3873758 - RNA, 15 nt, Human
ucuuggcuuucaugu

SEQ ID NO: 3873759 - RNA, 11 nt, Human
ucuugggaaau

SEQ ID NO: 3873760 - RNA, 19 nt, Human
ucuugggaaauaugaaugc

SEQ ID NO: 3873761 - RNA, 19 nt, Human
ucuugggcagagcuggcuc

SEQ ID NO: 3873762 - RNA, 11 nt, Human
ucuugggcccu

SEQ ID NO: 3873763 - RNA, 17 nt, Human
ucuuggggacaucucuu

SEQ ID NO: 3873764 - RNA, 17 nt, Human
ucuuggggcccagugca

SEQ ID NO: 3873765 - RNA, 21 nt, Human
ucuugggggacagggcuggcc

SEQ ID NO: 3873766 - RNA, 22 nt, Human
ucuugggggacagggcuggccc

SEQ ID NO: 3873767 - RNA, 20 nt, Human
ucuugguaaaguccuuuucu

SEQ ID NO: 3873768 - RNA, 22 nt, Human
ucuugguaaauuuccccaacag

SEQ ID NO: 3873769 - RNA, 17 nt, Human
ucuuggucagauuugaa

SEQ ID NO: 3873770 - RNA, 15 nt, Human
ucuugguccugcugc

SEQ ID NO: 3873771 - RNA, 17 nt, Human
ucuuggucuucccaggc

SEQ ID NO: 3873772 - RNA, 14 nt, Human
ucuugguguaauuu

SEQ ID NO: 3873773 - RNA, 13 nt, Human
ucuugguguuaaa

SEQ ID NO: 3873774 - RNA, 18 nt, Human
ucuugguucauaaaugaa

SEQ ID NO: 3873775 - RNA, 19 nt, Human
ucuugguuccagccugcca

SEQ ID NO: 3873776 - RNA, 23 nt, Human
ucuugguugaaaauaaaaagauc

SEQ ID NO: 3873777 - RNA, 15 nt, Human
ucuugguuuccuucc

SEQ ID NO: 3873778 - RNA, 16 nt, Human
ucuugguuuguaaauu

SEQ ID NO: 3873779 - RNA, 14 nt, Human
ucuuguaaagacug

SEQ ID NO: 3873780 - RNA, 17 nt, Human
ucuuguaaagacugguu

SEQ ID NO: 3873781 - RNA, 23 nt, Human
ucuuguaaagacugguuuucugc

SEQ ID NO: 3873782 - RNA, 11 nt, Human
ucuuguaagau

SEQ ID NO: 3873783 - RNA, 17 nt, Human
ucuuguaauauuuugua

SEQ ID NO: 3873784 - RNA, 19 nt, Human
ucuuguaauauuuuguauu

SEQ ID NO: 3873785 - RNA, 18 nt, Human
ucuuguagcuuuaucaaa

SEQ ID NO: 3873786 - RNA, 16 nt, Human
ucuuguaguagucuca

SEQ ID NO: 3873787 - RNA, 19 nt, Human
ucuuguauuaaacucuuca

SEQ ID NO: 3873788 - RNA, 23 nt, Human
ucuuguccaugugguucuucaaa

SEQ ID NO: 3873789 - RNA, 13 nt, Human
ucuuguccuagcu

SEQ ID NO: 3873790 - RNA, 15 nt, Human
ucuugucuauaaagc

SEQ ID NO: 3873791 - RNA, 12 nt, Human
ugaccacccucc

SEQ ID NO: 3873792 - RNA, 21 nt, Human
ugaccacgcuuucuagcuguu

SEQ ID NO: 3873793 - RNA, 22 nt, Human
ugaccacgcuuucuagcuguug

SEQ ID NO: 3873794 - RNA, 21 nt, Human
ugaccacggacguuuccauca

SEQ ID NO: 3873795 - RNA, 22 nt, Human
ugaccacggacguuuccaucag

SEQ ID NO: 3873796 - RNA, 16 nt, Human
ugaccacucagagaca

SEQ ID NO: 3873797 - RNA, 20 nt, Human
ugaccacucagagacaugca

SEQ ID NO: 3873798 - RNA, 18 nt, Human
ugaccacugcagaagaca

SEQ ID NO: 3873799 - RNA, 17 nt, Human
ugaccacuugaggccug

SEQ ID NO: 3873800 - RNA, 19 nt, Human
ugaccagcaacuugucuuu

SEQ ID NO: 3873801 - RNA, 20 nt, Human
ugaccagcaccaucucuccu

SEQ ID NO: 3873802 - RNA, 18 nt, Human
ugaccagcagaucccagc

SEQ ID NO: 3873803 - RNA, 11 nt, Human
ugaccagcagc

SEQ ID NO: 3873804 - RNA, 12 nt, Human
ugaccagcuccc

SEQ ID NO: 3873805 - RNA, 22 nt, Human
ugaccaggaucccaagccuccu

SEQ ID NO: 3873806 - RNA, 16 nt, Human
ugaccaggcauccucc

SEQ ID NO: 3873807 - RNA, 16 nt, Human
ugaccauacugaggga

SEQ ID NO: 3873808 - RNA, 14 nt, Human
ugaccaucauuuca

SEQ ID NO: 3873809 - RNA, 22 nt, Human
ugaccauccacucuacccuccc

SEQ ID NO: 3873810 - RNA, 19 nt, Human
ugaccaugcauuuuaccau

SEQ ID NO: 3873811 - RNA, 15 nt, Human
ugaccaugucuauga

SEQ ID NO: 3873812 - RNA, 14 nt, Human
ugaccauucuccac

SEQ ID NO: 3873813 - RNA, 16 nt, Human
ugaccauucuccaccu

SEQ ID NO: 3873814 - RNA, 17 nt, Human
ugaccauucuccaccug

SEQ ID NO: 3873815 - RNA, 18 nt, Human
ugaccauucuccaccugc

SEQ ID NO: 3873816 - RNA, 22 nt, Human
ugaccauucuccaccugccagg

SEQ ID NO: 3873817 - RNA, 23 nt, Human
ugaccauuuauaauguuaguaga

SEQ ID NO: 3873818 - RNA, 12 nt, Human
ugaccauuuuuu

SEQ ID NO: 3873819 - RNA, 22 nt, Human
ugaccauuuuuuaauuuacuug

SEQ ID NO: 3873820 - RNA, 14 nt, Human
ugacccacagccuc

SEQ ID NO: 3873821 - RNA, 19 nt, Human
ugacccacagccucugccu

SEQ ID NO: 3873822 - RNA, 15 nt, Human
ugacccacaugccau

SEQ ID NO: 3873823 - RNA, 12 nt, Human
ugacccaccccu

SEQ ID NO: 3873824 - RNA, 12 nt, Human
ugacccacugcu

SEQ ID NO: 3873825 - RNA, 13 nt, Human
ugacccacugcuu

SEQ ID NO: 3873826 - RNA, 22 nt, Human
ugacccacugguuccuucuucc

SEQ ID NO: 3873827 - RNA, 17 nt, Human
ugacccagaggacagca

SEQ ID NO: 3873828 - RNA, 20 nt, Human
ugacccagcacugcccaaag

SEQ ID NO: 3873829 - RNA, 18 nt, Human
ugacccagccccuugaga

SEQ ID NO: 3873830 - RNA, 19 nt, Human
ugacccagccccuugagaa

SEQ ID NO: 3873831 - RNA, 14 nt, Human
ugacccaggccgca

SEQ ID NO: 3873832 - RNA, 15 nt, Human
ugacccaggccgcag

SEQ ID NO: 3873833 - RNA, 12 nt, Human
ugacccaguccc

SEQ ID NO: 3873834 - RNA, 21 nt, Human
ugacccaguccccgugccccg

SEQ ID NO: 3873835 - RNA, 14 nt, Human
ugacccaugcugcc

SEQ ID NO: 3873836 - RNA, 17 nt, Human
ugacccaugcugcccug

SEQ ID NO: 3873837 - RNA, 19 nt, Human
ugacccaugggcaggagac

SEQ ID NO: 3873838 - RNA, 14 nt, Human
ugacccauugcugu

SEQ ID NO: 3873839 - RNA, 13 nt, Human
ugaccccagagga

SEQ ID NO: 3873840 - RNA, 11 nt, Human
ugaccccaggg

SEQ ID NO: 3873841 - RNA, 12 nt, Human
ugaccccagggc

SEQ ID NO: 3873842 - RNA, 17 nt, Human
ugaccccagggcacagg

SEQ ID NO: 3873843 - RNA, 22 nt, Human
ugaccccagggcacaggagcua

SEQ ID NO: 3873844 - RNA, 19 nt, Human
ugacccccccagcuucacu

SEQ ID NO: 3873845 - RNA, 19 nt, Human
ugaccccucauagcccuca

SEQ ID NO: 3873846 - RNA, 23 nt, Human
ugaccccucauagcccucacccu

SEQ ID NO: 3873847 - RNA, 15 nt, Human
ugaccccuccucacu

SEQ ID NO: 3873848 - RNA, 20 nt, Human
ugaccccuccucacuggcca

SEQ ID NO: 3873849 - RNA, 22 nt, Human
ugaccccuccucacuggccauc

SEQ ID NO: 3873850 - RNA, 13 nt, Human
ugaccccuccugg

SEQ ID NO: 3873851 - RNA, 14 nt, Human
ugaccccuccuggg

SEQ ID NO: 3873852 - RNA, 19 nt, Human
ugaccccuccuggggccag

SEQ ID NO: 3873853 - RNA, 23 nt, Human
ugaccccuccuggggccaggccg

SEQ ID NO: 3873854 - RNA, 20 nt, Human
ugaccccugcccagaucagc

SEQ ID NO: 3873855 - RNA, 15 nt, Human
ugaccccuucccugu

SEQ ID NO: 3873856 - RNA, 21 nt, Human
ugaccccuuuucagcuucugc

SEQ ID NO: 3873857 - RNA, 14 nt, Human
ugacccggaggcca

SEQ ID NO: 3873858 - RNA, 17 nt, Human
ugacccggaggccacau

SEQ ID NO: 3873859 - RNA, 20 nt, Human
ugacccggcacccccugcag

SEQ ID NO: 3873860 - RNA, 21 nt, Human
ugacccggcacccccugcagc

SEQ ID NO: 3873861 - RNA, 14 nt, Human
ugacccuccaaaug

SEQ ID NO: 3873862 - RNA, 22 nt, Human
ugacccuccaccgcagaaggaa

SEQ ID NO: 3873863 - RNA, 23 nt, Human
ugacccuccaccgcagaaggaag

SEQ ID NO: 3873864 - RNA, 13 nt, Human
ugacccucccuuc

SEQ ID NO: 3873865 - RNA, 16 nt, Human
ugacccucccuuccug

SEQ ID NO: 3873866 - RNA, 22 nt, Human
ugacccuccuguugcacccagc

SEQ ID NO: 3873867 - RNA, 22 nt, Human
ugacccucugaaugguccaggg

SEQ ID NO: 3873868 - RNA, 16 nt, Human
ugacccugaucagucu

SEQ ID NO: 3873869 - RNA, 13 nt, Human
ugacccugccucu

SEQ ID NO: 3873870 - RNA, 18 nt, Human
ugacccugccucucccag

SEQ ID NO: 3873871 - RNA, 19 nt, Human
ugacccugccucucccagg

SEQ ID NO: 3873872 - RNA, 22 nt, Human
ugacccugcgaaggggcccugg

SEQ ID NO: 3873873 - RNA, 14 nt, Human
ugacccuggggcug

SEQ ID NO: 3873874 - RNA, 15 nt, Human
ugacccuggggcugg

SEQ ID NO: 3873875 - RNA, 22 nt, Human
ugacccuuacagccucugacuu

SEQ ID NO: 3873876 - RNA, 20 nt, Human
ugacccuuccagacauacga

SEQ ID NO: 3873877 - RNA, 13 nt, Human
ugacccuuuucau

SEQ ID NO: 3873878 - RNA, 19 nt, Human
ugaccgaaacagcgcuggg

SEQ ID NO: 3873879 - RNA, 23 nt, Human
ugaccgugggcggggccuugcgg

SEQ ID NO: 3873880 - RNA, 19 nt, Human
ugaccguguuggucuguac

SEQ ID NO: 3873881 - RNA, 20 nt, Human
ugaccguguuggucuguacu

SEQ ID NO: 3873882 - RNA, 17 nt, Human
ugaccuacucgagggac

SEQ ID NO: 3873883 - RNA, 18 nt, Human
ugaccuacucgagggacu

SEQ ID NO: 3873884 - RNA, 13 nt, Human
ugaccuacucuca

SEQ ID NO: 3873885 - RNA, 16 nt, Human
ugaccuaucacuucca

SEQ ID NO: 3873886 - RNA, 17 nt, Human
ugaccucaauuucaauu

SEQ ID NO: 3873887 - RNA, 23 nt, Human
ugaccucaauuucaauuuugucu

SEQ ID NO: 3873888 - RNA, 14 nt, Human
ugaccucacgugca

SEQ ID NO: 3873889 - RNA, 16 nt, Human
ugaccucagcuuugau

SEQ ID NO: 3873890 - RNA, 20 nt, Human
ugaccucaggugauccaccc

SEQ ID NO: 3873891 - RNA, 19 nt, Human
ugaccucaugcaucuccac

SEQ ID NO: 3873892 - RNA, 14 nt, Human
ugaccuccacagcu

SEQ ID NO: 3873893 - RNA, 17 nt, Human
ugaccucccccuccuuc

SEQ ID NO: 3873894 - RNA, 13 nt, Human
ugaccucccucua

SEQ ID NO: 3873895 - RNA, 17 nt, Human
ugaccuccgccauccac

SEQ ID NO: 3873896 - RNA, 18 nt, Human
ugaccucgugauccaccc

SEQ ID NO: 3873897 - RNA, 19 nt, Human
ugaccucuagcccugcccg

SEQ ID NO: 3873898 - RNA, 21 nt, Human
ugaccucucauaaauuuacuu

SEQ ID NO: 3873899 - RNA, 16 nt, Human
ugaccucucucucugg

SEQ ID NO: 3873900 - RNA, 22 nt, Human
ugaccucuguuguccuccccuu

SEQ ID NO: 3873901 - RNA, 15 nt, Human
ugaccucuugcuguc

SEQ ID NO: 3873902 - RNA, 14 nt, Human
ugaccugaaguuca

SEQ ID NO: 3873903 - RNA, 18 nt, Human
ugaccugaaguucaccau

SEQ ID NO: 3873904 - RNA, 20 nt, Human
ugaccugaggcuccugugcu

SEQ ID NO: 3873905 - RNA, 12 nt, Human
ugaccugagggc

SEQ ID NO: 3873906 - RNA, 16 nt, Human
ugaccugcauuguaaa

SEQ ID NO: 3873907 - RNA, 13 nt, Human
ugaccugccccgc

SEQ ID NO: 3873908 - RNA, 19 nt, Human
ugaccugccccgcccagcu

SEQ ID NO: 3873909 - RNA, 19 nt, Human
ugaccugccucccuucaug

SEQ ID NO: 3873910 - RNA, 21 nt, Human
ugaccugccucccuucaugca

SEQ ID NO: 3873911 - RNA, 15 nt, Human
ugaccugccucucac

SEQ ID NO: 3873912 - RNA, 20 nt, Human
ugaccugccucucacacaca

SEQ ID NO: 3873913 - RNA, 21 nt, Human
ugaccugccucucacacacau

SEQ ID NO: 3873914 - RNA, 19 nt, Human
ugaccugcuaggccagagc

SEQ ID NO: 3873915 - RNA, 18 nt, Human
ugaccugcugaccugugc

SEQ ID NO: 3873916 - RNA, 16 nt, Human
ugaccugcugagcucu

SEQ ID NO: 3873917 - RNA, 19 nt, Human
ugaccugcugagcucugag

SEQ ID NO: 3873918 - RNA, 22 nt, Human
ugaccugcugagcucugagagg

SEQ ID NO: 3873919 - RNA, 22 nt, Human
ugaccuggauaacuuagguggc

SEQ ID NO: 3873920 - RNA, 15 nt, Human
ugaccuggcccccuc

SEQ ID NO: 3873921 - RNA, 13 nt, Human
ugaccuggucagg

SEQ ID NO: 3873922 - RNA, 21 nt, Human
ugaccugucaugccccccuca

SEQ ID NO: 3873923 - RNA, 22 nt, Human
ugaccugugaccagcacugucu

SEQ ID NO: 3873924 - RNA, 20 nt, Human
ugaccugugagcccagcugg

SEQ ID NO: 3873925 - RNA, 19 nt, Human
ugaccuguggggauuucuc

SEQ ID NO: 3873926 - RNA, 22 nt, Human
ugaccuguggggauuucuccca

SEQ ID NO: 3873927 - RNA, 16 nt, Human
ugaccuguuucucugc

SEQ ID NO: 3873928 - RNA, 16 nt, Human
ugaccuuaaaugcaac

SEQ ID NO: 3873929 - RNA, 13 nt, Human
ugaccuucauuuc

SEQ ID NO: 3873930 - RNA, 19 nt, Human
ugaccuuccaagagccuga

SEQ ID NO: 3873931 - RNA, 20 nt, Human
ugaccuuccaagagccugag

SEQ ID NO: 3873932 - RNA, 16 nt, Human
ugaccuuccucugggg

SEQ ID NO: 3873933 - RNA, 21 nt, Human
ugaccuuccucuggggcucua

SEQ ID NO: 3873934 - RNA, 16 nt, Human
ugaccuuccuuccugu

SEQ ID NO: 3873935 - RNA, 21 nt, Human
ugagaccaguugggagcacug

SEQ ID NO: 3873936 - RNA, 13 nt, Human
ugagacccccaca

SEQ ID NO: 3873937 - RNA, 13 nt, Human
ugagaccccuggc

SEQ ID NO: 3873938 - RNA, 14 nt, Human
ugagaccccuggcc

SEQ ID NO: 3873939 - RNA, 16 nt, Human
ugagaccccuggccuc

SEQ ID NO: 3873940 - RNA, 16 nt, Human
ugagaccccugucucc

SEQ ID NO: 3873941 - RNA, 13 nt, Human
ugagacccuggug

SEQ ID NO: 3873942 - RNA, 12 nt, Human
ugagacccuguc

SEQ ID NO: 3873943 - RNA, 20 nt, Human
ugagaccgugaagauacuuu

SEQ ID NO: 3873944 - RNA, 19 nt, Human
ugagaccuacaggcugacg

SEQ ID NO: 3873945 - RNA, 13 nt, Human
ugagaccucagcc

SEQ ID NO: 3873946 - RNA, 16 nt, Human
ugagaccucagccaug

SEQ ID NO: 3873947 - RNA, 12 nt, Human
ugagaccugccc

SEQ ID NO: 3873948 - RNA, 19 nt, Human
ugagaccuuccuuuuacuu

SEQ ID NO: 3873949 - RNA, 18 nt, Human
ugagacucacaggaagga

SEQ ID NO: 3873950 - RNA, 20 nt, Human
ugagacucagacaggaaagg

SEQ ID NO: 3873951 - RNA, 16 nt, Human
ugagacucagugcaga

SEQ ID NO: 3873952 - RNA, 18 nt, Human
ugagacucagugcagaug

SEQ ID NO: 3873953 - RNA, 17 nt, Human
ugagacucgagaacuuu

SEQ ID NO: 3873954 - RNA, 19 nt, Human
ugagacucgcgacaaugca

SEQ ID NO: 3873955 - RNA, 21 nt, Human
ugagacucgcgacaaugcaaa

SEQ ID NO: 3873956 - RNA, 21 nt, Human
ugagacucuaggguccagugg

SEQ ID NO: 3873957 - RNA, 19 nt, Human
ugagacucucuuaggagca

SEQ ID NO: 3873958 - RNA, 23 nt, Human
ugagacucucuuaggagcagagc

SEQ ID NO: 3873959 - RNA, 13 nt, Human
ugagacucugucu

SEQ ID NO: 3873960 - RNA, 20 nt, Human
ugagacucugucucagucca

SEQ ID NO: 3873961 - RNA, 22 nt, Human
ugagacuggggccacuacauuu

SEQ ID NO: 3873962 - RNA, 23 nt, Human
ugagacuggggccacuacauuug

SEQ ID NO: 3873963 - RNA, 15 nt, Human
ugagacuugccuucc

SEQ ID NO: 3873964 - RNA, 18 nt, Human
ugagacuuuaaaagcauu

SEQ ID NO: 3873965 - RNA, 14 nt, Human
ugagagaauuggcu

SEQ ID NO: 3873966 - RNA, 16 nt, Human
ugagagaauuggcuca

SEQ ID NO: 3873967 - RNA, 18 nt, Human
ugagagaauuguaucauu

SEQ ID NO: 3873968 - RNA, 19 nt, Human
ugagagaauuguaucauuu

SEQ ID NO: 3873969 - RNA, 16 nt, Human
ugagagacacacugaa

SEQ ID NO: 3873970 - RNA, 20 nt, Human
ugagagacacacugaagaag

SEQ ID NO: 3873971 - RNA, 21 nt, Human
ugagagacacacugaagaagc

SEQ ID NO: 3873972 - RNA, 14 nt, Human
ugagagagacaaga

SEQ ID NO: 3873973 - RNA, 23 nt, Human
ugagagagaugggagcuccucuc

SEQ ID NO: 3873974 - RNA, 16 nt, Human
ugagagagcagccagg

SEQ ID NO: 3873975 - RNA, 15 nt, Human
ugagagaguggcugg

SEQ ID NO: 3873976 - RNA, 21 nt, Human
ugagagauucugugaucuuuu

SEQ ID NO: 3873977 - RNA, 23 nt, Human
ugagagcaguuugguuucuagca

SEQ ID NO: 3873978 - RNA, 16 nt, Human
ugagagcccagaggua

SEQ ID NO: 3873979 - RNA, 16 nt, Human
ugagagccccagcuga

SEQ ID NO: 3873980 - RNA, 20 nt, Human
ugagagcccugaggccuaga

SEQ ID NO: 3873981 - RNA, 19 nt, Human
ugagagcgaggcugagccu

SEQ ID NO: 3873982 - RNA, 16 nt, Human
ugagagcugcaugugu

SEQ ID NO: 3873983 - RNA, 10 nt, Human
ugagaggaaa

SEQ ID NO: 3873984 - RNA, 12 nt, Human
ugagaggaaauc

SEQ ID NO: 3873985 - RNA, 16 nt, Human
ugagaggaggcagcag

SEQ ID NO: 3873986 - RNA, 12 nt, Human
ugagaggcaggc

SEQ ID NO: 3873987 - RNA, 13 nt, Human
ugagaggcccugg

SEQ ID NO: 3873988 - RNA, 16 nt, Human
ugagaggcccuggauc

SEQ ID NO: 3873989 - RNA, 17 nt, Human
ugagagggccgggcaga

SEQ ID NO: 3873990 - RNA, 19 nt, Human
ugagaggggaacagacugg

SEQ ID NO: 3873991 - RNA, 14 nt, Human
ugagaggggagagc

SEQ ID NO: 3873992 - RNA, 21 nt, Human
ugagaggggagagcugaacag

SEQ ID NO: 3873993 - RNA, 18 nt, Human
ugagaggggcuguccagu

SEQ ID NO: 3873994 - RNA, 19 nt, Human
ugagaguauauuauguauu

SEQ ID NO: 3873995 - RNA, 19 nt, Human
ugagaguaucaggucuccc

SEQ ID NO: 3873996 - RNA, 21 nt, Human
ugagagucagcucucugcccu

SEQ ID NO: 3873997 - RNA, 13 nt, Human
ugagagucuagau

SEQ ID NO: 3873998 - RNA, 14 nt, Human
ugagagugugacca

SEQ ID NO: 3873999 - RNA, 18 nt, Human
ugagaguuuugucuugaa

SEQ ID NO: 3874000 - RNA, 21 nt, Human
ugagaguuuugucuugaaugu

SEQ ID NO: 3874001 - RNA, 21 nt, Human
ugagauaccagcgaggaggcu

SEQ ID NO: 3874002 - RNA, 21 nt, Human
ugagauacuuugcauugucug

SEQ ID NO: 3874003 - RNA, 15 nt, Human
ugagauacuuuuucu

SEQ ID NO: 3874004 - RNA, 23 nt, Human
ugagauacuuuuucuuuuguaag

SEQ ID NO: 3874005 - RNA, 18 nt, Human
ugagauagaagauguuug

SEQ ID NO: 3874006 - RNA, 21 nt, Human
ugagauaguuuucauccauaa

SEQ ID NO: 3874007 - RNA, 12 nt, Human
ugagauauuaau

SEQ ID NO: 3874008 - RNA, 19 nt, Human
ugagauauuaaugcccaga

SEQ ID NO: 3874009 - RNA, 20 nt, Human
ugagauauuaaugcccagac

SEQ ID NO: 3874010 - RNA, 15 nt, Human
ugagaucaaaacggu

SEQ ID NO: 3874011 - RNA, 14 nt, Human
ugagaucagccugg

SEQ ID NO: 3874012 - RNA, 14 nt, Human
ugagaucaggcucu

SEQ ID NO: 3874013 - RNA, 12 nt, Human
ugagauccccug

SEQ ID NO: 3874014 - RNA, 18 nt, Human
ugagauccuuccuuuuga

SEQ ID NO: 3874015 - RNA, 18 nt, Human
ugagaucgugccacugca

SEQ ID NO: 3874016 - RNA, 20 nt, Human
ugagaucgugccacugcacu

SEQ ID NO: 3874017 - RNA, 23 nt, Human
ugagaucgugcuacugcacucca

SEQ ID NO: 3874018 - RNA, 17 nt, Human
ugagaugagaggggaga

SEQ ID NO: 3874019 - RNA, 21 nt, Human
ugagaugagggaugggccugg

SEQ ID NO: 3874020 - RNA, 22 nt, Human
ugagaugagggaugggccuggc

SEQ ID NO: 3874021 - RNA, 16 nt, Human
ugagaugauuaaaaug

SEQ ID NO: 3874022 - RNA, 19 nt, Human
ugagaugauucagaagggg

SEQ ID NO: 3874023 - RNA, 16 nt, Human
ugagaugauuuccaag

SEQ ID NO: 3874024 - RNA, 16 nt, Human
ugagaugcagcuggaa

SEQ ID NO: 3874025 - RNA, 13 nt, Human
ugagaugcuggag

SEQ ID NO: 3874026 - RNA, 19 nt, Human
ugagaugcuggagaagaga

SEQ ID NO: 3874027 - RNA, 20 nt, Human
ugagaugcuggagaagagag

SEQ ID NO: 3874028 - RNA, 23 nt, Human
ugagaugcuggagaagagaggag

SEQ ID NO: 3874029 - RNA, 17 nt, Human
ugagaugcuggcuuggg

SEQ ID NO: 3874030 - RNA, 13 nt, Human
ugagaugcugguu

SEQ ID NO: 3874031 - RNA, 12 nt, Human
ugagaugcugua

SEQ ID NO: 3874032 - RNA, 16 nt, Human
ugagauggcucccagg

SEQ ID NO: 3874033 - RNA, 22 nt, Human
ugagaugguaugcacaauucca

SEQ ID NO: 3874034 - RNA, 13 nt, Human
ugagaugugaaca

SEQ ID NO: 3874035 - RNA, 15 nt, Human
ugagauguguaucag

SEQ ID NO: 3874036 - RNA, 18 nt, Human
ugagauguguaucagugu

SEQ ID NO: 3874037 - RNA, 20 nt, Human
ugagauguguaucaguguuu

SEQ ID NO: 3874038 - RNA, 14 nt, Human
ugagauguguucac

SEQ ID NO: 3874039 - RNA, 16 nt, Human
ugagauuaauuccuuu

SEQ ID NO: 3874040 - RNA, 19 nt, Human
ugagauuacagaggaaguu

SEQ ID NO: 3874041 - RNA, 16 nt, Human
ugagauuacaggcaug

SEQ ID NO: 3874042 - RNA, 20 nt, Human
ugagauuccucuguauugug

SEQ ID NO: 3874043 - RNA, 15 nt, Human
ugagauucucaaagg

SEQ ID NO: 3874044 - RNA, 17 nt, Human
ugagauugaauuucacu

SEQ ID NO: 3874045 - RNA, 19 nt, Human
ugagauugguuuuccugug

SEQ ID NO: 3874046 - RNA, 16 nt, Human
ugagauuguccucauu

SEQ ID NO: 3874047 - RNA, 23 nt, Human
ugagauuguuuucuuuuucuacc

SEQ ID NO: 3874048 - RNA, 18 nt, Human
ugagauuuauuaaagaaa

SEQ ID NO: 3874049 - RNA, 13 nt, Human
ugagauuucaucu

SEQ ID NO: 3874050 - RNA, 14 nt, Human
ugagauuucaucug

SEQ ID NO: 3874051 - RNA, 21 nt, Human
ugagauuucaucugcucuccu

SEQ ID NO: 3874052 - RNA, 17 nt, Human
ugagauuuccuccuggc

SEQ ID NO: 3874053 - RNA, 18 nt, Human
ugagauuuuuuauugcua

SEQ ID NO: 3874054 - RNA, 19 nt, Human
ugagauuuuuuauugcuag

SEQ ID NO: 3874055 - RNA, 23 nt, Human
ugagauuuuuuauugcuaguauu

SEQ ID NO: 3874056 - RNA, 17 nt, Human
ugagcaaaccugcccca

SEQ ID NO: 3874057 - RNA, 21 nt, Human
ugagcaaaccugccccauccc

SEQ ID NO: 3874058 - RNA, 19 nt, Human
ugagcaaauguggcuccug

SEQ ID NO: 3874059 - RNA, 18 nt, Human
ugagcaacucuugauuau

SEQ ID NO: 3874060 - RNA, 14 nt, Human
ugagcaagcccagg

SEQ ID NO: 3874061 - RNA, 17 nt, Human
ugagcaauguauaaccc

SEQ ID NO: 3874062 - RNA, 20 nt, Human
ugagcaaugucugugcuagg

SEQ ID NO: 3874063 - RNA, 17 nt, Human
ugagcacagccuagggc

SEQ ID NO: 3874064 - RNA, 14 nt, Human
ugagcaccagggga

SEQ ID NO: 3874065 - RNA, 17 nt, Human
ugagcaccgucauggcu

SEQ ID NO: 3874066 - RNA, 22 nt, Human
ugagcaccgugucaagcugcuc

SEQ ID NO: 3874067 - RNA, 12 nt, Human
ugagcaccugcu

SEQ ID NO: 3874068 - RNA, 18 nt, Human
ugagcacucccaagucua

SEQ ID NO: 3874069 - RNA, 13 nt, Human
ugagcacugccag

SEQ ID NO: 3874070 - RNA, 22 nt, Human
ugagcacuguuuauacacugug

SEQ ID NO: 3874071 - RNA, 22 nt, Human
ugagcacuguuuucuaguguau

SEQ ID NO: 3874072 - RNA, 15 nt, Human
ugagcagaauucauu

SEQ ID NO: 3874073 - RNA, 12 nt, Human
ugagcagcaccc

SEQ ID NO: 3874074 - RNA, 21 nt, Human
ugagcagccuggagcccugga

SEQ ID NO: 3874075 - RNA, 12 nt, Human
ugagcagggcuc

SEQ ID NO: 3874076 - RNA, 16 nt, Human
ugagcagggcucagcg

SEQ ID NO: 3874077 - RNA, 20 nt, Human
ugagcagggcucagcgggga

SEQ ID NO: 3874078 - RNA, 14 nt, Human
ugagcaguccuugg

SEQ ID NO: 3874079 - RNA, 17 nt, Human
ugagcagugauauucuu

SEQ ID NO: 3874080 - RNA, 15 nt, Human
ugcagaacuguagcu

SEQ ID NO: 3874081 - RNA, 14 nt, Human
ugcagaagacagua

SEQ ID NO: 3874082 - RNA, 15 nt, Human
ugcagaagggagcug

SEQ ID NO: 3874083 - RNA, 22 nt, Human
ugcagaagggagcuggcuccag

SEQ ID NO: 3874084 - RNA, 13 nt, Human
ugcagaaguaagc

SEQ ID NO: 3874085 - RNA, 20 nt, Human
ugcagaauguaagugggccc

SEQ ID NO: 3874086 - RNA, 21 nt, Human
ugcagaauguaagugggccca

SEQ ID NO: 3874087 - RNA, 15 nt, Human
ugcagacaggaaucu

SEQ ID NO: 3874088 - RNA, 16 nt, Human
ugcagacaggaaucuu

SEQ ID NO: 3874089 - RNA, 15 nt, Human
ugcagacaugagugc

SEQ ID NO: 3874090 - RNA, 19 nt, Human
ugcagaccccuuggccagc

SEQ ID NO: 3874091 - RNA, 19 nt, Human
ugcagacccugcccuuguu

SEQ ID NO: 3874092 - RNA, 15 nt, Human
ugcagaccuguccuc

SEQ ID NO: 3874093 - RNA, 17 nt, Human
ugcagacuagaauucua

SEQ ID NO: 3874094 - RNA, 19 nt, Human
ugcagacucaauaaaauca

SEQ ID NO: 3874095 - RNA, 14 nt, Human
ugcagacucaguuu

SEQ ID NO: 3874096 - RNA, 19 nt, Human
ugcagacucaguuugucag

SEQ ID NO: 3874097 - RNA, 19 nt, Human
ugcagacucuacagaggcc

SEQ ID NO: 3874098 - RNA, 12 nt, Human
ugcagacugcua

SEQ ID NO: 3874099 - RNA, 22 nt, Human
ugcagacugcugcuagagccag

SEQ ID NO: 3874100 - RNA, 20 nt, Human
ugcagagacaggaccugacu

SEQ ID NO: 3874101 - RNA, 15 nt, Human
ugcagagagccauuu

SEQ ID NO: 3874102 - RNA, 18 nt, Human
ugcagagagccauuuugu

SEQ ID NO: 3874103 - RNA, 22 nt, Human
ugcagagagccauuuugugaau

SEQ ID NO: 3874104 - RNA, 19 nt, Human
ugcagagaugcgguggcua

SEQ ID NO: 3874105 - RNA, 20 nt, Human
ugcagagauuucucauugac

SEQ ID NO: 3874106 - RNA, 23 nt, Human
ugcagagcaccuuugcacaggau

SEQ ID NO: 3874107 - RNA, 22 nt, Human
ugcagagcagugggccuggcca

SEQ ID NO: 3874108 - RNA, 19 nt, Human
ugcagagccuucucagaag

SEQ ID NO: 3874109 - RNA, 22 nt, Human
ugcagagccuucucagaagcac

SEQ ID NO: 3874110 - RNA, 13 nt, Human
ugcagagcugaag

SEQ ID NO: 3874111 - RNA, 14 nt, Human
ugcagaggccagag

SEQ ID NO: 3874112 - RNA, 19 nt, Human
ugcagaggcuaugggaaga

SEQ ID NO: 3874113 - RNA, 12 nt, Human
ugcagaggcugu

SEQ ID NO: 3874114 - RNA, 19 nt, Human
ugcagagguacccugggug

SEQ ID NO: 3874115 - RNA, 14 nt, Human
ugcagaggucugug

SEQ ID NO: 3874116 - RNA, 18 nt, Human
ugcagaggucugugcuga

SEQ ID NO: 3874117 - RNA, 20 nt, Human
ugcagaguauuuuuguauuc

SEQ ID NO: 3874118 - RNA, 15 nt, Human
ugcagagucagcaga

SEQ ID NO: 3874119 - RNA, 14 nt, Human
ugcagagugcccag

SEQ ID NO: 3874120 - RNA, 20 nt, Human
ugcagaguuuccaaaaccag

SEQ ID NO: 3874121 - RNA, 17 nt, Human
ugcagauaaacaguagu

SEQ ID NO: 3874122 - RNA, 23 nt, Human
ugcagauacuacugaccagacaa

SEQ ID NO: 3874123 - RNA, 15 nt, Human
ugcagaugccagagc

SEQ ID NO: 3874124 - RNA, 18 nt, Human
ugcagauggggcucccgc

SEQ ID NO: 3874125 - RNA, 17 nt, Human
ugcagauuugggcugga

SEQ ID NO: 3874126 - RNA, 16 nt, Human
ugcagcaaucuuugaa

SEQ ID NO: 3874127 - RNA, 16 nt, Human
ugcagcacggacaaua

SEQ ID NO: 3874128 - RNA, 18 nt, Human
ugcagcacggacaauaaa

SEQ ID NO: 3874129 - RNA, 22 nt, Human
ugcagcacggacaauaaaccuc

SEQ ID NO: 3874130 - RNA, 23 nt, Human
ugcagcagauuggaaggagacac

SEQ ID NO: 3874131 - RNA, 19 nt, Human
ugcagcagcuugcugcacc

SEQ ID NO: 3874132 - RNA, 22 nt, Human
ugcagcaggaguggugcagaca

SEQ ID NO: 3874133 - RNA, 17 nt, Human
ugcagcagggaugcccu

SEQ ID NO: 3874134 - RNA, 14 nt, Human
ugcagcagggcagu

SEQ ID NO: 3874135 - RNA, 23 nt, Human
ugcagcaugaccugugaccagca

SEQ ID NO: 3874136 - RNA, 16 nt, Human
ugcagcauggucccug

SEQ ID NO: 3874137 - RNA, 22 nt, Human
ugcagcauuugauaaugauaaa

SEQ ID NO: 3874138 - RNA, 21 nt, Human
ugcagccaaguagccucuccu

SEQ ID NO: 3874139 - RNA, 12 nt, Human
ugcagccagccc

SEQ ID NO: 3874140 - RNA, 15 nt, Human
ugcagccagcccagc

SEQ ID NO: 3874141 - RNA, 12 nt, Human
ugcagcccaugc

SEQ ID NO: 3874142 - RNA, 19 nt, Human
ugcagcccauuucuccaga

SEQ ID NO: 3874143 - RNA, 21 nt, Human
ugcagcccugagaaagcccug

SEQ ID NO: 3874144 - RNA, 22 nt, Human
ugcagcccugcugcugccugcc

SEQ ID NO: 3874145 - RNA, 16 nt, Human
ugcagccucacagucc

SEQ ID NO: 3874146 - RNA, 21 nt, Human
ugcagccucacaguccuuacc

SEQ ID NO: 3874147 - RNA, 20 nt, Human
ugcagccucagagacaucag

SEQ ID NO: 3874148 - RNA, 16 nt, Human
ugcagccucaggacug

SEQ ID NO: 3874149 - RNA, 18 nt, Human
ugcagccucaggacuggg

SEQ ID NO: 3874150 - RNA, 19 nt, Human
ugcagccuccuccugacca

SEQ ID NO: 3874151 - RNA, 19 nt, Human
ugcagccucgaacuccugg

SEQ ID NO: 3874152 - RNA, 23 nt, Human
ugcagccucgaacuccugggcuc

SEQ ID NO: 3874153 - RNA, 12 nt, Human
ugcagccugcuc

SEQ ID NO: 3874154 - RNA, 12 nt, Human
ugcagccugggu

SEQ ID NO: 3874155 - RNA, 12 nt, Human
ugcagcgcagcu

SEQ ID NO: 3874156 - RNA, 22 nt, Human
ugcagcgcagcuggacucugca

SEQ ID NO: 3874157 - RNA, 22 nt, Human
ugcagcuaguccuagugaaccu

SEQ ID NO: 3874158 - RNA, 13 nt, Human
ugcagcuaucugg

SEQ ID NO: 3874159 - RNA, 17 nt, Human
ugcagcucaacuuucug

SEQ ID NO: 3874160 - RNA, 15 nt, Human
ugcagcucagaacca

SEQ ID NO: 3874161 - RNA, 20 nt, Human
ugcagcucccuggcuucugu

SEQ ID NO: 3874162 - RNA, 15 nt, Human
ugcagcucuuccugg

SEQ ID NO: 3874163 - RNA, 18 nt, Human
ugcagcugaaauugaaaa

SEQ ID NO: 3874164 - RNA, 16 nt, Human
ugcagcugauguugga

SEQ ID NO: 3874165 - RNA, 16 nt, Human
ugcagcugauuuuaac

SEQ ID NO: 3874166 - RNA, 20 nt, Human
ugcagcugauuuuaacaaua

SEQ ID NO: 3874167 - RNA, 22 nt, Human
ugcagcuguggcagaguuacag

SEQ ID NO: 3874168 - RNA, 15 nt, Human
ugcagcuuccuguca

SEQ ID NO: 3874169 - RNA, 18 nt, Human
ugcagcuuccugucaaca

SEQ ID NO: 3874170 - RNA, 17 nt, Human
ugcagcuuguagccagc

SEQ ID NO: 3874171 - RNA, 18 nt, Human
ugcagcuuguagccagcc

SEQ ID NO: 3874172 - RNA, 21 nt, Human
ugcagcuuguagccagccggg

SEQ ID NO: 3874173 - RNA, 22 nt, Human
ugcagcuuguagccagccgggg

SEQ ID NO: 3874174 - RNA, 22 nt, Human
ugcagcuuuaaaaaauuaaucu

SEQ ID NO: 3874175 - RNA, 16 nt, Human
ugcagcuuuacaugca

SEQ ID NO: 3874176 - RNA, 14 nt, Human
ugcagcuuuugguc

SEQ ID NO: 3874177 - RNA, 15 nt, Human
ugcaggaaggagcug

SEQ ID NO: 3874178 - RNA, 17 nt, Human
ugcaggaaggagcugcc

SEQ ID NO: 3874179 - RNA, 20 nt, Human
ugcaggaaggagcugccugg

SEQ ID NO: 3874180 - RNA, 21 nt, Human
ugcaggaaggagcugccugga

SEQ ID NO: 3874181 - RNA, 20 nt, Human
ugcaggaaucaaaaauugaa

SEQ ID NO: 3874182 - RNA, 21 nt, Human
ugcaggaaucaaaaauugaag

SEQ ID NO: 3874183 - RNA, 19 nt, Human
ugcaggaaucuuuaaaaga

SEQ ID NO: 3874184 - RNA, 16 nt, Human
ugcaggaccugccugu

SEQ ID NO: 3874185 - RNA, 17 nt, Human
ugcaggaccugccugua

SEQ ID NO: 3874186 - RNA, 18 nt, Human
ugcaggaccugccuguag

SEQ ID NO: 3874187 - RNA, 13 nt, Human
ugcaggacuugag

SEQ ID NO: 3874188 - RNA, 23 nt, Human
ugcaggaguuaaaaagggcaggg

SEQ ID NO: 3874189 - RNA, 19 nt, Human
ugcaggaucucaccaggca

SEQ ID NO: 3874190 - RNA, 20 nt, Human
ugcaggcacuuauuguaaau

SEQ ID NO: 3874191 - RNA, 14 nt, Human
ugcaggcagacacg

SEQ ID NO: 3874192 - RNA, 14 nt, Human
ugcaggcagccagg

SEQ ID NO: 3874193 - RNA, 19 nt, Human
ugcaggcaggaacaaacag

SEQ ID NO: 3874194 - RNA, 15 nt, Human
ugcaggccaggccag

SEQ ID NO: 3874195 - RNA, 19 nt, Human
ugcaggccccgcuugucca

SEQ ID NO: 3874196 - RNA, 17 nt, Human
ugcaggcccuggccucc

SEQ ID NO: 3874197 - RNA, 22 nt, Human
ugcaggcccuuugaagccucag

SEQ ID NO: 3874198 - RNA, 16 nt, Human
ugcaggccugcucagg

SEQ ID NO: 3874199 - RNA, 21 nt, Human
ugcaggccugcucagggacug

SEQ ID NO: 3874200 - RNA, 18 nt, Human
ugcaggcuccccugagga

SEQ ID NO: 3874201 - RNA, 23 nt, Human
ugcaggcuggcaccgccuucucu

SEQ ID NO: 3874202 - RNA, 14 nt, Human
ugcaggcuggccag

SEQ ID NO: 3874203 - RNA, 16 nt, Human
ugcaggcuggccagcc

SEQ ID NO: 3874204 - RNA, 18 nt, Human
ugcaggcuggccagccgc

SEQ ID NO: 3874205 - RNA, 19 nt, Human
ugcaggcuggccagccgcu

SEQ ID NO: 3874206 - RNA, 14 nt, Human
ugcagggagccgag

SEQ ID NO: 3874207 - RNA, 16 nt, Human
ugcagggauguggguu

SEQ ID NO: 3874208 - RNA, 22 nt, Human
ugcagggauguggguuccacag

SEQ ID NO: 3874209 - RNA, 13 nt, Human
ugcagggcagccc

SEQ ID NO: 3874210 - RNA, 20 nt, Human
ugcagggcagccccacaacu

SEQ ID NO: 3874211 - RNA, 13 nt, Human
ugcagggccagga

SEQ ID NO: 3874212 - RNA, 23 nt, Human
ugcagggccaggacugagccccg

SEQ ID NO: 3874213 - RNA, 19 nt, Human
ugcagggccauggcucagg

SEQ ID NO: 3874214 - RNA, 14 nt, Human
ugcaggggcucugg

SEQ ID NO: 3874215 - RNA, 19 nt, Human
ugcaggggcucuggagaga

SEQ ID NO: 3874216 - RNA, 13 nt, Human
ugcaggggugacg

SEQ ID NO: 3874217 - RNA, 17 nt, Human
ugcaggguggugcuggg

SEQ ID NO: 3874218 - RNA, 18 nt, Human
ugcagguagaccugucuc

SEQ ID NO: 3874219 - RNA, 12 nt, Human
ugcaggucccua

SEQ ID NO: 3874220 - RNA, 15 nt, Human
ugcaggucccuaaua

SEQ ID NO: 3874221 - RNA, 21 nt, Human
ugcaggucccuaauaaagcug

SEQ ID NO: 3874222 - RNA, 22 nt, Human
ugcaggucccuaauaaagcugu

SEQ ID NO: 3874223 - RNA, 15 nt, Human
ugcaggucucaaccc

SEQ ID NO: 3874224 - RNA, 19 nt, Human
ugcauuuuaacccuauuuu

SEQ ID NO: 3874225 - RNA, 21 nt, Human
ugcauuuuaauuuuaaccaaa

SEQ ID NO: 3874226 - RNA, 17 nt, Human
ugcauuuucaccccacc

SEQ ID NO: 3874227 - RNA, 20 nt, Human
ugcauuuucugaaacuaaug

SEQ ID NO: 3874228 - RNA, 13 nt, Human
ugcauuuugcuau

SEQ ID NO: 3874229 - RNA, 16 nt, Human
ugcauuuugcuauugu

SEQ ID NO: 3874230 - RNA, 18 nt, Human
ugcauuuugcuauuguaa

SEQ ID NO: 3874231 - RNA, 19 nt, Human
ugcauuuugcuauuguaaa

SEQ ID NO: 3874232 - RNA, 22 nt, Human
ugcauuuugcuauuguaaauau

SEQ ID NO: 3874233 - RNA, 14 nt, Human
ugcauuuuucugca

SEQ ID NO: 3874234 - RNA, 14 nt, Human
ugcauuuuugugaa

SEQ ID NO: 3874235 - RNA, 21 nt, Human
ugccaaaaaggauacauaaug

SEQ ID NO: 3874236 - RNA, 22 nt, Human
ugccaaaaagugaaauaaugug

SEQ ID NO: 3874237 - RNA, 17 nt, Human
ugccaaaacccagcugc

SEQ ID NO: 3874238 - RNA, 12 nt, Human
ugccaaaauaau

SEQ ID NO: 3874239 - RNA, 17 nt, Human
ugccaaaauaaugucuu

SEQ ID NO: 3874240 - RNA, 19 nt, Human
ugccaaaaucauuuuaaug

SEQ ID NO: 3874241 - RNA, 15 nt, Human
ugccaaagaaagugg

SEQ ID NO: 3874242 - RNA, 21 nt, Human
ugccaaagcuaggguggcccu

SEQ ID NO: 3874243 - RNA, 22 nt, Human
ugccaaagcuaggguggcccuu

SEQ ID NO: 3874244 - RNA, 15 nt, Human
ugccaaaggauguga

SEQ ID NO: 3874245 - RNA, 16 nt, Human
ugccaaaggaugugau

SEQ ID NO: 3874246 - RNA, 17 nt, Human
ugccaaaggaugugaua

SEQ ID NO: 3874247 - RNA, 22 nt, Human
ugccaaaguacagaauuugaau

SEQ ID NO: 3874248 - RNA, 18 nt, Human
ugccaaauauaaauaaaa

SEQ ID NO: 3874249 - RNA, 19 nt, Human
ugccaaauauaaauaaaaa

SEQ ID NO: 3874250 - RNA, 22 nt, Human
ugccaaauauaaauaaaaauaa

SEQ ID NO: 3874251 - RNA, 17 nt, Human
ugccaaauauguccugg

SEQ ID NO: 3874252 - RNA, 12 nt, Human
ugccaaaugcuc

SEQ ID NO: 3874253 - RNA, 22 nt, Human
ugccaaauuaaaaaagauaaac

SEQ ID NO: 3874254 - RNA, 22 nt, Human
ugccaaauuauucuccuauguu

SEQ ID NO: 3874255 - RNA, 18 nt, Human
ugccaacaagaaugcauu

SEQ ID NO: 3874256 - RNA, 19 nt, Human
ugccaacaagaaugcauug

SEQ ID NO: 3874257 - RNA, 20 nt, Human
ugccaacacucaagaagcag

SEQ ID NO: 3874258 - RNA, 23 nt, Human
ugccaacacucaagaagcaggcu

SEQ ID NO: 3874259 - RNA, 13 nt, Human
ugccaacauugcc

SEQ ID NO: 3874260 - RNA, 19 nt, Human
ugccaaccauaccuuccuu

SEQ ID NO: 3874261 - RNA, 17 nt, Human
ugccaaccuauuuugaa

SEQ ID NO: 3874262 - RNA, 18 nt, Human
ugccaaccuguaauaaau

SEQ ID NO: 3874263 - RNA, 17 nt, Human
ugccaagaacugaaaac

SEQ ID NO: 3874264 - RNA, 18 nt, Human
ugccaagaacugaaaaca

SEQ ID NO: 3874265 - RNA, 20 nt, Human
ugccaagaacugaaaacaua

SEQ ID NO: 3874266 - RNA, 23 nt, Human
ugccaagacaaaucaacagaagc

SEQ ID NO: 3874267 - RNA, 19 nt, Human
ugccaagcacagugccugc

SEQ ID NO: 3874268 - RNA, 23 nt, Human
ugccaagccauggguagccuggg

SEQ ID NO: 3874269 - RNA, 18 nt, Human
ugccaagccccauccugc

SEQ ID NO: 3874270 - RNA, 14 nt, Human
ugccaagcucagga

SEQ ID NO: 3874271 - RNA, 23 nt, Human
ugccaagucauagccauaaauga

SEQ ID NO: 3874272 - RNA, 13 nt, Human
ugccaaguccagg

SEQ ID NO: 3874273 - RNA, 20 nt, Human
ugccaaguuguuugagaaau

SEQ ID NO: 3874274 - RNA, 22 nt, Human
ugccaauaauaauaccucccuu

SEQ ID NO: 3874275 - RNA, 15 nt, Human
ugccaauauccuaau

SEQ ID NO: 3874276 - RNA, 17 nt, Human
ugccaauauccuaauaa

SEQ ID NO: 3874277 - RNA, 19 nt, Human
ugccaauauccuaauaaaa

SEQ ID NO: 3874278 - RNA, 23 nt, Human
ugccaauauccuaauaaaaaggu

SEQ ID NO: 3874279 - RNA, 15 nt, Human
ugccaauauguauug

SEQ ID NO: 3874280 - RNA, 16 nt, Human
ugccaauauguauugu

SEQ ID NO: 3874281 - RNA, 14 nt, Human
ugccaauggaaccu

SEQ ID NO: 3874282 - RNA, 13 nt, Human
ugccaauggacua

SEQ ID NO: 3874283 - RNA, 14 nt, Human
ugccaaugggagcu

SEQ ID NO: 3874284 - RNA, 21 nt, Human
ugccaauuugcacauuaaaug

SEQ ID NO: 3874285 - RNA, 17 nt, Human
ugccacaaccagccagg

SEQ ID NO: 3874286 - RNA, 17 nt, Human
ugccacaaggaagaaau

SEQ ID NO: 3874287 - RNA, 22 nt, Human
ugccacaaggaagaaauuaacu

SEQ ID NO: 3874288 - RNA, 23 nt, Human
ugccacaaggaagaaauuaacuu

SEQ ID NO: 3874289 - RNA, 15 nt, Human
ugccacaaggacuuc

SEQ ID NO: 3874290 - RNA, 16 nt, Human
ugccacaaggacuucc

SEQ ID NO: 3874291 - RNA, 14 nt, Human
ugccacacaaacgu

SEQ ID NO: 3874292 - RNA, 13 nt, Human
ugccacacccucc

SEQ ID NO: 3874293 - RNA, 22 nt, Human
ugccacacccucccccgccacu

SEQ ID NO: 3874294 - RNA, 16 nt, Human
ugccacacgucugacc

SEQ ID NO: 3874295 - RNA, 14 nt, Human
ugccacacucucca

SEQ ID NO: 3874296 - RNA, 12 nt, Human
ugccacacuuca

SEQ ID NO: 3874297 - RNA, 13 nt, Human
ugccacacuucag

SEQ ID NO: 3874298 - RNA, 15 nt, Human
ugccacacuucaggc

SEQ ID NO: 3874299 - RNA, 16 nt, Human
ugccacacuucaggcu

SEQ ID NO: 3874300 - RNA, 14 nt, Human
ugccacagagcggg

SEQ ID NO: 3874301 - RNA, 16 nt, Human
ugccacagagcgggga

SEQ ID NO: 3874302 - RNA, 22 nt, Human
ugccacagaguguagccagguc

SEQ ID NO: 3874303 - RNA, 17 nt, Human
ugccacagccuccccug

SEQ ID NO: 3874304 - RNA, 17 nt, Human
ugccacaggccucccug

SEQ ID NO: 3874305 - RNA, 22 nt, Human
ugccacaggccucccuguuuga

SEQ ID NO: 3874306 - RNA, 23 nt, Human
ugccacaggccucccuguuugaa

SEQ ID NO: 3874307 - RNA, 17 nt, Human
ugccacaguagaacugu

SEQ ID NO: 3874308 - RNA, 22 nt, Human
ugccacaguagaacugucugug

SEQ ID NO: 3874309 - RNA, 21 nt, Human
ugccacaucuugaucugcuca

SEQ ID NO: 3874310 - RNA, 21 nt, Human
ugccaccaacuggcccucuuc

SEQ ID NO: 3874311 - RNA, 16 nt, Human
ugccaccaacuuacaa

SEQ ID NO: 3874312 - RNA, 19 nt, Human
ugccaccaacuuacaaaaa

SEQ ID NO: 3874313 - RNA, 22 nt, Human
ugccaccacuauaaaaugucuu

SEQ ID NO: 3874314 - RNA, 18 nt, Human
ugccaccagagaccgucc

SEQ ID NO: 3874315 - RNA, 13 nt, Human
ugccaccaggaga

SEQ ID NO: 3874316 - RNA, 17 nt, Human
ugccaccaggagaacca

SEQ ID NO: 3874317 - RNA, 18 nt, Human
ugccaccaggccaccucc

SEQ ID NO: 3874318 - RNA, 19 nt, Human
ugccaccauccugcugcug

SEQ ID NO: 3874319 - RNA, 18 nt, Human
ugccaccauggccagcca

SEQ ID NO: 3874320 - RNA, 12 nt, Human
ugccacccacca

SEQ ID NO: 3874321 - RNA, 16 nt, Human
ugccacccaccucccu

SEQ ID NO: 3874322 - RNA, 18 nt, Human
ugccacccaccucccugc

SEQ ID NO: 3874323 - RNA, 20 nt, Human
ugccacccagccccagccag

SEQ ID NO: 3874324 - RNA, 22 nt, Human
ugccacccagccccagccaggg

SEQ ID NO: 3874325 - RNA, 21 nt, Human
ugccacccaggugauguuagu

SEQ ID NO: 3874326 - RNA, 21 nt, Human
ugccaccccacccucccugga

SEQ ID NO: 3874327 - RNA, 23 nt, Human
ugccaccccacccucccuggagu

SEQ ID NO: 3874328 - RNA, 18 nt, Human
ugccacccccgcuggagg

SEQ ID NO: 3874329 - RNA, 17 nt, Human
ugccaccccgagggcug

SEQ ID NO: 3874330 - RNA, 18 nt, Human
ugccaccccgagggcuga

SEQ ID NO: 3874331 - RNA, 20 nt, Human
ugccaccccuaaacuccagg

SEQ ID NO: 3874332 - RNA, 15 nt, Human
ugccacccugcugag

SEQ ID NO: 3874333 - RNA, 17 nt, Human
ugccacccugggcucug

SEQ ID NO: 3874334 - RNA, 18 nt, Human
ugccacccugggcucugu

SEQ ID NO: 3874335 - RNA, 19 nt, Human
ugccacccuggggagaaag

SEQ ID NO: 3874336 - RNA, 20 nt, Human
ugccacccuggggagaaagu

SEQ ID NO: 3874337 - RNA, 18 nt, Human
ugccaccuccccuugcca

SEQ ID NO: 3874338 - RNA, 21 nt, Human
ugccaccuccccuugccagcu

SEQ ID NO: 3874339 - RNA, 14 nt, Human
ugccaccuccugcc

SEQ ID NO: 3874340 - RNA, 18 nt, Human
ugccaccucuaacagcac

SEQ ID NO: 3874341 - RNA, 19 nt, Human
ugccaccucuaacagcacc

SEQ ID NO: 3874342 - RNA, 20 nt, Human
ugccaccucuaacagcacca

SEQ ID NO: 3874343 - RNA, 13 nt, Human
ugccaccuggacc

SEQ ID NO: 3874344 - RNA, 15 nt, Human
ugccaccuggacccc

SEQ ID NO: 3874345 - RNA, 18 nt, Human
ugccaccuggaccccugc

SEQ ID NO: 3874346 - RNA, 20 nt, Human
ugccaccuggaccccugcau

SEQ ID NO: 3874347 - RNA, 17 nt, Human
ugccaccuggggcaguc

SEQ ID NO: 3874348 - RNA, 23 nt, Human
ugccacgaauuucugugcccucc

SEQ ID NO: 3874349 - RNA, 22 nt, Human
ugccacgcgguacaaaggaaaa

SEQ ID NO: 3874350 - RNA, 15 nt, Human
ugccacguuccacag

SEQ ID NO: 3874351 - RNA, 20 nt, Human
ugccacguuccacaguugcc

SEQ ID NO: 3874352 - RNA, 16 nt, Human
ugccacuaaauugaca

SEQ ID NO: 3874353 - RNA, 18 nt, Human
ugccacuaauuuuaguau

SEQ ID NO: 3874354 - RNA, 21 nt, Human
ugccacuaccccuugauuuuc

SEQ ID NO: 3874355 - RNA, 18 nt, Human
ugccacuaggcugggugc

SEQ ID NO: 3874356 - RNA, 21 nt, Human
ugccacuaggcugggugccca

SEQ ID NO: 3874357 - RNA, 15 nt, Human
ugccacuagggcucu

SEQ ID NO: 3874358 - RNA, 16 nt, Human
ugccacucacacagcc

SEQ ID NO: 3874359 - RNA, 19 nt, Human
ugccacucacacagccagg

SEQ ID NO: 3874360 - RNA, 21 nt, Human
ugccacucacacagccaggug

SEQ ID NO: 3874361 - RNA, 23 nt, Human
ugccacucacacagccaggugcc

SEQ ID NO: 3874362 - RNA, 20 nt, Human
ugccacucacuaggccccca

SEQ ID NO: 3874363 - RNA, 17 nt, Human
ugccacucauuccugua

SEQ ID NO: 3874364 - RNA, 15 nt, Human
ugccacuccucccuc

SEQ ID NO: 3874365 - RNA, 16 nt, Human
ugccacuccucccucc

SEQ ID NO: 3874366 - RNA, 19 nt, Human
ugccacugacugcagggac

SEQ ID NO: 3874367 - RNA, 19 nt, Human
ugccccagcucuggcuucc

SEQ ID NO: 3874368 - RNA, 15 nt, Human
ugccccagcuugggc

SEQ ID NO: 3874369 - RNA, 18 nt, Human
ugccccaggaccagcuca

SEQ ID NO: 3874370 - RNA, 18 nt, Human
ugccccaucacugcgcca

SEQ ID NO: 3874371 - RNA, 17 nt, Human
ugccccaucccaugcug

SEQ ID NO: 3874372 - RNA, 16 nt, Human
ugccccaucuccccuc

SEQ ID NO: 3874373 - RNA, 19 nt, Human
ugccccaucuccccucagc

SEQ ID NO: 3874374 - RNA, 23 nt, Human
ugccccaugaagccacagcccag

SEQ ID NO: 3874375 - RNA, 16 nt, Human
ugccccauuuauccac

SEQ ID NO: 3874376 - RNA, 22 nt, Human
ugcccccaauaguagucucugu

SEQ ID NO: 3874377 - RNA, 22 nt, Human
ugcccccacaccuggcccuggg

SEQ ID NO: 3874378 - RNA, 22 nt, Human
ugcccccaccccggggacccug

SEQ ID NO: 3874379 - RNA, 16 nt, Human
ugcccccagagccaca

SEQ ID NO: 3874380 - RNA, 17 nt, Human
ugcccccagagccacag

SEQ ID NO: 3874381 - RNA, 18 nt, Human
ugcccccagagccacagu

SEQ ID NO: 3874382 - RNA, 14 nt, Human
ugcccccagcccaa

SEQ ID NO: 3874383 - RNA, 12 nt, Human
ugcccccaggac

SEQ ID NO: 3874384 - RNA, 16 nt, Human
ugcccccaggacuggg

SEQ ID NO: 3874385 - RNA, 14 nt, Human
ugcccccagggcac

SEQ ID NO: 3874386 - RNA, 21 nt, Human
ugcccccaggguccugggagg

SEQ ID NO: 3874387 - RNA, 22 nt, Human
ugcccccaggguccugggagga

SEQ ID NO: 3874388 - RNA, 18 nt, Human
ugcccccauuucugaggu

SEQ ID NO: 3874389 - RNA, 15 nt, Human
ugccccccaccccag

SEQ ID NO: 3874390 - RNA, 12 nt, Human
ugccccccagcc

SEQ ID NO: 3874391 - RNA, 14 nt, Human
ugccccccagccuc

SEQ ID NO: 3874392 - RNA, 20 nt, Human
ugccccccagccucuggcau

SEQ ID NO: 3874393 - RNA, 12 nt, Human
ugccccccaucc

SEQ ID NO: 3874394 - RNA, 14 nt, Human
ugccccccauccug

SEQ ID NO: 3874395 - RNA, 16 nt, Human
ugccccccauccuggc

SEQ ID NO: 3874396 - RNA, 23 nt, Human
ugccccccauccuggcccaucag

SEQ ID NO: 3874397 - RNA, 22 nt, Human
ugccccccucaaaccuccucuu

SEQ ID NO: 3874398 - RNA, 20 nt, Human
ugcccccgcauccccugccu

SEQ ID NO: 3874399 - RNA, 14 nt, Human
ugcccccggccccc

SEQ ID NO: 3874400 - RNA, 18 nt, Human
ugcccccggcccccuggu

SEQ ID NO: 3874401 - RNA, 12 nt, Human
ugcccccuccuc

SEQ ID NO: 3874402 - RNA, 17 nt, Human
ugcccccuccucuccca

SEQ ID NO: 3874403 - RNA, 21 nt, Human
ugcccccuccucucccauccc

SEQ ID NO: 3874404 - RNA, 17 nt, Human
ugcccccucgugccagu

SEQ ID NO: 3874405 - RNA, 18 nt, Human
ugcccccucgugccaguc

SEQ ID NO: 3874406 - RNA, 14 nt, Human
ugcccccucugccc

SEQ ID NO: 3874407 - RNA, 15 nt, Human
ugcccccucugcccu

SEQ ID NO: 3874408 - RNA, 17 nt, Human
ugcccccucugcccugc

SEQ ID NO: 3874409 - RNA, 12 nt, Human
ugcccccugcag

SEQ ID NO: 3874410 - RNA, 22 nt, Human
ugcccccugcagaaccggagag

SEQ ID NO: 3874411 - RNA, 14 nt, Human
ugcccccugcagac

SEQ ID NO: 3874412 - RNA, 18 nt, Human
ugcccccuuucagauguc

SEQ ID NO: 3874413 - RNA, 13 nt, Human
ugccccggagcug

SEQ ID NO: 3874414 - RNA, 18 nt, Human
ugccccggccaccucugc

SEQ ID NO: 3874415 - RNA, 23 nt, Human
ugccccggccccggccccagcca

SEQ ID NO: 3874416 - RNA, 20 nt, Human
ugccccgucuacagcucccc

SEQ ID NO: 3874417 - RNA, 14 nt, Human
ugccccgucucugu

SEQ ID NO: 3874418 - RNA, 17 nt, Human
ugccccgucucuguucc

SEQ ID NO: 3874419 - RNA, 21 nt, Human
ugccccuaaucucuguaggaa

SEQ ID NO: 3874420 - RNA, 17 nt, Human
ugccccuacccuggacu

SEQ ID NO: 3874421 - RNA, 23 nt, Human
ugccccuagcuuagagccucccu

SEQ ID NO: 3874422 - RNA, 12 nt, Human
ugccccuccccc

SEQ ID NO: 3874423 - RNA, 21 nt, Human
ugccccucccccaacccccac

SEQ ID NO: 3874424 - RNA, 22 nt, Human
ugccccucccccaacccccacc

SEQ ID NO: 3874425 - RNA, 15 nt, Human
ugccccucccugcuu

SEQ ID NO: 3874426 - RNA, 17 nt, Human
ugccccucccugcuuca

SEQ ID NO: 3874427 - RNA, 14 nt, Human
ugccccucucacca

SEQ ID NO: 3874428 - RNA, 12 nt, Human
ugccccucucug

SEQ ID NO: 3874429 - RNA, 13 nt, Human
ugccccucucugg

SEQ ID NO: 3874430 - RNA, 21 nt, Human
ugccccucucugggccucaga

SEQ ID NO: 3874431 - RNA, 17 nt, Human
ugccccucuuucucuuu

SEQ ID NO: 3874432 - RNA, 22 nt, Human
ugccccucuuucucuuucuucc

SEQ ID NO: 3874433 - RNA, 23 nt, Human
ugccccugagcaaugucugugcu

SEQ ID NO: 3874434 - RNA, 14 nt, Human
ugccccugcugccu

SEQ ID NO: 3874435 - RNA, 23 nt, Human
ugccccugcugccuccccaaccc

SEQ ID NO: 3874436 - RNA, 14 nt, Human
ugccccuggccuug

SEQ ID NO: 3874437 - RNA, 19 nt, Human
ugccccuggccuugggauc

SEQ ID NO: 3874438 - RNA, 18 nt, Human
ugccccuguucucuucca

SEQ ID NO: 3874439 - RNA, 20 nt, Human
ugccccuuccgccacugggg

SEQ ID NO: 3874440 - RNA, 14 nt, Human
ugccccuucuacac

SEQ ID NO: 3874441 - RNA, 20 nt, Human
ugccccuugacaacuggcag

SEQ ID NO: 3874442 - RNA, 14 nt, Human
ugccccuuucugga

SEQ ID NO: 3874443 - RNA, 16 nt, Human
ugcccgagcuggugca

SEQ ID NO: 3874444 - RNA, 20 nt, Human
ugcccgagcuggugcauuac

SEQ ID NO: 3874445 - RNA, 13 nt, Human
ugcccgcacagca

SEQ ID NO: 3874446 - RNA, 13 nt, Human
ugcccgccaccac

SEQ ID NO: 3874447 - RNA, 15 nt, Human
ugcccgccugcccac

SEQ ID NO: 3874448 - RNA, 13 nt, Human
ugcccgcucccag

SEQ ID NO: 3874449 - RNA, 14 nt, Human
ugcccgcucccagu

SEQ ID NO: 3874450 - RNA, 17 nt, Human
ugcccgcucccaguguc

SEQ ID NO: 3874451 - RNA, 15 nt, Human
ugcccggauucuggg

SEQ ID NO: 3874452 - RNA, 14 nt, Human
ugcccggcugcgga

SEQ ID NO: 3874453 - RNA, 22 nt, Human
ugcccgggcgcggccagccccg

SEQ ID NO: 3874454 - RNA, 21 nt, Human
ugcccggggaaaggcaagguc

SEQ ID NO: 3874455 - RNA, 14 nt, Human
ugcccggggcagca

SEQ ID NO: 3874456 - RNA, 19 nt, Human
ugcccgucucucucccaug

SEQ ID NO: 3874457 - RNA, 13 nt, Human
ugcccgucuucag

SEQ ID NO: 3874458 - RNA, 16 nt, Human
ugcccgucuucagccu

SEQ ID NO: 3874459 - RNA, 18 nt, Human
ugcccgucuucagccuag

SEQ ID NO: 3874460 - RNA, 19 nt, Human
ugcccguguaguccccaac

SEQ ID NO: 3874461 - RNA, 19 nt, Human
ugcccuaaauaacccuuca

SEQ ID NO: 3874462 - RNA, 23 nt, Human
ugcccuaacuguacauuucacag

SEQ ID NO: 3874463 - RNA, 13 nt, Human
ugcccuaagcaga

SEQ ID NO: 3874464 - RNA, 17 nt, Human
ugcccuaagcagaaagu

SEQ ID NO: 3874465 - RNA, 18 nt, Human
ugcccuaagcagaaagug

SEQ ID NO: 3874466 - RNA, 13 nt, Human
ugcccuaauaaaa

SEQ ID NO: 3874467 - RNA, 20 nt, Human
ugcccuaaugcgcaggcugg

SEQ ID NO: 3874468 - RNA, 18 nt, Human
ugcccuacagaggucucu

SEQ ID NO: 3874469 - RNA, 22 nt, Human
ugcccuacuauagcaguuuuua

SEQ ID NO: 3874470 - RNA, 23 nt, Human
ugcccuagagcacacuguagcau

SEQ ID NO: 3874471 - RNA, 16 nt, Human
ugcccuagaugagccc

SEQ ID NO: 3874472 - RNA, 14 nt, Human
ugcccuagcuccac

SEQ ID NO: 3874473 - RNA, 19 nt, Human
ugcccucaagagcaaagua

SEQ ID NO: 3874474 - RNA, 19 nt, Human
ugcccucauuacugggccu

SEQ ID NO: 3874475 - RNA, 21 nt, Human
ugcccuccacagccgcagccu

SEQ ID NO: 3874476 - RNA, 19 nt, Human
ugcccuccacugcccucug

SEQ ID NO: 3874477 - RNA, 14 nt, Human
ugcccuccaucccg

SEQ ID NO: 3874478 - RNA, 20 nt, Human
ugcccuccaucccgacaugg

SEQ ID NO: 3874479 - RNA, 16 nt, Human
ugcccucccuccuucc

SEQ ID NO: 3874480 - RNA, 14 nt, Human
ugcccuccucacuc

SEQ ID NO: 3874481 - RNA, 12 nt, Human
ugcccuccucuc

SEQ ID NO: 3874482 - RNA, 14 nt, Human
ugcccuccucuccc

SEQ ID NO: 3874483 - RNA, 16 nt, Human
ugcccuccucucccau

SEQ ID NO: 3874484 - RNA, 23 nt, Human
ugcccuccugacccauugcuguu

SEQ ID NO: 3874485 - RNA, 14 nt, Human
ugcccuccugugcu

SEQ ID NO: 3874486 - RNA, 21 nt, Human
ugcccuccugugcucagcccu

SEQ ID NO: 3874487 - RNA, 15 nt, Human
ugcccucgcugcuuc

SEQ ID NO: 3874488 - RNA, 20 nt, Human
ugcccucgggcgagucacug

SEQ ID NO: 3874489 - RNA, 23 nt, Human
ugcccucgggcgagucacugccu

SEQ ID NO: 3874490 - RNA, 15 nt, Human
ugcccucguggccag

SEQ ID NO: 3874491 - RNA, 17 nt, Human
ugcccucucccacccuc

SEQ ID NO: 3874492 - RNA, 15 nt, Human
ugcccucuccugggc

SEQ ID NO: 3874493 - RNA, 22 nt, Human
ugcccucuccugggcagcugcc

SEQ ID NO: 3874494 - RNA, 23 nt, Human
ugcccucuccugggcagcugccu

SEQ ID NO: 3874495 - RNA, 21 nt, Human
ugcccucuccuuccuuaccca

SEQ ID NO: 3874496 - RNA, 12 nt, Human
ugcccucugggc

SEQ ID NO: 3874497 - RNA, 12 nt, Human
ugcccucuucau

SEQ ID NO: 3874498 - RNA, 20 nt, Human
ugcccucuucucgugccucc

SEQ ID NO: 3874499 - RNA, 14 nt, Human
ugcccugaccuccc

SEQ ID NO: 3874500 - RNA, 16 nt, Human
ugcccugaccucccag

SEQ ID NO: 3874501 - RNA, 18 nt, Human
ugcccugaccucccagcc

SEQ ID NO: 3874502 - RNA, 20 nt, Human
ugcccugaccucccagcccu

SEQ ID NO: 3874503 - RNA, 15 nt, Human
ugcccugagaagcug

SEQ ID NO: 3874504 - RNA, 14 nt, Human
ugcccugaggaagg

SEQ ID NO: 3874505 - RNA, 17 nt, Human
ugcccugccaccugucu

SEQ ID NO: 3874506 - RNA, 11 nt, Human
ugcccugcccc

SEQ ID NO: 3874507 - RNA, 18 nt, Human
ugcccugcccugccaccu

SEQ ID NO: 3874508 - RNA, 14 nt, Human
ugcccugccugagg

SEQ ID NO: 3874509 - RNA, 19 nt, Human
ugcccugcggccccgucug

SEQ ID NO: 3874510 - RNA, 18 nt, Human
ugcccugcugagucccag

SEQ ID NO: 3874511 - RNA, 16 nt, Human
ugcccugcugcccucc

SEQ ID NO: 3874512 - RNA, 14 nt, Human
uggaaagaguacuc

SEQ ID NO: 3874513 - RNA, 18 nt, Human
uggaaagauaacuaggaa

SEQ ID NO: 3874514 - RNA, 19 nt, Human
uggaaagcagaguuuucau

SEQ ID NO: 3874515 - RNA, 20 nt, Human
uggaaagcaucaccucaggc

SEQ ID NO: 3874516 - RNA, 12 nt, Human
uggaaagccucu

SEQ ID NO: 3874517 - RNA, 20 nt, Human
uggaaagcuccuagcagaga

SEQ ID NO: 3874518 - RNA, 15 nt, Human
uggaaaggagaggaa

SEQ ID NO: 3874519 - RNA, 21 nt, Human
uggaaaggagccuaggccagg

SEQ ID NO: 3874520 - RNA, 13 nt, Human
uggaaaggcagcu

SEQ ID NO: 3874521 - RNA, 17 nt, Human
uggaaaggcucagucuc

SEQ ID NO: 3874522 - RNA, 15 nt, Human
uggaaaggggagagc

SEQ ID NO: 3874523 - RNA, 19 nt, Human
uggaaaggggagagccugc

SEQ ID NO: 3874524 - RNA, 21 nt, Human
uggaaaggggagagccugcug

SEQ ID NO: 3874525 - RNA, 19 nt, Human
uggaaaggggggagcuggg

SEQ ID NO: 3874526 - RNA, 23 nt, Human
uggaaagggugcugcuucccucu

SEQ ID NO: 3874527 - RNA, 21 nt, Human
uggaaagugaauuugaaugaa

SEQ ID NO: 3874528 - RNA, 12 nt, Human
uggaaauaaagu

SEQ ID NO: 3874529 - RNA, 14 nt, Human
uggaaauacacagu

SEQ ID NO: 3874530 - RNA, 17 nt, Human
uggaaauauauauuaua

SEQ ID NO: 3874531 - RNA, 13 nt, Human
uggaaauauuaaa

SEQ ID NO: 3874532 - RNA, 13 nt, Human
uggaaauauuaug

SEQ ID NO: 3874533 - RNA, 23 nt, Human
uggaaauauuaugcaaauuccca

SEQ ID NO: 3874534 - RNA, 23 nt, Human
uggaaauauucaugcuucuuccu

SEQ ID NO: 3874535 - RNA, 19 nt, Human
uggaaauccuaguuuccuc

SEQ ID NO: 3874536 - RNA, 15 nt, Human
uggaaaucuuuaaaa

SEQ ID NO: 3874537 - RNA, 19 nt, Human
uggaaauggaugcaaagua

SEQ ID NO: 3874538 - RNA, 18 nt, Human
uggaaauuaagaagaaac

SEQ ID NO: 3874539 - RNA, 20 nt, Human
uggaaauuaagaagaaacua

SEQ ID NO: 3874540 - RNA, 22 nt, Human
uggaaauuaggauguaaaucug

SEQ ID NO: 3874541 - RNA, 21 nt, Human
uggaaauucaggugaaaaugu

SEQ ID NO: 3874542 - RNA, 17 nt, Human
uggaaauucccuucauc

SEQ ID NO: 3874543 - RNA, 22 nt, Human
uggaaauucccuucaucuggaa

SEQ ID NO: 3874544 - RNA, 19 nt, Human
uggaaauuccuguacugug

SEQ ID NO: 3874545 - RNA, 14 nt, Human
uggaaauuuaaagc

SEQ ID NO: 3874546 - RNA, 16 nt, Human
uggaaauuuaaagcag

SEQ ID NO: 3874547 - RNA, 15 nt, Human
uggaaauuuagcauu

SEQ ID NO: 3874548 - RNA, 17 nt, Human
uggaaauuuagcauugu

SEQ ID NO: 3874549 - RNA, 12 nt, Human
uggaaauuucac

SEQ ID NO: 3874550 - RNA, 14 nt, Human
uggaaauuucacgu

SEQ ID NO: 3874551 - RNA, 18 nt, Human
uggaacaauauuuuaugg

SEQ ID NO: 3874552 - RNA, 21 nt, Human
uggaacaaucuaaaaguuuaa

SEQ ID NO: 3874553 - RNA, 16 nt, Human
uggaacacagaacuga

SEQ ID NO: 3874554 - RNA, 20 nt, Human
uggaacacagaacugaacug

SEQ ID NO: 3874555 - RNA, 16 nt, Human
uggaacagaauguuuu

SEQ ID NO: 3874556 - RNA, 21 nt, Human
uggaacagaauguuuuacugu

SEQ ID NO: 3874557 - RNA, 23 nt, Human
uggaacagauucacacugucugg

SEQ ID NO: 3874558 - RNA, 19 nt, Human
uggaacagugcuacugaaa

SEQ ID NO: 3874559 - RNA, 16 nt, Human
uggaacauacuguuca

SEQ ID NO: 3874560 - RNA, 17 nt, Human
uggaacauacuguucac

SEQ ID NO: 3874561 - RNA, 23 nt, Human
uggaacauccuuugcagggcagc

SEQ ID NO: 3874562 - RNA, 12 nt, Human
uggaaccagacu

SEQ ID NO: 3874563 - RNA, 19 nt, Human
uggaaccagacucuugccu

SEQ ID NO: 3874564 - RNA, 17 nt, Human
uggaacccagacucaga

SEQ ID NO: 3874565 - RNA, 22 nt, Human
uggaacccagacucagacauug

SEQ ID NO: 3874566 - RNA, 22 nt, Human
uggaacccuuuuaaaguugaua

SEQ ID NO: 3874567 - RNA, 18 nt, Human
uggaacccuuuuggcccc

SEQ ID NO: 3874568 - RNA, 17 nt, Human
uggaaccgcaggaagcu

SEQ ID NO: 3874569 - RNA, 13 nt, Human
uggaaccuccuuu

SEQ ID NO: 3874570 - RNA, 18 nt, Human
uggaaccuugcuguccug

SEQ ID NO: 3874571 - RNA, 15 nt, Human
uggaacgcguugaaa

SEQ ID NO: 3874572 - RNA, 17 nt, Human
uggaacgcguugaaauu

SEQ ID NO: 3874573 - RNA, 19 nt, Human
uggaacgcguugaaauugu

SEQ ID NO: 3874574 - RNA, 17 nt, Human
uggaacgcuaaugaaac

SEQ ID NO: 3874575 - RNA, 18 nt, Human
uggaacgcuaaugaaaca

SEQ ID NO: 3874576 - RNA, 17 nt, Human
uggaacuaauaaauaca

SEQ ID NO: 3874577 - RNA, 23 nt, Human
uggaacuacauuaguacacagca

SEQ ID NO: 3874578 - RNA, 18 nt, Human
uggaacuagguuuuaaua

SEQ ID NO: 3874579 - RNA, 16 nt, Human
uggaacucauuccugc

SEQ ID NO: 3874580 - RNA, 23 nt, Human
uggaacucuugacagcuauaauu

SEQ ID NO: 3874581 - RNA, 16 nt, Human
uggaacugaagggggc

SEQ ID NO: 3874582 - RNA, 21 nt, Human
uggaacugaagggggcggccu

SEQ ID NO: 3874583 - RNA, 21 nt, Human
uggaacugcguuaugaagagc

SEQ ID NO: 3874584 - RNA, 17 nt, Human
uggaacugcugccacug

SEQ ID NO: 3874585 - RNA, 23 nt, Human
uggaacugucucucaugaaccuc

SEQ ID NO: 3874586 - RNA, 13 nt, Human
uggaacuucuaau

SEQ ID NO: 3874587 - RNA, 13 nt, Human
uggaacuugaacu

SEQ ID NO: 3874588 - RNA, 16 nt, Human
uggaacuugaacugau

SEQ ID NO: 3874589 - RNA, 22 nt, Human
uggaagaaaaaaaucuucucca

SEQ ID NO: 3874590 - RNA, 20 nt, Human
uggaagaaauuccuguagca

SEQ ID NO: 3874591 - RNA, 13 nt, Human
uggaagaagggag

SEQ ID NO: 3874592 - RNA, 21 nt, Human
uggaagaagggagaagaaagg

SEQ ID NO: 3874593 - RNA, 11 nt, Human
uggaagacaca

SEQ ID NO: 3874594 - RNA, 13 nt, Human
uggaagacagaga

SEQ ID NO: 3874595 - RNA, 20 nt, Human
uggaagacagagaccuccug

SEQ ID NO: 3874596 - RNA, 14 nt, Human
uggaagacagcucu

SEQ ID NO: 3874597 - RNA, 17 nt, Human
uggaagacgcaagggcc

SEQ ID NO: 3874598 - RNA, 13 nt, Human
uggaagagaaauc

SEQ ID NO: 3874599 - RNA, 16 nt, Human
uggaagagaaaucuca

SEQ ID NO: 3874600 - RNA, 12 nt, Human
uggaagagaauc

SEQ ID NO: 3874601 - RNA, 14 nt, Human
uggaagagagaaag

SEQ ID NO: 3874602 - RNA, 16 nt, Human
uggaagagagaaagca

SEQ ID NO: 3874603 - RNA, 16 nt, Human
uggaagagcagcaccu

SEQ ID NO: 3874604 - RNA, 22 nt, Human
uggaagagcagcaccuccucag

SEQ ID NO: 3874605 - RNA, 23 nt, Human
uggaagaggaacagcacugggga

SEQ ID NO: 3874606 - RNA, 16 nt, Human
uggaagagugugugug

SEQ ID NO: 3874607 - RNA, 21 nt, Human
uggaagauccugcgggugggg

SEQ ID NO: 3874608 - RNA, 17 nt, Human
uggaagauccugugagg

SEQ ID NO: 3874609 - RNA, 18 nt, Human
uggaagauccugugagga

SEQ ID NO: 3874610 - RNA, 21 nt, Human
uggaagauggggaccagcagc

SEQ ID NO: 3874611 - RNA, 16 nt, Human
uggaagauuuuaaauu

SEQ ID NO: 3874612 - RNA, 17 nt, Human
uggaagauuuucagucu

SEQ ID NO: 3874613 - RNA, 14 nt, Human
uggaagcaaaguau

SEQ ID NO: 3874614 - RNA, 23 nt, Human
uggaagcacaccaaucuuacuuu

SEQ ID NO: 3874615 - RNA, 17 nt, Human
uggaagcagguuaaaug

SEQ ID NO: 3874616 - RNA, 17 nt, Human
uggaagcagugcccagg

SEQ ID NO: 3874617 - RNA, 17 nt, Human
uggaagcauguaggaga

SEQ ID NO: 3874618 - RNA, 22 nt, Human
uggaagcauguaggagaaucca

SEQ ID NO: 3874619 - RNA, 18 nt, Human
uggaagccagcuuucccu

SEQ ID NO: 3874620 - RNA, 13 nt, Human
uggaagcccuccu

SEQ ID NO: 3874621 - RNA, 15 nt, Human
uggaagcccuccuuc

SEQ ID NO: 3874622 - RNA, 17 nt, Human
uggaagcccuccuucca

SEQ ID NO: 3874623 - RNA, 18 nt, Human
uggaagcuagcuccccuc

SEQ ID NO: 3874624 - RNA, 17 nt, Human
uggaagcuguuuggaaa

SEQ ID NO: 3874625 - RNA, 19 nt, Human
uggaagcuguuuggaaaag

SEQ ID NO: 3874626 - RNA, 23 nt, Human
uggaagcuguuuggaaaagacag

SEQ ID NO: 3874627 - RNA, 20 nt, Human
uggaagcuuguuuuccaguc

SEQ ID NO: 3874628 - RNA, 18 nt, Human
uggaagcuuuguccccug

SEQ ID NO: 3874629 - RNA, 16 nt, Human
uggaagggaggugggc

SEQ ID NO: 3874630 - RNA, 19 nt, Human
uggaaggguucuggcugcc

SEQ ID NO: 3874631 - RNA, 15 nt, Human
uggaaggguuugugg

SEQ ID NO: 3874632 - RNA, 13 nt, Human
uggaagguauuua

SEQ ID NO: 3874633 - RNA, 14 nt, Human
uggaaguaguggag

SEQ ID NO: 3874634 - RNA, 17 nt, Human
uggaaguccaauguggc

SEQ ID NO: 3874635 - RNA, 14 nt, Human
uggaagugaggcau

SEQ ID NO: 3874636 - RNA, 19 nt, Human
uggaaguggggcgggcuuc

SEQ ID NO: 3874637 - RNA, 13 nt, Human
uggaagugugggu

SEQ ID NO: 3874638 - RNA, 21 nt, Human
uggaagugugugaucuguggg

SEQ ID NO: 3874639 - RNA, 18 nt, Human
uggaaguucauaccuaag

SEQ ID NO: 3874640 - RNA, 18 nt, Human
uggaaguuuagcucugag

SEQ ID NO: 3874641 - RNA, 19 nt, Human
uggaaguuuagcucugaga

SEQ ID NO: 3874642 - RNA, 19 nt, Human
uggaaguuuguguucuguu

SEQ ID NO: 3874643 - RNA, 13 nt, Human
uggaaguuuucag

SEQ ID NO: 3874644 - RNA, 15 nt, Human
uggaaguuuucagga

SEQ ID NO: 3874645 - RNA, 18 nt, Human
uggaauaaaaauuccaga

SEQ ID NO: 3874646 - RNA, 13 nt, Human
uggaauaaaauac

SEQ ID NO: 3874647 - RNA, 15 nt, Human
uggaauaaaauacua

SEQ ID NO: 3874648 - RNA, 19 nt, Human
uggaauaaaauacuauuuu

SEQ ID NO: 3874649 - RNA, 17 nt, Human
uggaauaaggagaauga

SEQ ID NO: 3874650 - RNA, 22 nt, Human
uggaauacaguguuauuuucuu

SEQ ID NO: 3874651 - RNA, 14 nt, Human
uggaauacauuucu

SEQ ID NO: 3874652 - RNA, 19 nt, Human
uggaauaguauccuccagg

SEQ ID NO: 3874653 - RNA, 15 nt, Human
uggaauauauaacca

SEQ ID NO: 3874654 - RNA, 16 nt, Human
uggaauauauaaccag

SEQ ID NO: 3874655 - RNA, 13 nt, Human
uggaauauuaaaa

SEQ ID NO: 3874656 - RNA, 20 nt, Human
uggaucacgacgcugcagag

SEQ ID NO: 3874657 - RNA, 16 nt, Human
uggaucagaugaacuc

SEQ ID NO: 3874658 - RNA, 16 nt, Human
uggaucaguccuuuga

SEQ ID NO: 3874659 - RNA, 22 nt, Human
uggauccaauguuagagacuuu

SEQ ID NO: 3874660 - RNA, 23 nt, Human
uggauccaauguuagagacuuuu

SEQ ID NO: 3874661 - RNA, 17 nt, Human
uggauccccagugaaaa

SEQ ID NO: 3874662 - RNA, 19 nt, Human
uggauccccagugaaaacu

SEQ ID NO: 3874663 - RNA, 20 nt, Human
uggauccccagugaaaacua

SEQ ID NO: 3874664 - RNA, 17 nt, Human
uggauccccucugucua

SEQ ID NO: 3874665 - RNA, 23 nt, Human
uggauccccucugucuacaaaua

SEQ ID NO: 3874666 - RNA, 13 nt, Human
uggauccuagccu

SEQ ID NO: 3874667 - RNA, 23 nt, Human
uggauccuagccuuauccucuga

SEQ ID NO: 3874668 - RNA, 20 nt, Human
uggauccugaaauagaggcu

SEQ ID NO: 3874669 - RNA, 18 nt, Human
uggauccuugucaguugu

SEQ ID NO: 3874670 - RNA, 14 nt, Human
uggaucuauuucau

SEQ ID NO: 3874671 - RNA, 15 nt, Human
uggaucuccaaggac

SEQ ID NO: 3874672 - RNA, 16 nt, Human
uggaucucccagggcu

SEQ ID NO: 3874673 - RNA, 14 nt, Human
uggaucucuuaaga

SEQ ID NO: 3874674 - RNA, 23 nt, Human
uggaucucuucuuaauguacaua

SEQ ID NO: 3874675 - RNA, 20 nt, Human
uggaucugggacccuuuccu

SEQ ID NO: 3874676 - RNA, 21 nt, Human
uggaucugggacccuuuccuu

SEQ ID NO: 3874677 - RNA, 18 nt, Human
uggaucuguccaaggaaa

SEQ ID NO: 3874678 - RNA, 15 nt, Human
uggaucuugaaugug

SEQ ID NO: 3874679 - RNA, 21 nt, Human
uggaucuugauguaaggaugg

SEQ ID NO: 3874680 - RNA, 13 nt, Human
uggaugaccagaa

SEQ ID NO: 3874681 - RNA, 16 nt, Human
uggaugauacuaauaa

SEQ ID NO: 3874682 - RNA, 19 nt, Human
uggaugauauaaugcgggu

SEQ ID NO: 3874683 - RNA, 21 nt, Human
uggaugauggucuucagccuc

SEQ ID NO: 3874684 - RNA, 20 nt, Human
uggaugcaaaguacaaugug

SEQ ID NO: 3874685 - RNA, 22 nt, Human
uggaugcagccucacaguccuu

SEQ ID NO: 3874686 - RNA, 20 nt, Human
uggaugcauguuuuccagcu

SEQ ID NO: 3874687 - RNA, 15 nt, Human
uggaugcauuucucu

SEQ ID NO: 3874688 - RNA, 21 nt, Human
uggaugccaauauuaaaucug

SEQ ID NO: 3874689 - RNA, 14 nt, Human
uggaugccucagaa

SEQ ID NO: 3874690 - RNA, 23 nt, Human
uggaugccugguggcagcugcgg

SEQ ID NO: 3874691 - RNA, 23 nt, Human
uggaugcggaacccaaauuacgu

SEQ ID NO: 3874692 - RNA, 16 nt, Human
uggaugcuuagaggga

SEQ ID NO: 3874693 - RNA, 15 nt, Human
uggauggagcccagg

SEQ ID NO: 3874694 - RNA, 14 nt, Human
uggauggccccagc

SEQ ID NO: 3874695 - RNA, 18 nt, Human
uggauggccccagcacag

SEQ ID NO: 3874696 - RNA, 13 nt, Human
uggauggggcagg

SEQ ID NO: 3874697 - RNA, 20 nt, Human
uggauggggcaggccaccug

SEQ ID NO: 3874698 - RNA, 22 nt, Human
uggaugggggaacucagaucca

SEQ ID NO: 3874699 - RNA, 18 nt, Human
uggauggucauugcaguu

SEQ ID NO: 3874700 - RNA, 14 nt, Human
uggaugucuuccuu

SEQ ID NO: 3874701 - RNA, 15 nt, Human
uggauguuacucucu

SEQ ID NO: 3874702 - RNA, 15 nt, Human
uggauuaaacuuaug

SEQ ID NO: 3874703 - RNA, 17 nt, Human
uggauuaaacuuaugaa

SEQ ID NO: 3874704 - RNA, 15 nt, Human
uggauuaaauacaua

SEQ ID NO: 3874705 - RNA, 14 nt, Human
uggauuaaauuagu

SEQ ID NO: 3874706 - RNA, 20 nt, Human
uggauuacugccauucacuu

SEQ ID NO: 3874707 - RNA, 17 nt, Human
uggauuagccuggagca

SEQ ID NO: 3874708 - RNA, 17 nt, Human
uggauuauaaucagaau

SEQ ID NO: 3874709 - RNA, 15 nt, Human
uggauuauuuaauaa

SEQ ID NO: 3874710 - RNA, 18 nt, Human
uggauuauuuaauaacau

SEQ ID NO: 3874711 - RNA, 20 nt, Human
uggauuauuuaauaacauua

SEQ ID NO: 3874712 - RNA, 23 nt, Human
uggauuauuuaauaacauuaccu

SEQ ID NO: 3874713 - RNA, 13 nt, Human
uggauuauuucau

SEQ ID NO: 3874714 - RNA, 23 nt, Human
uggauucagccuucuuuuucugg

SEQ ID NO: 3874715 - RNA, 23 nt, Human
uggauucauucucauaauuccua

SEQ ID NO: 3874716 - RNA, 15 nt, Human
uggauucauuuccug

SEQ ID NO: 3874717 - RNA, 17 nt, Human
uggauucauuuccugcc

SEQ ID NO: 3874718 - RNA, 18 nt, Human
uggauucauuuccugccc

SEQ ID NO: 3874719 - RNA, 19 nt, Human
uggauucauuuccugcccu

SEQ ID NO: 3874720 - RNA, 20 nt, Human
uggauucauuuccugcccuu

SEQ ID NO: 3874721 - RNA, 22 nt, Human
uggauuccccaucucaggccag

SEQ ID NO: 3874722 - RNA, 15 nt, Human
uggauucuaaaaugc

SEQ ID NO: 3874723 - RNA, 15 nt, Human
uggauucuaaauaca

SEQ ID NO: 3874724 - RNA, 13 nt, Human
uggauucucagau

SEQ ID NO: 3874725 - RNA, 16 nt, Human
uggauucucagauauu

SEQ ID NO: 3874726 - RNA, 19 nt, Human
uggauucucagauauuuau

SEQ ID NO: 3874727 - RNA, 14 nt, Human
uggauucugaaucu

SEQ ID NO: 3874728 - RNA, 17 nt, Human
uggauucuuguuuugcu

SEQ ID NO: 3874729 - RNA, 21 nt, Human
uggauuggagauagggaaaga

SEQ ID NO: 3874730 - RNA, 15 nt, Human
uggauuggauuauuu

SEQ ID NO: 3874731 - RNA, 16 nt, Human
uggauuggauuauuua

SEQ ID NO: 3874732 - RNA, 17 nt, Human
uggauuggauuauuuaa

SEQ ID NO: 3874733 - RNA, 20 nt, Human
uggauuggauuauuuaauaa

SEQ ID NO: 3874734 - RNA, 17 nt, Human
uggauugggggggccaa

SEQ ID NO: 3874735 - RNA, 18 nt, Human
uggauuguuaauuucagu

SEQ ID NO: 3874736 - RNA, 18 nt, Human
uggauuuaaaagccugcu

SEQ ID NO: 3874737 - RNA, 20 nt, Human
uggauuuaaaagccugcuca

SEQ ID NO: 3874738 - RNA, 15 nt, Human
uggauuuaacagaaa

SEQ ID NO: 3874739 - RNA, 20 nt, Human
uggauuuaacagaaauguac

SEQ ID NO: 3874740 - RNA, 21 nt, Human
uggauuuauguuguauagauu

SEQ ID NO: 3874741 - RNA, 22 nt, Human
uggauuuccagccaaagccucc

SEQ ID NO: 3874742 - RNA, 21 nt, Human
uggauuuccuaauacugucau

SEQ ID NO: 3874743 - RNA, 16 nt, Human
uggauuuggagagaaa

SEQ ID NO: 3874744 - RNA, 21 nt, Human
uggauuuggagagaaauauuu

SEQ ID NO: 3874745 - RNA, 22 nt, Human
uggauuuggagagaaauauuuu

SEQ ID NO: 3874746 - RNA, 22 nt, Human
uggauuuuccaggacuguuuca

SEQ ID NO: 3874747 - RNA, 20 nt, Human
uggauuuucuauuguuacuc

SEQ ID NO: 3874748 - RNA, 16 nt, Human
uggauuuuuaauuaaa

SEQ ID NO: 3874749 - RNA, 17 nt, Human
uggauuuuuaauuaaaa

SEQ ID NO: 3874750 - RNA, 19 nt, Human
uggauuuuuaauuaaaaac

SEQ ID NO: 3874751 - RNA, 14 nt, Human
uggauuuuuaccag

SEQ ID NO: 3874752 - RNA, 15 nt, Human
uggauuuuucuuuaa

SEQ ID NO: 3874753 - RNA, 18 nt, Human
uggauuuuucuuuaacug

SEQ ID NO: 3874754 - RNA, 20 nt, Human
uggcaaaacucuacuuaauc

SEQ ID NO: 3874755 - RNA, 20 nt, Human
uggcaaaaggaucuuugugg

SEQ ID NO: 3874756 - RNA, 21 nt, Human
uggcaaaauaguucugcaggu

SEQ ID NO: 3874757 - RNA, 16 nt, Human
uggcaaacagggccuc

SEQ ID NO: 3874758 - RNA, 17 nt, Human
uggcaaacgcuaaagag

SEQ ID NO: 3874759 - RNA, 17 nt, Human
uggcaaagaugugggga

SEQ ID NO: 3874760 - RNA, 23 nt, Human
uggcaaauguaacugugccaguu

SEQ ID NO: 3874761 - RNA, 17 nt, Human
uggcaaauuaacuugag

SEQ ID NO: 3874762 - RNA, 18 nt, Human
uggcaacaaacugcacau

SEQ ID NO: 3874763 - RNA, 13 nt, Human
uggcaacagaagc

SEQ ID NO: 3874764 - RNA, 13 nt, Human
uggcaacagaucu

SEQ ID NO: 3874765 - RNA, 17 nt, Human
uggcaacagaucuggaa

SEQ ID NO: 3874766 - RNA, 18 nt, Human
uggcaacagaucuggaac

SEQ ID NO: 3874767 - RNA, 15 nt, Human
uggcaagaaagcugg

SEQ ID NO: 3874768 - RNA, 22 nt, Human
uggcaagagggugacagcuucc

SEQ ID NO: 3874769 - RNA, 19 nt, Human
uggcaagaguguggaggcu

SEQ ID NO: 3874770 - RNA, 21 nt, Human
uggcaagcuagaaccuggagg

SEQ ID NO: 3874771 - RNA, 16 nt, Human
uggcaaggaaaaacag

SEQ ID NO: 3874772 - RNA, 12 nt, Human
uggcaaggaaag

SEQ ID NO: 3874773 - RNA, 21 nt, Human
uggcaaggacuuuguacauuu

SEQ ID NO: 3874774 - RNA, 16 nt, Human
uggcaaggcugugcuc

SEQ ID NO: 3874775 - RNA, 17 nt, Human
uggcaaggguucaccug

SEQ ID NO: 3874776 - RNA, 15 nt, Human
uggcaagucacaugc

SEQ ID NO: 3874777 - RNA, 14 nt, Human
uggcaagugaauuu

SEQ ID NO: 3874778 - RNA, 23 nt, Human
uggcaaguuuugauaugaguaua

SEQ ID NO: 3874779 - RNA, 17 nt, Human
uggcaauaaauuuugaa

SEQ ID NO: 3874780 - RNA, 18 nt, Human
uggcaauagugggcccuc

SEQ ID NO: 3874781 - RNA, 13 nt, Human
uggcaauauagaa

SEQ ID NO: 3874782 - RNA, 19 nt, Human
uggcaaucucagaugcagu

SEQ ID NO: 3874783 - RNA, 15 nt, Human
uggcaaugccacagc

SEQ ID NO: 3874784 - RNA, 21 nt, Human
uggcaaugguaguuucugugg

SEQ ID NO: 3874785 - RNA, 13 nt, Human
uggcaauugucua

SEQ ID NO: 3874786 - RNA, 16 nt, Human
uggcaauuuaacaugu

SEQ ID NO: 3874787 - RNA, 17 nt, Human
uggcacagccugcacuu

SEQ ID NO: 3874788 - RNA, 14 nt, Human
uggcacaggacaug

SEQ ID NO: 3874789 - RNA, 13 nt, Human
uggcacaggacug

SEQ ID NO: 3874790 - RNA, 21 nt, Human
uggcacaggaguguccucuuc

SEQ ID NO: 3874791 - RNA, 16 nt, Human
uggcacaggcccccuu

SEQ ID NO: 3874792 - RNA, 19 nt, Human
uggcacagugucugggcug

SEQ ID NO: 3874793 - RNA, 20 nt, Human
uggcacaguuuucugagaaa

SEQ ID NO: 3874794 - RNA, 14 nt, Human
uggcacaucagaaa

SEQ ID NO: 3874795 - RNA, 15 nt, Human
uggcacaucagaaag

SEQ ID NO: 3874796 - RNA, 19 nt, Human
uggcacauccuaugcaaua

SEQ ID NO: 3874797 - RNA, 17 nt, Human
uggcaccagcagccugg

SEQ ID NO: 3874798 - RNA, 18 nt, Human
uggcaccagcgaagggag

SEQ ID NO: 3874799 - RNA, 20 nt, Human
uggcacccaccguggaggag

SEQ ID NO: 3874800 - RNA, 11 nt, Human
ugguacagaga

SEQ ID NO: 3874801 - RNA, 15 nt, Human
ugguacagagaagcc

SEQ ID NO: 3874802 - RNA, 21 nt, Human
ugguacagagaagccagcuug

SEQ ID NO: 3874803 - RNA, 15 nt, Human
ugguacagguauauu

SEQ ID NO: 3874804 - RNA, 18 nt, Human
ugguacaugguguuugug

SEQ ID NO: 3874805 - RNA, 14 nt, Human
ugguaccagcccug

SEQ ID NO: 3874806 - RNA, 19 nt, Human
ugguaccagcccuggggcu

SEQ ID NO: 3874807 - RNA, 19 nt, Human
ugguacccagccaucugcc

SEQ ID NO: 3874808 - RNA, 20 nt, Human
ugguacccccuucugggcau

SEQ ID NO: 3874809 - RNA, 13 nt, Human
ugguaccuugcac

SEQ ID NO: 3874810 - RNA, 14 nt, Human
ugguaccuugcaca

SEQ ID NO: 3874811 - RNA, 16 nt, Human
ugguaccuugcacaca

SEQ ID NO: 3874812 - RNA, 15 nt, Human
ugguacgugacccuc

SEQ ID NO: 3874813 - RNA, 16 nt, Human
ugguacuaacuuuccu

SEQ ID NO: 3874814 - RNA, 17 nt, Human
ugguacuguacagcugg

SEQ ID NO: 3874815 - RNA, 24 nt, Human
ugguacuuagaguuucuguuugau

SEQ ID NO: 3874816 - RNA, 18 nt, Human
ugguacuuauuacugcua

SEQ ID NO: 3874817 - RNA, 17 nt, Human
ugguacuugcugcuauu

SEQ ID NO: 3874818 - RNA, 21 nt, Human
ugguacuuuuaugauguauau

SEQ ID NO: 3874819 - RNA, 23 nt, Human
ugguacuuuuaugauguauauuu

SEQ ID NO: 3874820 - RNA, 17 nt, Human
ugguagaccaaaauaaa

SEQ ID NO: 3874821 - RNA, 13 nt, Human
ugguagagaugga

SEQ ID NO: 3874822 - RNA, 20 nt, Human
ugguagagugugccugaagu

SEQ ID NO: 3874823 - RNA, 15 nt, Human
ugguagauuaaauau

SEQ ID NO: 3874824 - RNA, 12 nt, Human
ugguagcauuuu

SEQ ID NO: 3874825 - RNA, 19 nt, Human
ugguagcauuuuaaacaaa

SEQ ID NO: 3874826 - RNA, 19 nt, Human
ugguagccaguugaauuua

SEQ ID NO: 3874827 - RNA, 12 nt, Human
ugguagcucagg

SEQ ID NO: 3874828 - RNA, 20 nt, Human
ugguagcugggaaagcauaa

SEQ ID NO: 3874829 - RNA, 13 nt, Human
ugguaggaacugc

SEQ ID NO: 3874830 - RNA, 18 nt, Human
ugguaggccuuuuaacau

SEQ ID NO: 3874831 - RNA, 14 nt, Human
ugguagguacuuuu

SEQ ID NO: 3874832 - RNA, 22 nt, Human
ugguagguacuuuuugugaaga

SEQ ID NO: 3874833 - RNA, 18 nt, Human
ugguagguugggacacca

SEQ ID NO: 3874834 - RNA, 15 nt, Human
ugguaguaaaacaca

SEQ ID NO: 3874835 - RNA, 18 nt, Human
ugguaguuaguagcaugu

SEQ ID NO: 3874836 - RNA, 17 nt, Human
ugguaguugaggaaagc

SEQ ID NO: 3874837 - RNA, 15 nt, Human
ugguaguuucugugg

SEQ ID NO: 3874838 - RNA, 15 nt, Human
ugguaguuuuacagu

SEQ ID NO: 3874839 - RNA, 15 nt, Human
ugguaguuuuuucau

SEQ ID NO: 3874840 - RNA, 16 nt, Human
ugguaguuuuuucauc

SEQ ID NO: 3874841 - RNA, 18 nt, Human
ugguaguuuuuucaucuu

SEQ ID NO: 3874842 - RNA, 22 nt, Human
ugguauagaaaugcugguuuuu

SEQ ID NO: 3874843 - RNA, 14 nt, Human
ugguauauauacau

SEQ ID NO: 3874844 - RNA, 22 nt, Human
ugguauauccaaaagcuuuuua

SEQ ID NO: 3874845 - RNA, 22 nt, Human
ugguauauccuuuucuguguuu

SEQ ID NO: 3874846 - RNA, 15 nt, Human
ugguaucaagaaagu

SEQ ID NO: 3874847 - RNA, 14 nt, Human
ugguaucauauauu

SEQ ID NO: 3874848 - RNA, 20 nt, Human
ugguaucuaauucuuuaaug

SEQ ID NO: 3874849 - RNA, 17 nt, Human
ugguaucuguucuuuaa

SEQ ID NO: 3874850 - RNA, 19 nt, Human
ugguaucuguucuuuaauu

SEQ ID NO: 3874851 - RNA, 22 nt, Human
ugguaucuguucuuuaauuuau

SEQ ID NO: 3874852 - RNA, 22 nt, Human
ugguaugaacuugaggacacau

SEQ ID NO: 3874853 - RNA, 23 nt, Human
ugguaugaacuugaggacacaug

SEQ ID NO: 3874854 - RNA, 22 nt, Human
ugguaugcuugcauauauuuca

SEQ ID NO: 3874855 - RNA, 19 nt, Human
ugguauggaacucucucca

SEQ ID NO: 3874856 - RNA, 16 nt, Human
ugguauggcugcaguc

SEQ ID NO: 3874857 - RNA, 16 nt, Human
ugguauuaauaaaaag

SEQ ID NO: 3874858 - RNA, 14 nt, Human
ugguauuguauuua

SEQ ID NO: 3874859 - RNA, 19 nt, Human
ugguauuguauuuauucaa

SEQ ID NO: 3874860 - RNA, 21 nt, Human
ugguauuuaucuauuguaaga

SEQ ID NO: 3874861 - RNA, 22 nt, Human
ugguauuuucaauagccacuaa

SEQ ID NO: 3874862 - RNA, 22 nt, Human
uggucaaacaaacucucugaac

SEQ ID NO: 3874863 - RNA, 14 nt, Human
uggucaacacuuaa

SEQ ID NO: 3874864 - RNA, 14 nt, Human
uggucaacauuucu

SEQ ID NO: 3874865 - RNA, 14 nt, Human
uggucaaccuccug

SEQ ID NO: 3874866 - RNA, 15 nt, Human
uggucaaucaacacu

SEQ ID NO: 3874867 - RNA, 14 nt, Human
uggucacagccucc

SEQ ID NO: 3874868 - RNA, 15 nt, Human
uggucacagccuccu

SEQ ID NO: 3874869 - RNA, 16 nt, Human
uggucacagccuccuc

SEQ ID NO: 3874870 - RNA, 17 nt, Human
uggucacagccuccucu

SEQ ID NO: 3874871 - RNA, 22 nt, Human
uggucacaggaaguagaggagg

SEQ ID NO: 3874872 - RNA, 18 nt, Human
uggucacaggacucugcc

SEQ ID NO: 3874873 - RNA, 13 nt, Human
uggucacagggca

SEQ ID NO: 3874874 - RNA, 17 nt, Human
uggucacagggcaugcc

SEQ ID NO: 3874875 - RNA, 18 nt, Human
uggucaccaaaucagcug

SEQ ID NO: 3874876 - RNA, 14 nt, Human
uggucaccaugaaa

SEQ ID NO: 3874877 - RNA, 16 nt, Human
uggucaccuaggaagc

SEQ ID NO: 3874878 - RNA, 19 nt, Human
uggucacggauuugugucu

SEQ ID NO: 3874879 - RNA, 20 nt, Human
uggucacguuuggugcuucu

SEQ ID NO: 3874880 - RNA, 22 nt, Human
uggucacuuaaaaugugcagua

SEQ ID NO: 3874881 - RNA, 16 nt, Human
uggucacuucuucugu

SEQ ID NO: 3874882 - RNA, 10 nt, Human
uggucagccc

SEQ ID NO: 3874883 - RNA, 20 nt, Human
uggucagcccuaggauaaaa

SEQ ID NO: 3874884 - RNA, 19 nt, Human
uggucagcccuagggugga

SEQ ID NO: 3874885 - RNA, 18 nt, Human
uggucauuuuauguuaag

SEQ ID NO: 3874886 - RNA, 14 nt, Human
ugguccacagggca

SEQ ID NO: 3874887 - RNA, 15 nt, Human
ugguccacagggcac

SEQ ID NO: 3874888 - RNA, 14 nt, Human
ugguccacuuuucc

SEQ ID NO: 3874889 - RNA, 15 nt, Human
ugguccagcuugcuc

SEQ ID NO: 3874890 - RNA, 12 nt, Human
ugguccaggaga

SEQ ID NO: 3874891 - RNA, 13 nt, Human
ugguccagggcua

SEQ ID NO: 3874892 - RNA, 21 nt, Human
ugguccagggcuagugacuug

SEQ ID NO: 3874893 - RNA, 14 nt, Human
ugguccaugcaggg

SEQ ID NO: 3874894 - RNA, 18 nt, Human
ugguccaugcagggggcu

SEQ ID NO: 3874895 - RNA, 20 nt, Human
ugguccauggaaugcuugaa

SEQ ID NO: 3874896 - RNA, 22 nt, Human
ugguccaugggccauaugaaaa

SEQ ID NO: 3874897 - RNA, 20 nt, Human
uggucccacaucccugggcc

SEQ ID NO: 3874898 - RNA, 23 nt, Human
uggucccacaucccugggccugc

SEQ ID NO: 3874899 - RNA, 13 nt, Human
uggucccacucag

SEQ ID NO: 3874900 - RNA, 14 nt, Human
uggucccccuucca

SEQ ID NO: 3874901 - RNA, 15 nt, Human
uggucccccuuccau

SEQ ID NO: 3874902 - RNA, 18 nt, Human
ugguccccuccuucccaa

SEQ ID NO: 3874903 - RNA, 13 nt, Human
uggucccugggag

SEQ ID NO: 3874904 - RNA, 22 nt, Human
uggucccuguuuucccacgagg

SEQ ID NO: 3874905 - RNA, 16 nt, Human
ugguccggacacuccu

SEQ ID NO: 3874906 - RNA, 14 nt, Human
ugguccuaaguccc

SEQ ID NO: 3874907 - RNA, 21 nt, Human
ugguccuaagucccugccccc

SEQ ID NO: 3874908 - RNA, 17 nt, Human
ugguccuaaucuucuga

SEQ ID NO: 3874909 - RNA, 22 nt, Human
ugguccuagaggcccuuugcug

SEQ ID NO: 3874910 - RNA, 19 nt, Human
ugguccuaggcuggaagga

SEQ ID NO: 3874911 - RNA, 23 nt, Human
ugguccuaggcuggaaggaggaa

SEQ ID NO: 3874912 - RNA, 19 nt, Human
ugguccuauggccucaugu

SEQ ID NO: 3874913 - RNA, 19 nt, Human
ugguccucauucaaaggga

SEQ ID NO: 3874914 - RNA, 22 nt, Human
ugguccugacucaacauguuac

SEQ ID NO: 3874915 - RNA, 12 nt, Human
ugguccugacuu

SEQ ID NO: 3874916 - RNA, 11 nt, Human
ugguccugggg

SEQ ID NO: 3874917 - RNA, 13 nt, Human
ugguccuguagga

SEQ ID NO: 3874918 - RNA, 17 nt, Human
uggucgaggaguaacaa

SEQ ID NO: 3874919 - RNA, 14 nt, Human
uggucgcccaggag

SEQ ID NO: 3874920 - RNA, 13 nt, Human
uggucgcuccugc

SEQ ID NO: 3874921 - RNA, 15 nt, Human
uggucgcuccugccc

SEQ ID NO: 3874922 - RNA, 19 nt, Human
uggucguaaacaucucaga

SEQ ID NO: 3874923 - RNA, 17 nt, Human
uggucuaacacuggcau

SEQ ID NO: 3874924 - RNA, 18 nt, Human
uggucuaagguucagccu

SEQ ID NO: 3874925 - RNA, 19 nt, Human
uggucuaucuuugagcgcc

SEQ ID NO: 3874926 - RNA, 14 nt, Human
uggucuauguuccg

SEQ ID NO: 3874927 - RNA, 17 nt, Human
uggucucacccuggagg

SEQ ID NO: 3874928 - RNA, 19 nt, Human
uggucucagcagcgaccac

SEQ ID NO: 3874929 - RNA, 13 nt, Human
uggucucaggaua

SEQ ID NO: 3874930 - RNA, 23 nt, Human
uggucucaggauauccuuaucag

SEQ ID NO: 3874931 - RNA, 14 nt, Human
uggucuccugcccc

SEQ ID NO: 3874932 - RNA, 22 nt, Human
uggucuccuuggaaauccgucu

SEQ ID NO: 3874933 - RNA, 19 nt, Human
uggucucgaacuccugacc

SEQ ID NO: 3874934 - RNA, 21 nt, Human
uggucucgaacuccugaccuu

SEQ ID NO: 3874935 - RNA, 21 nt, Human
uggucucucuaugccucucua

SEQ ID NO: 3874936 - RNA, 13 nt, Human
uggucugaauguu

SEQ ID NO: 3874937 - RNA, 18 nt, Human
uggucugaauguucugac

SEQ ID NO: 3874938 - RNA, 17 nt, Human
uggucugacccacugcu

SEQ ID NO: 3874939 - RNA, 16 nt, Human
uggucugauuucagga

SEQ ID NO: 3874940 - RNA, 15 nt, Human
uggucugcaggcagg

SEQ ID NO: 3874941 - RNA, 18 nt, Human
uggucugcccucugcauc

SEQ ID NO: 3874942 - RNA, 16 nt, Human
uggucugggacucucu

SEQ ID NO: 3874943 - RNA, 16 nt, Human
uggucugggacuuccu

SEQ ID NO: 3874944 - RNA, 19 nt, Human
uggucugggacuuccuugc

SEQ ID NO: 3874945 - RNA, 13 nt, Human
uguaaaacaaaaa

SEQ ID NO: 3874946 - RNA, 16 nt, Human
uguaaaacaaaaaaca

SEQ ID NO: 3874947 - RNA, 14 nt, Human
uguaaaacaaaauu

SEQ ID NO: 3874948 - RNA, 14 nt, Human
uguaaaacagguag

SEQ ID NO: 3874949 - RNA, 19 nt, Human
uguaaaacauuuauuuuga

SEQ ID NO: 3874950 - RNA, 16 nt, Human
uguaaaaccugucaau

SEQ ID NO: 3874951 - RNA, 22 nt, Human
uguaaaacgagaauccacccau

SEQ ID NO: 3874952 - RNA, 15 nt, Human
uguaaaacugaggca

SEQ ID NO: 3874953 - RNA, 12 nt, Human
uguaaaacuuua

SEQ ID NO: 3874954 - RNA, 16 nt, Human
uguaaaacuuuauuuu

SEQ ID NO: 3874955 - RNA, 18 nt, Human
uguaaaagauuaaacugc

SEQ ID NO: 3874956 - RNA, 18 nt, Human
uguaaaagcaacaucagc

SEQ ID NO: 3874957 - RNA, 19 nt, Human
uguaaaagcaacaucagcu

SEQ ID NO: 3874958 - RNA, 21 nt, Human
uguaaaaggccaaaccucugu

SEQ ID NO: 3874959 - RNA, 23 nt, Human
uguaaaaggccaaaccucuguuc

SEQ ID NO: 3874960 - RNA, 12 nt, Human
uguaaaauaauu

SEQ ID NO: 3874961 - RNA, 14 nt, Human
uguaaaauagcuug

SEQ ID NO: 3874962 - RNA, 20 nt, Human
uguaaaauagcuuguauagu

SEQ ID NO: 3874963 - RNA, 21 nt, Human
uguaaaaucuuggcacagaaa

SEQ ID NO: 3874964 - RNA, 22 nt, Human
uguaaaaucuuggcacagaaac

SEQ ID NO: 3874965 - RNA, 15 nt, Human
uguaaaaucuuguca

SEQ ID NO: 3874966 - RNA, 20 nt, Human
uguaaaaucuugucaugugu

SEQ ID NO: 3874967 - RNA, 13 nt, Human
uguaaaaucuuuc

SEQ ID NO: 3874968 - RNA, 15 nt, Human
uguaaaaugaaauua

SEQ ID NO: 3874969 - RNA, 12 nt, Human
uguaaaaugaca

SEQ ID NO: 3874970 - RNA, 21 nt, Human
uguaaaaugacaaucaugugu

SEQ ID NO: 3874971 - RNA, 14 nt, Human
uguaaaauguauua

SEQ ID NO: 3874972 - RNA, 17 nt, Human
uguaaaauguugaauaa

SEQ ID NO: 3874973 - RNA, 20 nt, Human
uguaaaauuuugccuaauac

SEQ ID NO: 3874974 - RNA, 14 nt, Human
uguaaacaaacucu

SEQ ID NO: 3874975 - RNA, 13 nt, Human
uguaaacacaucu

SEQ ID NO: 3874976 - RNA, 18 nt, Human
uguaaacacucagcuguu

SEQ ID NO: 3874977 - RNA, 14 nt, Human
uguaaacauguguu

SEQ ID NO: 3874978 - RNA, 11 nt, Human
uguaaacauuu

SEQ ID NO: 3874979 - RNA, 14 nt, Human
uguaaaccgcuuug

SEQ ID NO: 3874980 - RNA, 15 nt, Human
uguaaacucaaaaua

SEQ ID NO: 3874981 - RNA, 23 nt, Human
uguaaacucaaaauauuuguaca

SEQ ID NO: 3874982 - RNA, 12 nt, Human
uguaaacugcca

SEQ ID NO: 3874983 - RNA, 21 nt, Human
uguaaacuguacuagucugug

SEQ ID NO: 3874984 - RNA, 13 nt, Human
uguaaacugugua

SEQ ID NO: 3874985 - RNA, 18 nt, Human
uguaaacuguguauucca

SEQ ID NO: 3874986 - RNA, 22 nt, Human
uguaaagaaagagagaaaauaa

SEQ ID NO: 3874987 - RNA, 22 nt, Human
uguaaagagaccuaccucaggu

SEQ ID NO: 3874988 - RNA, 18 nt, Human
uguaaagauuucuguuca

SEQ ID NO: 3874989 - RNA, 12 nt, Human
uguaaagcuaaa

SEQ ID NO: 3874990 - RNA, 16 nt, Human
uguaaagcuaaaauaa

SEQ ID NO: 3874991 - RNA, 17 nt, Human
uguaaagcuaaaauaaa

SEQ ID NO: 3874992 - RNA, 21 nt, Human
uguaaagcuaaaauaaagaaa

SEQ ID NO: 3874993 - RNA, 16 nt, Human
uguaaaggagucaaaa

SEQ ID NO: 3874994 - RNA, 19 nt, Human
uguaaaggagucaaaacua

SEQ ID NO: 3874995 - RNA, 16 nt, Human
uguaaaggucacuuuu

SEQ ID NO: 3874996 - RNA, 15 nt, Human
uguaaaguccccaga

SEQ ID NO: 3874997 - RNA, 19 nt, Human
uguaaagugaagaauccuu

SEQ ID NO: 3874998 - RNA, 14 nt, Human
uguaaaguuagucu

SEQ ID NO: 3874999 - RNA, 19 nt, Human
uguaaaguugguuggauaa

SEQ ID NO: 3875000 - RNA, 14 nt, Human
uguaaauaaagccc

SEQ ID NO: 3875001 - RNA, 23 nt, Human
uguaaauaauucuuuuuuauuaa

SEQ ID NO: 3875002 - RNA, 15 nt, Human
uguaaauaauuuauu

SEQ ID NO: 3875003 - RNA, 18 nt, Human
uguaaauacaauuuuguu

SEQ ID NO: 3875004 - RNA, 21 nt, Human
uguaaauacacauagcaugua

SEQ ID NO: 3875005 - RNA, 12 nt, Human
uguaaauacaua

SEQ ID NO: 3875006 - RNA, 20 nt, Human
uguaaauaccagacugcagg

SEQ ID NO: 3875007 - RNA, 19 nt, Human
uguaaauaccaggauuuuu

SEQ ID NO: 3875008 - RNA, 19 nt, Human
uguaaauaccauugacaca

SEQ ID NO: 3875009 - RNA, 20 nt, Human
uguaaauaccauugacacau

SEQ ID NO: 3875010 - RNA, 21 nt, Human
uguaaauacuguuuuuaacaa

SEQ ID NO: 3875011 - RNA, 18 nt, Human
uguaaauaggauuuuuag

SEQ ID NO: 3875012 - RNA, 13 nt, Human
uguaaauagguuu

SEQ ID NO: 3875013 - RNA, 16 nt, Human
uguaaauaguauuuga

SEQ ID NO: 3875014 - RNA, 12 nt, Human
uguaaauauaaa

SEQ ID NO: 3875015 - RNA, 14 nt, Human
uguaaauauaaaga

SEQ ID NO: 3875016 - RNA, 15 nt, Human
uguaaauauauaaau

SEQ ID NO: 3875017 - RNA, 19 nt, Human
uguaaauauauaaauauau

SEQ ID NO: 3875018 - RNA, 21 nt, Human
uguaaauauauaaauauauau

SEQ ID NO: 3875019 - RNA, 22 nt, Human
uguaaauauguuuuuuagauca

SEQ ID NO: 3875020 - RNA, 14 nt, Human
uguaaauauucuau

SEQ ID NO: 3875021 - RNA, 12 nt, Human
uguaaauauuua

SEQ ID NO: 3875022 - RNA, 18 nt, Human
uguaaauauuuuaaagaa

SEQ ID NO: 3875023 - RNA, 22 nt, Human
uguaaauauuuuaaagaauugu

SEQ ID NO: 3875024 - RNA, 21 nt, Human
uguaaaucauguugaucaugu

SEQ ID NO: 3875025 - RNA, 13 nt, Human
uguaaaucccauu

SEQ ID NO: 3875026 - RNA, 18 nt, Human
uguaaaucccauuauuca

SEQ ID NO: 3875027 - RNA, 20 nt, Human
uguaaaucccauuauucaaa

SEQ ID NO: 3875028 - RNA, 20 nt, Human
uguaaauccuuuuucuuuau

SEQ ID NO: 3875029 - RNA, 22 nt, Human
uguaaauccuuuuucuuuauaa

SEQ ID NO: 3875030 - RNA, 19 nt, Human
uguaaaucuaacauuauua

SEQ ID NO: 3875031 - RNA, 13 nt, Human
uguaaaucugcuc

SEQ ID NO: 3875032 - RNA, 21 nt, Human
uguaaaugaaguaacuugucu

SEQ ID NO: 3875033 - RNA, 18 nt, Human
uguaaaugcaucuguccu

SEQ ID NO: 3875034 - RNA, 15 nt, Human
uguaaaugguguaca

SEQ ID NO: 3875035 - RNA, 16 nt, Human
uguaaaugguguacau

SEQ ID NO: 3875036 - RNA, 11 nt, Human
uguaaauguau

SEQ ID NO: 3875037 - RNA, 15 nt, Human
uguaaauguguacau

SEQ ID NO: 3875038 - RNA, 22 nt, Human
uguaaauguguuggacaaaugu

SEQ ID NO: 3875039 - RNA, 19 nt, Human
uguaaauguuaguuucuug

SEQ ID NO: 3875040 - RNA, 17 nt, Human
uguaaauguuauuucug

SEQ ID NO: 3875041 - RNA, 19 nt, Human
uguaaauguuauuucugca

SEQ ID NO: 3875042 - RNA, 15 nt, Human
uguaaauuaacuuuu

SEQ ID NO: 3875043 - RNA, 20 nt, Human
uguaaauuaccaguaaagug

SEQ ID NO: 3875044 - RNA, 16 nt, Human
uguaaauuauguaaug

SEQ ID NO: 3875045 - RNA, 19 nt, Human
uguaaauucugauuucuuu

SEQ ID NO: 3875046 - RNA, 17 nt, Human
uguaaauugaaucagua

SEQ ID NO: 3875047 - RNA, 14 nt, Human
uguaaauuuagugu

SEQ ID NO: 3875048 - RNA, 18 nt, Human
uguaaauuuggcuucugu

SEQ ID NO: 3875049 - RNA, 21 nt, Human
uguaaauuuggcuucuguugu

SEQ ID NO: 3875050 - RNA, 15 nt, Human
uguaacaagaaaaca

SEQ ID NO: 3875051 - RNA, 13 nt, Human
uguaacaagaaag

SEQ ID NO: 3875052 - RNA, 15 nt, Human
uguaacaagaaagga

SEQ ID NO: 3875053 - RNA, 14 nt, Human
uguaacaagccacc

SEQ ID NO: 3875054 - RNA, 15 nt, Human
uguaacaauugugua

SEQ ID NO: 3875055 - RNA, 20 nt, Human
uguaacaauuguguagccuu

SEQ ID NO: 3875056 - RNA, 20 nt, Human
uguaacacagcugagagacu

SEQ ID NO: 3875057 - RNA, 16 nt, Human
uguaacacuccucugc

SEQ ID NO: 3875058 - RNA, 20 nt, Human
uguaacacuuuacaauguuc

SEQ ID NO: 3875059 - RNA, 22 nt, Human
uguaacagcuccuugggaggaa

SEQ ID NO: 3875060 - RNA, 21 nt, Human
uguaacaggucuccucuuaaa

SEQ ID NO: 3875061 - RNA, 14 nt, Human
uguaacagucugau

SEQ ID NO: 3875062 - RNA, 16 nt, Human
uguaacauaugcaaac

SEQ ID NO: 3875063 - RNA, 22 nt, Human
uguaacaucacuauccaugcac

SEQ ID NO: 3875064 - RNA, 17 nt, Human
uguaaccacaacuuuca

SEQ ID NO: 3875065 - RNA, 19 nt, Human
uguaaccauuuuauaaagu

SEQ ID NO: 3875066 - RNA, 14 nt, Human
uguaaccucagcuc

SEQ ID NO: 3875067 - RNA, 23 nt, Human
uguaaccuguugcuguguuuaau

SEQ ID NO: 3875068 - RNA, 18 nt, Human
uguaacgguuaacuguaa

SEQ ID NO: 3875069 - RNA, 18 nt, Human
uguaacgugugcuguguu

SEQ ID NO: 3875070 - RNA, 16 nt, Human
uguaacguugcugugg

SEQ ID NO: 3875071 - RNA, 17 nt, Human
uguaacguugcuguggg

SEQ ID NO: 3875072 - RNA, 20 nt, Human
uguaacguugcugugggaac

SEQ ID NO: 3875073 - RNA, 22 nt, Human
uguaacguuuucuuucacacac

SEQ ID NO: 3875074 - RNA, 23 nt, Human
uguaacuaaaauaauuuuguaau

SEQ ID NO: 3875075 - RNA, 18 nt, Human
uguaacuaggcucagaga

SEQ ID NO: 3875076 - RNA, 21 nt, Human
uguaacuauaguccagcuuug

SEQ ID NO: 3875077 - RNA, 18 nt, Human
uguaacucuaaaagaucc

SEQ ID NO: 3875078 - RNA, 13 nt, Human
uguaacugccagg

SEQ ID NO: 3875079 - RNA, 13 nt, Human
uguaacugcccaa

SEQ ID NO: 3875080 - RNA, 15 nt, Human
uguaacuguuacagu

SEQ ID NO: 3875081 - RNA, 14 nt, Human
uguaacuguuacca

SEQ ID NO: 3875082 - RNA, 17 nt, Human
uguaacuguuaccauug

SEQ ID NO: 3875083 - RNA, 16 nt, Human
uguaacuuauauugaa

SEQ ID NO: 3875084 - RNA, 20 nt, Human
uguaacuuauauugaagaca

SEQ ID NO: 3875085 - RNA, 23 nt, Human
uguaacuuauauugaagacaauu

SEQ ID NO: 3875086 - RNA, 22 nt, Human
uguaacuuauguagauauuugg

SEQ ID NO: 3875087 - RNA, 23 nt, Human
uguaacuuauguagauauuuggc

SEQ ID NO: 3875088 - RNA, 20 nt, Human
uguaacuuccaaauaaauaa

SEQ ID NO: 3875089 - RNA, 22 nt, Human
uguaacuugauccauuucuaau

SEQ ID NO: 3875090 - RNA, 12 nt, Human
uguagaugaugu

SEQ ID NO: 3875091 - RNA, 14 nt, Human
uguagauugauugu

SEQ ID NO: 3875092 - RNA, 18 nt, Human
uguagauugauuguauug

SEQ ID NO: 3875093 - RNA, 22 nt, Human
uguagauuuaguguaauaagac

SEQ ID NO: 3875094 - RNA, 18 nt, Human
uguagauuuuauagugug

SEQ ID NO: 3875095 - RNA, 19 nt, Human
uguagcaaacccugucaaa

SEQ ID NO: 3875096 - RNA, 21 nt, Human
uguagcaaacccugucaaaca

SEQ ID NO: 3875097 - RNA, 20 nt, Human
uguagcaaccuucugcauuc

SEQ ID NO: 3875098 - RNA, 17 nt, Human
uguagcaaucagauuuu

SEQ ID NO: 3875099 - RNA, 13 nt, Human
uguagcagaaagg

SEQ ID NO: 3875100 - RNA, 23 nt, Human
uguagcagugagaaaaagcuccu

SEQ ID NO: 3875101 - RNA, 22 nt, Human
uguagcagugagucauaucuua

SEQ ID NO: 3875102 - RNA, 12 nt, Human
uguagcauacug

SEQ ID NO: 3875103 - RNA, 15 nt, Human
uguagcauauaggug

SEQ ID NO: 3875104 - RNA, 14 nt, Human
uguagcauccugga

SEQ ID NO: 3875105 - RNA, 16 nt, Human
uguagcaucuucugga

SEQ ID NO: 3875106 - RNA, 18 nt, Human
uguagcauuucuugaugu

SEQ ID NO: 3875107 - RNA, 14 nt, Human
uguagccagccggg

SEQ ID NO: 3875108 - RNA, 21 nt, Human
uguagccaggucccccugcag

SEQ ID NO: 3875109 - RNA, 15 nt, Human
uguagccaugggacc

SEQ ID NO: 3875110 - RNA, 17 nt, Human
uguagccccaagaaggc

SEQ ID NO: 3875111 - RNA, 21 nt, Human
uguagccccaagaaggcuggg

SEQ ID NO: 3875112 - RNA, 16 nt, Human
uguagcccccuggccu

SEQ ID NO: 3875113 - RNA, 18 nt, Human
uguagcccccuggccucu

SEQ ID NO: 3875114 - RNA, 19 nt, Human
uguagcccuuuccaagcuu

SEQ ID NO: 3875115 - RNA, 15 nt, Human
uguagccucagauga

SEQ ID NO: 3875116 - RNA, 14 nt, Human
uguagccugugcau

SEQ ID NO: 3875117 - RNA, 20 nt, Human
uguagccugugcauguaugu

SEQ ID NO: 3875118 - RNA, 21 nt, Human
uguagccuuccuccacauccu

SEQ ID NO: 3875119 - RNA, 17 nt, Human
uguagccuugcccggau

SEQ ID NO: 3875120 - RNA, 14 nt, Human
uguagcuacagaga

SEQ ID NO: 3875121 - RNA, 16 nt, Human
uguagcuacagagaaa

SEQ ID NO: 3875122 - RNA, 17 nt, Human
uguagcuacagagaaac

SEQ ID NO: 3875123 - RNA, 18 nt, Human
uguagcuacagagaaacc

SEQ ID NO: 3875124 - RNA, 22 nt, Human
uguagcuacagagaaaccagcu

SEQ ID NO: 3875125 - RNA, 12 nt, Human
uguagcuguaaa

SEQ ID NO: 3875126 - RNA, 14 nt, Human
uguagcuguaaaac

SEQ ID NO: 3875127 - RNA, 17 nt, Human
uguagcuguaaaacgcu

SEQ ID NO: 3875128 - RNA, 18 nt, Human
uguagcuguaaaacgcug

SEQ ID NO: 3875129 - RNA, 13 nt, Human
uguagcugugacc

SEQ ID NO: 3875130 - RNA, 23 nt, Human
uguagcugugaccugcugagcuc

SEQ ID NO: 3875131 - RNA, 18 nt, Human
uguagcuucagucauuaa

SEQ ID NO: 3875132 - RNA, 18 nt, Human
uguaggaagguacuguau

SEQ ID NO: 3875133 - RNA, 19 nt, Human
uguaggaagguacuguaug

SEQ ID NO: 3875134 - RNA, 20 nt, Human
uguaggaagguacuguauga

SEQ ID NO: 3875135 - RNA, 20 nt, Human
uguaggaaggucucauucuu

SEQ ID NO: 3875136 - RNA, 18 nt, Human
uguaggaagguuaauguu

SEQ ID NO: 3875137 - RNA, 23 nt, Human
uguaggaauucuuuuggggaagu

SEQ ID NO: 3875138 - RNA, 20 nt, Human
uguaggagagguugucugug

SEQ ID NO: 3875139 - RNA, 17 nt, Human
uguaggagcugagguuu

SEQ ID NO: 3875140 - RNA, 12 nt, Human
uguaggagcugc

SEQ ID NO: 3875141 - RNA, 19 nt, Human
uguaggagggacugucgcu

SEQ ID NO: 3875142 - RNA, 11 nt, Human
uguaggcagac

SEQ ID NO: 3875143 - RNA, 13 nt, Human
uguaggcagacac

SEQ ID NO: 3875144 - RNA, 16 nt, Human
uguaggcagacacagg

SEQ ID NO: 3875145 - RNA, 20 nt, Human
uguaggcauaaagucagggg

SEQ ID NO: 3875146 - RNA, 13 nt, Human
uguagggagggcg

SEQ ID NO: 3875147 - RNA, 19 nt, Human
uguaggggacgagaaagau

SEQ ID NO: 3875148 - RNA, 23 nt, Human
uguaggggaggggcuccuuucca

SEQ ID NO: 3875149 - RNA, 19 nt, Human
uguagguaaaauguauuuu

SEQ ID NO: 3875150 - RNA, 15 nt, Human
uguagguaucauuuu

SEQ ID NO: 3875151 - RNA, 14 nt, Human
uguagguccucaga

SEQ ID NO: 3875152 - RNA, 20 nt, Human
uguaggugucugcacccagg

SEQ ID NO: 3875153 - RNA, 20 nt, Human
uguagguugcacacuuuggu

SEQ ID NO: 3875154 - RNA, 19 nt, Human
uguaguaaacuauuuaucu

SEQ ID NO: 3875155 - RNA, 13 nt, Human
uguaguaaagaaa

SEQ ID NO: 3875156 - RNA, 15 nt, Human
uguaguaaagaaauu

SEQ ID NO: 3875157 - RNA, 20 nt, Human
uguaguaaagccguuguuua

SEQ ID NO: 3875158 - RNA, 18 nt, Human
uguaguaaauaaugcuuu

SEQ ID NO: 3875159 - RNA, 15 nt, Human
uguaguaauugacau

SEQ ID NO: 3875160 - RNA, 16 nt, Human
uguaguaauugacaug

SEQ ID NO: 3875161 - RNA, 18 nt, Human
uguaguaauugacaugug

SEQ ID NO: 3875162 - RNA, 18 nt, Human
uguaguagcccuuucugu

SEQ ID NO: 3875163 - RNA, 16 nt, Human
uguaguagcguuuuuu

SEQ ID NO: 3875164 - RNA, 23 nt, Human
uguaguagcguuuuuuaaaugua

SEQ ID NO: 3875165 - RNA, 20 nt, Human
uguaguaggcauuuuuacca

SEQ ID NO: 3875166 - RNA, 15 nt, Human
uguaguauaaagaaa

SEQ ID NO: 3875167 - RNA, 23 nt, Human
uguaguaucaaauauuagaugug

SEQ ID NO: 3875168 - RNA, 14 nt, Human
uguaguaucucaua

SEQ ID NO: 3875169 - RNA, 18 nt, Human
uguaguauuuuuuguaua

SEQ ID NO: 3875170 - RNA, 19 nt, Human
uguaguauuuuuuguauaa

SEQ ID NO: 3875171 - RNA, 20 nt, Human
uguagucauuuacuaaacau

SEQ ID NO: 3875172 - RNA, 22 nt, Human
uguaguccgugcugacagcugc

SEQ ID NO: 3875173 - RNA, 23 nt, Human
uguaguccuagccacucaggagg

SEQ ID NO: 3875174 - RNA, 20 nt, Human
uguaguccuagcuacucagg

SEQ ID NO: 3875175 - RNA, 17 nt, Human
uguaguccucauaaaaa

SEQ ID NO: 3875176 - RNA, 21 nt, Human
uguaguccucauaaaaagcaa

SEQ ID NO: 3875177 - RNA, 17 nt, Human
uguagugccgcucuugg

SEQ ID NO: 3875178 - RNA, 22 nt, Human
uguaguguuggagaagaacuga

SEQ ID NO: 3875179 - RNA, 13 nt, Human
uguaguuaggaaa

SEQ ID NO: 3875180 - RNA, 13 nt, Human
uguaguucuaaga

SEQ ID NO: 3875181 - RNA, 15 nt, Human
uguaguucuuuaaac

SEQ ID NO: 3875182 - RNA, 17 nt, Human
uguaguucuuuaaacug

SEQ ID NO: 3875183 - RNA, 20 nt, Human
uguaguugaacugauaguua

SEQ ID NO: 3875184 - RNA, 22 nt, Human
uguaguugcaauagaacagaga

SEQ ID NO: 3875185 - RNA, 20 nt, Human
uguaguuuuaucacauguau

SEQ ID NO: 3875186 - RNA, 23 nt, Human
uguaguuuuauuuuauguuuaga

SEQ ID NO: 3875187 - RNA, 19 nt, Human
uguaguuuuuauauguugu

SEQ ID NO: 3875188 - RNA, 17 nt, Human
uguauaaaaaaaauagu

SEQ ID NO: 3875189 - RNA, 14 nt, Human
uguauaaaaauaaa

SEQ ID NO: 3875190 - RNA, 13 nt, Human
uguauaaaaauag

SEQ ID NO: 3875191 - RNA, 22 nt, Human
uguauaaaagggacugagaaau

SEQ ID NO: 3875192 - RNA, 14 nt, Human
uguauaaaauaauu

SEQ ID NO: 3875193 - RNA, 13 nt, Human
uguauaaaauaca

SEQ ID NO: 3875194 - RNA, 22 nt, Human
uguauaaaauacauagugaaaa

SEQ ID NO: 3875195 - RNA, 17 nt, Human
uguauaaacaagaaaaa

SEQ ID NO: 3875196 - RNA, 23 nt, Human
uguauaaacaagaaaaauaaaga

SEQ ID NO: 3875197 - RNA, 13 nt, Human
uguauaaagaaca

SEQ ID NO: 3875198 - RNA, 14 nt, Human
uguauaaauaggag

SEQ ID NO: 3875199 - RNA, 13 nt, Human
uguauaaauauac

SEQ ID NO: 3875200 - RNA, 14 nt, Human
uguauaaauauaca

SEQ ID NO: 3875201 - RNA, 19 nt, Human
uguauaaaugucuuuaaug

SEQ ID NO: 3875202 - RNA, 15 nt, Human
uguauaacagguuau

SEQ ID NO: 3875203 - RNA, 17 nt, Human
uguauaacagguuauuu

SEQ ID NO: 3875204 - RNA, 18 nt, Human
uguauaacccuguuacaa

SEQ ID NO: 3875205 - RNA, 16 nt, Human
uguauaacuaggagcu

SEQ ID NO: 3875206 - RNA, 21 nt, Human
uguauaacuucuuaaaaguug

SEQ ID NO: 3875207 - RNA, 14 nt, Human
uguauaaguaagaa

SEQ ID NO: 3875208 - RNA, 20 nt, Human
uguauaaguaagaaaauauu

SEQ ID NO: 3875209 - RNA, 16 nt, Human
uguauaagugcacaca

SEQ ID NO: 3875210 - RNA, 22 nt, Human
uguauaagugcacacagaaaua

SEQ ID NO: 3875211 - RNA, 23 nt, Human
uguauaagugcacacagaaauau

SEQ ID NO: 3875212 - RNA, 16 nt, Human
uguauaaguggaggca

SEQ ID NO: 3875213 - RNA, 21 nt, Human
uguauaaguggaggcacuuua

SEQ ID NO: 3875214 - RNA, 13 nt, Human
uguauaaguuauu

SEQ ID NO: 3875215 - RNA, 22 nt, Human
uguauaauacuuuguauacaag

SEQ ID NO: 3875216 - RNA, 16 nt, Human
uguauaauauaaaaaa

SEQ ID NO: 3875217 - RNA, 14 nt, Human
uguauaauuggauu

SEQ ID NO: 3875218 - RNA, 18 nt, Human
uguauaauuggauuuccu

SEQ ID NO: 3875219 - RNA, 19 nt, Human
uguauaauuggauuuccua

SEQ ID NO: 3875220 - RNA, 15 nt, Human
uguauaauuguaucg

SEQ ID NO: 3875221 - RNA, 13 nt, Human
uguauaauuucga

SEQ ID NO: 3875222 - RNA, 16 nt, Human
uguauacaaauauauu

SEQ ID NO: 3875223 - RNA, 22 nt, Human
uguauacaaauauauuguuaau

SEQ ID NO: 3875224 - RNA, 16 nt, Human
uguauacagugcagag

SEQ ID NO: 3875225 - RNA, 22 nt, Human
uguauacagugcagagccuucu

SEQ ID NO: 3875226 - RNA, 15 nt, Human
uguauacauccuggg

SEQ ID NO: 3875227 - RNA, 17 nt, Human
uguauacauccugggua

SEQ ID NO: 3875228 - RNA, 19 nt, Human
uguauacguuucaaaaaca

SEQ ID NO: 3875229 - RNA, 15 nt, Human
uguauacugccacua

SEQ ID NO: 3875230 - RNA, 11 nt, Human
uguauacuuua

SEQ ID NO: 3875231 - RNA, 14 nt, Human
uguauacuuuagua

SEQ ID NO: 3875232 - RNA, 15 nt, Human
uguauacuuuaguau

SEQ ID NO: 3875233 - RNA, 17 nt, Human
uguauacuuuaguauga

SEQ ID NO: 3875234 - RNA, 19 nt, Human
uguguauuaaaaaaaacaa

SEQ ID NO: 3875235 - RNA, 21 nt, Human
uguguauuaaaaaaaacaaaa

SEQ ID NO: 3875236 - RNA, 12 nt, Human
uguguauucuua

SEQ ID NO: 3875237 - RNA, 20 nt, Human
uguguauucuuaaaaugcaa

SEQ ID NO: 3875238 - RNA, 23 nt, Human
uguguauucuuaaaaugcaauau

SEQ ID NO: 3875239 - RNA, 12 nt, Human
uguguauuguuc

SEQ ID NO: 3875240 - RNA, 21 nt, Human
uguguauuuaauuguaaacug

SEQ ID NO: 3875241 - RNA, 15 nt, Human
uguguauuuacgcuu

SEQ ID NO: 3875242 - RNA, 15 nt, Human
uguguauuugcuaau

SEQ ID NO: 3875243 - RNA, 15 nt, Human
ugugucaagcugcuu

SEQ ID NO: 3875244 - RNA, 17 nt, Human
ugugucacuggcugccu

SEQ ID NO: 3875245 - RNA, 19 nt, Human
ugugucagcauagaaguaa

SEQ ID NO: 3875246 - RNA, 15 nt, Human
ugugucagcugaggc

SEQ ID NO: 3875247 - RNA, 17 nt, Human
ugugucagcugaggcug

SEQ ID NO: 3875248 - RNA, 17 nt, Human
ugugucagguggggcag

SEQ ID NO: 3875249 - RNA, 13 nt, Human
ugugucaguuuau

SEQ ID NO: 3875250 - RNA, 22 nt, Human
ugugucaucuagcauuagguau

SEQ ID NO: 3875251 - RNA, 16 nt, Human
ugugucaugccaguga

SEQ ID NO: 3875252 - RNA, 13 nt, Human
ugugucauuucaa

SEQ ID NO: 3875253 - RNA, 17 nt, Human
uguguccaaaaccgcca

SEQ ID NO: 3875254 - RNA, 17 nt, Human
uguguccacgacugucu

SEQ ID NO: 3875255 - RNA, 18 nt, Human
uguguccacgacugucuc

SEQ ID NO: 3875256 - RNA, 17 nt, Human
uguguccaugugugugc

SEQ ID NO: 3875257 - RNA, 13 nt, Human
ugugucccaggca

SEQ ID NO: 3875258 - RNA, 14 nt, Human
ugugucccaggcag

SEQ ID NO: 3875259 - RNA, 19 nt, Human
ugugucccaggcagggaga

SEQ ID NO: 3875260 - RNA, 14 nt, Human
ugugucccaugacc

SEQ ID NO: 3875261 - RNA, 19 nt, Human
ugugucccaugacccaccc

SEQ ID NO: 3875262 - RNA, 22 nt, Human
ugugucccaugacccaccccug

SEQ ID NO: 3875263 - RNA, 21 nt, Human
ugugucccccucuguccaggc

SEQ ID NO: 3875264 - RNA, 17 nt, Human
ugugucccucuucucuu

SEQ ID NO: 3875265 - RNA, 14 nt, Human
uguguccugacacu

SEQ ID NO: 3875266 - RNA, 17 nt, Human
uguguccugacacugca

SEQ ID NO: 3875267 - RNA, 20 nt, Human
uguguccuggugcucucugc

SEQ ID NO: 3875268 - RNA, 15 nt, Human
ugugucuaaacugca

SEQ ID NO: 3875269 - RNA, 17 nt, Human
ugugucuaaacugcauu

SEQ ID NO: 3875270 - RNA, 19 nt, Human
ugugucuaaauuugaaugu

SEQ ID NO: 3875271 - RNA, 18 nt, Human
ugugucuaagauucuaga

SEQ ID NO: 3875272 - RNA, 19 nt, Human
ugugucuaagauucuagau

SEQ ID NO: 3875273 - RNA, 20 nt, Human
ugugucuaagauucuagauc

SEQ ID NO: 3875274 - RNA, 14 nt, Human
ugugucuacagaga

SEQ ID NO: 3875275 - RNA, 19 nt, Human
ugugucuaggcaggaccug

SEQ ID NO: 3875276 - RNA, 20 nt, Human
ugugucuaggcaggaccugu

SEQ ID NO: 3875277 - RNA, 21 nt, Human
ugugucucuugguccugcugc

SEQ ID NO: 3875278 - RNA, 12 nt, Human
ugugucugcagg

SEQ ID NO: 3875279 - RNA, 17 nt, Human
ugugucugcgaaguccu

SEQ ID NO: 3875280 - RNA, 13 nt, Human
ugugucuguacac

SEQ ID NO: 3875281 - RNA, 17 nt, Human
ugugucuucaauuugua

SEQ ID NO: 3875282 - RNA, 21 nt, Human
ugugucuugcaauggcagccu

SEQ ID NO: 3875283 - RNA, 14 nt, Human
ugugucuuuagaua

SEQ ID NO: 3875284 - RNA, 18 nt, Human
ugugucuuucacagcucc

SEQ ID NO: 3875285 - RNA, 10 nt, Human
ugugucuuuu

SEQ ID NO: 3875286 - RNA, 17 nt, Human
ugugugaaacuuucauu

SEQ ID NO: 3875287 - RNA, 20 nt, Human
ugugugaaagguacuucaaa

SEQ ID NO: 3875288 - RNA, 15 nt, Human
ugugugaaggcagag

SEQ ID NO: 3875289 - RNA, 17 nt, Human
ugugugaccaacugugu

SEQ ID NO: 3875290 - RNA, 17 nt, Human
ugugugaggagcugcug

SEQ ID NO: 3875291 - RNA, 15 nt, Human
ugugugauauuucag

SEQ ID NO: 3875292 - RNA, 16 nt, Human
ugugugaugaacuuuc

SEQ ID NO: 3875293 - RNA, 19 nt, Human
ugugugaugugacauuugu

SEQ ID NO: 3875294 - RNA, 23 nt, Human
ugugugcaccuuaccaacuuucu

SEQ ID NO: 3875295 - RNA, 19 nt, Human
ugugugcacguacacacac

SEQ ID NO: 3875296 - RNA, 17 nt, Human
ugugugcagagcugaag

SEQ ID NO: 3875297 - RNA, 22 nt, Human
ugugugcaucaggcuuucuuuu

SEQ ID NO: 3875298 - RNA, 13 nt, Human
ugugugcccagcu

SEQ ID NO: 3875299 - RNA, 14 nt, Human
ugugugcccagcuu

SEQ ID NO: 3875300 - RNA, 22 nt, Human
ugugugccgagcccuugcccau

SEQ ID NO: 3875301 - RNA, 16 nt, Human
ugugugccucuagcug

SEQ ID NO: 3875302 - RNA, 17 nt, Human
ugugugccucuagcuga

SEQ ID NO: 3875303 - RNA, 19 nt, Human
ugugugcguccugucggag

SEQ ID NO: 3875304 - RNA, 21 nt, Human
ugugugcguguuuggguuuuu

SEQ ID NO: 3875305 - RNA, 22 nt, Human
ugugugcucauguaugugcgaa

SEQ ID NO: 3875306 - RNA, 18 nt, Human
ugugugcucuucuucuuu

SEQ ID NO: 3875307 - RNA, 15 nt, Human
ugugugcuuauguau

SEQ ID NO: 3875308 - RNA, 21 nt, Human
uguguggagagggaaugugaa

SEQ ID NO: 3875309 - RNA, 22 nt, Human
uguguggagagggaaugugaaa

SEQ ID NO: 3875310 - RNA, 22 nt, Human
uguguggagcucgcuaaaguca

SEQ ID NO: 3875311 - RNA, 17 nt, Human
uguguggagucauuucu

SEQ ID NO: 3875312 - RNA, 17 nt, Human
uguguggccacuucugu

SEQ ID NO: 3875313 - RNA, 17 nt, Human
uguguggcuuucagagc

SEQ ID NO: 3875314 - RNA, 15 nt, Human
ugugugggacuguac

SEQ ID NO: 3875315 - RNA, 15 nt, Human
ugugugggagugugu

SEQ ID NO: 3875316 - RNA, 13 nt, Human
ugugugggucuau

SEQ ID NO: 3875317 - RNA, 14 nt, Human
ugugugguagaaac

SEQ ID NO: 3875318 - RNA, 16 nt, Human
ugugugguagaaacaa

SEQ ID NO: 3875319 - RNA, 14 nt, Human
uguguguauacaug

SEQ ID NO: 3875320 - RNA, 22 nt, Human
uguguguauauauguguauaua

SEQ ID NO: 3875321 - RNA, 13 nt, Human
uguguguaugcua

SEQ ID NO: 3875322 - RNA, 19 nt, Human
uguguguauguuugcacac

SEQ ID NO: 3875323 - RNA, 17 nt, Human
ugugugucaguuuucau

SEQ ID NO: 3875324 - RNA, 18 nt, Human
ugugugucaugccaguga

SEQ ID NO: 3875325 - RNA, 19 nt, Human
uguguguccccuugcagcc

SEQ ID NO: 3875326 - RNA, 20 nt, Human
ugugugugaaugaacacucu

SEQ ID NO: 3875327 - RNA, 23 nt, Human
ugugugugaccccuccuggggcc

SEQ ID NO: 3875328 - RNA, 18 nt, Human
ugugugugcagacuucag

SEQ ID NO: 3875329 - RNA, 19 nt, Human
ugugugugcuuauguauga

SEQ ID NO: 3875330 - RNA, 19 nt, Human
ugugugugggcugugagug

SEQ ID NO: 3875331 - RNA, 13 nt, Human
ugugugugguuuu

SEQ ID NO: 3875332 - RNA, 11 nt, Human
ugugugugugc

SEQ ID NO: 3875333 - RNA, 13 nt, Human
uguguguguguau

SEQ ID NO: 3875334 - RNA, 15 nt, Human
uguguguguguauga

SEQ ID NO: 3875335 - RNA, 16 nt, Human
uguguguguguaugug

SEQ ID NO: 3875336 - RNA, 13 nt, Human
ugugugugugugu

SEQ ID NO: 3875337 - RNA, 15 nt, Human
ugugugugugugucc

SEQ ID NO: 3875338 - RNA, 16 nt, Human
ugugugugugugugca

SEQ ID NO: 3875339 - RNA, 20 nt, Human
uguguguuaagcucugcuau

SEQ ID NO: 3875340 - RNA, 14 nt, Human
uguguguuccuggc

SEQ ID NO: 3875341 - RNA, 20 nt, Human
uguguguugauacuguugca

SEQ ID NO: 3875342 - RNA, 21 nt, Human
uguguguugauacuguugcac

SEQ ID NO: 3875343 - RNA, 22 nt, Human
uguguguugaucccaagacaau

SEQ ID NO: 3875344 - RNA, 19 nt, Human
uguguguugccacaggaca

SEQ ID NO: 3875345 - RNA, 18 nt, Human
uguguguugucuugaaag

SEQ ID NO: 3875346 - RNA, 18 nt, Human
uguguguuguguguggga

SEQ ID NO: 3875347 - RNA, 18 nt, Human
uguguguuuaaauaaagu

SEQ ID NO: 3875348 - RNA, 23 nt, Human
uguguguuuauugucaaaguggu

SEQ ID NO: 3875349 - RNA, 13 nt, Human
uguguguuucacu

SEQ ID NO: 3875350 - RNA, 13 nt, Human
uguguguuuggaa

SEQ ID NO: 3875351 - RNA, 15 nt, Human
uguguguuugugcug

SEQ ID NO: 3875352 - RNA, 19 nt, Human
uguguuaagcucugcuauu

SEQ ID NO: 3875353 - RNA, 22 nt, Human
uguguuaaguauguguaaaaug

SEQ ID NO: 3875354 - RNA, 19 nt, Human
uguguuaaucuuaauguau

SEQ ID NO: 3875355 - RNA, 19 nt, Human
uguguuacccuccuguaaa

SEQ ID NO: 3875356 - RNA, 14 nt, Human
uguguuaguuccca

SEQ ID NO: 3875357 - RNA, 17 nt, Human
uguguuaguucccaaca

SEQ ID NO: 3875358 - RNA, 23 nt, Human
uguguuaucacccagaagaaaau

SEQ ID NO: 3875359 - RNA, 14 nt, Human
uguguuaugaagca

SEQ ID NO: 3875360 - RNA, 14 nt, Human
uguguuauuauaga

SEQ ID NO: 3875361 - RNA, 19 nt, Human
uguguucacuaaacucuga

SEQ ID NO: 3875362 - RNA, 19 nt, Human
uguguuccaacugccccca

SEQ ID NO: 3875363 - RNA, 17 nt, Human
uguguuccaaguuucca

SEQ ID NO: 3875364 - RNA, 19 nt, Human
uguguuccaaguuuccaaa

SEQ ID NO: 3875365 - RNA, 17 nt, Human
uguguucccauuucagc

SEQ ID NO: 3875366 - RNA, 10 nt, Human
uguguuccug

SEQ ID NO: 3875367 - RNA, 16 nt, Human
uguguuccuggcaaua

SEQ ID NO: 3875368 - RNA, 13 nt, Human
uguguugaagagg

SEQ ID NO: 3875369 - RNA, 15 nt, Human
uguguugaaggaacu

SEQ ID NO: 3875370 - RNA, 15 nt, Human
uguguugauacauuc

SEQ ID NO: 3875371 - RNA, 14 nt, Human
uguguugcauuauu

SEQ ID NO: 3875372 - RNA, 13 nt, Human
uguguugccaagc

SEQ ID NO: 3875373 - RNA, 16 nt, Human
uguguugccaagcucc

SEQ ID NO: 3875374 - RNA, 22 nt, Human
uguguugccacaguagaacugu

SEQ ID NO: 3875375 - RNA, 17 nt, Human
uguguugcuuauguugu

SEQ ID NO: 3875376 - RNA, 12 nt, Human
uguguuguauua

SEQ ID NO: 3875377 - RNA, 14 nt, Human
uguguugugugugg

SEQ ID NO: 3875378 - RNA, 13 nt, Human
uguguuguugcuu

SEQ ID NO: 3875379 - RNA, 13 nt, Human
uguucucugcccu

SEQ ID NO: 3875380 - RNA, 14 nt, Human
uguucucugcccuc

SEQ ID NO: 3875381 - RNA, 13 nt, Human
uguucucugggag

SEQ ID NO: 3875382 - RNA, 17 nt, Human
uguucucugggagaaaa

SEQ ID NO: 3875383 - RNA, 18 nt, Human
uguucugaauaauuucuu

SEQ ID NO: 3875384 - RNA, 19 nt, Human
uguucugacauuaacaguu

SEQ ID NO: 3875385 - RNA, 15 nt, Human
uguucugacccugcu

SEQ ID NO: 3875386 - RNA, 18 nt, Human
uguucugacccugcuuca

SEQ ID NO: 3875387 - RNA, 21 nt, Human
uguucugagauucaauauuga

SEQ ID NO: 3875388 - RNA, 14 nt, Human
uguucugauuagaa

SEQ ID NO: 3875389 - RNA, 13 nt, Human
uguucugcacuga

SEQ ID NO: 3875390 - RNA, 16 nt, Human
uguucugcacugaaaa

SEQ ID NO: 3875391 - RNA, 23 nt, Human
uguucugcccaaugccuuuuuga

SEQ ID NO: 3875392 - RNA, 22 nt, Human
uguucugcccccagcccaaagg

SEQ ID NO: 3875393 - RNA, 20 nt, Human
uguucugcuaaauuucaaau

SEQ ID NO: 3875394 - RNA, 13 nt, Human
uguucuggaggaa

SEQ ID NO: 3875395 - RNA, 17 nt, Human
uguucuggcucuuccag

SEQ ID NO: 3875396 - RNA, 14 nt, Human
uguucugggacaca

SEQ ID NO: 3875397 - RNA, 15 nt, Human
uguucugggacacag

SEQ ID NO: 3875398 - RNA, 20 nt, Human
uguucuggugaggccuugcu

SEQ ID NO: 3875399 - RNA, 16 nt, Human
uguucugucccuugcc

SEQ ID NO: 3875400 - RNA, 22 nt, Human
uguucugugauacagaacucuu

SEQ ID NO: 3875401 - RNA, 13 nt, Human
uguucuguggaaa

SEQ ID NO: 3875402 - RNA, 17 nt, Human
uguucuguggaaagugu

SEQ ID NO: 3875403 - RNA, 18 nt, Human
uguucuguggaaagugua

SEQ ID NO: 3875404 - RNA, 20 nt, Human
uguucuguggaaaguguaaa

SEQ ID NO: 3875405 - RNA, 19 nt, Human
uguucugugguuccucugc

SEQ ID NO: 3875406 - RNA, 13 nt, Human
uguucugugucuu

SEQ ID NO: 3875407 - RNA, 19 nt, Human
uguucuguuaacugaauac

SEQ ID NO: 3875408 - RNA, 13 nt, Human
uguucuguuacaa

SEQ ID NO: 3875409 - RNA, 18 nt, Human
uguucuguuacaaaaugu

SEQ ID NO: 3875410 - RNA, 13 nt, Human
uguucuguuuaau

SEQ ID NO: 3875411 - RNA, 16 nt, Human
uguucuguuuguuaaa

SEQ ID NO: 3875412 - RNA, 16 nt, Human
uguucuguuuuguuuc

SEQ ID NO: 3875413 - RNA, 18 nt, Human
uguucuguuuuguuuugu

SEQ ID NO: 3875414 - RNA, 16 nt, Human
uguucuuaauucuuag

SEQ ID NO: 3875415 - RNA, 18 nt, Human
uguucuuaauugcacucu

SEQ ID NO: 3875416 - RNA, 16 nt, Human
uguucuuacacauaca

SEQ ID NO: 3875417 - RNA, 10 nt, Human
uguucuucca

SEQ ID NO: 3875418 - RNA, 16 nt, Human
uguucuuccaaagcag

SEQ ID NO: 3875419 - RNA, 20 nt, Human
uguucuuccaaagcagagag

SEQ ID NO: 3875420 - RNA, 13 nt, Human
uguucuuccaguu

SEQ ID NO: 3875421 - RNA, 10 nt, Human
uguucuuccu

SEQ ID NO: 3875422 - RNA, 16 nt, Human
uguucuugcugcuaga

SEQ ID NO: 3875423 - RNA, 21 nt, Human
uguucuugcugcuagaacuuu

SEQ ID NO: 3875424 - RNA, 16 nt, Human
uguucuuggcaauaaa

SEQ ID NO: 3875425 - RNA, 17 nt, Human
uguucuuggcaauaaau

SEQ ID NO: 3875426 - RNA, 23 nt, Human
uguucuuggcaauaaauuuugaa

SEQ ID NO: 3875427 - RNA, 17 nt, Human
uguucuugguuuguaaa

SEQ ID NO: 3875428 - RNA, 22 nt, Human
uguucuugguuuguaaauuaac

SEQ ID NO: 3875429 - RNA, 14 nt, Human
uguucuuguauuua

SEQ ID NO: 3875430 - RNA, 20 nt, Human
uguucuuuauauacaauaau

SEQ ID NO: 3875431 - RNA, 19 nt, Human
uguucuuucacccuuuucu

SEQ ID NO: 3875432 - RNA, 20 nt, Human
uguucuuuccaaaguacacu

SEQ ID NO: 3875433 - RNA, 20 nt, Human
uguucuuucuggcuaugcau

SEQ ID NO: 3875434 - RNA, 20 nt, Human
uguucuuuggaaauacacag

SEQ ID NO: 3875435 - RNA, 13 nt, Human
uguucuuugggga

SEQ ID NO: 3875436 - RNA, 13 nt, Human
uguucuuuuuaga

SEQ ID NO: 3875437 - RNA, 15 nt, Human
uguugaaaaaauuua

SEQ ID NO: 3875438 - RNA, 18 nt, Human
uguugaaaaaguuuguuu

SEQ ID NO: 3875439 - RNA, 23 nt, Human
uguugaaacggaugauuucuaug

SEQ ID NO: 3875440 - RNA, 16 nt, Human
uguugaaacuuuaaga

SEQ ID NO: 3875441 - RNA, 12 nt, Human
uguugaaagcaa

SEQ ID NO: 3875442 - RNA, 23 nt, Human
uguugaaagcaaaaaugcuaaua

SEQ ID NO: 3875443 - RNA, 21 nt, Human
uguugaaauuuugcaaauaua

SEQ ID NO: 3875444 - RNA, 18 nt, Human
uguugaacaaaauaaauu

SEQ ID NO: 3875445 - RNA, 23 nt, Human
uguugaaccaaaccucccugcua

SEQ ID NO: 3875446 - RNA, 18 nt, Human
uguugaagaauacaguua

SEQ ID NO: 3875447 - RNA, 18 nt, Human
uguugaagagcagcuccu

SEQ ID NO: 3875448 - RNA, 17 nt, Human
uguugaagccacugccu

SEQ ID NO: 3875449 - RNA, 15 nt, Human
uguugaagccuuugu

SEQ ID NO: 3875450 - RNA, 14 nt, Human
uguugaaggaacuu

SEQ ID NO: 3875451 - RNA, 18 nt, Human
uguugaaggaacuugucu

SEQ ID NO: 3875452 - RNA, 13 nt, Human
uguugaagucacc

SEQ ID NO: 3875453 - RNA, 13 nt, Human
uguugaauacuuu

SEQ ID NO: 3875454 - RNA, 18 nt, Human
uguugaauacuuuuuaca

SEQ ID NO: 3875455 - RNA, 18 nt, Human
uguugaauucuuuugcca

SEQ ID NO: 3875456 - RNA, 17 nt, Human
uguugacaguucauaug

SEQ ID NO: 3875457 - RNA, 15 nt, Human
uguugacauauuuaa

SEQ ID NO: 3875458 - RNA, 16 nt, Human
uguugacauauuuaau

SEQ ID NO: 3875459 - RNA, 18 nt, Human
uguugacauauuuaaugu

SEQ ID NO: 3875460 - RNA, 23 nt, Human
uguugacauauuuaauguuuuaa

SEQ ID NO: 3875461 - RNA, 20 nt, Human
uguugacaucacuggcaugg

SEQ ID NO: 3875462 - RNA, 17 nt, Human
uguugacauccaagcuu

SEQ ID NO: 3875463 - RNA, 20 nt, Human
uguugacaugggacauuugc

SEQ ID NO: 3875464 - RNA, 14 nt, Human
uguugacauuaguc

SEQ ID NO: 3875465 - RNA, 22 nt, Human
uguugacucuaguacugugaau

SEQ ID NO: 3875466 - RNA, 23 nt, Human
uguugagaaucccaaauuugauu

SEQ ID NO: 3875467 - RNA, 13 nt, Human
uguugagacagag

SEQ ID NO: 3875468 - RNA, 23 nt, Human
uguugagcaagcaguagcauuug

SEQ ID NO: 3875469 - RNA, 17 nt, Human
uguugagcaucacagaa

SEQ ID NO: 3875470 - RNA, 20 nt, Human
uguugagcaugacagccugc

SEQ ID NO: 3875471 - RNA, 20 nt, Human
uguugagguggucugaaugu

SEQ ID NO: 3875472 - RNA, 23 nt, Human
uguugagguggucugaauguucu

SEQ ID NO: 3875473 - RNA, 14 nt, Human
uguugauacuguug

SEQ ID NO: 3875474 - RNA, 16 nt, Human
uguugauacuguugca

SEQ ID NO: 3875475 - RNA, 17 nt, Human
uguugauacuguugcac

SEQ ID NO: 3875476 - RNA, 19 nt, Human
uguugauacuguugcacgu

SEQ ID NO: 3875477 - RNA, 23 nt, Human
uguugaucauguacuuuuuagua

SEQ ID NO: 3875478 - RNA, 12 nt, Human
uguugaucccaa

SEQ ID NO: 3875479 - RNA, 16 nt, Human
uguugaucccaagaca

SEQ ID NO: 3875480 - RNA, 21 nt, Human
uguugaugcaauccuuacaaa

SEQ ID NO: 3875481 - RNA, 23 nt, Human
uguugaugcaauccuuacaaaug

SEQ ID NO: 3875482 - RNA, 22 nt, Human
uguugaugggcacuugagaacu

SEQ ID NO: 3875483 - RNA, 17 nt, Human
uguugauguaucugagu

SEQ ID NO: 3875484 - RNA, 21 nt, Human
uguugauguaucugaguugcc

SEQ ID NO: 3875485 - RNA, 16 nt, Human
uguugauuaaagauga

SEQ ID NO: 3875486 - RNA, 16 nt, Human
uguugauuucuaguua

SEQ ID NO: 3875487 - RNA, 19 nt, Human
uguugauuucuaguuauuu

SEQ ID NO: 3875488 - RNA, 20 nt, Human
uguugauuucuaguuauuua

SEQ ID NO: 3875489 - RNA, 19 nt, Human
uguugauuucuuuccagag

SEQ ID NO: 3875490 - RNA, 23 nt, Human
uguugcaagaugugaauuauuga

SEQ ID NO: 3875491 - RNA, 15 nt, Human
uguugcaauuaggau

SEQ ID NO: 3875492 - RNA, 23 nt, Human
uguugcacacccacucagcuccg

SEQ ID NO: 3875493 - RNA, 15 nt, Human
uguugcacccagccc

SEQ ID NO: 3875494 - RNA, 17 nt, Human
uguugcacugaaaugga

SEQ ID NO: 3875495 - RNA, 17 nt, Human
uguugcauggauguuuu

SEQ ID NO: 3875496 - RNA, 18 nt, Human
uguugcauuauucauuua

SEQ ID NO: 3875497 - RNA, 20 nt, Human
uguugcauuauucauuuagu

SEQ ID NO: 3875498 - RNA, 18 nt, Human
uguugccaagcuccaagc

SEQ ID NO: 3875499 - RNA, 15 nt, Human
uguugccacaggaca

SEQ ID NO: 3875500 - RNA, 19 nt, Human
uguugccaguuguccuccu

SEQ ID NO: 3875501 - RNA, 23 nt, Human
uguugcccaacuacuaucucaga

SEQ ID NO: 3875502 - RNA, 13 nt, Human
uguugcccaggca

SEQ ID NO: 3875503 - RNA, 15 nt, Human
uguugcccaggcagg

SEQ ID NO: 3875504 - RNA, 14 nt, Human
uguugcccaggcug

SEQ ID NO: 3875505 - RNA, 11 nt, Human
uguugccccag

SEQ ID NO: 3875506 - RNA, 20 nt, Human
uguugccccuuucucuuuuc

SEQ ID NO: 3875507 - RNA, 19 nt, Human
uguugccuugcauaauggu

SEQ ID NO: 3875508 - RNA, 21 nt, Human
uguugcgugacacucuccuug

SEQ ID NO: 3875509 - RNA, 14 nt, Human
uguugcguuccuuu

SEQ ID NO: 3875510 - RNA, 11 nt, Human
uguugcuaagc

SEQ ID NO: 3875511 - RNA, 12 nt, Human
uguugcuaagcc

SEQ ID NO: 3875512 - RNA, 17 nt, Human
uguugcuaugugccuua

SEQ ID NO: 3875513 - RNA, 23 nt, Human
uguugcucaaaucuauucagaca

SEQ ID NO: 3875514 - RNA, 23 nt, Human
uguugcucagcaaggggcucugc

SEQ ID NO: 3875515 - RNA, 14 nt, Human
uguugcugaauagg

SEQ ID NO: 3875516 - RNA, 16 nt, Human
uguugcugauuuuauu

SEQ ID NO: 3875517 - RNA, 13 nt, Human
uguugcugccaac

SEQ ID NO: 3875518 - RNA, 13 nt, Human
uguugcugccuca

SEQ ID NO: 3875519 - RNA, 14 nt, Human
uguugcugccucau

SEQ ID NO: 3875520 - RNA, 16 nt, Human
uguugcuuagucacuu

SEQ ID NO: 3875521 - RNA, 20 nt, Human
uguugcuuauguuguuuugu

SEQ ID NO: 3875522 - RNA, 15 nt, Human
uguugcuucuuguga

SEQ ID NO: 3875523 - RNA, 21 nt, Human
uguuggaaaagaauacagaaa

SEQ ID NO: 3875524 - RNA, 12 nt, Human
uguuuguguauu

SEQ ID NO: 3875525 - RNA, 12 nt, Human
uguuuguuaugg

SEQ ID NO: 3875526 - RNA, 15 nt, Human
uguuuguuguagauu

SEQ ID NO: 3875527 - RNA, 19 nt, Human
uguuuguuucaagaaccug

SEQ ID NO: 3875528 - RNA, 22 nt, Human
uguuuguuucucccccugggcu

SEQ ID NO: 3875529 - RNA, 12 nt, Human
uguuuguuuugu

SEQ ID NO: 3875530 - RNA, 23 nt, Human
uguuuuaaaauaaaaauucugaa

SEQ ID NO: 3875531 - RNA, 17 nt, Human
uguuuuaaaauaaggau

SEQ ID NO: 3875532 - RNA, 21 nt, Human
uguuuuaaacucuccuaguca

SEQ ID NO: 3875533 - RNA, 12 nt, Human
uguuuuaaagaa

SEQ ID NO: 3875534 - RNA, 18 nt, Human
uguuuuaaauauagaauu

SEQ ID NO: 3875535 - RNA, 13 nt, Human
uguuuuaaauucu

SEQ ID NO: 3875536 - RNA, 17 nt, Human
uguuuuaaauucugaga

SEQ ID NO: 3875537 - RNA, 13 nt, Human
uguuuuaacaaaa

SEQ ID NO: 3875538 - RNA, 16 nt, Human
uguuuuaagaaaugua

SEQ ID NO: 3875539 - RNA, 16 nt, Human
uguuuuaagaggcagg

SEQ ID NO: 3875540 - RNA, 22 nt, Human
uguuuuaagaggcagggucuca

SEQ ID NO: 3875541 - RNA, 18 nt, Human
uguuuuaaggaagaaaaa

SEQ ID NO: 3875542 - RNA, 19 nt, Human
uguuuuaaggaugcuugua

SEQ ID NO: 3875543 - RNA, 22 nt, Human
uguuuuaaggaugcuuguacau

SEQ ID NO: 3875544 - RNA, 18 nt, Human
uguuuuaaguacuacaca

SEQ ID NO: 3875545 - RNA, 13 nt, Human
uguuuuaauugua

SEQ ID NO: 3875546 - RNA, 22 nt, Human
uguuuuaauuuaaacaccuccu

SEQ ID NO: 3875547 - RNA, 23 nt, Human
uguuuuaauuuaaacaccuccuc

SEQ ID NO: 3875548 - RNA, 17 nt, Human
uguuuuacaauaguucu

SEQ ID NO: 3875549 - RNA, 16 nt, Human
uguuuuacuaaagaaa

SEQ ID NO: 3875550 - RNA, 24 nt, Human
uguuuuagaaugaugcacauuuca

SEQ ID NO: 3875551 - RNA, 20 nt, Human
uguuuuagacaaauacucau

SEQ ID NO: 3875552 - RNA, 21 nt, Human
uguuuuagacaaauacucaug

SEQ ID NO: 3875553 - RNA, 22 nt, Human
uguuuuagacaaauacucaugu

SEQ ID NO: 3875554 - RNA, 24 nt, Human
uguuuuagacaaauacucaugugu

SEQ ID NO: 3875555 - RNA, 18 nt, Human
uguuuuagaguaagaaau

SEQ ID NO: 3875556 - RNA, 16 nt, Human
uguuuuagcacagcgu

SEQ ID NO: 3875557 - RNA, 14 nt, Human
uguuuuaggagcau

SEQ ID NO: 3875558 - RNA, 16 nt, Human
uguuuuaguuaaauuu

SEQ ID NO: 3875559 - RNA, 19 nt, Human
uguuuuauaaaauuuugcu

SEQ ID NO: 3875560 - RNA, 23 nt, Human
uguuuuaucaugacauguuauau

SEQ ID NO: 3875561 - RNA, 23 nt, Human
uguuuuauuauuucuauuaaaua

SEQ ID NO: 3875562 - RNA, 14 nt, Human
uguuuuauuccugu

SEQ ID NO: 3875563 - RNA, 23 nt, Human
uguuuuauuuuuuauuguuuuca

SEQ ID NO: 3875564 - RNA, 14 nt, Human
uguuuucaaauguu

SEQ ID NO: 3875565 - RNA, 21 nt, Human
uguuuucaauuuuaaacauau

SEQ ID NO: 3875566 - RNA, 15 nt, Human
uguuuucagacucag

SEQ ID NO: 3875567 - RNA, 19 nt, Human
uguuuucauuaucucaaaa

SEQ ID NO: 3875568 - RNA, 12 nt, Human
uguuuucccuga

SEQ ID NO: 3875569 - RNA, 16 nt, Human
uguuuucccugaccuc

SEQ ID NO: 3875570 - RNA, 13 nt, Human
uguuuucuagugu

SEQ ID NO: 3875571 - RNA, 15 nt, Human
uguuuucuaguguau

SEQ ID NO: 3875572 - RNA, 16 nt, Human
uguuuucuaguguauc

SEQ ID NO: 3875573 - RNA, 20 nt, Human
uguuuucuaguguaucaaaa

SEQ ID NO: 3875574 - RNA, 17 nt, Human
uguuuucucugaacaca

SEQ ID NO: 3875575 - RNA, 21 nt, Human
uguuuucucuggaguauucua

SEQ ID NO: 3875576 - RNA, 17 nt, Human
uguuuucuuuugguaaa

SEQ ID NO: 3875577 - RNA, 17 nt, Human
uguuuugaaggcaaaau

SEQ ID NO: 3875578 - RNA, 15 nt, Human
uguuuugaauauuac

SEQ ID NO: 3875579 - RNA, 21 nt, Human
uguuuugaauauuacuccuau

SEQ ID NO: 3875580 - RNA, 19 nt, Human
uguuuugaaugguguugua

SEQ ID NO: 3875581 - RNA, 17 nt, Human
uguuuugacggaugauu

SEQ ID NO: 3875582 - RNA, 12 nt, Human
uguuuugagaac

SEQ ID NO: 3875583 - RNA, 16 nt, Human
uguuuugagaguaaug

SEQ ID NO: 3875584 - RNA, 12 nt, Human
uguuuugauaaa

SEQ ID NO: 3875585 - RNA, 20 nt, Human
uguuuugauguuuguggccu

SEQ ID NO: 3875586 - RNA, 14 nt, Human
uguuuugcaagcca

SEQ ID NO: 3875587 - RNA, 20 nt, Human
uguuuugccaaagacuguaa

SEQ ID NO: 3875588 - RNA, 16 nt, Human
uguuuugccagcccau

SEQ ID NO: 3875589 - RNA, 17 nt, Human
uguuuuggacuuuguua

SEQ ID NO: 3875590 - RNA, 17 nt, Human
uguuuuggauggcuugu

SEQ ID NO: 3875591 - RNA, 22 nt, Human
uguuuuggauuuggagagaaau

SEQ ID NO: 3875592 - RNA, 18 nt, Human
uguuuuggcugaaauucu

SEQ ID NO: 3875593 - RNA, 21 nt, Human
uguuuugguagauuaaauaua

SEQ ID NO: 3875594 - RNA, 15 nt, Human
uguuuugguuugcua

SEQ ID NO: 3875595 - RNA, 16 nt, Human
uguuuuguaaacuuug

SEQ ID NO: 3875596 - RNA, 17 nt, Human
uguuuuguaaacuuuga

SEQ ID NO: 3875597 - RNA, 18 nt, Human
uguuuuguaaacuuugaa

SEQ ID NO: 3875598 - RNA, 20 nt, Human
uguuuuguaaacuuugaaau

SEQ ID NO: 3875599 - RNA, 21 nt, Human
uguuuuguaaacuuugaaaua

SEQ ID NO: 3875600 - RNA, 15 nt, Human
uguuuuguacagaug

SEQ ID NO: 3875601 - RNA, 15 nt, Human
uguuuuguaccagug

SEQ ID NO: 3875602 - RNA, 16 nt, Human
uguuuuguaccaguga

SEQ ID NO: 3875603 - RNA, 20 nt, Human
uguuuuguaccagugaauuu

SEQ ID NO: 3875604 - RNA, 14 nt, Human
uguuuuguauacaa

SEQ ID NO: 3875605 - RNA, 17 nt, Human
uguuuugucuuacaaag

SEQ ID NO: 3875606 - RNA, 13 nt, Human
uguuuugugcauu

SEQ ID NO: 3875607 - RNA, 19 nt, Human
uguuuuguugacauucuga

SEQ ID NO: 3875608 - RNA, 13 nt, Human
uguuuuguuuguc

SEQ ID NO: 3875609 - RNA, 14 nt, Human
uguuuuguuugucu

SEQ ID NO: 3875610 - RNA, 12 nt, Human
uguuuuuaaaag

SEQ ID NO: 3875611 - RNA, 19 nt, Human
uguuuuuaaaaucuuauua

SEQ ID NO: 3875612 - RNA, 14 nt, Human
uguuuuuaaacugu

SEQ ID NO: 3875613 - RNA, 15 nt, Human
uguuuuuaaacugua

SEQ ID NO: 3875614 - RNA, 18 nt, Human
uguuuuuaaacuguacag

SEQ ID NO: 3875615 - RNA, 19 nt, Human
uguuuuuaacaugucaauc

SEQ ID NO: 3875616 - RNA, 20 nt, Human
uguuuuuaagcuguuuccau

SEQ ID NO: 3875617 - RNA, 16 nt, Human
uguuuuuaucuuuuua

SEQ ID NO: 3875618 - RNA, 14 nt, Human
uguuuuucaguuca

SEQ ID NO: 3875619 - RNA, 11 nt, Human
uguuuuucauu

SEQ ID NO: 3875620 - RNA, 16 nt, Human
uguuuuuccuuccaau

SEQ ID NO: 3875621 - RNA, 13 nt, Human
uguuuuucuaaag

SEQ ID NO: 3875622 - RNA, 20 nt, Human
uguuuuucuauuaaaagacu

SEQ ID NO: 3875623 - RNA, 22 nt, Human
uguuuuucuauuaaaagacuca

SEQ ID NO: 3875624 - RNA, 12 nt, Human
uguuuuucucac

SEQ ID NO: 3875625 - RNA, 21 nt, Human
uguuuuucucacuccuuuugg

SEQ ID NO: 3875626 - RNA, 12 nt, Human
uguuuuucugcu

SEQ ID NO: 3875627 - RNA, 22 nt, Human
uguuuuucugugugucaguuuu

SEQ ID NO: 3875628 - RNA, 13 nt, Human
uguuuuugaaaua

SEQ ID NO: 3875629 - RNA, 13 nt, Human
uguuuuuguauau

SEQ ID NO: 3875630 - RNA, 15 nt, Human
uguuuuuguugugug

SEQ ID NO: 3875631 - RNA, 14 nt, Human
uguuuuuguuuugu

SEQ ID NO: 3875632 - RNA, 15 nt, Human
uguuuuuuaaagucu

SEQ ID NO: 3875633 - RNA, 12 nt, Human
uguuuuuuaaga

SEQ ID NO: 3875634 - RNA, 21 nt, Human
uguuuuuuagaucaaauacuu

SEQ ID NO: 3875635 - RNA, 14 nt, Human
uguuuuuuaucuuu

SEQ ID NO: 3875636 - RNA, 23 nt, Human
uguuuuuuaucuuuucuacagca

SEQ ID NO: 3875637 - RNA, 15 nt, Human
uguuuuuuaugaagu

SEQ ID NO: 3875638 - RNA, 17 nt, Human
uguuuuuuaugaagugc

SEQ ID NO: 3875639 - RNA, 14 nt, Human
uguuuuuucaugug

SEQ ID NO: 3875640 - RNA, 14 nt, Human
uguuuuuugaaaac

SEQ ID NO: 3875641 - RNA, 23 nt, Human
uguuuuuugccacagcuuuugca

SEQ ID NO: 3875642 - RNA, 16 nt, Human
uguuuuuuggucuuuu

SEQ ID NO: 3875643 - RNA, 18 nt, Human
uguuuuuuguuuuucugc

SEQ ID NO: 3875644 - RNA, 15 nt, Human
uguuuuuuuguuugu

SEQ ID NO: 3875645 - RNA, 22 nt, Human
uuaaaaaaaaaaaaaaaaaaga

SEQ ID NO: 3875646 - RNA, 20 nt, Human
uuaaaaaaaaaaaaaggaaa

SEQ ID NO: 3875647 - RNA, 22 nt, Human
uuaaaaaaaaaccugagcccca

SEQ ID NO: 3875648 - RNA, 16 nt, Human
uuaaaaaaaaaggcau

SEQ ID NO: 3875649 - RNA, 22 nt, Human
uuaaaaaaaaagucagagacag

SEQ ID NO: 3875650 - RNA, 16 nt, Human
uuaaaaaaaaauugua

SEQ ID NO: 3875651 - RNA, 19 nt, Human
uuaaaaaaaaauuguaucu

SEQ ID NO: 3875652 - RNA, 19 nt, Human
uuaaaaaaaacaaaaagaa

SEQ ID NO: 3875653 - RNA, 21 nt, Human
uuaaaaaaaacaaaaagaaca

SEQ ID NO: 3875654 - RNA, 17 nt, Human
uuaaaaaaaacucuuua

SEQ ID NO: 3875655 - RNA, 12 nt, Human
uuaaaaaaaaua

SEQ ID NO: 3875656 - RNA, 19 nt, Human
uuaaaaaaaauaauaaauu

SEQ ID NO: 3875657 - RNA, 13 nt, Human
uuaaaaaaagaaa

SEQ ID NO: 3875658 - RNA, 21 nt, Human
uuaaaaaaaggcauuguuuga

SEQ ID NO: 3875659 - RNA, 18 nt, Human
uuaaaaaaaucaaaacaa

SEQ ID NO: 3875660 - RNA, 20 nt, Human
uuaaaaaacuucauguaauu

SEQ ID NO: 3875661 - RNA, 18 nt, Human
uuaaaaaagaaacauuug

SEQ ID NO: 3875662 - RNA, 15 nt, Human
uuaaaaaagagacau

SEQ ID NO: 3875663 - RNA, 12 nt, Human
uuaaaaaagaua

SEQ ID NO: 3875664 - RNA, 15 nt, Human
uuaaaaaagauaaac

SEQ ID NO: 3875665 - RNA, 18 nt, Human
uuaaaaaagauaaacaca

SEQ ID NO: 3875666 - RNA, 21 nt, Human
uuaaaaaagcuuaaaacuuug

SEQ ID NO: 3875667 - RNA, 15 nt, Human
uuaaaaaaguuuaaa

SEQ ID NO: 3875668 - RNA, 21 nt, Human
uuaaaaaauauuuauuaaaua

SEQ ID NO: 3875669 - RNA, 14 nt, Human
uuaucuauaauuua

SEQ ID NO: 3875670 - RNA, 17 nt, Human
uuaucuauacauaucuu

SEQ ID NO: 3875671 - RNA, 19 nt, Human
uuaucuauacauaucuuua

SEQ ID NO: 3875672 - RNA, 21 nt, Human
uuaucuauuguaagauaaaaa

SEQ ID NO: 3875673 - RNA, 16 nt, Human
uuaucucacuugugcc

SEQ ID NO: 3875674 - RNA, 16 nt, Human
uuaucucagauguuaa

SEQ ID NO: 3875675 - RNA, 21 nt, Human
uuaucucagucaugcauaaau

SEQ ID NO: 3875676 - RNA, 21 nt, Human
uuaucuccacaaccucuuccc

SEQ ID NO: 3875677 - RNA, 21 nt, Human
uuaucuccccuucacaugcau

SEQ ID NO: 3875678 - RNA, 12 nt, Human
uuaucucugugu

SEQ ID NO: 3875679 - RNA, 20 nt, Human
uuaucucuuuuauauuugua

SEQ ID NO: 3875680 - RNA, 17 nt, Human
uuaucugaagucagauc

SEQ ID NO: 3875681 - RNA, 18 nt, Human
uuaucugccucucuugua

SEQ ID NO: 3875682 - RNA, 14 nt, Human
uuaucuggcuucaa

SEQ ID NO: 3875683 - RNA, 23 nt, Human
uuaucugggauuaugguuuugug

SEQ ID NO: 3875684 - RNA, 12 nt, Human
uuaucuguccca

SEQ ID NO: 3875685 - RNA, 17 nt, Human
uuaucugugaauucaga

SEQ ID NO: 3875686 - RNA, 18 nt, Human
uuaucuugaaggaaaaau

SEQ ID NO: 3875687 - RNA, 16 nt, Human
uuaucuugaauaaugu

SEQ ID NO: 3875688 - RNA, 20 nt, Human
uuaucuugaauaauguaaga

SEQ ID NO: 3875689 - RNA, 16 nt, Human
uuaucuuuacuuuuaa

SEQ ID NO: 3875690 - RNA, 15 nt, Human
uuaucuuuguaauua

SEQ ID NO: 3875691 - RNA, 12 nt, Human
uuaucuuuugag

SEQ ID NO: 3875692 - RNA, 18 nt, Human
uuaugaaaaagaagaauc

SEQ ID NO: 3875693 - RNA, 19 nt, Human
uuaugaaacuuuuggaagg

SEQ ID NO: 3875694 - RNA, 21 nt, Human
uuaugaaagcaacaaagaaau

SEQ ID NO: 3875695 - RNA, 18 nt, Human
uuaugaaagguuuacauu

SEQ ID NO: 3875696 - RNA, 19 nt, Human
uuaugaaauucacccccuu

SEQ ID NO: 3875697 - RNA, 12 nt, Human
uuaugaagaaaa

SEQ ID NO: 3875698 - RNA, 23 nt, Human
uuaugaagaaaaaauacauuuua

SEQ ID NO: 3875699 - RNA, 20 nt, Human
uuaugaagcuuuuaugugaa

SEQ ID NO: 3875700 - RNA, 13 nt, Human
uuaugaaguuuaa

SEQ ID NO: 3875701 - RNA, 14 nt, Human
uuaugaaguuuaaa

SEQ ID NO: 3875702 - RNA, 13 nt, Human
uuaugaaucagug

SEQ ID NO: 3875703 - RNA, 12 nt, Human
uuaugaaucuga

SEQ ID NO: 3875704 - RNA, 14 nt, Human
uuaugaaugaaaaa

SEQ ID NO: 3875705 - RNA, 19 nt, Human
uuaugaaugugaagccuuc

SEQ ID NO: 3875706 - RNA, 17 nt, Human
uuaugaauuacauuugu

SEQ ID NO: 3875707 - RNA, 24 nt, Human
uuaugacaguaauuguguuuacau

SEQ ID NO: 3875708 - RNA, 15 nt, Human
uuaugacuauguaaa

SEQ ID NO: 3875709 - RNA, 22 nt, Human
uuaugacuucauuaauaauaaa

SEQ ID NO: 3875710 - RNA, 22 nt, Human
uuaugagaaacuuaaauguuau

SEQ ID NO: 3875711 - RNA, 18 nt, Human
uuaugagaaauguaaugc

SEQ ID NO: 3875712 - RNA, 19 nt, Human
uuaugagauggaucacaua

SEQ ID NO: 3875713 - RNA, 18 nt, Human
uuaugagcucauguagca

SEQ ID NO: 3875714 - RNA, 14 nt, Human
uuaugagcuuccaa

SEQ ID NO: 3875715 - RNA, 19 nt, Human
uuaugaguuauucauauuc

SEQ ID NO: 3875716 - RNA, 21 nt, Human
uuaugaguuuuugauagcuuu

SEQ ID NO: 3875717 - RNA, 16 nt, Human
uuaugauaauagauuc

SEQ ID NO: 3875718 - RNA, 17 nt, Human
uuaugauaauagauucu

SEQ ID NO: 3875719 - RNA, 20 nt, Human
uuaugauacuugaaaauuaa

SEQ ID NO: 3875720 - RNA, 18 nt, Human
uuaugauagugguaugac

SEQ ID NO: 3875721 - RNA, 15 nt, Human
uuaugaucaguguug

SEQ ID NO: 3875722 - RNA, 18 nt, Human
uuaugauccagcagauua

SEQ ID NO: 3875723 - RNA, 16 nt, Human
uuaugauguauauuua

SEQ ID NO: 3875724 - RNA, 18 nt, Human
uuaugaugugcuuaacag

SEQ ID NO: 3875725 - RNA, 21 nt, Human
uuaugaugugggucaaggaau

SEQ ID NO: 3875726 - RNA, 15 nt, Human
uuaugauugccuuuu

SEQ ID NO: 3875727 - RNA, 20 nt, Human
uuaugauuuaauaaaauaau

SEQ ID NO: 3875728 - RNA, 14 nt, Human
uuaugcaaaaugga

SEQ ID NO: 3875729 - RNA, 15 nt, Human
uuaugcaaaauggaa

SEQ ID NO: 3875730 - RNA, 22 nt, Human
uuaugcaaggaaggaaagaaag

SEQ ID NO: 3875731 - RNA, 16 nt, Human
uuaugcacuuauaagg

SEQ ID NO: 3875732 - RNA, 19 nt, Human
uuaugcacuuauaaggugu

SEQ ID NO: 3875733 - RNA, 20 nt, Human
uuaugcagcuuccuuuugag

SEQ ID NO: 3875734 - RNA, 16 nt, Human
uuaugcagugcugcuu

SEQ ID NO: 3875735 - RNA, 16 nt, Human
uuaugcaucauuucag

SEQ ID NO: 3875736 - RNA, 22 nt, Human
uuaugcaugaagauaauguaaa

SEQ ID NO: 3875737 - RNA, 22 nt, Human
uuaugcaugaaguaauaugcac

SEQ ID NO: 3875738 - RNA, 13 nt, Human
uuaugccaccuga

SEQ ID NO: 3875739 - RNA, 16 nt, Human
uuaugcgguuaauuuu

SEQ ID NO: 3875740 - RNA, 16 nt, Human
uuaugcuaacuguaga

SEQ ID NO: 3875741 - RNA, 10 nt, Human
uuaugcuaag

SEQ ID NO: 3875742 - RNA, 20 nt, Human
uuaugcuaagaauuuuuuau

SEQ ID NO: 3875743 - RNA, 14 nt, Human
uuaugcugaguaug

SEQ ID NO: 3875744 - RNA, 16 nt, Human
uuaugcuguauuuucu

SEQ ID NO: 3875745 - RNA, 21 nt, Human
uuaugcuguauuuucuuuuua

SEQ ID NO: 3875746 - RNA, 17 nt, Human
uuaugcugugacacaug

SEQ ID NO: 3875747 - RNA, 16 nt, Human
uuaugcuuccagaaac

SEQ ID NO: 3875748 - RNA, 11 nt, Human
uuaugcuucuu

SEQ ID NO: 3875749 - RNA, 17 nt, Human
uuauggaacacucugag

SEQ ID NO: 3875750 - RNA, 19 nt, Human
uuauggaagauuuuaaauu

SEQ ID NO: 3875751 - RNA, 22 nt, Human
uuauggaagauuuuaaauucac

SEQ ID NO: 3875752 - RNA, 14 nt, Human
uuauggaauugauu

SEQ ID NO: 3875753 - RNA, 19 nt, Human
uuauggaauugauuugcau

SEQ ID NO: 3875754 - RNA, 19 nt, Human
uuauggagaccucuccuuc

SEQ ID NO: 3875755 - RNA, 21 nt, Human
uuauggagaccucuccuuccu

SEQ ID NO: 3875756 - RNA, 17 nt, Human
uuauggauaugaaaaau

SEQ ID NO: 3875757 - RNA, 17 nt, Human
uuauggaugauuuaagu

SEQ ID NO: 3875758 - RNA, 11 nt, Human
uuauggaugca

SEQ ID NO: 3875759 - RNA, 11 nt, Human
uuauggccuca

SEQ ID NO: 3875760 - RNA, 15 nt, Human
uuauggccucagcug

SEQ ID NO: 3875761 - RNA, 14 nt, Human
uuauggcugcauag

SEQ ID NO: 3875762 - RNA, 16 nt, Human
uuauggcuuuugugca

SEQ ID NO: 3875763 - RNA, 17 nt, Human
uuauggcuuuugugcau

SEQ ID NO: 3875764 - RNA, 24 nt, Human
uuaugggagcugucaagcauguau

SEQ ID NO: 3875765 - RNA, 17 nt, Human
uuaugggcauugacaaa

SEQ ID NO: 3875766 - RNA, 15 nt, Human
uuaugggucacagga

SEQ ID NO: 3875767 - RNA, 22 nt, Human
uuaugguaacugcuuucuguuc

SEQ ID NO: 3875768 - RNA, 22 nt, Human
uuauguaaaaggccaaaccucu

SEQ ID NO: 3875769 - RNA, 16 nt, Human
uuauguaaaauguuuu

SEQ ID NO: 3875770 - RNA, 23 nt, Human
uuauguaaacaaaucuuuccaua

SEQ ID NO: 3875771 - RNA, 16 nt, Human
uuauguaaauaauucu

SEQ ID NO: 3875772 - RNA, 12 nt, Human
uuauguaaaucc

SEQ ID NO: 3875773 - RNA, 16 nt, Human
uuauguaauaauguga

SEQ ID NO: 3875774 - RNA, 17 nt, Human
uuauguaauaaugugaa

SEQ ID NO: 3875775 - RNA, 11 nt, Human
uuauguaauuu

SEQ ID NO: 3875776 - RNA, 16 nt, Human
uuauguagaugugcau

SEQ ID NO: 3875777 - RNA, 16 nt, Human
uuauguagcucuuugu

SEQ ID NO: 3875778 - RNA, 21 nt, Human
uuauguauauuuaaaagaaag

SEQ ID NO: 3875779 - RNA, 19 nt, Human
uuauguauguuuacacugu

SEQ ID NO: 3875780 - RNA, 14 nt, Human
uuauguauugugca

SEQ ID NO: 3875781 - RNA, 20 nt, Human
uuauguauugugcaaugugu

SEQ ID NO: 3875782 - RNA, 17 nt, Human
uuauguccacuguguau

SEQ ID NO: 3875783 - RNA, 18 nt, Human
uuaugucccuucacauag

SEQ ID NO: 3875784 - RNA, 17 nt, Human
uuaugucuauuuaagcc

SEQ ID NO: 3875785 - RNA, 19 nt, Human
uuaugucugcugaauaaua

SEQ ID NO: 3875786 - RNA, 11 nt, Human
uuaugucuggg

SEQ ID NO: 3875787 - RNA, 17 nt, Human
uuaugucuguggauuuu

SEQ ID NO: 3875788 - RNA, 13 nt, Human
uuaugucuuuuau

SEQ ID NO: 3875789 - RNA, 21 nt, Human
uuaugucuuuugaugaauaga

SEQ ID NO: 3875790 - RNA, 18 nt, Human
uuaugugccguguuauug

SEQ ID NO: 3875791 - RNA, 16 nt, Human
uuaugugcgcugauaa

SEQ ID NO: 3875792 - RNA, 15 nt, Human
uuaugugcuauuaau

SEQ ID NO: 3875793 - RNA, 19 nt, Human
uuauguggguugccuggug

SEQ ID NO: 3875794 - RNA, 18 nt, Human
uuaugugguuuuagauuu

SEQ ID NO: 3875795 - RNA, 13 nt, Human
uuauguguaugug

SEQ ID NO: 3875796 - RNA, 18 nt, Human
uuauguguaugugccauu

SEQ ID NO: 3875797 - RNA, 18 nt, Human
uuauguguguauauguau

SEQ ID NO: 3875798 - RNA, 22 nt, Human
uuauguguguauauguaugugu

SEQ ID NO: 3875799 - RNA, 19 nt, Human
uuauguuaaaacugggaca

SEQ ID NO: 3875800 - RNA, 11 nt, Human
uuauguuaaac

SEQ ID NO: 3875801 - RNA, 12 nt, Human
uuauguuaaacu

SEQ ID NO: 3875802 - RNA, 15 nt, Human
uuauguuacaucugu

SEQ ID NO: 3875803 - RNA, 13 nt, Human
uuauguuauauau

SEQ ID NO: 3875804 - RNA, 15 nt, Human
uuauguuauauauaa

SEQ ID NO: 3875805 - RNA, 17 nt, Human
uuauguuauauauaaau

SEQ ID NO: 3875806 - RNA, 18 nt, Human
uuauguuauauauaaaua

SEQ ID NO: 3875807 - RNA, 16 nt, Human
uuauguuguuagagaa

SEQ ID NO: 3875808 - RNA, 19 nt, Human
uuauguuguuuauaauaaa

SEQ ID NO: 3875809 - RNA, 12 nt, Human
uuauguuugaau

SEQ ID NO: 3875810 - RNA, 13 nt, Human
uuauguuugaaua

SEQ ID NO: 3875811 - RNA, 11 nt, Human
uuauguuugcc

SEQ ID NO: 3875812 - RNA, 20 nt, Human
uuauguuugccacuuugcaa

SEQ ID NO: 3875813 - RNA, 16 nt, Human
uuauguuuuguuucug

SEQ ID NO: 3875814 - RNA, 17 nt, Human
uuauguuuuuguacucu

SEQ ID NO: 3875815 - RNA, 15 nt, Human
uucaaaccugugaag

SEQ ID NO: 3875816 - RNA, 13 nt, Human
uucaaacuacuuu

SEQ ID NO: 3875817 - RNA, 22 nt, Human
uucaaacuacuuugcugcuaau

SEQ ID NO: 3875818 - RNA, 17 nt, Human
uucaaacugaaaagcug

SEQ ID NO: 3875819 - RNA, 15 nt, Human
uucaaacuggggccu

SEQ ID NO: 3875820 - RNA, 12 nt, Human
uucaaacuguga

SEQ ID NO: 3875821 - RNA, 13 nt, Human
uucaaagaaucac

SEQ ID NO: 3875822 - RNA, 23 nt, Human
uucaaagagaaaacaucucauca

SEQ ID NO: 3875823 - RNA, 13 nt, Human
uucaaagaugcug

SEQ ID NO: 3875824 - RNA, 17 nt, Human
uucaaagauucaaaauu

SEQ ID NO: 3875825 - RNA, 21 nt, Human
uucaaagccagcguccuccuc

SEQ ID NO: 3875826 - RNA, 13 nt, Human
uucaaagccauuu

SEQ ID NO: 3875827 - RNA, 14 nt, Human
uucaaaggaacauu

SEQ ID NO: 3875828 - RNA, 22 nt, Human
uucaaagggacggucaguuugg

SEQ ID NO: 3875829 - RNA, 16 nt, Human
uucaaagguucuaggu

SEQ ID NO: 3875830 - RNA, 21 nt, Human
uucaaagguucuagguuucaa

SEQ ID NO: 3875831 - RNA, 18 nt, Human
uucaaagucaugauguuu

SEQ ID NO: 3875832 - RNA, 19 nt, Human
uucaaaguuuaauaaauuu

SEQ ID NO: 3875833 - RNA, 19 nt, Human
uucaaauagggucuaacuc

SEQ ID NO: 3875834 - RNA, 19 nt, Human
uucaaaugguuuaacaaaa

SEQ ID NO: 3875835 - RNA, 14 nt, Human
uucaaaugugcugu

SEQ ID NO: 3875836 - RNA, 18 nt, Human
uucaaauguguuuugguc

SEQ ID NO: 3875837 - RNA, 18 nt, Human
uucaaauuggacuuucaa

SEQ ID NO: 3875838 - RNA, 23 nt, Human
uucaaauuguaagcaugcacaaa

SEQ ID NO: 3875839 - RNA, 21 nt, Human
uucaaauugugugugcucugc

SEQ ID NO: 3875840 - RNA, 13 nt, Human
uucaaauuucaca

SEQ ID NO: 3875841 - RNA, 21 nt, Human
uucaaauuuuuuaaaagagac

SEQ ID NO: 3875842 - RNA, 21 nt, Human
uucaacaaagaaacaaagaug

SEQ ID NO: 3875843 - RNA, 20 nt, Human
uucaacaaauaucuuguguu

SEQ ID NO: 3875844 - RNA, 22 nt, Human
uucaacaaauauucacuggccc

SEQ ID NO: 3875845 - RNA, 19 nt, Human
uucaacaauucuaaaauga

SEQ ID NO: 3875846 - RNA, 16 nt, Human
uucaacaggagaauuu

SEQ ID NO: 3875847 - RNA, 18 nt, Human
uucaacagugaagacaga

SEQ ID NO: 3875848 - RNA, 19 nt, Human
uucaacagugaagacagaa

SEQ ID NO: 3875849 - RNA, 14 nt, Human
uucaacaucaaugu

SEQ ID NO: 3875850 - RNA, 15 nt, Human
uucaacauccugcca

SEQ ID NO: 3875851 - RNA, 15 nt, Human
uucaaccauggacuu

SEQ ID NO: 3875852 - RNA, 20 nt, Human
uucaaccccacccuguuugg

SEQ ID NO: 3875853 - RNA, 21 nt, Human
uucaaccccacccuguuugga

SEQ ID NO: 3875854 - RNA, 15 nt, Human
uucaacccuggagag

SEQ ID NO: 3875855 - RNA, 15 nt, Human
uucaaccucuagaau

SEQ ID NO: 3875856 - RNA, 15 nt, Human
uucaacguuucuuca

SEQ ID NO: 3875857 - RNA, 11 nt, Human
uucaacuauuu

SEQ ID NO: 3875858 - RNA, 16 nt, Human
uucaacuucaggaaag

SEQ ID NO: 3875859 - RNA, 18 nt, Human
uucaacuugugccuggga

SEQ ID NO: 3875860 - RNA, 21 nt, Human
uucaagaaaaaauaaauggaa

SEQ ID NO: 3875861 - RNA, 22 nt, Human
uucaagaaagcuucaaacugca

SEQ ID NO: 3875862 - RNA, 15 nt, Human
uucaagaaaugaaga

SEQ ID NO: 3875863 - RNA, 16 nt, Human
uucaagaaccuggaaa

SEQ ID NO: 3875864 - RNA, 23 nt, Human
uucaagaaguucuuugauucugu

SEQ ID NO: 3875865 - RNA, 23 nt, Human
uucaagaauaaucacgcuuuccu

SEQ ID NO: 3875866 - RNA, 21 nt, Human
uucaagaggagcccccacccu

SEQ ID NO: 3875867 - RNA, 17 nt, Human
uucaagaucccauuuga

SEQ ID NO: 3875868 - RNA, 23 nt, Human
uucaagaucuaaaucauauauaa

SEQ ID NO: 3875869 - RNA, 16 nt, Human
uucaagcagcaucuuc

SEQ ID NO: 3875870 - RNA, 17 nt, Human
uucaagcagucgugccu

SEQ ID NO: 3875871 - RNA, 23 nt, Human
uucaagcagucgugccugugucc

SEQ ID NO: 3875872 - RNA, 16 nt, Human
uucaagcgauucucuu

SEQ ID NO: 3875873 - RNA, 21 nt, Human
uucaagcgauucuucugcuuc

SEQ ID NO: 3875874 - RNA, 16 nt, Human
uucaagcucugaggga

SEQ ID NO: 3875875 - RNA, 14 nt, Human
uucaagcugcuuuu

SEQ ID NO: 3875876 - RNA, 17 nt, Human
uucaagcugcuuuuugu

SEQ ID NO: 3875877 - RNA, 19 nt, Human
uucaagcuuauuuuggaga

SEQ ID NO: 3875878 - RNA, 20 nt, Human
uucaagcuuauuuuggagag

SEQ ID NO: 3875879 - RNA, 12 nt, Human
uucaaggaauca

SEQ ID NO: 3875880 - RNA, 15 nt, Human
uucaaggauccugag

SEQ ID NO: 3875881 - RNA, 16 nt, Human
uucaaggauccugagc

SEQ ID NO: 3875882 - RNA, 15 nt, Human
uucaaggcuuccacu

SEQ ID NO: 3875883 - RNA, 16 nt, Human
uucaagggcugcuuca

SEQ ID NO: 3875884 - RNA, 24 nt, Human
uucaaggggagccaaaaucucaag

SEQ ID NO: 3875885 - RNA, 15 nt, Human
uucaagguaaaauuc

SEQ ID NO: 3875886 - RNA, 19 nt, Human
uucaagguaaaauucuaaa

SEQ ID NO: 3875887 - RNA, 19 nt, Human
uucaagguaauuucuugug

SEQ ID NO: 3875888 - RNA, 22 nt, Human
uucaaggucacuguuuccuggg

SEQ ID NO: 3875889 - RNA, 14 nt, Human
uucaaggugacaga

SEQ ID NO: 3875890 - RNA, 15 nt, Human
uucaaguauuuaagc

SEQ ID NO: 3875891 - RNA, 16 nt, Human
uucaaguauuuaagcc

SEQ ID NO: 3875892 - RNA, 22 nt, Human
uucaagugcaugcucucugcag

SEQ ID NO: 3875893 - RNA, 13 nt, Human
uucaagugccuuu

SEQ ID NO: 3875894 - RNA, 23 nt, Human
uucaagugccuuucugcaguuuu

SEQ ID NO: 3875895 - RNA, 22 nt, Human
uucaaguggggcucgccaugcc

SEQ ID NO: 3875896 - RNA, 17 nt, Human
uucaaguuaaauuuuau

SEQ ID NO: 3875897 - RNA, 16 nt, Human
uucaaguuagcucagg

SEQ ID NO: 3875898 - RNA, 17 nt, Human
uucaaguuagcucagga

SEQ ID NO: 3875899 - RNA, 22 nt, Human
uucaaguuguaaauaauuuauu

SEQ ID NO: 3875900 - RNA, 16 nt, Human
uucaaguuuuaaaguu

SEQ ID NO: 3875901 - RNA, 20 nt, Human
uucaauaaagcauuuauaaa

SEQ ID NO: 3875902 - RNA, 12 nt, Human
uucaauaaagcu

SEQ ID NO: 3875903 - RNA, 13 nt, Human
uucaauaaaguau

SEQ ID NO: 3875904 - RNA, 19 nt, Human
uucaauaaaguauuuaauu

SEQ ID NO: 3875905 - RNA, 13 nt, Human
uucaauaaaguuu

SEQ ID NO: 3875906 - RNA, 16 nt, Human
uucaauaaaguuugau

SEQ ID NO: 3875907 - RNA, 18 nt, Human
uucaauaaaugucuguug

SEQ ID NO: 3875908 - RNA, 22 nt, Human
uucaauacaaacaaucucuuaa

SEQ ID NO: 3875909 - RNA, 12 nt, Human
uucaauacagau

SEQ ID NO: 3875910 - RNA, 15 nt, Human
uucaauagccacuaa

SEQ ID NO: 3875911 - RNA, 17 nt, Human
uucaauagccacuaacc

SEQ ID NO: 3875912 - RNA, 21 nt, Human
uucaauaggaaaaacugauuu

SEQ ID NO: 3875913 - RNA, 15 nt, Human
uucaauauccuuugc

SEQ ID NO: 3875914 - RNA, 14 nt, Human
uucaauauugacau

SEQ ID NO: 3875915 - RNA, 16 nt, Human
uucaauauugacauuu

SEQ ID NO: 3875916 - RNA, 18 nt, Human
uucaauauugacauuugu

SEQ ID NO: 3875917 - RNA, 11 nt, Human
uucaauauuua

SEQ ID NO: 3875918 - RNA, 11 nt, Human
uucaauauuuu

SEQ ID NO: 3875919 - RNA, 16 nt, Human
uucaauauuuucuuuu

SEQ ID NO: 3875920 - RNA, 12 nt, Human
uucaaucacugu

SEQ ID NO: 3875921 - RNA, 22 nt, Human
uucaaucucguauagaagucuu

SEQ ID NO: 3875922 - RNA, 19 nt, Human
uucaaucuggauucauauu

SEQ ID NO: 3875923 - RNA, 15 nt, Human
uucaaucuguaaacu

SEQ ID NO: 3875924 - RNA, 17 nt, Human
uucaaucuguaaacugu

SEQ ID NO: 3875925 - RNA, 15 nt, Human
uucaaugaucuaggu

SEQ ID NO: 3875926 - RNA, 19 nt, Human
uucaaugaucuagguuuaa

SEQ ID NO: 3875927 - RNA, 22 nt, Human
uucaaugaucuagguuuaacuc

SEQ ID NO: 3875928 - RNA, 17 nt, Human
uucaaugggcucuucca

SEQ ID NO: 3875929 - RNA, 20 nt, Human
uucaaugguuugcaaggaag

SEQ ID NO: 3875930 - RNA, 15 nt, Human
uucaauguaauuaaa

SEQ ID NO: 3875931 - RNA, 14 nt, Human
uucaauguguauaa

SEQ ID NO: 3875932 - RNA, 21 nt, Human
uucaauguguauaaauugucu

SEQ ID NO: 3875933 - RNA, 19 nt, Human
uucaauucaaaaauguaca

SEQ ID NO: 3875934 - RNA, 13 nt, Human
uucaauucagugc

SEQ ID NO: 3875935 - RNA, 14 nt, Human
uucaauuccugggc

SEQ ID NO: 3875936 - RNA, 18 nt, Human
uucaauucucauuuguca

SEQ ID NO: 3875937 - RNA, 12 nt, Human
uucaauuguaaa

SEQ ID NO: 3875938 - RNA, 22 nt, Human
uucaauuugauguggugaaaag

SEQ ID NO: 3875939 - RNA, 14 nt, Human
uucaauuuuaaaga

SEQ ID NO: 3875940 - RNA, 15 nt, Human
uucacaaaauuucca

SEQ ID NO: 3875941 - RNA, 15 nt, Human
uucacaaagcccaag

SEQ ID NO: 3875942 - RNA, 11 nt, Human
uucacaaauau

SEQ ID NO: 3875943 - RNA, 14 nt, Human
uucacaaauauuaa

SEQ ID NO: 3875944 - RNA, 15 nt, Human
uucacaaauauuaaa

SEQ ID NO: 3875945 - RNA, 19 nt, Human
uucacaaauauuaaaaagu

SEQ ID NO: 3875946 - RNA, 20 nt, Human
uucacaaauauuaaaaaguc

SEQ ID NO: 3875947 - RNA, 22 nt, Human
uucacaaauauuaaaaagucuu

SEQ ID NO: 3875948 - RNA, 22 nt, Human
uucacaacagccugacaacauu

SEQ ID NO: 3875949 - RNA, 12 nt, Human
uucacaaccugg

SEQ ID NO: 3875950 - RNA, 23 nt, Human
uucacaagacccaaaaggcagaa

SEQ ID NO: 3875951 - RNA, 13 nt, Human
uucacaagcugcc

SEQ ID NO: 3875952 - RNA, 15 nt, Human
uucacaaguuaagau

SEQ ID NO: 3875953 - RNA, 13 nt, Human
uucacaauagaaa

SEQ ID NO: 3875954 - RNA, 13 nt, Human
uucacaauguggc

SEQ ID NO: 3875955 - RNA, 14 nt, Human
uucacaccccaccu

SEQ ID NO: 3875956 - RNA, 15 nt, Human
uucacaccccaccug

SEQ ID NO: 3875957 - RNA, 11 nt, Human
uucacacccug

SEQ ID NO: 3875958 - RNA, 19 nt, Human
uucacaccugacucugaaa

SEQ ID NO: 3875959 - RNA, 21 nt, Human
uucacacugcaagagccuugg

SEQ ID NO: 3875960 - RNA, 17 nt, Human
uucucaucacuccccuc

SEQ ID NO: 3875961 - RNA, 12 nt, Human
uucucaucagua

SEQ ID NO: 3875962 - RNA, 17 nt, Human
uucucaucccacgcacu

SEQ ID NO: 3875963 - RNA, 14 nt, Human
uucucaucugcacc

SEQ ID NO: 3875964 - RNA, 17 nt, Human
uucucaugauuuacaga

SEQ ID NO: 3875965 - RNA, 21 nt, Human
uucucaugccucagccuccug

SEQ ID NO: 3875966 - RNA, 17 nt, Human
uucucaugugauccuuu

SEQ ID NO: 3875967 - RNA, 18 nt, Human
uucucaugugauccuuuu

SEQ ID NO: 3875968 - RNA, 20 nt, Human
uucucauguugaagccacug

SEQ ID NO: 3875969 - RNA, 21 nt, Human
uucucauuacuuguugccuau

SEQ ID NO: 3875970 - RNA, 11 nt, Human
uucucauucuu

SEQ ID NO: 3875971 - RNA, 21 nt, Human
uucucauuggaaauuuagcau

SEQ ID NO: 3875972 - RNA, 19 nt, Human
uucucauuucaccccuccc

SEQ ID NO: 3875973 - RNA, 17 nt, Human
uucucauuuuuuaaaaa

SEQ ID NO: 3875974 - RNA, 22 nt, Human
uucucauuuuuuaaaaaagcuu

SEQ ID NO: 3875975 - RNA, 23 nt, Human
uucucauuuuuuaaaaaagcuua

SEQ ID NO: 3875976 - RNA, 22 nt, Human
uucuccaacaucacagcccagc

SEQ ID NO: 3875977 - RNA, 16 nt, Human
uucuccaagcaggaca

SEQ ID NO: 3875978 - RNA, 19 nt, Human
uucuccaauaucagugcuc

SEQ ID NO: 3875979 - RNA, 15 nt, Human
uucuccacagcaacc

SEQ ID NO: 3875980 - RNA, 13 nt, Human
uucuccacccugc

SEQ ID NO: 3875981 - RNA, 16 nt, Human
uucuccacccugcucu

SEQ ID NO: 3875982 - RNA, 14 nt, Human
uucuccagaaccca

SEQ ID NO: 3875983 - RNA, 19 nt, Human
uucuccagacccaccacac

SEQ ID NO: 3875984 - RNA, 17 nt, Human
uucuccagauuuuuaau

SEQ ID NO: 3875985 - RNA, 17 nt, Human
uucuccagccuggaccc

SEQ ID NO: 3875986 - RNA, 14 nt, Human
uucuccagcucaga

SEQ ID NO: 3875987 - RNA, 17 nt, Human
uucuccagucauuaugu

SEQ ID NO: 3875988 - RNA, 15 nt, Human
uucuccauccuacca

SEQ ID NO: 3875989 - RNA, 19 nt, Human
uucuccaucucucuggccc

SEQ ID NO: 3875990 - RNA, 18 nt, Human
uucuccauggcccugcca

SEQ ID NO: 3875991 - RNA, 12 nt, Human
uucucccaggaa

SEQ ID NO: 3875992 - RNA, 13 nt, Human
uucuccccagaau

SEQ ID NO: 3875993 - RNA, 12 nt, Human
uucuccccagcu

SEQ ID NO: 3875994 - RNA, 21 nt, Human
uucucccccauguucuguccc

SEQ ID NO: 3875995 - RNA, 17 nt, Human
uucucccccccggggcu

SEQ ID NO: 3875996 - RNA, 18 nt, Human
uucucccccugggcucug

SEQ ID NO: 3875997 - RNA, 16 nt, Human
uucuccccugcacugu

SEQ ID NO: 3875998 - RNA, 15 nt, Human
uucuccccugccccc

SEQ ID NO: 3875999 - RNA, 23 nt, Human
uucuccccugcccccaggacugg

SEQ ID NO: 3876000 - RNA, 13 nt, Human
uucuccccuucca

SEQ ID NO: 3876001 - RNA, 22 nt, Human
uucuccccuuccauuucugccu

SEQ ID NO: 3876002 - RNA, 20 nt, Human
uucucccuccuucccuuccu

SEQ ID NO: 3876003 - RNA, 15 nt, Human
uucuccgccagccuc

SEQ ID NO: 3876004 - RNA, 20 nt, Human
uucuccgccagccuccucug

SEQ ID NO: 3876005 - RNA, 16 nt, Human
uucuccguuagcuccu

SEQ ID NO: 3876006 - RNA, 17 nt, Human
uucuccguuagcuccug

SEQ ID NO: 3876007 - RNA, 19 nt, Human
uucuccguuagcuccugug

SEQ ID NO: 3876008 - RNA, 18 nt, Human
uucuccucacuguaucca

SEQ ID NO: 3876009 - RNA, 19 nt, Human
uucuccucccuuccuuuuc

SEQ ID NO: 3876010 - RNA, 14 nt, Human
uucuccucuccccu

SEQ ID NO: 3876011 - RNA, 13 nt, Human
uucuccucuugua

SEQ ID NO: 3876012 - RNA, 14 nt, Human
uucuccucuuguaa

SEQ ID NO: 3876013 - RNA, 17 nt, Human
uucuccucuuguaaaua

SEQ ID NO: 3876014 - RNA, 12 nt, Human
uucuccugccuc

SEQ ID NO: 3876015 - RNA, 13 nt, Human
uucuccugccuca

SEQ ID NO: 3876016 - RNA, 15 nt, Human
uucuccugccugugc

SEQ ID NO: 3876017 - RNA, 22 nt, Human
uucuccugcugcucccucagac

SEQ ID NO: 3876018 - RNA, 20 nt, Human
uucuccuuaagagacaauuu

SEQ ID NO: 3876019 - RNA, 15 nt, Human
uucuccuuagucuuc

SEQ ID NO: 3876020 - RNA, 20 nt, Human
uucuccuuagucuucucaua

SEQ ID NO: 3876021 - RNA, 18 nt, Human
uucuccuuucacaaccuu

SEQ ID NO: 3876022 - RNA, 22 nt, Human
uucuccuuucacaaccuucugu

SEQ ID NO: 3876023 - RNA, 20 nt, Human
uucuccuuugauaaaauaaa

SEQ ID NO: 3876024 - RNA, 14 nt, Human
uucuccuuuguacu

SEQ ID NO: 3876025 - RNA, 16 nt, Human
uucuccuuuugaaaag

SEQ ID NO: 3876026 - RNA, 17 nt, Human
uucucgauuuuaucuuu

SEQ ID NO: 3876027 - RNA, 19 nt, Human
uucucguccucguuugugu

SEQ ID NO: 3876028 - RNA, 17 nt, Human
uucucgugccuccccac

SEQ ID NO: 3876029 - RNA, 23 nt, Human
uucucuaaaugaggggccucagg

SEQ ID NO: 3876030 - RNA, 19 nt, Human
uucucuaagagaacaaugu

SEQ ID NO: 3876031 - RNA, 24 nt, Human
uucucuaagagaacaaugugcuau

SEQ ID NO: 3876032 - RNA, 20 nt, Human
uucucuaaguuccacugagc

SEQ ID NO: 3876033 - RNA, 14 nt, Human
uucucuaauaauaa

SEQ ID NO: 3876034 - RNA, 20 nt, Human
uucucuaauaauaaauaguu

SEQ ID NO: 3876035 - RNA, 20 nt, Human
uucucuaguuugauuaaauu

SEQ ID NO: 3876036 - RNA, 21 nt, Human
uucucuaguuugauuaaauuc

SEQ ID NO: 3876037 - RNA, 15 nt, Human
uucucuauuaaaaug

SEQ ID NO: 3876038 - RNA, 15 nt, Human
uucucucaacaccau

SEQ ID NO: 3876039 - RNA, 11 nt, Human
uucucucagac

SEQ ID NO: 3876040 - RNA, 20 nt, Human
uucucucagccuuacauuug

SEQ ID NO: 3876041 - RNA, 23 nt, Human
uucucucaucucuuagcuccccu

SEQ ID NO: 3876042 - RNA, 13 nt, Human
uucucuccagccc

SEQ ID NO: 3876043 - RNA, 16 nt, Human
uucucuccagccccug

SEQ ID NO: 3876044 - RNA, 14 nt, Human
uucucuccccaacc

SEQ ID NO: 3876045 - RNA, 18 nt, Human
uucucucccugccagagg

SEQ ID NO: 3876046 - RNA, 14 nt, Human
uucucuccucccca

SEQ ID NO: 3876047 - RNA, 22 nt, Human
uucucuccuguaccucuugagc

SEQ ID NO: 3876048 - RNA, 16 nt, Human
uucucucuccugucca

SEQ ID NO: 3876049 - RNA, 21 nt, Human
uucucucugccugugagccag

SEQ ID NO: 3876050 - RNA, 20 nt, Human
uucucucuuuauacagcugu

SEQ ID NO: 3876051 - RNA, 20 nt, Human
uucucugaacacaggcagcu

SEQ ID NO: 3876052 - RNA, 15 nt, Human
uucucugaagggagg

SEQ ID NO: 3876053 - RNA, 12 nt, Human
uucucugacuuc

SEQ ID NO: 3876054 - RNA, 16 nt, Human
uucucugacuucugcc

SEQ ID NO: 3876055 - RNA, 18 nt, Human
uucucugaggaagcuggg

SEQ ID NO: 3876056 - RNA, 20 nt, Human
uucucugaggacaagagaaa

SEQ ID NO: 3876057 - RNA, 20 nt, Human
uucucugaggacacuaacca

SEQ ID NO: 3876058 - RNA, 15 nt, Human
uucucugcccagcuu

SEQ ID NO: 3876059 - RNA, 18 nt, Human
uucucugcccagcuuuuc

SEQ ID NO: 3876060 - RNA, 21 nt, Human
uucucugccgcuaccucccuc

SEQ ID NO: 3876061 - RNA, 19 nt, Human
uucucugccuuugacauuu

SEQ ID NO: 3876062 - RNA, 20 nt, Human
uucucugccuuugacauuua

SEQ ID NO: 3876063 - RNA, 14 nt, Human
uucucugcuccacc

SEQ ID NO: 3876064 - RNA, 17 nt, Human
uucucuggagccaaguc

SEQ ID NO: 3876065 - RNA, 16 nt, Human
uucucugggagaaaau

SEQ ID NO: 3876066 - RNA, 19 nt, Human
uucucugggagaaaaucau

SEQ ID NO: 3876067 - RNA, 23 nt, Human
uucucugggagaaaaucaucaag

SEQ ID NO: 3876068 - RNA, 13 nt, Human
uucucuguacuuu

SEQ ID NO: 3876069 - RNA, 17 nt, Human
uucucugucucagacuu

SEQ ID NO: 3876070 - RNA, 17 nt, Human
uucucugucucauccau

SEQ ID NO: 3876071 - RNA, 19 nt, Human
uucucugugacccacuucu

SEQ ID NO: 3876072 - RNA, 20 nt, Human
uucucuguugucguaaagau

SEQ ID NO: 3876073 - RNA, 22 nt, Human
uucucuguugucguaaagauuu

SEQ ID NO: 3876074 - RNA, 15 nt, Human
uucucuuaauuuaau

SEQ ID NO: 3876075 - RNA, 12 nt, Human
uucucuuagaaa

SEQ ID NO: 3876076 - RNA, 18 nt, Human
uucucuuagcaacucaga

SEQ ID NO: 3876077 - RNA, 19 nt, Human
uucucuucauauucagcuu

SEQ ID NO: 3876078 - RNA, 12 nt, Human
uucucuuccugu

SEQ ID NO: 3876079 - RNA, 12 nt, Human
uucucuucucug

SEQ ID NO: 3876080 - RNA, 14 nt, Human
uucucuugagcugg

SEQ ID NO: 3876081 - RNA, 20 nt, Human
uucucuugagcuggccucuc

SEQ ID NO: 3876082 - RNA, 12 nt, Human
uucucuugccuc

SEQ ID NO: 3876083 - RNA, 15 nt, Human
uucucuugggcugag

SEQ ID NO: 3876084 - RNA, 21 nt, Human
uucucuugguguuaaaacacu

SEQ ID NO: 3876085 - RNA, 19 nt, Human
uucucuuguauaagauccu

SEQ ID NO: 3876086 - RNA, 15 nt, Human
uucucuuuaacucag

SEQ ID NO: 3876087 - RNA, 13 nt, Human
uucucuuucaaag

SEQ ID NO: 3876088 - RNA, 16 nt, Human
uucucuuuccaugaca

SEQ ID NO: 3876089 - RNA, 14 nt, Human
uucucuuucucucc

SEQ ID NO: 3876090 - RNA, 16 nt, Human
uucucuuucucuccuu

SEQ ID NO: 3876091 - RNA, 16 nt, Human
uucucuuucuuuacaa

SEQ ID NO: 3876092 - RNA, 22 nt, Human
uucucuuucuuuacaagauggg

SEQ ID NO: 3876093 - RNA, 22 nt, Human
uucucuuugauuauuugcaugu

SEQ ID NO: 3876094 - RNA, 15 nt, Human
uucucuuugccucaa

SEQ ID NO: 3876095 - RNA, 17 nt, Human
uucucuuugguguacaa

SEQ ID NO: 3876096 - RNA, 16 nt, Human
uucucuuuucaaaaca

SEQ ID NO: 3876097 - RNA, 21 nt, Human
uucucuuuucaagaaguucuu

SEQ ID NO: 3876098 - RNA, 19 nt, Human
uucugaaaauuaacacugc

SEQ ID NO: 3876099 - RNA, 16 nt, Human
uucugaaaauuccaga

SEQ ID NO: 3876100 - RNA, 13 nt, Human
uucugaaacuaau

SEQ ID NO: 3876101 - RNA, 18 nt, Human
uucugaaacuaaugaaag

SEQ ID NO: 3876102 - RNA, 15 nt, Human
uucugaaagggacgc

SEQ ID NO: 3876103 - RNA, 14 nt, Human
uucugaaauauuuu

SEQ ID NO: 3876104 - RNA, 20 nt, Human
uucugaaaugucaguucuga

SEQ ID NO: 3876105 - RNA, 13 nt, Human
uucuuauaaauau

SEQ ID NO: 3876106 - RNA, 17 nt, Human
uucuuauaaauaugaag

SEQ ID NO: 3876107 - RNA, 13 nt, Human
uucuuauaauacu

SEQ ID NO: 3876108 - RNA, 19 nt, Human
uucuuauaauacucuguug

SEQ ID NO: 3876109 - RNA, 23 nt, Human
uucuuaugccauguuaauuucau

SEQ ID NO: 3876110 - RNA, 15 nt, Human
uucuuauggaauuga

SEQ ID NO: 3876111 - RNA, 17 nt, Human
uucuuauggaauugauu

SEQ ID NO: 3876112 - RNA, 13 nt, Human
uucuuaugugaca

SEQ ID NO: 3876113 - RNA, 16 nt, Human
uucuuaugugacauua

SEQ ID NO: 3876114 - RNA, 20 nt, Human
uucuuaugugacauuaacaa

SEQ ID NO: 3876115 - RNA, 19 nt, Human
uucuuauugcgcugcuacc

SEQ ID NO: 3876116 - RNA, 15 nt, Human
uucuuauugcuuuua

SEQ ID NO: 3876117 - RNA, 21 nt, Human
uucuuauuuaaucuuuucuua

SEQ ID NO: 3876118 - RNA, 11 nt, Human
uucuucaaaau

SEQ ID NO: 3876119 - RNA, 21 nt, Human
uucuucaaaauauaaaaugcc

SEQ ID NO: 3876120 - RNA, 23 nt, Human
uucuucaaaauauaaaaugccaa

SEQ ID NO: 3876121 - RNA, 15 nt, Human
uucuucaaaauguau

SEQ ID NO: 3876122 - RNA, 17 nt, Human
uucuucaaccagcagau

SEQ ID NO: 3876123 - RNA, 14 nt, Human
uucuucacccagcu

SEQ ID NO: 3876124 - RNA, 14 nt, Human
uucuucacugcaac

SEQ ID NO: 3876125 - RNA, 14 nt, Human
uucuucagaagaca

SEQ ID NO: 3876126 - RNA, 13 nt, Human
uucuucagagacu

SEQ ID NO: 3876127 - RNA, 17 nt, Human
uucuucagaucagugcu

SEQ ID NO: 3876128 - RNA, 23 nt, Human
uucuucaggcugccuaagacaug

SEQ ID NO: 3876129 - RNA, 24 nt, Human
uucuucaggcugccuaagacaugu

SEQ ID NO: 3876130 - RNA, 13 nt, Human
uucuucaguuggu

SEQ ID NO: 3876131 - RNA, 21 nt, Human
uucuucauccggcagccugga

SEQ ID NO: 3876132 - RNA, 20 nt, Human
uucuuccaggugcccagcua

SEQ ID NO: 3876133 - RNA, 14 nt, Human
uucuuccaucugau

SEQ ID NO: 3876134 - RNA, 19 nt, Human
uucuucccaacuugccuuu

SEQ ID NO: 3876135 - RNA, 21 nt, Human
uucuucccaacuugccuuuga

SEQ ID NO: 3876136 - RNA, 20 nt, Human
uucuucccaauagcaaggcu

SEQ ID NO: 3876137 - RNA, 17 nt, Human
uucuucccauucuccau

SEQ ID NO: 3876138 - RNA, 18 nt, Human
uucuucccuuaaaauuua

SEQ ID NO: 3876139 - RNA, 22 nt, Human
uucuucccuuuuaaacacauuu

SEQ ID NO: 3876140 - RNA, 16 nt, Human
uucuuccucagccagc

SEQ ID NO: 3876141 - RNA, 13 nt, Human
uucuuccucugcu

SEQ ID NO: 3876142 - RNA, 18 nt, Human
uucuuccuuaaacuccug

SEQ ID NO: 3876143 - RNA, 17 nt, Human
uucuuccuuuacuuucc

SEQ ID NO: 3876144 - RNA, 17 nt, Human
uucuucgggaagagagg

SEQ ID NO: 3876145 - RNA, 15 nt, Human
uucuucuagaguuca

SEQ ID NO: 3876146 - RNA, 20 nt, Human
uucuucuauugccucugaga

SEQ ID NO: 3876147 - RNA, 23 nt, Human
uucuucucaggcaugaacaugua

SEQ ID NO: 3876148 - RNA, 13 nt, Human
uucuucucccuca

SEQ ID NO: 3876149 - RNA, 17 nt, Human
uucuucuccuaugugua

SEQ ID NO: 3876150 - RNA, 14 nt, Human
uucuucugaggccu

SEQ ID NO: 3876151 - RNA, 13 nt, Human
uucuucugcuuca

SEQ ID NO: 3876152 - RNA, 20 nt, Human
uucuucugcuucagccuccc

SEQ ID NO: 3876153 - RNA, 13 nt, Human
uucuucuguaaua

SEQ ID NO: 3876154 - RNA, 14 nt, Human
uucuucuguaauau

SEQ ID NO: 3876155 - RNA, 13 nt, Human
uucuucuguauuu

SEQ ID NO: 3876156 - RNA, 21 nt, Human
uucuucuguguuuauaaaaua

SEQ ID NO: 3876157 - RNA, 16 nt, Human
uucuucuugaggggaa

SEQ ID NO: 3876158 - RNA, 17 nt, Human
uucuucuuuuugcuuca

SEQ ID NO: 3876159 - RNA, 16 nt, Human
uucuugaaagaagaau

SEQ ID NO: 3876160 - RNA, 14 nt, Human
uucuugaaagcugu

SEQ ID NO: 3876161 - RNA, 15 nt, Human
uucuugaaagcugug

SEQ ID NO: 3876162 - RNA, 21 nt, Human
uucuugaggggaagcuagucu

SEQ ID NO: 3876163 - RNA, 20 nt, Human
uucuugauguaaaaucuugu

SEQ ID NO: 3876164 - RNA, 18 nt, Human
uucuugauuaaagugauu

SEQ ID NO: 3876165 - RNA, 12 nt, Human
uucuugcaaagu

SEQ ID NO: 3876166 - RNA, 13 nt, Human
uucuugcaaagua

SEQ ID NO: 3876167 - RNA, 14 nt, Human
uucuugcauauuuu

SEQ ID NO: 3876168 - RNA, 16 nt, Human
uucuugcauccuuccu

SEQ ID NO: 3876169 - RNA, 12 nt, Human
uucuugccucau

SEQ ID NO: 3876170 - RNA, 18 nt, Human
uucuugccugaacuccug

SEQ ID NO: 3876171 - RNA, 22 nt, Human
uucuugcgauaguuuacugaga

SEQ ID NO: 3876172 - RNA, 17 nt, Human
uucuugcucccuucagc

SEQ ID NO: 3876173 - RNA, 22 nt, Human
uucuugcucgggucccuucacc

SEQ ID NO: 3876174 - RNA, 12 nt, Human
uucuugcugccc

SEQ ID NO: 3876175 - RNA, 14 nt, Human
uucuugcugcccug

SEQ ID NO: 3876176 - RNA, 18 nt, Human
uucuugcugcccugcccc

SEQ ID NO: 3876177 - RNA, 16 nt, Human
uucuugcugcuagaac

SEQ ID NO: 3876178 - RNA, 23 nt, Human
uucuugcugguugucauuuuugc

SEQ ID NO: 3876179 - RNA, 12 nt, Human
uucuugcuugua

SEQ ID NO: 3876180 - RNA, 21 nt, Human
uucuuggcaauaaauuuugaa

SEQ ID NO: 3876181 - RNA, 21 nt, Human
uucuugguaaaguccuuuucu

SEQ ID NO: 3876182 - RNA, 14 nt, Human
uucuugguagagau

SEQ ID NO: 3876183 - RNA, 16 nt, Human
uucuugguagagauuc

SEQ ID NO: 3876184 - RNA, 21 nt, Human
uucuugguauuuggauaucug

SEQ ID NO: 3876185 - RNA, 21 nt, Human
uucuuggugcuuacacaucuc

SEQ ID NO: 3876186 - RNA, 15 nt, Human
uucuugguuuguaaa

SEQ ID NO: 3876187 - RNA, 23 nt, Human
uucuugguuuguaaauuaacuuu

SEQ ID NO: 3876188 - RNA, 22 nt, Human
uucuuguaaauguguuggacaa

SEQ ID NO: 3876189 - RNA, 12 nt, Human
uucuuguaauuu

SEQ ID NO: 3876190 - RNA, 12 nt, Human
uucuuguacagu

SEQ ID NO: 3876191 - RNA, 12 nt, Human
uucuuguaucug

SEQ ID NO: 3876192 - RNA, 13 nt, Human
uucuugucaaaaa

SEQ ID NO: 3876193 - RNA, 16 nt, Human
uucuugucagacauaa

SEQ ID NO: 3876194 - RNA, 20 nt, Human
uucuugucagacauaaagcc

SEQ ID NO: 3876195 - RNA, 13 nt, Human
uucuugucuauaa

SEQ ID NO: 3876196 - RNA, 21 nt, Human
uucuugucuauaaagcauuua

SEQ ID NO: 3876197 - RNA, 23 nt, Human
uucuugucuauaguugucaguau

SEQ ID NO: 3876198 - RNA, 22 nt, Human
uucuugugacagauuauacaga

SEQ ID NO: 3876199 - RNA, 17 nt, Human
uucuugugaucuugcuc

SEQ ID NO: 3876200 - RNA, 22 nt, Human
uucuugugccauagucacaugg

SEQ ID NO: 3876201 - RNA, 17 nt, Human
uucuuguuggugcacag

SEQ ID NO: 3876202 - RNA, 15 nt, Human
uucuuguuuauugag

SEQ ID NO: 3876203 - RNA, 14 nt, Human
uucuuguuuccuug

SEQ ID NO: 3876204 - RNA, 16 nt, Human
uucuuguuuugcuucc

SEQ ID NO: 3876205 - RNA, 16 nt, Human
uucuuuaaaagaauga

SEQ ID NO: 3876206 - RNA, 17 nt, Human
uucuuuaaaagaaugac

SEQ ID NO: 3876207 - RNA, 18 nt, Human
uucuuuaaaagaaugacu

SEQ ID NO: 3876208 - RNA, 19 nt, Human
uucuuuaaaagaaugggca

SEQ ID NO: 3876209 - RNA, 20 nt, Human
uucuuuaaaauguaaagcca

SEQ ID NO: 3876210 - RNA, 22 nt, Human
uucuuuaaagaaguugaaguuu

SEQ ID NO: 3876211 - RNA, 14 nt, Human
uucuuuaaccaguc

SEQ ID NO: 3876212 - RNA, 16 nt, Human
uucuuuaaccuuguau

SEQ ID NO: 3876213 - RNA, 21 nt, Human
uucuuuaagaauuacagguug

SEQ ID NO: 3876214 - RNA, 18 nt, Human
uucuuuaaugcuuuuaua

SEQ ID NO: 3876215 - RNA, 12 nt, Human
uucuuuaauuuu

SEQ ID NO: 3876216 - RNA, 18 nt, Human
uucuuuaauuuuggaauu

SEQ ID NO: 3876217 - RNA, 11 nt, Human
uucuuuacaaa

SEQ ID NO: 3876218 - RNA, 14 nt, Human
uucuuuaccugaga

SEQ ID NO: 3876219 - RNA, 23 nt, Human
uucuuuagagaacugaaaagaga

SEQ ID NO: 3876220 - RNA, 12 nt, Human
uucuuuagucuu

SEQ ID NO: 3876221 - RNA, 19 nt, Human
uucuuucaagggcuuuccu

SEQ ID NO: 3876222 - RNA, 20 nt, Human
uucuuucaagugaaucuaaa

SEQ ID NO: 3876223 - RNA, 22 nt, Human
uucuuucaagugaaucuaaaag

SEQ ID NO: 3876224 - RNA, 18 nt, Human
uucuuucaauacagauau

SEQ ID NO: 3876225 - RNA, 15 nt, Human
uucuuucaauucugu

SEQ ID NO: 3876226 - RNA, 13 nt, Human
uucuuucauuucu

SEQ ID NO: 3876227 - RNA, 14 nt, Human
uucuuucauuuucu

SEQ ID NO: 3876228 - RNA, 14 nt, Human
uucuuuccaaagua

SEQ ID NO: 3876229 - RNA, 21 nt, Human
uucuuuccaaaguacacuguu

SEQ ID NO: 3876230 - RNA, 18 nt, Human
uucuuuccacagaagcuc

SEQ ID NO: 3876231 - RNA, 16 nt, Human
uucuuucccagugagu

SEQ ID NO: 3876232 - RNA, 21 nt, Human
uucuuuccugaggcugggcuc

SEQ ID NO: 3876233 - RNA, 18 nt, Human
uucuuucuaguggucuuu

SEQ ID NO: 3876234 - RNA, 16 nt, Human
uucuuucuauuugacu

SEQ ID NO: 3876235 - RNA, 15 nt, Human
uucuuucucacuaaa

SEQ ID NO: 3876236 - RNA, 23 nt, Human
uucuuucucucagccuuacauuu

SEQ ID NO: 3876237 - RNA, 22 nt, Human
uucuuucuggcuaugcauuuga

SEQ ID NO: 3876238 - RNA, 13 nt, Human
uucuuucuuagaa

SEQ ID NO: 3876239 - RNA, 14 nt, Human
uucuuucuuagaaa

SEQ ID NO: 3876240 - RNA, 15 nt, Human
uucuuucuuagaaau

SEQ ID NO: 3876241 - RNA, 11 nt, Human
uucuuugaaaa

SEQ ID NO: 3876242 - RNA, 15 nt, Human
uucuuugaaauuguu

SEQ ID NO: 3876243 - RNA, 14 nt, Human
uucuuugaauaaau

SEQ ID NO: 3876244 - RNA, 11 nt, Human
uucuuugaaug

SEQ ID NO: 3876245 - RNA, 17 nt, Human
uucuuugaauuuucauu

SEQ ID NO: 3876246 - RNA, 17 nt, Human
uucuuugagacuggguc

SEQ ID NO: 3876247 - RNA, 22 nt, Human
uucuuugagggacugccucugc

SEQ ID NO: 3876248 - RNA, 15 nt, Human
uucuuugaucaugaa

SEQ ID NO: 3876249 - RNA, 17 nt, Human
uucuuugaucaugaaua

SEQ ID NO: 3876250 - RNA, 22 nt, Human
uucuuugauguuaacacauuuu

SEQ ID NO: 3876251 - RNA, 23 nt, Human
uuguagcauauaggugauguuug

SEQ ID NO: 3876252 - RNA, 17 nt, Human
uuguagcauccucuuua

SEQ ID NO: 3876253 - RNA, 16 nt, Human
uuguagcauccuggaa

SEQ ID NO: 3876254 - RNA, 16 nt, Human
uuguagcauuucuuga

SEQ ID NO: 3876255 - RNA, 15 nt, Human
uuguagccagccggg

SEQ ID NO: 3876256 - RNA, 17 nt, Human
uuguagcccaggcugga

SEQ ID NO: 3876257 - RNA, 15 nt, Human
uuguagccuuuugac

SEQ ID NO: 3876258 - RNA, 14 nt, Human
uuguagcuggggcu

SEQ ID NO: 3876259 - RNA, 13 nt, Human
uuguagcuguaaa

SEQ ID NO: 3876260 - RNA, 20 nt, Human
uuguaggagcugagguuuca

SEQ ID NO: 3876261 - RNA, 17 nt, Human
uuguaggauaagugaaa

SEQ ID NO: 3876262 - RNA, 16 nt, Human
uuguagggaugccuuu

SEQ ID NO: 3876263 - RNA, 20 nt, Human
uuguaggggucaaagaaaug

SEQ ID NO: 3876264 - RNA, 15 nt, Human
uuguagguaaaaugu

SEQ ID NO: 3876265 - RNA, 23 nt, Human
uuguaguagcguuuuuuaaaugu

SEQ ID NO: 3876266 - RNA, 23 nt, Human
uuguagugcuuugagagagaaag

SEQ ID NO: 3876267 - RNA, 19 nt, Human
uuguaguguucagaaaaaa

SEQ ID NO: 3876268 - RNA, 23 nt, Human
uuguaguguuggagaagaacuga

SEQ ID NO: 3876269 - RNA, 13 nt, Human
uuguaguuccacu

SEQ ID NO: 3876270 - RNA, 14 nt, Human
uuguaguuguuuua

SEQ ID NO: 3876271 - RNA, 13 nt, Human
uuguaguuuaccu

SEQ ID NO: 3876272 - RNA, 12 nt, Human
uuguauaaaaau

SEQ ID NO: 3876273 - RNA, 15 nt, Human
uuguauaaaauaauu

SEQ ID NO: 3876274 - RNA, 17 nt, Human
uuguauaaaauaauuuu

SEQ ID NO: 3876275 - RNA, 19 nt, Human
uuguauaaaauaauuuuua

SEQ ID NO: 3876276 - RNA, 13 nt, Human
uuguauaaaugua

SEQ ID NO: 3876277 - RNA, 17 nt, Human
uuguauaaauguauaua

SEQ ID NO: 3876278 - RNA, 22 nt, Human
uuguauaaauguauauacacau

SEQ ID NO: 3876279 - RNA, 19 nt, Human
uuguauaaauuuauuuacu

SEQ ID NO: 3876280 - RNA, 13 nt, Human
uuguauaacaggu

SEQ ID NO: 3876281 - RNA, 14 nt, Human
uuguauaacagguu

SEQ ID NO: 3876282 - RNA, 21 nt, Human
uuguauaagauuagaaugaaa

SEQ ID NO: 3876283 - RNA, 15 nt, Human
uuguauaauauugaa

SEQ ID NO: 3876284 - RNA, 16 nt, Human
uuguauaauauugaaa

SEQ ID NO: 3876285 - RNA, 13 nt, Human
uuguauaauugua

SEQ ID NO: 3876286 - RNA, 14 nt, Human
uuguauaauuucga

SEQ ID NO: 3876287 - RNA, 16 nt, Human
uuguauacaaauauau

SEQ ID NO: 3876288 - RNA, 22 nt, Human
uuguauacaaauauauuguuaa

SEQ ID NO: 3876289 - RNA, 18 nt, Human
uuguauacauccugggua

SEQ ID NO: 3876290 - RNA, 19 nt, Human
uuguauacauccuggguaa

SEQ ID NO: 3876291 - RNA, 15 nt, Human
uuguauacuuuaaau

SEQ ID NO: 3876292 - RNA, 21 nt, Human
uuguauacuuuaaauaauuua

SEQ ID NO: 3876293 - RNA, 22 nt, Human
uuguauacuuuaaauaauuuaa

SEQ ID NO: 3876294 - RNA, 15 nt, Human
uuguauaguaaagug

SEQ ID NO: 3876295 - RNA, 19 nt, Human
uuguauaguuaacacacua

SEQ ID NO: 3876296 - RNA, 14 nt, Human
uuguauaguuaugu

SEQ ID NO: 3876297 - RNA, 21 nt, Human
uuguauaguuauguaaauaau

SEQ ID NO: 3876298 - RNA, 20 nt, Human
uuguauaguugcuugccuga

SEQ ID NO: 3876299 - RNA, 13 nt, Human
uuguauauaucug

SEQ ID NO: 3876300 - RNA, 19 nt, Human
uuguauauaucugcuucag

SEQ ID NO: 3876301 - RNA, 14 nt, Human
uuguauauaugugu

SEQ ID NO: 3876302 - RNA, 21 nt, Human
uuguauauauuauuauaaucu

SEQ ID NO: 3876303 - RNA, 14 nt, Human
uuguauauuacaau

SEQ ID NO: 3876304 - RNA, 15 nt, Human
uuguauauuacaaug

SEQ ID NO: 3876305 - RNA, 16 nt, Human
uuguauauuauuucua

SEQ ID NO: 3876306 - RNA, 14 nt, Human
uuguauauucacuu

SEQ ID NO: 3876307 - RNA, 13 nt, Human
uuguauauugguu

SEQ ID NO: 3876308 - RNA, 19 nt, Human
uuguauauugguuuuauga

SEQ ID NO: 3876309 - RNA, 16 nt, Human
uuguauauuuguacaa

SEQ ID NO: 3876310 - RNA, 17 nt, Human
uuguauauuuguacaaa

SEQ ID NO: 3876311 - RNA, 17 nt, Human
uuguaucguauagcugu

SEQ ID NO: 3876312 - RNA, 18 nt, Human
uuguaucguauagcugua

SEQ ID NO: 3876313 - RNA, 13 nt, Human
uuguaucuagugc

SEQ ID NO: 3876314 - RNA, 16 nt, Human
uuguaucugucuuucc

SEQ ID NO: 3876315 - RNA, 18 nt, Human
uuguaucugucuuuccac

SEQ ID NO: 3876316 - RNA, 20 nt, Human
uuguaugcaagcaguuucaa

SEQ ID NO: 3876317 - RNA, 15 nt, Human
uuguaugcaauggau

SEQ ID NO: 3876318 - RNA, 12 nt, Human
uuguaugccuuu

SEQ ID NO: 3876319 - RNA, 13 nt, Human
uuguauguaaaug

SEQ ID NO: 3876320 - RNA, 18 nt, Human
uuguauguaaaugugcau

SEQ ID NO: 3876321 - RNA, 16 nt, Human
uuguaugucaaagcuu

SEQ ID NO: 3876322 - RNA, 15 nt, Human
uuguauuaaacucuu

SEQ ID NO: 3876323 - RNA, 22 nt, Human
uuguauuauugcuguugcuuga

SEQ ID NO: 3876324 - RNA, 13 nt, Human
uuguauucaauua

SEQ ID NO: 3876325 - RNA, 13 nt, Human
uuguauucuuuga

SEQ ID NO: 3876326 - RNA, 17 nt, Human
uuguauucuuugauguu

SEQ ID NO: 3876327 - RNA, 19 nt, Human
uuguauuguauauuacaau

SEQ ID NO: 3876328 - RNA, 14 nt, Human
uuguauugugguau

SEQ ID NO: 3876329 - RNA, 15 nt, Human
uuguauuguuucaau

SEQ ID NO: 3876330 - RNA, 23 nt, Human
uuguauuuaaaugaaagugagac

SEQ ID NO: 3876331 - RNA, 13 nt, Human
uuguauuuaacag

SEQ ID NO: 3876332 - RNA, 17 nt, Human
uuguauuuaacagaaau

SEQ ID NO: 3876333 - RNA, 23 nt, Human
uuguauuuuccaagugugcauau

SEQ ID NO: 3876334 - RNA, 23 nt, Human
uuguauuuugugugaccaacugu

SEQ ID NO: 3876335 - RNA, 14 nt, Human
uuguauuuuuaaug

SEQ ID NO: 3876336 - RNA, 19 nt, Human
uuguauuuuuguuguuggg

SEQ ID NO: 3876337 - RNA, 22 nt, Human
uugucaaaguggugagaggcau

SEQ ID NO: 3876338 - RNA, 13 nt, Human
uugucaacauugu

SEQ ID NO: 3876339 - RNA, 14 nt, Human
uugucaauauuaaa

SEQ ID NO: 3876340 - RNA, 18 nt, Human
uugucaauauuaaauaca

SEQ ID NO: 3876341 - RNA, 22 nt, Human
uugucaaugcaguugucucugu

SEQ ID NO: 3876342 - RNA, 13 nt, Human
uugucacaauaaa

SEQ ID NO: 3876343 - RNA, 18 nt, Human
uugucacacacuuuggcu

SEQ ID NO: 3876344 - RNA, 14 nt, Human
uugucaccagaucu

SEQ ID NO: 3876345 - RNA, 16 nt, Human
uugucaccagaucuga

SEQ ID NO: 3876346 - RNA, 16 nt, Human
uugucacugacacaaa

SEQ ID NO: 3876347 - RNA, 19 nt, Human
uugucacugacacaaagga

SEQ ID NO: 3876348 - RNA, 15 nt, Human
uugucacuugcaugu

SEQ ID NO: 3876349 - RNA, 14 nt, Human
uugucagacauaaa

SEQ ID NO: 3876350 - RNA, 15 nt, Human
uugucagacauaaag

SEQ ID NO: 3876351 - RNA, 16 nt, Human
uugucagacauaaagc

SEQ ID NO: 3876352 - RNA, 16 nt, Human
uugucagaccauaaga

SEQ ID NO: 3876353 - RNA, 20 nt, Human
uugucagacuuuaaagaaua

SEQ ID NO: 3876354 - RNA, 18 nt, Human
uugucagauaugauaugu

SEQ ID NO: 3876355 - RNA, 12 nt, Human
uugucagcuacu

SEQ ID NO: 3876356 - RNA, 17 nt, Human
uugucaggagugugugu

SEQ ID NO: 3876357 - RNA, 21 nt, Human
uugucauauaagauucauauu

SEQ ID NO: 3876358 - RNA, 21 nt, Human
uugucauaucagcacauauuu

SEQ ID NO: 3876359 - RNA, 21 nt, Human
uugucauauguagccuucaca

SEQ ID NO: 3876360 - RNA, 23 nt, Human
uugucaucauuguauauaugugu

SEQ ID NO: 3876361 - RNA, 12 nt, Human
uugucaugguua

SEQ ID NO: 3876362 - RNA, 20 nt, Human
uugucauuagccugaguaga

SEQ ID NO: 3876363 - RNA, 14 nt, Human
uugucauugcuguu

SEQ ID NO: 3876364 - RNA, 15 nt, Human
uugucauugcuguug

SEQ ID NO: 3876365 - RNA, 13 nt, Human
uugucauuuauaa

SEQ ID NO: 3876366 - RNA, 19 nt, Human
uugucauuuucauuagcaa

SEQ ID NO: 3876367 - RNA, 15 nt, Human
uugucauuuucucca

SEQ ID NO: 3876368 - RNA, 16 nt, Human
uugucauuuugaagcu

SEQ ID NO: 3876369 - RNA, 19 nt, Human
uuguccagagcugcuuccc

SEQ ID NO: 3876370 - RNA, 13 nt, Human
uuguccagcgccu

SEQ ID NO: 3876371 - RNA, 13 nt, Human
uuguccauugucc

SEQ ID NO: 3876372 - RNA, 15 nt, Human
uugucccaagugcca

SEQ ID NO: 3876373 - RNA, 23 nt, Human
uugucccauuucuaaaggccucu

SEQ ID NO: 3876374 - RNA, 23 nt, Human
uuguccccaaauccgaaccuccu

SEQ ID NO: 3876375 - RNA, 18 nt, Human
uuguccccaaugaauaua

SEQ ID NO: 3876376 - RNA, 14 nt, Human
uugucccccaacuu

SEQ ID NO: 3876377 - RNA, 16 nt, Human
uugucccccaacuuga

SEQ ID NO: 3876378 - RNA, 18 nt, Human
uugucccccaacuugaga

SEQ ID NO: 3876379 - RNA, 16 nt, Human
uuguccccgacccuug

SEQ ID NO: 3876380 - RNA, 12 nt, Human
uuguccccugcu

SEQ ID NO: 3876381 - RNA, 15 nt, Human
uugucccucugcccc

SEQ ID NO: 3876382 - RNA, 20 nt, Human
uuguccgguggaaggccuuc

SEQ ID NO: 3876383 - RNA, 18 nt, Human
uuguccguguucauacau

SEQ ID NO: 3876384 - RNA, 16 nt, Human
uuguccuauuaguguu

SEQ ID NO: 3876385 - RNA, 17 nt, Human
uuguccucaguccauuu

SEQ ID NO: 3876386 - RNA, 17 nt, Human
uuguccuccugcugcca

SEQ ID NO: 3876387 - RNA, 23 nt, Human
uugucgaaaagagucuuccaauu

SEQ ID NO: 3876388 - RNA, 21 nt, Human
uugucggccccaccagugccu

SEQ ID NO: 3876389 - RNA, 20 nt, Human
uugucggcuccaguccccag

SEQ ID NO: 3876390 - RNA, 17 nt, Human
uugucuaaaacaauaaa

SEQ ID NO: 3876391 - RNA, 23 nt, Human
uugucuaagaaacauuggaagca

SEQ ID NO: 3876392 - RNA, 19 nt, Human
uugucuaagaaauugaaua

SEQ ID NO: 3876393 - RNA, 18 nt, Human
uugucuacacacccugca

SEQ ID NO: 3876394 - RNA, 16 nt, Human
uugucuauaaagcauu

SEQ ID NO: 3876395 - RNA, 18 nt, Human
uugucuauaaagcauuua

SEQ ID NO: 3876396 - RNA, 20 nt, Human
uugucuauaguugucaguau

SEQ ID NO: 3876397 - RNA, 16 nt, Human
uuguuuacaugcuuau

SEQ ID NO: 3876398 - RNA, 23 nt, Human
uuguuuacuuaaagauuuaucaa

SEQ ID NO: 3876399 - RNA, 18 nt, Human
uuguuuagaagaagugug

SEQ ID NO: 3876400 - RNA, 15 nt, Human
uuguuuauaauaaaa

SEQ ID NO: 3876401 - RNA, 16 nt, Human
uuguuuauaauaaaaa

SEQ ID NO: 3876402 - RNA, 18 nt, Human
uuguuuauaccuuugccu

SEQ ID NO: 3876403 - RNA, 19 nt, Human
uuguuuaucagauacauca

SEQ ID NO: 3876404 - RNA, 17 nt, Human
uuguuuaucuagaugua

SEQ ID NO: 3876405 - RNA, 12 nt, Human
uuguuuauguaa

SEQ ID NO: 3876406 - RNA, 15 nt, Human
uuguuuauguaauuu

SEQ ID NO: 3876407 - RNA, 13 nt, Human
uuguuuauuucau

SEQ ID NO: 3876408 - RNA, 18 nt, Human
uuguuucaaacacaaaug

SEQ ID NO: 3876409 - RNA, 18 nt, Human
uuguuucaagaaccugga

SEQ ID NO: 3876410 - RNA, 12 nt, Human
uuguuucaguga

SEQ ID NO: 3876411 - RNA, 20 nt, Human
uuguuucauugacuaucaaa

SEQ ID NO: 3876412 - RNA, 15 nt, Human
uuguuuccuuucacu

SEQ ID NO: 3876413 - RNA, 13 nt, Human
uuguuucgcucuu

SEQ ID NO: 3876414 - RNA, 23 nt, Human
uuguuucuacuuugauaugacug

SEQ ID NO: 3876415 - RNA, 14 nt, Human
uuguuucuccccca

SEQ ID NO: 3876416 - RNA, 16 nt, Human
uuguuucucccccugg

SEQ ID NO: 3876417 - RNA, 12 nt, Human
uuguuucugaaa

SEQ ID NO: 3876418 - RNA, 14 nt, Human
uuguuucuguacuu

SEQ ID NO: 3876419 - RNA, 14 nt, Human
uuguuucugugggc

SEQ ID NO: 3876420 - RNA, 17 nt, Human
uuguuucuguuccaaau

SEQ ID NO: 3876421 - RNA, 12 nt, Human
uuguuucuguuu

SEQ ID NO: 3876422 - RNA, 14 nt, Human
uuguuucuuaaaua

SEQ ID NO: 3876423 - RNA, 13 nt, Human
uuguuucuuccaa

SEQ ID NO: 3876424 - RNA, 13 nt, Human
uuguuucuuguuu

SEQ ID NO: 3876425 - RNA, 15 nt, Human
uuguuucuuucuagu

SEQ ID NO: 3876426 - RNA, 20 nt, Human
uuguuucuuucucugaggac

SEQ ID NO: 3876427 - RNA, 14 nt, Human
uuguuucuuugaau

SEQ ID NO: 3876428 - RNA, 16 nt, Human
uuguuugaaaauauua

SEQ ID NO: 3876429 - RNA, 12 nt, Human
uuguuugcuauc

SEQ ID NO: 3876430 - RNA, 19 nt, Human
uuguuugcucaccuggggu

SEQ ID NO: 3876431 - RNA, 14 nt, Human
uuguuugcugcuau

SEQ ID NO: 3876432 - RNA, 18 nt, Human
uuguuuggagacagaguc

SEQ ID NO: 3876433 - RNA, 16 nt, Human
uuguuuggcaaggaaa

SEQ ID NO: 3876434 - RNA, 20 nt, Human
uuguuuggggaugagaaagg

SEQ ID NO: 3876435 - RNA, 17 nt, Human
uuguuugguaaauguuu

SEQ ID NO: 3876436 - RNA, 21 nt, Human
uuguuugguauuguauuuauu

SEQ ID NO: 3876437 - RNA, 11 nt, Human
uuguuugugcu

SEQ ID NO: 3876438 - RNA, 10 nt, Human
uuguuuguuu

SEQ ID NO: 3876439 - RNA, 12 nt, Human
uuguuuguuucu

SEQ ID NO: 3876440 - RNA, 21 nt, Human
uuguuuguuucucccccuggg

SEQ ID NO: 3876441 - RNA, 13 nt, Human
uuguuuguuucuu

SEQ ID NO: 3876442 - RNA, 15 nt, Human
uuguuuuacugucuu

SEQ ID NO: 3876443 - RNA, 16 nt, Human
uuguuuucugacuaau

SEQ ID NO: 3876444 - RNA, 17 nt, Human
uuguuuucugacuaauu

SEQ ID NO: 3876445 - RNA, 15 nt, Human
uuguuuugaaaauaa

SEQ ID NO: 3876446 - RNA, 17 nt, Human
uuguuuugagcuuucca

SEQ ID NO: 3876447 - RNA, 20 nt, Human
uuguuuugagcuuuccaugu

SEQ ID NO: 3876448 - RNA, 20 nt, Human
uuguuuugcacacuuugcca

SEQ ID NO: 3876449 - RNA, 18 nt, Human
uuguuuugccaauuugca

SEQ ID NO: 3876450 - RNA, 16 nt, Human
uuguuuugcuuccccu

SEQ ID NO: 3876451 - RNA, 18 nt, Human
uuguuuugcuuuuucuga

SEQ ID NO: 3876452 - RNA, 14 nt, Human
uuguuuuguuuguc

SEQ ID NO: 3876453 - RNA, 16 nt, Human
uuguuuuguuuuuugg

SEQ ID NO: 3876454 - RNA, 18 nt, Human
uuguuuuuaaacuguaca

SEQ ID NO: 3876455 - RNA, 19 nt, Human
uuguuuuuaaacuguacag

SEQ ID NO: 3876456 - RNA, 17 nt, Human
uuguuuuuagaaucauu

SEQ ID NO: 3876457 - RNA, 12 nt, Human
uuguuuuuauga

SEQ ID NO: 3876458 - RNA, 13 nt, Human
uuguuuuuccuug

SEQ ID NO: 3876459 - RNA, 21 nt, Human
uuguuuuuccuuguauuuaaa

SEQ ID NO: 3876460 - RNA, 12 nt, Human
uuguuuuucugc

SEQ ID NO: 3876461 - RNA, 15 nt, Human
uuguuuuuguaaaga

SEQ ID NO: 3876462 - RNA, 13 nt, Human
uuguuuuuguaua

SEQ ID NO: 3876463 - RNA, 16 nt, Human
uuguuuuuuaaagucu

SEQ ID NO: 3876464 - RNA, 21 nt, Human
uuguuuuuucaaaauagaaaa

SEQ ID NO: 3876465 - RNA, 12 nt, Human
uuguuuuuugaa

SEQ ID NO: 3876466 - RNA, 17 nt, Human
uuguuuuuugaaguguu

SEQ ID NO: 3876467 - RNA, 19 nt, Human
uuguuuuuuuuuuccacuu

SEQ ID NO: 3876468 - RNA, 22 nt, Human
uuuaaaaaaagaaaaugaaaaa

SEQ ID NO: 3876469 - RNA, 20 nt, Human
uuuaaaaaaauaaaacauuu

SEQ ID NO: 3876470 - RNA, 21 nt, Human
uuuaaaaaaauaaaacauuuu

SEQ ID NO: 3876471 - RNA, 17 nt, Human
uuuaaaaaaaucacaaa

SEQ ID NO: 3876472 - RNA, 16 nt, Human
uuuaaaaaaauuuaag

SEQ ID NO: 3876473 - RNA, 17 nt, Human
uuuaaaaaaauuuaagu

SEQ ID NO: 3876474 - RNA, 11 nt, Human
uuuaaaaaacu

SEQ ID NO: 3876475 - RNA, 21 nt, Human
uuuaaaaaagcuuaaaacuuu

SEQ ID NO: 3876476 - RNA, 23 nt, Human
uuuaaaaaagcuuaaaacuuuga

SEQ ID NO: 3876477 - RNA, 21 nt, Human
uuuaaaaaaguuuaaaaugua

SEQ ID NO: 3876478 - RNA, 12 nt, Human
uuuaaaaaauaa

SEQ ID NO: 3876479 - RNA, 16 nt, Human
uuuaaaaaauauuuuc

SEQ ID NO: 3876480 - RNA, 15 nt, Human
uuuaaaaaaucucaa

SEQ ID NO: 3876481 - RNA, 19 nt, Human
uuuaaaaaccgaauaaaug

SEQ ID NO: 3876482 - RNA, 21 nt, Human
uuuaaaaacuauuuaacuuga

SEQ ID NO: 3876483 - RNA, 14 nt, Human
uuuaaaaacuguuu

SEQ ID NO: 3876484 - RNA, 14 nt, Human
uuuaaaaagccagu

SEQ ID NO: 3876485 - RNA, 20 nt, Human
uuuaaaaaggaacugcagca

SEQ ID NO: 3876486 - RNA, 20 nt, Human
uuuaaaaaguauugccaaac

SEQ ID NO: 3876487 - RNA, 15 nt, Human
uuuaaaaagucuuca

SEQ ID NO: 3876488 - RNA, 20 nt, Human
uuuaaaaaguguuuaaaugu

SEQ ID NO: 3876489 - RNA, 23 nt, Human
uuuaaaaaguuguagcagauugu

SEQ ID NO: 3876490 - RNA, 21 nt, Human
uuuaaaaauaagucaacagua

SEQ ID NO: 3876491 - RNA, 23 nt, Human
uuuaaaaauaagucaacaguaaa

SEQ ID NO: 3876492 - RNA, 17 nt, Human
uuuaaaaauacacuugu

SEQ ID NO: 3876493 - RNA, 17 nt, Human
uuuaaaaauagaaacau

SEQ ID NO: 3876494 - RNA, 15 nt, Human
uuuaaaaauauaauu

SEQ ID NO: 3876495 - RNA, 16 nt, Human
uuuaaaaaucaacuuu

SEQ ID NO: 3876496 - RNA, 15 nt, Human
uuuaaaaaucauaaa

SEQ ID NO: 3876497 - RNA, 11 nt, Human
uuuaaaaauga

SEQ ID NO: 3876498 - RNA, 12 nt, Human
uuuaaaaaugaa

SEQ ID NO: 3876499 - RNA, 12 nt, Human
uuuaaaaaugca

SEQ ID NO: 3876500 - RNA, 11 nt, Human
uuuaaaaaugu

SEQ ID NO: 3876501 - RNA, 13 nt, Human
uuuaaaaaugucu

SEQ ID NO: 3876502 - RNA, 23 nt, Human
uuuaaaaauuagccuaagauaua

SEQ ID NO: 3876503 - RNA, 11 nt, Human
uuuaaaacaaa

SEQ ID NO: 3876504 - RNA, 13 nt, Human
uuuaaaacacaug

SEQ ID NO: 3876505 - RNA, 15 nt, Human
uuuaaaacauguaau

SEQ ID NO: 3876506 - RNA, 22 nt, Human
uuuaaaacuguuggaauggauu

SEQ ID NO: 3876507 - RNA, 11 nt, Human
uuuaaaacuug

SEQ ID NO: 3876508 - RNA, 12 nt, Human
uuuaaaagaaau

SEQ ID NO: 3876509 - RNA, 17 nt, Human
uuuaaaagaaugauuau

SEQ ID NO: 3876510 - RNA, 23 nt, Human
uuuaaaagaaugggcaguuacau

SEQ ID NO: 3876511 - RNA, 16 nt, Human
uuuaaaagagacaaac

SEQ ID NO: 3876512 - RNA, 16 nt, Human
uuuaaaagaucuucaa

SEQ ID NO: 3876513 - RNA, 18 nt, Human
uuuaaaagaugcaaugua

SEQ ID NO: 3876514 - RNA, 12 nt, Human
uuuaaaagauuu

SEQ ID NO: 3876515 - RNA, 14 nt, Human
uuuaaaagccugcu

SEQ ID NO: 3876516 - RNA, 17 nt, Human
uuuaaaaggaaagaaaa

SEQ ID NO: 3876517 - RNA, 21 nt, Human
uuuaaaagguauuuugaauac

SEQ ID NO: 3876518 - RNA, 18 nt, Human
uuuaaaagugucaagcug

SEQ ID NO: 3876519 - RNA, 19 nt, Human
uuuaaaaguuauuaauauu

SEQ ID NO: 3876520 - RNA, 16 nt, Human
uuuaaaauacuguaga

SEQ ID NO: 3876521 - RNA, 17 nt, Human
uuuaaaauacuguagau

SEQ ID NO: 3876522 - RNA, 21 nt, Human
uuuaaaauagaaauuuuguaa

SEQ ID NO: 3876523 - RNA, 23 nt, Human
uuuaaaauagaaauuuuguaaga

SEQ ID NO: 3876524 - RNA, 17 nt, Human
uuuaaaauagcguucuu

SEQ ID NO: 3876525 - RNA, 14 nt, Human
uuuaaaauauaauu

SEQ ID NO: 3876526 - RNA, 21 nt, Human
uuuaaaauauauugaauauuu

SEQ ID NO: 3876527 - RNA, 16 nt, Human
uuuaaaauaucuacau

SEQ ID NO: 3876528 - RNA, 14 nt, Human
uuuaaaaucacuaa

SEQ ID NO: 3876529 - RNA, 19 nt, Human
uuuaaaaucaucagaaagg

SEQ ID NO: 3876530 - RNA, 20 nt, Human
uuuaaaaucuuauuaaaguu

SEQ ID NO: 3876531 - RNA, 16 nt, Human
uuuaaaaucuuuucua

SEQ ID NO: 3876532 - RNA, 21 nt, Human
uuuaaaauguaauuuaaauga

SEQ ID NO: 3876533 - RNA, 23 nt, Human
uuuaaaauguaauuuaaaugaaa

SEQ ID NO: 3876534 - RNA, 12 nt, Human
uuuaaaauguac

SEQ ID NO: 3876535 - RNA, 12 nt, Human
uuuaaaaugucu

SEQ ID NO: 3876536 - RNA, 18 nt, Human
uuuaaaauugcuauguua

SEQ ID NO: 3876537 - RNA, 23 nt, Human
uuuaaaauugcuauguuacuauu

SEQ ID NO: 3876538 - RNA, 19 nt, Human
uuuaaaauuuaaguaucuu

SEQ ID NO: 3876539 - RNA, 17 nt, Human
uuuaaaauuuauauugu

SEQ ID NO: 3876540 - RNA, 21 nt, Human
uuuaaaauuuuguauguuaaa

SEQ ID NO: 3876541 - RNA, 15 nt, Human
uuuaaacaaacauug

SEQ ID NO: 3876542 - RNA, 23 nt, Human
uuuaaacaaauucauauucuguc

SEQ ID NO: 3876543 - RNA, 13 nt, Human
uuuaaacacacag

SEQ ID NO: 3876544 - RNA, 23 nt, Human
uuuacagccagugggagauguua

SEQ ID NO: 3876545 - RNA, 15 nt, Human
uuuacagcuguguua

SEQ ID NO: 3876546 - RNA, 19 nt, Human
uuuacagcuuuacacacac

SEQ ID NO: 3876547 - RNA, 19 nt, Human
uuuacaggcccugcuccug

SEQ ID NO: 3876548 - RNA, 19 nt, Human
uuuacaguaaauaaauugu

SEQ ID NO: 3876549 - RNA, 16 nt, Human
uuuacaguccuucaaa

SEQ ID NO: 3876550 - RNA, 16 nt, Human
uuuacagucuauuuga

SEQ ID NO: 3876551 - RNA, 23 nt, Human
uuuacagugaaaauguaagcugu

SEQ ID NO: 3876552 - RNA, 20 nt, Human
uuuacagugaagaaagccug

SEQ ID NO: 3876553 - RNA, 17 nt, Human
uuuacaguguuucuggc

SEQ ID NO: 3876554 - RNA, 21 nt, Human
uuuacauacacuguauguuau

SEQ ID NO: 3876555 - RNA, 15 nt, Human
uuuacauacugcugu

SEQ ID NO: 3876556 - RNA, 13 nt, Human
uuuacaugaagua

SEQ ID NO: 3876557 - RNA, 16 nt, Human
uuuacaugaaguauuu

SEQ ID NO: 3876558 - RNA, 16 nt, Human
uuuacaugaggacucu

SEQ ID NO: 3876559 - RNA, 20 nt, Human
uuuacaugcaauuuauuaaa

SEQ ID NO: 3876560 - RNA, 13 nt, Human
uuuacaugcuuau

SEQ ID NO: 3876561 - RNA, 17 nt, Human
uuuacaugcuuauucca

SEQ ID NO: 3876562 - RNA, 15 nt, Human
uuuacauguaguagu

SEQ ID NO: 3876563 - RNA, 12 nt, Human
uuuacauguuuu

SEQ ID NO: 3876564 - RNA, 16 nt, Human
uuuacauuguugagcu

SEQ ID NO: 3876565 - RNA, 12 nt, Human
uuuacauuuaaa

SEQ ID NO: 3876566 - RNA, 16 nt, Human
uuuacauuuaaagcau

SEQ ID NO: 3876567 - RNA, 17 nt, Human
uuuacauuuaaagcauu

SEQ ID NO: 3876568 - RNA, 20 nt, Human
uuuacauuuaaagcauugcu

SEQ ID NO: 3876569 - RNA, 13 nt, Human
uuuacauuuuaug

SEQ ID NO: 3876570 - RNA, 22 nt, Human
uuuacauuuuauggugccuagu

SEQ ID NO: 3876571 - RNA, 14 nt, Human
uuuaccaaaaauuu

SEQ ID NO: 3876572 - RNA, 21 nt, Human
uuuaccaaguuauauaaagag

SEQ ID NO: 3876573 - RNA, 13 nt, Human
uuuaccaccccca

SEQ ID NO: 3876574 - RNA, 18 nt, Human
uuuaccacccccacaccu

SEQ ID NO: 3876575 - RNA, 19 nt, Human
uuuaccagcuuuuaaccau

SEQ ID NO: 3876576 - RNA, 19 nt, Human
uuuaccaguuaauuacuca

SEQ ID NO: 3876577 - RNA, 17 nt, Human
uuuaccaguugccuuuu

SEQ ID NO: 3876578 - RNA, 14 nt, Human
uuuaccaucugaaa

SEQ ID NO: 3876579 - RNA, 22 nt, Human
uuuacccagaaugucagauucc

SEQ ID NO: 3876580 - RNA, 23 nt, Human
uuuacccagaaugucagauuccu

SEQ ID NO: 3876581 - RNA, 14 nt, Human
uuuacccauauccc

SEQ ID NO: 3876582 - RNA, 16 nt, Human
uuuaccccaucccugu

SEQ ID NO: 3876583 - RNA, 21 nt, Human
uuuacccucuugaauauaauc

SEQ ID NO: 3876584 - RNA, 21 nt, Human
uuuacccuugagcccucccca

SEQ ID NO: 3876585 - RNA, 14 nt, Human
uuuaccuagagaac

SEQ ID NO: 3876586 - RNA, 15 nt, Human
uuuaccuauguaaca

SEQ ID NO: 3876587 - RNA, 12 nt, Human
uuuaccucagcc

SEQ ID NO: 3876588 - RNA, 18 nt, Human
uuuaccugaagucuuugu

SEQ ID NO: 3876589 - RNA, 20 nt, Human
uuuaccugucacauugcauu

SEQ ID NO: 3876590 - RNA, 16 nt, Human
uuuaccuucaaacuuu

SEQ ID NO: 3876591 - RNA, 18 nt, Human
uuuaccuucaaacuuuag

SEQ ID NO: 3876592 - RNA, 13 nt, Human
uuuaccuuguaua

SEQ ID NO: 3876593 - RNA, 17 nt, Human
uuuaccuugucauuuug

SEQ ID NO: 3876594 - RNA, 18 nt, Human
uuuaccuuuuaugcaaaa

SEQ ID NO: 3876595 - RNA, 13 nt, Human
uuuacgcuuugau

SEQ ID NO: 3876596 - RNA, 17 nt, Human
uuuacuaaagaaagauu

SEQ ID NO: 3876597 - RNA, 21 nt, Human
uuuacuaagccacaagaaauu

SEQ ID NO: 3876598 - RNA, 13 nt, Human
uuuacuacaguuu

SEQ ID NO: 3876599 - RNA, 17 nt, Human
uuuacuaccaaugccaa

SEQ ID NO: 3876600 - RNA, 21 nt, Human
uuuacuacuguggaaaaauau

SEQ ID NO: 3876601 - RNA, 14 nt, Human
uuuacuauauauau

SEQ ID NO: 3876602 - RNA, 15 nt, Human
uuuacuauauauaua

SEQ ID NO: 3876603 - RNA, 15 nt, Human
uuuacuaugccugug

SEQ ID NO: 3876604 - RNA, 13 nt, Human
uuuacucauugaa

SEQ ID NO: 3876605 - RNA, 17 nt, Human
uuuacucauugaaaugu

SEQ ID NO: 3876606 - RNA, 18 nt, Human
uuuacucauugaaauguc

SEQ ID NO: 3876607 - RNA, 22 nt, Human
uuuacuccagguuauugcaaua

SEQ ID NO: 3876608 - RNA, 21 nt, Human
uuuacuccucacacuuacugu

SEQ ID NO: 3876609 - RNA, 21 nt, Human
uuuacucuaugccccaaauau

SEQ ID NO: 3876610 - RNA, 13 nt, Human
uuuacucugccua

SEQ ID NO: 3876611 - RNA, 14 nt, Human
uuuacugagcuucu

SEQ ID NO: 3876612 - RNA, 15 nt, Human
uuuacugcucugaga

SEQ ID NO: 3876613 - RNA, 16 nt, Human
uuuacugguugcaugg

SEQ ID NO: 3876614 - RNA, 22 nt, Human
uuuacugguugcauggaaauca

SEQ ID NO: 3876615 - RNA, 20 nt, Human
uuuacugucaaaauaauuuu

SEQ ID NO: 3876616 - RNA, 17 nt, Human
uuuacugugaaacuggc

SEQ ID NO: 3876617 - RNA, 17 nt, Human
uuuacugugacuuuauu

SEQ ID NO: 3876618 - RNA, 20 nt, Human
uuuacuguuuugaaaucaau

SEQ ID NO: 3876619 - RNA, 16 nt, Human
uuuacuuaaagauuua

SEQ ID NO: 3876620 - RNA, 23 nt, Human
uuuacuucaaugggcucuuccaa

SEQ ID NO: 3876621 - RNA, 16 nt, Human
uuuacuucacuucaaa

SEQ ID NO: 3876622 - RNA, 14 nt, Human
uuuacuucuuauac

SEQ ID NO: 3876623 - RNA, 15 nt, Human
uuuacuucuuauaca

SEQ ID NO: 3876624 - RNA, 22 nt, Human
uuuacuucuuauacauuugaua

SEQ ID NO: 3876625 - RNA, 14 nt, Human
uuuacuuggaaaua

SEQ ID NO: 3876626 - RNA, 15 nt, Human
uuuacuuguuuugga

SEQ ID NO: 3876627 - RNA, 13 nt, Human
uuuacuuugaauu

SEQ ID NO: 3876628 - RNA, 15 nt, Human
uuuacuuuuaaacag

SEQ ID NO: 3876629 - RNA, 15 nt, Human
uuuacuuuuaaacug

SEQ ID NO: 3876630 - RNA, 13 nt, Human
uuuacuuuuguuu

SEQ ID NO: 3876631 - RNA, 23 nt, Human
uuuagaaaaaaguuuacaacaua

SEQ ID NO: 3876632 - RNA, 15 nt, Human
uuuagaaaacuuuaa

SEQ ID NO: 3876633 - RNA, 13 nt, Human
uuuagaaaauaua

SEQ ID NO: 3876634 - RNA, 11 nt, Human
uuuagaaacuu

SEQ ID NO: 3876635 - RNA, 15 nt, Human
uuuagaaagaauauu

SEQ ID NO: 3876636 - RNA, 11 nt, Human
uuuagaaauau

SEQ ID NO: 3876637 - RNA, 14 nt, Human
uuuagaaauauaau

SEQ ID NO: 3876638 - RNA, 15 nt, Human
uuuagaaauauaauu

SEQ ID NO: 3876639 - RNA, 13 nt, Human
uuuagaaaucauu

SEQ ID NO: 3876640 - RNA, 16 nt, Human
uuuagaacagaaaaca

SEQ ID NO: 3876641 - RNA, 18 nt, Human
uuuagaacagaaaacaac

SEQ ID NO: 3876642 - RNA, 23 nt, Human
uuuagaacagaaaacaacaaaaa

SEQ ID NO: 3876643 - RNA, 14 nt, Human
uuuagaacagguuu

SEQ ID NO: 3876644 - RNA, 19 nt, Human
uuuagaagaagugugucac

SEQ ID NO: 3876645 - RNA, 14 nt, Human
uuuagaagacucua

SEQ ID NO: 3876646 - RNA, 14 nt, Human
uuuagaagccaacu

SEQ ID NO: 3876647 - RNA, 14 nt, Human
uuuagaagccugca

SEQ ID NO: 3876648 - RNA, 18 nt, Human
uuuagaauggugauuuua

SEQ ID NO: 3876649 - RNA, 13 nt, Human
uuuagaauuaaaa

SEQ ID NO: 3876650 - RNA, 17 nt, Human
uuuagaauugaagguuu

SEQ ID NO: 3876651 - RNA, 19 nt, Human
uuuagacaccuucauuuug

SEQ ID NO: 3876652 - RNA, 13 nt, Human
uuuagaccaagga

SEQ ID NO: 3876653 - RNA, 19 nt, Human
uuuagacccuauugcugcu

SEQ ID NO: 3876654 - RNA, 12 nt, Human
uuuagacuugaa

SEQ ID NO: 3876655 - RNA, 14 nt, Human
uuuagacuugaaaa

SEQ ID NO: 3876656 - RNA, 15 nt, Human
uuuagacuugaaaag

SEQ ID NO: 3876657 - RNA, 19 nt, Human
uuuagacuugaaaagagac

SEQ ID NO: 3876658 - RNA, 21 nt, Human
uuuagacuuggauucuuucca

SEQ ID NO: 3876659 - RNA, 22 nt, Human
uuuagacuuggauucuuuccau

SEQ ID NO: 3876660 - RNA, 14 nt, Human
uuuagagaacugaa

SEQ ID NO: 3876661 - RNA, 17 nt, Human
uuuagaguuagacuguu

SEQ ID NO: 3876662 - RNA, 18 nt, Human
uuuagaguugauacuaca

SEQ ID NO: 3876663 - RNA, 15 nt, Human
uuuagaucucugaag

SEQ ID NO: 3876664 - RNA, 22 nt, Human
uuuagaugaaugucaguuguua

SEQ ID NO: 3876665 - RNA, 20 nt, Human
uuuagaugguuacacuguua

SEQ ID NO: 3876666 - RNA, 19 nt, Human
uuuagauugaaaacuuuuc

SEQ ID NO: 3876667 - RNA, 19 nt, Human
uuuagauugaguaagauuu

SEQ ID NO: 3876668 - RNA, 16 nt, Human
uuuagauuucaagaaa

SEQ ID NO: 3876669 - RNA, 19 nt, Human
uuuagauuuucuuuugccu

SEQ ID NO: 3876670 - RNA, 22 nt, Human
uuuagauuuuguguuuauucuu

SEQ ID NO: 3876671 - RNA, 22 nt, Human
uuuagcaauuuaauauuuugca

SEQ ID NO: 3876672 - RNA, 14 nt, Human
uuuagcacaaaaaa

SEQ ID NO: 3876673 - RNA, 18 nt, Human
uuuagcagaaucaaaaug

SEQ ID NO: 3876674 - RNA, 19 nt, Human
uuuagcaguaaaauagcug

SEQ ID NO: 3876675 - RNA, 18 nt, Human
uuuagcaguucugcaaau

SEQ ID NO: 3876676 - RNA, 21 nt, Human
uuuagcaguucugcaaauaga

SEQ ID NO: 3876677 - RNA, 23 nt, Human
uuuagcaguucugcaaauagaaa

SEQ ID NO: 3876678 - RNA, 20 nt, Human
uuuagcaugacaagccccag

SEQ ID NO: 3876679 - RNA, 23 nt, Human
uuuagcaugacaagccccaggca

SEQ ID NO: 3876680 - RNA, 14 nt, Human
uuuagcauguuguu

SEQ ID NO: 3876681 - RNA, 12 nt, Human
uuuagcauugua

SEQ ID NO: 3876682 - RNA, 22 nt, Human
uuuagccugugucauugcccca

SEQ ID NO: 3876683 - RNA, 14 nt, Human
uuuagcuauuacug

SEQ ID NO: 3876684 - RNA, 11 nt, Human
uuuagcucuga

SEQ ID NO: 3876685 - RNA, 12 nt, Human
uuuagcucugag

SEQ ID NO: 3876686 - RNA, 20 nt, Human
uuuagcuggaaaaguauguu

SEQ ID NO: 3876687 - RNA, 13 nt, Human
uuuagcuggccac

SEQ ID NO: 3876688 - RNA, 16 nt, Human
uuuagcuguaucaaac

SEQ ID NO: 3876689 - RNA, 15 nt, Human
uuuaggaacuucaga

SEQ ID NO: 3876690 - RNA, 23 nt, Human
uuuguacaaggggccauuuggca

SEQ ID NO: 3876691 - RNA, 21 nt, Human
uuuguacacccaugaaagaaa

SEQ ID NO: 3876692 - RNA, 10 nt, Human
uuuguacaga

SEQ ID NO: 3876693 - RNA, 17 nt, Human
uuuguacaguuugcugu

SEQ ID NO: 3876694 - RNA, 12 nt, Human
uuuguacaucug

SEQ ID NO: 3876695 - RNA, 23 nt, Human
uuuguaccagugaauuuuugcaa

SEQ ID NO: 3876696 - RNA, 20 nt, Human
uuuguacgacgucagauguu

SEQ ID NO: 3876697 - RNA, 14 nt, Human
uuuguacugaaaaa

SEQ ID NO: 3876698 - RNA, 13 nt, Human
uuuguacuguaaa

SEQ ID NO: 3876699 - RNA, 17 nt, Human
uuuguagccuuccucca

SEQ ID NO: 3876700 - RNA, 21 nt, Human
uuuguaggaaggucucauucu

SEQ ID NO: 3876701 - RNA, 22 nt, Human
uuuguaggaaggucucauucuu

SEQ ID NO: 3876702 - RNA, 21 nt, Human
uuuguaggagaaacucccaug

SEQ ID NO: 3876703 - RNA, 18 nt, Human
uuuguaggggaacucauu

SEQ ID NO: 3876704 - RNA, 20 nt, Human
uuuguaggggaacucauuug

SEQ ID NO: 3876705 - RNA, 19 nt, Human
uuuguaggggucaaagaaa

SEQ ID NO: 3876706 - RNA, 15 nt, Human
uuuguaggguuucua

SEQ ID NO: 3876707 - RNA, 15 nt, Human
uuuguagguaaaaug

SEQ ID NO: 3876708 - RNA, 17 nt, Human
uuuguagguaaaaugua

SEQ ID NO: 3876709 - RNA, 18 nt, Human
uuuguagugaaauaauag

SEQ ID NO: 3876710 - RNA, 20 nt, Human
uuuguauaaaagugugaaau

SEQ ID NO: 3876711 - RNA, 14 nt, Human
uuuguauaaaauaa

SEQ ID NO: 3876712 - RNA, 18 nt, Human
uuuguauaaaauaauuuu

SEQ ID NO: 3876713 - RNA, 13 nt, Human
uuuguauaaaaug

SEQ ID NO: 3876714 - RNA, 13 nt, Human
uuuguauaauugu

SEQ ID NO: 3876715 - RNA, 14 nt, Human
uuuguauacaaaua

SEQ ID NO: 3876716 - RNA, 14 nt, Human
uuuguauacaagua

SEQ ID NO: 3876717 - RNA, 17 nt, Human
uuuguauacauccuggg

SEQ ID NO: 3876718 - RNA, 16 nt, Human
uuuguauaguuaugua

SEQ ID NO: 3876719 - RNA, 22 nt, Human
uuuguauaguuauguaaauaau

SEQ ID NO: 3876720 - RNA, 21 nt, Human
uuuguauauuacacauuugua

SEQ ID NO: 3876721 - RNA, 15 nt, Human
uuuguaugaaaacau

SEQ ID NO: 3876722 - RNA, 19 nt, Human
uuuguaugaaauauaugug

SEQ ID NO: 3876723 - RNA, 13 nt, Human
uuuguaugauauu

SEQ ID NO: 3876724 - RNA, 21 nt, Human
uuuguaugcaagcaguuucaa

SEQ ID NO: 3876725 - RNA, 22 nt, Human
uuuguaugccaagugagaagau

SEQ ID NO: 3876726 - RNA, 16 nt, Human
uuuguauguaaaugug

SEQ ID NO: 3876727 - RNA, 17 nt, Human
uuuguauguaaaugugc

SEQ ID NO: 3876728 - RNA, 14 nt, Human
uuuguauguauaau

SEQ ID NO: 3876729 - RNA, 16 nt, Human
uuuguauguuaaagag

SEQ ID NO: 3876730 - RNA, 18 nt, Human
uuuguauguuuuuuuucu

SEQ ID NO: 3876731 - RNA, 15 nt, Human
uuuguauuauugcug

SEQ ID NO: 3876732 - RNA, 20 nt, Human
uuuguauuauugcuguugcu

SEQ ID NO: 3876733 - RNA, 22 nt, Human
uuuguauucaauuaaagaaaua

SEQ ID NO: 3876734 - RNA, 14 nt, Human
uuuguauucucuga

SEQ ID NO: 3876735 - RNA, 14 nt, Human
uuuguauuguauau

SEQ ID NO: 3876736 - RNA, 16 nt, Human
uuuguauuuauucuuu

SEQ ID NO: 3876737 - RNA, 23 nt, Human
uuuguauuuuccaagugugcaua

SEQ ID NO: 3876738 - RNA, 23 nt, Human
uuuguauuuugugugaccaacug

SEQ ID NO: 3876739 - RNA, 14 nt, Human
uuuguauuuuuaau

SEQ ID NO: 3876740 - RNA, 15 nt, Human
uuugucacugcuuca

SEQ ID NO: 3876741 - RNA, 23 nt, Human
uuugucaguguagaucaacucau

SEQ ID NO: 3876742 - RNA, 18 nt, Human
uuugucauuuucauuagc

SEQ ID NO: 3876743 - RNA, 13 nt, Human
uuuguccauuugu

SEQ ID NO: 3876744 - RNA, 16 nt, Human
uuugucccacagcuug

SEQ ID NO: 3876745 - RNA, 21 nt, Human
uuuguccccaccgcagacagg

SEQ ID NO: 3876746 - RNA, 14 nt, Human
uuugucccccaacu

SEQ ID NO: 3876747 - RNA, 21 nt, Human
uuugucccccaacuugagaug

SEQ ID NO: 3876748 - RNA, 12 nt, Human
uuuguccucaaa

SEQ ID NO: 3876749 - RNA, 19 nt, Human
uuuguccugaugcuuuugu

SEQ ID NO: 3876750 - RNA, 22 nt, Human
uuugucgauauuuccaucauua

SEQ ID NO: 3876751 - RNA, 11 nt, Human
uuugucuaaaa

SEQ ID NO: 3876752 - RNA, 14 nt, Human
uuugucuaaaacaa

SEQ ID NO: 3876753 - RNA, 16 nt, Human
uuugucuaaaacaaua

SEQ ID NO: 3876754 - RNA, 16 nt, Human
uuugucuaagaaacau

SEQ ID NO: 3876755 - RNA, 17 nt, Human
uuugucuacguuuaguu

SEQ ID NO: 3876756 - RNA, 18 nt, Human
uuugucuauuuuaaaaua

SEQ ID NO: 3876757 - RNA, 17 nt, Human
uuugucucuccuuuucu

SEQ ID NO: 3876758 - RNA, 12 nt, Human
uuugucucuucu

SEQ ID NO: 3876759 - RNA, 14 nt, Human
uuugucugaaaaau

SEQ ID NO: 3876760 - RNA, 19 nt, Human
uuugucugccccaaguuuu

SEQ ID NO: 3876761 - RNA, 17 nt, Human
uuugucugucuucauag

SEQ ID NO: 3876762 - RNA, 16 nt, Human
uuugucuucuccccag

SEQ ID NO: 3876763 - RNA, 13 nt, Human
uuugucuuuuugu

SEQ ID NO: 3876764 - RNA, 17 nt, Human
uuugugaaauuuuucau

SEQ ID NO: 3876765 - RNA, 22 nt, Human
uuugugaacaagucccuguaau

SEQ ID NO: 3876766 - RNA, 15 nt, Human
uuugugaagcccugu

SEQ ID NO: 3876767 - RNA, 24 nt, Human
uuugugaaggccucgcaggaagac

SEQ ID NO: 3876768 - RNA, 18 nt, Human
uuugugacuaauuguaua

SEQ ID NO: 3876769 - RNA, 12 nt, Human
uuugugagagcg

SEQ ID NO: 3876770 - RNA, 16 nt, Human
uuugugagcaggcugu

SEQ ID NO: 3876771 - RNA, 19 nt, Human
uuugugaggaagccgcugg

SEQ ID NO: 3876772 - RNA, 18 nt, Human
uuugugagucaauacaua

SEQ ID NO: 3876773 - RNA, 13 nt, Human
uuugugauaauuu

SEQ ID NO: 3876774 - RNA, 15 nt, Human
uuugugauacaaugc

SEQ ID NO: 3876775 - RNA, 22 nt, Human
uuugugauacaaugcugugccc

SEQ ID NO: 3876776 - RNA, 21 nt, Human
uuugugauggagugcuguuuu

SEQ ID NO: 3876777 - RNA, 20 nt, Human
uuugugauucaaucuguaaa

SEQ ID NO: 3876778 - RNA, 17 nt, Human
uuugugauuuagaacug

SEQ ID NO: 3876779 - RNA, 13 nt, Human
uuugugccagagg

SEQ ID NO: 3876780 - RNA, 12 nt, Human
uuugugcccuau

SEQ ID NO: 3876781 - RNA, 14 nt, Human
uuugugcuagaaau

SEQ ID NO: 3876782 - RNA, 12 nt, Human
uuugugcuucua

SEQ ID NO: 3876783 - RNA, 14 nt, Human
uuugugcuucuaau

SEQ ID NO: 3876784 - RNA, 11 nt, Human
uuuguggaaaa

SEQ ID NO: 3876785 - RNA, 14 nt, Human
uuuguggaugucuu

SEQ ID NO: 3876786 - RNA, 17 nt, Human
uuuguggcaccuuuucu

SEQ ID NO: 3876787 - RNA, 18 nt, Human
uuuguggccaaggagcug

SEQ ID NO: 3876788 - RNA, 21 nt, Human
uuuguggccaaggagcugcua

SEQ ID NO: 3876789 - RNA, 17 nt, Human
uuugugggggacuguaa

SEQ ID NO: 3876790 - RNA, 18 nt, Human
uuugugggggacuguaag

SEQ ID NO: 3876791 - RNA, 22 nt, Human
uuugugguacgaccuuuagauu

SEQ ID NO: 3876792 - RNA, 16 nt, Human
uuugugguuuuaugga

SEQ ID NO: 3876793 - RNA, 21 nt, Human
uuuguguaacucccagugaug

SEQ ID NO: 3876794 - RNA, 16 nt, Human
uuuguguaauaaagug

SEQ ID NO: 3876795 - RNA, 19 nt, Human
uuuguguaauagaaaacug

SEQ ID NO: 3876796 - RNA, 22 nt, Human
uuugugucaaugggcaaugaca

SEQ ID NO: 3876797 - RNA, 21 nt, Human
uuugugucauguuuaagaaau

SEQ ID NO: 3876798 - RNA, 20 nt, Human
uuugugucucuuauggaugu

SEQ ID NO: 3876799 - RNA, 21 nt, Human
uuugugugaccaacuguguug

SEQ ID NO: 3876800 - RNA, 12 nt, Human
uuugugugagag

SEQ ID NO: 3876801 - RNA, 14 nt, Human
uuugugugauugaa

SEQ ID NO: 3876802 - RNA, 16 nt, Human
uuugugugcucuccau

SEQ ID NO: 3876803 - RNA, 14 nt, Human
uuuguguguagucu

SEQ ID NO: 3876804 - RNA, 14 nt, Human
uuuguguguuauac

SEQ ID NO: 3876805 - RNA, 19 nt, Human
uuuguguguucacuaaacu

SEQ ID NO: 3876806 - RNA, 17 nt, Human
uuuguguguugucucuu

SEQ ID NO: 3876807 - RNA, 17 nt, Human
uuuguguucuguuuugu

SEQ ID NO: 3876808 - RNA, 13 nt, Human
uuuguguucuuug

SEQ ID NO: 3876809 - RNA, 17 nt, Human
uuuguguuguaauucuu

SEQ ID NO: 3876810 - RNA, 23 nt, Human
uuuguguuguaauucuucaguug

SEQ ID NO: 3876811 - RNA, 16 nt, Human
uuuguguuuauucuug

SEQ ID NO: 3876812 - RNA, 18 nt, Human
uuuguguuugguuuacau

SEQ ID NO: 3876813 - RNA, 24 nt, Human
uuuguuaaaauacaguucugucau

SEQ ID NO: 3876814 - RNA, 22 nt, Human
uuuguuaauuuagaaaacuuua

SEQ ID NO: 3876815 - RNA, 23 nt, Human
uuuguuaauuuagaaaacuuuaa

SEQ ID NO: 3876816 - RNA, 24 nt, Human
uuuguuaccuccaacagaacuaaa

SEQ ID NO: 3876817 - RNA, 9 nt, Human
uuuguuacu

SEQ ID NO: 3876818 - RNA, 13 nt, Human
uuuguuacuguuc

SEQ ID NO: 3876819 - RNA, 16 nt, Human
uuuguuacuguucuug

SEQ ID NO: 3876820 - RNA, 23 nt, Human
uuuguuacuguucuugcugcuag

SEQ ID NO: 3876821 - RNA, 15 nt, Human
uuuguuagauagcug

SEQ ID NO: 3876822 - RNA, 21 nt, Human
uuuguuagauagcugcaugug

SEQ ID NO: 3876823 - RNA, 18 nt, Human
uuuguuauauaauuuaga

SEQ ID NO: 3876824 - RNA, 16 nt, Human
uuuguuauuguuuugu

SEQ ID NO: 3876825 - RNA, 12 nt, Human
uuuguuauuuug

SEQ ID NO: 3876826 - RNA, 16 nt, Human
uuuguucauacauauu

SEQ ID NO: 3876827 - RNA, 15 nt, Human
uuuguucauauuaag

SEQ ID NO: 3876828 - RNA, 12 nt, Human
uuuguucaucug

SEQ ID NO: 3876829 - RNA, 12 nt, Human
uuuguucauguu

SEQ ID NO: 3876830 - RNA, 14 nt, Human
uuuguucauguuug

SEQ ID NO: 3876831 - RNA, 23 nt, Human
uuuguucauuucauccuuucacu

SEQ ID NO: 3876832 - RNA, 15 nt, Human
uuuguuccccuccuc

SEQ ID NO: 3876833 - RNA, 19 nt, Human
uuuguucucagcucccccu

SEQ ID NO: 3876834 - RNA, 21 nt, Human
uuuguucuggcucuuccaggc

SEQ ID NO: 3876835 - RNA, 20 nt, Human
uuuuccaugcguguuucuga

SEQ ID NO: 3876836 - RNA, 22 nt, Human
uuuuccauggcaggaaggcuug

SEQ ID NO: 3876837 - RNA, 16 nt, Human
uuuuccauugguuuac

SEQ ID NO: 3876838 - RNA, 13 nt, Human
uuuuccauuuuau

SEQ ID NO: 3876839 - RNA, 14 nt, Human
uuuuccauuuuaua

SEQ ID NO: 3876840 - RNA, 18 nt, Human
uuuucccaaaauguugaa

SEQ ID NO: 3876841 - RNA, 20 nt, Human
uuuucccaaagcaucccucu

SEQ ID NO: 3876842 - RNA, 12 nt, Human
uuuucccacgag

SEQ ID NO: 3876843 - RNA, 15 nt, Human
uuuucccauaagaca

SEQ ID NO: 3876844 - RNA, 16 nt, Human
uuuucccauaagacaa

SEQ ID NO: 3876845 - RNA, 14 nt, Human
uuuuccccagacuu

SEQ ID NO: 3876846 - RNA, 19 nt, Human
uuuuccccucuuuuguuaa

SEQ ID NO: 3876847 - RNA, 17 nt, Human
uuuuccccuuuccuguc

SEQ ID NO: 3876848 - RNA, 15 nt, Human
uuuucccugaaguua

SEQ ID NO: 3876849 - RNA, 21 nt, Human
uuuucccugaaguuaugugua

SEQ ID NO: 3876850 - RNA, 15 nt, Human
uuuucccuguacagu

SEQ ID NO: 3876851 - RNA, 13 nt, Human
uuuuccuaaguga

SEQ ID NO: 3876852 - RNA, 20 nt, Human
uuuuccuaagugauuguaug

SEQ ID NO: 3876853 - RNA, 17 nt, Human
uuuuccuagcccucuca

SEQ ID NO: 3876854 - RNA, 15 nt, Human
uuuuccuaugcuauu

SEQ ID NO: 3876855 - RNA, 14 nt, Human
uuuuccucccuucu

SEQ ID NO: 3876856 - RNA, 17 nt, Human
uuuuccucccuucugcu

SEQ ID NO: 3876857 - RNA, 21 nt, Human
uuuuccucccuuggguucuga

SEQ ID NO: 3876858 - RNA, 19 nt, Human
uuuuccuccgggagagggg

SEQ ID NO: 3876859 - RNA, 17 nt, Human
uuuuccucgcuucuuuc

SEQ ID NO: 3876860 - RNA, 19 nt, Human
uuuuccucucaauaaaauu

SEQ ID NO: 3876861 - RNA, 16 nt, Human
uuuuccucuccacaca

SEQ ID NO: 3876862 - RNA, 18 nt, Human
uuuuccucuucuauuuug

SEQ ID NO: 3876863 - RNA, 20 nt, Human
uuuuccuggaauugccagcu

SEQ ID NO: 3876864 - RNA, 14 nt, Human
uuuuccuguucaua

SEQ ID NO: 3876865 - RNA, 16 nt, Human
uuuuccuguuucugaa

SEQ ID NO: 3876866 - RNA, 21 nt, Human
uuuuccuucaagaaugcagua

SEQ ID NO: 3876867 - RNA, 17 nt, Human
uuuuccuucagauauuu

SEQ ID NO: 3876868 - RNA, 15 nt, Human
uuuuccuucagugcc

SEQ ID NO: 3876869 - RNA, 13 nt, Human
uuuuccuugcaua

SEQ ID NO: 3876870 - RNA, 14 nt, Human
uuuuccuugcauac

SEQ ID NO: 3876871 - RNA, 16 nt, Human
uuuuccuuugucauca

SEQ ID NO: 3876872 - RNA, 13 nt, Human
uuuuccuuugugc

SEQ ID NO: 3876873 - RNA, 23 nt, Human
uuuucgaacauucuuugccuggu

SEQ ID NO: 3876874 - RNA, 14 nt, Human
uuuucgccuuuccu

SEQ ID NO: 3876875 - RNA, 19 nt, Human
uuuucggccccauguaucu

SEQ ID NO: 3876876 - RNA, 14 nt, Human
uuuucuaaaagcuu

SEQ ID NO: 3876877 - RNA, 23 nt, Human
uuuucuaacagaaagcaugauuu

SEQ ID NO: 3876878 - RNA, 13 nt, Human
uuuucuaaccuug

SEQ ID NO: 3876879 - RNA, 12 nt, Human
uuuucuaacugg

SEQ ID NO: 3876880 - RNA, 15 nt, Human
uuuucuacagcaaau

SEQ ID NO: 3876881 - RNA, 16 nt, Human
uuuucuacagcaaauu

SEQ ID NO: 3876882 - RNA, 17 nt, Human
uuuucuacagcaaauuu

SEQ ID NO: 3876883 - RNA, 21 nt, Human
uuuucuacagcaaauuuauaa

SEQ ID NO: 3876884 - RNA, 16 nt, Human
uuuucuacguuucuuu

SEQ ID NO: 3876885 - RNA, 20 nt, Human
uuuucuagaauuauuuuuca

SEQ ID NO: 3876886 - RNA, 22 nt, Human
uuuucuagaauuauuuuucacu

SEQ ID NO: 3876887 - RNA, 14 nt, Human
uuuucuagacuuuc

SEQ ID NO: 3876888 - RNA, 18 nt, Human
uuuucuagcccgaauaca

SEQ ID NO: 3876889 - RNA, 21 nt, Human
uuuucuagcccgaauacaaac

SEQ ID NO: 3876890 - RNA, 14 nt, Human
uuuucuaguacacu

SEQ ID NO: 3876891 - RNA, 17 nt, Human
uuuucuaguuugcucau

SEQ ID NO: 3876892 - RNA, 16 nt, Human
uuuucuauaauuuaaa

SEQ ID NO: 3876893 - RNA, 14 nt, Human
uuuucuauguacua

SEQ ID NO: 3876894 - RNA, 16 nt, Human
uuuucuauuaaaagac

SEQ ID NO: 3876895 - RNA, 17 nt, Human
uuuucuauuaaaagacu

SEQ ID NO: 3876896 - RNA, 23 nt, Human
uuuucuauuguuacucugguucu

SEQ ID NO: 3876897 - RNA, 15 nt, Human
uuuucucaaaguuuu

SEQ ID NO: 3876898 - RNA, 17 nt, Human
uuuucucacuccuuuug

SEQ ID NO: 3876899 - RNA, 20 nt, Human
uuuucuccaauaucagugcu

SEQ ID NO: 3876900 - RNA, 21 nt, Human
uuuucuccaauaucagugcuc

SEQ ID NO: 3876901 - RNA, 14 nt, Human
uuuucuccucccag

SEQ ID NO: 3876902 - RNA, 21 nt, Human
uuuucucgcuguccuuucuag

SEQ ID NO: 3876903 - RNA, 14 nt, Human
uuuucucuaggaaa

SEQ ID NO: 3876904 - RNA, 20 nt, Human
uuuucucuaggaaauauacu

SEQ ID NO: 3876905 - RNA, 21 nt, Human
uuuucucucaacaccaugauu

SEQ ID NO: 3876906 - RNA, 16 nt, Human
uuuucucuccuguccu

SEQ ID NO: 3876907 - RNA, 18 nt, Human
uuuucucuccuguccucc

SEQ ID NO: 3876908 - RNA, 16 nt, Human
uuuucucugguaauau

SEQ ID NO: 3876909 - RNA, 14 nt, Human
uuuucucuuagaaa

SEQ ID NO: 3876910 - RNA, 21 nt, Human
uuuucucuuagaacauuguau

SEQ ID NO: 3876911 - RNA, 22 nt, Human
uuuucucuuucuccuuagucuu

SEQ ID NO: 3876912 - RNA, 15 nt, Human
uuuucugaaucuucu

SEQ ID NO: 3876913 - RNA, 10 nt, Human
uuuucugagc

SEQ ID NO: 3876914 - RNA, 16 nt, Human
uuuucugagcccgggc

SEQ ID NO: 3876915 - RNA, 15 nt, Human
uuuucugauccaguu

SEQ ID NO: 3876916 - RNA, 14 nt, Human
uuuucugauuguaa

SEQ ID NO: 3876917 - RNA, 12 nt, Human
uuuucugcacua

SEQ ID NO: 3876918 - RNA, 21 nt, Human
uuuucugcaucaucuguagau

SEQ ID NO: 3876919 - RNA, 13 nt, Human
uuuucugcccugg

SEQ ID NO: 3876920 - RNA, 18 nt, Human
uuuucuggaauguaauca

SEQ ID NO: 3876921 - RNA, 16 nt, Human
uuuucuggacucugga

SEQ ID NO: 3876922 - RNA, 22 nt, Human
uuuucuggacucuggacuuucu

SEQ ID NO: 3876923 - RNA, 21 nt, Human
uuuucuggagguugauaacuu

SEQ ID NO: 3876924 - RNA, 23 nt, Human
uuuucuggagguugauaacuuug

SEQ ID NO: 3876925 - RNA, 22 nt, Human
uuuucuggguguccaaaggaag

SEQ ID NO: 3876926 - RNA, 14 nt, Human
uuuucuguaccagu

SEQ ID NO: 3876927 - RNA, 14 nt, Human
uuuucuguagucau

SEQ ID NO: 3876928 - RNA, 18 nt, Human
uuuucugugccugaauau

SEQ ID NO: 3876929 - RNA, 23 nt, Human
uuuucugugugucaguuuucaua

SEQ ID NO: 3876930 - RNA, 15 nt, Human
uuuucuguguguucc

SEQ ID NO: 3876931 - RNA, 12 nt, Human
uuuucuguuaua

SEQ ID NO: 3876932 - RNA, 13 nt, Human
uuuucuguucuuu

SEQ ID NO: 3876933 - RNA, 13 nt, Human
uuuucuguuguaa

SEQ ID NO: 3876934 - RNA, 15 nt, Human
uuuucuguuguaacu

SEQ ID NO: 3876935 - RNA, 12 nt, Human
uuuucuuaaaaa

SEQ ID NO: 3876936 - RNA, 13 nt, Human
uuuucuuaaaaag

SEQ ID NO: 3876937 - RNA, 17 nt, Human
uuuucuuaaccaguugu

SEQ ID NO: 3876938 - RNA, 13 nt, Human
uuuucuuauuuca

SEQ ID NO: 3876939 - RNA, 22 nt, Human
uuuucuucaacaucaauguuca

SEQ ID NO: 3876940 - RNA, 15 nt, Human
uuuucuucacugucc

SEQ ID NO: 3876941 - RNA, 13 nt, Human
uuuucuucucccu

SEQ ID NO: 3876942 - RNA, 18 nt, Human
uuuucuucuucccucccu

SEQ ID NO: 3876943 - RNA, 16 nt, Human
uuuucuucuugggaua

SEQ ID NO: 3876944 - RNA, 19 nt, Human
uuuucuugauaauuuuccu

SEQ ID NO: 3876945 - RNA, 13 nt, Human
uuuucuugccuga

SEQ ID NO: 3876946 - RNA, 13 nt, Human
uuuucuuguaauu

SEQ ID NO: 3876947 - RNA, 19 nt, Human
uuuucuuguaucuggauuc

SEQ ID NO: 3876948 - RNA, 15 nt, Human
uuuucuuuaaaagaa

SEQ ID NO: 3876949 - RNA, 20 nt, Human
uuuucuuuacaaaacaaacu

SEQ ID NO: 3876950 - RNA, 13 nt, Human
uuuucuuuauaag

SEQ ID NO: 3876951 - RNA, 12 nt, Human
uuuucuuucagu

SEQ ID NO: 3876952 - RNA, 17 nt, Human
uuuucuuuccuccuuuc

SEQ ID NO: 3876953 - RNA, 13 nt, Human
uuuucuuugaaua

SEQ ID NO: 3876954 - RNA, 12 nt, Human
uuuucuuuguau

SEQ ID NO: 3876955 - RNA, 18 nt, Human
uuuucuuuguaucauuca

SEQ ID NO: 3876956 - RNA, 11 nt, Human
uuuucuuuucu

SEQ ID NO: 3876957 - RNA, 22 nt, Human
uuuucuuuugcuuuauggguuu

SEQ ID NO: 3876958 - RNA, 16 nt, Human
uuuucuuuuguuacug

SEQ ID NO: 3876959 - RNA, 19 nt, Human
uuuucuuuuguuacuguuc

SEQ ID NO: 3876960 - RNA, 20 nt, Human
uuuucuuuuguuacuguucu

SEQ ID NO: 3876961 - RNA, 21 nt, Human
uuuucuuuuuuaaauuaauau

SEQ ID NO: 3876962 - RNA, 23 nt, Human
uuuugaaaaaagcucauuucaug

SEQ ID NO: 3876963 - RNA, 22 nt, Human
uuuugaaaaaugcacugggaaa

SEQ ID NO: 3876964 - RNA, 22 nt, Human
uuuugaaaaauuccuauuguga

SEQ ID NO: 3876965 - RNA, 23 nt, Human
uuuugaaaacuacauuuuaacau

SEQ ID NO: 3876966 - RNA, 16 nt, Human
uuuugaaaagcuauua

SEQ ID NO: 3876967 - RNA, 21 nt, Human
uuuugaaaccaugaagagauu

SEQ ID NO: 3876968 - RNA, 23 nt, Human
uuuugaaaucaaugcaagaguga

SEQ ID NO: 3876969 - RNA, 13 nt, Human
uuuugaaaugcug

SEQ ID NO: 3876970 - RNA, 16 nt, Human
uuuugaaaugcugaaa

SEQ ID NO: 3876971 - RNA, 18 nt, Human
uuuugaaaugcugaaaau

SEQ ID NO: 3876972 - RNA, 20 nt, Human
uuuugaaaugcugaaaauug

SEQ ID NO: 3876973 - RNA, 20 nt, Human
uuuugaaauuaugugacauu

SEQ ID NO: 3876974 - RNA, 23 nt, Human
uuuugaacuaagaaacuuuugua

SEQ ID NO: 3876975 - RNA, 14 nt, Human
uuuugaaggaauac

SEQ ID NO: 3876976 - RNA, 19 nt, Human
uuuugaaguaguuuguaua

SEQ ID NO: 3876977 - RNA, 15 nt, Human
uuuugaagucuugua

SEQ ID NO: 3876978 - RNA, 13 nt, Human
uuuugaaucaaua

SEQ ID NO: 3876979 - RNA, 16 nt, Human
uuuugaauccaugcuu

SEQ ID NO: 3876980 - RNA, 20 nt, Human
uuuugaaucucauaauuuau

SEQ ID NO: 3876981 - RNA, 18 nt, Human
acuguaguaaauaaugcu

SEQ ID NO: 3876982 - RNA, 21 nt, Human
acuguaguaaauaaugcuuug

SEQ ID NO: 3876983 - RNA, 17 nt, Human
acuguaguucuaagacu

SEQ ID NO: 3876984 - RNA, 23 nt, Human
acuguauaaauaggagaggauga

SEQ ID NO: 3876985 - RNA, 15 nt, Human
acuguauagacaguu

SEQ ID NO: 3876986 - RNA, 22 nt, Human
acuguauagacaguuuguaaau

SEQ ID NO: 3876987 - RNA, 18 nt, Human
acuguauauaaaggaaaa

SEQ ID NO: 3876988 - RNA, 13 nt, Human
acuguauauuugu

SEQ ID NO: 3876989 - RNA, 14 nt, Human
acuguauauuugua

SEQ ID NO: 3876990 - RNA, 15 nt, Human
acuguaucauuuucu

SEQ ID NO: 3876991 - RNA, 13 nt, Human
acuguaugaucaa

SEQ ID NO: 3876992 - RNA, 15 nt, Human
acuguaugaucaaau

SEQ ID NO: 3876993 - RNA, 20 nt, Human
acuguaugaucaaauguuua

SEQ ID NO: 3876994 - RNA, 22 nt, Human
acuguaugaucaaauguuuaau

SEQ ID NO: 3876995 - RNA, 15 nt, Human
acuguaugauuuaua

SEQ ID NO: 3876996 - RNA, 12 nt, Human
acuguaugcuca

SEQ ID NO: 3876997 - RNA, 13 nt, Human
acuguaugcugga

SEQ ID NO: 3876998 - RNA, 12 nt, Human
acuguauguuau

SEQ ID NO: 3876999 - RNA, 12 nt, Human
acuguauuugaa

SEQ ID NO: 3877000 - RNA, 23 nt, Human
acuguauuugaaauaagaauuca

SEQ ID NO: 3877001 - RNA, 14 nt, Human
acuguauuugugac

SEQ ID NO: 3877002 - RNA, 20 nt, Human
acuguauuugugacuaauug

SEQ ID NO: 3877003 - RNA, 21 nt, Human
acuguauuuuguauuguuuca

SEQ ID NO: 3877004 - RNA, 23 nt, Human
acugucaaaaaguuugguucugu

SEQ ID NO: 3877005 - RNA, 20 nt, Human
acugucaaaugaugugcaaa

SEQ ID NO: 3877006 - RNA, 20 nt, Human
acugucaaggcugcuuagaa

SEQ ID NO: 3877007 - RNA, 21 nt, Human
acugucaaggcugcuuagaau

SEQ ID NO: 3877008 - RNA, 12 nt, Human
acugucaauaaa

SEQ ID NO: 3877009 - RNA, 18 nt, Human
acugucaauaaacagcuu

SEQ ID NO: 3877010 - RNA, 17 nt, Human
acugucacccuccaccu

SEQ ID NO: 3877011 - RNA, 15 nt, Human
acugucacuguuccu

SEQ ID NO: 3877012 - RNA, 19 nt, Human
acugucagcagggacugua

SEQ ID NO: 3877013 - RNA, 22 nt, Human
acugucagcagggacuguaaac

SEQ ID NO: 3877014 - RNA, 23 nt, Human
acugucagcuccccucggagaag

SEQ ID NO: 3877015 - RNA, 16 nt, Human
acugucaggaagaaau

SEQ ID NO: 3877016 - RNA, 24 nt, Human
acugucaugcuucaucauucccuc

SEQ ID NO: 3877017 - RNA, 13 nt, Human
acuguccagagag

SEQ ID NO: 3877018 - RNA, 13 nt, Human
acugucccucaaa

SEQ ID NO: 3877019 - RNA, 20 nt, Human
acugucccucaaaugaccca

SEQ ID NO: 3877020 - RNA, 14 nt, Human
acugucccuccugg

SEQ ID NO: 3877021 - RNA, 15 nt, Human
acugucccuccuggu

SEQ ID NO: 3877022 - RNA, 16 nt, Human
acugucccuccuggug

SEQ ID NO: 3877023 - RNA, 18 nt, Human
acuguccuacccacccuc

SEQ ID NO: 3877024 - RNA, 18 nt, Human
acuguccuccaagccagc

SEQ ID NO: 3877025 - RNA, 17 nt, Human
acuguccucuccccucc

SEQ ID NO: 3877026 - RNA, 19 nt, Human
acuguccucuuucagaaaa

SEQ ID NO: 3877027 - RNA, 22 nt, Human
acuguccucuuucagaaaacag

SEQ ID NO: 3877028 - RNA, 10 nt, Human
acuguccugc

SEQ ID NO: 3877029 - RNA, 13 nt, Human
acuguccugcucc

SEQ ID NO: 3877030 - RNA, 16 nt, Human
acuguccugcuccaca

SEQ ID NO: 3877031 - RNA, 18 nt, Human
acuguccugcuccacagu

SEQ ID NO: 3877032 - RNA, 12 nt, Human
acuguccugggc

SEQ ID NO: 3877033 - RNA, 14 nt, Human
acuguccugggccu

SEQ ID NO: 3877034 - RNA, 13 nt, Human
acuguccugggcg

SEQ ID NO: 3877035 - RNA, 22 nt, Human
acuguccuguugauuaauuucu

SEQ ID NO: 3877036 - RNA, 13 nt, Human
acugucgcugcuu

SEQ ID NO: 3877037 - RNA, 14 nt, Human
acugucgcugcuuc

SEQ ID NO: 3877038 - RNA, 14 nt, Human
acugucggaggaaa

SEQ ID NO: 3877039 - RNA, 17 nt, Human
acugucggaggaaagac

SEQ ID NO: 3877040 - RNA, 21 nt, Human
acugucggaggaaagacaaca

SEQ ID NO: 3877041 - RNA, 17 nt, Human
acugucuauuaauauuc

SEQ ID NO: 3877042 - RNA, 19 nt, Human
acugucuauuucugcugaa

SEQ ID NO: 3877043 - RNA, 21 nt, Human
acugucucaagagggcacugg

SEQ ID NO: 3877044 - RNA, 15 nt, Human
acugucucucaugaa

SEQ ID NO: 3877045 - RNA, 13 nt, Human
acugucugguuuu

SEQ ID NO: 3877046 - RNA, 19 nt, Human
acugucugguuuuaacaau

SEQ ID NO: 3877047 - RNA, 10 nt, Human
acugucuuaa

SEQ ID NO: 3877048 - RNA, 12 nt, Human
acugucuucagu

SEQ ID NO: 3877049 - RNA, 16 nt, Human
acugucuucuucaggg

SEQ ID NO: 3877050 - RNA, 18 nt, Human
acugucuuuaaaagagag

SEQ ID NO: 3877051 - RNA, 12 nt, Human
acugugaagagc

SEQ ID NO: 3877052 - RNA, 23 nt, Human
acugugacaacugucuaacuuua

SEQ ID NO: 3877053 - RNA, 13 nt, Human
acugugacacacu

SEQ ID NO: 3877054 - RNA, 23 nt, Human
acugugacacacuacaccacaca

SEQ ID NO: 3877055 - RNA, 15 nt, Human
acugugacaggcagc

SEQ ID NO: 3877056 - RNA, 17 nt, Human
acugugacaggcagcag

SEQ ID NO: 3877057 - RNA, 18 nt, Human
acugugacaggcagcaga

SEQ ID NO: 3877058 - RNA, 17 nt, Human
acugugagaacccaguu

SEQ ID NO: 3877059 - RNA, 23 nt, Human
acugugaugaagccgaccuuaga

SEQ ID NO: 3877060 - RNA, 22 nt, Human
acugugauucagaaaauguucu

SEQ ID NO: 3877061 - RNA, 13 nt, Human
acugugauuugaa

SEQ ID NO: 3877062 - RNA, 21 nt, Human
acugugcacaucugugucuug

SEQ ID NO: 3877063 - RNA, 20 nt, Human
acugugcaggugcuauuguu

SEQ ID NO: 3877064 - RNA, 19 nt, Human
acugugcauagugcuggga

SEQ ID NO: 3877065 - RNA, 12 nt, Human
acugugcccugg

SEQ ID NO: 3877066 - RNA, 14 nt, Human
acugugcccuggug

SEQ ID NO: 3877067 - RNA, 22 nt, Human
acugugccucagagaccagggc

SEQ ID NO: 3877068 - RNA, 23 nt, Human
acugugccucagagaccagggcu

SEQ ID NO: 3877069 - RNA, 11 nt, Human
acugugccuuu

SEQ ID NO: 3877070 - RNA, 12 nt, Human
acugugcuaaua

SEQ ID NO: 3877071 - RNA, 18 nt, Human
acugugcuaauaacagug

SEQ ID NO: 3877072 - RNA, 21 nt, Human
acugugcuaauaacagugcau

SEQ ID NO: 3877073 - RNA, 22 nt, Human
acugugcuacugucuuuggaaa

SEQ ID NO: 3877074 - RNA, 18 nt, Human
acugugcuccagccuggg

SEQ ID NO: 3877075 - RNA, 20 nt, Human
acugugcugagucugaaggc

SEQ ID NO: 3877076 - RNA, 22 nt, Human
acugugcugagucugaaggcug

SEQ ID NO: 3877077 - RNA, 21 nt, Human
acugugcuggagccacuaacu

SEQ ID NO: 3877078 - RNA, 22 nt, Human
acugugcuggagccacuaacua

SEQ ID NO: 3877079 - RNA, 14 nt, Human
acugugcuguuguu

SEQ ID NO: 3877080 - RNA, 11 nt, Human
acugugcuuuc

SEQ ID NO: 3877081 - RNA, 20 nt, Human
acugugcuuucuauuguaca

SEQ ID NO: 3877082 - RNA, 11 nt, Human
acuguggagac

SEQ ID NO: 3877083 - RNA, 15 nt, Human
acuguggagacugcu

SEQ ID NO: 3877084 - RNA, 15 nt, Human
acuguggaggaagga

SEQ ID NO: 3877085 - RNA, 17 nt, Human
acuguggaggaaggauu

SEQ ID NO: 3877086 - RNA, 19 nt, Human
acuguggcacuugccuggg

SEQ ID NO: 3877087 - RNA, 23 nt, Human
acuguggccguuaucuggaagua

SEQ ID NO: 3877088 - RNA, 19 nt, Human
acuguggcugcuagcacuu

SEQ ID NO: 3877089 - RNA, 14 nt, Human
acuguggcugucug

SEQ ID NO: 3877090 - RNA, 18 nt, Human
acugugggcaauuuagaa

SEQ ID NO: 3877091 - RNA, 18 nt, Human
acuguggguagacacaca

SEQ ID NO: 3877092 - RNA, 15 nt, Human
acuguggguguguga

SEQ ID NO: 3877093 - RNA, 19 nt, Human
acugugguagguguuugaa

SEQ ID NO: 3877094 - RNA, 20 nt, Human
acuguggugacuuuggauaa

SEQ ID NO: 3877095 - RNA, 21 nt, Human
acuguggugacuuuggauaau

SEQ ID NO: 3877096 - RNA, 21 nt, Human
acuuaauuucuuuauguaauc

SEQ ID NO: 3877097 - RNA, 22 nt, Human
acuuacagagcguggcugugcu

SEQ ID NO: 3877098 - RNA, 19 nt, Human
acuuacauauauuuuuaaa

SEQ ID NO: 3877099 - RNA, 14 nt, Human
acuuacaugauuca

SEQ ID NO: 3877100 - RNA, 15 nt, Human
acuuacauuuacaaa

SEQ ID NO: 3877101 - RNA, 18 nt, Human
acuuaccaggcaccaaaa

SEQ ID NO: 3877102 - RNA, 21 nt, Human
acuuaccaggcaccaaaagaa

SEQ ID NO: 3877103 - RNA, 21 nt, Human
acuuaccuaagugacauuugu

SEQ ID NO: 3877104 - RNA, 16 nt, Human
acuuaccuagugaaac

SEQ ID NO: 3877105 - RNA, 19 nt, Human
acuuaccugaguugaagag

SEQ ID NO: 3877106 - RNA, 15 nt, Human
acuuaccuucaauaa

SEQ ID NO: 3877107 - RNA, 20 nt, Human
acuuaccuucaauaaaguau

SEQ ID NO: 3877108 - RNA, 17 nt, Human
acuuacuaaaauauaua

SEQ ID NO: 3877109 - RNA, 12 nt, Human
acuuacuauuuu

SEQ ID NO: 3877110 - RNA, 18 nt, Human
acuuacugcgacuaaacu

SEQ ID NO: 3877111 - RNA, 16 nt, Human
acuuacuguaagacau

SEQ ID NO: 3877112 - RNA, 17 nt, Human
acuuacuguaagacauu

SEQ ID NO: 3877113 - RNA, 13 nt, Human
acuuacuguacau

SEQ ID NO: 3877114 - RNA, 21 nt, Human
acuuacuguacaugaaaacac

SEQ ID NO: 3877115 - RNA, 16 nt, Human
acuuacuuacccucac

SEQ ID NO: 3877116 - RNA, 15 nt, Human
acuuacuugcuuauu

SEQ ID NO: 3877117 - RNA, 15 nt, Human
acuuacuuuuguaaa

SEQ ID NO: 3877118 - RNA, 21 nt, Human
acuuacuuuuucuggucucua

SEQ ID NO: 3877119 - RNA, 15 nt, Human
acuuagaaagcaggg

SEQ ID NO: 3877120 - RNA, 16 nt, Human
acuuagaaauugcauu

SEQ ID NO: 3877121 - RNA, 15 nt, Human
acuuagaauaaaauu

SEQ ID NO: 3877122 - RNA, 18 nt, Human
acuuagaaucccuguguu

SEQ ID NO: 3877123 - RNA, 20 nt, Human
acuuagaaucccuguguuaa

SEQ ID NO: 3877124 - RNA, 19 nt, Human
acuuagacucuaguauuua

SEQ ID NO: 3877125 - RNA, 23 nt, Human
acuuagagcuuuuuuuuuuuaau

SEQ ID NO: 3877126 - RNA, 16 nt, Human
acuuagauuuuacaug

SEQ ID NO: 3877127 - RNA, 24 nt, Human
acuuagauuuuacaugaaguauuu

SEQ ID NO: 3877128 - RNA, 13 nt, Human
acuuagcaaaaag

SEQ ID NO: 3877129 - RNA, 19 nt, Human
acuuagcauccuaagaaau

SEQ ID NO: 3877130 - RNA, 16 nt, Human
acuuagcaugcacaaa

SEQ ID NO: 3877131 - RNA, 23 nt, Human
acuuagcaugcacaaaguguauu

SEQ ID NO: 3877132 - RNA, 21 nt, Human
acuuagcauuuucugcaucuc

SEQ ID NO: 3877133 - RNA, 23 nt, Human
acuuagccauuuuucaaagcaau

SEQ ID NO: 3877134 - RNA, 17 nt, Human
acuuagccuuuaccugu

SEQ ID NO: 3877135 - RNA, 20 nt, Human
acuuagccuuuaccugugaa

SEQ ID NO: 3877136 - RNA, 15 nt, Human
acuuagccuuucuuu

SEQ ID NO: 3877137 - RNA, 21 nt, Human
acuuagcuggagaugucucua

SEQ ID NO: 3877138 - RNA, 17 nt, Human
agaagcaacagaaaaaa

SEQ ID NO: 3877139 - RNA, 19 nt, Human
agaagcaacccaaauguuc

SEQ ID NO: 3877140 - RNA, 23 nt, Human
agaagcaaccucaguaauuuaga

SEQ ID NO: 3877141 - RNA, 15 nt, Human
agaagcaagaaagaa

SEQ ID NO: 3877142 - RNA, 20 nt, Human
agaagcaauaaagaagagug

SEQ ID NO: 3877143 - RNA, 21 nt, Human
agaagcaauaaagaagagugc

SEQ ID NO: 3877144 - RNA, 14 nt, Human
agaagcagaaauac

SEQ ID NO: 3877145 - RNA, 15 nt, Human
agaagcagaaauaca

SEQ ID NO: 3877146 - RNA, 13 nt, Human
agaagcagaugag

SEQ ID NO: 3877147 - RNA, 18 nt, Human
agaagcaggcuacacuga

SEQ ID NO: 3877148 - RNA, 17 nt, Human
agaagcagugagccgca

SEQ ID NO: 3877149 - RNA, 15 nt, Human
agaagcauacaacuu

SEQ ID NO: 3877150 - RNA, 10 nt, Human
agaagcauuu

SEQ ID NO: 3877151 - RNA, 15 nt, Human
acuuuugcccuuuga

SEQ ID NO: 3877152 - RNA, 14 nt, Human
acuuuuggcauuuu

SEQ ID NO: 3877153 - RNA, 20 nt, Human
acuuuugguuaagucuguuu

SEQ ID NO: 3877154 - RNA, 17 nt, Human
acuuuuguaaagaaauu

SEQ ID NO: 3877155 - RNA, 16 nt, Human
acuuuuguacugaauu

SEQ ID NO: 3877156 - RNA, 17 nt, Human
acuuuuguacugaauuu

SEQ ID NO: 3877157 - RNA, 19 nt, Human
acuuuuguguaaugaaaau

SEQ ID NO: 3877158 - RNA, 13 nt, Human
acuuuuguucuug

SEQ ID NO: 3877159 - RNA, 18 nt, Human
acuuuuuaaaaaacuuuc

SEQ ID NO: 3877160 - RNA, 11 nt, Human
acuuuuuacaa

SEQ ID NO: 3877161 - RNA, 12 nt, Human
acuuuuuauaaa

SEQ ID NO: 3877162 - RNA, 14 nt, Human
acuuuuuauauaua

SEQ ID NO: 3877163 - RNA, 12 nt, Human
acuuuuuauauu

SEQ ID NO: 3877164 - RNA, 21 nt, Human
acuuuuuauauuuuauacauu

SEQ ID NO: 3877165 - RNA, 17 nt, Human
acuuuuuauugccuucu

SEQ ID NO: 3877166 - RNA, 13 nt, Human
acuuuuucauuug

SEQ ID NO: 3877167 - RNA, 11 nt, Human
acuuuuucuga

SEQ ID NO: 3877168 - RNA, 17 nt, Human
acuuuuugaacuaagaa

SEQ ID NO: 3877169 - RNA, 21 nt, Human
acuuuuugaacuaagaaacuu

SEQ ID NO: 3877170 - RNA, 17 nt, Human
acuuuuugguggaugua

SEQ ID NO: 3877171 - RNA, 15 nt, Human
acuuuuugugaagac

SEQ ID NO: 3877172 - RNA, 23 nt, Human
acuuuuuguucugguccuuuuug

SEQ ID NO: 3877173 - RNA, 19 nt, Human
acuuuuuuaaauaaacuuu

SEQ ID NO: 3877174 - RNA, 20 nt, Human
acuuuuuuaaauaaacuuuu

SEQ ID NO: 3877175 - RNA, 15 nt, Human
acuuuuuuauuuaaa

SEQ ID NO: 3877176 - RNA, 13 nt, Human
acuuuuuuccaca

SEQ ID NO: 3877177 - RNA, 12 nt, Human
acuuuuuuuagu

SEQ ID NO: 3877178 - RNA, 16 nt, Human
acuuuuuuucaaugug

SEQ ID NO: 3877179 - RNA, 18 nt, Human
acuuuuuuucuucuacuu

SEQ ID NO: 3877180 - RNA, 14 nt, Human
acuuuuuuuguaug

SEQ ID NO: 3877181 - RNA, 20 nt, Human
agaaaaaaaaaagaagaaga

SEQ ID NO: 3877182 - RNA, 17 nt, Human
agaaaaaaaaagaaaaa

SEQ ID NO: 3877183 - RNA, 13 nt, Human
agaaaaaaaaaug

SEQ ID NO: 3877184 - RNA, 16 nt, Human
agaaaaaaaaaugcca

SEQ ID NO: 3877185 - RNA, 19 nt, Human
agaaaaaaaauaacacaga

SEQ ID NO: 3877186 - RNA, 22 nt, Human
agaaaaaaauaauuuuaugaac

SEQ ID NO: 3877187 - RNA, 17 nt, Human
agaaaaaaaucuucucc

SEQ ID NO: 3877188 - RNA, 14 nt, Human
agaaaaaaauguau

SEQ ID NO: 3877189 - RNA, 23 nt, Human
agaaaaaaauguauuuuauguua

SEQ ID NO: 3877190 - RNA, 13 nt, Human
agaaaaaaauguc

SEQ ID NO: 3877191 - RNA, 19 nt, Human
agaaaaaaauuacuaauuu

SEQ ID NO: 3877192 - RNA, 15 nt, Human
agaaaaaaauucaug

SEQ ID NO: 3877193 - RNA, 17 nt, Human
agaaaaaaauugaaaug

SEQ ID NO: 3877194 - RNA, 18 nt, Human
agaaaaaagagaaaagaa

SEQ ID NO: 3877195 - RNA, 18 nt, Human
agaaaaaauaacacacau

SEQ ID NO: 3877196 - RNA, 14 nt, Human
agaaaaaauacauu

SEQ ID NO: 3877197 - RNA, 16 nt, Human
agaaaaaauacauuuu

SEQ ID NO: 3877198 - RNA, 19 nt, Human
agaaaaaauauuuucccua

SEQ ID NO: 3877199 - RNA, 13 nt, Human
agaaaaacaaauc

SEQ ID NO: 3877200 - RNA, 19 nt, Human
agaaaaacaaugguaacau

SEQ ID NO: 3877201 - RNA, 22 nt, Human
agaaaaacaaugguaacauuuu

SEQ ID NO: 3877202 - RNA, 14 nt, Human
agaaaaagaagcaa

SEQ ID NO: 3877203 - RNA, 12 nt, Human
agaaaaagcaaa

SEQ ID NO: 3877204 - RNA, 14 nt, Human
agaaaaaggagcuu

SEQ ID NO: 3877205 - RNA, 13 nt, Human
agaaaaauaaaga

SEQ ID NO: 3877206 - RNA, 20 nt, Human
agaaaaauaaagaaaagaug

SEQ ID NO: 3877207 - RNA, 15 nt, Human
agaaaaauaacccuu

SEQ ID NO: 3877208 - RNA, 17 nt, Human
agaaaaauauauacuaa

SEQ ID NO: 3877209 - RNA, 15 nt, Human
agaaaaauaucugua

SEQ ID NO: 3877210 - RNA, 19 nt, Human
agaaaaauaugaccacacu

SEQ ID NO: 3877211 - RNA, 15 nt, Human
acugauaaagaaaga

SEQ ID NO: 3877212 - RNA, 15 nt, Human
acugauaguuacugu

SEQ ID NO: 3877213 - RNA, 23 nt, Human
acugauaguuacuguugugaccu

SEQ ID NO: 3877214 - RNA, 17 nt, Human
acugauauauuuuacaa

SEQ ID NO: 3877215 - RNA, 17 nt, Human
acugaucaugcauuguu

SEQ ID NO: 3877216 - RNA, 17 nt, Human
acugauccagcccugag

SEQ ID NO: 3877217 - RNA, 23 nt, Human
acugaucucaggggucuuaccuu

SEQ ID NO: 3877218 - RNA, 15 nt, Human
acugaugcugagauu

SEQ ID NO: 3877219 - RNA, 16 nt, Human
acugaugcugagauuc

SEQ ID NO: 3877220 - RNA, 19 nt, Human
acugaugcugccccucauc

SEQ ID NO: 3877221 - RNA, 20 nt, Human
acugaugcugccccucaucu

SEQ ID NO: 3877222 - RNA, 15 nt, Human
acugaugcuguucuc

SEQ ID NO: 3877223 - RNA, 20 nt, Human
acugaugcuguucucuucuu

SEQ ID NO: 3877224 - RNA, 22 nt, Human
acugauggcuaauguacugcau

SEQ ID NO: 3877225 - RNA, 12 nt, Human
acugaugggcaa

SEQ ID NO: 3877226 - RNA, 18 nt, Human
acugauguacaauuaaaa

SEQ ID NO: 3877227 - RNA, 20 nt, Human
acugauguaugaggaauuuc

SEQ ID NO: 3877228 - RNA, 14 nt, Human
acugaugucuccua

SEQ ID NO: 3877229 - RNA, 17 nt, Human
acugaugucuccuaagc

SEQ ID NO: 3877230 - RNA, 13 nt, Human
acugaugugaaac

SEQ ID NO: 3877231 - RNA, 14 nt, Human
acugaugugaaacu

SEQ ID NO: 3877232 - RNA, 18 nt, Human
acugauguuaggcugggc

SEQ ID NO: 3877233 - RNA, 23 nt, Human
acugauguuaggcugggcccaga

SEQ ID NO: 3877234 - RNA, 13 nt, Human
acugauguugugu

SEQ ID NO: 3877235 - RNA, 18 nt, Human
acugauguuugugcagua

SEQ ID NO: 3877236 - RNA, 20 nt, Human
acugauuaugucuuuuauau

SEQ ID NO: 3877237 - RNA, 18 nt, Human
acugauuauuuucuucau

SEQ ID NO: 3877238 - RNA, 19 nt, Human
acugauucacaucucauuu

SEQ ID NO: 3877239 - RNA, 20 nt, Human
acugauuguuuuagagacua

SEQ ID NO: 3877240 - RNA, 13 nt, Human
acugauuucacaa

SEQ ID NO: 3877241 - RNA, 17 nt, Human
acugauuucacaacaga

SEQ ID NO: 3877242 - RNA, 12 nt, Human
acugauuucaga

SEQ ID NO: 3877243 - RNA, 15 nt, Human
acugauuucaguaag

SEQ ID NO: 3877244 - RNA, 19 nt, Human
acugauuuccccuuuugca

SEQ ID NO: 3877245 - RNA, 22 nt, Human
acugauuuccccuuuugcauuc

SEQ ID NO: 3877246 - RNA, 23 nt, Human
acugauuuccccuuuugcauucu

SEQ ID NO: 3877247 - RNA, 14 nt, Human
acugauuuccuuug

SEQ ID NO: 3877248 - RNA, 22 nt, Human
acugauuugcaauaaaaaugau

SEQ ID NO: 3877249 - RNA, 16 nt, Human
acugauuuggagauau

SEQ ID NO: 3877250 - RNA, 18 nt, Human
acugauuuuuguaagaca

SEQ ID NO: 3877251 - RNA, 14 nt, Human
acugauuuuuguga

SEQ ID NO: 3877252 - RNA, 15 nt, Human
acugauuuuugugau

SEQ ID NO: 3877253 - RNA, 22 nt, Human
acugcaaaaagaaaaucuuuau

SEQ ID NO: 3877254 - RNA, 15 nt, Human
acugcaaaggcgcag

SEQ ID NO: 3877255 - RNA, 21 nt, Human
acugcaaaucaggcuuuuguu

SEQ ID NO: 3877256 - RNA, 21 nt, Human
acugcaaaugucaucagaacu

SEQ ID NO: 3877257 - RNA, 18 nt, Human
acugcaacaggcuugugc

SEQ ID NO: 3877258 - RNA, 13 nt, Human
acugcaaccucca

SEQ ID NO: 3877259 - RNA, 17 nt, Human
acugcaaccucugccuc

SEQ ID NO: 3877260 - RNA, 14 nt, Human
acugcaaccuuguu

SEQ ID NO: 3877261 - RNA, 17 nt, Human
acugcaagagccuuggu

SEQ ID NO: 3877262 - RNA, 15 nt, Human
acugcaagucacaaa

SEQ ID NO: 3877263 - RNA, 19 nt, Human
acugcaaguccuuuuguaa

SEQ ID NO: 3877264 - RNA, 20 nt, Human
acugcaaguccuuuuguaaa

SEQ ID NO: 3877265 - RNA, 16 nt, Human
acugcaauaacuucug

SEQ ID NO: 3877266 - RNA, 17 nt, Human
acugcaauaacuucuga

SEQ ID NO: 3877267 - RNA, 18 nt, Human
acugcaauaacuucugac

SEQ ID NO: 3877268 - RNA, 17 nt, Human
acugcaauagagacugu

SEQ ID NO: 3877269 - RNA, 22 nt, Human
acugcaauagagacuguagauu

SEQ ID NO: 3877270 - RNA, 20 nt, Human
acugcaauccugucuuucug

SEQ ID NO: 3877271 - RNA, 21 nt, Human
acugcaauccugucuuucuga

SEQ ID NO: 3877272 - RNA, 15 nt, Human
acugcaaugugaucu

SEQ ID NO: 3877273 - RNA, 14 nt, Human
acugcacaauaacu

SEQ ID NO: 3877274 - RNA, 20 nt, Human
acugcacaauaacuccuccc

SEQ ID NO: 3877275 - RNA, 12 nt, Human
acugcacagagc

SEQ ID NO: 3877276 - RNA, 17 nt, Human
acugcacagagcucucc

SEQ ID NO: 3877277 - RNA, 18 nt, Human
acugcacagagcucucca

SEQ ID NO: 3877278 - RNA, 23 nt, Human
acugcacagagcucuccagcucc

SEQ ID NO: 3877279 - RNA, 16 nt, Human
acugcacagugcaucu

SEQ ID NO: 3877280 - RNA, 22 nt, Human
acugcacagugcaucucagccc

SEQ ID NO: 3877281 - RNA, 16 nt, Human
acugcacaugaagaaa

SEQ ID NO: 3877282 - RNA, 18 nt, Human
acugcacaugaagaaaua

SEQ ID NO: 3877283 - RNA, 19 nt, Human
acugcacaugauuucacaa

SEQ ID NO: 3877284 - RNA, 20 nt, Human
acugcacaugauuucacaaa

SEQ ID NO: 3877285 - RNA, 21 nt, Human
acugcacaugauuucacaaau

SEQ ID NO: 3877286 - RNA, 16 nt, Human
acugcacccccuccug

SEQ ID NO: 3877287 - RNA, 19 nt, Human
acugcacccccuccugcug

SEQ ID NO: 3877288 - RNA, 20 nt, Human
acugcacccccuccugcugc

SEQ ID NO: 3877289 - RNA, 21 nt, Human
acugcacccccuccugcugca

SEQ ID NO: 3877290 - RNA, 16 nt, Human
acugcaccgggccaca

SEQ ID NO: 3877291 - RNA, 21 nt, Human
acugcacuauagccuagguga

SEQ ID NO: 3877292 - RNA, 13 nt, Human
acugcacuccagc

SEQ ID NO: 3877293 - RNA, 18 nt, Human
acugcacuccagccuggg

SEQ ID NO: 3877294 - RNA, 19 nt, Human
acugcacuccagccugggc

SEQ ID NO: 3877295 - RNA, 20 nt, Human
acugcacuccagccugggca

SEQ ID NO: 3877296 - RNA, 21 nt, Human
acugcacuccagccugggcga

SEQ ID NO: 3877297 - RNA, 20 nt, Human
acugcacuccagccugggug

SEQ ID NO: 3877298 - RNA, 17 nt, Human
acugcacucuagccgga

SEQ ID NO: 3877299 - RNA, 16 nt, Human
acugcagaccuguccu

SEQ ID NO: 3877300 - RNA, 14 nt, Human
acugcagauugaga

SEQ ID NO: 3877301 - RNA, 20 nt, Human
acugcagauugagaccuaca

SEQ ID NO: 3877302 - RNA, 23 nt, Human
acugcagauugagaccuacaggc

SEQ ID NO: 3877303 - RNA, 21 nt, Human
acugcagcaaucuuugaaaga

SEQ ID NO: 3877304 - RNA, 14 nt, Human
acugcagcaccucc

SEQ ID NO: 3877305 - RNA, 15 nt, Human
acugcagcaccucca

SEQ ID NO: 3877306 - RNA, 22 nt, Human
acugcagccucaaccuccuggg

SEQ ID NO: 3877307 - RNA, 22 nt, Human
acugcagccucgaacuccuggg

SEQ ID NO: 3877308 - RNA, 19 nt, Human
acugcaggcaucacagcua

SEQ ID NO: 3877309 - RNA, 12 nt, Human
acugcaggcccc

SEQ ID NO: 3877310 - RNA, 18 nt, Human
acugcaggcccuggccuc

SEQ ID NO: 3877311 - RNA, 17 nt, Human
acugcaggucaaguugu

SEQ ID NO: 3877312 - RNA, 22 nt, Human
acugcagugaaagacaagcugc

SEQ ID NO: 3877313 - RNA, 22 nt, Human
acugcauaccaaccugggcaau

SEQ ID NO: 3877314 - RNA, 14 nt, Human
acugcaugcacuuc

SEQ ID NO: 3877315 - RNA, 22 nt, Human
acugcaugcccagagacccagc

SEQ ID NO: 3877316 - RNA, 14 nt, Human
acugcauggaccua

SEQ ID NO: 3877317 - RNA, 21 nt, Human
acugcauggaccuaacauucg

SEQ ID NO: 3877318 - RNA, 14 nt, Human
acugcauuauauuu

SEQ ID NO: 3877319 - RNA, 17 nt, Human
acugcauucuucugauc

SEQ ID NO: 3877320 - RNA, 21 nt, Human
acugcauugacuuucaguaaa

SEQ ID NO: 3877321 - RNA, 14 nt, Human
acugcauuuaggga

SEQ ID NO: 3877322 - RNA, 12 nt, Human
acugcauuugug

SEQ ID NO: 3877323 - RNA, 17 nt, Human
acugccaaaaugcucua

SEQ ID NO: 3877324 - RNA, 18 nt, Human
acugccaaccucgcucca

SEQ ID NO: 3877325 - RNA, 19 nt, Human
acugccaacugaucuguua

SEQ ID NO: 3877326 - RNA, 23 nt, Human
acugccaauauagaaaaauaaaa

SEQ ID NO: 3877327 - RNA, 20 nt, Human
acugccacaaggaagaaauu

SEQ ID NO: 3877328 - RNA, 12 nt, Human
acugccaccucc

SEQ ID NO: 3877329 - RNA, 14 nt, Human
acugccagaugcug

SEQ ID NO: 3877330 - RNA, 19 nt, Human
acugccagaugcugauguu

SEQ ID NO: 3877331 - RNA, 22 nt, Human
acugccagaugcugauguucag

SEQ ID NO: 3877332 - RNA, 13 nt, Human
acugccagcagca

SEQ ID NO: 3877333 - RNA, 14 nt, Human
acugccagcagcag

SEQ ID NO: 3877334 - RNA, 16 nt, Human
acugccagcagcagca

SEQ ID NO: 3877335 - RNA, 18 nt, Human
acugccagcagcagcagg

SEQ ID NO: 3877336 - RNA, 12 nt, Human
acugccagcucu

SEQ ID NO: 3877337 - RNA, 13 nt, Human
acugccaggaggg

SEQ ID NO: 3877338 - RNA, 15 nt, Human
acugccaggccagcc

SEQ ID NO: 3877339 - RNA, 23 nt, Human
acugccaggccagccuccgagag

SEQ ID NO: 3877340 - RNA, 15 nt, Human
acugccauaaaacau

SEQ ID NO: 3877341 - RNA, 21 nt, Human
acugccauauuaaauuuuuug

SEQ ID NO: 3877342 - RNA, 20 nt, Human
acugccauuauuuucuguca

SEQ ID NO: 3877343 - RNA, 22 nt, Human
acugccauuauuuucugucaga

SEQ ID NO: 3877344 - RNA, 17 nt, Human
acugccccaacuccugg

SEQ ID NO: 3877345 - RNA, 18 nt, Human
acugccccaacuccugga

SEQ ID NO: 3877346 - RNA, 16 nt, Human
acugcccccucugccc

SEQ ID NO: 3877347 - RNA, 18 nt, Human
acugcccccucugcccug

SEQ ID NO: 3877348 - RNA, 18 nt, Human
acugccccgugcagacug

SEQ ID NO: 3877349 - RNA, 19 nt, Human
acugccccgugcagacugg

SEQ ID NO: 3877350 - RNA, 14 nt, Human
acugcccgcacacc

SEQ ID NO: 3877351 - RNA, 19 nt, Human
acugcccgcacacccucac

SEQ ID NO: 3877352 - RNA, 22 nt, Human
acugcccggggcagcugccaga

SEQ ID NO: 3877353 - RNA, 23 nt, Human
acugcccuccagcucuuuccucc

SEQ ID NO: 3877354 - RNA, 18 nt, Human
acugccgaccgaggcugg

SEQ ID NO: 3877355 - RNA, 19 nt, Human
agaaccagucuuucaacuc

SEQ ID NO: 3877356 - RNA, 22 nt, Human
agaaccagucuuucaacucauu

SEQ ID NO: 3877357 - RNA, 18 nt, Human
agaaccaguuucaggugu

SEQ ID NO: 3877358 - RNA, 22 nt, Human
agaaccaucccuauuuuguauu

SEQ ID NO: 3877359 - RNA, 14 nt, Human
agaaccccucugcu

SEQ ID NO: 3877360 - RNA, 16 nt, Human
agaaccccucugcuuu

SEQ ID NO: 3877361 - RNA, 16 nt, Human
agaacccugccaugga

SEQ ID NO: 3877362 - RNA, 14 nt, Human
agaaccgagcaaag

SEQ ID NO: 3877363 - RNA, 16 nt, Human
agaaccgagcaaagau

SEQ ID NO: 3877364 - RNA, 21 nt, Human
agaaccgagcaaagaucaaaa

SEQ ID NO: 3877365 - RNA, 22 nt, Human
agaaccgagcaaagaucaaaau

SEQ ID NO: 3877366 - RNA, 13 nt, Human
agaaccuaacaug

SEQ ID NO: 3877367 - RNA, 17 nt, Human
agaaccuaacuguaucu

SEQ ID NO: 3877368 - RNA, 18 nt, Human
agaaccuaacuguaucuu

SEQ ID NO: 3877369 - RNA, 14 nt, Human
agaaccuaauucaa

SEQ ID NO: 3877370 - RNA, 19 nt, Human
agaaccucaggcuuccuug

SEQ ID NO: 3877371 - RNA, 23 nt, Human
agaaccuggaaaaauuccagaag

SEQ ID NO: 3877372 - RNA, 12 nt, Human
agaaccuggaga

SEQ ID NO: 3877373 - RNA, 14 nt, Human
agaaccuggccuuc

SEQ ID NO: 3877374 - RNA, 14 nt, Human
agaaccuucucuau

SEQ ID NO: 3877375 - RNA, 23 nt, Human
agaaccuuuugagugccuuacac

SEQ ID NO: 3877376 - RNA, 12 nt, Human
agaacggaagaa

SEQ ID NO: 3877377 - RNA, 22 nt, Human
agaacggacgagauaaugugaa

SEQ ID NO: 3877378 - RNA, 17 nt, Human
agaacguaaagaacuuu

SEQ ID NO: 3877379 - RNA, 20 nt, Human
agaacguauuuuaaaagcca

SEQ ID NO: 3877380 - RNA, 20 nt, Human
agaacguuuuuuccucagug

SEQ ID NO: 3877381 - RNA, 17 nt, Human
agaacuaaaauguucua

SEQ ID NO: 3877382 - RNA, 11 nt, Human
agaacuaaaug

SEQ ID NO: 3877383 - RNA, 13 nt, Human
agaacuaaauguu

SEQ ID NO: 3877384 - RNA, 22 nt, Human
agaacuacaaacaaaauuucua

SEQ ID NO: 3877385 - RNA, 23 nt, Human
agaacuacaaacaaaauuucuau

SEQ ID NO: 3877386 - RNA, 17 nt, Human
agaacuagaaccuggag

SEQ ID NO: 3877387 - RNA, 18 nt, Human
agaacuagaaccuggagg

SEQ ID NO: 3877388 - RNA, 15 nt, Human
agaacuagcauauag

SEQ ID NO: 3877389 - RNA, 17 nt, Human
agaacuagccaaaccag

SEQ ID NO: 3877390 - RNA, 21 nt, Human
agaacuauaugugaauccucu

SEQ ID NO: 3877391 - RNA, 14 nt, Human
agaacuaucuucau

SEQ ID NO: 3877392 - RNA, 18 nt, Human
agaacuaucuucaucuga

SEQ ID NO: 3877393 - RNA, 15 nt, Human
agaacucacucuggg

SEQ ID NO: 3877394 - RNA, 19 nt, Human
agaacucaucacuguggcu

SEQ ID NO: 3877395 - RNA, 23 nt, Human
agaacucaucccuaaugcugcag

SEQ ID NO: 3877396 - RNA, 21 nt, Human
agaacucaugacggaagaguu

SEQ ID NO: 3877397 - RNA, 19 nt, Human
agaacucauguuauuuuuu

SEQ ID NO: 3877398 - RNA, 16 nt, Human
agaacuccaggcccuc

SEQ ID NO: 3877399 - RNA, 14 nt, Human
agaacuccugacug

SEQ ID NO: 3877400 - RNA, 18 nt, Human
agaacucgcgcucaguaa

SEQ ID NO: 3877401 - RNA, 21 nt, Human
agaacucgcgcucaguaaacg

SEQ ID NO: 3877402 - RNA, 12 nt, Human
agaacucugccu

SEQ ID NO: 3877403 - RNA, 13 nt, Human
agaacucugccug

SEQ ID NO: 3877404 - RNA, 14 nt, Human
agaacucugccugc

SEQ ID NO: 3877405 - RNA, 14 nt, Human
agaacucuggcuuu

SEQ ID NO: 3877406 - RNA, 20 nt, Human
agaacucugggcugcuaccc

SEQ ID NO: 3877407 - RNA, 13 nt, Human
agaacucuuccuc

SEQ ID NO: 3877408 - RNA, 22 nt, Human
agaacucuuccuccaaggacag

SEQ ID NO: 3877409 - RNA, 14 nt, Human
agaacugaaaacau

SEQ ID NO: 3877410 - RNA, 17 nt, Human
agaacugaaaacauaaa

SEQ ID NO: 3877411 - RNA, 21 nt, Human
agaacugaaccggcuuuacca

SEQ ID NO: 3877412 - RNA, 15 nt, Human
agaacugaaugagaa

SEQ ID NO: 3877413 - RNA, 16 nt, Human
agaacugagcuccucu

SEQ ID NO: 3877414 - RNA, 15 nt, Human
agaacugcacaugaa

SEQ ID NO: 3877415 - RNA, 18 nt, Human
agaacugcaggcccuggc

SEQ ID NO: 3877416 - RNA, 15 nt, Human
agaacugcauauguu

SEQ ID NO: 3877417 - RNA, 11 nt, Human
agaacugccau

SEQ ID NO: 3877418 - RNA, 20 nt, Human
agaacugccauuauuuucug

SEQ ID NO: 3877419 - RNA, 22 nt, Human
agaacuggacucaggaugccca

SEQ ID NO: 3877420 - RNA, 21 nt, Human
agaacuggauuuucagaccug

SEQ ID NO: 3877421 - RNA, 15 nt, Human
agaacuggguaaaug

SEQ ID NO: 3877422 - RNA, 20 nt, Human
agaacuggguaaaugcaaag

SEQ ID NO: 3877423 - RNA, 22 nt, Human
agaacugucauguaaacauacc

SEQ ID NO: 3877424 - RNA, 23 nt, Human
agaacugucggaggaaagacaac

SEQ ID NO: 3877425 - RNA, 14 nt, Human
agaacugucuguga

SEQ ID NO: 3877426 - RNA, 20 nt, Human
agaacuguguuucaaguuca

SEQ ID NO: 3877427 - RNA, 21 nt, Human
agaacuguguuucaaguucaa

SEQ ID NO: 3877428 - RNA, 21 nt, Human
agaacuuacugauuauuuucu

SEQ ID NO: 3877429 - RNA, 16 nt, Human
agaacuucagaaagac

SEQ ID NO: 3877430 - RNA, 18 nt, Human
agaacuuccccauacaaa

SEQ ID NO: 3877431 - RNA, 13 nt, Human
agaacuucccuga

SEQ ID NO: 3877432 - RNA, 21 nt, Human
agaacuucccugauugaccug

SEQ ID NO: 3877433 - RNA, 17 nt, Human
agaacuugaagccugcu

SEQ ID NO: 3877434 - RNA, 18 nt, Human
agaacuugaaugugucag

SEQ ID NO: 3877435 - RNA, 15 nt, Human
agaacuugacccuga

SEQ ID NO: 3877436 - RNA, 14 nt, Human
agaacuugcugccu

SEQ ID NO: 3877437 - RNA, 23 nt, Human
agaacuuggauguaccugccccc

SEQ ID NO: 3877438 - RNA, 14 nt, Human
agaacuuucauuuu

SEQ ID NO: 3877439 - RNA, 15 nt, Human
agaacuuuuuuaaau

SEQ ID NO: 3877440 - RNA, 17 nt, Human
agaacuuuuuuaaauaa

SEQ ID NO: 3877441 - RNA, 18 nt, Human
agaacuuuuuuaaauaaa

SEQ ID NO: 3877442 - RNA, 14 nt, Human
agaagaaaaaaacg

SEQ ID NO: 3877443 - RNA, 12 nt, Human
agaagaaaagag

SEQ ID NO: 3877444 - RNA, 18 nt, Human
agaagaaaagagaagaag

SEQ ID NO: 3877445 - RNA, 20 nt, Human
agaagaaaagagaagaagaa

SEQ ID NO: 3877446 - RNA, 19 nt, Human
agaagaaaauggaaccagg

SEQ ID NO: 3877447 - RNA, 23 nt, Human
agaagaaaauggaaccaggcuug

SEQ ID NO: 3877448 - RNA, 12 nt, Human
agaagaaaauuc

SEQ ID NO: 3877449 - RNA, 13 nt, Human
agaagaaacaagg

SEQ ID NO: 3877450 - RNA, 21 nt, Human
agaagaaacaagguuuucagu

SEQ ID NO: 3877451 - RNA, 13 nt, Human
agaagaaacuagg

SEQ ID NO: 3877452 - RNA, 18 nt, Human
agaagaaagaacggaaga

SEQ ID NO: 3877453 - RNA, 14 nt, Human
agaagaaagacucu

SEQ ID NO: 3877454 - RNA, 15 nt, Human
agaagaaagacucua

SEQ ID NO: 3877455 - RNA, 18 nt, Human
agaagaaauaguucugug

SEQ ID NO: 3877456 - RNA, 13 nt, Human
agaagaaaugaaa

SEQ ID NO: 3877457 - RNA, 23 nt, Human
agaagaacuagagguuuuaugau

SEQ ID NO: 3877458 - RNA, 19 nt, Human
agaagaacuauaugugaau

SEQ ID NO: 3877459 - RNA, 21 nt, Human
agaagaacuguguuucaaguu

SEQ ID NO: 3877460 - RNA, 13 nt, Human
agaagaagaaaaa

SEQ ID NO: 3877461 - RNA, 14 nt, Human
agaagaagaagaaa

SEQ ID NO: 3877462 - RNA, 14 nt, Human
agaagaaggcagca

SEQ ID NO: 3877463 - RNA, 17 nt, Human
agaagaagucagagagg

SEQ ID NO: 3877464 - RNA, 18 nt, Human
agaagaauauucaggacu

SEQ ID NO: 3877465 - RNA, 19 nt, Human
agaagaauauucaggacuu

SEQ ID NO: 3877466 - RNA, 14 nt, Human
agaagaauauugua

SEQ ID NO: 3877467 - RNA, 22 nt, Human
agaagaauauuguauuguuaga

SEQ ID NO: 3877468 - RNA, 14 nt, Human
agaagaauauuguu

SEQ ID NO: 3877469 - RNA, 20 nt, Human
agaagaauauuguuccuaag

SEQ ID NO: 3877470 - RNA, 15 nt, Human
agaagaaugcaugcu

SEQ ID NO: 3877471 - RNA, 19 nt, Human
agaagaauguguuucaaac

SEQ ID NO: 3877472 - RNA, 15 nt, Human
agaagaauuugaaga

SEQ ID NO: 3877473 - RNA, 22 nt, Human
agaagaauuugaagacuucaaa

SEQ ID NO: 3877474 - RNA, 15 nt, Human
agaagacaaaaagac

SEQ ID NO: 3877475 - RNA, 12 nt, Human
agaagacaaaau

SEQ ID NO: 3877476 - RNA, 15 nt, Human
agaagacaaacuuug

SEQ ID NO: 3877477 - RNA, 13 nt, Human
agaagacacugau

SEQ ID NO: 3877478 - RNA, 18 nt, Human
agaagacaggcuggaaga

SEQ ID NO: 3877479 - RNA, 22 nt, Human
agaagacauggagacuccugcc

SEQ ID NO: 3877480 - RNA, 19 nt, Human
agaagacauguuuuagaca

SEQ ID NO: 3877481 - RNA, 18 nt, Human
agaagacugcauuauauu

SEQ ID NO: 3877482 - RNA, 13 nt, Human
agaagagaagcug

SEQ ID NO: 3877483 - RNA, 15 nt, Human
agaagagaagcugcu

SEQ ID NO: 3877484 - RNA, 17 nt, Human
agaagagaagcugcuga

SEQ ID NO: 3877485 - RNA, 22 nt, Human
agaagagaauauuagcuuuacu

SEQ ID NO: 3877486 - RNA, 12 nt, Human
agaagagacagg

SEQ ID NO: 3877487 - RNA, 15 nt, Human
agaagagagaaauag

SEQ ID NO: 3877488 - RNA, 15 nt, Human
agaagagaggagagg

SEQ ID NO: 3877489 - RNA, 15 nt, Human
agaagagaggggaag

SEQ ID NO: 3877490 - RNA, 22 nt, Human
agaagagaguccauauuucaau

SEQ ID NO: 3877491 - RNA, 17 nt, Human
agaagagaucaggaaga

SEQ ID NO: 3877492 - RNA, 21 nt, Human
agaagagauugugguuucauu

SEQ ID NO: 3877493 - RNA, 11 nt, Human
agaagagccac

SEQ ID NO: 3877494 - RNA, 13 nt, Human
agaagagccccac

SEQ ID NO: 3877495 - RNA, 23 nt, Human
agaagagcgcaguguuuugcaag

SEQ ID NO: 3877496 - RNA, 12 nt, Human
agaagagggaga

SEQ ID NO: 3877497 - RNA, 18 nt, Human
agaagagggccuguggga

SEQ ID NO: 3877498 - RNA, 14 nt, Human
agaagauaauuguu

SEQ ID NO: 3877499 - RNA, 19 nt, Human
agaagaucacgcuccccgc

SEQ ID NO: 3877500 - RNA, 14 nt, Human
agaagauccccuca

SEQ ID NO: 3877501 - RNA, 15 nt, Human
agaagaucuuugggc

SEQ ID NO: 3877502 - RNA, 19 nt, Human
agaagaugaauacaaacaa

SEQ ID NO: 3877503 - RNA, 16 nt, Human
agaagaugacuuccca

SEQ ID NO: 3877504 - RNA, 17 nt, Human
agaagaugaucagaccu

SEQ ID NO: 3877505 - RNA, 19 nt, Human
agaagauggcacuuauaac

SEQ ID NO: 3877506 - RNA, 15 nt, Human
acuccuuccuggccu

SEQ ID NO: 3877507 - RNA, 19 nt, Human
acuccuuccuggccugaga

SEQ ID NO: 3877508 - RNA, 20 nt, Human
acuccuuccuggccugagag

SEQ ID NO: 3877509 - RNA, 23 nt, Human
acuccuuccuggccugagaguca

SEQ ID NO: 3877510 - RNA, 21 nt, Human
acuccuugagagaccaggcaa

SEQ ID NO: 3877511 - RNA, 23 nt, Human
acuccuugagagaccaggcaaag

SEQ ID NO: 3877512 - RNA, 23 nt, Human
acuccuugauuuuagccuucucu

SEQ ID NO: 3877513 - RNA, 17 nt, Human
acuccuugcaucaaggg

SEQ ID NO: 3877514 - RNA, 19 nt, Human
acuccuugcaucaaggggu

SEQ ID NO: 3877515 - RNA, 16 nt, Human
acuccuuggccuagcc

SEQ ID NO: 3877516 - RNA, 15 nt, Human
acucgaaucugugug

SEQ ID NO: 3877517 - RNA, 17 nt, Human
acucgagaacuuucauu

SEQ ID NO: 3877518 - RNA, 19 nt, Human
acucgaggacuguauuugu

SEQ ID NO: 3877519 - RNA, 16 nt, Human
acucgaguuacagaca

SEQ ID NO: 3877520 - RNA, 15 nt, Human
acucgcccgcccacu

SEQ ID NO: 3877521 - RNA, 21 nt, Human
acucgcccgcccacuguccug

SEQ ID NO: 3877522 - RNA, 15 nt, Human
acucgcgacaaugca

SEQ ID NO: 3877523 - RNA, 16 nt, Human
acucgcgacaaugcaa

SEQ ID NO: 3877524 - RNA, 20 nt, Human
acucgcgacaaugcaaacca

SEQ ID NO: 3877525 - RNA, 23 nt, Human
acucgcgacaaugcaaaccauca

SEQ ID NO: 3877526 - RNA, 14 nt, Human
acucgcuagcagug

SEQ ID NO: 3877527 - RNA, 18 nt, Human
acucgcuagcaguggcag

SEQ ID NO: 3877528 - RNA, 23 nt, Human
acucgcuagcaguggcaggcaga

SEQ ID NO: 3877529 - RNA, 15 nt, Human
acucgcuguaugaaa

SEQ ID NO: 3877530 - RNA, 13 nt, Human
acucgcuuguaaa

SEQ ID NO: 3877531 - RNA, 17 nt, Human
acucgcuugugcagaaa

SEQ ID NO: 3877532 - RNA, 23 nt, Human
acucgcuugugcagaaaacauug

SEQ ID NO: 3877533 - RNA, 22 nt, Human
acucggcagcccuuccaaacuc

SEQ ID NO: 3877534 - RNA, 21 nt, Human
acucggccucccaaagugcug

SEQ ID NO: 3877535 - RNA, 15 nt, Human
acucggcucugcagu

SEQ ID NO: 3877536 - RNA, 20 nt, Human
acucgggaggcugagacagg

SEQ ID NO: 3877537 - RNA, 22 nt, Human
acucgggaggcugagacaggag

SEQ ID NO: 3877538 - RNA, 21 nt, Human
acucgggaggcugaggcacaa

SEQ ID NO: 3877539 - RNA, 21 nt, Human
acucgggaggcugaggcagga

SEQ ID NO: 3877540 - RNA, 15 nt, Human
acucgggcuccugug

SEQ ID NO: 3877541 - RNA, 23 nt, Human
acucgguguccccaccaucugcu

SEQ ID NO: 3877542 - RNA, 19 nt, Human
acucguauagcaugcaucu

SEQ ID NO: 3877543 - RNA, 14 nt, Human
acucguauaugucu

SEQ ID NO: 3877544 - RNA, 16 nt, Human
acucgucugacugugu

SEQ ID NO: 3877545 - RNA, 15 nt, Human
acucuaaaagguuca

SEQ ID NO: 3877546 - RNA, 16 nt, Human
acucuaaaagguucag

SEQ ID NO: 3877547 - RNA, 21 nt, Human
acucuaaaauuauaaaugaca

SEQ ID NO: 3877548 - RNA, 14 nt, Human
acucuaaagaccaa

SEQ ID NO: 3877549 - RNA, 18 nt, Human
acucuaaagaccaaacuu

SEQ ID NO: 3877550 - RNA, 22 nt, Human
acucuaaauucuuuauuucugu

SEQ ID NO: 3877551 - RNA, 18 nt, Human
acucuaacuguauauuug

SEQ ID NO: 3877552 - RNA, 21 nt, Human
acucuaacuguauauuuguau

SEQ ID NO: 3877553 - RNA, 13 nt, Human
acucuaagaaaga

SEQ ID NO: 3877554 - RNA, 12 nt, Human
acucuaagaucu

SEQ ID NO: 3877555 - RNA, 13 nt, Human
acucuaagaucuu

SEQ ID NO: 3877556 - RNA, 17 nt, Human
acucuaagaucuuagau

SEQ ID NO: 3877557 - RNA, 20 nt, Human
acucuaagaucuuagauucu

SEQ ID NO: 3877558 - RNA, 14 nt, Human
acucuaagauguua

SEQ ID NO: 3877559 - RNA, 20 nt, Human
acucuaagucauguauguuu

SEQ ID NO: 3877560 - RNA, 23 nt, Human
acucuaaguguuugcugcaauuu

SEQ ID NO: 3877561 - RNA, 21 nt, Human
acucuaauagugcuuaaaaau

SEQ ID NO: 3877562 - RNA, 13 nt, Human
acucuaauucuaa

SEQ ID NO: 3877563 - RNA, 16 nt, Human
acucuaauucuaacca

SEQ ID NO: 3877564 - RNA, 21 nt, Human
acucuaauucuaaccagagca

SEQ ID NO: 3877565 - RNA, 13 nt, Human
acucuacauaauu

SEQ ID NO: 3877566 - RNA, 16 nt, Human
acucuacaugcuuguu

SEQ ID NO: 3877567 - RNA, 17 nt, Human
acucuacccauauuaca

SEQ ID NO: 3877568 - RNA, 19 nt, Human
acucuacccauauuacaga

SEQ ID NO: 3877569 - RNA, 16 nt, Human
acucuacccucccacc

SEQ ID NO: 3877570 - RNA, 18 nt, Human
acucuacccucccacccc

SEQ ID NO: 3877571 - RNA, 13 nt, Human
acucuaccucaua

SEQ ID NO: 3877572 - RNA, 22 nt, Human
acucuaccucauaucaguuugc

SEQ ID NO: 3877573 - RNA, 20 nt, Human
acucuagacaagauauugua

SEQ ID NO: 3877574 - RNA, 21 nt, Human
acucuagacaagauauuguac

SEQ ID NO: 3877575 - RNA, 14 nt, Human
acucuagaguccaa

SEQ ID NO: 3877576 - RNA, 20 nt, Human
acucuagauaccuaaaacau

SEQ ID NO: 3877577 - RNA, 22 nt, Human
acucuagaugaaguuuuacauu

SEQ ID NO: 3877578 - RNA, 14 nt, Human
acucuagauuccau

SEQ ID NO: 3877579 - RNA, 21 nt, Human
acucuagauuuuguuuugcuu

SEQ ID NO: 3877580 - RNA, 23 nt, Human
acucuagauuuuguuuugcuuuu

SEQ ID NO: 3877581 - RNA, 21 nt, Human
acucuaggauguauauuuuau

SEQ ID NO: 3877582 - RNA, 17 nt, Human
acucuagggaaaaacca

SEQ ID NO: 3877583 - RNA, 13 nt, Human
acucuagggcagu

SEQ ID NO: 3877584 - RNA, 21 nt, Human
acucuaggggucaggcuccau

SEQ ID NO: 3877585 - RNA, 23 nt, Human
acucuagucaaugacaugaauuu

SEQ ID NO: 3877586 - RNA, 16 nt, Human
acucuaucaaguauua

SEQ ID NO: 3877587 - RNA, 16 nt, Human
acucuaucugggccug

SEQ ID NO: 3877588 - RNA, 17 nt, Human
acucuaucugggccugg

SEQ ID NO: 3877589 - RNA, 19 nt, Human
acucuaugccccaaauaua

SEQ ID NO: 3877590 - RNA, 23 nt, Human
acucuauggguaucaaacagcuc

SEQ ID NO: 3877591 - RNA, 12 nt, Human
acucuauucuuu

SEQ ID NO: 3877592 - RNA, 14 nt, Human
acucuauuuuuaca

SEQ ID NO: 3877593 - RNA, 22 nt, Human
acucucacacugguucucaaug

SEQ ID NO: 3877594 - RNA, 15 nt, Human
acucucagcccagaa

SEQ ID NO: 3877595 - RNA, 16 nt, Human
acucucagcccagaag

SEQ ID NO: 3877596 - RNA, 21 nt, Human
acucucagcccagaagaaaau

SEQ ID NO: 3877597 - RNA, 22 nt, Human
acucucaggaccaaagcuuuca

SEQ ID NO: 3877598 - RNA, 18 nt, Human
acucucaggaucaagaaa

SEQ ID NO: 3877599 - RNA, 16 nt, Human
acucucagucucugag

SEQ ID NO: 3877600 - RNA, 17 nt, Human
acucucagucucugagc

SEQ ID NO: 3877601 - RNA, 14 nt, Human
acucucauucccca

SEQ ID NO: 3877602 - RNA, 18 nt, Human
acggauuauuuuuucaga

SEQ ID NO: 3877603 - RNA, 19 nt, Human
acggauuauuuuuucagac

SEQ ID NO: 3877604 - RNA, 21 nt, Human
acggauuauuuuuucagaccg

SEQ ID NO: 3877605 - RNA, 15 nt, Human
acggauuuauuuuuc

SEQ ID NO: 3877606 - RNA, 20 nt, Human
acggcaccugggcccugggg

SEQ ID NO: 3877607 - RNA, 21 nt, Human
acggcaccugggcccuggggc

SEQ ID NO: 3877608 - RNA, 19 nt, Human
acggcacggucuucccucu

SEQ ID NO: 3877609 - RNA, 16 nt, Human
acggcacuguggccuu

SEQ ID NO: 3877610 - RNA, 15 nt, Human
acggcaggcucacug

SEQ ID NO: 3877611 - RNA, 17 nt, Human
acggcaggcucacugcc

SEQ ID NO: 3877612 - RNA, 21 nt, Human
acggcauuagcuuccugcccc

SEQ ID NO: 3877613 - RNA, 16 nt, Human
acggccaacaaagcug

SEQ ID NO: 3877614 - RNA, 15 nt, Human
acggccaagaaugua

SEQ ID NO: 3877615 - RNA, 15 nt, Human
acggccacacagcug

SEQ ID NO: 3877616 - RNA, 13 nt, Human
acggccacaucaa

SEQ ID NO: 3877617 - RNA, 12 nt, Human
acggccaggcca

SEQ ID NO: 3877618 - RNA, 17 nt, Human
acggccagggagaagcu

SEQ ID NO: 3877619 - RNA, 20 nt, Human
acggccaucucuuuguacag

SEQ ID NO: 3877620 - RNA, 22 nt, Human
acggccaucucuuuguacagga

SEQ ID NO: 3877621 - RNA, 22 nt, Human
acggcccucaucuaugaggaaa

SEQ ID NO: 3877622 - RNA, 11 nt, Human
acggcccugca

SEQ ID NO: 3877623 - RNA, 23 nt, Human
acggcccuggccuugggcccucu

SEQ ID NO: 3877624 - RNA, 14 nt, Human
acggccgcuccagg

SEQ ID NO: 3877625 - RNA, 18 nt, Human
acggccugaugcucccuc

SEQ ID NO: 3877626 - RNA, 19 nt, Human
acggccugaugcucccucc

SEQ ID NO: 3877627 - RNA, 20 nt, Human
acggccugaugcucccuccc

SEQ ID NO: 3877628 - RNA, 23 nt, Human
acggccuugcugggggccgcccu

SEQ ID NO: 3877629 - RNA, 21 nt, Human
acggccuuucuagccuggcua

SEQ ID NO: 3877630 - RNA, 16 nt, Human
acggcuaagaggcugc

SEQ ID NO: 3877631 - RNA, 16 nt, Human
acggcucacugcagcc

SEQ ID NO: 3877632 - RNA, 18 nt, Human
acggcucacugcagccuc

SEQ ID NO: 3877633 - RNA, 19 nt, Human
acggcucacugcagccuca

SEQ ID NO: 3877634 - RNA, 19 nt, Human
acggcucuguccccagccu

SEQ ID NO: 3877635 - RNA, 16 nt, Human
acggcugcgcacugug

SEQ ID NO: 3877636 - RNA, 15 nt, Human
acgggaccgggccgc

SEQ ID NO: 3877637 - RNA, 15 nt, Human
acgggacugacgcaa

SEQ ID NO: 3877638 - RNA, 16 nt, Human
acgggacugacgcaac

SEQ ID NO: 3877639 - RNA, 23 nt, Human
acgggagcuggggagaggaaaga

SEQ ID NO: 3877640 - RNA, 20 nt, Human
acgggaggguaaggcugugg

SEQ ID NO: 3877641 - RNA, 22 nt, Human
acgggaugguucuggcuguuug

SEQ ID NO: 3877642 - RNA, 15 nt, Human
acggggacucagccc

SEQ ID NO: 3877643 - RNA, 14 nt, Human
acggggacugggga

SEQ ID NO: 3877644 - RNA, 15 nt, Human
acggggccggccagg

SEQ ID NO: 3877645 - RNA, 18 nt, Human
acggggccggccaggugg

SEQ ID NO: 3877646 - RNA, 14 nt, Human
acggggggccccag

SEQ ID NO: 3877647 - RNA, 22 nt, Human
acggggggccccagucagccuc

SEQ ID NO: 3877648 - RNA, 23 nt, Human
acggggggccccagucagccucu

SEQ ID NO: 3877649 - RNA, 23 nt, Human
acggguuagacagccaaaggcug

SEQ ID NO: 3877650 - RNA, 17 nt, Human
acgguauuaugcuucuu

SEQ ID NO: 3877651 - RNA, 18 nt, Human
acgguauuaugcuucuug

SEQ ID NO: 3877652 - RNA, 17 nt, Human
acggucagguuuaacau

SEQ ID NO: 3877653 - RNA, 13 nt, Human
acggucaguuugg

SEQ ID NO: 3877654 - RNA, 18 nt, Human
acggucuguucuugaagc

SEQ ID NO: 3877655 - RNA, 17 nt, Human
acggugacaaagauggc

SEQ ID NO: 3877656 - RNA, 22 nt, Human
acggugcuccaggcaggcuaag

SEQ ID NO: 3877657 - RNA, 19 nt, Human
acggugcugugagggaggg

SEQ ID NO: 3877658 - RNA, 21 nt, Human
acgguggggguagggggcugg

SEQ ID NO: 3877659 - RNA, 21 nt, Human
acgguggucacuggaacucag

SEQ ID NO: 3877660 - RNA, 15 nt, Human
acgguguuuugccau

SEQ ID NO: 3877661 - RNA, 20 nt, Human
acgguuccuacacaggacag

SEQ ID NO: 3877662 - RNA, 18 nt, Human
acgguuucgaagucauua

SEQ ID NO: 3877663 - RNA, 18 nt, Human
acguaaagcuagaaauga

SEQ ID NO: 3877664 - RNA, 19 nt, Human
acguaaaguacuuguaguu

SEQ ID NO: 3877665 - RNA, 15 nt, Human
acguaauaagguuuu

SEQ ID NO: 3877666 - RNA, 17 nt, Human
acguaauaagguuuuaa

SEQ ID NO: 3877667 - RNA, 15 nt, Human
acguacaaguaguuc

SEQ ID NO: 3877668 - RNA, 17 nt, Human
acguacaaguaguucug

SEQ ID NO: 3877669 - RNA, 18 nt, Human
acguacaaguaguucugu

SEQ ID NO: 3877670 - RNA, 20 nt, Human
acguacaaguaguucuguau

SEQ ID NO: 3877671 - RNA, 21 nt, Human
acguacaaguaguucuguauu

SEQ ID NO: 3877672 - RNA, 22 nt, Human
acguacaaguaguucuguauuu

SEQ ID NO: 3877673 - RNA, 17 nt, Human
acguagcugaggccgga

SEQ ID NO: 3877674 - RNA, 20 nt, Human
acguagcugcaaaggacaga

SEQ ID NO: 3877675 - RNA, 24 nt, Human
acguagcuucuaccaugaacagaa

SEQ ID NO: 3877676 - RNA, 20 nt, Human
acguagucggcacagccugg

SEQ ID NO: 3877677 - RNA, 22 nt, Human
acguaguguagauuuguuuugu

SEQ ID NO: 3877678 - RNA, 13 nt, Human
acguaugcaugug

SEQ ID NO: 3877679 - RNA, 14 nt, Human
acguaugcauguga

SEQ ID NO: 3877680 - RNA, 18 nt, Human
acguaugucugguucuca

SEQ ID NO: 3877681 - RNA, 20 nt, Human
acguauguuuuuguguauuu

SEQ ID NO: 3877682 - RNA, 21 nt, Human
acguauuuaauagcaaagaau

SEQ ID NO: 3877683 - RNA, 21 nt, Human
acgucacuggaccacugggca

SEQ ID NO: 3877684 - RNA, 22 nt, Human
acgucauaggaaguuagccuuu

SEQ ID NO: 3877685 - RNA, 17 nt, Human
acgucaucuaguuuuaa

SEQ ID NO: 3877686 - RNA, 18 nt, Human
acgucauguauuugagca

SEQ ID NO: 3877687 - RNA, 18 nt, Human
acguccagaauuuuucau

SEQ ID NO: 3877688 - RNA, 20 nt, Human
acguccaucacguuagcugu

SEQ ID NO: 3877689 - RNA, 12 nt, Human
acgucccuccac

SEQ ID NO: 3877690 - RNA, 16 nt, Human
acguccugagaaagcu

SEQ ID NO: 3877691 - RNA, 15 nt, Human
acguccugccaccug

SEQ ID NO: 3877692 - RNA, 20 nt, Human
acguccugccaccuggggca

SEQ ID NO: 3877693 - RNA, 18 nt, Human
acguccugucagugccgc

SEQ ID NO: 3877694 - RNA, 21 nt, Human
acguccugucagugccgccgc

SEQ ID NO: 3877695 - RNA, 17 nt, Human
acgucuagcuaugcugu

SEQ ID NO: 3877696 - RNA, 22 nt, Human
acgucugaagcuugacucccaa

SEQ ID NO: 3877697 - RNA, 16 nt, Human
acgucugacccucucc

SEQ ID NO: 3877698 - RNA, 22 nt, Human
acgucugacccucuccacccca

SEQ ID NO: 3877699 - RNA, 17 nt, Human
acgucugggagaaauug

SEQ ID NO: 3877700 - RNA, 16 nt, Human
acgucuguaagcugaa

SEQ ID NO: 3877701 - RNA, 14 nt, Human
acgucugucuucac

SEQ ID NO: 3877702 - RNA, 15 nt, Human
acgucugucuucaca

SEQ ID NO: 3877703 - RNA, 13 nt, Human
acgucugugccau

SEQ ID NO: 3877704 - RNA, 12 nt, Human
acgucuucuaaa

SEQ ID NO: 3877705 - RNA, 20 nt, Human
acgugacacaaacacacaca

SEQ ID NO: 3877706 - RNA, 19 nt, Human
acgugacagugccugggaa

SEQ ID NO: 3877707 - RNA, 15 nt, Human
acgugagagugucuu

SEQ ID NO: 3877708 - RNA, 23 nt, Human
acgugagagugucuucacggcag

SEQ ID NO: 3877709 - RNA, 22 nt, Human
acgugagccagguaaugaggga

SEQ ID NO: 3877710 - RNA, 20 nt, Human
acgugauccucucaccucag

SEQ ID NO: 3877711 - RNA, 19 nt, Human
acgugauuuugcuguagaa

SEQ ID NO: 3877712 - RNA, 14 nt, Human
acgugcaauuuguu

SEQ ID NO: 3877713 - RNA, 23 nt, Human
acgugcaccuguacucaggaggc

SEQ ID NO: 3877714 - RNA, 16 nt, Human
acgugcacgcacacug

SEQ ID NO: 3877715 - RNA, 14 nt, Human
acgugccaggcccg

SEQ ID NO: 3877716 - RNA, 18 nt, Human
acgugccaggcccggggc

SEQ ID NO: 3877717 - RNA, 21 nt, Human
acgugccaggcccggggcugg

SEQ ID NO: 3877718 - RNA, 15 nt, Human
acgugccuuuugcac

SEQ ID NO: 3877719 - RNA, 20 nt, Human
acgugcgcugggcacuuccc

SEQ ID NO: 3877720 - RNA, 18 nt, Human
acgugcucugugggucuc

SEQ ID NO: 3877721 - RNA, 14 nt, Human
acguggaaccucug

SEQ ID NO: 3877722 - RNA, 20 nt, Human
acguggaaccucugucucau

SEQ ID NO: 3877723 - RNA, 17 nt, Human
acguggacguuuuuaau

SEQ ID NO: 3877724 - RNA, 21 nt, Human
acguggagaaucacaggcugg

SEQ ID NO: 3877725 - RNA, 14 nt, Human
acguggagagcugg

SEQ ID NO: 3877726 - RNA, 16 nt, Human
acguggagagcuggug

SEQ ID NO: 3877727 - RNA, 14 nt, Human
acguggagagggau

SEQ ID NO: 3877728 - RNA, 16 nt, Human
acguggagcucuuggc

SEQ ID NO: 3877729 - RNA, 21 nt, Human
acguggaggaaugcuccccca

SEQ ID NO: 3877730 - RNA, 17 nt, Human
acguggaggagcagugc

SEQ ID NO: 3877731 - RNA, 16 nt, Human
acguggcaccuccucg

SEQ ID NO: 3877732 - RNA, 20 nt, Human
acguggccauguaugaagcc

SEQ ID NO: 3877733 - RNA, 16 nt, Human
acguggccucuugagc

SEQ ID NO: 3877734 - RNA, 17 nt, Human
acguggcucagccagca

SEQ ID NO: 3877735 - RNA, 14 nt, Human
acguggcucugcug

SEQ ID NO: 3877736 - RNA, 22 nt, Human
acguggcugcgugccccugcug

SEQ ID NO: 3877737 - RNA, 13 nt, Human
acguggcugcuuc

SEQ ID NO: 3877738 - RNA, 19 nt, Human
acguggcugcuucaaggau

SEQ ID NO: 3877739 - RNA, 21 nt, Human
acguggcugcuucaaggaucc

SEQ ID NO: 3877740 - RNA, 23 nt, Human
acguggcuucugaugaaucuugc

SEQ ID NO: 3877741 - RNA, 11 nt, Human
acgugggagac

SEQ ID NO: 3877742 - RNA, 16 nt, Human
acgugggagacaagaa

SEQ ID NO: 3877743 - RNA, 16 nt, Human
acgugggcaaacaggc

SEQ ID NO: 3877744 - RNA, 20 nt, Human
acgugggcauucaaauguau

SEQ ID NO: 3877745 - RNA, 20 nt, Human
acgugggcggcagagaggac

SEQ ID NO: 3877746 - RNA, 19 nt, Human
acgugggcuccccucuucc

SEQ ID NO: 3877747 - RNA, 20 nt, Human
acguggggcagcacagagag

SEQ ID NO: 3877748 - RNA, 14 nt, Human
acguguagcuauau

SEQ ID NO: 3877749 - RNA, 15 nt, Human
acguguaguguccau

SEQ ID NO: 3877750 - RNA, 16 nt, Human
acguguaguguccauu

SEQ ID NO: 3877751 - RNA, 16 nt, Human
acguguauguuuuuca

SEQ ID NO: 3877752 - RNA, 19 nt, Human
acguguauguuuuucaguu

SEQ ID NO: 3877753 - RNA, 15 nt, Human
acgugugauuuuucu

SEQ ID NO: 3877754 - RNA, 14 nt, Human
acguguguuuuucu

SEQ ID NO: 3877755 - RNA, 17 nt, Human
acguguguuuuucuauu

SEQ ID NO: 3877756 - RNA, 11 nt, Human
acguguugccu

SEQ ID NO: 3877757 - RNA, 22 nt, Human
acguguuuuauuccuguauguu

SEQ ID NO: 3877758 - RNA, 13 nt, Human
acguuaaaguagg

SEQ ID NO: 3877759 - RNA, 12 nt, Human
acguuacauuuu

SEQ ID NO: 3877760 - RNA, 17 nt, Human
acguuaccuugacacau

SEQ ID NO: 3877761 - RNA, 15 nt, Human
acguuacucagggcu

SEQ ID NO: 3877762 - RNA, 21 nt, Human
acguuagucgugagcucuugu

SEQ ID NO: 3877763 - RNA, 19 nt, Human
acguuaugauaguguccca

SEQ ID NO: 3877764 - RNA, 21 nt, Human
acguucacccaucuuaucaag

SEQ ID NO: 3877765 - RNA, 14 nt, Human
acguucaccccucc

SEQ ID NO: 3877766 - RNA, 12 nt, Human
acguuccgggca

SEQ ID NO: 3877767 - RNA, 14 nt, Human
acguuccuaagcug

SEQ ID NO: 3877768 - RNA, 16 nt, Human
acguuccuauugucau

SEQ ID NO: 3877769 - RNA, 19 nt, Human
acguuccuuacugcagaau

SEQ ID NO: 3877770 - RNA, 20 nt, Human
acguuccuuacugcagaaua

SEQ ID NO: 3877771 - RNA, 21 nt, Human
acguuccuuacugcagaauag

SEQ ID NO: 3877772 - RNA, 13 nt, Human
acguugcucccca

SEQ ID NO: 3877773 - RNA, 12 nt, Human
acguugcugugg

SEQ ID NO: 3877774 - RNA, 14 nt, Human
acguugcuguggga

SEQ ID NO: 3877775 - RNA, 23 nt, Human
acguuggacuuuucguuaacauu

SEQ ID NO: 3877776 - RNA, 16 nt, Human
acguugggacagggag

SEQ ID NO: 3877777 - RNA, 14 nt, Human
acguugugcauuug

SEQ ID NO: 3877778 - RNA, 13 nt, Human
acguuuaaagugu

SEQ ID NO: 3877779 - RNA, 19 nt, Human
acguuuaagccaaaacaau

SEQ ID NO: 3877780 - RNA, 17 nt, Human
acguuucaguaauaaaa

SEQ ID NO: 3877781 - RNA, 19 nt, Human
acguuucaguaauaaaaca

SEQ ID NO: 3877782 - RNA, 12 nt, Human
acguuucuaaag

SEQ ID NO: 3877783 - RNA, 22 nt, Human
acguuucuaaaggcuaccuuug

SEQ ID NO: 3877784 - RNA, 10 nt, Human
acguuucuca

SEQ ID NO: 3877785 - RNA, 12 nt, Human
acguuucuuuaa

SEQ ID NO: 3877786 - RNA, 21 nt, Human
acguuucuuuaaccuuguaua

SEQ ID NO: 3877787 - RNA, 20 nt, Human
acguuuggaagauccuguga

SEQ ID NO: 3877788 - RNA, 19 nt, Human
acguuuuaaggacugacug

SEQ ID NO: 3877789 - RNA, 20 nt, Human
acguuuuauaagcaucauua

SEQ ID NO: 3877790 - RNA, 14 nt, Human
acguuuuauugugu

SEQ ID NO: 3877791 - RNA, 17 nt, Human
acguuuucuaauugcuu

SEQ ID NO: 3877792 - RNA, 18 nt, Human
acguuuucuaauugcuua

SEQ ID NO: 3877793 - RNA, 17 nt, Human
acguuuuuuccucagug

SEQ ID NO: 3877794 - RNA, 18 nt, Human
acguuuuuuccucagugc

SEQ ID NO: 3877795 - RNA, 16 nt, Human
acuaaaaaaaagauga

SEQ ID NO: 3877796 - RNA, 16 nt, Human
acuaaaaacaaacccu

SEQ ID NO: 3877797 - RNA, 17 nt, Human
acuaaaaaguauaaaau

SEQ ID NO: 3877798 - RNA, 12 nt, Human
acuaaaaauaca

SEQ ID NO: 3877799 - RNA, 13 nt, Human
acuaaaaauacaa

SEQ ID NO: 3877800 - RNA, 15 nt, Human
acuaaaaauauuguu

SEQ ID NO: 3877801 - RNA, 23 nt, Human
acuaaaagauauaagugcuguau

SEQ ID NO: 3877802 - RNA, 20 nt, Human
acuaaaaguucuucuccaau

SEQ ID NO: 3877803 - RNA, 17 nt, Human
acuaaaauaauuuugua

SEQ ID NO: 3877804 - RNA, 14 nt, Human
acuaaaauauauau

SEQ ID NO: 3877805 - RNA, 14 nt, Human
acuaaaauauuuau

SEQ ID NO: 3877806 - RNA, 12 nt, Human
acuaaacucauu

SEQ ID NO: 3877807 - RNA, 14 nt, Human
acuaaacucauuua

SEQ ID NO: 3877808 - RNA, 21 nt, Human
acuaaacucugaauaagcacu

SEQ ID NO: 3877809 - RNA, 23 nt, Human
acuaaacugguuuguugcagcca

SEQ ID NO: 3877810 - RNA, 13 nt, Human
acuaaacuuuacc

SEQ ID NO: 3877811 - RNA, 21 nt, Human
acuaaagaaaauaucugaaau

SEQ ID NO: 3877812 - RNA, 17 nt, Human
acuaaagaaagauuacu

SEQ ID NO: 3877813 - RNA, 16 nt, Human
acuaaagagagaaugu

SEQ ID NO: 3877814 - RNA, 11 nt, Human
acuaaagcaau

SEQ ID NO: 3877815 - RNA, 15 nt, Human
acuaaagcaauagaa

SEQ ID NO: 3877816 - RNA, 20 nt, Human
acuaaagcaguggacaccag

SEQ ID NO: 3877817 - RNA, 12 nt, Human
acuaaagcauga

SEQ ID NO: 3877818 - RNA, 15 nt, Human
acuaaagcaugaaau

SEQ ID NO: 3877819 - RNA, 16 nt, Human
acuaaagccaaacaua

SEQ ID NO: 3877820 - RNA, 13 nt, Human
acuaaagccaagg

SEQ ID NO: 3877821 - RNA, 15 nt, Human
acuaaagccagccug

SEQ ID NO: 3877822 - RNA, 17 nt, Human
acuaaagguggccacaa

SEQ ID NO: 3877823 - RNA, 22 nt, Human
acuaaaguuagaaaguugauuu

SEQ ID NO: 3877824 - RNA, 15 nt, Human
acuaaaguuguacuu

SEQ ID NO: 3877825 - RNA, 19 nt, Human
acuaaauagcauguauugu

SEQ ID NO: 3877826 - RNA, 21 nt, Human
acuaaaucagagacaaaauau

SEQ ID NO: 3877827 - RNA, 16 nt, Human
acuaaaucucuaauau

SEQ ID NO: 3877828 - RNA, 17 nt, Human
acuaaaucucuaauaug

SEQ ID NO: 3877829 - RNA, 14 nt, Human
acuaaaucuguaag

SEQ ID NO: 3877830 - RNA, 18 nt, Human
acuaaaucuguaagcucu

SEQ ID NO: 3877831 - RNA, 13 nt, Human
acuaaaucuuuua

SEQ ID NO: 3877832 - RNA, 15 nt, Human
acuaaaucuuuuaua

SEQ ID NO: 3877833 - RNA, 19 nt, Human
acuaaaugccuaguuuuua

SEQ ID NO: 3877834 - RNA, 18 nt, Human
acuaaauuguaaacuccu

SEQ ID NO: 3877835 - RNA, 20 nt, Human
acuaaauuugauacuuauau

SEQ ID NO: 3877836 - RNA, 15 nt, Human
acuaaauuuuaaagc

SEQ ID NO: 3877837 - RNA, 14 nt, Human
acuaacacaaggac

SEQ ID NO: 3877838 - RNA, 15 nt, Human
acuaacacaaggaca

SEQ ID NO: 3877839 - RNA, 12 nt, Human
acuaacacuauu

SEQ ID NO: 3877840 - RNA, 15 nt, Human
acuaacacuauuuua

SEQ ID NO: 3877841 - RNA, 18 nt, Human
acuaacacucagaagccu

SEQ ID NO: 3877842 - RNA, 20 nt, Human
acuaacacucagaagccugg

SEQ ID NO: 3877843 - RNA, 16 nt, Human
acuaacagauaagcaa

SEQ ID NO: 3877844 - RNA, 18 nt, Human
acuaacauuuauuugagu

SEQ ID NO: 3877845 - RNA, 15 nt, Human
acuaaccaagcugag

SEQ ID NO: 3877846 - RNA, 21 nt, Human
acuaaccaagcugaguuuccu

SEQ ID NO: 3877847 - RNA, 22 nt, Human
acuaaccaagcugaguuuccua

SEQ ID NO: 3877848 - RNA, 14 nt, Human
acuaaccccgggcg

SEQ ID NO: 3877849 - RNA, 17 nt, Human
acuaaccuugccuggua

SEQ ID NO: 3877850 - RNA, 22 nt, Human
acuaacgaaauaucaaagucau

SEQ ID NO: 3877851 - RNA, 22 nt, Human
acuaacuaaacucucuuuggga

SEQ ID NO: 3877852 - RNA, 15 nt, Human
acuaacuaugcaugg

SEQ ID NO: 3877853 - RNA, 20 nt, Human
acuaacuccuaggaaaauac

SEQ ID NO: 3877854 - RNA, 17 nt, Human
acuaacuucuaaaacug

SEQ ID NO: 3877855 - RNA, 22 nt, Human
acuaacuucuaaaacuguacuu

SEQ ID NO: 3877856 - RNA, 17 nt, Human
acuaacuugacuuuuaa

SEQ ID NO: 3877857 - RNA, 17 nt, Human
acuaagaaacuuuugua

SEQ ID NO: 3877858 - RNA, 19 nt, Human
acuaagaaacuuuuguaaa

SEQ ID NO: 3877859 - RNA, 17 nt, Human
acuaagaaauauuccaa

SEQ ID NO: 3877860 - RNA, 16 nt, Human
acuaagaauucaaacu

SEQ ID NO: 3877861 - RNA, 17 nt, Human
acuaagagaaguuguaa

SEQ ID NO: 3877862 - RNA, 13 nt, Human
acuaagagagaau

SEQ ID NO: 3877863 - RNA, 20 nt, Human
acuaagaggaaaguacauuu

SEQ ID NO: 3877864 - RNA, 21 nt, Human
acuaagaggaaaguacauuuu

SEQ ID NO: 3877865 - RNA, 17 nt, Human
acuaagaucgguuaaca

SEQ ID NO: 3877866 - RNA, 22 nt, Human
acuaagaucgguuaacaaauaa

SEQ ID NO: 3877867 - RNA, 20 nt, Human
acuaagaugacauugcuaag

SEQ ID NO: 3877868 - RNA, 23 nt, Human
acuaagaugugcagcauuucacu

SEQ ID NO: 3877869 - RNA, 18 nt, Human
acuaagauguucacugug

SEQ ID NO: 3877870 - RNA, 14 nt, Human
acuaagcagaggag

SEQ ID NO: 3877871 - RNA, 15 nt, Human
acuaagccacaagaa

SEQ ID NO: 3877872 - RNA, 13 nt, Human
acuaagcccuguc

SEQ ID NO: 3877873 - RNA, 14 nt, Human
acuaagccuaccug

SEQ ID NO: 3877874 - RNA, 17 nt, Human
acuaaggugcuaaaucu

SEQ ID NO: 3877875 - RNA, 19 nt, Human
acuaagucucuuuuuuaca

SEQ ID NO: 3877876 - RNA, 21 nt, Human
acuaagucucuuuuuuacaaa

SEQ ID NO: 3877877 - RNA, 22 nt, Human
acuaaguuuuuauggcuuuugu

SEQ ID NO: 3877878 - RNA, 15 nt, Human
acuaauaaaauauuu

SEQ ID NO: 3877879 - RNA, 21 nt, Human
acuaauaaaauauuuucugug

SEQ ID NO: 3877880 - RNA, 14 nt, Human
acuaauaaauacau

SEQ ID NO: 3877881 - RNA, 11 nt, Human
acuaauaauug

SEQ ID NO: 3877882 - RNA, 13 nt, Human
acuaauaauugca

SEQ ID NO: 3877883 - RNA, 14 nt, Human
acuaauagaaaagu

SEQ ID NO: 3877884 - RNA, 15 nt, Human
acuaauagacaauuu

SEQ ID NO: 3877885 - RNA, 22 nt, Human
acuaauaugggcauuguaguua

SEQ ID NO: 3877886 - RNA, 17 nt, Human
acuaauauuucuguaau

SEQ ID NO: 3877887 - RNA, 18 nt, Human
acuaaucuauuggguuca

SEQ ID NO: 3877888 - RNA, 20 nt, Human
acuaaucuauuggguucauu

SEQ ID NO: 3877889 - RNA, 18 nt, Human
acuaaugaaaacagaaug

SEQ ID NO: 3877890 - RNA, 23 nt, Human
acuaaugccuuacucuucuugaa

SEQ ID NO: 3877891 - RNA, 22 nt, Human
acuaauggcaugagaaauacaa

SEQ ID NO: 3877892 - RNA, 12 nt, Human
acuaauguaaaa

SEQ ID NO: 3877893 - RNA, 20 nt, Human
acuaauguguaagacaaaaa

SEQ ID NO: 3877894 - RNA, 18 nt, Human
acuaauucauaaucacuc

SEQ ID NO: 3877895 - RNA, 15 nt, Human
acuaauuccacaccu

SEQ ID NO: 3877896 - RNA, 16 nt, Human
acuaauuucaaaaugc

SEQ ID NO: 3877897 - RNA, 19 nt, Human
acuaauuucaaaaugcuuu

SEQ ID NO: 3877898 - RNA, 17 nt, Human
acuaauuugauguuuac

SEQ ID NO: 3877899 - RNA, 19 nt, Human
acuaauuuuuguauuauuu

SEQ ID NO: 3877900 - RNA, 13 nt, Human
acuacaaaauuug

SEQ ID NO: 3877901 - RNA, 18 nt, Human
acuacaaaauuugaaauu

SEQ ID NO: 3877902 - RNA, 23 nt, Human
acuacaaagcuucuaucccagga

SEQ ID NO: 3877903 - RNA, 21 nt, Human
acuacaaagguuuaaaugaac

SEQ ID NO: 3877904 - RNA, 22 nt, Human
acuacacauuuuuaaauuguua

SEQ ID NO: 3877905 - RNA, 16 nt, Human
acuacaccacacacaa

SEQ ID NO: 3877906 - RNA, 23 nt, Human
acuacacgguucaaaccugugaa

SEQ ID NO: 3877907 - RNA, 18 nt, Human
acuacagaaaaaccagag

SEQ ID NO: 3877908 - RNA, 23 nt, Human
acuacagaccugcuuuuugaaau

SEQ ID NO: 3877909 - RNA, 17 nt, Human
acuacagcuggggugca

SEQ ID NO: 3877910 - RNA, 18 nt, Human
acuacagcuggggugcag

SEQ ID NO: 3877911 - RNA, 23 nt, Human
acuacagcuggggugcagggaug

SEQ ID NO: 3877912 - RNA, 17 nt, Human
acuacaggcgugagcca

SEQ ID NO: 3877913 - RNA, 16 nt, Human
acuacaguccucccau

SEQ ID NO: 3877914 - RNA, 17 nt, Human
acuacaguccucccauc

SEQ ID NO: 3877915 - RNA, 17 nt, Human
acuacagucuaaagcug

SEQ ID NO: 3877916 - RNA, 15 nt, Human
acuacaguuagggcu

SEQ ID NO: 3877917 - RNA, 13 nt, Human
acuacauaaacug

SEQ ID NO: 3877918 - RNA, 14 nt, Human
acuacaugcacuug

SEQ ID NO: 3877919 - RNA, 13 nt, Human
acuacauucuguu

SEQ ID NO: 3877920 - RNA, 15 nt, Human
acuacauucuguuaa

SEQ ID NO: 3877921 - RNA, 20 nt, Human
acuacccaaaacaagccugg

SEQ ID NO: 3877922 - RNA, 18 nt, Human
acuacccuauucucucuu

SEQ ID NO: 3877923 - RNA, 17 nt, Human
acuaccgaaugugucuu

SEQ ID NO: 3877924 - RNA, 18 nt, Human
acuaccgaaugugucuuu

SEQ ID NO: 3877925 - RNA, 19 nt, Human
acuaccgaaugugucuuua

SEQ ID NO: 3877926 - RNA, 16 nt, Human
acuaccuccucuccug

SEQ ID NO: 3877927 - RNA, 22 nt, Human
acuaccuguauuuaaaaauaga

SEQ ID NO: 3877928 - RNA, 17 nt, Human
acuaccuugaaaauaag

SEQ ID NO: 3877929 - RNA, 18 nt, Human
acuaccuugguuccccca

SEQ ID NO: 3877930 - RNA, 15 nt, Human
acuacgugacugugg

SEQ ID NO: 3877931 - RNA, 14 nt, Human
acuacuagggaaau

SEQ ID NO: 3877932 - RNA, 21 nt, Human
acuacuagggaaaugccuuug

SEQ ID NO: 3877933 - RNA, 13 nt, Human
acuacucagcaug

SEQ ID NO: 3877934 - RNA, 19 nt, Human
acuacuccucugcagugcc

SEQ ID NO: 3877935 - RNA, 21 nt, Human
acuacuccucugcagugccuu

SEQ ID NO: 3877936 - RNA, 17 nt, Human
acuacugaaacagauuu

SEQ ID NO: 3877937 - RNA, 23 nt, Human
acuacugacauguggggccaggu

SEQ ID NO: 3877938 - RNA, 22 nt, Human
acuacugacggaguccuguguu

SEQ ID NO: 3877939 - RNA, 13 nt, Human
acuacugcagcac

SEQ ID NO: 3877940 - RNA, 17 nt, Human
acuacugggugucauuu

SEQ ID NO: 3877941 - RNA, 18 nt, Human
acuacugggugucauuuc

SEQ ID NO: 3877942 - RNA, 19 nt, Human
acuacugggugucauuuca

SEQ ID NO: 3877943 - RNA, 23 nt, Human
acuacugggugucauuucauucc

SEQ ID NO: 3877944 - RNA, 19 nt, Human
acuacuguggaaaaauauu

SEQ ID NO: 3877945 - RNA, 20 nt, Human
acuacuguggaaaaauauuu

SEQ ID NO: 3877946 - RNA, 22 nt, Human
acuacuguggaaaaauauuuaa

SEQ ID NO: 3877947 - RNA, 12 nt, Human
acuacuguguuc

SEQ ID NO: 3877948 - RNA, 15 nt, Human
acuacuguguuccug

SEQ ID NO: 3877949 - RNA, 20 nt, Human
acuacuguucagcuuuuauu

SEQ ID NO: 3877950 - RNA, 14 nt, Human
acuacuuagcacuu

SEQ ID NO: 3877951 - RNA, 21 nt, Human
acuacuuagcauccuaagaaa

SEQ ID NO: 3877952 - RNA, 16 nt, Human
acuacuucucucugua

SEQ ID NO: 3877953 - RNA, 19 nt, Human
acuacuugauuuuauugua

SEQ ID NO: 3877954 - RNA, 12 nt, Human
acuacuuuauaa

SEQ ID NO: 3877955 - RNA, 22 nt, Human
acuacuuuguuaggauuuucac

SEQ ID NO: 3877956 - RNA, 22 nt, Human
acuagaaagugaauaaaaauua

SEQ ID NO: 3877957 - RNA, 23 nt, Human
acuagaacugaauuuugucuuua

SEQ ID NO: 3877958 - RNA, 18 nt, Human
acuagaagaugaauacaa

SEQ ID NO: 3877959 - RNA, 21 nt, Human
acuagaauucuagugcugcug

SEQ ID NO: 3877960 - RNA, 22 nt, Human
acuagaauucuagugcugcuga

SEQ ID NO: 3877961 - RNA, 18 nt, Human
acuagacacacaaagcag

SEQ ID NO: 3877962 - RNA, 21 nt, Human
acuagacacacaaagcaguug

SEQ ID NO: 3877963 - RNA, 16 nt, Human
acuagacacagauaau

SEQ ID NO: 3877964 - RNA, 17 nt, Human
acuagacucuucacugu

SEQ ID NO: 3877965 - RNA, 18 nt, Human
acuagagauauuuuguaa

SEQ ID NO: 3877966 - RNA, 17 nt, Human
acuagagaucugguuuu

SEQ ID NO: 3877967 - RNA, 16 nt, Human
acuagagcaagcagga

SEQ ID NO: 3877968 - RNA, 21 nt, Human
acuagagcagcccuggaguca

SEQ ID NO: 3877969 - RNA, 16 nt, Human
acuagaggcagggagg

SEQ ID NO: 3877970 - RNA, 16 nt, Human
acuagagguuuuauga

SEQ ID NO: 3877971 - RNA, 14 nt, Human
acuagaugaccuca

SEQ ID NO: 3877972 - RNA, 15 nt, Human
acuagauggugcuga

SEQ ID NO: 3877973 - RNA, 17 nt, Human
acuagauguaguauuuu

SEQ ID NO: 3877974 - RNA, 18 nt, Human
acuagauuacauucaguu

SEQ ID NO: 3877975 - RNA, 19 nt, Human
acuagcaaaauaaaacaua

SEQ ID NO: 3877976 - RNA, 23 nt, Human
acuagcaccauuuuaagucccug

SEQ ID NO: 3877977 - RNA, 19 nt, Human
acuagcauaucugccuuua

SEQ ID NO: 3877978 - RNA, 18 nt, Human
acuagccaaaccaggacc

SEQ ID NO: 3877979 - RNA, 15 nt, Human
acuagccaaaccuca

SEQ ID NO: 3877980 - RNA, 15 nt, Human
acuagccaccaacuc

SEQ ID NO: 3877981 - RNA, 23 nt, Human
acuagccaccaacucuugcaggu

SEQ ID NO: 3877982 - RNA, 17 nt, Human
acuagcccaaugaaaug

SEQ ID NO: 3877983 - RNA, 16 nt, Human
acuagccugucauccu

SEQ ID NO: 3877984 - RNA, 14 nt, Human
acuagcuauggugu

SEQ ID NO: 3877985 - RNA, 24 nt, Human
acuagcucuuguugagccgugggc

SEQ ID NO: 3877986 - RNA, 22 nt, Human
acuagcuggaauuuuuuauucu

SEQ ID NO: 3877987 - RNA, 23 nt, Human
acuagcuggaauuuuuuauucuu

SEQ ID NO: 3877988 - RNA, 24 nt, Human
acuagcuggaauuuuuuauucuug

SEQ ID NO: 3877989 - RNA, 16 nt, Human
acuagcuuuucaaaca

SEQ ID NO: 3877990 - RNA, 15 nt, Human
acuaggaaggcacuu

SEQ ID NO: 3877991 - RNA, 21 nt, Human
acuaggcaguuagagaugccu

SEQ ID NO: 3877992 - RNA, 22 nt, Human
acuaggcccccacuugccucuu

SEQ ID NO: 3877993 - RNA, 23 nt, Human
acuaggcccccacuugccucuuc

SEQ ID NO: 3877994 - RNA, 14 nt, Human
acuaggcucagaga

SEQ ID NO: 3877995 - RNA, 14 nt, Human
acuaggcugggugc

SEQ ID NO: 3877996 - RNA, 20 nt, Human
acuaggcugggugcccacag

SEQ ID NO: 3877997 - RNA, 17 nt, Human
acuagggaagauaauau

SEQ ID NO: 3877998 - RNA, 13 nt, Human
acuagggaccugg

SEQ ID NO: 3877999 - RNA, 17 nt, Human
acuagggagaagguuuc

SEQ ID NO: 3878000 - RNA, 18 nt, Human
acuagggaucccucaucu

SEQ ID NO: 3878001 - RNA, 19 nt, Human
acuagggaucccucaucug

SEQ ID NO: 3878002 - RNA, 17 nt, Human
acuagggauucaggcug

SEQ ID NO: 3878003 - RNA, 18 nt, Human
acuagggauucaggcugc

SEQ ID NO: 3878004 - RNA, 19 nt, Human
acuagggauucaggcugcu

SEQ ID NO: 3878005 - RNA, 21 nt, Human
acuagggauucaggcugcuug

SEQ ID NO: 3878006 - RNA, 21 nt, Human
acuagggugaggguuuucugu

SEQ ID NO: 3878007 - RNA, 18 nt, Human
acuaggucaaaaaucugu

SEQ ID NO: 3878008 - RNA, 21 nt, Human
acuagguucaauucccugaag

SEQ ID NO: 3878009 - RNA, 13 nt, Human
acuaguacugugu

SEQ ID NO: 3878010 - RNA, 23 nt, Human
acuaguacuguguacuguauaga

SEQ ID NO: 3878011 - RNA, 17 nt, Human
acuaguaguucucuugg

SEQ ID NO: 3878012 - RNA, 16 nt, Human
acuaguauuucuauga

SEQ ID NO: 3878013 - RNA, 19 nt, Human
acuaguauuucuaugaaau

SEQ ID NO: 3878014 - RNA, 22 nt, Human
acuagucaccccaaguagucug

SEQ ID NO: 3878015 - RNA, 14 nt, Human
acuagucugugugc

SEQ ID NO: 3878016 - RNA, 16 nt, Human
acuagugcugaagcuu

SEQ ID NO: 3878017 - RNA, 18 nt, Human
acuagugcugaagcuuau

SEQ ID NO: 3878018 - RNA, 13 nt, Human
acuaguguucugu

SEQ ID NO: 3878019 - RNA, 21 nt, Human
acuaguugugaccuuaguguu

SEQ ID NO: 3878020 - RNA, 18 nt, Human
acuauaaagguugacaau

SEQ ID NO: 3878021 - RNA, 22 nt, Human
acuauaacauauguacauaaau

SEQ ID NO: 3878022 - RNA, 20 nt, Human
acuauaagcaagaaggcaaa

SEQ ID NO: 3878023 - RNA, 13 nt, Human
acuauaauguaag

SEQ ID NO: 3878024 - RNA, 14 nt, Human
acuauaauguaagc

SEQ ID NO: 3878025 - RNA, 21 nt, Human
acuauaauguaagcucuacug

SEQ ID NO: 3878026 - RNA, 15 nt, Human
acuauaaugugaaau

SEQ ID NO: 3878027 - RNA, 23 nt, Human
acuauaauuuaccugaagucuuu

SEQ ID NO: 3878028 - RNA, 15 nt, Human
acuauacaacaaagg

SEQ ID NO: 3878029 - RNA, 14 nt, Human
acuauacuugaaca

SEQ ID NO: 3878030 - RNA, 18 nt, Human
acuauacuugaacaaaag

SEQ ID NO: 3878031 - RNA, 20 nt, Human
acuauaggcaugcgccacca

SEQ ID NO: 3878032 - RNA, 16 nt, Human
acuauaguuuaaaaca

SEQ ID NO: 3878033 - RNA, 20 nt, Human
acuauaguuuaaaacacauu

SEQ ID NO: 3878034 - RNA, 17 nt, Human
acuauauauauaaaugu

SEQ ID NO: 3878035 - RNA, 22 nt, Human
acuauauauauaaauguauaaa

SEQ ID NO: 3878036 - RNA, 14 nt, Human
acuauauauauaug

SEQ ID NO: 3878037 - RNA, 17 nt, Human
acuauaucuguauauaa

SEQ ID NO: 3878038 - RNA, 14 nt, Human
acuauaucuguuuu

SEQ ID NO: 3878039 - RNA, 23 nt, Human
acuauaucuguuuuacugcuuuu

SEQ ID NO: 3878040 - RNA, 19 nt, Human
acuauauucauuuccacuc

SEQ ID NO: 3878041 - RNA, 18 nt, Human
acuauauugauuguccuu

SEQ ID NO: 3878042 - RNA, 22 nt, Human
acuauauuguuugcuaagcauu

SEQ ID NO: 3878043 - RNA, 13 nt, Human
acuauauuugcua

SEQ ID NO: 3878044 - RNA, 13 nt, Human
acuaucauaaaau

SEQ ID NO: 3878045 - RNA, 13 nt, Human
acuauccuggcuu

SEQ ID NO: 3878046 - RNA, 15 nt, Human
acuaucucauuucca

SEQ ID NO: 3878047 - RNA, 16 nt, Human
acuaucucauuuccaa

SEQ ID NO: 3878048 - RNA, 20 nt, Human
acuaucugaaccauuaaagu

SEQ ID NO: 3878049 - RNA, 17 nt, Human
accucagggcucccagg

SEQ ID NO: 3878050 - RNA, 19 nt, Human
accucaggguauugcuugc

SEQ ID NO: 3878051 - RNA, 23 nt, Human
accucaggguauugcuugccacu

SEQ ID NO: 3878052 - RNA, 22 nt, Human
accucagguaaucgaccugccu

SEQ ID NO: 3878053 - RNA, 15 nt, Human
accucagguugcugg

SEQ ID NO: 3878054 - RNA, 17 nt, Human
accucagguugcugguu

SEQ ID NO: 3878055 - RNA, 17 nt, Human
accucaguaauuuagaa

SEQ ID NO: 3878056 - RNA, 18 nt, Human
accucaguuauuacaugu

SEQ ID NO: 3878057 - RNA, 22 nt, Human
accucaguuauuacauguaauu

SEQ ID NO: 3878058 - RNA, 17 nt, Human
accucaguucccuuggc

SEQ ID NO: 3878059 - RNA, 17 nt, Human
accucaguuuuaucauu

SEQ ID NO: 3878060 - RNA, 14 nt, Human
accucauccaaaca

SEQ ID NO: 3878061 - RNA, 14 nt, Human
accucaucccauga

SEQ ID NO: 3878062 - RNA, 18 nt, Human
accucaugcaucuccacc

SEQ ID NO: 3878063 - RNA, 20 nt, Human
accucaugcaucuccaccug

SEQ ID NO: 3878064 - RNA, 21 nt, Human
accucaugcccacccccugcc

SEQ ID NO: 3878065 - RNA, 11 nt, Human
accucauguuu

SEQ ID NO: 3878066 - RNA, 19 nt, Human
accucauguuuaugaaaau

SEQ ID NO: 3878067 - RNA, 20 nt, Human
accuccaaaacuccugcccc

SEQ ID NO: 3878068 - RNA, 19 nt, Human
accuccaaagcuucccacg

SEQ ID NO: 3878069 - RNA, 23 nt, Human
accuccaacagaacuaaauguuc

SEQ ID NO: 3878070 - RNA, 23 nt, Human
accuccaacccugccgucaccac

SEQ ID NO: 3878071 - RNA, 17 nt, Human
accuccaagccacugag

SEQ ID NO: 3878072 - RNA, 19 nt, Human
accuccacacccgugagaa

SEQ ID NO: 3878073 - RNA, 15 nt, Human
accuccacagcuucc

SEQ ID NO: 3878074 - RNA, 19 nt, Human
accuccacaguucaguggc

SEQ ID NO: 3878075 - RNA, 14 nt, Human
accuccacauccuc

SEQ ID NO: 3878076 - RNA, 15 nt, Human
accuccaccuccugg

SEQ ID NO: 3878077 - RNA, 15 nt, Human
accuccaggccuguu

SEQ ID NO: 3878078 - RNA, 14 nt, Human
accuccaggcuuuc

SEQ ID NO: 3878079 - RNA, 18 nt, Human
accuccagucccccuauc

SEQ ID NO: 3878080 - RNA, 16 nt, Human
accuccauuaaagucu

SEQ ID NO: 3878081 - RNA, 18 nt, Human
accuccauuaaagucuga

SEQ ID NO: 3878082 - RNA, 20 nt, Human
accuccauuaaagucugaau

SEQ ID NO: 3878083 - RNA, 12 nt, Human
accucccaccuu

SEQ ID NO: 3878084 - RNA, 12 nt, Human
accucccagagg

SEQ ID NO: 3878085 - RNA, 13 nt, Human
accucccagaggu

SEQ ID NO: 3878086 - RNA, 14 nt, Human
accucccagagguc

SEQ ID NO: 3878087 - RNA, 23 nt, Human
accucccagagguccagcccauc

SEQ ID NO: 3878088 - RNA, 16 nt, Human
accucccagccccugc

SEQ ID NO: 3878089 - RNA, 21 nt, Human
accucccagccccugccccuc

SEQ ID NO: 3878090 - RNA, 21 nt, Human
accucccagcccuauggaugu

SEQ ID NO: 3878091 - RNA, 22 nt, Human
accuccccacgcccuccccucc

SEQ ID NO: 3878092 - RNA, 23 nt, Human
accuccccagccccuagcccagg

SEQ ID NO: 3878093 - RNA, 17 nt, Human
accuccccagccugcgc

SEQ ID NO: 3878094 - RNA, 22 nt, Human
accuccccagccugcgccugcu

SEQ ID NO: 3878095 - RNA, 13 nt, Human
accuccccaggcc

SEQ ID NO: 3878096 - RNA, 14 nt, Human
accuccccaggccg

SEQ ID NO: 3878097 - RNA, 11 nt, Human
accucccccac

SEQ ID NO: 3878098 - RNA, 13 nt, Human
accuccccccacu

SEQ ID NO: 3878099 - RNA, 15 nt, Human
accuccccccacugc

SEQ ID NO: 3878100 - RNA, 19 nt, Human
accucccccucccccuucu

SEQ ID NO: 3878101 - RNA, 20 nt, Human
accucccccucccccuucuc

SEQ ID NO: 3878102 - RNA, 21 nt, Human
accucccccucccccuucucc

SEQ ID NO: 3878103 - RNA, 14 nt, Human
accucccccuccuu

SEQ ID NO: 3878104 - RNA, 21 nt, Human
accucccccuccuucccagcu

SEQ ID NO: 3878105 - RNA, 14 nt, Human
accuccccuaucca

SEQ ID NO: 3878106 - RNA, 18 nt, Human
accuccccuauccaccca

SEQ ID NO: 3878107 - RNA, 20 nt, Human
accuccccuauccacccagc

SEQ ID NO: 3878108 - RNA, 13 nt, Human
accuccccuccuu

SEQ ID NO: 3878109 - RNA, 19 nt, Human
accuccccuccuugccucc

SEQ ID NO: 3878110 - RNA, 13 nt, Human
accuccccugccu

SEQ ID NO: 3878111 - RNA, 17 nt, Human
accuccccugccuugcu

SEQ ID NO: 3878112 - RNA, 19 nt, Human
accuccccuugccagcugc

SEQ ID NO: 3878113 - RNA, 23 nt, Human
accucccucuuguuuuguuuguc

SEQ ID NO: 3878114 - RNA, 13 nt, Human
accucccugaccc

SEQ ID NO: 3878115 - RNA, 14 nt, Human
accucccugccucc

SEQ ID NO: 3878116 - RNA, 18 nt, Human
accucccuuccgacccuc

SEQ ID NO: 3878117 - RNA, 22 nt, Human
accucccuuccgacccucuggg

SEQ ID NO: 3878118 - RNA, 21 nt, Human
accucccuuuccaaaugccca

SEQ ID NO: 3878119 - RNA, 20 nt, Human
accuccgccucuuggguuca

SEQ ID NO: 3878120 - RNA, 22 nt, Human
accuccggccaggugccuccug

SEQ ID NO: 3878121 - RNA, 14 nt, Human
accuccuaaaacaa

SEQ ID NO: 3878122 - RNA, 18 nt, Human
accuccuaaaaggcccag

SEQ ID NO: 3878123 - RNA, 22 nt, Human
accuccuaaaaggcccagagag

SEQ ID NO: 3878124 - RNA, 13 nt, Human
accuccucacauu

SEQ ID NO: 3878125 - RNA, 13 nt, Human
accuccucagccu

SEQ ID NO: 3878126 - RNA, 15 nt, Human
accuccucccuguua

SEQ ID NO: 3878127 - RNA, 18 nt, Human
accuccucucacucccca

SEQ ID NO: 3878128 - RNA, 13 nt, Human
accuccucuccug

SEQ ID NO: 3878129 - RNA, 13 nt, Human
accuccucuguga

SEQ ID NO: 3878130 - RNA, 14 nt, Human
accuccucugugaa

SEQ ID NO: 3878131 - RNA, 17 nt, Human
accuccugacacccuuc

SEQ ID NO: 3878132 - RNA, 19 nt, Human
accuccugacacccuucuc

SEQ ID NO: 3878133 - RNA, 16 nt, Human
accuccugcccaggag

SEQ ID NO: 3878134 - RNA, 17 nt, Human
accuccugcccaggaga

SEQ ID NO: 3878135 - RNA, 19 nt, Human
accuccugcccaggagagc

SEQ ID NO: 3878136 - RNA, 21 nt, Human
accuccugcccaggagagcca

SEQ ID NO: 3878137 - RNA, 23 nt, Human
accuccugccucgaacuggcugc

SEQ ID NO: 3878138 - RNA, 11 nt, Human
accuccugcug

SEQ ID NO: 3878139 - RNA, 12 nt, Human
accuccugcugg

SEQ ID NO: 3878140 - RNA, 13 nt, Human
accuccugcuggg

SEQ ID NO: 3878141 - RNA, 14 nt, Human
accuccugcugggc

SEQ ID NO: 3878142 - RNA, 17 nt, Human
accuccuucccucucug

SEQ ID NO: 3878143 - RNA, 18 nt, Human
accuccuucccucucugg

SEQ ID NO: 3878144 - RNA, 21 nt, Human
accuccuucccucucuggaga

SEQ ID NO: 3878145 - RNA, 12 nt, Human
accuccuucucu

SEQ ID NO: 3878146 - RNA, 23 nt, Human
accuccuucucugucucaugugu

SEQ ID NO: 3878147 - RNA, 19 nt, Human
accuccuugucacuuuauu

SEQ ID NO: 3878148 - RNA, 22 nt, Human
accuccuuucaucacacugggu

SEQ ID NO: 3878149 - RNA, 14 nt, Human
accucgaguacugu

SEQ ID NO: 3878150 - RNA, 15 nt, Human
accucgaguacugug

SEQ ID NO: 3878151 - RNA, 22 nt, Human
accucgaguacugugggcaauu

SEQ ID NO: 3878152 - RNA, 15 nt, Human
accucgcaucauugc

SEQ ID NO: 3878153 - RNA, 23 nt, Human
accucgcccagcggcaucaggcu

SEQ ID NO: 3878154 - RNA, 22 nt, Human
accucgcccucuccuuuguucc

SEQ ID NO: 3878155 - RNA, 15 nt, Human
accucguccuccccc

SEQ ID NO: 3878156 - RNA, 18 nt, Human
accucguccucccccugc

SEQ ID NO: 3878157 - RNA, 17 nt, Human
accucgugauccacccg

SEQ ID NO: 3878158 - RNA, 19 nt, Human
accucgugccaccccgagg

SEQ ID NO: 3878159 - RNA, 23 nt, Human
accucguuagggaagagaaacag

SEQ ID NO: 3878160 - RNA, 14 nt, Human
accucuaaauucuu

SEQ ID NO: 3878161 - RNA, 18 nt, Human
accucuaaauucuuucau

SEQ ID NO: 3878162 - RNA, 20 nt, Human
accucuacccaaacccuagg

SEQ ID NO: 3878163 - RNA, 22 nt, Human
accucuacuaaaaagaaggaaa

SEQ ID NO: 3878164 - RNA, 15 nt, Human
accucuacuuuccag

SEQ ID NO: 3878165 - RNA, 20 nt, Human
accucucaauauucaauaaa

SEQ ID NO: 3878166 - RNA, 22 nt, Human
accucuccagccucagcucuca

SEQ ID NO: 3878167 - RNA, 16 nt, Human
accucuccauccugcu

SEQ ID NO: 3878168 - RNA, 19 nt, Human
accucuccaucuucagcuu

SEQ ID NO: 3878169 - RNA, 12 nt, Human
accucucccacg

SEQ ID NO: 3878170 - RNA, 21 nt, Human
accucuccccuggaacugucu

SEQ ID NO: 3878171 - RNA, 23 nt, Human
accucucccugacccuguauaua

SEQ ID NO: 3878172 - RNA, 19 nt, Human
accucucucacuccuugaa

SEQ ID NO: 3878173 - RNA, 23 nt, Human
accucucuccuuugcugaggccu

SEQ ID NO: 3878174 - RNA, 16 nt, Human
accucucugucccuug

SEQ ID NO: 3878175 - RNA, 22 nt, Human
accucucuuauagaauauuuau

SEQ ID NO: 3878176 - RNA, 20 nt, Human
accucugaaaacggcccucu

SEQ ID NO: 3878177 - RNA, 20 nt, Human
accucugaaacccuggacca

SEQ ID NO: 3878178 - RNA, 17 nt, Human
accucugacagcagcau

SEQ ID NO: 3878179 - RNA, 19 nt, Human
accucugacagcagcaucu

SEQ ID NO: 3878180 - RNA, 13 nt, Human
accucugauaccu

SEQ ID NO: 3878181 - RNA, 18 nt, Human
accucugcacaagcugca

SEQ ID NO: 3878182 - RNA, 18 nt, Human
accucugcagcaauaaag

SEQ ID NO: 3878183 - RNA, 12 nt, Human
accucugccaga

SEQ ID NO: 3878184 - RNA, 19 nt, Human
accucugccuuugugguga

SEQ ID NO: 3878185 - RNA, 14 nt, Human
accucugcucugag

SEQ ID NO: 3878186 - RNA, 17 nt, Human
acgcucccucccccugc

SEQ ID NO: 3878187 - RNA, 15 nt, Human
acgcuccuuccucug

SEQ ID NO: 3878188 - RNA, 14 nt, Human
acgcuccuuucuga

SEQ ID NO: 3878189 - RNA, 13 nt, Human
acgcuccuuugug

SEQ ID NO: 3878190 - RNA, 16 nt, Human
acgcucucuggccuuc

SEQ ID NO: 3878191 - RNA, 17 nt, Human
acgcucucuggccuucg

SEQ ID NO: 3878192 - RNA, 12 nt, Human
acgcugaauaaa

SEQ ID NO: 3878193 - RNA, 15 nt, Human
acgcugaauaaaugu

SEQ ID NO: 3878194 - RNA, 18 nt, Human
acgcugaauaaaugucuu

SEQ ID NO: 3878195 - RNA, 14 nt, Human
acgcugcagagcac

SEQ ID NO: 3878196 - RNA, 14 nt, Human
acgcugcugucaca

SEQ ID NO: 3878197 - RNA, 19 nt, Human
acgcugcugucacaaccaa

SEQ ID NO: 3878198 - RNA, 21 nt, Human
acgcugcugucacaaccaaga

SEQ ID NO: 3878199 - RNA, 15 nt, Human
acgcuggagugcagu

SEQ ID NO: 3878200 - RNA, 17 nt, Human
acgcuggagugcaguga

SEQ ID NO: 3878201 - RNA, 18 nt, Human
acgcuggcaacacagagg

SEQ ID NO: 3878202 - RNA, 11 nt, Human
acgcuggcucc

SEQ ID NO: 3878203 - RNA, 23 nt, Human
acgcugguagagauggaggagga

SEQ ID NO: 3878204 - RNA, 20 nt, Human
acgcugucaaaaguuggacu

SEQ ID NO: 3878205 - RNA, 23 nt, Human
acgcugucccuaguaaaaauaca

SEQ ID NO: 3878206 - RNA, 14 nt, Human
acgcugucuccaga

SEQ ID NO: 3878207 - RNA, 15 nt, Human
acgcugucuccagac

SEQ ID NO: 3878208 - RNA, 14 nt, Human
acgcugugcugccc

SEQ ID NO: 3878209 - RNA, 16 nt, Human
acgcugugcugcccug

SEQ ID NO: 3878210 - RNA, 19 nt, Human
acgcuuucagcgaaugaca

SEQ ID NO: 3878211 - RNA, 17 nt, Human
acgcuuucuagcuguug

SEQ ID NO: 3878212 - RNA, 11 nt, Human
acgcuuugauu

SEQ ID NO: 3878213 - RNA, 12 nt, Human
acgcuuugauuc

SEQ ID NO: 3878214 - RNA, 11 nt, Human
acgcuuuguca

SEQ ID NO: 3878215 - RNA, 23 nt, Human
acgcuuuugugauggagugcugu

SEQ ID NO: 3878216 - RNA, 17 nt, Human
acgcuuuuugaaaaagc

SEQ ID NO: 3878217 - RNA, 15 nt, Human
acggaaaaugccaau

SEQ ID NO: 3878218 - RNA, 15 nt, Human
acggaagagccuugc

SEQ ID NO: 3878219 - RNA, 22 nt, Human
acggaaggguaaacaauauagu

SEQ ID NO: 3878220 - RNA, 21 nt, Human
acggaagugguggcuguggaa

SEQ ID NO: 3878221 - RNA, 14 nt, Human
acggaaguuuucaa

SEQ ID NO: 3878222 - RNA, 19 nt, Human
acggaaguuuucaaugaug

SEQ ID NO: 3878223 - RNA, 19 nt, Human
acggaauaguuggcuagga

SEQ ID NO: 3878224 - RNA, 23 nt, Human
acggacaaaaccccccagauauc

SEQ ID NO: 3878225 - RNA, 14 nt, Human
acggacaauaaacc

SEQ ID NO: 3878226 - RNA, 18 nt, Human
acggacaauaaaccuccg

SEQ ID NO: 3878227 - RNA, 19 nt, Human
acggacaauaaaccuccgc

SEQ ID NO: 3878228 - RNA, 19 nt, Human
acggacacucaaaagcugg

SEQ ID NO: 3878229 - RNA, 13 nt, Human
acggagagaaaaa

SEQ ID NO: 3878230 - RNA, 18 nt, Human
acggagccacuccucuga

SEQ ID NO: 3878231 - RNA, 19 nt, Human
acggagccacuccucugac

SEQ ID NO: 3878232 - RNA, 20 nt, Human
acggagccacuccucugacu

SEQ ID NO: 3878233 - RNA, 21 nt, Human
acggagccacuccucugacuc

SEQ ID NO: 3878234 - RNA, 21 nt, Human
acggagccccaggccucugug

SEQ ID NO: 3878235 - RNA, 17 nt, Human
acggaucagaaauacag

SEQ ID NO: 3878236 - RNA, 23 nt, Human
acggauccugcacugacucugga

SEQ ID NO: 3878237 - RNA, 15 nt, Human
acggaucugagaauc

SEQ ID NO: 3878238 - RNA, 13 nt, Human
acggaugauuucu

SEQ ID NO: 3878239 - RNA, 23 nt, Human
accucugcucugaggcuuccaga

SEQ ID NO: 3878240 - RNA, 15 nt, Human
accucugcuucccag

SEQ ID NO: 3878241 - RNA, 17 nt, Human
accucugcuucccaggu

SEQ ID NO: 3878242 - RNA, 20 nt, Human
accucugcuuucugauguug

SEQ ID NO: 3878243 - RNA, 24 nt, Human
accucugcuuuuaucucagauguu

SEQ ID NO: 3878244 - RNA, 23 nt, Human
accucuggacuggcuagaguccu

SEQ ID NO: 3878245 - RNA, 22 nt, Human
accucuguauuugaaucagccu

SEQ ID NO: 3878246 - RNA, 12 nt, Human
accucugucuca

SEQ ID NO: 3878247 - RNA, 16 nt, Human
accucugucucauccu

SEQ ID NO: 3878248 - RNA, 20 nt, Human
accucugucucauccuccug

SEQ ID NO: 3878249 - RNA, 22 nt, Human
accucugucuuggcuuucaugu

SEQ ID NO: 3878250 - RNA, 15 nt, Human
accucugugaccuca

SEQ ID NO: 3878251 - RNA, 16 nt, Human
accucugugaccucag

SEQ ID NO: 3878252 - RNA, 14 nt, Human
accucuguuguccu

SEQ ID NO: 3878253 - RNA, 22 nt, Human
accucuuaaagaaaacccaccc

SEQ ID NO: 3878254 - RNA, 15 nt, Human
accucuucacccccc

SEQ ID NO: 3878255 - RNA, 12 nt, Human
accucuuccgac

SEQ ID NO: 3878256 - RNA, 19 nt, Human
accucuugagccuugaacu

SEQ ID NO: 3878257 - RNA, 12 nt, Human
accucuugcugu

SEQ ID NO: 3878258 - RNA, 13 nt, Human
accucuugcuguc

SEQ ID NO: 3878259 - RNA, 16 nt, Human
accucuugcugucucu

SEQ ID NO: 3878260 - RNA, 22 nt, Human
accucuuuaaguauugauucug

SEQ ID NO: 3878261 - RNA, 22 nt, Human
accucuuuauuuuuugauugaa

SEQ ID NO: 3878262 - RNA, 15 nt, Human
accucuuuucugcau

SEQ ID NO: 3878263 - RNA, 18 nt, Human
accugaaaaaaaguuuac

SEQ ID NO: 3878264 - RNA, 19 nt, Human
accugaaaacacugugcac

SEQ ID NO: 3878265 - RNA, 20 nt, Human
accugaaaacacugugcaca

SEQ ID NO: 3878266 - RNA, 12 nt, Human
accugaaaagua

SEQ ID NO: 3878267 - RNA, 18 nt, Human
accugaacacuuauugcu

SEQ ID NO: 3878268 - RNA, 16 nt, Human
accugaagacugagga

SEQ ID NO: 3878269 - RNA, 22 nt, Human
accugaagcuaucguaaaauua

SEQ ID NO: 3878270 - RNA, 23 nt, Human
accugaagggguuuucuugauaa

SEQ ID NO: 3878271 - RNA, 13 nt, Human
accugaaguucac

SEQ ID NO: 3878272 - RNA, 18 nt, Human
accugaauagcucccaga

SEQ ID NO: 3878273 - RNA, 19 nt, Human
accugaauuuuggcugugu

SEQ ID NO: 3878274 - RNA, 15 nt, Human
accugacacaagagg

SEQ ID NO: 3878275 - RNA, 19 nt, Human
accugacacaccaggcgcu

SEQ ID NO: 3878276 - RNA, 16 nt, Human
accugacacucccuug

SEQ ID NO: 3878277 - RNA, 17 nt, Human
accugaccccugacccc

SEQ ID NO: 3878278 - RNA, 15 nt, Human
accugaccccugcuc

SEQ ID NO: 3878279 - RNA, 16 nt, Human
accugaccccugcuca

SEQ ID NO: 3878280 - RNA, 14 nt, Human
accugaccgugggc

SEQ ID NO: 3878281 - RNA, 18 nt, Human
accugaccucuugcuguc

SEQ ID NO: 3878282 - RNA, 21 nt, Human
accugaccucuugcugucucu

SEQ ID NO: 3878283 - RNA, 19 nt, Human
accugacguagcugcaaag

SEQ ID NO: 3878284 - RNA, 16 nt, Human
accugacucugaaauc

SEQ ID NO: 3878285 - RNA, 17 nt, Human
accugacucugaaaucu

SEQ ID NO: 3878286 - RNA, 20 nt, Human
accugacugguuaacagcag

SEQ ID NO: 3878287 - RNA, 17 nt, Human
accugagauuuauuaaa

SEQ ID NO: 3878288 - RNA, 19 nt, Human
accugagauuuauuaaaga

SEQ ID NO: 3878289 - RNA, 12 nt, Human
accugagcccca

SEQ ID NO: 3878290 - RNA, 23 nt, Human
accugagcccggaugcuucucca

SEQ ID NO: 3878291 - RNA, 13 nt, Human
accugagccugcc

SEQ ID NO: 3878292 - RNA, 12 nt, Human
accugagcuaaa

SEQ ID NO: 3878293 - RNA, 22 nt, Human
accugagcuaaauaaagauauu

SEQ ID NO: 3878294 - RNA, 20 nt, Human
accugagcuagaagcuggag

SEQ ID NO: 3878295 - RNA, 13 nt, Human
accugagcuuugg

SEQ ID NO: 3878296 - RNA, 17 nt, Human
accugaggaacugucuc

SEQ ID NO: 3878297 - RNA, 21 nt, Human
accugaggacauggcuucuga

SEQ ID NO: 3878298 - RNA, 21 nt, Human
accugaggcccuucucuccag

SEQ ID NO: 3878299 - RNA, 12 nt, Human
accugaggcugu

SEQ ID NO: 3878300 - RNA, 15 nt, Human
accugagggucugua

SEQ ID NO: 3878301 - RNA, 16 nt, Human
accugaggugggccca

SEQ ID NO: 3878302 - RNA, 19 nt, Human
accugaggugggcccagga

SEQ ID NO: 3878303 - RNA, 22 nt, Human
accugaggugggcccaggacca

SEQ ID NO: 3878304 - RNA, 23 nt, Human
accugaggugggcccaggaccag

SEQ ID NO: 3878305 - RNA, 23 nt, Human
accugagucacccuaccugugcc

SEQ ID NO: 3878306 - RNA, 18 nt, Human
accugagucugcuauauu

SEQ ID NO: 3878307 - RNA, 20 nt, Human
accugauccuggaggcccag

SEQ ID NO: 3878308 - RNA, 13 nt, Human
accugaugaaaau

SEQ ID NO: 3878309 - RNA, 22 nt, Human
accugaugaaaauaaagaaugg

SEQ ID NO: 3878310 - RNA, 22 nt, Human
accugauggaaguaaagccuca

SEQ ID NO: 3878311 - RNA, 21 nt, Human
accugauggcacuuagcuauc

SEQ ID NO: 3878312 - RNA, 19 nt, Human
accugauguaccugaugcu

SEQ ID NO: 3878313 - RNA, 13 nt, Human
accugauguguac

SEQ ID NO: 3878314 - RNA, 21 nt, Human
accugauguuaaaauuccauc

SEQ ID NO: 3878315 - RNA, 11 nt, Human
accugauucaa

SEQ ID NO: 3878316 - RNA, 16 nt, Human
accugauuuuuuuucc

SEQ ID NO: 3878317 - RNA, 15 nt, Human
accugcaaaaaauag

SEQ ID NO: 3878318 - RNA, 15 nt, Human
accugcaaagaucug

SEQ ID NO: 3878319 - RNA, 16 nt, Human
accugcaaagaucugu

SEQ ID NO: 3878320 - RNA, 22 nt, Human
accugcaaagaucuguccucag

SEQ ID NO: 3878321 - RNA, 15 nt, Human
accugcaaucccagc

SEQ ID NO: 3878322 - RNA, 15 nt, Human
accugcaccuccccc

SEQ ID NO: 3878323 - RNA, 17 nt, Human
accugcaccucccccca

SEQ ID NO: 3878324 - RNA, 21 nt, Human
accugcaccuccccccacugc

SEQ ID NO: 3878325 - RNA, 17 nt, Human
accugcagauucuagga

SEQ ID NO: 3878326 - RNA, 17 nt, Human
accugcagccucccucc

SEQ ID NO: 3878327 - RNA, 15 nt, Human
accugcagcucccuc

SEQ ID NO: 3878328 - RNA, 23 nt, Human
accugcaggcugagccacucucu

SEQ ID NO: 3878329 - RNA, 19 nt, Human
accugcauccguaguuccc

SEQ ID NO: 3878330 - RNA, 21 nt, Human
accugcauccguaguucccug

SEQ ID NO: 3878331 - RNA, 21 nt, Human
accugcauuuguauguguccc

SEQ ID NO: 3878332 - RNA, 22 nt, Human
accugccacccugggccuggca

SEQ ID NO: 3878333 - RNA, 22 nt, Human
accugccacuaggcugggugcc

SEQ ID NO: 3878334 - RNA, 16 nt, Human
accugccacucacaca

SEQ ID NO: 3878335 - RNA, 17 nt, Human
accugccacucacacag

SEQ ID NO: 3878336 - RNA, 19 nt, Human
accugccacucacacagcc

SEQ ID NO: 3878337 - RNA, 22 nt, Human
accugccacucacacagccagg

SEQ ID NO: 3878338 - RNA, 14 nt, Human
accugccagccugg

SEQ ID NO: 3878339 - RNA, 14 nt, Human
accugccaggaagc

SEQ ID NO: 3878340 - RNA, 15 nt, Human
accugccaggcaggg

SEQ ID NO: 3878341 - RNA, 18 nt, Human
accugccaggcaggggug

SEQ ID NO: 3878342 - RNA, 11 nt, Human
accugccaggg

SEQ ID NO: 3878343 - RNA, 13 nt, Human
accugccagggag

SEQ ID NO: 3878344 - RNA, 18 nt, Human
accugccauuugcacccu

SEQ ID NO: 3878345 - RNA, 15 nt, Human
accugcccaucacag

SEQ ID NO: 3878346 - RNA, 17 nt, Human
accugccccaacucucc

SEQ ID NO: 3878347 - RNA, 23 nt, Human
accugccccacuuguccuuagcc

SEQ ID NO: 3878348 - RNA, 13 nt, Human
accugccccaucc

SEQ ID NO: 3878349 - RNA, 17 nt, Human
accugcccccuucuccc

SEQ ID NO: 3878350 - RNA, 18 nt, Human
accugcccccuucuccca

SEQ ID NO: 3878351 - RNA, 16 nt, Human
accugccccgcccagc

SEQ ID NO: 3878352 - RNA, 20 nt, Human
accugccccucaacucuccu

SEQ ID NO: 3878353 - RNA, 20 nt, Human
accugccccuccucucugcc

SEQ ID NO: 3878354 - RNA, 22 nt, Human
accugccccuccucucugcccu

SEQ ID NO: 3878355 - RNA, 23 nt, Human
accugccccuccucucugcccua

SEQ ID NO: 3878356 - RNA, 18 nt, Human
accugcccuaccugcccc

SEQ ID NO: 3878357 - RNA, 19 nt, Human
accugcccuaccugcccca

SEQ ID NO: 3878358 - RNA, 15 nt, Human
accugcccucaaggg

SEQ ID NO: 3878359 - RNA, 17 nt, Human
accugcccugcccccac

SEQ ID NO: 3878360 - RNA, 20 nt, Human
accugcccugcccugccacc

SEQ ID NO: 3878361 - RNA, 22 nt, Human
accugcccugcccugccaccug

SEQ ID NO: 3878362 - RNA, 12 nt, Human
accugcccugga

SEQ ID NO: 3878363 - RNA, 20 nt, Human
accugcccuuuuuucugccu

SEQ ID NO: 3878364 - RNA, 12 nt, Human
accugccgaccu

SEQ ID NO: 3878365 - RNA, 18 nt, Human
accugccgaccucguccu

SEQ ID NO: 3878366 - RNA, 16 nt, Human
accugccgagagucca

SEQ ID NO: 3878367 - RNA, 17 nt, Human
accugccucacagcugg

SEQ ID NO: 3878368 - RNA, 23 nt, Human
accugccucccuucaugcaugga

SEQ ID NO: 3878369 - RNA, 18 nt, Human
accugccuccucguuccu

SEQ ID NO: 3878370 - RNA, 14 nt, Human
accugccuccugcc

SEQ ID NO: 3878371 - RNA, 18 nt, Human
accugccuccugccugcc

SEQ ID NO: 3878372 - RNA, 23 nt, Human
accugccucggccucccaaagug

SEQ ID NO: 3878373 - RNA, 10 nt, Human
accugccugc

SEQ ID NO: 3878374 - RNA, 18 nt, Human
accugccugcgucuuccg

SEQ ID NO: 3878375 - RNA, 11 nt, Human
accugccugua

SEQ ID NO: 3878376 - RNA, 13 nt, Human
accugcgcuucac

SEQ ID NO: 3878377 - RNA, 14 nt, Human
accugcgcuucacu

SEQ ID NO: 3878378 - RNA, 22 nt, Human
accugcggcugcugugugccuu

SEQ ID NO: 3878379 - RNA, 16 nt, Human
accugcggugcuaucu

SEQ ID NO: 3878380 - RNA, 16 nt, Human
accugcucacgucaaa

SEQ ID NO: 3878381 - RNA, 13 nt, Human
accugcucccagg

SEQ ID NO: 3878382 - RNA, 13 nt, Human
accugcucuccuc

SEQ ID NO: 3878383 - RNA, 15 nt, Human
accugcucuccucuu

SEQ ID NO: 3878384 - RNA, 16 nt, Human
accugcucuccucuuc

SEQ ID NO: 3878385 - RNA, 23 nt, Human
accugcucuccucuucuacucac

SEQ ID NO: 3878386 - RNA, 18 nt, Human
accugcucuccucuugcc

SEQ ID NO: 3878387 - RNA, 12 nt, Human
accugcucugcu

SEQ ID NO: 3878388 - RNA, 16 nt, Human
gacuuuggcugcaugc

SEQ ID NO: 3878389 - RNA, 14 nt, Human
gacuuuguaccccc

SEQ ID NO: 3878390 - RNA, 22 nt, Human
gacuuuguaccccccaaccccu

SEQ ID NO: 3878391 - RNA, 19 nt, Human
gacuuuucaaguauuuaag

SEQ ID NO: 3878392 - RNA, 22 nt, Human
gacuuuuccaauaugugauuuu

SEQ ID NO: 3878393 - RNA, 22 nt, Human
gacuuuucgaccaauucaaccc

SEQ ID NO: 3878394 - RNA, 17 nt, Human
gacuuuucguuaacauu

SEQ ID NO: 3878395 - RNA, 13 nt, Human
gacuuuucugcaa

SEQ ID NO: 3878396 - RNA, 12 nt, Human
gacuuuucugua

SEQ ID NO: 3878397 - RNA, 23 nt, Human
gacuuuucuguccgagcuuugaa

SEQ ID NO: 3878398 - RNA, 23 nt, Human
gacuuuucuuucagccaagaauu

SEQ ID NO: 3878399 - RNA, 15 nt, Human
gacuuuugcuuuaau

SEQ ID NO: 3878400 - RNA, 20 nt, Human
gacuuuuguacaucuggcuu

SEQ ID NO: 3878401 - RNA, 13 nt, Human
gacuuuuuauaaa

SEQ ID NO: 3878402 - RNA, 16 nt, Human
gacuuuuuauaaaaug

SEQ ID NO: 3878403 - RNA, 18 nt, Human
gacuuuuugguggaugua

SEQ ID NO: 3878404 - RNA, 20 nt, Human
gagaaaaagaaaaaauauau

SEQ ID NO: 3878405 - RNA, 16 nt, Human
gagaaaaagaaaugca

SEQ ID NO: 3878406 - RNA, 12 nt, Human
gagaaaaagacc

SEQ ID NO: 3878407 - RNA, 19 nt, Human
gagaaaaagcuccuguccu

SEQ ID NO: 3878408 - RNA, 18 nt, Human
gagaaaaaugcuccccac

SEQ ID NO: 3878409 - RNA, 15 nt, Human
gagaaaacagaccua

SEQ ID NO: 3878410 - RNA, 17 nt, Human
gagaaaaccccuuccca

SEQ ID NO: 3878411 - RNA, 15 nt, Human
gagaaaaccuguucu

SEQ ID NO: 3878412 - RNA, 22 nt, Human
gagaaaacuuauuugagugauu

SEQ ID NO: 3878413 - RNA, 14 nt, Human
gagaaaagaaaaaa

SEQ ID NO: 3878414 - RNA, 15 nt, Human
gagaaaagaaaaaaa

SEQ ID NO: 3878415 - RNA, 14 nt, Human
gagaaaagagagaa

SEQ ID NO: 3878416 - RNA, 13 nt, Human
gagaaaauaaaaa

SEQ ID NO: 3878417 - RNA, 18 nt, Human
gagaaaauaaaaaguuaa

SEQ ID NO: 3878418 - RNA, 18 nt, Human
gagaaaaucaucaagaag

SEQ ID NO: 3878419 - RNA, 18 nt, Human
gagaaaauccccauugaa

SEQ ID NO: 3878420 - RNA, 13 nt, Human
gagaaacaaacuu

SEQ ID NO: 3878421 - RNA, 14 nt, Human
gagaaacagagaca

SEQ ID NO: 3878422 - RNA, 19 nt, Human
gagaaacagagacaggccc

SEQ ID NO: 3878423 - RNA, 16 nt, Human
gagaaaccagcuuccu

SEQ ID NO: 3878424 - RNA, 23 nt, Human
gagaaaccagcuuccuucagaga

SEQ ID NO: 3878425 - RNA, 12 nt, Human
gagaaacccugu

SEQ ID NO: 3878426 - RNA, 22 nt, Human
gagaaaccguccucuuuuucca

SEQ ID NO: 3878427 - RNA, 17 nt, Human
gagaaaccuguaucuuu

SEQ ID NO: 3878428 - RNA, 18 nt, Human
gagaaacuuaagcaaagg

SEQ ID NO: 3878429 - RNA, 19 nt, Human
gagaaacuuuauacauuag

SEQ ID NO: 3878430 - RNA, 20 nt, Human
gagaaagccaggcagguagc

SEQ ID NO: 3878431 - RNA, 19 nt, Human
gagaaagcugacuuggcug

SEQ ID NO: 3878432 - RNA, 20 nt, Human
gagaaagcugacuuggcugg

SEQ ID NO: 3878433 - RNA, 15 nt, Human
gagaaagggacaaug

SEQ ID NO: 3878434 - RNA, 17 nt, Human
gagaaaggggagcccac

SEQ ID NO: 3878435 - RNA, 18 nt, Human
gagaaaggggagcccacu

SEQ ID NO: 3878436 - RNA, 23 nt, Human
gagaaauaaaguuugcuuagaaa

SEQ ID NO: 3878437 - RNA, 18 nt, Human
gagaaauaagugcccucu

SEQ ID NO: 3878438 - RNA, 23 nt, Human
gagaaauagcuuaugaaaagaau

SEQ ID NO: 3878439 - RNA, 20 nt, Human
gagaaauauggacacuuaau

SEQ ID NO: 3878440 - RNA, 14 nt, Human
gagaaaugaaaaca

SEQ ID NO: 3878441 - RNA, 19 nt, Human
gagaaauucguguguuuuu

SEQ ID NO: 3878442 - RNA, 12 nt, Human
gagaaauucugu

SEQ ID NO: 3878443 - RNA, 14 nt, Human
gagaaauucuguua

SEQ ID NO: 3878444 - RNA, 20 nt, Human
gagaaauucuguuaaaaucu

SEQ ID NO: 3878445 - RNA, 14 nt, Human
gagaaauucuuguu

SEQ ID NO: 3878446 - RNA, 14 nt, Human
gagaaauuuauaaa

SEQ ID NO: 3878447 - RNA, 12 nt, Human
gagaacaaagcu

SEQ ID NO: 3878448 - RNA, 22 nt, Human
gagaacaaagcuguuaaacugu

SEQ ID NO: 3878449 - RNA, 12 nt, Human
gagaacaaauau

SEQ ID NO: 3878450 - RNA, 22 nt, Human
gagaacacagccgauucaccug

SEQ ID NO: 3878451 - RNA, 12 nt, Human
gagaacaggacu

SEQ ID NO: 3878452 - RNA, 18 nt, Human
gagaacaggugguuuuua

SEQ ID NO: 3878453 - RNA, 13 nt, Human
gagaaccaaaucu

SEQ ID NO: 3878454 - RNA, 22 nt, Human
gagaaccgagcaaagaucaaaa

SEQ ID NO: 3878455 - RNA, 23 nt, Human
gagaaccgagcaaagaucaaaau

SEQ ID NO: 3878456 - RNA, 18 nt, Human
gagaaccuaaguuucagu

SEQ ID NO: 3878457 - RNA, 21 nt, Human
gagaaccuagggugauauuaa

SEQ ID NO: 3878458 - RNA, 22 nt, Human
aauccuauauagaaugcugcac

SEQ ID NO: 3878459 - RNA, 20 nt, Human
aauccuauucucgggcugag

SEQ ID NO: 3878460 - RNA, 20 nt, Human
aauccucaguuuuugugaaa

SEQ ID NO: 3878461 - RNA, 13 nt, Human
aauccuccuccag

SEQ ID NO: 3878462 - RNA, 15 nt, Human
aauccuccugaguga

SEQ ID NO: 3878463 - RNA, 18 nt, Human
aauccucucucuguguua

SEQ ID NO: 3878464 - RNA, 17 nt, Human
aauccucuuccucugag

SEQ ID NO: 3878465 - RNA, 19 nt, Human
aauccugauuccucucuaa

SEQ ID NO: 3878466 - RNA, 10 nt, Human
aauccugccc

SEQ ID NO: 3878467 - RNA, 21 nt, Human
aauccuggagaggguauuuuu

SEQ ID NO: 3878468 - RNA, 15 nt, Human
aauccuggauuuuuu

SEQ ID NO: 3878469 - RNA, 12 nt, Human
aauccuggcagc

SEQ ID NO: 3878470 - RNA, 13 nt, Human
aauccuggcagcc

SEQ ID NO: 3878471 - RNA, 19 nt, Human
aauccuggcccucuguguu

SEQ ID NO: 3878472 - RNA, 21 nt, Human
aauccuggggaacauagaacu

SEQ ID NO: 3878473 - RNA, 22 nt, Human
aauccuguaggaagguacugua

SEQ ID NO: 3878474 - RNA, 15 nt, Human
aauccuguccucagc

SEQ ID NO: 3878475 - RNA, 18 nt, Human
aauccuguccucagcuuc

SEQ ID NO: 3878476 - RNA, 21 nt, Human
aauccuguccucagcuucuua

SEQ ID NO: 3878477 - RNA, 16 nt, Human
aauccuguugaaaagc

SEQ ID NO: 3878478 - RNA, 22 nt, Human
aauccuguugaaaagccauguu

SEQ ID NO: 3878479 - RNA, 20 nt, Human
aauccuuagaucuggcaugu

SEQ ID NO: 3878480 - RNA, 12 nt, Human
aauccuuccaaa

SEQ ID NO: 3878481 - RNA, 21 nt, Human
aauccuuccaaaaauuauuau

SEQ ID NO: 3878482 - RNA, 14 nt, Human
aauccuucuaaucu

SEQ ID NO: 3878483 - RNA, 15 nt, Human
aauccuugaagguau

SEQ ID NO: 3878484 - RNA, 17 nt, Human
aauccuugcuuaugaca

SEQ ID NO: 3878485 - RNA, 18 nt, Human
aauccuugcuuaugacau

SEQ ID NO: 3878486 - RNA, 13 nt, Human
aauccuuuacugu

SEQ ID NO: 3878487 - RNA, 14 nt, Human
aauccuuugccugc

SEQ ID NO: 3878488 - RNA, 14 nt, Human
aauccuuuggaaaa

SEQ ID NO: 3878489 - RNA, 13 nt, Human
aauccuuugugaa

SEQ ID NO: 3878490 - RNA, 12 nt, Human
aauccuuuugua

SEQ ID NO: 3878491 - RNA, 20 nt, Human
aauccuuuuucuuuauaaac

SEQ ID NO: 3878492 - RNA, 15 nt, Human
aaucgaccugccucg

SEQ ID NO: 3878493 - RNA, 19 nt, Human
aaucgaggaaccagagcca

SEQ ID NO: 3878494 - RNA, 20 nt, Human
aaucgagugagacaaaauuu

SEQ ID NO: 3878495 - RNA, 13 nt, Human
aaucgauuggcuu

SEQ ID NO: 3878496 - RNA, 21 nt, Human
aaucgcuuaaagauguuccua

SEQ ID NO: 3878497 - RNA, 23 nt, Human
aaucgcuucucuuuugaaacaau

SEQ ID NO: 3878498 - RNA, 21 nt, Human
aaucgcuuuccuaaaacagua

SEQ ID NO: 3878499 - RNA, 23 nt, Human
aaucggaucuggggcucugggau

SEQ ID NO: 3878500 - RNA, 15 nt, Human
aaucgguuuaaacau

SEQ ID NO: 3878501 - RNA, 16 nt, Human
aaucguuaugugugua

SEQ ID NO: 3878502 - RNA, 18 nt, Human
aaucguuauguguguaua

SEQ ID NO: 3878503 - RNA, 14 nt, Human
aaucuaaaagcuuu

SEQ ID NO: 3878504 - RNA, 17 nt, Human
aaucuaaaucuauuuau

SEQ ID NO: 3878505 - RNA, 18 nt, Human
aaucuaaauggaaccacu

SEQ ID NO: 3878506 - RNA, 22 nt, Human
aaucuaagcagcauuucugaag

SEQ ID NO: 3878507 - RNA, 21 nt, Human
aaucuaagcagcuuauuguuu

SEQ ID NO: 3878508 - RNA, 15 nt, Human
aaucuaagugauaua

SEQ ID NO: 3878509 - RNA, 17 nt, Human
aaucuaaugacauucaa

SEQ ID NO: 3878510 - RNA, 18 nt, Human
aaucuaaugacauucaau

SEQ ID NO: 3878511 - RNA, 16 nt, Human
aaucuacacacggugc

SEQ ID NO: 3878512 - RNA, 15 nt, Human
aaucuacccaaagga

SEQ ID NO: 3878513 - RNA, 17 nt, Human
aaucuaccuucuguagu

SEQ ID NO: 3878514 - RNA, 16 nt, Human
aaucuacuaauuccac

SEQ ID NO: 3878515 - RNA, 17 nt, Human
aaucuacuaauuccaca

SEQ ID NO: 3878516 - RNA, 17 nt, Human
aaucuacucaaagcaug

SEQ ID NO: 3878517 - RNA, 15 nt, Human
aaucuagaagaaaug

SEQ ID NO: 3878518 - RNA, 17 nt, Human
aaucuagaagaaaugaa

SEQ ID NO: 3878519 - RNA, 18 nt, Human
aaucuagaagaaaugaaa

SEQ ID NO: 3878520 - RNA, 19 nt, Human
aaucuagaagaaaugaaau

SEQ ID NO: 3878521 - RNA, 21 nt, Human
aaucuguaaacuguguauucc

SEQ ID NO: 3878522 - RNA, 11 nt, Human
aaucuguacau

SEQ ID NO: 3878523 - RNA, 22 nt, Human
aaucuguacauuuuguuguaaa

SEQ ID NO: 3878524 - RNA, 16 nt, Human
aaucuguagggcugga

SEQ ID NO: 3878525 - RNA, 20 nt, Human
aaucuguauaauacuuugua

SEQ ID NO: 3878526 - RNA, 21 nt, Human
aaucuguauaauacuuuguau

SEQ ID NO: 3878527 - RNA, 14 nt, Human
aaucugucaaaaca

SEQ ID NO: 3878528 - RNA, 18 nt, Human
aaucugucaaaacacugu

SEQ ID NO: 3878529 - RNA, 13 nt, Human
aaucugucaagag

SEQ ID NO: 3878530 - RNA, 20 nt, Human
aaucuguccaaaggaggcug

SEQ ID NO: 3878531 - RNA, 11 nt, Human
aaucugucugc

SEQ ID NO: 3878532 - RNA, 14 nt, Human
aaucugucugcugg

SEQ ID NO: 3878533 - RNA, 22 nt, Human
aaucugucugcuggucacuucu

SEQ ID NO: 3878534 - RNA, 23 nt, Human
aaucugucugcuggucacuucuu

SEQ ID NO: 3878535 - RNA, 13 nt, Human
aaucugugaacuu

SEQ ID NO: 3878536 - RNA, 18 nt, Human
aaucugugaacuugaaau

SEQ ID NO: 3878537 - RNA, 20 nt, Human
aaucugugaacuugaaauuu

SEQ ID NO: 3878538 - RNA, 18 nt, Human
aaucuguguacaaagaaa

SEQ ID NO: 3878539 - RNA, 20 nt, Human
aaucuguguacaaagaaaua

SEQ ID NO: 3878540 - RNA, 20 nt, Human
aaucuguguauauuauuugg

SEQ ID NO: 3878541 - RNA, 17 nt, Human
aaucugugugugcccug

SEQ ID NO: 3878542 - RNA, 19 nt, Human
aaucuguucugggcucuuu

SEQ ID NO: 3878543 - RNA, 21 nt, Human
aaucuguugauaaauccauca

SEQ ID NO: 3878544 - RNA, 13 nt, Human
aaucuuaagaaau

SEQ ID NO: 3878545 - RNA, 15 nt, Human
aaucuuaagaaauaa

SEQ ID NO: 3878546 - RNA, 19 nt, Human
aaucuuaagguguagccac

SEQ ID NO: 3878547 - RNA, 22 nt, Human
aaucuuaauacuguuauucuuu

SEQ ID NO: 3878548 - RNA, 18 nt, Human
aaucuuacuuuguaaauu

SEQ ID NO: 3878549 - RNA, 19 nt, Human
aaucuuacuuuguaaauuc

SEQ ID NO: 3878550 - RNA, 20 nt, Human
aaucuuacuuuguaaauucu

SEQ ID NO: 3878551 - RNA, 16 nt, Human
aaucuuagcugccaag

SEQ ID NO: 3878552 - RNA, 21 nt, Human
aaucuuaguguaugauuacug

SEQ ID NO: 3878553 - RNA, 17 nt, Human
aaucuuauaauuguucu

SEQ ID NO: 3878554 - RNA, 14 nt, Human
aaucuuauaauuua

SEQ ID NO: 3878555 - RNA, 14 nt, Human
aaucuuauaguucu

SEQ ID NO: 3878556 - RNA, 15 nt, Human
aaucuuaucaugguc

SEQ ID NO: 3878557 - RNA, 14 nt, Human
aaucuuauuaaagu

SEQ ID NO: 3878558 - RNA, 17 nt, Human
aaucuucaaagccuucu

SEQ ID NO: 3878559 - RNA, 20 nt, Human
aaucuucaguuuuaucuuua

SEQ ID NO: 3878560 - RNA, 23 nt, Human
aaucuuccaauuuaguuguugua

SEQ ID NO: 3878561 - RNA, 19 nt, Human
aaucuuccuggucgaaagu

SEQ ID NO: 3878562 - RNA, 14 nt, Human
aaucuugaaauuaa

SEQ ID NO: 3878563 - RNA, 13 nt, Human
aaucuugucucaa

SEQ ID NO: 3878564 - RNA, 20 nt, Human
aaucuugucucaaugcucau

SEQ ID NO: 3878565 - RNA, 14 nt, Human
aaucuugugcuaga

SEQ ID NO: 3878566 - RNA, 22 nt, Human
aaucuugugcuagaauacuuuu

SEQ ID NO: 3878567 - RNA, 18 nt, Human
aaucuuguugguucacca

SEQ ID NO: 3878568 - RNA, 13 nt, Human
aaucuuguuuuga

SEQ ID NO: 3878569 - RNA, 14 nt, Human
aaucuuguuuugaa

SEQ ID NO: 3878570 - RNA, 14 nt, Human
aaucuuuaauuaaa

SEQ ID NO: 3878571 - RNA, 21 nt, Human
aaucuuuaauuaaaaccuggg

SEQ ID NO: 3878572 - RNA, 15 nt, Human
aaucuuuaauuuuac

SEQ ID NO: 3878573 - RNA, 22 nt, Human
aaucuuuagagaaguauacaua

SEQ ID NO: 3878574 - RNA, 16 nt, Human
aaucuuuauaaaugua

SEQ ID NO: 3878575 - RNA, 21 nt, Human
aaucuuucaaaccagcuucau

SEQ ID NO: 3878576 - RNA, 21 nt, Human
aaucuuucuuuaccugagacc

SEQ ID NO: 3878577 - RNA, 18 nt, Human
aaucuuucuuucuuagaa

SEQ ID NO: 3878578 - RNA, 23 nt, Human
aaucuuugaaagacuuccaaaga

SEQ ID NO: 3878579 - RNA, 20 nt, Human
aaucuuuguaccaaaauuuu

SEQ ID NO: 3878580 - RNA, 22 nt, Human
aaucuuuguuucagguucagua

SEQ ID NO: 3878581 - RNA, 21 nt, Human
aaucuuuuacaacugccucga

SEQ ID NO: 3878582 - RNA, 23 nt, Human
aaucuuuuacaacugccucgaaa

SEQ ID NO: 3878583 - RNA, 16 nt, Human
aaucuuuucacaaaua

SEQ ID NO: 3878584 - RNA, 14 nt, Human
aaucuuuucugaau

SEQ ID NO: 3878585 - RNA, 14 nt, Human
aaugaaaaaagcuu

SEQ ID NO: 3878586 - RNA, 18 nt, Human
aaugaaaaaugaaagaug

SEQ ID NO: 3878587 - RNA, 14 nt, Human
aaugaaaaauucuc

SEQ ID NO: 3878588 - RNA, 18 nt, Human
aaugaaaaauuuaagcau

SEQ ID NO: 3878589 - RNA, 16 nt, Human
aaugaaaacagaaugu

SEQ ID NO: 3878590 - RNA, 13 nt, Human
aaugaaaacagug

SEQ ID NO: 3878591 - RNA, 20 nt, Human
aaugauugaaaauaaugcug

SEQ ID NO: 3878592 - RNA, 15 nt, Human
aaugauugcuuuuaa

SEQ ID NO: 3878593 - RNA, 20 nt, Human
aaugauugcuuuuaaaauuu

SEQ ID NO: 3878594 - RNA, 18 nt, Human
aaugauuguuuaaagguu

SEQ ID NO: 3878595 - RNA, 22 nt, Human
aaugauuucaugcuaucucugu

SEQ ID NO: 3878596 - RNA, 20 nt, Human
aaugauuuccucuguaaucu

SEQ ID NO: 3878597 - RNA, 13 nt, Human
aaugauuuuuaaa

SEQ ID NO: 3878598 - RNA, 18 nt, Human
aaugauuuuucuuuacaa

SEQ ID NO: 3878599 - RNA, 17 nt, Human
aaugcaaaaaaaauuag

SEQ ID NO: 3878600 - RNA, 14 nt, Human
aaugcaaaaaaucu

SEQ ID NO: 3878601 - RNA, 11 nt, Human
aaugcaaacca

SEQ ID NO: 3878602 - RNA, 12 nt, Human
aaugcaaaccau

SEQ ID NO: 3878603 - RNA, 14 nt, Human
aaugcaaaccauca

SEQ ID NO: 3878604 - RNA, 21 nt, Human
aaugcaaacugggaugaaacu

SEQ ID NO: 3878605 - RNA, 14 nt, Human
aaugcaaagaugaa

SEQ ID NO: 3878606 - RNA, 18 nt, Human
aaugcaaagaugaagguc

SEQ ID NO: 3878607 - RNA, 23 nt, Human
aaugcaaaguucuguguuuaauu

SEQ ID NO: 3878608 - RNA, 15 nt, Human
aaugcaacaacaugu

SEQ ID NO: 3878609 - RNA, 19 nt, Human
aaugcaagagugauugcag

SEQ ID NO: 3878610 - RNA, 22 nt, Human
aaugcaagagugauugcagcuu

SEQ ID NO: 3878611 - RNA, 17 nt, Human
aaugcaagcuaguggcu

SEQ ID NO: 3878612 - RNA, 14 nt, Human
aaugcaauauguau

SEQ ID NO: 3878613 - RNA, 14 nt, Human
aaugcaauauuugu

SEQ ID NO: 3878614 - RNA, 21 nt, Human
aaugcaauguaagcauacuuu

SEQ ID NO: 3878615 - RNA, 14 nt, Human
aaugcacaaugucu

SEQ ID NO: 3878616 - RNA, 16 nt, Human
aaugcacaaugucuug

SEQ ID NO: 3878617 - RNA, 14 nt, Human
aaugcacacaaaac

SEQ ID NO: 3878618 - RNA, 16 nt, Human
aaugcacagauauacu

SEQ ID NO: 3878619 - RNA, 18 nt, Human
aaugcacauccauuccca

SEQ ID NO: 3878620 - RNA, 15 nt, Human
aaugcaccuaaagaa

SEQ ID NO: 3878621 - RNA, 13 nt, Human
aaugcacggccuc

SEQ ID NO: 3878622 - RNA, 19 nt, Human
aaugcacguagcugaggcc

SEQ ID NO: 3878623 - RNA, 18 nt, Human
aaugcacugggaaaaagu

SEQ ID NO: 3878624 - RNA, 13 nt, Human
aaugcacuuucua

SEQ ID NO: 3878625 - RNA, 13 nt, Human
aaugcacuuuguu

SEQ ID NO: 3878626 - RNA, 20 nt, Human
aaugcagcaaggcccugcug

SEQ ID NO: 3878627 - RNA, 20 nt, Human
aaugcagcagggaugcccug

SEQ ID NO: 3878628 - RNA, 22 nt, Human
aaugcagcagggaugcccugga

SEQ ID NO: 3878629 - RNA, 12 nt, Human
aaugcagccaga

SEQ ID NO: 3878630 - RNA, 12 nt, Human
aaugcagcccau

SEQ ID NO: 3878631 - RNA, 17 nt, Human
aaugcagcccauuucuc

SEQ ID NO: 3878632 - RNA, 14 nt, Human
aaugcaguauggua

SEQ ID NO: 3878633 - RNA, 19 nt, Human
aaugcaguaugguacauuu

SEQ ID NO: 3878634 - RNA, 19 nt, Human
aaugcagucuguccaggcu

SEQ ID NO: 3878635 - RNA, 20 nt, Human
aaugcagucuguccaggcuc

SEQ ID NO: 3878636 - RNA, 23 nt, Human
aaugcaguuacaaauuauaaugu

SEQ ID NO: 3878637 - RNA, 19 nt, Human
aaugcaguugucucuguuu

SEQ ID NO: 3878638 - RNA, 16 nt, Human
aaugcaguuucuucau

SEQ ID NO: 3878639 - RNA, 13 nt, Human
aaugcauaaaaug

SEQ ID NO: 3878640 - RNA, 17 nt, Human
aaugcauacagaaauau

SEQ ID NO: 3878641 - RNA, 18 nt, Human
aaugcauauccugagcca

SEQ ID NO: 3878642 - RNA, 17 nt, Human
aaugcauauuugcaaag

SEQ ID NO: 3878643 - RNA, 17 nt, Human
aauggagaagcugcagg

SEQ ID NO: 3878644 - RNA, 20 nt, Human
aauggagauuugaaggucug

SEQ ID NO: 3878645 - RNA, 17 nt, Human
aauggagcaucaagcca

SEQ ID NO: 3878646 - RNA, 20 nt, Human
aauggaggaucucuaaagag

SEQ ID NO: 3878647 - RNA, 19 nt, Human
aauggaguagaccccuggc

SEQ ID NO: 3878648 - RNA, 23 nt, Human
aauggaguagaccccuggcuggu

SEQ ID NO: 3878649 - RNA, 21 nt, Human
aauggaguuggaguucauuca

SEQ ID NO: 3878650 - RNA, 17 nt, Human
aauggauacauaaagac

SEQ ID NO: 3878651 - RNA, 14 nt, Human
aauggauagcucau

SEQ ID NO: 3878652 - RNA, 18 nt, Human
aauggaucacaagaugga

SEQ ID NO: 3878653 - RNA, 20 nt, Human
aauggauccccagugaaaac

SEQ ID NO: 3878654 - RNA, 12 nt, Human
aauggaugaaau

SEQ ID NO: 3878655 - RNA, 18 nt, Human
aauggauuggauuauuua

SEQ ID NO: 3878656 - RNA, 21 nt, Human
aauggauuggauuauuuaaua

SEQ ID NO: 3878657 - RNA, 18 nt, Human
aauggauuguuaauuuca

SEQ ID NO: 3878658 - RNA, 21 nt, Human
aauggauuugaugcuguuuga

SEQ ID NO: 3878659 - RNA, 20 nt, Human
aauggauuuuucuuuaacug

SEQ ID NO: 3878660 - RNA, 21 nt, Human
aauggcaacaaacugcacaug

SEQ ID NO: 3878661 - RNA, 12 nt, Human
aauggcagcaga

SEQ ID NO: 3878662 - RNA, 12 nt, Human
aauggcagccuu

SEQ ID NO: 3878663 - RNA, 20 nt, Human
aauggcaugagaaauacaaa

SEQ ID NO: 3878664 - RNA, 15 nt, Human
aauggcaugagauag

SEQ ID NO: 3878665 - RNA, 16 nt, Human
aauggccggcuggaaa

SEQ ID NO: 3878666 - RNA, 14 nt, Human
aauggccuucauau

SEQ ID NO: 3878667 - RNA, 14 nt, Human
aauggccuuccuuc

SEQ ID NO: 3878668 - RNA, 20 nt, Human
aauggcgcagugccucuggu

SEQ ID NO: 3878669 - RNA, 14 nt, Human
aauggcuauguuuu

SEQ ID NO: 3878670 - RNA, 20 nt, Human
aauggcuauguuuuuaaugu

SEQ ID NO: 3878671 - RNA, 16 nt, Human
aauggcugauaauuuu

SEQ ID NO: 3878672 - RNA, 17 nt, Human
aauggcugauaauuuua

SEQ ID NO: 3878673 - RNA, 18 nt, Human
aauggcuuuggucucuug

SEQ ID NO: 3878674 - RNA, 14 nt, Human
aaugggaaaagaga

SEQ ID NO: 3878675 - RNA, 20 nt, Human
aaugggaaauacuacuccug

SEQ ID NO: 3878676 - RNA, 13 nt, Human
aaugggacacuaa

SEQ ID NO: 3878677 - RNA, 18 nt, Human
aaugggacuggagucccu

SEQ ID NO: 3878678 - RNA, 16 nt, Human
aaugggaggccucuga

SEQ ID NO: 3878679 - RNA, 16 nt, Human
aaugggaucaugaaag

SEQ ID NO: 3878680 - RNA, 23 nt, Human
aaugggauguaugaauacagcag

SEQ ID NO: 3878681 - RNA, 18 nt, Human
aaugggcgccccccccuc

SEQ ID NO: 3878682 - RNA, 21 nt, Human
aaugggcgccccccccucccc

SEQ ID NO: 3878683 - RNA, 15 nt, Human
aaugggcucuuccaa

SEQ ID NO: 3878684 - RNA, 20 nt, Human
aaugggcucuuccaacaagg

SEQ ID NO: 3878685 - RNA, 13 nt, Human
aauggggccagau

SEQ ID NO: 3878686 - RNA, 17 nt, Human
aaugggggugcauuuga

SEQ ID NO: 3878687 - RNA, 19 nt, Human
aaugguacaugucuuccau

SEQ ID NO: 3878688 - RNA, 20 nt, Human
aaugguacuccacauauuuc

SEQ ID NO: 3878689 - RNA, 16 nt, Human
aaugguagcauuuuaa

SEQ ID NO: 3878690 - RNA, 23 nt, Human
aaugguaguaaucacaguuggcc

SEQ ID NO: 3878691 - RNA, 20 nt, Human
aaugguaguuucugugguug

SEQ ID NO: 3878692 - RNA, 16 nt, Human
aaugguauaaauuuca

SEQ ID NO: 3878693 - RNA, 16 nt, Human
aaugguauggaacucu

SEQ ID NO: 3878694 - RNA, 14 nt, Human
aaugguccaggaga

SEQ ID NO: 3878695 - RNA, 15 nt, Human
aaugguccugacuuu

SEQ ID NO: 3878696 - RNA, 22 nt, Human
aauggugaacugucauuacaga

SEQ ID NO: 3878697 - RNA, 16 nt, Human
aauggugaucacucca

SEQ ID NO: 3878698 - RNA, 16 nt, Human
aauggugccuucauuu

SEQ ID NO: 3878699 - RNA, 16 nt, Human
aauggugcucauuuca

SEQ ID NO: 3878700 - RNA, 17 nt, Human
aauggugcuuaaguucc

SEQ ID NO: 3878701 - RNA, 21 nt, Human
aaugguggcuucagcuccagc

SEQ ID NO: 3878702 - RNA, 22 nt, Human
aaugguggcuucuuuucuuugu

SEQ ID NO: 3878703 - RNA, 23 nt, Human
aauggugguuguuucuuccaaga

SEQ ID NO: 3878704 - RNA, 20 nt, Human
aauggugucaguauccaggc

SEQ ID NO: 3878705 - RNA, 14 nt, Human
aauggugugggaga

SEQ ID NO: 3878706 - RNA, 17 nt, Human
aaugguguuauuugaaa

SEQ ID NO: 3878707 - RNA, 20 nt, Human
aaugguguuuuucuuguaaa

SEQ ID NO: 3878708 - RNA, 14 nt, Human
aaugguuauaaaag

SEQ ID NO: 3878709 - RNA, 17 nt, Human
aaugguugaugauacuu

SEQ ID NO: 3878710 - RNA, 13 nt, Human
aaugguuguauua

SEQ ID NO: 3878711 - RNA, 16 nt, Human
aaugguuguauuagau

SEQ ID NO: 3878712 - RNA, 21 nt, Human
aaugguuguauuagauguucu

SEQ ID NO: 3878713 - RNA, 23 nt, Human
aaugguuguauuagauguucucu

SEQ ID NO: 3878714 - RNA, 16 nt, Human
aaugguuuaaaugguc

SEQ ID NO: 3878715 - RNA, 22 nt, Human
aaugguuuauuuuguauugugg

SEQ ID NO: 3878716 - RNA, 14 nt, Human
aaugguuugaauau

SEQ ID NO: 3878717 - RNA, 18 nt, Human
aaugguuugcaaggaagc

SEQ ID NO: 3878718 - RNA, 19 nt, Human
aaugguuugcaaggaagcc

SEQ ID NO: 3878719 - RNA, 21 nt, Human
aaugguuuggugcuuuuuaua

SEQ ID NO: 3878720 - RNA, 17 nt, Human
aaugguuuucuugugug

SEQ ID NO: 3878721 - RNA, 17 nt, Human
aaugguuuuuaaauuuu

SEQ ID NO: 3878722 - RNA, 12 nt, Human
aauguaaaaaag

SEQ ID NO: 3878723 - RNA, 23 nt, Human
aauguaaaaaggaauaugaaagu

SEQ ID NO: 3878724 - RNA, 13 nt, Human
aauguaaacauuu

SEQ ID NO: 3878725 - RNA, 15 nt, Human
aauguaaacugccau

SEQ ID NO: 3878726 - RNA, 22 nt, Human
aauguaaagcaaccaaaaagaa

SEQ ID NO: 3878727 - RNA, 14 nt, Human
aauguaaagccaug

SEQ ID NO: 3878728 - RNA, 18 nt, Human
aauguaaauauucuauau

SEQ ID NO: 3878729 - RNA, 17 nt, Human
aauguaaauauuuuaaa

SEQ ID NO: 3878730 - RNA, 22 nt, Human
aauguaaauauuuuaaagaauu

SEQ ID NO: 3878731 - RNA, 18 nt, Human
aauguaaaugucucacug

SEQ ID NO: 3878732 - RNA, 15 nt, Human
aauguaaauuuguac

SEQ ID NO: 3878733 - RNA, 16 nt, Human
aauguaaauuuguacu

SEQ ID NO: 3878734 - RNA, 17 nt, Human
aauguaaauuuguacua

SEQ ID NO: 3878735 - RNA, 18 nt, Human
aauguaaauuuguacuau

SEQ ID NO: 3878736 - RNA, 17 nt, Human
aauguaacagucugauc

SEQ ID NO: 3878737 - RNA, 20 nt, Human
aauguaacuguccguaguau

SEQ ID NO: 3878738 - RNA, 22 nt, Human
aauguaacuguuaccauuggaa

SEQ ID NO: 3878739 - RNA, 16 nt, Human
aauguaacuuuuguaa

SEQ ID NO: 3878740 - RNA, 17 nt, Human
aauguaagaaucauugu

SEQ ID NO: 3878741 - RNA, 23 nt, Human
aauguaagaaucauuguaaacau

SEQ ID NO: 3878742 - RNA, 13 nt, Human
aauguaagacaaa

SEQ ID NO: 3878743 - RNA, 19 nt, Human
aauguaagauuauagauuc

SEQ ID NO: 3878744 - RNA, 20 nt, Human
aauguaagauuauagauucu

SEQ ID NO: 3878745 - RNA, 15 nt, Human
aauguaagcuguuua

SEQ ID NO: 3878746 - RNA, 13 nt, Human
aauguaaggcugu

SEQ ID NO: 3878747 - RNA, 15 nt, Human
aauguaaggcugugu

SEQ ID NO: 3878748 - RNA, 17 nt, Human
aauguauauaaaaaugg

SEQ ID NO: 3878749 - RNA, 16 nt, Human
aauguauauacacaua

SEQ ID NO: 3878750 - RNA, 17 nt, Human
aauguauauacacauau

SEQ ID NO: 3878751 - RNA, 12 nt, Human
aauguauauauu

SEQ ID NO: 3878752 - RNA, 20 nt, Human
aauguauauauuuagugcug

SEQ ID NO: 3878753 - RNA, 16 nt, Human
aauguaucaaacugua

SEQ ID NO: 3878754 - RNA, 14 nt, Human
aauguaucaggaaa

SEQ ID NO: 3878755 - RNA, 15 nt, Human
aauguaucaggaaau

SEQ ID NO: 3878756 - RNA, 18 nt, Human
aauguaucauagaaaugu

SEQ ID NO: 3878757 - RNA, 22 nt, Human
aauguaucauagaaauguaacu

SEQ ID NO: 3878758 - RNA, 13 nt, Human
aauguaucuaaga

SEQ ID NO: 3878759 - RNA, 17 nt, Human
aauguaucuuauucaca

SEQ ID NO: 3878760 - RNA, 18 nt, Human
aauguaucuuauucacau

SEQ ID NO: 3878761 - RNA, 13 nt, Human
aauguaugcaugu

SEQ ID NO: 3878762 - RNA, 20 nt, Human
aauguaugcauucacauuua

SEQ ID NO: 3878763 - RNA, 16 nt, Human
aauguaugcuucauac

SEQ ID NO: 3878764 - RNA, 18 nt, Human
aauguaugcuucauacag

SEQ ID NO: 3878765 - RNA, 15 nt, Human
aauguauguaaauag

SEQ ID NO: 3878766 - RNA, 20 nt, Human
aauguaugugcacugucacu

SEQ ID NO: 3878767 - RNA, 21 nt, Human
aauguaugugcacugucacuu

SEQ ID NO: 3878768 - RNA, 22 nt, Human
aauguauuauguccugugagau

SEQ ID NO: 3878769 - RNA, 18 nt, Human
aauguauuauucugcagc

SEQ ID NO: 3878770 - RNA, 15 nt, Human
aauguauuguaccuu

SEQ ID NO: 3878771 - RNA, 19 nt, Human
aauguauuuguucauguuu

SEQ ID NO: 3878772 - RNA, 20 nt, Human
aauguauuuguucauguuug

SEQ ID NO: 3878773 - RNA, 17 nt, Human
aauguauuuuauuguaa

SEQ ID NO: 3878774 - RNA, 14 nt, Human
aaugucaaggugcu

SEQ ID NO: 3878775 - RNA, 23 nt, Human
aaugucacguuuuguuuugugcc

SEQ ID NO: 3878776 - RNA, 17 nt, Human
aaugucacuuaaaggcu

SEQ ID NO: 3878777 - RNA, 16 nt, Human
aaugucagauacaaug

SEQ ID NO: 3878778 - RNA, 16 nt, Human
aaugucaguauuucag

SEQ ID NO: 3878779 - RNA, 19 nt, Human
aaugucaguuguuauuuau

SEQ ID NO: 3878780 - RNA, 19 nt, Human
aaugucauugaaaaacuaa

SEQ ID NO: 3878781 - RNA, 21 nt, Human
aauguccaccaauagaaugag

SEQ ID NO: 3878782 - RNA, 20 nt, Human
aauguccaguaagaucacug

SEQ ID NO: 3878783 - RNA, 17 nt, Human
aauguccuccagaagcc

SEQ ID NO: 3878784 - RNA, 21 nt, Human
aauguccuccagaagccucug

SEQ ID NO: 3878785 - RNA, 12 nt, Human
aaugucuaaaug

SEQ ID NO: 3878786 - RNA, 17 nt, Human
aaugucuaaaugcugaa

SEQ ID NO: 3878787 - RNA, 18 nt, Human
aaugucuaaaugcugaaa

SEQ ID NO: 3878788 - RNA, 16 nt, Human
aaugucucacugagca

SEQ ID NO: 3878789 - RNA, 13 nt, Human
aaugucuggagac

SEQ ID NO: 3878790 - RNA, 17 nt, Human
aaugucuguaauaauag

SEQ ID NO: 3878791 - RNA, 18 nt, Human
aaugucuguaauaauaga

SEQ ID NO: 3878792 - RNA, 17 nt, Human
aaugucuguuaacuuaa

SEQ ID NO: 3878793 - RNA, 19 nt, Human
aaugucuugguacuugcug

SEQ ID NO: 3878794 - RNA, 18 nt, Human
aaugucuuguuaauauuc

SEQ ID NO: 3878795 - RNA, 20 nt, Human
aaugucuuguuaauauucuu

SEQ ID NO: 3878796 - RNA, 17 nt, Human
aaugucuuuaaugcaau

SEQ ID NO: 3878797 - RNA, 16 nt, Human
aaugucuuuguaaguc

SEQ ID NO: 3878798 - RNA, 13 nt, Human
aaugucuuuugaa

SEQ ID NO: 3878799 - RNA, 15 nt, Human
aaugucuuuugaaua

SEQ ID NO: 3878800 - RNA, 21 nt, Human
aaugucuuuuuuuuaaugugc

SEQ ID NO: 3878801 - RNA, 18 nt, Human
aaugugaaaaaucugcug

SEQ ID NO: 3878802 - RNA, 14 nt, Human
aaugugaaacugga

SEQ ID NO: 3878803 - RNA, 13 nt, Human
aaugugaaagcac

SEQ ID NO: 3878804 - RNA, 15 nt, Human
aaugugaacuuguag

SEQ ID NO: 3878805 - RNA, 14 nt, Human
aaugugaaguguua

SEQ ID NO: 3878806 - RNA, 20 nt, Human
aaugugaauuuuuauuguug

SEQ ID NO: 3878807 - RNA, 22 nt, Human
aaugugagugguugaauaugau

SEQ ID NO: 3878808 - RNA, 16 nt, Human
aaugugauauuauaca

SEQ ID NO: 3878809 - RNA, 19 nt, Human
aaugugaucuauguuucau

SEQ ID NO: 3878810 - RNA, 13 nt, Human
aaugugauguucu

SEQ ID NO: 3878811 - RNA, 19 nt, Human
aaugugauucuaaugucuu

SEQ ID NO: 3878812 - RNA, 13 nt, Human
aaugugcccccag

SEQ ID NO: 3878813 - RNA, 21 nt, Human
aaugugccuauugcuagagcu

SEQ ID NO: 3878814 - RNA, 19 nt, Human
aaugugcuacugauuguuu

SEQ ID NO: 3878815 - RNA, 20 nt, Human
aaugugcuguguaaaguuag

SEQ ID NO: 3878816 - RNA, 17 nt, Human
aauguggccuaaaaaug

SEQ ID NO: 3878817 - RNA, 16 nt, Human
aauguggcuugagaaa

SEQ ID NO: 3878818 - RNA, 14 nt, Human
aaugugggcagaga

SEQ ID NO: 3878819 - RNA, 17 nt, Human
aaugugguuuuccugaa

SEQ ID NO: 3878820 - RNA, 11 nt, Human
aaugugucuuu

SEQ ID NO: 3878821 - RNA, 13 nt, Human
aaugugucuuuag

SEQ ID NO: 3878822 - RNA, 17 nt, Human
aaugugucuuuagauag

SEQ ID NO: 3878823 - RNA, 20 nt, Human
aaugugugagugcauguacu

SEQ ID NO: 3878824 - RNA, 16 nt, Human
aauguguggccugcac

SEQ ID NO: 3878825 - RNA, 16 nt, Human
aaugugugguggccuc

SEQ ID NO: 3878826 - RNA, 15 nt, Human
aauguguguaugugu

SEQ ID NO: 3878827 - RNA, 16 nt, Human
aaugugugugauguga

SEQ ID NO: 3878828 - RNA, 17 nt, Human
aaugugugugguuuuuu

SEQ ID NO: 3878829 - RNA, 23 nt, Human
aauguguuggacaaaugugaaga

SEQ ID NO: 3878830 - RNA, 23 nt, Human
aauguguuguuccaaauacuaau

SEQ ID NO: 3878831 - RNA, 22 nt, Human
aauguguuuuguuuauuaaaua

SEQ ID NO: 3878832 - RNA, 13 nt, Human
aauguuaaaaugu

SEQ ID NO: 3878833 - RNA, 16 nt, Human
aauguuaaagauguag

SEQ ID NO: 3878834 - RNA, 21 nt, Human
aauguuaaagauguagcaaac

SEQ ID NO: 3878835 - RNA, 13 nt, Human
aauguuaaauaaa

SEQ ID NO: 3878836 - RNA, 15 nt, Human
aauguuaaauaaauu

SEQ ID NO: 3878837 - RNA, 21 nt, Human
aauguuaaauaaauuguauau

SEQ ID NO: 3878838 - RNA, 22 nt, Human
aauguuaaauaaauuguauauu

SEQ ID NO: 3878839 - RNA, 16 nt, Human
aauguuaaauuuguaa

SEQ ID NO: 3878840 - RNA, 14 nt, Human
aauguuaagaauug

SEQ ID NO: 3878841 - RNA, 13 nt, Human
aauguuaagcaga

SEQ ID NO: 3878842 - RNA, 13 nt, Human
aauguuaauuuuu

SEQ ID NO: 3878843 - RNA, 20 nt, Human
aauguuaauuuuuugguaca

SEQ ID NO: 3878844 - RNA, 21 nt, Human
aauguuaauuuuuugguacaa

SEQ ID NO: 3878845 - RNA, 15 nt, Human
aauguuaccucugaa

SEQ ID NO: 3878846 - RNA, 21 nt, Human
aauguuacugaucaugcauug

SEQ ID NO: 3878847 - RNA, 15 nt, Human
aauguuagagacuuu

SEQ ID NO: 3878848 - RNA, 13 nt, Human
aauguuagagcac

SEQ ID NO: 3878849 - RNA, 22 nt, Human
aauguuagagguuuuaaaguga

SEQ ID NO: 3878850 - RNA, 20 nt, Human
aauguuagaguaaugaaaug

SEQ ID NO: 3878851 - RNA, 21 nt, Human
aauguuaucuuauacuguaca

SEQ ID NO: 3878852 - RNA, 22 nt, Human
aauguuaucuuauacuguacaa

SEQ ID NO: 3878853 - RNA, 23 nt, Human
aauguuaucuucucaaguucuaa

SEQ ID NO: 3878854 - RNA, 19 nt, Human
aauguuaugacuauguaaa

SEQ ID NO: 3878855 - RNA, 14 nt, Human
aauguuauguauau

SEQ ID NO: 3878856 - RNA, 14 nt, Human
aauguuauuucccu

SEQ ID NO: 3878857 - RNA, 15 nt, Human
aauguuauuucugca

SEQ ID NO: 3878858 - RNA, 21 nt, Human
aauguuauuuguuauuuucag

SEQ ID NO: 3878859 - RNA, 21 nt, Human
aauuuauuuugucgaauuuuu

SEQ ID NO: 3878860 - RNA, 20 nt, Human
aauuuauuuuuaagaaagaa

SEQ ID NO: 3878861 - RNA, 23 nt, Human
aauuuauuuuuaccuucacugug

SEQ ID NO: 3878862 - RNA, 17 nt, Human
aauuucaaaagacaugu

SEQ ID NO: 3878863 - RNA, 13 nt, Human
aauuucaagcuua

SEQ ID NO: 3878864 - RNA, 20 nt, Human
aauuucaagcuuauuuugga

SEQ ID NO: 3878865 - RNA, 14 nt, Human
aauuucaagguucu

SEQ ID NO: 3878866 - RNA, 15 nt, Human
aauuucaagguucua

SEQ ID NO: 3878867 - RNA, 16 nt, Human
aauuucaagguucuaa

SEQ ID NO: 3878868 - RNA, 19 nt, Human
aauuucaccuguaaaccug

SEQ ID NO: 3878869 - RNA, 20 nt, Human
aauuucaccuguaaaccuga

SEQ ID NO: 3878870 - RNA, 21 nt, Human
aauuucacgucauaggaaguu

SEQ ID NO: 3878871 - RNA, 23 nt, Human
aauuucacugucuuuaauucugu

SEQ ID NO: 3878872 - RNA, 21 nt, Human
aauuucaggaggaauacugaa

SEQ ID NO: 3878873 - RNA, 22 nt, Human
aauuucagguuuuguaaagaug

SEQ ID NO: 3878874 - RNA, 20 nt, Human
aauuucauagcuguacuucu

SEQ ID NO: 3878875 - RNA, 21 nt, Human
aauuucauagcuguacuucuu

SEQ ID NO: 3878876 - RNA, 15 nt, Human
aauuucauaucuaca

SEQ ID NO: 3878877 - RNA, 16 nt, Human
aauuucauguaaaaca

SEQ ID NO: 3878878 - RNA, 17 nt, Human
aauuuccaguaccuuug

SEQ ID NO: 3878879 - RNA, 21 nt, Human
aauuuccauuuacuuaagacu

SEQ ID NO: 3878880 - RNA, 19 nt, Human
aauuucccaauuaggaagu

SEQ ID NO: 3878881 - RNA, 13 nt, Human
aauuucccacccc

SEQ ID NO: 3878882 - RNA, 16 nt, Human
aauuucccaggacccu

SEQ ID NO: 3878883 - RNA, 17 nt, Human
aauuuccccaacagugu

SEQ ID NO: 3878884 - RNA, 18 nt, Human
aauuuccccaacagugug

SEQ ID NO: 3878885 - RNA, 19 nt, Human
aauuuccccaacaguguga

SEQ ID NO: 3878886 - RNA, 12 nt, Human
aauuuccuggga

SEQ ID NO: 3878887 - RNA, 17 nt, Human
aauuuccugggagcuuu

SEQ ID NO: 3878888 - RNA, 18 nt, Human
aauuuccugggagcuuuu

SEQ ID NO: 3878889 - RNA, 15 nt, Human
aauuuccuuuuugac

SEQ ID NO: 3878890 - RNA, 18 nt, Human
aauuuccuuuuugacacu

SEQ ID NO: 3878891 - RNA, 20 nt, Human
aauuuccuuuuugacacuga

SEQ ID NO: 3878892 - RNA, 21 nt, Human
aauuuccuuuuugacacugaa

SEQ ID NO: 3878893 - RNA, 22 nt, Human
aauuuccuuuuugacacugaaa

SEQ ID NO: 3878894 - RNA, 19 nt, Human
aauuucgcuucuuagaaca

SEQ ID NO: 3878895 - RNA, 22 nt, Human
aauuucuaaaaaacagaggcca

SEQ ID NO: 3878896 - RNA, 17 nt, Human
aauuucuaaaaagauua

SEQ ID NO: 3878897 - RNA, 13 nt, Human
aauuucuaaaucu

SEQ ID NO: 3878898 - RNA, 18 nt, Human
aauuucuaggacugaauu

SEQ ID NO: 3878899 - RNA, 23 nt, Human
aauuucuaggacugaauuaugaa

SEQ ID NO: 3878900 - RNA, 19 nt, Human
aauuucucccagucauuua

SEQ ID NO: 3878901 - RNA, 12 nt, Human
aauuucucccca

SEQ ID NO: 3878902 - RNA, 12 nt, Human
aauuucuccucc

SEQ ID NO: 3878903 - RNA, 23 nt, Human
aauuucucuuaaguacugaaaua

SEQ ID NO: 3878904 - RNA, 14 nt, Human
aauuucugccauuu

SEQ ID NO: 3878905 - RNA, 16 nt, Human
aauuucugucagaaug

SEQ ID NO: 3878906 - RNA, 12 nt, Human
aauuucugugcc

SEQ ID NO: 3878907 - RNA, 12 nt, Human
aauuucuuaacu

SEQ ID NO: 3878908 - RNA, 20 nt, Human
aauuucuuaacuucuugcuu

SEQ ID NO: 3878909 - RNA, 14 nt, Human
aauuucuuauguga

SEQ ID NO: 3878910 - RNA, 16 nt, Human
aauuucuuaugugaca

SEQ ID NO: 3878911 - RNA, 14 nt, Human
aauuucuucaaaau

SEQ ID NO: 3878912 - RNA, 20 nt, Human
aauuucuucacuguugaaaa

SEQ ID NO: 3878913 - RNA, 21 nt, Human
aauuucuucacuguugaaaau

SEQ ID NO: 3878914 - RNA, 24 nt, Human
aauuucuugcucuaucucucaaaa

SEQ ID NO: 3878915 - RNA, 15 nt, Human
aauuucuuugccugu

SEQ ID NO: 3878916 - RNA, 18 nt, Human
aauuucuuuuuucuuuuu

SEQ ID NO: 3878917 - RNA, 23 nt, Human
aauuugaaaacauaaucugcaaa

SEQ ID NO: 3878918 - RNA, 19 nt, Human
aauuugaaaauaauuguuc

SEQ ID NO: 3878919 - RNA, 20 nt, Human
aauuugaaacacuuugcaua

SEQ ID NO: 3878920 - RNA, 14 nt, Human
aauuugaaacauug

SEQ ID NO: 3878921 - RNA, 17 nt, Human
aauuugaaccaaaacau

SEQ ID NO: 3878922 - RNA, 18 nt, Human
aauuugaagacuucaaaa

SEQ ID NO: 3878923 - RNA, 13 nt, Human
aauuugaauuuug

SEQ ID NO: 3878924 - RNA, 16 nt, Human
aauuugaauuuugugu

SEQ ID NO: 3878925 - RNA, 18 nt, Human
aauuugaauuuuguguua

SEQ ID NO: 3878926 - RNA, 20 nt, Human
aauuugagagaaauaugaag

SEQ ID NO: 3878927 - RNA, 15 nt, Human
aauuugauacauaau

SEQ ID NO: 3878928 - RNA, 20 nt, Human
aauuugauacauaugugaau

SEQ ID NO: 3878929 - RNA, 15 nt, Human
aauuugauacuuaua

SEQ ID NO: 3878930 - RNA, 21 nt, Human
aauuugauaguauugugcaua

SEQ ID NO: 3878931 - RNA, 15 nt, Human
aauuugauaugugaa

SEQ ID NO: 3878932 - RNA, 18 nt, Human
aauuugaucguuccaguu

SEQ ID NO: 3878933 - RNA, 16 nt, Human
aauuugaugaaagcug

SEQ ID NO: 3878934 - RNA, 17 nt, Human
aauuugaugaaagcuga

SEQ ID NO: 3878935 - RNA, 12 nt, Human
aauuugaugugg

SEQ ID NO: 3878936 - RNA, 13 nt, Human
aauuugauuaaca

SEQ ID NO: 3878937 - RNA, 20 nt, Human
aauuugauugacugcccauu

SEQ ID NO: 3878938 - RNA, 11 nt, Human
aauuugcaaag

SEQ ID NO: 3878939 - RNA, 12 nt, Human
aauuugcaaagu

SEQ ID NO: 3878940 - RNA, 13 nt, Human
aauuugcaaagua

SEQ ID NO: 3878941 - RNA, 14 nt, Human
aauuugcaaaguac

SEQ ID NO: 3878942 - RNA, 12 nt, Human
aauuugcacauu

SEQ ID NO: 3878943 - RNA, 14 nt, Human
aauuugcacauuaa

SEQ ID NO: 3878944 - RNA, 15 nt, Human
aauuugcccucccau

SEQ ID NO: 3878945 - RNA, 23 nt, Human
aauuugccuaauaugaugacugu

SEQ ID NO: 3878946 - RNA, 16 nt, Human
aauuugccuguaacaa

SEQ ID NO: 3878947 - RNA, 14 nt, Human
aauuugcugccaaa

SEQ ID NO: 3878948 - RNA, 9 nt, Human
aauuuggaa

SEQ ID NO: 3878949 - RNA, 14 nt, Human
aauuuggaaacuaa

SEQ ID NO: 3878950 - RNA, 22 nt, Human
aauuuggaaacuaauaaaauau

SEQ ID NO: 3878951 - RNA, 11 nt, Human
aauuuggaauu

SEQ ID NO: 3878952 - RNA, 19 nt, Human
aauuuggaccauuuuccug

SEQ ID NO: 3878953 - RNA, 20 nt, Human
aauuuggagcacaaaauuca

SEQ ID NO: 3878954 - RNA, 22 nt, Human
aauuuggaggcuggaguaauca

SEQ ID NO: 3878955 - RNA, 13 nt, Human
aauuuggcaauuu

SEQ ID NO: 3878956 - RNA, 16 nt, Human
aauuugggcuuccugu

SEQ ID NO: 3878957 - RNA, 20 nt, Human
aauuugggcuuccuguuugu

SEQ ID NO: 3878958 - RNA, 18 nt, Human
aauuugggggaaaauuua

SEQ ID NO: 3878959 - RNA, 13 nt, Human
aauuugguuuuca

SEQ ID NO: 3878960 - RNA, 15 nt, Human
aauuugguuuucaca

SEQ ID NO: 3878961 - RNA, 16 nt, Human
aauuuguaaccucagc

SEQ ID NO: 3878962 - RNA, 15 nt, Human
aauuuguaaguuuau

SEQ ID NO: 3878963 - RNA, 14 nt, Human
aauuuguaaguuuc

SEQ ID NO: 3878964 - RNA, 19 nt, Human
aauuuguaaguuucaggug

SEQ ID NO: 3878965 - RNA, 14 nt, Human
aauuuguauaaaau

SEQ ID NO: 3878966 - RNA, 15 nt, Human
aauuuguauaaaaug

SEQ ID NO: 3878967 - RNA, 18 nt, Human
aauuuguaucugaaggag

SEQ ID NO: 3878968 - RNA, 19 nt, Human
aauuuguaucugaaggaga

SEQ ID NO: 3878969 - RNA, 16 nt, Human
aauuugucauuuugaa

SEQ ID NO: 3878970 - RNA, 19 nt, Human
aauuugucauuuugaagcu

SEQ ID NO: 3878971 - RNA, 14 nt, Human
aauuugugauacaa

SEQ ID NO: 3878972 - RNA, 13 nt, Human
aauuuguguaaua

SEQ ID NO: 3878973 - RNA, 16 nt, Human
aauuuguguaauaaag

SEQ ID NO: 3878974 - RNA, 17 nt, Human
aauuuguguaauaaagu

SEQ ID NO: 3878975 - RNA, 23 nt, Human
aauuuguguguuuuuagcuguga

SEQ ID NO: 3878976 - RNA, 21 nt, Human
aauuuguucuuguauuuauug

SEQ ID NO: 3878977 - RNA, 21 nt, Human
aauuuguuggggcuuuacaua

SEQ ID NO: 3878978 - RNA, 17 nt, Human
aauuuguuugaaaucuu

SEQ ID NO: 3878979 - RNA, 14 nt, Human
aauuuguuugugcu

SEQ ID NO: 3878980 - RNA, 17 nt, Human
aauuuguuuuggauaua

SEQ ID NO: 3878981 - RNA, 14 nt, Human
aauuuuaaaaauga

SEQ ID NO: 3878982 - RNA, 22 nt, Human
aauuuuaaaaucugagggaaau

SEQ ID NO: 3878983 - RNA, 17 nt, Human
aauuuuaaacaaagguu

SEQ ID NO: 3878984 - RNA, 13 nt, Human
aauuuuaaacaua

SEQ ID NO: 3878985 - RNA, 13 nt, Human
aauuuuaaaguau

SEQ ID NO: 3878986 - RNA, 16 nt, Human
aauuuuaaaguaugca

SEQ ID NO: 3878987 - RNA, 13 nt, Human
aauuuuaaagugc

SEQ ID NO: 3878988 - RNA, 22 nt, Human
aauuuuaaauaaaagugaucaa

SEQ ID NO: 3878989 - RNA, 12 nt, Human
aauuuuaaauua

SEQ ID NO: 3878990 - RNA, 14 nt, Human
aauuuuaacacaca

SEQ ID NO: 3878991 - RNA, 23 nt, Human
aauuuuaagcuaggaaaagaaau

SEQ ID NO: 3878992 - RNA, 22 nt, Human
aauuuuaagguagaaccucacc

SEQ ID NO: 3878993 - RNA, 19 nt, Human
aauuuuaagugcuuuguaa

SEQ ID NO: 3878994 - RNA, 22 nt, Human
aauuuuaagugcuuuguaaugg

SEQ ID NO: 3878995 - RNA, 16 nt, Human
aauuuuaauauuuuau

SEQ ID NO: 3878996 - RNA, 21 nt, Human
aauuuuacccuuuagacugua

SEQ ID NO: 3878997 - RNA, 15 nt, Human
aauuuuagaaauauu

SEQ ID NO: 3878998 - RNA, 14 nt, Human
aauuuuagcuuuug

SEQ ID NO: 3878999 - RNA, 21 nt, Human
aauuuuaggaacuucagagau

SEQ ID NO: 3879000 - RNA, 19 nt, Human
aauuuuaguagagacaggg

SEQ ID NO: 3879001 - RNA, 18 nt, Human
aauuuuaguuuuucauua

SEQ ID NO: 3879002 - RNA, 21 nt, Human
aauuuuauaaggacuuccuga

SEQ ID NO: 3879003 - RNA, 20 nt, Human
aauuuuauagcucaguuuau

SEQ ID NO: 3879004 - RNA, 15 nt, Human
aauuuuauaucuugu

SEQ ID NO: 3879005 - RNA, 14 nt, Human
aauuuuaucccuca

SEQ ID NO: 3879006 - RNA, 19 nt, Human
aauuuuaucuguuuccuga

SEQ ID NO: 3879007 - RNA, 12 nt, Human
aauuuuaugaac

SEQ ID NO: 3879008 - RNA, 22 nt, Human
aauuuuauuuuaaaauuucaua

SEQ ID NO: 3879009 - RNA, 16 nt, Human
acaaaauauugaaagg

SEQ ID NO: 3879010 - RNA, 19 nt, Human
acaaaaucgauuggcuuua

SEQ ID NO: 3879011 - RNA, 17 nt, Human
acaaaaucuguugccac

SEQ ID NO: 3879012 - RNA, 13 nt, Human
acaaaauggaaua

SEQ ID NO: 3879013 - RNA, 14 nt, Human
acaaaauggaauac

SEQ ID NO: 3879014 - RNA, 20 nt, Human
acaaaauggaauacucuuau

SEQ ID NO: 3879015 - RNA, 16 nt, Human
acaaaauggcuucagu

SEQ ID NO: 3879016 - RNA, 14 nt, Human
acaaaauguaacug

SEQ ID NO: 3879017 - RNA, 16 nt, Human
acaaaauguagaauau

SEQ ID NO: 3879018 - RNA, 19 nt, Human
acaaaauguagaauauuca

SEQ ID NO: 3879019 - RNA, 23 nt, Human
acaaaauguagaauauucagaca

SEQ ID NO: 3879020 - RNA, 12 nt, Human
acaaaauguuau

SEQ ID NO: 3879021 - RNA, 14 nt, Human
acaaaauuauuugu

SEQ ID NO: 3879022 - RNA, 13 nt, Human
acaaaauucaaag

SEQ ID NO: 3879023 - RNA, 18 nt, Human
acaaaauucaaagcaugg

SEQ ID NO: 3879024 - RNA, 20 nt, Human
acaaaauucgaccugauuua

SEQ ID NO: 3879025 - RNA, 16 nt, Human
acaaaauucuuucugg

SEQ ID NO: 3879026 - RNA, 15 nt, Human
acaaaauuuaguuuu

SEQ ID NO: 3879027 - RNA, 20 nt, Human
acaaaauuuaguuuuuguuc

SEQ ID NO: 3879028 - RNA, 15 nt, Human
acaaaauuuuauuuu

SEQ ID NO: 3879029 - RNA, 11 nt, Human
acaaacaaaag

SEQ ID NO: 3879030 - RNA, 16 nt, Human
acaaacaaacaaacaa

SEQ ID NO: 3879031 - RNA, 13 nt, Human
acaaacaaacaag

SEQ ID NO: 3879032 - RNA, 13 nt, Human
acaaacaaugaaa

SEQ ID NO: 3879033 - RNA, 17 nt, Human
acaaacacauuguuauu

SEQ ID NO: 3879034 - RNA, 19 nt, Human
acaaacacauuguuauuuu

SEQ ID NO: 3879035 - RNA, 15 nt, Human
acaaacaccucccag

SEQ ID NO: 3879036 - RNA, 21 nt, Human
acaaacaccuucuuauuauau

SEQ ID NO: 3879037 - RNA, 20 nt, Human
acaaacagggcugccuucug

SEQ ID NO: 3879038 - RNA, 14 nt, Human
acaaacaugacccu

SEQ ID NO: 3879039 - RNA, 12 nt, Human
acaaacauugug

SEQ ID NO: 3879040 - RNA, 13 nt, Human
acaaacauugugu

SEQ ID NO: 3879041 - RNA, 12 nt, Human
acaaacauuuuu

SEQ ID NO: 3879042 - RNA, 14 nt, Human
acaaacauuuuuca

SEQ ID NO: 3879043 - RNA, 17 nt, Human
acaaacauuuuucaaca

SEQ ID NO: 3879044 - RNA, 20 nt, Human
acaaaccacaacugacacag

SEQ ID NO: 3879045 - RNA, 14 nt, Human
acaaaccagaagca

SEQ ID NO: 3879046 - RNA, 18 nt, Human
acaaaccuaccaaaaugg

SEQ ID NO: 3879047 - RNA, 21 nt, Human
acaaaccuaccaaaauggaau

SEQ ID NO: 3879048 - RNA, 23 nt, Human
acaaaccugaaaagauguugugu

SEQ ID NO: 3879049 - RNA, 21 nt, Human
acaaacguauguaaauguaua

SEQ ID NO: 3879050 - RNA, 21 nt, Human
acaaacuacagaccugcuuuu

SEQ ID NO: 3879051 - RNA, 16 nt, Human
acaaacuacauguaau

SEQ ID NO: 3879052 - RNA, 22 nt, Human
acaaacuauuucuuauauaugu

SEQ ID NO: 3879053 - RNA, 20 nt, Human
acaaacucguuuuuuacaaa

SEQ ID NO: 3879054 - RNA, 11 nt, Human
acaaacugcaa

SEQ ID NO: 3879055 - RNA, 14 nt, Human
acaaacugcaauag

SEQ ID NO: 3879056 - RNA, 20 nt, Human
acaaacugcaauagagacug

SEQ ID NO: 3879057 - RNA, 14 nt, Human
acaaacugcacaug

SEQ ID NO: 3879058 - RNA, 19 nt, Human
acaaacugcacaugauuuc

SEQ ID NO: 3879059 - RNA, 20 nt, Human
acaaacugcacaugauuuca

SEQ ID NO: 3879060 - RNA, 15 nt, Human
acaaacugcuuccuu

SEQ ID NO: 3879061 - RNA, 17 nt, Human
acaaacugguauucugu

SEQ ID NO: 3879062 - RNA, 18 nt, Human
acaaacuguaaaaaaugu

SEQ ID NO: 3879063 - RNA, 19 nt, Human
acaaacuguaauacaauga

SEQ ID NO: 3879064 - RNA, 16 nt, Human
acaaacuguguaacug

SEQ ID NO: 3879065 - RNA, 16 nt, Human
acaaacuguguacaua

SEQ ID NO: 3879066 - RNA, 18 nt, Human
acaaacuuuucaaggcuu

SEQ ID NO: 3879067 - RNA, 20 nt, Human
acaaagaaacaaagauguua

SEQ ID NO: 3879068 - RNA, 21 nt, Human
acaaagaaauccggagaagcu

SEQ ID NO: 3879069 - RNA, 14 nt, Human
acaaagaaauuaug

SEQ ID NO: 3879070 - RNA, 16 nt, Human
acaaagaaauuaugug

SEQ ID NO: 3879071 - RNA, 18 nt, Human
acaaagaagacaacauua

SEQ ID NO: 3879072 - RNA, 22 nt, Human
acaaagaagacauguuuuagac

SEQ ID NO: 3879073 - RNA, 18 nt, Human
acaaagacaaauucuguu

SEQ ID NO: 3879074 - RNA, 22 nt, Human
acaaagacaaauucuguuucuu

SEQ ID NO: 3879075 - RNA, 15 nt, Human
acaaagacccuggcu

SEQ ID NO: 3879076 - RNA, 20 nt, Human
acaaagagcguugaaguuga

SEQ ID NO: 3879077 - RNA, 18 nt, Human
acaaagaguucaagaaau

SEQ ID NO: 3879078 - RNA, 21 nt, Human
acaaagauaucuuuucuuuag

SEQ ID NO: 3879079 - RNA, 21 nt, Human
acaaagaugggugaaggcugg

SEQ ID NO: 3879080 - RNA, 21 nt, Human
acaaagauguuugucagauau

SEQ ID NO: 3879081 - RNA, 24 nt, Human
acaaagauguuugucagauaugau

SEQ ID NO: 3879082 - RNA, 16 nt, Human
acaaagcacaguuuga

SEQ ID NO: 3879083 - RNA, 19 nt, Human
acaaagcacaguuugaaca

SEQ ID NO: 3879084 - RNA, 23 nt, Human
acaaagcacuagagaaugcacag

SEQ ID NO: 3879085 - RNA, 13 nt, Human
acaaagcagccac

SEQ ID NO: 3879086 - RNA, 18 nt, Human
acaaagccacuuucaauc

SEQ ID NO: 3879087 - RNA, 16 nt, Human
acaaagccagaagcug

SEQ ID NO: 3879088 - RNA, 20 nt, Human
acaaagccagaagcugagca

SEQ ID NO: 3879089 - RNA, 13 nt, Human
acaaagcccaagg

SEQ ID NO: 3879090 - RNA, 15 nt, Human
acaaagcgugcacaa

SEQ ID NO: 3879091 - RNA, 21 nt, Human
acaaagcgugguggacaugca

SEQ ID NO: 3879092 - RNA, 13 nt, Human
acaaagcuguuaa

SEQ ID NO: 3879093 - RNA, 21 nt, Human
acaaagcuucuaucccaggag

SEQ ID NO: 3879094 - RNA, 22 nt, Human
acaaagcuucuaucccaggagg

SEQ ID NO: 3879095 - RNA, 23 nt, Human
acaaagcuuggaagagccugcag

SEQ ID NO: 3879096 - RNA, 13 nt, Human
acaaaggaaaaag

SEQ ID NO: 3879097 - RNA, 19 nt, Human
acaaaggaagugcccccuc

SEQ ID NO: 3879098 - RNA, 14 nt, Human
acaaaggagccugu

SEQ ID NO: 3879099 - RNA, 21 nt, Human
acaaaggauacuuauuuaaau

SEQ ID NO: 3879100 - RNA, 20 nt, Human
acaaaggauuaauugcugca

SEQ ID NO: 3879101 - RNA, 19 nt, Human
acaaaggcaaguuaagaga

SEQ ID NO: 3879102 - RNA, 15 nt, Human
acaaaggccaaacug

SEQ ID NO: 3879103 - RNA, 20 nt, Human
acaaaggcuguauucagcaa

SEQ ID NO: 3879104 - RNA, 14 nt, Human
acaaagggcccaga

SEQ ID NO: 3879105 - RNA, 15 nt, Human
acaaaggggaaagaa

SEQ ID NO: 3879106 - RNA, 19 nt, Human
acaaaggggaucauaaagu

SEQ ID NO: 3879107 - RNA, 17 nt, Human
acaaaggguuuuaaugu

SEQ ID NO: 3879108 - RNA, 24 nt, Human
acaaagguugagauguaaaaggua

SEQ ID NO: 3879109 - RNA, 15 nt, Human
acaaagguuuaaaug

SEQ ID NO: 3879110 - RNA, 20 nt, Human
acaaagguuuaaaugaacaa

SEQ ID NO: 3879111 - RNA, 21 nt, Human
acaaagguuuuccucuucuau

SEQ ID NO: 3879112 - RNA, 20 nt, Human
acaaaguauuaagcauauau

SEQ ID NO: 3879113 - RNA, 15 nt, Human
acaaagucuccagcc

SEQ ID NO: 3879114 - RNA, 18 nt, Human
acaaagugagacagucca

SEQ ID NO: 3879115 - RNA, 17 nt, Human
acaaagugccaaagaaa

SEQ ID NO: 3879116 - RNA, 18 nt, Human
acaaaguggaaggaaaga

SEQ ID NO: 3879117 - RNA, 19 nt, Human
acaaaguggaaggaaagau

SEQ ID NO: 3879118 - RNA, 23 nt, Human
acaaaguguauuuuauaaaauua

SEQ ID NO: 3879119 - RNA, 23 nt, Human
acaaaguuacuagguaacuucau

SEQ ID NO: 3879120 - RNA, 19 nt, Human
acaaaguuccaaaaugcca

SEQ ID NO: 3879121 - RNA, 19 nt, Human
acaaaguuucagaguauau

SEQ ID NO: 3879122 - RNA, 22 nt, Human
acaaauaacaacuuuuuuuucu

SEQ ID NO: 3879123 - RNA, 16 nt, Human
acaaauaauaagcaaa

SEQ ID NO: 3879124 - RNA, 13 nt, Human
acaaauaauuuag

SEQ ID NO: 3879125 - RNA, 15 nt, Human
acaaauaauuuuagu

SEQ ID NO: 3879126 - RNA, 13 nt, Human
acaaauacucaug

SEQ ID NO: 3879127 - RNA, 14 nt, Human
acaaauacucaugu

SEQ ID NO: 3879128 - RNA, 15 nt, Human
acaaauacucaugug

SEQ ID NO: 3879129 - RNA, 18 nt, Human
acaaauacucauguguau

SEQ ID NO: 3879130 - RNA, 17 nt, Human
acaaauacucuuaggaa

SEQ ID NO: 3879131 - RNA, 21 nt, Human
acaaauagucggauuagaaau

SEQ ID NO: 3879132 - RNA, 14 nt, Human
acaaauauaagaau

SEQ ID NO: 3879133 - RNA, 15 nt, Human
acaaauauaagaaua

SEQ ID NO: 3879134 - RNA, 21 nt, Human
acaaauaucuuguguuguccu

SEQ ID NO: 3879135 - RNA, 22 nt, Human
acaaauaucuuguguuguccuu

SEQ ID NO: 3879136 - RNA, 12 nt, Human
acaaauaugcaa

SEQ ID NO: 3879137 - RNA, 21 nt, Human
acaaauauuauuuguguuucc

SEQ ID NO: 3879138 - RNA, 19 nt, Human
acaaauauucacuggcccc

SEQ ID NO: 3879139 - RNA, 13 nt, Human
acaaauauucaga

SEQ ID NO: 3879140 - RNA, 14 nt, Human
acaaauauucagaa

SEQ ID NO: 3879141 - RNA, 18 nt, Human
acaaauauuuauuuucuu

SEQ ID NO: 3879142 - RNA, 16 nt, Human
acaaaucaacagaagc

SEQ ID NO: 3879143 - RNA, 12 nt, Human
acaaaucaaguu

SEQ ID NO: 3879144 - RNA, 19 nt, Human
acaaaucaaguuuccaagc

SEQ ID NO: 3879145 - RNA, 22 nt, Human
acaaaucaaguuuccaagcaaa

SEQ ID NO: 3879146 - RNA, 17 nt, Human
acaaaucaguuaguuuu

SEQ ID NO: 3879147 - RNA, 19 nt, Human
acaaaucuaagggaaaaag

SEQ ID NO: 3879148 - RNA, 22 nt, Human
acaaaucuaggaaaauauuuug

SEQ ID NO: 3879149 - RNA, 15 nt, Human
acaaaucuaugccac

SEQ ID NO: 3879150 - RNA, 21 nt, Human
acaaaucuaugccacucagaa

SEQ ID NO: 3879151 - RNA, 21 nt, Human
acaaaucucaagcaaacagcu

SEQ ID NO: 3879152 - RNA, 16 nt, Human
acaaaugacuuuauua

SEQ ID NO: 3879153 - RNA, 23 nt, Human
acaaaugacuuuauuauuuauuu

SEQ ID NO: 3879154 - RNA, 18 nt, Human
acaaaugcaucuuugaug

SEQ ID NO: 3879155 - RNA, 17 nt, Human
acaaaugcucaaagaaa

SEQ ID NO: 3879156 - RNA, 22 nt, Human
acaaaugcugcgcccuucccca

SEQ ID NO: 3879157 - RNA, 16 nt, Human
acaaauggaggccugu

SEQ ID NO: 3879158 - RNA, 18 nt, Human
acagauaagcaagagaga

SEQ ID NO: 3879159 - RNA, 19 nt, Human
acagauaagcaagagagau

SEQ ID NO: 3879160 - RNA, 21 nt, Human
acagauaagcaagagagaugu

SEQ ID NO: 3879161 - RNA, 22 nt, Human
acagauaauaauggguuucuuu

SEQ ID NO: 3879162 - RNA, 15 nt, Human
acagauacacacaca

SEQ ID NO: 3879163 - RNA, 13 nt, Human
acagauacauuuc

SEQ ID NO: 3879164 - RNA, 12 nt, Human
acagauaccaua

SEQ ID NO: 3879165 - RNA, 14 nt, Human
acagauagagaguu

SEQ ID NO: 3879166 - RNA, 19 nt, Human
acagauaggccuucuugug

SEQ ID NO: 3879167 - RNA, 17 nt, Human
acagauauaaauggcug

SEQ ID NO: 3879168 - RNA, 14 nt, Human
acagaucaagcugu

SEQ ID NO: 3879169 - RNA, 12 nt, Human
acagaucaguaa

SEQ ID NO: 3879170 - RNA, 12 nt, Human
acagaucuggaa

SEQ ID NO: 3879171 - RNA, 14 nt, Human
acagaucuggaacc

SEQ ID NO: 3879172 - RNA, 20 nt, Human
acagaucuggaaccucagcc

SEQ ID NO: 3879173 - RNA, 12 nt, Human
acagaugaaaag

SEQ ID NO: 3879174 - RNA, 12 nt, Human
acagaugaaaau

SEQ ID NO: 3879175 - RNA, 15 nt, Human
acagaugaaaauuug

SEQ ID NO: 3879176 - RNA, 16 nt, Human
acagaugcaaugugcu

SEQ ID NO: 3879177 - RNA, 16 nt, Human
acagaugccccagagc

SEQ ID NO: 3879178 - RNA, 19 nt, Human
acagaugccccagagcugu

SEQ ID NO: 3879179 - RNA, 22 nt, Human
acagaugccccagagcuguuua

SEQ ID NO: 3879180 - RNA, 17 nt, Human
acagaugccuccuuccu

SEQ ID NO: 3879181 - RNA, 22 nt, Human
acagaugccuccuuccucuuuu

SEQ ID NO: 3879182 - RNA, 18 nt, Human
acagaugccuuuuuugua

SEQ ID NO: 3879183 - RNA, 14 nt, Human
acagaugcuccagg

SEQ ID NO: 3879184 - RNA, 14 nt, Human
acagaugcuuuucu

SEQ ID NO: 3879185 - RNA, 21 nt, Human
acagauggaaaaacugaggcu

SEQ ID NO: 3879186 - RNA, 23 nt, Human
acagaugggugcuuggaggaagg

SEQ ID NO: 3879187 - RNA, 19 nt, Human
acagauguucccccaucuc

SEQ ID NO: 3879188 - RNA, 23 nt, Human
acagauguuucuuuuguauguaa

SEQ ID NO: 3879189 - RNA, 24 nt, Human
acagauguuucuuuuguauguaaa

SEQ ID NO: 3879190 - RNA, 15 nt, Human
acagauucacacugu

SEQ ID NO: 3879191 - RNA, 19 nt, Human
acagauucagucuugccuu

SEQ ID NO: 3879192 - RNA, 13 nt, Human
acagauucuuuau

SEQ ID NO: 3879193 - RNA, 17 nt, Human
acagauugcugcuucug

SEQ ID NO: 3879194 - RNA, 21 nt, Human
acagauuggauuuuauguuga

SEQ ID NO: 3879195 - RNA, 14 nt, Human
acagauuguuucua

SEQ ID NO: 3879196 - RNA, 17 nt, Human
acagauuuauuccuuug

SEQ ID NO: 3879197 - RNA, 15 nt, Human
acagauuucauaccu

SEQ ID NO: 3879198 - RNA, 16 nt, Human
acagauuucauaccuc

SEQ ID NO: 3879199 - RNA, 22 nt, Human
acagauuugagcucagcccugg

SEQ ID NO: 3879200 - RNA, 21 nt, Human
acagauuuggaaagacuggac

SEQ ID NO: 3879201 - RNA, 19 nt, Human
acagauuuuaauugucaug

SEQ ID NO: 3879202 - RNA, 22 nt, Human
acagauuuugggguuguguugu

SEQ ID NO: 3879203 - RNA, 15 nt, Human
acagauuuuuacaaa

SEQ ID NO: 3879204 - RNA, 16 nt, Human
acagauuuuuacaaau

SEQ ID NO: 3879205 - RNA, 21 nt, Human
acagcaaaaccauugcuucac

SEQ ID NO: 3879206 - RNA, 18 nt, Human
acaucucugaaagcacag

SEQ ID NO: 3879207 - RNA, 16 nt, Human
acaucucugacuuucu

SEQ ID NO: 3879208 - RNA, 23 nt, Human
acaucucuuugaauuuucugugu

SEQ ID NO: 3879209 - RNA, 13 nt, Human
acaucugaaagcc

SEQ ID NO: 3879210 - RNA, 21 nt, Human
acaucugagguuuuauuucau

SEQ ID NO: 3879211 - RNA, 23 nt, Human
acaucugagguuuuauuucauuu

SEQ ID NO: 3879212 - RNA, 11 nt, Human
acaucugccuu

SEQ ID NO: 3879213 - RNA, 21 nt, Human
acaucuggcuuauuuuaaugu

SEQ ID NO: 3879214 - RNA, 19 nt, Human
acaucuguaaaucuacaca

SEQ ID NO: 3879215 - RNA, 14 nt, Human
acaucuuaguauuu

SEQ ID NO: 3879216 - RNA, 20 nt, Human
acaucuugaauacucugccc

SEQ ID NO: 3879217 - RNA, 14 nt, Human
acaucuugaauccu

SEQ ID NO: 3879218 - RNA, 19 nt, Human
acaucuugaauccuuccau

SEQ ID NO: 3879219 - RNA, 20 nt, Human
acaucuugaucugcucagcc

SEQ ID NO: 3879220 - RNA, 22 nt, Human
acaucuugaucugcucagcccu

SEQ ID NO: 3879221 - RNA, 18 nt, Human
acaucuugcucugcugac

SEQ ID NO: 3879222 - RNA, 22 nt, Human
acaucuugcucugcugacagac

SEQ ID NO: 3879223 - RNA, 17 nt, Human
acaucuuuaucuguucu

SEQ ID NO: 3879224 - RNA, 12 nt, Human
acaucuuucaca

SEQ ID NO: 3879225 - RNA, 14 nt, Human
acaucuuucacacu

SEQ ID NO: 3879226 - RNA, 13 nt, Human
acaucuuucacau

SEQ ID NO: 3879227 - RNA, 23 nt, Human
acaucuuugaaauuauguaaauu

SEQ ID NO: 3879228 - RNA, 17 nt, Human
acaugaaaacacauuuu

SEQ ID NO: 3879229 - RNA, 19 nt, Human
acaugaaaacacauuuuuc

SEQ ID NO: 3879230 - RNA, 18 nt, Human
acaugaaaauuuuaaaaa

SEQ ID NO: 3879231 - RNA, 13 nt, Human
acaugaaacagaa

SEQ ID NO: 3879232 - RNA, 20 nt, Human
acaugaaaccuacacacugu

SEQ ID NO: 3879233 - RNA, 12 nt, Human
acaugaaaugau

SEQ ID NO: 3879234 - RNA, 19 nt, Human
acaugaacacccuuagaaa

SEQ ID NO: 3879235 - RNA, 18 nt, Human
acaugaagaauagaaaca

SEQ ID NO: 3879236 - RNA, 21 nt, Human
acaugaagaccuuuuucugca

SEQ ID NO: 3879237 - RNA, 22 nt, Human
acaugaagauucuuucccaauu

SEQ ID NO: 3879238 - RNA, 15 nt, Human
acaugaagcuucaug

SEQ ID NO: 3879239 - RNA, 16 nt, Human
acaugaagguaaauaa

SEQ ID NO: 3879240 - RNA, 16 nt, Human
acaugaaguccaagca

SEQ ID NO: 3879241 - RNA, 21 nt, Human
acaugaaguguguuuccuuca

SEQ ID NO: 3879242 - RNA, 21 nt, Human
acaugaaucaaaagugccuca

SEQ ID NO: 3879243 - RNA, 18 nt, Human
acaugaauuuuagcuuuu

SEQ ID NO: 3879244 - RNA, 11 nt, Human
acaugacacug

SEQ ID NO: 3879245 - RNA, 12 nt, Human
acaugacacuga

SEQ ID NO: 3879246 - RNA, 19 nt, Human
acaugacacugaaaugccu

SEQ ID NO: 3879247 - RNA, 23 nt, Human
acaugacacugaaaugccuuacu

SEQ ID NO: 3879248 - RNA, 18 nt, Human
acaugacuccauagaccu

SEQ ID NO: 3879249 - RNA, 20 nt, Human
acaugacuccauagaccuuu

SEQ ID NO: 3879250 - RNA, 21 nt, Human
acaugacucuuuauugucugu

SEQ ID NO: 3879251 - RNA, 18 nt, Human
acaugagauguguggacu

SEQ ID NO: 3879252 - RNA, 20 nt, Human
acaugagauguguggacugu

SEQ ID NO: 3879253 - RNA, 17 nt, Human
acaugagcaucaggcca

SEQ ID NO: 3879254 - RNA, 23 nt, Human
acaugagcuauuuccauuccaga

SEQ ID NO: 3879255 - RNA, 21 nt, Human
acaugaggaacuguagaugau

SEQ ID NO: 3879256 - RNA, 21 nt, Human
acaugaggacaugauggagcg

SEQ ID NO: 3879257 - RNA, 17 nt, Human
acaugaggggacauuuu

SEQ ID NO: 3879258 - RNA, 20 nt, Human
acaugagguacugagaguga

SEQ ID NO: 3879259 - RNA, 13 nt, Human
acaugagucaaga

SEQ ID NO: 3879260 - RNA, 13 nt, Human
acaugauucauuu

SEQ ID NO: 3879261 - RNA, 13 nt, Human
acaugauuccuuc

SEQ ID NO: 3879262 - RNA, 14 nt, Human
acaugauuucacaa

SEQ ID NO: 3879263 - RNA, 22 nt, Human
acaugauuucacaaauauuaaa

SEQ ID NO: 3879264 - RNA, 21 nt, Human
acaugauuuccuugaaugugg

SEQ ID NO: 3879265 - RNA, 23 nt, Human
acaugauuuccuugaauguggcu

SEQ ID NO: 3879266 - RNA, 15 nt, Human
acaugcaaaaagaaa

SEQ ID NO: 3879267 - RNA, 15 nt, Human
acaugcaaggcacug

SEQ ID NO: 3879268 - RNA, 16 nt, Human
acaugcaauaaaauuu

SEQ ID NO: 3879269 - RNA, 18 nt, Human
acaugcaauaaaauuuaa

SEQ ID NO: 3879270 - RNA, 19 nt, Human
acaugcaauaaaauuuaaa

SEQ ID NO: 3879271 - RNA, 12 nt, Human
acaugcacacac

SEQ ID NO: 3879272 - RNA, 17 nt, Human
acaugcacucagcucuu

SEQ ID NO: 3879273 - RNA, 12 nt, Human
acaugcacugac

SEQ ID NO: 3879274 - RNA, 15 nt, Human
acauuagguugugaa

SEQ ID NO: 3879275 - RNA, 14 nt, Human
acauuaguaaaugu

SEQ ID NO: 3879276 - RNA, 15 nt, Human
acauuaguaaauguc

SEQ ID NO: 3879277 - RNA, 17 nt, Human
acauuaguaaaugucuu

SEQ ID NO: 3879278 - RNA, 19 nt, Human
acauuaguaaaugucuuug

SEQ ID NO: 3879279 - RNA, 16 nt, Human
acauuaguacuuuaua

SEQ ID NO: 3879280 - RNA, 18 nt, Human
acauuaguacuuuauaga

SEQ ID NO: 3879281 - RNA, 19 nt, Human
acauuaguacuuuauagaa

SEQ ID NO: 3879282 - RNA, 15 nt, Human
acauuauagauuuuc

SEQ ID NO: 3879283 - RNA, 19 nt, Human
acauuaucucacuugugcc

SEQ ID NO: 3879284 - RNA, 14 nt, Human
acauuaugugugca

SEQ ID NO: 3879285 - RNA, 17 nt, Human
acauuaugugugcaugu

SEQ ID NO: 3879286 - RNA, 19 nt, Human
acauuaugugugcaugugu

SEQ ID NO: 3879287 - RNA, 22 nt, Human
acauuaugugugcaugugugua

SEQ ID NO: 3879288 - RNA, 18 nt, Human
acauuauuaucaacaaua

SEQ ID NO: 3879289 - RNA, 22 nt, Human
acauucaagauuaaacugagug

SEQ ID NO: 3879290 - RNA, 20 nt, Human
acauucagcugagguucauu

SEQ ID NO: 3879291 - RNA, 16 nt, Human
acauucaugccuggcu

SEQ ID NO: 3879292 - RNA, 15 nt, Human
acauuccaagacagu

SEQ ID NO: 3879293 - RNA, 17 nt, Human
acauuccaagacaguau

SEQ ID NO: 3879294 - RNA, 19 nt, Human
acauuccccuggggaccca

SEQ ID NO: 3879295 - RNA, 22 nt, Human
acauuccccuggggacccacgu

SEQ ID NO: 3879296 - RNA, 11 nt, Human
acauucccugc

SEQ ID NO: 3879297 - RNA, 20 nt, Human
acauuccuaaacuaucuuuu

SEQ ID NO: 3879298 - RNA, 19 nt, Human
acauuccucaugaauguaa

SEQ ID NO: 3879299 - RNA, 14 nt, Human
acauuccugaacag

SEQ ID NO: 3879300 - RNA, 11 nt, Human
acauuccuucu

SEQ ID NO: 3879301 - RNA, 21 nt, Human
acauucgaucucauucaguau

SEQ ID NO: 3879302 - RNA, 15 nt, Human
acauucggcucccug

SEQ ID NO: 3879303 - RNA, 17 nt, Human
acauucucaguuuuucu

SEQ ID NO: 3879304 - RNA, 16 nt, Human
acauucucuaauaaga

SEQ ID NO: 3879305 - RNA, 20 nt, Human
acauucucuaauaagaaaac

SEQ ID NO: 3879306 - RNA, 14 nt, Human
acauucugaaugcu

SEQ ID NO: 3879307 - RNA, 23 nt, Human
acauucugauucgaaugacacug

SEQ ID NO: 3879308 - RNA, 18 nt, Human
acauucugcuuucaucuu

SEQ ID NO: 3879309 - RNA, 20 nt, Human
acauucuggcucagggaggu

SEQ ID NO: 3879310 - RNA, 20 nt, Human
acauucuggggaaacaacau

SEQ ID NO: 3879311 - RNA, 20 nt, Human
acauucuggucucgucuucc

SEQ ID NO: 3879312 - RNA, 14 nt, Human
acauucuguaaaau

SEQ ID NO: 3879313 - RNA, 22 nt, Human
acauucugucgccuuagcaugu

SEQ ID NO: 3879314 - RNA, 15 nt, Human
acauucuguuaauca

SEQ ID NO: 3879315 - RNA, 18 nt, Human
acauucuuauaaauauga

SEQ ID NO: 3879316 - RNA, 16 nt, Human
acauucuuauauuuca

SEQ ID NO: 3879317 - RNA, 19 nt, Human
acauucuuccaaaaagauu

SEQ ID NO: 3879318 - RNA, 23 nt, Human
acauucuuggcuuaaucauuuuc

SEQ ID NO: 3879319 - RNA, 19 nt, Human
acauucuuuuaacuucuuu

SEQ ID NO: 3879320 - RNA, 20 nt, Human
acauucuuuuaacuucuuuc

SEQ ID NO: 3879321 - RNA, 14 nt, Human
acauucuuuuugcu

SEQ ID NO: 3879322 - RNA, 18 nt, Human
acauugaauuagaaacau

SEQ ID NO: 3879323 - RNA, 16 nt, Human
acauugaccaagaacu

SEQ ID NO: 3879324 - RNA, 17 nt, Human
acauugaccaagaacug

SEQ ID NO: 3879325 - RNA, 18 nt, Human
acauugaccaagaacugc

SEQ ID NO: 3879326 - RNA, 20 nt, Human
acauugaccaagaacugcau

SEQ ID NO: 3879327 - RNA, 14 nt, Human
acauugacuauuuu

SEQ ID NO: 3879328 - RNA, 16 nt, Human
acauugauuugauuuu

SEQ ID NO: 3879329 - RNA, 19 nt, Human
acauugcauauaacuuaua

SEQ ID NO: 3879330 - RNA, 11 nt, Human
acauugcauuc

SEQ ID NO: 3879331 - RNA, 17 nt, Human
acauugccaaaaaggau

SEQ ID NO: 3879332 - RNA, 21 nt, Human
acauugcggacagccacggcc

SEQ ID NO: 3879333 - RNA, 14 nt, Human
acauugcuaagaug

SEQ ID NO: 3879334 - RNA, 17 nt, Human
acauugcuaagaugcuc

SEQ ID NO: 3879335 - RNA, 19 nt, Human
acauugcuggucuuguaag

SEQ ID NO: 3879336 - RNA, 20 nt, Human
acauugcuggucuuguaaga

SEQ ID NO: 3879337 - RNA, 21 nt, Human
acauugcuggucuuguaagag

SEQ ID NO: 3879338 - RNA, 14 nt, Human
acauugcuuuuaaa

SEQ ID NO: 3879339 - RNA, 16 nt, Human
acauuggagccugggc

SEQ ID NO: 3879340 - RNA, 17 nt, Human
acauugggcagcgcccu

SEQ ID NO: 3879341 - RNA, 20 nt, Human
acauugggcagcgcccuucc

SEQ ID NO: 3879342 - RNA, 22 nt, Human
acauugggcagcgcccuuccuc

SEQ ID NO: 3879343 - RNA, 23 nt, Human
acauuggguccugggucuuucau

SEQ ID NO: 3879344 - RNA, 22 nt, Human
acauugggucuauuccagcuca

SEQ ID NO: 3879345 - RNA, 22 nt, Human
acauugguauucgcuugagaaa

SEQ ID NO: 3879346 - RNA, 16 nt, Human
acauugguguuguacu

SEQ ID NO: 3879347 - RNA, 23 nt, Human
acauugguguuguacucaauuuu

SEQ ID NO: 3879348 - RNA, 16 nt, Human
acauugguucuuguau

SEQ ID NO: 3879349 - RNA, 21 nt, Human
acauugguucuuguauuaaga

SEQ ID NO: 3879350 - RNA, 17 nt, Human
acauuguaaauaguauu

SEQ ID NO: 3879351 - RNA, 19 nt, Human
acauuguacgaagaguauu

SEQ ID NO: 3879352 - RNA, 14 nt, Human
acauugucaauaaa

SEQ ID NO: 3879353 - RNA, 14 nt, Human
acauugucagcaaa

SEQ ID NO: 3879354 - RNA, 18 nt, Human
acauugucagcaaauuaa

SEQ ID NO: 3879355 - RNA, 19 nt, Human
acauugucauuuauauaga

SEQ ID NO: 3879356 - RNA, 12 nt, Human
acauugucuccc

SEQ ID NO: 3879357 - RNA, 22 nt, Human
acauugucucuaaauugugggu

SEQ ID NO: 3879358 - RNA, 15 nt, Human
acauugugucuagga

SEQ ID NO: 3879359 - RNA, 15 nt, Human
acauuguuauuuuca

SEQ ID NO: 3879360 - RNA, 13 nt, Human
acauuguucaccu

SEQ ID NO: 3879361 - RNA, 17 nt, Human
acacugaccauccacuc

SEQ ID NO: 3879362 - RNA, 13 nt, Human
acacugacuugag

SEQ ID NO: 3879363 - RNA, 15 nt, Human
acacugauccagccc

SEQ ID NO: 3879364 - RNA, 20 nt, Human
acacugcaaucauaugugau

SEQ ID NO: 3879365 - RNA, 21 nt, Human
acacugcaggcaucacagcua

SEQ ID NO: 3879366 - RNA, 14 nt, Human
acacugcauguuug

SEQ ID NO: 3879367 - RNA, 15 nt, Human
acacugcccucgcac

SEQ ID NO: 3879368 - RNA, 20 nt, Human
acacugccugccuuaaguga

SEQ ID NO: 3879369 - RNA, 14 nt, Human
acacugccuguaua

SEQ ID NO: 3879370 - RNA, 22 nt, Human
acacugccuguauacuuuagua

SEQ ID NO: 3879371 - RNA, 23 nt, Human
acacugccuuuuuauuuauaugu

SEQ ID NO: 3879372 - RNA, 18 nt, Human
acacugcgcuuuauuuuc

SEQ ID NO: 3879373 - RNA, 14 nt, Human
acacugcucuaaca

SEQ ID NO: 3879374 - RNA, 19 nt, Human
acacugcucuaacagcccu

SEQ ID NO: 3879375 - RNA, 21 nt, Human
acacugcugcuccagugcagg

SEQ ID NO: 3879376 - RNA, 21 nt, Human
acacuggaggagagaagaaug

SEQ ID NO: 3879377 - RNA, 22 nt, Human
acacuggaggagagaagaauga

SEQ ID NO: 3879378 - RNA, 13 nt, Human
acacuggccccua

SEQ ID NO: 3879379 - RNA, 16 nt, Human
acacuggccccuagaa

SEQ ID NO: 3879380 - RNA, 14 nt, Human
acacuggccccuca

SEQ ID NO: 3879381 - RNA, 22 nt, Human
acacuggcugccagcuauuuuu

SEQ ID NO: 3879382 - RNA, 18 nt, Human
acacugggacuugcaaaa

SEQ ID NO: 3879383 - RNA, 15 nt, Human
acacugggaggccag

SEQ ID NO: 3879384 - RNA, 20 nt, Human
acacugggaggccagugagc

SEQ ID NO: 3879385 - RNA, 22 nt, Human
acacugggaggccgaggcaggg

SEQ ID NO: 3879386 - RNA, 18 nt, Human
acacuggggacuuggccu

SEQ ID NO: 3879387 - RNA, 15 nt, Human
acacugggggagggg

SEQ ID NO: 3879388 - RNA, 20 nt, Human
acacuggggugccgccugcc

SEQ ID NO: 3879389 - RNA, 17 nt, Human
acacugggugcccaagc

SEQ ID NO: 3879390 - RNA, 18 nt, Human
acacugggugguggccug

SEQ ID NO: 3879391 - RNA, 19 nt, Human
acacugggugguggccugg

SEQ ID NO: 3879392 - RNA, 20 nt, Human
acacugggugguggccuggu

SEQ ID NO: 3879393 - RNA, 18 nt, Human
acacugguauuccugccu

SEQ ID NO: 3879394 - RNA, 21 nt, Human
acacuggugugaccugagggc

SEQ ID NO: 3879395 - RNA, 15 nt, Human
acacugguucucaau

SEQ ID NO: 3879396 - RNA, 17 nt, Human
acauuuggguaaaucau

SEQ ID NO: 3879397 - RNA, 17 nt, Human
acauuuguacagaauuu

SEQ ID NO: 3879398 - RNA, 14 nt, Human
acauuuguauaaaa

SEQ ID NO: 3879399 - RNA, 19 nt, Human
acauuuguauaaaauaauu

SEQ ID NO: 3879400 - RNA, 20 nt, Human
acauuuguauguugugaaga

SEQ ID NO: 3879401 - RNA, 16 nt, Human
acauuugucauuuuca

SEQ ID NO: 3879402 - RNA, 20 nt, Human
acauuugugccgacacuguu

SEQ ID NO: 3879403 - RNA, 14 nt, Human
acauuuguguguua

SEQ ID NO: 3879404 - RNA, 16 nt, Human
acauuuuaaaagugcc

SEQ ID NO: 3879405 - RNA, 15 nt, Human
acauuuuaaauaaaa

SEQ ID NO: 3879406 - RNA, 15 nt, Human
acauuuuaaauggac

SEQ ID NO: 3879407 - RNA, 12 nt, Human
acauuuuaacaa

SEQ ID NO: 3879408 - RNA, 15 nt, Human
acauuuuaaugcacc

SEQ ID NO: 3879409 - RNA, 18 nt, Human
acauuuuacauuaaauuu

SEQ ID NO: 3879410 - RNA, 18 nt, Human
acauuuuacuuuuuccug

SEQ ID NO: 3879411 - RNA, 16 nt, Human
acauuuuagacaguaa

SEQ ID NO: 3879412 - RNA, 18 nt, Human
acauuuuagcucuauuga

SEQ ID NO: 3879413 - RNA, 14 nt, Human
acauuuuauuuuau

SEQ ID NO: 3879414 - RNA, 20 nt, Human
acauuuucacacaauacaau

SEQ ID NO: 3879415 - RNA, 12 nt, Human
acauuuuccuuu

SEQ ID NO: 3879416 - RNA, 19 nt, Human
acauuuucuaagaaacauu

SEQ ID NO: 3879417 - RNA, 13 nt, Human
acauuuugaaagu

SEQ ID NO: 3879418 - RNA, 21 nt, Human
acauuuugaaagucuguccuu

SEQ ID NO: 3879419 - RNA, 19 nt, Human
acauuuugagaacaaagau

SEQ ID NO: 3879420 - RNA, 14 nt, Human
acauuuugccaaaa

SEQ ID NO: 3879421 - RNA, 21 nt, Human
acauuuuguauaauuguaucg

SEQ ID NO: 3879422 - RNA, 13 nt, Human
acauuuuguugua

SEQ ID NO: 3879423 - RNA, 16 nt, Human
acauuuuguuguaaaa

SEQ ID NO: 3879424 - RNA, 18 nt, Human
acauuuuuaagugcugca

SEQ ID NO: 3879425 - RNA, 19 nt, Human
acauuuuuaagugcugcau

SEQ ID NO: 3879426 - RNA, 23 nt, Human
acauuuuuaagugcugcauuuaa

SEQ ID NO: 3879427 - RNA, 14 nt, Human
acauuuuuacaaua

SEQ ID NO: 3879428 - RNA, 20 nt, Human
acauuuuuauaccuguuuaa

SEQ ID NO: 3879429 - RNA, 21 nt, Human
acauuuuuauaccuguuuaaa

SEQ ID NO: 3879430 - RNA, 23 nt, Human
acauuuuucaacuuugaauaaag

SEQ ID NO: 3879431 - RNA, 19 nt, Human
acauuuuuccguuugcuuu

SEQ ID NO: 3879432 - RNA, 17 nt, Human
acauuuuuuaagcuuca

SEQ ID NO: 3879433 - RNA, 16 nt, Human
acauuuuuuaggaaau

SEQ ID NO: 3879434 - RNA, 20 nt, Human
acauuuuuuaggaaauguuu

SEQ ID NO: 3879435 - RNA, 14 nt, Human
acauuuuuugaaau

SEQ ID NO: 3879436 - RNA, 23 nt, Human
acauuuuuuugcaugcaugcaaa

SEQ ID NO: 3879437 - RNA, 21 nt, Human
acauuuuuuuuuuuaauuuug

SEQ ID NO: 3879438 - RNA, 18 nt, Human
accaaaaaaauccagaaa

SEQ ID NO: 3879439 - RNA, 12 nt, Human
accaaaaaauau

SEQ ID NO: 3879440 - RNA, 12 nt, Human
accaaaaacaaa

SEQ ID NO: 3879441 - RNA, 12 nt, Human
accaaaacaugu

SEQ ID NO: 3879442 - RNA, 13 nt, Human
accaaaacugcuc

SEQ ID NO: 3879443 - RNA, 15 nt, Human
accaaaagaacaaga

SEQ ID NO: 3879444 - RNA, 14 nt, Human
accaaaaguuacau

SEQ ID NO: 3879445 - RNA, 21 nt, Human
accaaaaguuacauguuugca

SEQ ID NO: 3879446 - RNA, 18 nt, Human
accaaaaguuauuaaaau

SEQ ID NO: 3879447 - RNA, 19 nt, Human
accaaaaguuauuaaaauu

SEQ ID NO: 3879448 - RNA, 22 nt, Human
accaaaaguuauuaaaauuguu

SEQ ID NO: 3879449 - RNA, 14 nt, Human
accaaaauccccuu

SEQ ID NO: 3879450 - RNA, 21 nt, Human
accaaaaugauacuuacugaa

SEQ ID NO: 3879451 - RNA, 13 nt, Human
accaaaauucauc

SEQ ID NO: 3879452 - RNA, 14 nt, Human
accaaaauuuuaaa

SEQ ID NO: 3879453 - RNA, 18 nt, Human
accaaaauuuuaaaaaag

SEQ ID NO: 3879454 - RNA, 21 nt, Human
accaaacaauauugcuccaug

SEQ ID NO: 3879455 - RNA, 14 nt, Human
accaaacaauuauu

SEQ ID NO: 3879456 - RNA, 21 nt, Human
accaaacagcaaaccaagaga

SEQ ID NO: 3879457 - RNA, 17 nt, Human
accaaacuacugaauga

SEQ ID NO: 3879458 - RNA, 18 nt, Human
accaaagagacuggagca

SEQ ID NO: 3879459 - RNA, 15 nt, Human
accaaagagggcuuc

SEQ ID NO: 3879460 - RNA, 13 nt, Human
accaaagaugcag

SEQ ID NO: 3879461 - RNA, 12 nt, Human
accaaagcugcc

SEQ ID NO: 3879462 - RNA, 19 nt, Human
accaaaggaaaaugucugu

SEQ ID NO: 3879463 - RNA, 21 nt, Human
accaaagggagaguuccagag

SEQ ID NO: 3879464 - RNA, 17 nt, Human
accaaagggagucugcc

SEQ ID NO: 3879465 - RNA, 19 nt, Human
accaaagggagucugccag

SEQ ID NO: 3879466 - RNA, 20 nt, Human
accaaagggagucugccagg

SEQ ID NO: 3879467 - RNA, 20 nt, Human
accaaaggugaaggaauaua

SEQ ID NO: 3879468 - RNA, 12 nt, Human
accaaaguucua

SEQ ID NO: 3879469 - RNA, 12 nt, Human
accaaaguuuua

SEQ ID NO: 3879470 - RNA, 18 nt, Human
accaaauagugugaaaua

SEQ ID NO: 3879471 - RNA, 16 nt, Human
accaaaucagcugcua

SEQ ID NO: 3879472 - RNA, 16 nt, Human
accaaaugcaucaauc

SEQ ID NO: 3879473 - RNA, 13 nt, Human
accaaaugcuuua

SEQ ID NO: 3879474 - RNA, 19 nt, Human
accaaaugcuuuaaaaacu

SEQ ID NO: 3879475 - RNA, 14 nt, Human
accaaauggaaaca

SEQ ID NO: 3879476 - RNA, 15 nt, Human
accaaauuaaaaaaa

SEQ ID NO: 3879477 - RNA, 20 nt, Human
accaaauuaacuuacuucca

SEQ ID NO: 3879478 - RNA, 14 nt, Human
accaaauuccuugg

SEQ ID NO: 3879479 - RNA, 16 nt, Human
accaacaccaucacag

SEQ ID NO: 3879480 - RNA, 23 nt, Human
accaacaggcuguucugcacuga

SEQ ID NO: 3879481 - RNA, 16 nt, Human
accaacaguuccuuca

SEQ ID NO: 3879482 - RNA, 14 nt, Human
accaacauaaaaau

SEQ ID NO: 3879483 - RNA, 23 nt, Human
accaacauaaaaaugaucuaaac

SEQ ID NO: 3879484 - RNA, 22 nt, Human
accaacaucccauugcccuggu

SEQ ID NO: 3879485 - RNA, 23 nt, Human
accaacauggagaaacccugucu

SEQ ID NO: 3879486 - RNA, 15 nt, Human
accaacccagccgcu

SEQ ID NO: 3879487 - RNA, 16 nt, Human
accaacccuguuuccu

SEQ ID NO: 3879488 - RNA, 19 nt, Human
accaacccuguuuccugag

SEQ ID NO: 3879489 - RNA, 17 nt, Human
accagugaaccaaagag

SEQ ID NO: 3879490 - RNA, 22 nt, Human
accagugaauuuuugcaauaau

SEQ ID NO: 3879491 - RNA, 13 nt, Human
accagugcaggcu

SEQ ID NO: 3879492 - RNA, 14 nt, Human
accagugcaggcug

SEQ ID NO: 3879493 - RNA, 15 nt, Human
accagugcaggcugg

SEQ ID NO: 3879494 - RNA, 21 nt, Human
accagugcaggcuggccagcc

SEQ ID NO: 3879495 - RNA, 16 nt, Human
accagugccaaggacc

SEQ ID NO: 3879496 - RNA, 23 nt, Human
accagugcccaaagucuguguga

SEQ ID NO: 3879497 - RNA, 13 nt, Human
accagugccucuc

SEQ ID NO: 3879498 - RNA, 21 nt, Human
accagugccucucccugcugc

SEQ ID NO: 3879499 - RNA, 22 nt, Human
accaguggcguuguugcauguu

SEQ ID NO: 3879500 - RNA, 23 nt, Human
accaguggcguuguugcauguuu

SEQ ID NO: 3879501 - RNA, 12 nt, Human
accaguggucuc

SEQ ID NO: 3879502 - RNA, 17 nt, Human
accaguggucucacaug

SEQ ID NO: 3879503 - RNA, 13 nt, Human
accaguguagccu

SEQ ID NO: 3879504 - RNA, 22 nt, Human
accaguguuagggaagggccug

SEQ ID NO: 3879505 - RNA, 15 nt, Human
accaguguuguggau

SEQ ID NO: 3879506 - RNA, 14 nt, Human
accaguuaauuacu

SEQ ID NO: 3879507 - RNA, 12 nt, Human
accaguuaauuu

SEQ ID NO: 3879508 - RNA, 16 nt, Human
accaguuaauuuuucc

SEQ ID NO: 3879509 - RNA, 24 nt, Human
accaguugaauaaaagugcacacc

SEQ ID NO: 3879510 - RNA, 19 nt, Human
accaguugggagcacugga

SEQ ID NO: 3879511 - RNA, 21 nt, Human
accaguuuagauuucaagaaa

SEQ ID NO: 3879512 - RNA, 19 nt, Human
accauaaccccggaagcca

SEQ ID NO: 3879513 - RNA, 17 nt, Human
accauaagcuacugcca

SEQ ID NO: 3879514 - RNA, 18 nt, Human
accauaauguuacauuau

SEQ ID NO: 3879515 - RNA, 21 nt, Human
accauacuaauuauacccccu

SEQ ID NO: 3879516 - RNA, 22 nt, Human
accauagcacaggcuaauuuuu

SEQ ID NO: 3879517 - RNA, 17 nt, Human
accauaggucaccuuua

SEQ ID NO: 3879518 - RNA, 15 nt, Human
accauaguuacugua

SEQ ID NO: 3879519 - RNA, 18 nt, Human
accauaguuacuguaaaa

SEQ ID NO: 3879520 - RNA, 14 nt, Human
accauaguugacag

SEQ ID NO: 3879521 - RNA, 21 nt, Human
accauauagcaaaacuuuuaa

SEQ ID NO: 3879522 - RNA, 13 nt, Human
accauaugaauug

SEQ ID NO: 3879523 - RNA, 14 nt, Human
accauauuaccaca

SEQ ID NO: 3879524 - RNA, 21 nt, Human
accauauuuauccauuuguaa

SEQ ID NO: 3879525 - RNA, 18 nt, Human
accaucacaauacagaua

SEQ ID NO: 3879526 - RNA, 20 nt, Human
accaucagaaacacccucac

SEQ ID NO: 3879527 - RNA, 14 nt, Human
accaucagggacag

SEQ ID NO: 3879528 - RNA, 14 nt, Human
accaucaugucugg

SEQ ID NO: 3879529 - RNA, 23 nt, Human
accauccacucuacccucccacc

SEQ ID NO: 3879530 - RNA, 18 nt, Human
accaucccugaaggcccc

SEQ ID NO: 3879531 - RNA, 18 nt, Human
accauccuaggcugacac

SEQ ID NO: 3879532 - RNA, 16 nt, Human
accauccugcagccuc

SEQ ID NO: 3879533 - RNA, 19 nt, Human
accauccuggccaacauga

SEQ ID NO: 3879534 - RNA, 13 nt, Human
accauccuggcua

SEQ ID NO: 3879535 - RNA, 20 nt, Human
accauccuggcuaacacggu

SEQ ID NO: 3879536 - RNA, 18 nt, Human
accauccuguauucuuca

SEQ ID NO: 3879537 - RNA, 16 nt, Human
accaucgcuggccccu

SEQ ID NO: 3879538 - RNA, 17 nt, Human
accaucucaggccaccu

SEQ ID NO: 3879539 - RNA, 12 nt, Human
accaucucccug

SEQ ID NO: 3879540 - RNA, 13 nt, Human
accaucucccugg

SEQ ID NO: 3879541 - RNA, 14 nt, Human
accaucucccuggu

SEQ ID NO: 3879542 - RNA, 17 nt, Human
accaucucccuggugcu

SEQ ID NO: 3879543 - RNA, 22 nt, Human
accaucugaaagugguacuuga

SEQ ID NO: 3879544 - RNA, 23 nt, Human
accaucuggccuggccuggcccu

SEQ ID NO: 3879545 - RNA, 17 nt, Human
accaucuuuuauucuuu

SEQ ID NO: 3879546 - RNA, 19 nt, Human
accaucuuuuauucuuuuu

SEQ ID NO: 3879547 - RNA, 20 nt, Human
accaucuuuuauucuuuuuu

SEQ ID NO: 3879548 - RNA, 21 nt, Human
accaucuuuuccucauuuuca

SEQ ID NO: 3879549 - RNA, 15 nt, Human
accaugaaacaaagc

SEQ ID NO: 3879550 - RNA, 12 nt, Human
accaugaaagac

SEQ ID NO: 3879551 - RNA, 20 nt, Human
accaugaagagauuuuucau

SEQ ID NO: 3879552 - RNA, 24 nt, Human
accaugaagagauuuuucaugauu

SEQ ID NO: 3879553 - RNA, 23 nt, Human
accaugacaacccugugguuucc

SEQ ID NO: 3879554 - RNA, 21 nt, Human
accaugagaagagggccugug

SEQ ID NO: 3879555 - RNA, 20 nt, Human
accaugaucacuuaucaguu

SEQ ID NO: 3879556 - RNA, 22 nt, Human
accaugauuaaccacuucagcu

SEQ ID NO: 3879557 - RNA, 16 nt, Human
accaugcaaaugcuau

SEQ ID NO: 3879558 - RNA, 17 nt, Human
accaugccucacuaauu

SEQ ID NO: 3879559 - RNA, 23 nt, Human
accaugcgacacugggaggccag

SEQ ID NO: 3879560 - RNA, 14 nt, Human
accauggacuuuau

SEQ ID NO: 3879561 - RNA, 16 nt, Human
accauggacuuuauaa

SEQ ID NO: 3879562 - RNA, 16 nt, Human
accauggagacaagaa

SEQ ID NO: 3879563 - RNA, 23 nt, Human
accauggaguggcagcccagcca

SEQ ID NO: 3879564 - RNA, 21 nt, Human
accauggcuaaggcaccagcc

SEQ ID NO: 3879565 - RNA, 23 nt, Human
accauggcugaaggaaaccagug

SEQ ID NO: 3879566 - RNA, 13 nt, Human
accauguaaaaca

SEQ ID NO: 3879567 - RNA, 17 nt, Human
accauguaaaacaaaaa

SEQ ID NO: 3879568 - RNA, 21 nt, Human
accauguaaaacaaaaaacaa

SEQ ID NO: 3879569 - RNA, 21 nt, Human
accauguaaagaacauaaaua

SEQ ID NO: 3879570 - RNA, 18 nt, Human
accauguaagcacucugg

SEQ ID NO: 3879571 - RNA, 21 nt, Human
accauguaagcacucuggaug

SEQ ID NO: 3879572 - RNA, 12 nt, Human
accauguaaugg

SEQ ID NO: 3879573 - RNA, 22 nt, Human
accaugucaaggguucaagauu

SEQ ID NO: 3879574 - RNA, 13 nt, Human
accaugucacugu

SEQ ID NO: 3879575 - RNA, 15 nt, Human
accaugucacugugg

SEQ ID NO: 3879576 - RNA, 22 nt, Human
accaugucagcaaaaagcaaaa

SEQ ID NO: 3879577 - RNA, 15 nt, Human
accaugucauuucag

SEQ ID NO: 3879578 - RNA, 18 nt, Human
accaugugagcucuuccu

SEQ ID NO: 3879579 - RNA, 13 nt, Human
accaugugccuga

SEQ ID NO: 3879580 - RNA, 20 nt, Human
accauguuuguggcuauuaa

SEQ ID NO: 3879581 - RNA, 13 nt, Human
accauuaaaacug

SEQ ID NO: 3879582 - RNA, 21 nt, Human
accauuaaaacugaagucuga

SEQ ID NO: 3879583 - RNA, 19 nt, Human
accauuaaaacugcuuuuu

SEQ ID NO: 3879584 - RNA, 14 nt, Human
accauuaaaauaug

SEQ ID NO: 3879585 - RNA, 20 nt, Human
accauuaaaauaugcacuaa

SEQ ID NO: 3879586 - RNA, 13 nt, Human
accauuaaaccau

SEQ ID NO: 3879587 - RNA, 14 nt, Human
accauuaaaccauc

SEQ ID NO: 3879588 - RNA, 15 nt, Human
accauuaaagucaga

SEQ ID NO: 3879589 - RNA, 14 nt, Human
accauuaccaaaau

SEQ ID NO: 3879590 - RNA, 21 nt, Human
accauuauaaccuuaauuuau

SEQ ID NO: 3879591 - RNA, 17 nt, Human
accauuauaaugaauuu

SEQ ID NO: 3879592 - RNA, 17 nt, Human
accauucacaauaaaag

SEQ ID NO: 3879593 - RNA, 23 nt, Human
accauucagaucacugaauuuau

SEQ ID NO: 3879594 - RNA, 13 nt, Human
accauucuccacc

SEQ ID NO: 3879595 - RNA, 16 nt, Human
accauucuccaccugc

SEQ ID NO: 3879596 - RNA, 24 nt, Human
accauucugacucgguuucuccaa

SEQ ID NO: 3879597 - RNA, 18 nt, Human
accauugaauucuugguu

SEQ ID NO: 3879598 - RNA, 23 nt, Human
accauugagaccgugaagauacu

SEQ ID NO: 3879599 - RNA, 15 nt, Human
accauugcaacaaaa

SEQ ID NO: 3879600 - RNA, 16 nt, Human
accauugcaacaaaau

SEQ ID NO: 3879601 - RNA, 12 nt, Human
accauugcugcu

SEQ ID NO: 3879602 - RNA, 20 nt, Human
accauugcuucacuacccau

SEQ ID NO: 3879603 - RNA, 13 nt, Human
accauuggaaauu

SEQ ID NO: 3879604 - RNA, 15 nt, Human
accauuggaaauuuc

SEQ ID NO: 3879605 - RNA, 20 nt, Human
accauuggaaauuucacguc

SEQ ID NO: 3879606 - RNA, 16 nt, Human
accauuggggcuccca

SEQ ID NO: 3879607 - RNA, 14 nt, Human
accauugucucaga

SEQ ID NO: 3879608 - RNA, 19 nt, Human
accauugucucagagcagg

SEQ ID NO: 3879609 - RNA, 21 nt, Human
accauugucuuguucugugau

SEQ ID NO: 3879610 - RNA, 21 nt, Human
accauuuaaaaacaggcagcu

SEQ ID NO: 3879611 - RNA, 19 nt, Human
accauuuauacaaauuaga

SEQ ID NO: 3879612 - RNA, 15 nt, Human
accauuuaucuugaa

SEQ ID NO: 3879613 - RNA, 16 nt, Human
accauuuaucuugaag

SEQ ID NO: 3879614 - RNA, 19 nt, Human
accauuuccccagggcacg

SEQ ID NO: 3879615 - RNA, 13 nt, Human
accauuuccucag

SEQ ID NO: 3879616 - RNA, 22 nt, Human
accauuuccucagcuuaucucu

SEQ ID NO: 3879617 - RNA, 23 nt, Human
accauuugaaguguaccugugua

SEQ ID NO: 3879618 - RNA, 20 nt, Human
accauuuggcaucccugggc

SEQ ID NO: 3879619 - RNA, 22 nt, Human
accauuuggcaucccugggccu

SEQ ID NO: 3879620 - RNA, 19 nt, Human
accauuuguaauaaaguau

SEQ ID NO: 3879621 - RNA, 21 nt, Human
accauuuguaauaaaguauau

SEQ ID NO: 3879622 - RNA, 12 nt, Human
accauuuuccug

SEQ ID NO: 3879623 - RNA, 23 nt, Human
accauuuugggguacccacugcu

SEQ ID NO: 3879624 - RNA, 21 nt, Human
acccaaaacaagccugguagg

SEQ ID NO: 3879625 - RNA, 17 nt, Human
accccuccuuccuugac

SEQ ID NO: 3879626 - RNA, 22 nt, Human
accccuccuuccuugaccagca

SEQ ID NO: 3879627 - RNA, 23 nt, Human
accccucgcccagucccagcagc

SEQ ID NO: 3879628 - RNA, 13 nt, Human
accccucuggcca

SEQ ID NO: 3879629 - RNA, 18 nt, Human
accccucuggccaggaug

SEQ ID NO: 3879630 - RNA, 15 nt, Human
accccugagcuugca

SEQ ID NO: 3879631 - RNA, 19 nt, Human
accccugaggaagaugggg

SEQ ID NO: 3879632 - RNA, 15 nt, Human
accccugaucugaca

SEQ ID NO: 3879633 - RNA, 10 nt, Human
accccugcau

SEQ ID NO: 3879634 - RNA, 16 nt, Human
accccugcccagauca

SEQ ID NO: 3879635 - RNA, 11 nt, Human
accccugcccc

SEQ ID NO: 3879636 - RNA, 13 nt, Human
accccugccccca

SEQ ID NO: 3879637 - RNA, 19 nt, Human
accccugcccccacuuccu

SEQ ID NO: 3879638 - RNA, 12 nt, Human
accccugccucc

SEQ ID NO: 3879639 - RNA, 22 nt, Human
accccugcuuugggcuugggcc

SEQ ID NO: 3879640 - RNA, 19 nt, Human
accccuggaagagcccagu

SEQ ID NO: 3879641 - RNA, 12 nt, Human
accccuggaccc

SEQ ID NO: 3879642 - RNA, 20 nt, Human
accccuggaccccagccuca

SEQ ID NO: 3879643 - RNA, 14 nt, Human
accccuggccuccg

SEQ ID NO: 3879644 - RNA, 13 nt, Human
accccuggcuggu

SEQ ID NO: 3879645 - RNA, 15 nt, Human
accccuggcuguacu

SEQ ID NO: 3879646 - RNA, 21 nt, Human
accccuggcuguacugcucag

SEQ ID NO: 3879647 - RNA, 19 nt, Human
accccuggcuuuucacugc

SEQ ID NO: 3879648 - RNA, 20 nt, Human
accccugguucucaucuuuc

SEQ ID NO: 3879649 - RNA, 16 nt, Human
accccuguaggccuca

SEQ ID NO: 3879650 - RNA, 15 nt, Human
accccuguccucacu

SEQ ID NO: 3879651 - RNA, 19 nt, Human
accccuuaagcccuggccc

SEQ ID NO: 3879652 - RNA, 17 nt, Human
accccuuagccucccug

SEQ ID NO: 3879653 - RNA, 16 nt, Human
accccuuauccaggac

SEQ ID NO: 3879654 - RNA, 16 nt, Human
accccuuccagaagca

SEQ ID NO: 3879655 - RNA, 13 nt, Human
accccuuccagau

SEQ ID NO: 3879656 - RNA, 19 nt, Human
accccuuccauguggagaa

SEQ ID NO: 3879657 - RNA, 20 nt, Human
accccuucgcuccugugucu

SEQ ID NO: 3879658 - RNA, 17 nt, Human
accccuucucugugacc

SEQ ID NO: 3879659 - RNA, 14 nt, Human
accccuugauuuuc

SEQ ID NO: 3879660 - RNA, 21 nt, Human
accccuuucuagaccaauaaa

SEQ ID NO: 3879661 - RNA, 16 nt, Human
acccgacagagggaag

SEQ ID NO: 3879662 - RNA, 23 nt, Human
acccgaccccccgugggcucccg

SEQ ID NO: 3879663 - RNA, 15 nt, Human
acccgaggcugccca

SEQ ID NO: 3879664 - RNA, 17 nt, Human
acccgaggcugcccacu

SEQ ID NO: 3879665 - RNA, 22 nt, Human
acccgaugcugcuuuccccugu

SEQ ID NO: 3879666 - RNA, 15 nt, Human
acccgccccacuccc

SEQ ID NO: 3879667 - RNA, 15 nt, Human
acccgccuagcugcu

SEQ ID NO: 3879668 - RNA, 21 nt, Human
acccgccucucccgucagggc

SEQ ID NO: 3879669 - RNA, 16 nt, Human
acccgccuuuuauaaa

SEQ ID NO: 3879670 - RNA, 19 nt, Human
acccgcuaagagggaggga

SEQ ID NO: 3879671 - RNA, 22 nt, Human
acccggagcuaacacuggcccc

SEQ ID NO: 3879672 - RNA, 23 nt, Human
acccggagcuaacacuggccccu

SEQ ID NO: 3879673 - RNA, 19 nt, Human
acccggaggccacaugagu

SEQ ID NO: 3879674 - RNA, 14 nt, Human
acccggaggccgag

SEQ ID NO: 3879675 - RNA, 21 nt, Human
acccggaggggccuggcagcc

SEQ ID NO: 3879676 - RNA, 16 nt, Human
acccggcacccccugc

SEQ ID NO: 3879677 - RNA, 22 nt, Human
acccggcaggcuagaaccuggc

SEQ ID NO: 3879678 - RNA, 17 nt, Human
acccggccccugcuggu

SEQ ID NO: 3879679 - RNA, 20 nt, Human
acccgggaagggggcuggga

SEQ ID NO: 3879680 - RNA, 15 nt, Human
acccgggaggcagag

SEQ ID NO: 3879681 - RNA, 17 nt, Human
acccgggaggcagaggu

SEQ ID NO: 3879682 - RNA, 21 nt, Human
acccgggaggcggagcuugca

SEQ ID NO: 3879683 - RNA, 13 nt, Human
acccgggcucagg

SEQ ID NO: 3879684 - RNA, 23 nt, Human
acccgggcucagggaccacagca

SEQ ID NO: 3879685 - RNA, 15 nt, Human
acccggggcccaggg

SEQ ID NO: 3879686 - RNA, 15 nt, Human
acccgguccccacuu

SEQ ID NO: 3879687 - RNA, 19 nt, Human
acccgguuucuuuuuaagu

SEQ ID NO: 3879688 - RNA, 15 nt, Human
acccguacaacgugu

SEQ ID NO: 3879689 - RNA, 14 nt, Human
acccgucuccagcu

SEQ ID NO: 3879690 - RNA, 15 nt, Human
acccguggaggcugc

SEQ ID NO: 3879691 - RNA, 13 nt, Human
acccguucaacuu

SEQ ID NO: 3879692 - RNA, 18 nt, Human
acccguucaugggggagg

SEQ ID NO: 3879693 - RNA, 13 nt, Human
acccguuccaaaa

SEQ ID NO: 3879694 - RNA, 14 nt, Human
acccguuuuaugau

SEQ ID NO: 3879695 - RNA, 16 nt, Human
acccuaaauaauaaaa

SEQ ID NO: 3879696 - RNA, 13 nt, Human
acccuaaccaagu

SEQ ID NO: 3879697 - RNA, 14 nt, Human
acccuaaccaaguu

SEQ ID NO: 3879698 - RNA, 17 nt, Human
acccuaaccaaguuccu

SEQ ID NO: 3879699 - RNA, 22 nt, Human
acccuaaggucauuaccacagg

SEQ ID NO: 3879700 - RNA, 19 nt, Human
acccuaaugucuucauaaa

SEQ ID NO: 3879701 - RNA, 13 nt, Human
acccuagcaaaag

SEQ ID NO: 3879702 - RNA, 17 nt, Human
acccuagccauuccugg

SEQ ID NO: 3879703 - RNA, 19 nt, Human
acccuagguucccgguccc

SEQ ID NO: 3879704 - RNA, 16 nt, Human
acccuaguuucccuga

SEQ ID NO: 3879705 - RNA, 15 nt, Human
acccuaucuccugac

SEQ ID NO: 3879706 - RNA, 14 nt, Human
acccucacucugcc

SEQ ID NO: 3879707 - RNA, 15 nt, Human
acccucacucugcca

SEQ ID NO: 3879708 - RNA, 16 nt, Human
acccucacucugccag

SEQ ID NO: 3879709 - RNA, 22 nt, Human
acccucacuggcucuccuggcc

SEQ ID NO: 3879710 - RNA, 11 nt, Human
acccucagagc

SEQ ID NO: 3879711 - RNA, 20 nt, Human
acccucagaugcacaugagc

SEQ ID NO: 3879712 - RNA, 13 nt, Human
acccucaggcagg

SEQ ID NO: 3879713 - RNA, 14 nt, Human
acccucauguucuu

SEQ ID NO: 3879714 - RNA, 17 nt, Human
acccucauucuacugaa

SEQ ID NO: 3879715 - RNA, 17 nt, Human
acccucauuguguuucu

SEQ ID NO: 3879716 - RNA, 11 nt, Human
acccuccaaau

SEQ ID NO: 3879717 - RNA, 15 nt, Human
acccuccacccuguc

SEQ ID NO: 3879718 - RNA, 16 nt, Human
acccuccacccugucc

SEQ ID NO: 3879719 - RNA, 17 nt, Human
acccuccacccuguccc

SEQ ID NO: 3879720 - RNA, 12 nt, Human
acccucccaccc

SEQ ID NO: 3879721 - RNA, 20 nt, Human
acccucccacccccuucucu

SEQ ID NO: 3879722 - RNA, 14 nt, Human
acccuccccucucu

SEQ ID NO: 3879723 - RNA, 19 nt, Human
acccuccccuucccagggc

SEQ ID NO: 3879724 - RNA, 19 nt, Human
acccucccucagccccucu

SEQ ID NO: 3879725 - RNA, 11 nt, Human
acccucccugc

SEQ ID NO: 3879726 - RNA, 12 nt, Human
acccucccugga

SEQ ID NO: 3879727 - RNA, 15 nt, Human
acccucccuggagug

SEQ ID NO: 3879728 - RNA, 20 nt, Human
acccuccgauuguuccugaa

SEQ ID NO: 3879729 - RNA, 17 nt, Human
acccuccuaucaccucc

SEQ ID NO: 3879730 - RNA, 21 nt, Human
acccuccuaucaccuccccuc

SEQ ID NO: 3879731 - RNA, 19 nt, Human
acccuccuggccucagacu

SEQ ID NO: 3879732 - RNA, 22 nt, Human
acccuccuggccucagacugca

SEQ ID NO: 3879733 - RNA, 14 nt, Human
acccuccuguaaau

SEQ ID NO: 3879734 - RNA, 22 nt, Human
acccuccuguugcacccagccc

SEQ ID NO: 3879735 - RNA, 15 nt, Human
acccuccuucccacu

SEQ ID NO: 3879736 - RNA, 21 nt, Human
acccuccuucccacucuucuc

SEQ ID NO: 3879737 - RNA, 21 nt, Human
acccuccuuucaccacaugug

SEQ ID NO: 3879738 - RNA, 14 nt, Human
acccucgcuggccc

SEQ ID NO: 3879739 - RNA, 16 nt, Human
acccucgggcccaccu

SEQ ID NO: 3879740 - RNA, 20 nt, Human
agcuagugacccacaugcca

SEQ ID NO: 3879741 - RNA, 16 nt, Human
agcuaguguaccuccu

SEQ ID NO: 3879742 - RNA, 18 nt, Human
agcuaguguaccuccucu

SEQ ID NO: 3879743 - RNA, 22 nt, Human
agcuaguguaccuccucucagu

SEQ ID NO: 3879744 - RNA, 23 nt, Human
agcuaguguaccuccucucagug

SEQ ID NO: 3879745 - RNA, 17 nt, Human
agcuaguugaauacuug

SEQ ID NO: 3879746 - RNA, 18 nt, Human
agcuaguugaauacuuga

SEQ ID NO: 3879747 - RNA, 20 nt, Human
agcuaguugaauacuugaac

SEQ ID NO: 3879748 - RNA, 22 nt, Human
agcuauaaagcaguauuuuucu

SEQ ID NO: 3879749 - RNA, 23 nt, Human
agcuauaaauuccucuuugcuuu

SEQ ID NO: 3879750 - RNA, 13 nt, Human
agcuauacaguuu

SEQ ID NO: 3879751 - RNA, 16 nt, Human
agcuauaccugugccu

SEQ ID NO: 3879752 - RNA, 18 nt, Human
agcuauagacccgaggaa

SEQ ID NO: 3879753 - RNA, 11 nt, Human
agcuauauaag

SEQ ID NO: 3879754 - RNA, 14 nt, Human
agcuauauccaugu

SEQ ID NO: 3879755 - RNA, 20 nt, Human
agcuauauccauguacugua

SEQ ID NO: 3879756 - RNA, 16 nt, Human
agcuaucaagaggcug

SEQ ID NO: 3879757 - RNA, 19 nt, Human
agcuaucaagaggcugaga

SEQ ID NO: 3879758 - RNA, 21 nt, Human
agcuaucaagaggcugagaca

SEQ ID NO: 3879759 - RNA, 20 nt, Human
agcuaucagaagaccacaaa

SEQ ID NO: 3879760 - RNA, 18 nt, Human
agcuaucuauauggaauu

SEQ ID NO: 3879761 - RNA, 15 nt, Human
agcuaucuucaugua

SEQ ID NO: 3879762 - RNA, 12 nt, Human
agcuaugacuua

SEQ ID NO: 3879763 - RNA, 13 nt, Human
agcuaugagagga

SEQ ID NO: 3879764 - RNA, 13 nt, Human
agcuaugcaaaaa

SEQ ID NO: 3879765 - RNA, 23 nt, Human
agcuaugcugguaggcuccugcc

SEQ ID NO: 3879766 - RNA, 19 nt, Human
agcuauggugucauaggcu

SEQ ID NO: 3879767 - RNA, 18 nt, Human
agcuaugucaagaggcug

SEQ ID NO: 3879768 - RNA, 15 nt, Human
agcuauuacugucug

SEQ ID NO: 3879769 - RNA, 14 nt, Human
agcuauuagccagg

SEQ ID NO: 3879770 - RNA, 17 nt, Human
agcuauugauauaaaua

SEQ ID NO: 3879771 - RNA, 16 nt, Human
agcuauuuaugggccc

SEQ ID NO: 3879772 - RNA, 21 nt, Human
agcuauuucaucuauuuuugg

SEQ ID NO: 3879773 - RNA, 18 nt, Human
agcuauuuccauuccaga

SEQ ID NO: 3879774 - RNA, 20 nt, Human
agcuauuuccauuccagaau

SEQ ID NO: 3879775 - RNA, 15 nt, Human
agcuauuugauguaa

SEQ ID NO: 3879776 - RNA, 13 nt, Human
agcuauuuuccag

SEQ ID NO: 3879777 - RNA, 13 nt, Human
agcuauuuuguga

SEQ ID NO: 3879778 - RNA, 22 nt, Human
agcucaaagcguggacaggugu

SEQ ID NO: 3879779 - RNA, 13 nt, Human
agcucaaaggcac

SEQ ID NO: 3879780 - RNA, 16 nt, Human
agcucaaaggcacagu

SEQ ID NO: 3879781 - RNA, 12 nt, Human
agcucaaaugaa

SEQ ID NO: 3879782 - RNA, 17 nt, Human
agcucaaaugaaaugua

SEQ ID NO: 3879783 - RNA, 23 nt, Human
agcucaacucucuuauugccuca

SEQ ID NO: 3879784 - RNA, 17 nt, Human
agcucaaugagcauguu

SEQ ID NO: 3879785 - RNA, 15 nt, Human
agcucacaaggcagc

SEQ ID NO: 3879786 - RNA, 16 nt, Human
agcucacaaggcagca

SEQ ID NO: 3879787 - RNA, 19 nt, Human
agcucacaaggcagcaagg

SEQ ID NO: 3879788 - RNA, 22 nt, Human
agcucaccagccccagugccca

SEQ ID NO: 3879789 - RNA, 21 nt, Human
agcucaccccccacacucacu

SEQ ID NO: 3879790 - RNA, 13 nt, Human
agcucaccccugg

SEQ ID NO: 3879791 - RNA, 19 nt, Human
agcucacugcaaccuccac

SEQ ID NO: 3879792 - RNA, 23 nt, Human
agcucacuucugggcuucaucug

SEQ ID NO: 3879793 - RNA, 19 nt, Human
agcucagaaaauaucccuc

SEQ ID NO: 3879794 - RNA, 14 nt, Human
agcucagaacccag

SEQ ID NO: 3879795 - RNA, 16 nt, Human
agcucagaacccaggg

SEQ ID NO: 3879796 - RNA, 18 nt, Human
agcucagaacccagggcu

SEQ ID NO: 3879797 - RNA, 19 nt, Human
agcucagaacccagggcuc

SEQ ID NO: 3879798 - RNA, 19 nt, Human
agcucagaaggcucuucug

SEQ ID NO: 3879799 - RNA, 15 nt, Human
agcucagacccccac

SEQ ID NO: 3879800 - RNA, 16 nt, Human
agcucagacccccacu

SEQ ID NO: 3879801 - RNA, 20 nt, Human
agcucagacccccacucuca

SEQ ID NO: 3879802 - RNA, 12 nt, Human
agcucagagagg

SEQ ID NO: 3879803 - RNA, 21 nt, Human
agcucagagagggcaggcaug

SEQ ID NO: 3879804 - RNA, 20 nt, Human
agcucagcacugccugcucc

SEQ ID NO: 3879805 - RNA, 21 nt, Human
agcucagcacugccugcuccc

SEQ ID NO: 3879806 - RNA, 23 nt, Human
agcucagcacugccugcucccau

SEQ ID NO: 3879807 - RNA, 16 nt, Human
agcucagcauuuccac

SEQ ID NO: 3879808 - RNA, 11 nt, Human
agcucagccca

SEQ ID NO: 3879809 - RNA, 21 nt, Human
agcucagcccaccccccucau

SEQ ID NO: 3879810 - RNA, 18 nt, Human
agcucagccccagcccag

SEQ ID NO: 3879811 - RNA, 17 nt, Human
agcucagcgccagccug

SEQ ID NO: 3879812 - RNA, 21 nt, Human
agcucagcuacugauuuuugu

SEQ ID NO: 3879813 - RNA, 18 nt, Human
agcauuuguguugaagag

SEQ ID NO: 3879814 - RNA, 14 nt, Human
agcauuuguuucua

SEQ ID NO: 3879815 - RNA, 19 nt, Human
agcauuuguuucuacuuug

SEQ ID NO: 3879816 - RNA, 19 nt, Human
agcauuuuaaacaaaauag

SEQ ID NO: 3879817 - RNA, 23 nt, Human
agcauuuuagcaauuuauacaau

SEQ ID NO: 3879818 - RNA, 13 nt, Human
agcauuuuauaaa

SEQ ID NO: 3879819 - RNA, 15 nt, Human
agcauuuuauaaauc

SEQ ID NO: 3879820 - RNA, 20 nt, Human
agcauuuuccagcacuuugc

SEQ ID NO: 3879821 - RNA, 13 nt, Human
agcauuuuccucu

SEQ ID NO: 3879822 - RNA, 14 nt, Human
agcauuuuccucug

SEQ ID NO: 3879823 - RNA, 21 nt, Human
agcauuuuccucugcuuugaa

SEQ ID NO: 3879824 - RNA, 19 nt, Human
agcauuuucugcaucucca

SEQ ID NO: 3879825 - RNA, 14 nt, Human
agcauuuuggcgcu

SEQ ID NO: 3879826 - RNA, 16 nt, Human
agcauuuuuauuucag

SEQ ID NO: 3879827 - RNA, 17 nt, Human
agcauuuuuauuucaga

SEQ ID NO: 3879828 - RNA, 12 nt, Human
agcauuuuucaa

SEQ ID NO: 3879829 - RNA, 22 nt, Human
agcauuuuucaauauauugaac

SEQ ID NO: 3879830 - RNA, 16 nt, Human
agcauuuuugauuuau

SEQ ID NO: 3879831 - RNA, 14 nt, Human
agccaaaaauagcu

SEQ ID NO: 3879832 - RNA, 22 nt, Human
agccaaaaauagcuaaauaccu

SEQ ID NO: 3879833 - RNA, 16 nt, Human
agccaaaacagaucca

SEQ ID NO: 3879834 - RNA, 22 nt, Human
agccaaaauguaggcuuaguuu

SEQ ID NO: 3879835 - RNA, 18 nt, Human
agccaaaauuaagguguu

SEQ ID NO: 3879836 - RNA, 12 nt, Human
agccaaaccagg

SEQ ID NO: 3879837 - RNA, 18 nt, Human
agccaaacccaugaggca

SEQ ID NO: 3879838 - RNA, 15 nt, Human
agccaaacucugcca

SEQ ID NO: 3879839 - RNA, 13 nt, Human
agccaaagaaaaa

SEQ ID NO: 3879840 - RNA, 14 nt, Human
agccaaagaaauga

SEQ ID NO: 3879841 - RNA, 19 nt, Human
agccaaagaaaugaacauu

SEQ ID NO: 3879842 - RNA, 16 nt, Human
agccaaagcuaggccu

SEQ ID NO: 3879843 - RNA, 23 nt, Human
agccaaagcuaggccuggccaga

SEQ ID NO: 3879844 - RNA, 19 nt, Human
agccaaagggaaauaugcu

SEQ ID NO: 3879845 - RNA, 17 nt, Human
agccaaaucaaaauaug

SEQ ID NO: 3879846 - RNA, 15 nt, Human
agccaaaugguuuaa

SEQ ID NO: 3879847 - RNA, 12 nt, Human
agccaaauuuaa

SEQ ID NO: 3879848 - RNA, 12 nt, Human
agccaacagcua

SEQ ID NO: 3879849 - RNA, 19 nt, Human
agccaacagcuacaacagc

SEQ ID NO: 3879850 - RNA, 23 nt, Human
agccaacagguggcaggaccagg

SEQ ID NO: 3879851 - RNA, 21 nt, Human
agccaacagucaaaacagaga

SEQ ID NO: 3879852 - RNA, 16 nt, Human
agccaaccuaagcaag

SEQ ID NO: 3879853 - RNA, 17 nt, Human
agccaacuagccccugg

SEQ ID NO: 3879854 - RNA, 17 nt, Human
agccaacuaugauuauu

SEQ ID NO: 3879855 - RNA, 20 nt, Human
agccaacuaugauuauuaac

SEQ ID NO: 3879856 - RNA, 13 nt, Human
agccaacucuggg

SEQ ID NO: 3879857 - RNA, 14 nt, Human
agccaacuuggcuu

SEQ ID NO: 3879858 - RNA, 20 nt, Human
agccaacuuguaaauacacc

SEQ ID NO: 3879859 - RNA, 16 nt, Human
agccaagaaagaugua

SEQ ID NO: 3879860 - RNA, 17 nt, Human
agccaagaaagauguau

SEQ ID NO: 3879861 - RNA, 21 nt, Human
agccaagcacagugguggcag

SEQ ID NO: 3879862 - RNA, 16 nt, Human
agccaagcagccaagc

SEQ ID NO: 3879863 - RNA, 15 nt, Human
agccaagcuccuugg

SEQ ID NO: 3879864 - RNA, 23 nt, Human
agccaagcuccuugggaggcccc

SEQ ID NO: 3879865 - RNA, 21 nt, Human
agccaggaagaucccccagaa

SEQ ID NO: 3879866 - RNA, 22 nt, Human
agccaggaagaucccccagaaa

SEQ ID NO: 3879867 - RNA, 19 nt, Human
agccaggaauuucccagga

SEQ ID NO: 3879868 - RNA, 20 nt, Human
agccaggaauuucccaggac

SEQ ID NO: 3879869 - RNA, 15 nt, Human
agccaggagaagcuc

SEQ ID NO: 3879870 - RNA, 22 nt, Human
agccaggagcaaauguuucugc

SEQ ID NO: 3879871 - RNA, 14 nt, Human
agccaggagcuguc

SEQ ID NO: 3879872 - RNA, 15 nt, Human
agccaggagcuguca

SEQ ID NO: 3879873 - RNA, 17 nt, Human
agccaggagcugucacc

SEQ ID NO: 3879874 - RNA, 19 nt, Human
agccaggaggccugcuagg

SEQ ID NO: 3879875 - RNA, 14 nt, Human
agccaggaucaugg

SEQ ID NO: 3879876 - RNA, 18 nt, Human
agccaggaucauggugua

SEQ ID NO: 3879877 - RNA, 17 nt, Human
agccaggcacacacugu

SEQ ID NO: 3879878 - RNA, 18 nt, Human
agccaggcacacacugug

SEQ ID NO: 3879879 - RNA, 22 nt, Human
agccaggccugggucugugucu

SEQ ID NO: 3879880 - RNA, 15 nt, Human
agccaggcgggcuca

SEQ ID NO: 3879881 - RNA, 21 nt, Human
agccaggcuagcuggagccug

SEQ ID NO: 3879882 - RNA, 15 nt, Human
agccaggcucacuca

SEQ ID NO: 3879883 - RNA, 13 nt, Human
agccagggcucaa

SEQ ID NO: 3879884 - RNA, 14 nt, Human
agccagggcugcua

SEQ ID NO: 3879885 - RNA, 20 nt, Human
agccagggcuuaccuguaca

SEQ ID NO: 3879886 - RNA, 18 nt, Human
agccagggggacuagccc

SEQ ID NO: 3879887 - RNA, 23 nt, Human
agccagggggacuagccccugug

SEQ ID NO: 3879888 - RNA, 16 nt, Human
agccagggucucuccc

SEQ ID NO: 3879889 - RNA, 20 nt, Human
agccagggucucucccucag

SEQ ID NO: 3879890 - RNA, 22 nt, Human
agccagggucucucccucaggu

SEQ ID NO: 3879891 - RNA, 22 nt, Human
agccaggguguggcccugccau

SEQ ID NO: 3879892 - RNA, 18 nt, Human
agccagguaaugagggac

SEQ ID NO: 3879893 - RNA, 12 nt, Human
agccaggucccu

SEQ ID NO: 3879894 - RNA, 14 nt, Human
agccaggugccuug

SEQ ID NO: 3879895 - RNA, 18 nt, Human
agccagguuccacagagg

SEQ ID NO: 3879896 - RNA, 21 nt, Human
agccaguaaaugggggugcau

SEQ ID NO: 3879897 - RNA, 14 nt, Human
agccagugaacaua

SEQ ID NO: 3879898 - RNA, 13 nt, Human
agccagugacucc

SEQ ID NO: 3879899 - RNA, 16 nt, Human
agccagugacuccagg

SEQ ID NO: 3879900 - RNA, 17 nt, Human
agccagugacuccagga

SEQ ID NO: 3879901 - RNA, 19 nt, Human
agccagugacuccaggaga

SEQ ID NO: 3879902 - RNA, 21 nt, Human
agccagugacuccaggagagg

SEQ ID NO: 3879903 - RNA, 17 nt, Human
agccagugcccugagcc

SEQ ID NO: 3879904 - RNA, 23 nt, Human
agccagugcccugagccaggguc

SEQ ID NO: 3879905 - RNA, 16 nt, Human
agccaguguugccuaa

SEQ ID NO: 3879906 - RNA, 19 nt, Human
agccaguucaguaccugga

SEQ ID NO: 3879907 - RNA, 21 nt, Human
agccaguucaguaccuggagg

SEQ ID NO: 3879908 - RNA, 22 nt, Human
agccaguuuggguaaaauacuu

SEQ ID NO: 3879909 - RNA, 16 nt, Human
agccauacauaaaaga

SEQ ID NO: 3879910 - RNA, 23 nt, Human
agccauacauaaaagaaauaaac

SEQ ID NO: 3879911 - RNA, 16 nt, Human
agccauacuuaucucu

SEQ ID NO: 3879912 - RNA, 16 nt, Human
agccauauuuguaaaa

SEQ ID NO: 3879913 - RNA, 16 nt, Human
agccaucaaaaugcuu

SEQ ID NO: 3879914 - RNA, 21 nt, Human
agccaucaccucagauggcag

SEQ ID NO: 3879915 - RNA, 12 nt, Human
agccaucaugua

SEQ ID NO: 3879916 - RNA, 18 nt, Human
agccaucccgucuucucc

SEQ ID NO: 3879917 - RNA, 15 nt, Human
agccaucugcccagg

SEQ ID NO: 3879918 - RNA, 16 nt, Human
agccaucugcccaggg

SEQ ID NO: 3879919 - RNA, 17 nt, Human
agccaucuugguaaauu

SEQ ID NO: 3879920 - RNA, 14 nt, Human
agccaugagaaugu

SEQ ID NO: 3879921 - RNA, 15 nt, Human
agccaugcugggaag

SEQ ID NO: 3879922 - RNA, 13 nt, Human
agccaugggacca

SEQ ID NO: 3879923 - RNA, 15 nt, Human
agccaugggaccaaa

SEQ ID NO: 3879924 - RNA, 16 nt, Human
agccaugggaccaaac

SEQ ID NO: 3879925 - RNA, 23 nt, Human
agccaugggcacaaagggcccag

SEQ ID NO: 3879926 - RNA, 18 nt, Human
agccauggguagccuggg

SEQ ID NO: 3879927 - RNA, 20 nt, Human
agccauguacagacagagaa

SEQ ID NO: 3879928 - RNA, 15 nt, Human
agccaugucugcauu

SEQ ID NO: 3879929 - RNA, 17 nt, Human
agccaugucuucucccu

SEQ ID NO: 3879930 - RNA, 17 nt, Human
agccauguuaacaugac

SEQ ID NO: 3879931 - RNA, 18 nt, Human
agccauguuuaagauuua

SEQ ID NO: 3879932 - RNA, 14 nt, Human
agccauguuuauua

SEQ ID NO: 3879933 - RNA, 15 nt, Human
agccauguuucacaa

SEQ ID NO: 3879934 - RNA, 12 nt, Human
agccauuccugg

SEQ ID NO: 3879935 - RNA, 20 nt, Human
agccauuccugguacccagc

SEQ ID NO: 3879936 - RNA, 22 nt, Human
agccauuggcuauuuaaaacuu

SEQ ID NO: 3879937 - RNA, 17 nt, Human
agccauugucuucggaa

SEQ ID NO: 3879938 - RNA, 18 nt, Human
agccauuguuggcuuucc

SEQ ID NO: 3879939 - RNA, 17 nt, Human
agccauuugucccaagu

SEQ ID NO: 3879940 - RNA, 18 nt, Human
agccauuugucccaagug

SEQ ID NO: 3879941 - RNA, 17 nt, Human
agccauuuguuggggca

SEQ ID NO: 3879942 - RNA, 18 nt, Human
agccauuuguuggggcag

SEQ ID NO: 3879943 - RNA, 14 nt, Human
agccauuuugugaa

SEQ ID NO: 3879944 - RNA, 16 nt, Human
agccauuuugugaaug

SEQ ID NO: 3879945 - RNA, 20 nt, Human
agccauuuuucaaagcaauu

SEQ ID NO: 3879946 - RNA, 20 nt, Human
agcccaaaccaccagaagcc

SEQ ID NO: 3879947 - RNA, 13 nt, Human
agcccaaagaagg

SEQ ID NO: 3879948 - RNA, 16 nt, Human
agcccaaagaaggaaa

SEQ ID NO: 3879949 - RNA, 23 nt, Human
agcccaacagacaccaucuuuug

SEQ ID NO: 3879950 - RNA, 21 nt, Human
agcccaacgggaagcaaccuc

SEQ ID NO: 3879951 - RNA, 14 nt, Human
agcccaagcuuccc

SEQ ID NO: 3879952 - RNA, 21 nt, Human
agcccaagggaucugguccua

SEQ ID NO: 3879953 - RNA, 16 nt, Human
agcccaauauuauaau

SEQ ID NO: 3879954 - RNA, 21 nt, Human
agcccaauccagguacgcaca

SEQ ID NO: 3879955 - RNA, 22 nt, Human
agcccaauccagguacgcacag

SEQ ID NO: 3879956 - RNA, 16 nt, Human
agcccacaaagccuua

SEQ ID NO: 3879957 - RNA, 17 nt, Human
agcccacaaagccuuau

SEQ ID NO: 3879958 - RNA, 12 nt, Human
agcccacagcac

SEQ ID NO: 3879959 - RNA, 23 nt, Human
agcccacauuggauucaucagca

SEQ ID NO: 3879960 - RNA, 22 nt, Human
agcccaccauuuggcaucccug

SEQ ID NO: 3879961 - RNA, 13 nt, Human
agcccaccccccu

SEQ ID NO: 3879962 - RNA, 15 nt, Human
agcccacccuccugu

SEQ ID NO: 3879963 - RNA, 16 nt, Human
agcccacccuccuguc

SEQ ID NO: 3879964 - RNA, 17 nt, Human
agcccacccuccugucu

SEQ ID NO: 3879965 - RNA, 18 nt, Human
agcccacccuccugucuu

SEQ ID NO: 3879966 - RNA, 12 nt, Human
agcccacccugc

SEQ ID NO: 3879967 - RNA, 14 nt, Human
agcccacccugcug

SEQ ID NO: 3879968 - RNA, 19 nt, Human
agcccacccugcugcuggu

SEQ ID NO: 3879969 - RNA, 13 nt, Human
agcccaccuuggc

SEQ ID NO: 3879970 - RNA, 14 nt, Human
agcccaccuuggcu

SEQ ID NO: 3879971 - RNA, 16 nt, Human
agcccaccuuggcuca

SEQ ID NO: 3879972 - RNA, 15 nt, Human
agcugugacccucaa

SEQ ID NO: 3879973 - RNA, 15 nt, Human
agcugugaccugcug

SEQ ID NO: 3879974 - RNA, 17 nt, Human
agcugugaccugcugag

SEQ ID NO: 3879975 - RNA, 19 nt, Human
agcugugacuucuauuuua

SEQ ID NO: 3879976 - RNA, 21 nt, Human
agcugugagacagugggaaau

SEQ ID NO: 3879977 - RNA, 15 nt, Human
agcugugcacaaagu

SEQ ID NO: 3879978 - RNA, 19 nt, Human
agcugugcagguggggaga

SEQ ID NO: 3879979 - RNA, 22 nt, Human
agcugugccacccugggcucug

SEQ ID NO: 3879980 - RNA, 22 nt, Human
agcuguggcagaguuacaguuc

SEQ ID NO: 3879981 - RNA, 22 nt, Human
agcugugggcaaaagaguguaa

SEQ ID NO: 3879982 - RNA, 21 nt, Human
agcuguggguacagagagguc

SEQ ID NO: 3879983 - RNA, 22 nt, Human
agcuguggucaaggcuacagau

SEQ ID NO: 3879984 - RNA, 15 nt, Human
agcugugguuuucuu

SEQ ID NO: 3879985 - RNA, 15 nt, Human
agcuguguccuugca

SEQ ID NO: 3879986 - RNA, 13 nt, Human
agcugugugaaau

SEQ ID NO: 3879987 - RNA, 16 nt, Human
agcuguguggcagucu

SEQ ID NO: 3879988 - RNA, 14 nt, Human
agcuguguuauuau

SEQ ID NO: 3879989 - RNA, 23 nt, Human
agcuguguuguugcuucuuguga

SEQ ID NO: 3879990 - RNA, 11 nt, Human
agcuguguuua

SEQ ID NO: 3879991 - RNA, 15 nt, Human
agcuguuaaacuguu

SEQ ID NO: 3879992 - RNA, 22 nt, Human
agcuguuaaacuguuagcacug

SEQ ID NO: 3879993 - RNA, 16 nt, Human
agcuguuaccauucac

SEQ ID NO: 3879994 - RNA, 17 nt, Human
agcuguuaccauucaca

SEQ ID NO: 3879995 - RNA, 18 nt, Human
agcuguucugucuuccca

SEQ ID NO: 3879996 - RNA, 22 nt, Human
agcuguugaagucucaggaguc

SEQ ID NO: 3879997 - RNA, 20 nt, Human
agcuguugacucuaguacug

SEQ ID NO: 3879998 - RNA, 13 nt, Human
agcuguugagcug

SEQ ID NO: 3879999 - RNA, 15 nt, Human
agcuguugagcuguu

SEQ ID NO: 3880000 - RNA, 17 nt, Human
agcuguugagcuguuuu

SEQ ID NO: 3880001 - RNA, 17 nt, Human
agcuguugaugggauga

SEQ ID NO: 3880002 - RNA, 16 nt, Human
agcuguugucucuucu

SEQ ID NO: 3880003 - RNA, 20 nt, Human
agcuguugucucuucuccuu

SEQ ID NO: 3880004 - RNA, 16 nt, Human
agcuguuuacuaggga

SEQ ID NO: 3880005 - RNA, 22 nt, Human
agcuguuuacuagggaucccuc

SEQ ID NO: 3880006 - RNA, 19 nt, Human
agcuguuuauuuuauauua

SEQ ID NO: 3880007 - RNA, 14 nt, Human
agcuguuuccauag

SEQ ID NO: 3880008 - RNA, 20 nt, Human
agcuguuugguuuuaaaaua

SEQ ID NO: 3880009 - RNA, 13 nt, Human
agcuguuugucau

SEQ ID NO: 3880010 - RNA, 14 nt, Human
agcuguuuucuucu

SEQ ID NO: 3880011 - RNA, 12 nt, Human
agcuuaaaaaaa

SEQ ID NO: 3880012 - RNA, 13 nt, Human
agcuuaaaacuuu

SEQ ID NO: 3880013 - RNA, 14 nt, Human
agcuuaaaacuuug

SEQ ID NO: 3880014 - RNA, 20 nt, Human
agcuuaaaauaaacaguugu

SEQ ID NO: 3880015 - RNA, 20 nt, Human
agcuuaaaggggcuagagug

SEQ ID NO: 3880016 - RNA, 22 nt, Human
agcuuacaaauacuaaaaagaa

SEQ ID NO: 3880017 - RNA, 15 nt, Human
agcuuacaagccagc

SEQ ID NO: 3880018 - RNA, 21 nt, Human
agcuuacaaucgcaaaucaaa

SEQ ID NO: 3880019 - RNA, 17 nt, Human
agcuuacauaguuuuaa

SEQ ID NO: 3880020 - RNA, 16 nt, Human
agcuuacaugagaaca

SEQ ID NO: 3880021 - RNA, 20 nt, Human
agcuuaccagaagcuuccau

SEQ ID NO: 3880022 - RNA, 22 nt, Human
agcuuaccagaagcuuccauag

SEQ ID NO: 3880023 - RNA, 16 nt, Human
agcuuagaccucagcc

SEQ ID NO: 3880024 - RNA, 20 nt, Human
agcuuagaccucagccugug

SEQ ID NO: 3880025 - RNA, 15 nt, Human
agcuuagacuaaggc

SEQ ID NO: 3880026 - RNA, 13 nt, Human
agcuuagauuuca

SEQ ID NO: 3880027 - RNA, 16 nt, Human
agcuuaucaauuuguc

SEQ ID NO: 3880028 - RNA, 23 nt, Human
agcuuaucaauuugucauuuuga

SEQ ID NO: 3880029 - RNA, 13 nt, Human
agcuuaucucuuu

SEQ ID NO: 3880030 - RNA, 16 nt, Human
agcuuaugaaaagaau

SEQ ID NO: 3880031 - RNA, 20 nt, Human
agcuuauguuaacugacaag

SEQ ID NO: 3880032 - RNA, 17 nt, Human
agcuuauuaaugcuaag

SEQ ID NO: 3880033 - RNA, 19 nt, Human
agcuuauuaaugcuaaggg

SEQ ID NO: 3880034 - RNA, 22 nt, Human
agcuuauucaucuguuuuucuu

SEQ ID NO: 3880035 - RNA, 22 nt, Human
agcuuauuguuucucugaaagu

SEQ ID NO: 3880036 - RNA, 12 nt, Human
agcuuauuuaau

SEQ ID NO: 3880037 - RNA, 21 nt, Human
agcuucaagucugugccugga

SEQ ID NO: 3880038 - RNA, 20 nt, Human
agcuucaccccaaucccagc

SEQ ID NO: 3880039 - RNA, 23 nt, Human
agcuucacuucugacucuucccc

SEQ ID NO: 3880040 - RNA, 13 nt, Human
agcuucagguuau

SEQ ID NO: 3880041 - RNA, 15 nt, Human
agcuucaguugcuug

SEQ ID NO: 3880042 - RNA, 19 nt, Human
agcuucaguuguuuucccg

SEQ ID NO: 3880043 - RNA, 16 nt, Human
agcuucauacuucaug

SEQ ID NO: 3880044 - RNA, 22 nt, Human
agcuucaugccuuuguaaguua

SEQ ID NO: 3880045 - RNA, 18 nt, Human
agcuucauuuccuguguc

SEQ ID NO: 3880046 - RNA, 18 nt, Human
agcuuccaauuuuccuuc

SEQ ID NO: 3880047 - RNA, 14 nt, Human
agcuuccagcagga

SEQ ID NO: 3880048 - RNA, 16 nt, Human
agcuuccagcaggagg

SEQ ID NO: 3880049 - RNA, 17 nt, Human
agcuuccagcaggaggg

SEQ ID NO: 3880050 - RNA, 15 nt, Human
agcuuccagcucuaa

SEQ ID NO: 3880051 - RNA, 21 nt, Human
agcuuccaggaaaaaggacag

SEQ ID NO: 3880052 - RNA, 20 nt, Human
agcuuccaggcugcauagaa

SEQ ID NO: 3880053 - RNA, 21 nt, Human
agcuuccaggcugcauagaag

SEQ ID NO: 3880054 - RNA, 17 nt, Human
agcuuccauagcugcug

SEQ ID NO: 3880055 - RNA, 23 nt, Human
agcuuccauagcugcugcccuag

SEQ ID NO: 3880056 - RNA, 22 nt, Human
agcuuccaugauucuauuuaua

SEQ ID NO: 3880057 - RNA, 20 nt, Human
agcuuccauuuuaauuuuaa

SEQ ID NO: 3880058 - RNA, 18 nt, Human
agcuuccccaguagcugg

SEQ ID NO: 3880059 - RNA, 22 nt, Human
agcuucccccccaccacaggcc

SEQ ID NO: 3880060 - RNA, 13 nt, Human
agcuucccuccau

SEQ ID NO: 3880061 - RNA, 16 nt, Human
aggcauuaauguuucu

SEQ ID NO: 3880062 - RNA, 19 nt, Human
aggcauuaauguuucuauc

SEQ ID NO: 3880063 - RNA, 20 nt, Human
aggcauuaauguuucuaucu

SEQ ID NO: 3880064 - RNA, 12 nt, Human
aggcauucaagu

SEQ ID NO: 3880065 - RNA, 13 nt, Human
aggcauuccagcu

SEQ ID NO: 3880066 - RNA, 24 nt, Human
aggcauuccagcuccuccgugcuu

SEQ ID NO: 3880067 - RNA, 18 nt, Human
aggcauuccccaggaggc

SEQ ID NO: 3880068 - RNA, 15 nt, Human
aggcauucuggaccu

SEQ ID NO: 3880069 - RNA, 21 nt, Human
aggcauucuggaccucugggu

SEQ ID NO: 3880070 - RNA, 20 nt, Human
aggcauugccaagggcuuug

SEQ ID NO: 3880071 - RNA, 14 nt, Human
aggcauuguuugag

SEQ ID NO: 3880072 - RNA, 15 nt, Human
aggcauuuaggaacu

SEQ ID NO: 3880073 - RNA, 12 nt, Human
aggcauuuccua

SEQ ID NO: 3880074 - RNA, 18 nt, Human
aggcauuugcaggguccu

SEQ ID NO: 3880075 - RNA, 16 nt, Human
aggcauuugcugaaua

SEQ ID NO: 3880076 - RNA, 20 nt, Human
aggcauuuguaaauauuaaa

SEQ ID NO: 3880077 - RNA, 11 nt, Human
aggcauuuguu

SEQ ID NO: 3880078 - RNA, 18 nt, Human
aggcauuuguuugaacug

SEQ ID NO: 3880079 - RNA, 13 nt, Human
aggccaaaaaaau

SEQ ID NO: 3880080 - RNA, 14 nt, Human
aggccaaaccucug

SEQ ID NO: 3880081 - RNA, 14 nt, Human
aggccaaacugcug

SEQ ID NO: 3880082 - RNA, 15 nt, Human
aggccaaaggaagca

SEQ ID NO: 3880083 - RNA, 19 nt, Human
aggccaaaggaagcacaug

SEQ ID NO: 3880084 - RNA, 17 nt, Human
aggccaaaggcuggugg

SEQ ID NO: 3880085 - RNA, 22 nt, Human
aggccaaaggggaccuggaagg

SEQ ID NO: 3880086 - RNA, 17 nt, Human
aggccaacacugugggu

SEQ ID NO: 3880087 - RNA, 17 nt, Human
aggccaagaaacgucuu

SEQ ID NO: 3880088 - RNA, 19 nt, Human
aggccaagaauauugcaaa

SEQ ID NO: 3880089 - RNA, 20 nt, Human
aggccaagaauauugcaaaa

SEQ ID NO: 3880090 - RNA, 14 nt, Human
aggccaagaaucaa

SEQ ID NO: 3880091 - RNA, 17 nt, Human
aggccaagagcagaggc

SEQ ID NO: 3880092 - RNA, 13 nt, Human
aggccaagagguu

SEQ ID NO: 3880093 - RNA, 22 nt, Human
aggccaaggggagucaccuucc

SEQ ID NO: 3880094 - RNA, 14 nt, Human
aggccaaggugucc

SEQ ID NO: 3880095 - RNA, 22 nt, Human
aggccaagugugauaaauaaac

SEQ ID NO: 3880096 - RNA, 16 nt, Human
aggccaaucagaagcu

SEQ ID NO: 3880097 - RNA, 20 nt, Human
aggccaaucagaagcuaaca

SEQ ID NO: 3880098 - RNA, 17 nt, Human
aggccacaagacccuug

SEQ ID NO: 3880099 - RNA, 18 nt, Human
aggccacaagacccuugu

SEQ ID NO: 3880100 - RNA, 19 nt, Human
aggccacaagacccuugug

SEQ ID NO: 3880101 - RNA, 21 nt, Human
aggccacaccaucuccuuuca

SEQ ID NO: 3880102 - RNA, 22 nt, Human
aggccacaccaucuccuuucag

SEQ ID NO: 3880103 - RNA, 18 nt, Human
aggccacaugagucccag

SEQ ID NO: 3880104 - RNA, 21 nt, Human
aggccacaugggagcagucca

SEQ ID NO: 3880105 - RNA, 19 nt, Human
aggccacauggggcugggc

SEQ ID NO: 3880106 - RNA, 15 nt, Human
aggccacaugucacc

SEQ ID NO: 3880107 - RNA, 22 nt, Human
aggccaccauauucagugcugu

SEQ ID NO: 3880108 - RNA, 20 nt, Human
aggccacccugugcagaagg

SEQ ID NO: 3880109 - RNA, 14 nt, Human
aggccaccucccca

SEQ ID NO: 3880110 - RNA, 13 nt, Human
aggccaccuccua

SEQ ID NO: 3880111 - RNA, 11 nt, Human
aggccaccucu

SEQ ID NO: 3880112 - RNA, 13 nt, Human
aggccaccucucc

SEQ ID NO: 3880113 - RNA, 15 nt, Human
aggccaccucuuccu

SEQ ID NO: 3880114 - RNA, 16 nt, Human
aggccaccugcccccu

SEQ ID NO: 3880115 - RNA, 21 nt, Human
aggccaccugcccccuucucc

SEQ ID NO: 3880116 - RNA, 14 nt, Human
aggccacuccucca

SEQ ID NO: 3880117 - RNA, 17 nt, Human
aggccagaccauggaca

SEQ ID NO: 3880118 - RNA, 18 nt, Human
aggccagaccauggacac

SEQ ID NO: 3880119 - RNA, 16 nt, Human
aggccagaguggccug

SEQ ID NO: 3880120 - RNA, 19 nt, Human
aggccagaguggccuggcc

SEQ ID NO: 3880121 - RNA, 13 nt, Human
aggccagcaacgc

SEQ ID NO: 3880122 - RNA, 14 nt, Human
aggccagcaacgcu

SEQ ID NO: 3880123 - RNA, 17 nt, Human
aggccagcaacgcuugu

SEQ ID NO: 3880124 - RNA, 15 nt, Human
aggccagcaaggugg

SEQ ID NO: 3880125 - RNA, 17 nt, Human
aggccagcaagguggag

SEQ ID NO: 3880126 - RNA, 20 nt, Human
aggccagcaagguggagugg

SEQ ID NO: 3880127 - RNA, 13 nt, Human
aggccagccagug

SEQ ID NO: 3880128 - RNA, 17 nt, Human
aggccagccuccgagag

SEQ ID NO: 3880129 - RNA, 22 nt, Human
aggccagccuccgagagggaga

SEQ ID NO: 3880130 - RNA, 23 nt, Human
aggccagccuccgagagggagag

SEQ ID NO: 3880131 - RNA, 16 nt, Human
aggccagccuggccuc

SEQ ID NO: 3880132 - RNA, 17 nt, Human
aggccagccuggccucc

SEQ ID NO: 3880133 - RNA, 19 nt, Human
aggccagccuggccuccug

SEQ ID NO: 3880134 - RNA, 21 nt, Human
aggccagccuggccuccugcc

SEQ ID NO: 3880135 - RNA, 19 nt, Human
aggccagcugccccagcca

SEQ ID NO: 3880136 - RNA, 12 nt, Human
aggccagcugcu

SEQ ID NO: 3880137 - RNA, 13 nt, Human
aggccagcugcuu

SEQ ID NO: 3880138 - RNA, 23 nt, Human
aggccagcugcuugggcuucauc

SEQ ID NO: 3880139 - RNA, 14 nt, Human
aggccagcuggcag

SEQ ID NO: 3880140 - RNA, 20 nt, Human
aggccagcuggcagcagagu

SEQ ID NO: 3880141 - RNA, 23 nt, Human
aggccagcugugguuuucuuuug

SEQ ID NO: 3880142 - RNA, 19 nt, Human
aggccaggacucugcagcc

SEQ ID NO: 3880143 - RNA, 23 nt, Human
aggccaggacucugcagccucag

SEQ ID NO: 3880144 - RNA, 16 nt, Human
aggccaggccaccagg

SEQ ID NO: 3880145 - RNA, 17 nt, Human
aggccaggcccucugcc

SEQ ID NO: 3880146 - RNA, 11 nt, Human
aggccaggcuc

SEQ ID NO: 3880147 - RNA, 12 nt, Human
aggccaggcucc

SEQ ID NO: 3880148 - RNA, 13 nt, Human
aggccaggggcuu

SEQ ID NO: 3880149 - RNA, 16 nt, Human
aggccaggggcuuuug

SEQ ID NO: 3880150 - RNA, 23 nt, Human
aggccagggggccagucccugag

SEQ ID NO: 3880151 - RNA, 20 nt, Human
aggccagggucacugaaggc

SEQ ID NO: 3880152 - RNA, 16 nt, Human
aggccagguccagaga

SEQ ID NO: 3880153 - RNA, 17 nt, Human
aggccagguccagagag

SEQ ID NO: 3880154 - RNA, 18 nt, Human
aggccaguaguucucaaa

SEQ ID NO: 3880155 - RNA, 14 nt, Human
aggccaucuggaga

SEQ ID NO: 3880156 - RNA, 21 nt, Human
aggccaucuggagagcccaga

SEQ ID NO: 3880157 - RNA, 21 nt, Human
aggccaucugggcuccuccag

SEQ ID NO: 3880158 - RNA, 18 nt, Human
aggccaucuuccaggugg

SEQ ID NO: 3880159 - RNA, 13 nt, Human
aggccaugaaaaa

SEQ ID NO: 3880160 - RNA, 21 nt, Human
aggccaugauucgcccaaagc

SEQ ID NO: 3880161 - RNA, 17 nt, Human
aggccauggacucuguc

SEQ ID NO: 3880162 - RNA, 21 nt, Human
aggccauggacucuguccuga

SEQ ID NO: 3880163 - RNA, 16 nt, Human
aggccauggagagcug

SEQ ID NO: 3880164 - RNA, 18 nt, Human
aggccauggagagcugga

SEQ ID NO: 3880165 - RNA, 20 nt, Human
aggccaugugcauaguuucu

SEQ ID NO: 3880166 - RNA, 13 nt, Human
aggccauuauugu

SEQ ID NO: 3880167 - RNA, 18 nt, Human
aggccauucuuucccaac

SEQ ID NO: 3880168 - RNA, 14 nt, Human
aggccauugugaac

SEQ ID NO: 3880169 - RNA, 17 nt, Human
aggccauugugaaccaa

SEQ ID NO: 3880170 - RNA, 12 nt, Human
aggcccaaagcc

SEQ ID NO: 3880171 - RNA, 22 nt, Human
aggcccaaauuaucaagcuaau

SEQ ID NO: 3880172 - RNA, 18 nt, Human
aggcccaaccaccagaug

SEQ ID NO: 3880173 - RNA, 14 nt, Human
aggcccaacuguga

SEQ ID NO: 3880174 - RNA, 12 nt, Human
aggcccaagaga

SEQ ID NO: 3880175 - RNA, 17 nt, Human
aggcccaaggcucccgg

SEQ ID NO: 3880176 - RNA, 13 nt, Human
aggcccacacaca

SEQ ID NO: 3880177 - RNA, 15 nt, Human
aggcccacacacagg

SEQ ID NO: 3880178 - RNA, 15 nt, Human
aggcccacccugcuu

SEQ ID NO: 3880179 - RNA, 23 nt, Human
aggcccacccugcuuggcccagg

SEQ ID NO: 3880180 - RNA, 22 nt, Human
aggcccaccuaccuucaaagcu

SEQ ID NO: 3880181 - RNA, 20 nt, Human
aggcccagagagaagagccc

SEQ ID NO: 3880182 - RNA, 22 nt, Human
aggcccagagagaagagcccca

SEQ ID NO: 3880183 - RNA, 23 nt, Human
aggcccagagagaagagccccac

SEQ ID NO: 3880184 - RNA, 13 nt, Human
aggcccagagggc

SEQ ID NO: 3880185 - RNA, 13 nt, Human
aggcccagcauug

SEQ ID NO: 3880186 - RNA, 21 nt, Human
aggcccagcauugcugguucu

SEQ ID NO: 3880187 - RNA, 15 nt, Human
aggcccagccccuag

SEQ ID NO: 3880188 - RNA, 12 nt, Human
aggcccagcuga

SEQ ID NO: 3880189 - RNA, 13 nt, Human
aggcccaggcugg

SEQ ID NO: 3880190 - RNA, 13 nt, Human
aggcccagugaga

SEQ ID NO: 3880191 - RNA, 13 nt, Human
aggcccauagcag

SEQ ID NO: 3880192 - RNA, 18 nt, Human
aggcccaugggaggcugg

SEQ ID NO: 3880193 - RNA, 22 nt, Human
aggccccaaaggaaaaagcaca

SEQ ID NO: 3880194 - RNA, 21 nt, Human
aggccccaagggguuucuguu

SEQ ID NO: 3880195 - RNA, 13 nt, Human
aggccccacugau

SEQ ID NO: 3880196 - RNA, 19 nt, Human
aggccccacugaugcuguu

SEQ ID NO: 3880197 - RNA, 15 nt, Human
aggccccacugggga

SEQ ID NO: 3880198 - RNA, 13 nt, Human
aggccccagagac

SEQ ID NO: 3880199 - RNA, 20 nt, Human
aggccccagagacucagagg

SEQ ID NO: 3880200 - RNA, 12 nt, Human
aggccccagccu

SEQ ID NO: 3880201 - RNA, 16 nt, Human
aggccccaggaagccg

SEQ ID NO: 3880202 - RNA, 16 nt, Human
aggcccccaccacaca

SEQ ID NO: 3880203 - RNA, 17 nt, Human
aggcccccacuugccuc

SEQ ID NO: 3880204 - RNA, 14 nt, Human
aggcccccagccca

SEQ ID NO: 3880205 - RNA, 18 nt, Human
aggcccccagcccagggc

SEQ ID NO: 3880206 - RNA, 18 nt, Human
aggcccccgccuuggccu

SEQ ID NO: 3880207 - RNA, 17 nt, Human
aguguuuauuuuucaua

SEQ ID NO: 3880208 - RNA, 21 nt, Human
aguguuuauuuuucauauugu

SEQ ID NO: 3880209 - RNA, 13 nt, Human
aguguuucagcua

SEQ ID NO: 3880210 - RNA, 20 nt, Human
aguguuucagcuaagggaag

SEQ ID NO: 3880211 - RNA, 21 nt, Human
aguguuucuaauaaacuugga

SEQ ID NO: 3880212 - RNA, 14 nt, Human
aguguuucugugca

SEQ ID NO: 3880213 - RNA, 17 nt, Human
aguguuucugugcaugg

SEQ ID NO: 3880214 - RNA, 21 nt, Human
aguguuucuguuauuaacaaa

SEQ ID NO: 3880215 - RNA, 11 nt, Human
aguguuucuuu

SEQ ID NO: 3880216 - RNA, 12 nt, Human
aguguuugcugc

SEQ ID NO: 3880217 - RNA, 20 nt, Human
aguguuuggugcucauuuaa

SEQ ID NO: 3880218 - RNA, 14 nt, Human
aguguuuuaaauuc

SEQ ID NO: 3880219 - RNA, 14 nt, Human
aguguuuucagagc

SEQ ID NO: 3880220 - RNA, 14 nt, Human
aguguuuucucuga

SEQ ID NO: 3880221 - RNA, 13 nt, Human
aguguuuucuggg

SEQ ID NO: 3880222 - RNA, 19 nt, Human
aguguuuuggacuccaucu

SEQ ID NO: 3880223 - RNA, 22 nt, Human
aguguuuuguaccagugaauuu

SEQ ID NO: 3880224 - RNA, 23 nt, Human
aguguuuuguaccagugaauuuu

SEQ ID NO: 3880225 - RNA, 14 nt, Human
aguguuuuuguaaa

SEQ ID NO: 3880226 - RNA, 20 nt, Human
aguguuuuuguaaagugugg

SEQ ID NO: 3880227 - RNA, 15 nt, Human
aguguuuuugugaau

SEQ ID NO: 3880228 - RNA, 16 nt, Human
aguguuuuugugaauu

SEQ ID NO: 3880229 - RNA, 19 nt, Human
aguguuuuuuuauuucuac

SEQ ID NO: 3880230 - RNA, 22 nt, Human
aguuaaaaaaaaaaaaaggaaa

SEQ ID NO: 3880231 - RNA, 16 nt, Human
aguuaaaaaaaauaau

SEQ ID NO: 3880232 - RNA, 18 nt, Human
aguuaaaaaaaauaauaa

SEQ ID NO: 3880233 - RNA, 21 nt, Human
aguuaaaagaauguaaaauau

SEQ ID NO: 3880234 - RNA, 13 nt, Human
aguuaaagaaagg

SEQ ID NO: 3880235 - RNA, 18 nt, Human
aguuaaagaaaggaaaag

SEQ ID NO: 3880236 - RNA, 21 nt, Human
aguuaaagaagacauuugcca

SEQ ID NO: 3880237 - RNA, 13 nt, Human
aguuaaagggaag

SEQ ID NO: 3880238 - RNA, 17 nt, Human
aguuaaagggaagaaaa

SEQ ID NO: 3880239 - RNA, 18 nt, Human
aguuaaagggaagaaaac

SEQ ID NO: 3880240 - RNA, 23 nt, Human
aguuaaagggaagaaaacacugu

SEQ ID NO: 3880241 - RNA, 12 nt, Human
aguuaaaucuca

SEQ ID NO: 3880242 - RNA, 14 nt, Human
aguuaaauuucugg

SEQ ID NO: 3880243 - RNA, 13 nt, Human
aguuaacaaugau

SEQ ID NO: 3880244 - RNA, 16 nt, Human
aguuaacaaugauaua

SEQ ID NO: 3880245 - RNA, 17 nt, Human
aguuaacaaugauauau

SEQ ID NO: 3880246 - RNA, 18 nt, Human
aguuaacaggcaaacauu

SEQ ID NO: 3880247 - RNA, 15 nt, Human
aguuaacaucaugaa

SEQ ID NO: 3880248 - RNA, 19 nt, Human
aguuaacuauugcauuuau

SEQ ID NO: 3880249 - RNA, 16 nt, Human
aguuaacuauuuuauu

SEQ ID NO: 3880250 - RNA, 20 nt, Human
aguuaagaaaaaaauaauuu

SEQ ID NO: 3880251 - RNA, 12 nt, Human
aguuaagaagcu

SEQ ID NO: 3880252 - RNA, 16 nt, Human
aguuaagaagcuguug

SEQ ID NO: 3880253 - RNA, 16 nt, Human
aguuaagaccuggcag

SEQ ID NO: 3880254 - RNA, 22 nt, Human
aguuaagagaaacuuuauacau

SEQ ID NO: 3880255 - RNA, 16 nt, Human
aguuaagauucuuggu

SEQ ID NO: 3880256 - RNA, 19 nt, Human
aguuaaggugggcccggcc

SEQ ID NO: 3880257 - RNA, 22 nt, Human
aguuaagucuaucugguauuaa

SEQ ID NO: 3880258 - RNA, 20 nt, Human
aguuaauauaucccagaaau

SEQ ID NO: 3880259 - RNA, 14 nt, Human
aguuaaucaacuga

SEQ ID NO: 3880260 - RNA, 16 nt, Human
aguuaaucaacugaaa

SEQ ID NO: 3880261 - RNA, 15 nt, Human
aguuaaucaucaaga

SEQ ID NO: 3880262 - RNA, 16 nt, Human
aguuaaucuugcuuuc

SEQ ID NO: 3880263 - RNA, 16 nt, Human
aguuaaugcuuaagag

SEQ ID NO: 3880264 - RNA, 20 nt, Human
aguuaaugcuuaagagggaa

SEQ ID NO: 3880265 - RNA, 17 nt, Human
aguuaauguauauaaaa

SEQ ID NO: 3880266 - RNA, 15 nt, Human
aguuaauuuuuccaa

SEQ ID NO: 3880267 - RNA, 17 nt, Human
aguuaauuuuuccaacu

SEQ ID NO: 3880268 - RNA, 13 nt, Human
aguuacagaaagu

SEQ ID NO: 3880269 - RNA, 22 nt, Human
aguuacagcgagaggcagagaa

SEQ ID NO: 3880270 - RNA, 13 nt, Human
aguuacagcugug

SEQ ID NO: 3880271 - RNA, 16 nt, Human
aguuacagcugugauu

SEQ ID NO: 3880272 - RNA, 22 nt, Human
aguuacauaauucacucugagu

SEQ ID NO: 3880273 - RNA, 17 nt, Human
aguuaccacacaucuau

SEQ ID NO: 3880274 - RNA, 16 nt, Human
aguuaccagugccuua

SEQ ID NO: 3880275 - RNA, 19 nt, Human
aguuaccauuaaaccaucu

SEQ ID NO: 3880276 - RNA, 13 nt, Human
aguuacccacuga

SEQ ID NO: 3880277 - RNA, 20 nt, Human
aguuaccuggaaucaaauaa

SEQ ID NO: 3880278 - RNA, 17 nt, Human
aguuaccuuauaguuac

SEQ ID NO: 3880279 - RNA, 20 nt, Human
aguuaccuuauaguuacugu

SEQ ID NO: 3880280 - RNA, 16 nt, Human
aguuacuaccuccucu

SEQ ID NO: 3880281 - RNA, 16 nt, Human
aguuacuagguaacuu

SEQ ID NO: 3880282 - RNA, 17 nt, Human
aguuacuagguaacuuc

SEQ ID NO: 3880283 - RNA, 19 nt, Human
aguuacuagguaacuucau

SEQ ID NO: 3880284 - RNA, 12 nt, Human
aguuacucagcc

SEQ ID NO: 3880285 - RNA, 13 nt, Human
aguuacucagccc

SEQ ID NO: 3880286 - RNA, 17 nt, Human
aguuacuccagugccaa

SEQ ID NO: 3880287 - RNA, 21 nt, Human
aguuacucuucaguuaagccu

SEQ ID NO: 3880288 - RNA, 12 nt, Human
aguuacugaaug

SEQ ID NO: 3880289 - RNA, 13 nt, Human
aguuacugaaugc

SEQ ID NO: 3880290 - RNA, 18 nt, Human
aguuacugauucacugca

SEQ ID NO: 3880291 - RNA, 14 nt, Human
aguuacugugcauu

SEQ ID NO: 3880292 - RNA, 16 nt, Human
aguuacuguguaaacu

SEQ ID NO: 3880293 - RNA, 14 nt, Human
aguuacuguguaau

SEQ ID NO: 3880294 - RNA, 16 nt, Human
aguuacuguguaauua

SEQ ID NO: 3880295 - RNA, 17 nt, Human
aguuacuguuauagagg

SEQ ID NO: 3880296 - RNA, 22 nt, Human
aguuacuucacuuuaauucuca

SEQ ID NO: 3880297 - RNA, 13 nt, Human
aguuacuuuagau

SEQ ID NO: 3880298 - RNA, 15 nt, Human
aguuacuuuagaugg

SEQ ID NO: 3880299 - RNA, 21 nt, Human
aguuacuuuccaauucuccuu

SEQ ID NO: 3880300 - RNA, 17 nt, Human
aguuacuuuuccuugca

SEQ ID NO: 3880301 - RNA, 20 nt, Human
aguuacuuuuccuugcauac

SEQ ID NO: 3880302 - RNA, 15 nt, Human
aguuagaacauuugc

SEQ ID NO: 3880303 - RNA, 18 nt, Human
aguuagaauaauaaauau

SEQ ID NO: 3880304 - RNA, 15 nt, Human
aguuagaaucuauuu

SEQ ID NO: 3880305 - RNA, 14 nt, Human
aguuagaauuccuu

SEQ ID NO: 3880306 - RNA, 15 nt, Human
aguuagaauuccuuc

SEQ ID NO: 3880307 - RNA, 21 nt, Human
aguuagaauuccuucagggug

SEQ ID NO: 3880308 - RNA, 12 nt, Human
aguuagacuguu

SEQ ID NO: 3880309 - RNA, 12 nt, Human
aguuagagcuga

SEQ ID NO: 3880310 - RNA, 19 nt, Human
aguuagaggccagccuggc

SEQ ID NO: 3880311 - RNA, 17 nt, Human
aguuagauucacuuuga

SEQ ID NO: 3880312 - RNA, 16 nt, Human
aguuagcaaacuuugu

SEQ ID NO: 3880313 - RNA, 22 nt, Human
aguuagcaaacuuuguauguca

SEQ ID NO: 3880314 - RNA, 15 nt, Human
aguuagccuccacca

SEQ ID NO: 3880315 - RNA, 23 nt, Human
aguuagccuuuaucuaccaacuu

SEQ ID NO: 3880316 - RNA, 18 nt, Human
aguuagcuaauaaaaagc

SEQ ID NO: 3880317 - RNA, 15 nt, Human
aguuaggaaauaaaa

SEQ ID NO: 3880318 - RNA, 20 nt, Human
aguuaggaaauaaaaccuuu

SEQ ID NO: 3880319 - RNA, 21 nt, Human
aguuaggaaauaaaaccuuuc

SEQ ID NO: 3880320 - RNA, 22 nt, Human
aguuaggaaauaaaaccuuuca

SEQ ID NO: 3880321 - RNA, 16 nt, Human
aguuaggauagcauuu

SEQ ID NO: 3880322 - RNA, 18 nt, Human
aguuagguuuaacauaaa

SEQ ID NO: 3880323 - RNA, 23 nt, Human
aguuagguuuaacauaaagguua

SEQ ID NO: 3880324 - RNA, 17 nt, Human
aguuagucuacucuuaa

SEQ ID NO: 3880325 - RNA, 14 nt, Human
aguuaguggaaauc

SEQ ID NO: 3880326 - RNA, 13 nt, Human
aguuaguguagau

SEQ ID NO: 3880327 - RNA, 16 nt, Human
aguuaguuaaguuggg

SEQ ID NO: 3880328 - RNA, 17 nt, Human
aguuaguuccacugaga

SEQ ID NO: 3880329 - RNA, 14 nt, Human
aguuaguuuguaua

SEQ ID NO: 3880330 - RNA, 15 nt, Human
aguuaguuuguauau

SEQ ID NO: 3880331 - RNA, 22 nt, Human
aguuaguuuguauauauuauua

SEQ ID NO: 3880332 - RNA, 18 nt, Human
aguuauaaaauuaaaagu

SEQ ID NO: 3880333 - RNA, 14 nt, Human
aguuauaagaagaa

SEQ ID NO: 3880334 - RNA, 19 nt, Human
aguuauacaguuauaaaau

SEQ ID NO: 3880335 - RNA, 20 nt, Human
aguuauacaguuauaaaauu

SEQ ID NO: 3880336 - RNA, 15 nt, Human
aguuauagaugucua

SEQ ID NO: 3880337 - RNA, 17 nt, Human
aguuauagaugucuagg

SEQ ID NO: 3880338 - RNA, 19 nt, Human
aguuauagaugucuaggua

SEQ ID NO: 3880339 - RNA, 18 nt, Human
aguuauaguuucagauau

SEQ ID NO: 3880340 - RNA, 20 nt, Human
aguuauauaauucacucaag

SEQ ID NO: 3880341 - RNA, 21 nt, Human
aguuauauagguuuuguuugc

SEQ ID NO: 3880342 - RNA, 14 nt, Human
aguuauauuuccua

SEQ ID NO: 3880343 - RNA, 16 nt, Human
aguuauauuuugcagu

SEQ ID NO: 3880344 - RNA, 16 nt, Human
aguuaucaugaauuuu

SEQ ID NO: 3880345 - RNA, 19 nt, Human
aguuaucauguuaguaaua

SEQ ID NO: 3880346 - RNA, 14 nt, Human
aguuaucuaagaau

SEQ ID NO: 3880347 - RNA, 21 nt, Human
aguuaucuaagaauacagcuu

SEQ ID NO: 3880348 - RNA, 18 nt, Human
aguuaucuguucuuuuga

SEQ ID NO: 3880349 - RNA, 18 nt, Human
aguuaucuuugaauaugu

SEQ ID NO: 3880350 - RNA, 23 nt, Human
aguuaugaacacuuaaauuauga

SEQ ID NO: 3880351 - RNA, 14 nt, Human
aguuaugauguaau

SEQ ID NO: 3880352 - RNA, 14 nt, Human
auacuacugaaaca

SEQ ID NO: 3880353 - RNA, 19 nt, Human
auacuauuaaacaugcugu

SEQ ID NO: 3880354 - RNA, 16 nt, Human
auacuauuuaagaugu

SEQ ID NO: 3880355 - RNA, 15 nt, Human
auacucagccugcug

SEQ ID NO: 3880356 - RNA, 19 nt, Human
auacucauaaugugaagug

SEQ ID NO: 3880357 - RNA, 20 nt, Human
auacucauaaugugaagugu

SEQ ID NO: 3880358 - RNA, 19 nt, Human
auacucauuucuaaaagaa

SEQ ID NO: 3880359 - RNA, 22 nt, Human
auacucauuucuaaaagaauau

SEQ ID NO: 3880360 - RNA, 16 nt, Human
auacuccaguguacau

SEQ ID NO: 3880361 - RNA, 17 nt, Human
auacuccaguguacaua

SEQ ID NO: 3880362 - RNA, 23 nt, Human
auacuccaguguacauaguguaa

SEQ ID NO: 3880363 - RNA, 11 nt, Human
auacucccauc

SEQ ID NO: 3880364 - RNA, 12 nt, Human
auacuccuuccc

SEQ ID NO: 3880365 - RNA, 18 nt, Human
auacucuaauucuaacca

SEQ ID NO: 3880366 - RNA, 23 nt, Human
auacucuagaugaaguuuuacau

SEQ ID NO: 3880367 - RNA, 15 nt, Human
auacucugucagaug

SEQ ID NO: 3880368 - RNA, 19 nt, Human
auacucuuaggaagagaaa

SEQ ID NO: 3880369 - RNA, 22 nt, Human
auacucuuaggaagagaaacca

SEQ ID NO: 3880370 - RNA, 18 nt, Human
auacucuuauagacaaca

SEQ ID NO: 3880371 - RNA, 14 nt, Human
auacucuuauaucu

SEQ ID NO: 3880372 - RNA, 22 nt, Human
auacucuuucuguauauacuuu

SEQ ID NO: 3880373 - RNA, 22 nt, Human
auacugaacaucugaguccugg

SEQ ID NO: 3880374 - RNA, 23 nt, Human
auacugaacaucugaguccugga

SEQ ID NO: 3880375 - RNA, 12 nt, Human
auacugaaggaa

SEQ ID NO: 3880376 - RNA, 13 nt, Human
auacugaaggaaa

SEQ ID NO: 3880377 - RNA, 20 nt, Human
auacugaaggaaaaacacaa

SEQ ID NO: 3880378 - RNA, 18 nt, Human
auacugagccaaguauaa

SEQ ID NO: 3880379 - RNA, 22 nt, Human
auacugagggaccaacugggcc

SEQ ID NO: 3880380 - RNA, 22 nt, Human
auacugauggaauuuuuuugua

SEQ ID NO: 3880381 - RNA, 20 nt, Human
auacugauuaugucuuuuau

SEQ ID NO: 3880382 - RNA, 16 nt, Human
auacugcacuuacaau

SEQ ID NO: 3880383 - RNA, 14 nt, Human
auacugcagggcca

SEQ ID NO: 3880384 - RNA, 18 nt, Human
auacugccagaugcugau

SEQ ID NO: 3880385 - RNA, 18 nt, Human
auacugccuuguuuaaug

SEQ ID NO: 3880386 - RNA, 20 nt, Human
auacugccuuguuuaauggu

SEQ ID NO: 3880387 - RNA, 19 nt, Human
auacugcgacuuucugccu

SEQ ID NO: 3880388 - RNA, 22 nt, Human
auacugcgacuuucugccugga

SEQ ID NO: 3880389 - RNA, 19 nt, Human
auacugcuacuguaauuuu

SEQ ID NO: 3880390 - RNA, 18 nt, Human
auacugcugagauacaua

SEQ ID NO: 3880391 - RNA, 19 nt, Human
auacugcugagauacauac

SEQ ID NO: 3880392 - RNA, 21 nt, Human
auacugcugagauacauacag

SEQ ID NO: 3880393 - RNA, 21 nt, Human
auacugcuuggagcugagcaa

SEQ ID NO: 3880394 - RNA, 14 nt, Human
auacuggaaguuuu

SEQ ID NO: 3880395 - RNA, 18 nt, Human
auacuggaaguuuugcau

SEQ ID NO: 3880396 - RNA, 16 nt, Human
auacuggacucuucaa

SEQ ID NO: 3880397 - RNA, 15 nt, Human
auacuggauuguacu

SEQ ID NO: 3880398 - RNA, 12 nt, Human
auacuggcaugc

SEQ ID NO: 3880399 - RNA, 16 nt, Human
auacuggcaugcuaaa

SEQ ID NO: 3880400 - RNA, 17 nt, Human
auacuggccucgccugg

SEQ ID NO: 3880401 - RNA, 21 nt, Human
auacuggugcagucauuauga

SEQ ID NO: 3880402 - RNA, 14 nt, Human
auacuguaaagaaa

SEQ ID NO: 3880403 - RNA, 22 nt, Human
auacuguaaagaaagagagaaa

SEQ ID NO: 3880404 - RNA, 13 nt, Human
auacuguacaaua

SEQ ID NO: 3880405 - RNA, 19 nt, Human
auacuguauauucaggacu

SEQ ID NO: 3880406 - RNA, 20 nt, Human
auacuguauuaagagugaaa

SEQ ID NO: 3880407 - RNA, 19 nt, Human
auacuguauuuuguauugu

SEQ ID NO: 3880408 - RNA, 21 nt, Human
auacugucgguuuuuuuuaaa

SEQ ID NO: 3880409 - RNA, 17 nt, Human
auacugucucuuucaug

SEQ ID NO: 3880410 - RNA, 16 nt, Human
auacugugcuggagcc

SEQ ID NO: 3880411 - RNA, 18 nt, Human
auacuguuauucuuugca

SEQ ID NO: 3880412 - RNA, 14 nt, Human
auacuguugcacgu

SEQ ID NO: 3880413 - RNA, 16 nt, Human
auacuguuugagguuu

SEQ ID NO: 3880414 - RNA, 16 nt, Human
auacuuaaaaauuuau

SEQ ID NO: 3880415 - RNA, 21 nt, Human
auacuuaaauggaaaaaauga

SEQ ID NO: 3880416 - RNA, 20 nt, Human
auacuuaaauguuauguaua

SEQ ID NO: 3880417 - RNA, 24 nt, Human
auacuuacugaacuguguguaauu

SEQ ID NO: 3880418 - RNA, 17 nt, Human
auacuuauauuucccua

SEQ ID NO: 3880419 - RNA, 15 nt, Human
auacuuaucucucug

SEQ ID NO: 3880420 - RNA, 15 nt, Human
auacuuauuuaaaua

SEQ ID NO: 3880421 - RNA, 22 nt, Human
auacuucagcucacacaugaga

SEQ ID NO: 3880422 - RNA, 17 nt, Human
auacuucauuuaaaaaa

SEQ ID NO: 3880423 - RNA, 15 nt, Human
auacuucuugugugu

SEQ ID NO: 3880424 - RNA, 18 nt, Human
auacuucuuguguguaug

SEQ ID NO: 3880425 - RNA, 15 nt, Human
auacuugaaaauuaa

SEQ ID NO: 3880426 - RNA, 14 nt, Human
auacuugaacaaaa

SEQ ID NO: 3880427 - RNA, 12 nt, Human
auacuugaacca

SEQ ID NO: 3880428 - RNA, 16 nt, Human
auacuugaagggccag

SEQ ID NO: 3880429 - RNA, 19 nt, Human
auacuugaagggccagagc

SEQ ID NO: 3880430 - RNA, 22 nt, Human
auacuugaagggccagagccag

SEQ ID NO: 3880431 - RNA, 23 nt, Human
auacuugcagcucccauucuaug

SEQ ID NO: 3880432 - RNA, 12 nt, Human
auacuugcuuug

SEQ ID NO: 3880433 - RNA, 16 nt, Human
auacuuggauuuaguu

SEQ ID NO: 3880434 - RNA, 22 nt, Human
auacuuggauuuaguuucagua

SEQ ID NO: 3880435 - RNA, 14 nt, Human
auacuuguaauuau

SEQ ID NO: 3880436 - RNA, 18 nt, Human
auacuugucaauauuuaa

SEQ ID NO: 3880437 - RNA, 17 nt, Human
auacuugucuuguucac

SEQ ID NO: 3880438 - RNA, 14 nt, Human
auacuuguggacua

SEQ ID NO: 3880439 - RNA, 15 nt, Human
auacuuguuuuugua

SEQ ID NO: 3880440 - RNA, 20 nt, Human
auacuuguuuuuguaaagaa

SEQ ID NO: 3880441 - RNA, 19 nt, Human
auacuuuaaauaauuuaac

SEQ ID NO: 3880442 - RNA, 20 nt, Human
auacuuuaaauaauuuaacu

SEQ ID NO: 3880443 - RNA, 23 nt, Human
auacuuuagaaguagaauugaca

SEQ ID NO: 3880444 - RNA, 23 nt, Human
auacuuuagugaacguggacucc

SEQ ID NO: 3880445 - RNA, 21 nt, Human
auacuuuaucaaugugucuuu

SEQ ID NO: 3880446 - RNA, 21 nt, Human
auacuuucauccugacucugc

SEQ ID NO: 3880447 - RNA, 15 nt, Human
auacuuucccuaccc

SEQ ID NO: 3880448 - RNA, 21 nt, Human
auacuuucccuacccucuaga

SEQ ID NO: 3880449 - RNA, 22 nt, Human
auacuuucccuacccucuagag

SEQ ID NO: 3880450 - RNA, 23 nt, Human
auacuuucccuacccucuagaga

SEQ ID NO: 3880451 - RNA, 24 nt, Human
auacuuucccuacccucuagagaa

SEQ ID NO: 3880452 - RNA, 18 nt, Human
auacuuugcauugucugu

SEQ ID NO: 3880453 - RNA, 14 nt, Human
auacuuuguauugu

SEQ ID NO: 3880454 - RNA, 16 nt, Human
auacuuuuacaaguaa

SEQ ID NO: 3880455 - RNA, 20 nt, Human
auacuuuuacaaguaacaaa

SEQ ID NO: 3880456 - RNA, 19 nt, Human
auacuuuuccuuaccuuua

SEQ ID NO: 3880457 - RNA, 13 nt, Human
auacuuuuucuaa

SEQ ID NO: 3880458 - RNA, 21 nt, Human
auacuuuuuuuucuuuaaaaa

SEQ ID NO: 3880459 - RNA, 16 nt, Human
auagaaaaacccugcc

SEQ ID NO: 3880460 - RNA, 14 nt, Human
auagaaaaguuauu

SEQ ID NO: 3880461 - RNA, 16 nt, Human
auagaaacaugacacu

SEQ ID NO: 3880462 - RNA, 12 nt, Human
auagaaagcauu

SEQ ID NO: 3880463 - RNA, 12 nt, Human
auagaaagcuau

SEQ ID NO: 3880464 - RNA, 17 nt, Human
auagaaaguugcaaggc

SEQ ID NO: 3880465 - RNA, 20 nt, Human
auagaaauaaauagcuauau

SEQ ID NO: 3880466 - RNA, 12 nt, Human
auagaaaugcca

SEQ ID NO: 3880467 - RNA, 22 nt, Human
auagaaaugcugguuuuucagu

SEQ ID NO: 3880468 - RNA, 22 nt, Human
auagaaaugucucaaggcaguu

SEQ ID NO: 3880469 - RNA, 17 nt, Human
auagaaauguuugcuga

SEQ ID NO: 3880470 - RNA, 15 nt, Human
auagaaauuuccaga

SEQ ID NO: 3880471 - RNA, 14 nt, Human
auagaaauuuugua

SEQ ID NO: 3880472 - RNA, 23 nt, Human
auagaaauuuuguaagaaggcaa

SEQ ID NO: 3880473 - RNA, 18 nt, Human
auagaacaacauauacaa

SEQ ID NO: 3880474 - RNA, 14 nt, Human
auagaacaaggcug

SEQ ID NO: 3880475 - RNA, 15 nt, Human
auagaacucugggcu

SEQ ID NO: 3880476 - RNA, 13 nt, Human
auagaagaaaaaa

SEQ ID NO: 3880477 - RNA, 17 nt, Human
auagaagaaaaaagaau

SEQ ID NO: 3880478 - RNA, 20 nt, Human
auagaagaauacaaacauau

SEQ ID NO: 3880479 - RNA, 23 nt, Human
auagaagaaugcaugcuuuccau

SEQ ID NO: 3880480 - RNA, 13 nt, Human
auagaagcuguag

SEQ ID NO: 3880481 - RNA, 14 nt, Human
auagaagcuguagu

SEQ ID NO: 3880482 - RNA, 19 nt, Human
auagaagucuucaugaaau

SEQ ID NO: 3880483 - RNA, 21 nt, Human
auagaagucuucaugaaaugc

SEQ ID NO: 3880484 - RNA, 23 nt, Human
auagaagucuucaugaaaugcua

SEQ ID NO: 3880485 - RNA, 16 nt, Human
auagaaguuuuaaauu

SEQ ID NO: 3880486 - RNA, 14 nt, Human
auagaauaaaauuu

SEQ ID NO: 3880487 - RNA, 22 nt, Human
auagaauaaaauuuuuaaucuu

SEQ ID NO: 3880488 - RNA, 20 nt, Human
auagaauaaaggcaguuuuc

SEQ ID NO: 3880489 - RNA, 20 nt, Human
auagaauaggcacuuuaaaa

SEQ ID NO: 3880490 - RNA, 16 nt, Human
auagaaucaaucagua

SEQ ID NO: 3880491 - RNA, 12 nt, Human
auagaaugcugc

SEQ ID NO: 3880492 - RNA, 13 nt, Human
auagaaugcugca

SEQ ID NO: 3880493 - RNA, 14 nt, Human
auagaauguaaaug

SEQ ID NO: 3880494 - RNA, 15 nt, Human
auagaauguaaaugu

SEQ ID NO: 3880495 - RNA, 20 nt, Human
auagaauuagcuuuuucauc

SEQ ID NO: 3880496 - RNA, 23 nt, Human
auauaaaauggcaacaaacugca

SEQ ID NO: 3880497 - RNA, 13 nt, Human
auauaaacacuau

SEQ ID NO: 3880498 - RNA, 12 nt, Human
auauaaacaucu

SEQ ID NO: 3880499 - RNA, 21 nt, Human
auauaaaccuaaaaaagauau

SEQ ID NO: 3880500 - RNA, 17 nt, Human
auauaaagagaaaauug

SEQ ID NO: 3880501 - RNA, 22 nt, Human
auauaaagagaaaauugaauuu

SEQ ID NO: 3880502 - RNA, 20 nt, Human
auauaaagcaucuaaacuuu

SEQ ID NO: 3880503 - RNA, 19 nt, Human
auauaaaguaguccuguga

SEQ ID NO: 3880504 - RNA, 13 nt, Human
auauaaaguauag

SEQ ID NO: 3880505 - RNA, 17 nt, Human
auauaaaguauucuuuu

SEQ ID NO: 3880506 - RNA, 22 nt, Human
auauaaaguuuuauauauuaua

SEQ ID NO: 3880507 - RNA, 19 nt, Human
auauaaauaaauauauaua

SEQ ID NO: 3880508 - RNA, 21 nt, Human
auauaaauagaauguaaaugu

SEQ ID NO: 3880509 - RNA, 22 nt, Human
auauaaauagaauguaaauguc

SEQ ID NO: 3880510 - RNA, 14 nt, Human
auauaaauauauau

SEQ ID NO: 3880511 - RNA, 16 nt, Human
auauaaauauauauuc

SEQ ID NO: 3880512 - RNA, 22 nt, Human
auauaaauauuagaaacagcuu

SEQ ID NO: 3880513 - RNA, 13 nt, Human
auauaaauauuug

SEQ ID NO: 3880514 - RNA, 17 nt, Human
auauaaaugcaaauaac

SEQ ID NO: 3880515 - RNA, 18 nt, Human
auauaaauguauaaauau

SEQ ID NO: 3880516 - RNA, 11 nt, Human
auauaaaugug

SEQ ID NO: 3880517 - RNA, 19 nt, Human
auauaaauguuaagaaaaa

SEQ ID NO: 3880518 - RNA, 22 nt, Human
auauaaauuuuuuuuguuucau

SEQ ID NO: 3880519 - RNA, 15 nt, Human
auauaacaaugcugu

SEQ ID NO: 3880520 - RNA, 12 nt, Human
auauaacacauu

SEQ ID NO: 3880521 - RNA, 14 nt, Human
auauaacacauuuu

SEQ ID NO: 3880522 - RNA, 16 nt, Human
auauaacagauacauu

SEQ ID NO: 3880523 - RNA, 11 nt, Human
auauaaccaau

SEQ ID NO: 3880524 - RNA, 23 nt, Human
auauaaccacaaagcacaguuug

SEQ ID NO: 3880525 - RNA, 12 nt, Human
auauaagaaaga

SEQ ID NO: 3880526 - RNA, 14 nt, Human
auauaagaaagaca

SEQ ID NO: 3880527 - RNA, 16 nt, Human
auauaagaaagacauc

SEQ ID NO: 3880528 - RNA, 14 nt, Human
auauaagaauaaaa

SEQ ID NO: 3880529 - RNA, 23 nt, Human
auauaagggaaguaguuaucaug

SEQ ID NO: 3880530 - RNA, 22 nt, Human
auauaaguaaagugauuaaagu

SEQ ID NO: 3880531 - RNA, 19 nt, Human
auauaaguauucuaaauuu

SEQ ID NO: 3880532 - RNA, 22 nt, Human
auauaaguauucuaaauuuuau

SEQ ID NO: 3880533 - RNA, 15 nt, Human
auauaagugauugcu

SEQ ID NO: 3880534 - RNA, 15 nt, Human
auauaagugcuguau

SEQ ID NO: 3880535 - RNA, 20 nt, Human
auauaagugcuguauaaaau

SEQ ID NO: 3880536 - RNA, 15 nt, Human
auauaaguguacaua

SEQ ID NO: 3880537 - RNA, 21 nt, Human
auauaaguuugaaggaaacag

SEQ ID NO: 3880538 - RNA, 14 nt, Human
auauaauaaaguau

SEQ ID NO: 3880539 - RNA, 19 nt, Human
auauaauacacaaaaucaa

SEQ ID NO: 3880540 - RNA, 21 nt, Human
auauaauacacaaaaucaaau

SEQ ID NO: 3880541 - RNA, 17 nt, Human
auauaauauauuugugu

SEQ ID NO: 3880542 - RNA, 17 nt, Human
auauaauaucuaaaguu

SEQ ID NO: 3880543 - RNA, 23 nt, Human
auauaauaugcacacagugcuuu

SEQ ID NO: 3880544 - RNA, 17 nt, Human
auauaaucuuucaaacc

SEQ ID NO: 3880545 - RNA, 18 nt, Human
auauaaugguuucaaaga

SEQ ID NO: 3880546 - RNA, 12 nt, Human
auauaauucugu

SEQ ID NO: 3880547 - RNA, 17 nt, Human
auauaauucuguaaaug

SEQ ID NO: 3880548 - RNA, 18 nt, Human
auauaauuguuuuuuauc

SEQ ID NO: 3880549 - RNA, 22 nt, Human
auauaauuguuuuuuaucuuuu

SEQ ID NO: 3880550 - RNA, 22 nt, Human
auauaauuuauuuccacuaaaa

SEQ ID NO: 3880551 - RNA, 15 nt, Human
auauacaaaaagaaa

SEQ ID NO: 3880552 - RNA, 14 nt, Human
auauacaauuauau

SEQ ID NO: 3880553 - RNA, 17 nt, Human
auauacacgaauagaca

SEQ ID NO: 3880554 - RNA, 22 nt, Human
auauacacgaauagacaucaaa

SEQ ID NO: 3880555 - RNA, 21 nt, Human
auauacagaugaaaauuugag

SEQ ID NO: 3880556 - RNA, 22 nt, Human
auauacagaugaaaauuugaga

SEQ ID NO: 3880557 - RNA, 15 nt, Human
auauacagcucagaa

SEQ ID NO: 3880558 - RNA, 14 nt, Human
auauacaguaacuu

SEQ ID NO: 3880559 - RNA, 17 nt, Human
auauacaguaacuuuau

SEQ ID NO: 3880560 - RNA, 23 nt, Human
auauacaguaacuuuauguguaa

SEQ ID NO: 3880561 - RNA, 13 nt, Human
auauacauacacu

SEQ ID NO: 3880562 - RNA, 16 nt, Human
auauacauacacuugu

SEQ ID NO: 3880563 - RNA, 21 nt, Human
auauacauacacuuguauaaa

SEQ ID NO: 3880564 - RNA, 18 nt, Human
auauacauacugcaucuu

SEQ ID NO: 3880565 - RNA, 19 nt, Human
auauacaugaaaauuuuaa

SEQ ID NO: 3880566 - RNA, 14 nt, Human
auauacaugugugu

SEQ ID NO: 3880567 - RNA, 15 nt, Human
auauacaugugugua

SEQ ID NO: 3880568 - RNA, 16 nt, Human
auauacauguguguau

SEQ ID NO: 3880569 - RNA, 17 nt, Human
auauacauguguguaua

SEQ ID NO: 3880570 - RNA, 15 nt, Human
auauacauguuuaug

SEQ ID NO: 3880571 - RNA, 16 nt, Human
auauacauguuuaugu

SEQ ID NO: 3880572 - RNA, 23 nt, Human
auauacauuuuuagccuguguca

SEQ ID NO: 3880573 - RNA, 22 nt, Human
auauaccacucuuuaccuuuau

SEQ ID NO: 3880574 - RNA, 15 nt, Human
auauaccuauaaugu

SEQ ID NO: 3880575 - RNA, 20 nt, Human
auauaccuauaaugugugua

SEQ ID NO: 3880576 - RNA, 19 nt, Human
auauacucacuuucuagau

SEQ ID NO: 3880577 - RNA, 22 nt, Human
auauacucuagaugaaguuuua

SEQ ID NO: 3880578 - RNA, 10 nt, Human
auauacugua

SEQ ID NO: 3880579 - RNA, 11 nt, Human
auauacuguaa

SEQ ID NO: 3880580 - RNA, 13 nt, Human
auauacuguaaag

SEQ ID NO: 3880581 - RNA, 15 nt, Human
auauacuguaaagaa

SEQ ID NO: 3880582 - RNA, 20 nt, Human
auauacuguaaagaaagaga

SEQ ID NO: 3880583 - RNA, 24 nt, Human
auauacuguaaagaaagagagaaa

SEQ ID NO: 3880584 - RNA, 15 nt, Human
auauacuuguggacu

SEQ ID NO: 3880585 - RNA, 20 nt, Human
auauacuuugaaaggagaug

SEQ ID NO: 3880586 - RNA, 18 nt, Human
auauacuuuuacaaguaa

SEQ ID NO: 3880587 - RNA, 11 nt, Human
auauacuuuuu

SEQ ID NO: 3880588 - RNA, 22 nt, Human
auauacuuuuuucuuauuuaac

SEQ ID NO: 3880589 - RNA, 15 nt, Human
auauagaacagugcu

SEQ ID NO: 3880590 - RNA, 22 nt, Human
auauagagauguuuuuaaaagu

SEQ ID NO: 3880591 - RNA, 17 nt, Human
auauagagucauuguaa

SEQ ID NO: 3880592 - RNA, 23 nt, Human
auauagaucaguuauaaguagca

SEQ ID NO: 3880593 - RNA, 18 nt, Human
auauagauuauaacuugu

SEQ ID NO: 3880594 - RNA, 18 nt, Human
auauagcauuuaugguaa

SEQ ID NO: 3880595 - RNA, 20 nt, Human
auauagcauuuaugguaauc

SEQ ID NO: 3880596 - RNA, 18 nt, Human
auauagcguucccaacaa

SEQ ID NO: 3880597 - RNA, 19 nt, Human
auauagcuggcaagaaugg

SEQ ID NO: 3880598 - RNA, 15 nt, Human
auauagcuguacaaa

SEQ ID NO: 3880599 - RNA, 18 nt, Human
auauagcuguacaaauau

SEQ ID NO: 3880600 - RNA, 19 nt, Human
auauagcuguacaaauaua

SEQ ID NO: 3880601 - RNA, 16 nt, Human
auauagguugugcaaa

SEQ ID NO: 3880602 - RNA, 19 nt, Human
auauagguuucuauucuug

SEQ ID NO: 3880603 - RNA, 14 nt, Human
auauagguuuuguu

SEQ ID NO: 3880604 - RNA, 20 nt, Human
auauagguuuuguuugcuau

SEQ ID NO: 3880605 - RNA, 23 nt, Human
auauagguuuuguuugcuaucuu

SEQ ID NO: 3880606 - RNA, 18 nt, Human
auauagugcuauauauau

SEQ ID NO: 3880607 - RNA, 22 nt, Human
auauaguuccuaagaagcuucu

SEQ ID NO: 3880608 - RNA, 12 nt, Human
auauaguuuuac

SEQ ID NO: 3880609 - RNA, 16 nt, Human
auauaguuuuacuuuu

SEQ ID NO: 3880610 - RNA, 18 nt, Human
auauaguuuuacuuuuaa

SEQ ID NO: 3880611 - RNA, 21 nt, Human
auauaguuuuuaccuuuuaug

SEQ ID NO: 3880612 - RNA, 10 nt, Human
auauauaaaa

SEQ ID NO: 3880613 - RNA, 19 nt, Human
auauauaaaaagaaaagau

SEQ ID NO: 3880614 - RNA, 21 nt, Human
auauauaaaaagaaaagauaa

SEQ ID NO: 3880615 - RNA, 19 nt, Human
auauauaaagaauauauau

SEQ ID NO: 3880616 - RNA, 18 nt, Human
auauauaaaguauagaga

SEQ ID NO: 3880617 - RNA, 12 nt, Human
auauauaaauaa

SEQ ID NO: 3880618 - RNA, 13 nt, Human
auauauaaauaua

SEQ ID NO: 3880619 - RNA, 19 nt, Human
auauauaaauauauuauua

SEQ ID NO: 3880620 - RNA, 12 nt, Human
auauauaaccag

SEQ ID NO: 3880621 - RNA, 13 nt, Human
auauauaaccagu

SEQ ID NO: 3880622 - RNA, 13 nt, Human
auauauaagaaag

SEQ ID NO: 3880623 - RNA, 18 nt, Human
auauauaagaaagacauc

SEQ ID NO: 3880624 - RNA, 23 nt, Human
auauauaagcucagauuauuuaa

SEQ ID NO: 3880625 - RNA, 15 nt, Human
auauauaaguguaca

SEQ ID NO: 3880626 - RNA, 16 nt, Human
auauauaaguguacau

SEQ ID NO: 3880627 - RNA, 13 nt, Human
auauauacacaca

SEQ ID NO: 3880628 - RNA, 15 nt, Human
auauauacacacaca

SEQ ID NO: 3880629 - RNA, 23 nt, Human
auauauacaguaacuuuaugugu

SEQ ID NO: 3880630 - RNA, 18 nt, Human
auauauacauacacuugu

SEQ ID NO: 3880631 - RNA, 14 nt, Human
auauauacauauau

SEQ ID NO: 3880632 - RNA, 14 nt, Human
auauauacauaugu

SEQ ID NO: 3880633 - RNA, 18 nt, Human
auauauacuuaagaauau

SEQ ID NO: 3880634 - RNA, 18 nt, Human
auauauagaaauauauac

SEQ ID NO: 3880635 - RNA, 16 nt, Human
auauauagugcuauau

SEQ ID NO: 3880636 - RNA, 11 nt, Human
auauauauaaa

SEQ ID NO: 3880637 - RNA, 14 nt, Human
auauauauaaaccu

SEQ ID NO: 3880638 - RNA, 13 nt, Human
auauauauaaaga

SEQ ID NO: 3880639 - RNA, 15 nt, Human
auauauauaaaugua

SEQ ID NO: 3880640 - RNA, 13 nt, Human
auauauauacaca

SEQ ID NO: 3880641 - RNA, 22 nt, Human
auauguguuuuucacauuugcg

SEQ ID NO: 3880642 - RNA, 16 nt, Human
auauguuaauuugugu

SEQ ID NO: 3880643 - RNA, 17 nt, Human
auauguuauuuuaaaca

SEQ ID NO: 3880644 - RNA, 12 nt, Human
auauguucaacu

SEQ ID NO: 3880645 - RNA, 15 nt, Human
auauguucaacugga

SEQ ID NO: 3880646 - RNA, 16 nt, Human
auauguugaauacuuu

SEQ ID NO: 3880647 - RNA, 18 nt, Human
auauguugaauacuuuuu

SEQ ID NO: 3880648 - RNA, 14 nt, Human
auauguugaugaaa

SEQ ID NO: 3880649 - RNA, 24 nt, Human
auauguuuaccuuuuaauuaauga

SEQ ID NO: 3880650 - RNA, 17 nt, Human
auauguuuccuucccuc

SEQ ID NO: 3880651 - RNA, 17 nt, Human
auauguuuuaaauauag

SEQ ID NO: 3880652 - RNA, 20 nt, Human
auauguuuuaagaggcaggg

SEQ ID NO: 3880653 - RNA, 17 nt, Human
auauguuuuuaaaggug

SEQ ID NO: 3880654 - RNA, 13 nt, Human
auauuaaaaaguc

SEQ ID NO: 3880655 - RNA, 16 nt, Human
auauuaaaaauauaaa

SEQ ID NO: 3880656 - RNA, 17 nt, Human
auauuaaaaauauaaaa

SEQ ID NO: 3880657 - RNA, 15 nt, Human
auauuaaaaauggua

SEQ ID NO: 3880658 - RNA, 16 nt, Human
auauuaaaaaugguaa

SEQ ID NO: 3880659 - RNA, 20 nt, Human
auauuaaaaaugguaaaauu

SEQ ID NO: 3880660 - RNA, 22 nt, Human
auauuaaaauuccaaauucaug

SEQ ID NO: 3880661 - RNA, 18 nt, Human
auauuaaacaaaguuuca

SEQ ID NO: 3880662 - RNA, 22 nt, Human
auauuaaacaaaguuucagagu

SEQ ID NO: 3880663 - RNA, 22 nt, Human
auauuaaagagaaagcccgcuu

SEQ ID NO: 3880664 - RNA, 14 nt, Human
auauuaaagccaug

SEQ ID NO: 3880665 - RNA, 23 nt, Human
auauuaaagccauguuuauuaca

SEQ ID NO: 3880666 - RNA, 14 nt, Human
auauuaaaggaguu

SEQ ID NO: 3880667 - RNA, 13 nt, Human
auauuaaaucugc

SEQ ID NO: 3880668 - RNA, 16 nt, Human
auauuaagaaagacua

SEQ ID NO: 3880669 - RNA, 14 nt, Human
auauuaagaaugau

SEQ ID NO: 3880670 - RNA, 17 nt, Human
auauuaagaaugaucug

SEQ ID NO: 3880671 - RNA, 23 nt, Human
auauuaagcaugacagaaaauau

SEQ ID NO: 3880672 - RNA, 14 nt, Human
auauuaaugccuuu

SEQ ID NO: 3880673 - RNA, 15 nt, Human
auauuaaugccuuua

SEQ ID NO: 3880674 - RNA, 17 nt, Human
auauuaaugccuuuaaa

SEQ ID NO: 3880675 - RNA, 23 nt, Human
auauuaaugccuuuaaaguauga

SEQ ID NO: 3880676 - RNA, 21 nt, Human
auauuaauuuucuacaaauaa

SEQ ID NO: 3880677 - RNA, 13 nt, Human
auauuacaauauu

SEQ ID NO: 3880678 - RNA, 15 nt, Human
auauuacaauauuug

SEQ ID NO: 3880679 - RNA, 15 nt, Human
auauuacacauuugu

SEQ ID NO: 3880680 - RNA, 21 nt, Human
auauuaccuaaugaaagugau

SEQ ID NO: 3880681 - RNA, 21 nt, Human
auauuacuccuauuuuuguaa

SEQ ID NO: 3880682 - RNA, 21 nt, Human
auauuacuguacaugggacua

SEQ ID NO: 3880683 - RNA, 18 nt, Human
auauuacuguuuauuucu

SEQ ID NO: 3880684 - RNA, 20 nt, Human
auauuacuguuuauuucugu

SEQ ID NO: 3880685 - RNA, 12 nt, Human
auauuacuuuau

SEQ ID NO: 3880686 - RNA, 13 nt, Human
auauuacuuuauc

SEQ ID NO: 3880687 - RNA, 14 nt, Human
auauuacuuuauca

SEQ ID NO: 3880688 - RNA, 17 nt, Human
auauuacuuuaucacuu

SEQ ID NO: 3880689 - RNA, 16 nt, Human
auauuagaaaacuuug

SEQ ID NO: 3880690 - RNA, 17 nt, Human
auauuagaaaacuuugu

SEQ ID NO: 3880691 - RNA, 18 nt, Human
auauuagaaaacuuuguu

SEQ ID NO: 3880692 - RNA, 20 nt, Human
auauuagacuucuguuuuca

SEQ ID NO: 3880693 - RNA, 19 nt, Human
auauuagcgacaacagauu

SEQ ID NO: 3880694 - RNA, 22 nt, Human
auauuagcgacaacagauugga

SEQ ID NO: 3880695 - RNA, 20 nt, Human
auauuagcuuuacuguuugu

SEQ ID NO: 3880696 - RNA, 21 nt, Human
auauuagcuuuacuguuuguu

SEQ ID NO: 3880697 - RNA, 15 nt, Human
auauuaguauguaug

SEQ ID NO: 3880698 - RNA, 13 nt, Human
auauuauaaagga

SEQ ID NO: 3880699 - RNA, 20 nt, Human
auauuauacuaagaaaagau

SEQ ID NO: 3880700 - RNA, 16 nt, Human
auauuauacuuguaau

SEQ ID NO: 3880701 - RNA, 19 nt, Human
auauuauacuuguaauuau

SEQ ID NO: 3880702 - RNA, 14 nt, Human
auauuauagagagu

SEQ ID NO: 3880703 - RNA, 13 nt, Human
auauuauaucaga

SEQ ID NO: 3880704 - RNA, 13 nt, Human
auauuauauggaa

SEQ ID NO: 3880705 - RNA, 12 nt, Human
auauuauauuug

SEQ ID NO: 3880706 - RNA, 15 nt, Human
auauuauauuuggau

SEQ ID NO: 3880707 - RNA, 14 nt, Human
auauuauguuaaaa

SEQ ID NO: 3880708 - RNA, 19 nt, Human
auauuauuacuuguaaaua

SEQ ID NO: 3880709 - RNA, 13 nt, Human
auauuauuagaaa

SEQ ID NO: 3880710 - RNA, 19 nt, Human
auauuauuauaaucuuaua

SEQ ID NO: 3880711 - RNA, 23 nt, Human
auauuauuauaaucuuauaauug

SEQ ID NO: 3880712 - RNA, 19 nt, Human
auauuauuccucaaaaaau

SEQ ID NO: 3880713 - RNA, 19 nt, Human
auauuauuuggcaguuugg

SEQ ID NO: 3880714 - RNA, 21 nt, Human
auauuauuuggcaguuuggua

SEQ ID NO: 3880715 - RNA, 12 nt, Human
auauucaaccau

SEQ ID NO: 3880716 - RNA, 21 nt, Human
auauucaaccauggacuuuau

SEQ ID NO: 3880717 - RNA, 20 nt, Human
auauucaacucauaagacuu

SEQ ID NO: 3880718 - RNA, 15 nt, Human
auauucaauaaagcu

SEQ ID NO: 3880719 - RNA, 15 nt, Human
auauucacacuugaa

SEQ ID NO: 3880720 - RNA, 16 nt, Human
auauucacacuugaac

SEQ ID NO: 3880721 - RNA, 19 nt, Human
auauucagaaucuuuguua

SEQ ID NO: 3880722 - RNA, 17 nt, Human
auauucagaauuaugau

SEQ ID NO: 3880723 - RNA, 16 nt, Human
auauucagacaaaaug

SEQ ID NO: 3880724 - RNA, 12 nt, Human
auauucauauug

SEQ ID NO: 3880725 - RNA, 19 nt, Human
auauucauauuggaaaaau

SEQ ID NO: 3880726 - RNA, 20 nt, Human
auauucaugcuucuuccuua

SEQ ID NO: 3880727 - RNA, 22 nt, Human
auauucauguaaacaaaauuua

SEQ ID NO: 3880728 - RNA, 17 nt, Human
auauucauucuuuuuga

SEQ ID NO: 3880729 - RNA, 14 nt, Human
auauucauuguaua

SEQ ID NO: 3880730 - RNA, 13 nt, Human
auauucauuugga

SEQ ID NO: 3880731 - RNA, 20 nt, Human
auauuccagguuuaaguaga

SEQ ID NO: 3880732 - RNA, 12 nt, Human
auauuccauagu

SEQ ID NO: 3880733 - RNA, 18 nt, Human
auauuccauauauuagca

SEQ ID NO: 3880734 - RNA, 18 nt, Human
auauuccccuaucucuag

SEQ ID NO: 3880735 - RNA, 17 nt, Human
auauucccuagaaacuu

SEQ ID NO: 3880736 - RNA, 15 nt, Human
auauuccugaaugaa

SEQ ID NO: 3880737 - RNA, 18 nt, Human
auauuccugaaugaaaua

SEQ ID NO: 3880738 - RNA, 23 nt, Human
auauuccugaaugaaauaucaga

SEQ ID NO: 3880739 - RNA, 20 nt, Human
auauuccuuucuaucauuuu

SEQ ID NO: 3880740 - RNA, 12 nt, Human
auauuccuuuga

SEQ ID NO: 3880741 - RNA, 13 nt, Human
auauucuaagacu

SEQ ID NO: 3880742 - RNA, 19 nt, Human
auauucuaguaauaaagac

SEQ ID NO: 3880743 - RNA, 20 nt, Human
auauucuauaugaauuuaaa

SEQ ID NO: 3880744 - RNA, 23 nt, Human
auauucuauuuucauuuucugca

SEQ ID NO: 3880745 - RNA, 17 nt, Human
auauucucagcagagug

SEQ ID NO: 3880746 - RNA, 23 nt, Human
auauucuggagucaucauucccu

SEQ ID NO: 3880747 - RNA, 22 nt, Human
auauucuuccuggggcccaaau

SEQ ID NO: 3880748 - RNA, 13 nt, Human
auauucuugucaa

SEQ ID NO: 3880749 - RNA, 13 nt, Human
auauugaaaaaaa

SEQ ID NO: 3880750 - RNA, 16 nt, Human
auauugaaaauugaaa

SEQ ID NO: 3880751 - RNA, 20 nt, Human
auauugaacuuuuguacuga

SEQ ID NO: 3880752 - RNA, 16 nt, Human
auauugaagacaauuu

SEQ ID NO: 3880753 - RNA, 20 nt, Human
auauugaagacaauuugaua

SEQ ID NO: 3880754 - RNA, 21 nt, Human
auauugaauauaauauauuug

SEQ ID NO: 3880755 - RNA, 12 nt, Human
auauugaauguu

SEQ ID NO: 3880756 - RNA, 15 nt, Human
auauugacauuugua

SEQ ID NO: 3880757 - RNA, 16 nt, Human
auauugacauuuguag

SEQ ID NO: 3880758 - RNA, 20 nt, Human
auauugacauuuguaguuga

SEQ ID NO: 3880759 - RNA, 16 nt, Human
auauugagacaaaaau

SEQ ID NO: 3880760 - RNA, 20 nt, Human
auauugagacaaaaauuauc

SEQ ID NO: 3880761 - RNA, 14 nt, Human
auauugagcaauau

SEQ ID NO: 3880762 - RNA, 22 nt, Human
auauugaggcuuuguguuguaa

SEQ ID NO: 3880763 - RNA, 17 nt, Human
auauugagucaaauggu

SEQ ID NO: 3880764 - RNA, 15 nt, Human
auauugauccagaaa

SEQ ID NO: 3880765 - RNA, 13 nt, Human
auauugauuuauu

SEQ ID NO: 3880766 - RNA, 16 nt, Human
auauugcaaaauacau

SEQ ID NO: 3880767 - RNA, 23 nt, Human
auauugcaaaauacaugaagcuu

SEQ ID NO: 3880768 - RNA, 22 nt, Human
auauugcauacuauuaaacaug

SEQ ID NO: 3880769 - RNA, 16 nt, Human
auauugcauaugcaua

SEQ ID NO: 3880770 - RNA, 19 nt, Human
auauugcugaagaaucuac

SEQ ID NO: 3880771 - RNA, 22 nt, Human
auauugcugauggugcaaugac

SEQ ID NO: 3880772 - RNA, 17 nt, Human
auauugcuucuucuccu

SEQ ID NO: 3880773 - RNA, 16 nt, Human
auauugcuuuuucuaa

SEQ ID NO: 3880774 - RNA, 15 nt, Human
auauuggaaaaauca

SEQ ID NO: 3880775 - RNA, 12 nt, Human
auauuggaacuu

SEQ ID NO: 3880776 - RNA, 17 nt, Human
auauuggcauggauuuc

SEQ ID NO: 3880777 - RNA, 17 nt, Human
auauuggccaaggaaag

SEQ ID NO: 3880778 - RNA, 15 nt, Human
auauugguauucacu

SEQ ID NO: 3880779 - RNA, 12 nt, Human
auauugguuuua

SEQ ID NO: 3880780 - RNA, 19 nt, Human
auauugguuuuaugaugac

SEQ ID NO: 3880781 - RNA, 13 nt, Human
auauuguaagaaa

SEQ ID NO: 3880782 - RNA, 13 nt, Human
auauuguacaguu

SEQ ID NO: 3880783 - RNA, 14 nt, Human
auauuguacaguuu

SEQ ID NO: 3880784 - RNA, 21 nt, Human
auauuguacauaaaagaauuu

SEQ ID NO: 3880785 - RNA, 18 nt, Human
auauuguauuacuagaag

SEQ ID NO: 3880786 - RNA, 23 nt, Human
aucugaaaauguauguguaagua

SEQ ID NO: 3880787 - RNA, 13 nt, Human
aucugaaauucua

SEQ ID NO: 3880788 - RNA, 13 nt, Human
aucugaagauugu

SEQ ID NO: 3880789 - RNA, 18 nt, Human
aucugaagcccucccagg

SEQ ID NO: 3880790 - RNA, 20 nt, Human
aucugaagcuucacucacug

SEQ ID NO: 3880791 - RNA, 15 nt, Human
aucugaaggagauuu

SEQ ID NO: 3880792 - RNA, 21 nt, Human
aucugaaggggcaaauucuuu

SEQ ID NO: 3880793 - RNA, 23 nt, Human
aucugaaggggcaaauucuuuug

SEQ ID NO: 3880794 - RNA, 16 nt, Human
aucugaagucagaucu

SEQ ID NO: 3880795 - RNA, 21 nt, Human
aucugaauaaaguguaacaau

SEQ ID NO: 3880796 - RNA, 16 nt, Human
aucugaauuggaaugc

SEQ ID NO: 3880797 - RNA, 14 nt, Human
aucugaauuuuuaa

SEQ ID NO: 3880798 - RNA, 18 nt, Human
aucugaauuuuuaaacaa

SEQ ID NO: 3880799 - RNA, 13 nt, Human
aucugacacaaaa

SEQ ID NO: 3880800 - RNA, 14 nt, Human
aucugacaucccca

SEQ ID NO: 3880801 - RNA, 15 nt, Human
aucugacaucucugc

SEQ ID NO: 3880802 - RNA, 23 nt, Human
aucugacaugauuccuuccuguu

SEQ ID NO: 3880803 - RNA, 14 nt, Human
aucugacccagugc

SEQ ID NO: 3880804 - RNA, 14 nt, Human
aucugacuaugaca

SEQ ID NO: 3880805 - RNA, 17 nt, Human
aucugacuaugacauaa

SEQ ID NO: 3880806 - RNA, 13 nt, Human
aucugagaaucuu

SEQ ID NO: 3880807 - RNA, 17 nt, Human
aucugagcaagagcugg

SEQ ID NO: 3880808 - RNA, 22 nt, Human
aucugaggaaucaacagggcag

SEQ ID NO: 3880809 - RNA, 18 nt, Human
aucugaggaauucuguau

SEQ ID NO: 3880810 - RNA, 21 nt, Human
aucugaggaauucuguauaga

SEQ ID NO: 3880811 - RNA, 23 nt, Human
aucugaggcauccagcagucucu

SEQ ID NO: 3880812 - RNA, 21 nt, Human
aucugagggaggaggccaccu

SEQ ID NO: 3880813 - RNA, 16 nt, Human
aucugagucagagcca

SEQ ID NO: 3880814 - RNA, 14 nt, Human
aucugaguccugga

SEQ ID NO: 3880815 - RNA, 17 nt, Human
aucugaguccuggauga

SEQ ID NO: 3880816 - RNA, 13 nt, Human
aucugaguugcca

SEQ ID NO: 3880817 - RNA, 14 nt, Human
aucugaguugccaa

SEQ ID NO: 3880818 - RNA, 17 nt, Human
aucugaucugagugaga

SEQ ID NO: 3880819 - RNA, 19 nt, Human
aucugauggccuuaauuuc

SEQ ID NO: 3880820 - RNA, 21 nt, Human
aucugauggccuuaauuuccu

SEQ ID NO: 3880821 - RNA, 18 nt, Human
aucugauggcuucuccag

SEQ ID NO: 3880822 - RNA, 19 nt, Human
aucugauuggacauuuucu

SEQ ID NO: 3880823 - RNA, 21 nt, Human
aucugauuugcauauucauuc

SEQ ID NO: 3880824 - RNA, 21 nt, Human
aucugcaaaaggccucuugua

SEQ ID NO: 3880825 - RNA, 21 nt, Human
aucugcaaagcauguuuugca

SEQ ID NO: 3880826 - RNA, 18 nt, Human
aucugcaauuucuacuac

SEQ ID NO: 3880827 - RNA, 23 nt, Human
aucugcaccccuucucuccuccc

SEQ ID NO: 3880828 - RNA, 12 nt, Human
aucugcacccuu

SEQ ID NO: 3880829 - RNA, 19 nt, Human
aucugcacccuucuuuucu

SEQ ID NO: 3880830 - RNA, 13 nt, Human
aucugcagaagga

SEQ ID NO: 3880831 - RNA, 16 nt, Human
aucugcagucacuucg

SEQ ID NO: 3880832 - RNA, 16 nt, Human
aucugcauugcccagu

SEQ ID NO: 3880833 - RNA, 21 nt, Human
aucugcauugcccagucuuuc

SEQ ID NO: 3880834 - RNA, 22 nt, Human
aucugcauugcccagucuuuca

SEQ ID NO: 3880835 - RNA, 11 nt, Human
aucugcauuua

SEQ ID NO: 3880836 - RNA, 17 nt, Human
aucugcauuuagcacaa

SEQ ID NO: 3880837 - RNA, 19 nt, Human
aucugcauuuucaccccac

SEQ ID NO: 3880838 - RNA, 23 nt, Human
aucugcauuuucaccccacccuu

SEQ ID NO: 3880839 - RNA, 23 nt, Human
aucugcauuuucuggguucuggg

SEQ ID NO: 3880840 - RNA, 16 nt, Human
aucugccaagggccga

SEQ ID NO: 3880841 - RNA, 21 nt, Human
aucugcccaacuguguagcau

SEQ ID NO: 3880842 - RNA, 13 nt, Human
aucugcccagggg

SEQ ID NO: 3880843 - RNA, 11 nt, Human
aucugccccuc

SEQ ID NO: 3880844 - RNA, 14 nt, Human
aucugccccucccu

SEQ ID NO: 3880845 - RNA, 13 nt, Human
aucugcccgccug

SEQ ID NO: 3880846 - RNA, 17 nt, Human
aucugcccgccugccca

SEQ ID NO: 3880847 - RNA, 18 nt, Human
aucugcccgccugcccac

SEQ ID NO: 3880848 - RNA, 19 nt, Human
aucugcccgccugcccacc

SEQ ID NO: 3880849 - RNA, 11 nt, Human
aucugccuaag

SEQ ID NO: 3880850 - RNA, 13 nt, Human
aucugccuaagga

SEQ ID NO: 3880851 - RNA, 16 nt, Human
aucugccuaaggacuu

SEQ ID NO: 3880852 - RNA, 19 nt, Human
aucugccuaaggacuucuu

SEQ ID NO: 3880853 - RNA, 23 nt, Human
aucugccuaaggacuucuuuaau

SEQ ID NO: 3880854 - RNA, 12 nt, Human
aucugccucccu

SEQ ID NO: 3880855 - RNA, 18 nt, Human
aucugccucucuuguaau

SEQ ID NO: 3880856 - RNA, 12 nt, Human
aucugccugggu

SEQ ID NO: 3880857 - RNA, 18 nt, Human
aucugccuuaaaaccaaa

SEQ ID NO: 3880858 - RNA, 19 nt, Human
aucugccuuaaaaccaaag

SEQ ID NO: 3880859 - RNA, 23 nt, Human
aucugcggaucucagcuuugaga

SEQ ID NO: 3880860 - RNA, 18 nt, Human
aucugcgggggcagugcu

SEQ ID NO: 3880861 - RNA, 19 nt, Human
aucugcgggggcagugcuc

SEQ ID NO: 3880862 - RNA, 23 nt, Human
aucugcgggggcagugcucaccc

SEQ ID NO: 3880863 - RNA, 13 nt, Human
aucugcucacuuu

SEQ ID NO: 3880864 - RNA, 15 nt, Human
aucugcucuccuucc

SEQ ID NO: 3880865 - RNA, 16 nt, Human
aucugcucuccuuccu

SEQ ID NO: 3880866 - RNA, 20 nt, Human
aucugcucuccuuccuggag

SEQ ID NO: 3880867 - RNA, 14 nt, Human
aucugcuggaguuu

SEQ ID NO: 3880868 - RNA, 22 nt, Human
aucugcuguccagacagccugu

SEQ ID NO: 3880869 - RNA, 19 nt, Human
aucugcuuacaauucccug

SEQ ID NO: 3880870 - RNA, 21 nt, Human
aucugcuuacaauucccugcu

SEQ ID NO: 3880871 - RNA, 16 nt, Human
aucugcuuuuauuaaa

SEQ ID NO: 3880872 - RNA, 19 nt, Human
aucuggaaccucagccugg

SEQ ID NO: 3880873 - RNA, 13 nt, Human
aucuggaagagcu

SEQ ID NO: 3880874 - RNA, 20 nt, Human
aucuggaaggggaucccacc

SEQ ID NO: 3880875 - RNA, 21 nt, Human
aucuggaauugguuuagccca

SEQ ID NO: 3880876 - RNA, 22 nt, Human
aucuggaccccaucugugaaua

SEQ ID NO: 3880877 - RNA, 16 nt, Human
aucuggacuccucugu

SEQ ID NO: 3880878 - RNA, 19 nt, Human
aucuggagagcccagaguc

SEQ ID NO: 3880879 - RNA, 22 nt, Human
aucuggagagcuagaaccugga

SEQ ID NO: 3880880 - RNA, 23 nt, Human
aucuggagagcuagaaccuggag

SEQ ID NO: 3880881 - RNA, 17 nt, Human
aucuggaggccuuccag

SEQ ID NO: 3880882 - RNA, 17 nt, Human
aucuggauaggagccug

SEQ ID NO: 3880883 - RNA, 16 nt, Human
aucuggcaacaucuuu

SEQ ID NO: 3880884 - RNA, 20 nt, Human
aucuggcccucgacacucac

SEQ ID NO: 3880885 - RNA, 13 nt, Human
aucuggccuggcc

SEQ ID NO: 3880886 - RNA, 14 nt, Human
aucuggccuggcca

SEQ ID NO: 3880887 - RNA, 16 nt, Human
aucuggccuggccagu

SEQ ID NO: 3880888 - RNA, 15 nt, Human
aucuggccuggccug

SEQ ID NO: 3880889 - RNA, 23 nt, Human
aucuggccuggccuggcccugcc

SEQ ID NO: 3880890 - RNA, 16 nt, Human
aucuggcuuauuuuaa

SEQ ID NO: 3880891 - RNA, 12 nt, Human
aucuggcuucug

SEQ ID NO: 3880892 - RNA, 20 nt, Human
aucuggcuucuggccaggaa

SEQ ID NO: 3880893 - RNA, 22 nt, Human
aucuggcuucuggccaggaagc

SEQ ID NO: 3880894 - RNA, 22 nt, Human
aucugggaaaauaccccaucau

SEQ ID NO: 3880895 - RNA, 19 nt, Human
aucugggaacucccaagaa

SEQ ID NO: 3880896 - RNA, 22 nt, Human
aucugggacccuuuccuuccuu

SEQ ID NO: 3880897 - RNA, 15 nt, Human
aucugggccagaauu

SEQ ID NO: 3880898 - RNA, 14 nt, Human
aucugggccugggc

SEQ ID NO: 3880899 - RNA, 16 nt, Human
aucugggccugggcua

SEQ ID NO: 3880900 - RNA, 15 nt, Human
aucugggccuuggcc

SEQ ID NO: 3880901 - RNA, 22 nt, Human
aucugggcuccuaaccuuccug

SEQ ID NO: 3880902 - RNA, 18 nt, Human
aucugggcuuccuggagc

SEQ ID NO: 3880903 - RNA, 16 nt, Human
aucuggggagcaggca

SEQ ID NO: 3880904 - RNA, 23 nt, Human
aucuggggagcaggcagccagca

SEQ ID NO: 3880905 - RNA, 22 nt, Human
aucuggggcagcacccuauaaa

SEQ ID NO: 3880906 - RNA, 16 nt, Human
aucuggggcucuggga

SEQ ID NO: 3880907 - RNA, 18 nt, Human
aucuggguccuugcaccc

SEQ ID NO: 3880908 - RNA, 15 nt, Human
aucugggucucuaau

SEQ ID NO: 3880909 - RNA, 18 nt, Human
aucugggugcaugaucuu

SEQ ID NO: 3880910 - RNA, 19 nt, Human
aucuggguucacugcaacc

SEQ ID NO: 3880911 - RNA, 15 nt, Human
aucugguauuaaaug

SEQ ID NO: 3880912 - RNA, 16 nt, Human
aucugguauuaaaugc

SEQ ID NO: 3880913 - RNA, 18 nt, Human
aucugguccuacccaucc

SEQ ID NO: 3880914 - RNA, 18 nt, Human
aucuggucuuguuagaaa

SEQ ID NO: 3880915 - RNA, 21 nt, Human
aucugguuuauuuuuguucca

SEQ ID NO: 3880916 - RNA, 13 nt, Human
aucugguuuucuc

SEQ ID NO: 3880917 - RNA, 13 nt, Human
aucuguaaacugu

SEQ ID NO: 3880918 - RNA, 22 nt, Human
aucuguaaacuguguauuccaa

SEQ ID NO: 3880919 - RNA, 16 nt, Human
aucuguacauuuuguu

SEQ ID NO: 3880920 - RNA, 20 nt, Human
aucuguacauuuuguuguaa

SEQ ID NO: 3880921 - RNA, 23 nt, Human
aucuguacauuuuguuguaaaaa

SEQ ID NO: 3880922 - RNA, 14 nt, Human
aucuguagggcugg

SEQ ID NO: 3880923 - RNA, 17 nt, Human
aucuguauaaguaagaa

SEQ ID NO: 3880924 - RNA, 15 nt, Human
aucuguauaauacuu

SEQ ID NO: 3880925 - RNA, 16 nt, Human
aucuguauaauacuuu

SEQ ID NO: 3880926 - RNA, 20 nt, Human
aucuguauaauacuuuguau

SEQ ID NO: 3880927 - RNA, 21 nt, Human
aucuguauaauacuuuguaua

SEQ ID NO: 3880928 - RNA, 22 nt, Human
aucuguauauaaaauauuuuca

SEQ ID NO: 3880929 - RNA, 21 nt, Human
aucuguauauacaauaacaua

SEQ ID NO: 3880930 - RNA, 14 nt, Human
auguacuauaacau

SEQ ID NO: 3880931 - RNA, 16 nt, Human
auguacucuacugaua

SEQ ID NO: 3880932 - RNA, 19 nt, Human
auguacugauuucaguaag

SEQ ID NO: 3880933 - RNA, 11 nt, Human
auguacuguac

SEQ ID NO: 3880934 - RNA, 16 nt, Human
auguacuguacuaauu

SEQ ID NO: 3880935 - RNA, 17 nt, Human
auguacuguacuaauuc

SEQ ID NO: 3880936 - RNA, 16 nt, Human
auguacuucaugcugu

SEQ ID NO: 3880937 - RNA, 16 nt, Human
auguacuugucaaaga

SEQ ID NO: 3880938 - RNA, 17 nt, Human
auguacuugucaaagaa

SEQ ID NO: 3880939 - RNA, 19 nt, Human
auguacuuguuucucuguu

SEQ ID NO: 3880940 - RNA, 20 nt, Human
auguacuuuuauuuuacaca

SEQ ID NO: 3880941 - RNA, 17 nt, Human
auguagaauauucagac

SEQ ID NO: 3880942 - RNA, 20 nt, Human
auguagacaguuggguuuuu

SEQ ID NO: 3880943 - RNA, 16 nt, Human
auguagacuauauaca

SEQ ID NO: 3880944 - RNA, 17 nt, Human
auguagacuauauacau

SEQ ID NO: 3880945 - RNA, 23 nt, Human
auguagacuauauacaugugugu

SEQ ID NO: 3880946 - RNA, 20 nt, Human
auguagagcacaauggaauu

SEQ ID NO: 3880947 - RNA, 18 nt, Human
auguagauaaacucagaa

SEQ ID NO: 3880948 - RNA, 19 nt, Human
auguagauaacaagaccuc

SEQ ID NO: 3880949 - RNA, 15 nt, Human
auguagauauuuggc

SEQ ID NO: 3880950 - RNA, 20 nt, Human
auguagauauuuggcuuaaa

SEQ ID NO: 3880951 - RNA, 20 nt, Human
auguagauuuguacaggagu

SEQ ID NO: 3880952 - RNA, 20 nt, Human
auguagcaaacccugucaaa

SEQ ID NO: 3880953 - RNA, 18 nt, Human
auguagcaaucagauuuu

SEQ ID NO: 3880954 - RNA, 14 nt, Human
auguagcaugcuug

SEQ ID NO: 3880955 - RNA, 19 nt, Human
auguagcaugcuuguugca

SEQ ID NO: 3880956 - RNA, 13 nt, Human
auguagcccaucc

SEQ ID NO: 3880957 - RNA, 20 nt, Human
auguagcccauccuucccuu

SEQ ID NO: 3880958 - RNA, 21 nt, Human
auguagcgcuuugaauaugaa

SEQ ID NO: 3880959 - RNA, 14 nt, Human
auguagcugguuuc

SEQ ID NO: 3880960 - RNA, 18 nt, Human
auguagcuuuucaccuuu

SEQ ID NO: 3880961 - RNA, 13 nt, Human
auguaggagggac

SEQ ID NO: 3880962 - RNA, 18 nt, Human
auguaggguaaggugccu

SEQ ID NO: 3880963 - RNA, 16 nt, Human
auguagguaagacugu

SEQ ID NO: 3880964 - RNA, 20 nt, Human
auguagguaagacuguagau

SEQ ID NO: 3880965 - RNA, 22 nt, Human
auguaguaacacuaauauauuu

SEQ ID NO: 3880966 - RNA, 16 nt, Human
auguaguaaguaaauu

SEQ ID NO: 3880967 - RNA, 13 nt, Human
auguaguaauuga

SEQ ID NO: 3880968 - RNA, 14 nt, Human
auguaguaguacuu

SEQ ID NO: 3880969 - RNA, 20 nt, Human
auguaguaugcuaugauuaa

SEQ ID NO: 3880970 - RNA, 14 nt, Human
auguagugccucuu

SEQ ID NO: 3880971 - RNA, 18 nt, Human
auguaguugauguaucca

SEQ ID NO: 3880972 - RNA, 15 nt, Human
auguaguuugaggaa

SEQ ID NO: 3880973 - RNA, 15 nt, Human
auguauaaaauacau

SEQ ID NO: 3880974 - RNA, 22 nt, Human
auguauaaaauacauagugaaa

SEQ ID NO: 3880975 - RNA, 17 nt, Human
auguauaaagaacaagg

SEQ ID NO: 3880976 - RNA, 16 nt, Human
auguauaaaugugaua

SEQ ID NO: 3880977 - RNA, 14 nt, Human
auguauaauauuuu

SEQ ID NO: 3880978 - RNA, 18 nt, Human
auguauauacacauauac

SEQ ID NO: 3880979 - RNA, 16 nt, Human
auguauauacauuuau

SEQ ID NO: 3880980 - RNA, 20 nt, Human
auguauauuaaaaaagagac

SEQ ID NO: 3880981 - RNA, 20 nt, Human
auguauauuuuuuuaauuua

SEQ ID NO: 3880982 - RNA, 13 nt, Human
auguaucaggaaa

SEQ ID NO: 3880983 - RNA, 21 nt, Human
auguaucaggaaauauauaug

SEQ ID NO: 3880984 - RNA, 21 nt, Human
auguaucccuucucacagcac

SEQ ID NO: 3880985 - RNA, 14 nt, Human
auguaucuaagaau

SEQ ID NO: 3880986 - RNA, 15 nt, Human
auguaucuaccucac

SEQ ID NO: 3880987 - RNA, 16 nt, Human
auguaucuauuuauua

SEQ ID NO: 3880988 - RNA, 14 nt, Human
auguaucugaguug

SEQ ID NO: 3880989 - RNA, 18 nt, Human
auguaugaauacagcagc

SEQ ID NO: 3880990 - RNA, 23 nt, Human
auguaugaauacagcagcaagaa

SEQ ID NO: 3880991 - RNA, 18 nt, Human
auguaugagguacaaccu

SEQ ID NO: 3880992 - RNA, 17 nt, Human
auguaugcacacacaua

SEQ ID NO: 3880993 - RNA, 19 nt, Human
auguaugcauguugucuaa

SEQ ID NO: 3880994 - RNA, 17 nt, Human
auguaugcuucauacag

SEQ ID NO: 3880995 - RNA, 18 nt, Human
auguauggaauacagugu

SEQ ID NO: 3880996 - RNA, 20 nt, Human
auguauggaauacaguguua

SEQ ID NO: 3880997 - RNA, 12 nt, Human
auguauguaaaa

SEQ ID NO: 3880998 - RNA, 13 nt, Human
auguauguaaaaa

SEQ ID NO: 3880999 - RNA, 14 nt, Human
auguauguaaaaau

SEQ ID NO: 3881000 - RNA, 15 nt, Human
auguaugugcacugu

SEQ ID NO: 3881001 - RNA, 15 nt, Human
auguauguguaagua

SEQ ID NO: 3881002 - RNA, 15 nt, Human
auguauguguuuaga

SEQ ID NO: 3881003 - RNA, 18 nt, Human
auguauguguuuagaauu

SEQ ID NO: 3881004 - RNA, 21 nt, Human
auguauguguuuagaauugaa

SEQ ID NO: 3881005 - RNA, 14 nt, Human
auguauguuaccaa

SEQ ID NO: 3881006 - RNA, 19 nt, Human
auguauguucagaagaaau

SEQ ID NO: 3881007 - RNA, 20 nt, Human
auguauguucagaagaaauu

SEQ ID NO: 3881008 - RNA, 13 nt, Human
auguauguuuaca

SEQ ID NO: 3881009 - RNA, 17 nt, Human
auguauguuuacacugu

SEQ ID NO: 3881010 - RNA, 21 nt, Human
auguauguuuacacugucaaa

SEQ ID NO: 3881011 - RNA, 17 nt, Human
auguauguuuacauauc

SEQ ID NO: 3881012 - RNA, 12 nt, Human
auguauguuucu

SEQ ID NO: 3881013 - RNA, 14 nt, Human
auguauguuucucu

SEQ ID NO: 3881014 - RNA, 20 nt, Human
auguauguuuugguaucugu

SEQ ID NO: 3881015 - RNA, 12 nt, Human
auguauuaaauu

SEQ ID NO: 3881016 - RNA, 17 nt, Human
auguauuaauauucauu

SEQ ID NO: 3881017 - RNA, 12 nt, Human
auguauuaguga

SEQ ID NO: 3881018 - RNA, 16 nt, Human
auguauuagugauauu

SEQ ID NO: 3881019 - RNA, 23 nt, Human
auguauuagugauauuucucuag

SEQ ID NO: 3881020 - RNA, 12 nt, Human
auguauuauguc

SEQ ID NO: 3881021 - RNA, 24 nt, Human
auguauucagcuuuaguagauauu

SEQ ID NO: 3881022 - RNA, 19 nt, Human
auguauucuagcuaaugua

SEQ ID NO: 3881023 - RNA, 18 nt, Human
auguauucuguaaaagaa

SEQ ID NO: 3881024 - RNA, 17 nt, Human
auguauucuuuucucag

SEQ ID NO: 3881025 - RNA, 14 nt, Human
auguauugauaaga

SEQ ID NO: 3881026 - RNA, 15 nt, Human
auguauuggccugga

SEQ ID NO: 3881027 - RNA, 16 nt, Human
auguauuggccuggag

SEQ ID NO: 3881028 - RNA, 19 nt, Human
auguauuguaaacaugugu

SEQ ID NO: 3881029 - RNA, 13 nt, Human
auguauuguaccu

SEQ ID NO: 3881030 - RNA, 17 nt, Human
auguauugugcaaugug

SEQ ID NO: 3881031 - RNA, 17 nt, Human
auguauuuaccaaaaau

SEQ ID NO: 3881032 - RNA, 16 nt, Human
auguauuuauuuaaaa

SEQ ID NO: 3881033 - RNA, 13 nt, Human
auguauuuguuca

SEQ ID NO: 3881034 - RNA, 19 nt, Human
auguauuuguucauguuug

SEQ ID NO: 3881035 - RNA, 14 nt, Human
auguauuuuaugua

SEQ ID NO: 3881036 - RNA, 20 nt, Human
auguauuuuauguauguuua

SEQ ID NO: 3881037 - RNA, 14 nt, Human
auguauuuuauugu

SEQ ID NO: 3881038 - RNA, 12 nt, Human
auguauuuugug

SEQ ID NO: 3881039 - RNA, 13 nt, Human
auguauuuuguga

SEQ ID NO: 3881040 - RNA, 15 nt, Human
auguauuuugugagu

SEQ ID NO: 3881041 - RNA, 19 nt, Human
auguauuuugugaguuugu

SEQ ID NO: 3881042 - RNA, 19 nt, Human
auguauuuuucuacauuau

SEQ ID NO: 3881043 - RNA, 23 nt, Human
augucaaaaauauuuaggaauuu

SEQ ID NO: 3881044 - RNA, 22 nt, Human
augucaaaaguagaacuuugua

SEQ ID NO: 3881045 - RNA, 14 nt, Human
augucaaacaaaua

SEQ ID NO: 3881046 - RNA, 21 nt, Human
augucaaacaugagaugugug

SEQ ID NO: 3881047 - RNA, 14 nt, Human
augucaaacgugaa

SEQ ID NO: 3881048 - RNA, 14 nt, Human
augucaacuucugg

SEQ ID NO: 3881049 - RNA, 18 nt, Human
augucaacuucuggcucc

SEQ ID NO: 3881050 - RNA, 17 nt, Human
augucaagauucagcua

SEQ ID NO: 3881051 - RNA, 18 nt, Human
augucaaugaacaagcau

SEQ ID NO: 3881052 - RNA, 19 nt, Human
augucaauuucuguguugc

SEQ ID NO: 3881053 - RNA, 12 nt, Human
augucacagggc

SEQ ID NO: 3881054 - RNA, 18 nt, Human
augucaccaccuucccag

SEQ ID NO: 3881055 - RNA, 20 nt, Human
augucaccaccuucccagcu

SEQ ID NO: 3881056 - RNA, 21 nt, Human
augucaccguggaccuuccug

SEQ ID NO: 3881057 - RNA, 16 nt, Human
augucacuagaaugga

SEQ ID NO: 3881058 - RNA, 22 nt, Human
augucacuagaauggauaaaau

SEQ ID NO: 3881059 - RNA, 14 nt, Human
augucacugugguc

SEQ ID NO: 3881060 - RNA, 23 nt, Human
augucagacauccauguuuguaa

SEQ ID NO: 3881061 - RNA, 15 nt, Human
augucagcaaaaagc

SEQ ID NO: 3881062 - RNA, 22 nt, Human
augucagcaaaaagcaaaauca

SEQ ID NO: 3881063 - RNA, 20 nt, Human
augucagcaguugcugguaa

SEQ ID NO: 3881064 - RNA, 22 nt, Human
augucagcaguugcugguaaaa

SEQ ID NO: 3881065 - RNA, 15 nt, Human
augucaggaacagaa

SEQ ID NO: 3881066 - RNA, 16 nt, Human
augucaggccugugug

SEQ ID NO: 3881067 - RNA, 19 nt, Human
augucaggucagccaacug

SEQ ID NO: 3881068 - RNA, 16 nt, Human
augucaguauguggaa

SEQ ID NO: 3881069 - RNA, 18 nt, Human
augucagucugcuuagaa

SEQ ID NO: 3881070 - RNA, 20 nt, Human
augucagucugcuuagaaau

SEQ ID NO: 3881071 - RNA, 15 nt, Human
augucagugcugaug

SEQ ID NO: 3881072 - RNA, 14 nt, Human
augucaguucugau

SEQ ID NO: 3881073 - RNA, 14 nt, Human
augucauacagaga

SEQ ID NO: 3881074 - RNA, 16 nt, Human
augucauacagagaag

SEQ ID NO: 3881075 - RNA, 15 nt, Human
auguugugaauaauu

SEQ ID NO: 3881076 - RNA, 15 nt, Human
auguugugauguauu

SEQ ID NO: 3881077 - RNA, 20 nt, Human
auguuguucauuauuggagg

SEQ ID NO: 3881078 - RNA, 17 nt, Human
auguuguuuauaauaaa

SEQ ID NO: 3881079 - RNA, 18 nt, Human
auguuguuuauaauaaaa

SEQ ID NO: 3881080 - RNA, 23 nt, Human
auguuguuuccuaauaucaaaug

SEQ ID NO: 3881081 - RNA, 15 nt, Human
auguuguuuuguaca

SEQ ID NO: 3881082 - RNA, 18 nt, Human
auguuguuuuguacagau

SEQ ID NO: 3881083 - RNA, 17 nt, Human
auguuuaaaaaaguuua

SEQ ID NO: 3881084 - RNA, 21 nt, Human
auguuuaaaaaaguuuaaaau

SEQ ID NO: 3881085 - RNA, 12 nt, Human
auguuuaaaaca

SEQ ID NO: 3881086 - RNA, 17 nt, Human
auguuuaaaauaaaaug

SEQ ID NO: 3881087 - RNA, 19 nt, Human
auguuuaaaauaaaaugaa

SEQ ID NO: 3881088 - RNA, 21 nt, Human
auguuuaaaguaauuguucca

SEQ ID NO: 3881089 - RNA, 19 nt, Human
auguuuaacuuaaucaauu

SEQ ID NO: 3881090 - RNA, 13 nt, Human
auguuuaagauuu

SEQ ID NO: 3881091 - RNA, 22 nt, Human
auguuuaagcagaauuggaaaa

SEQ ID NO: 3881092 - RNA, 15 nt, Human
auguuuaaucauaua

SEQ ID NO: 3881093 - RNA, 16 nt, Human
auguuuaaucauauaa

SEQ ID NO: 3881094 - RNA, 17 nt, Human
auguuuaaucauauaaa

SEQ ID NO: 3881095 - RNA, 16 nt, Human
auguuuacacucuuug

SEQ ID NO: 3881096 - RNA, 21 nt, Human
auguuuacacucuuuguaaga

SEQ ID NO: 3881097 - RNA, 22 nt, Human
auguuuacacucuuuguaagag

SEQ ID NO: 3881098 - RNA, 22 nt, Human
auguuuacagguggacacacaa

SEQ ID NO: 3881099 - RNA, 13 nt, Human
auguuuacauauc

SEQ ID NO: 3881100 - RNA, 19 nt, Human
auguuuaccuuuuaauuaa

SEQ ID NO: 3881101 - RNA, 13 nt, Human
auguuuauauaaa

SEQ ID NO: 3881102 - RNA, 14 nt, Human
auguuuauauaaau

SEQ ID NO: 3881103 - RNA, 16 nt, Human
auguuuauauaaaugc

SEQ ID NO: 3881104 - RNA, 19 nt, Human
auguuuauauaaaugcuuu

SEQ ID NO: 3881105 - RNA, 18 nt, Human
auguuuaugaaaauaaau

SEQ ID NO: 3881106 - RNA, 14 nt, Human
auguuuaugagcca

SEQ ID NO: 3881107 - RNA, 15 nt, Human
auguuuaugagccag

SEQ ID NO: 3881108 - RNA, 21 nt, Human
auguuuaugagccagacaaau

SEQ ID NO: 3881109 - RNA, 18 nt, Human
auguuuaugcaaggaagg

SEQ ID NO: 3881110 - RNA, 15 nt, Human
auguuuauuacagua

SEQ ID NO: 3881111 - RNA, 14 nt, Human
auguuuauuccuga

SEQ ID NO: 3881112 - RNA, 16 nt, Human
auguuuauucuucuag

SEQ ID NO: 3881113 - RNA, 19 nt, Human
auguuuauucuucuagagu

SEQ ID NO: 3881114 - RNA, 14 nt, Human
auguuuauuucagg

SEQ ID NO: 3881115 - RNA, 18 nt, Human
auguuucaaacauauaua

SEQ ID NO: 3881116 - RNA, 15 nt, Human
auguuucaagaggag

SEQ ID NO: 3881117 - RNA, 17 nt, Human
auguuucacacaaacaa

SEQ ID NO: 3881118 - RNA, 18 nt, Human
auguuucaggaggcugga

SEQ ID NO: 3881119 - RNA, 13 nt, Human
auguuuccaaccu

SEQ ID NO: 3881120 - RNA, 12 nt, Human
auguuuccagca

SEQ ID NO: 3881121 - RNA, 13 nt, Human
auguuuccagcau

SEQ ID NO: 3881122 - RNA, 21 nt, Human
auguuuccagcauucccaggu

SEQ ID NO: 3881123 - RNA, 20 nt, Human
auguuuccucuaguucuuug

SEQ ID NO: 3881124 - RNA, 22 nt, Human
auguuucgcugauauauguguu

SEQ ID NO: 3881125 - RNA, 13 nt, Human
auguuucuaaggu

SEQ ID NO: 3881126 - RNA, 17 nt, Human
auguuucucuggcccca

SEQ ID NO: 3881127 - RNA, 22 nt, Human
auguuucugcaguagucucugu

SEQ ID NO: 3881128 - RNA, 22 nt, Human
auguuucuucuagguucuaaaa

SEQ ID NO: 3881129 - RNA, 16 nt, Human
auguuucuuuuaaaga

SEQ ID NO: 3881130 - RNA, 19 nt, Human
auguuucuuuuguauguaa

SEQ ID NO: 3881131 - RNA, 20 nt, Human
auguuucuuuuguauguaaa

SEQ ID NO: 3881132 - RNA, 16 nt, Human
auguuucuuuuguuug

SEQ ID NO: 3881133 - RNA, 21 nt, Human
auguuucuuuuguuugguaaa

SEQ ID NO: 3881134 - RNA, 12 nt, Human
auguuugaaaug

SEQ ID NO: 3881135 - RNA, 17 nt, Human
auguuugaauauggaca

SEQ ID NO: 3881136 - RNA, 20 nt, Human
auguuugaauuuuucucuuc

SEQ ID NO: 3881137 - RNA, 22 nt, Human
auguuugaggagcauguuuugu

SEQ ID NO: 3881138 - RNA, 21 nt, Human
auguuugcaccuuucuaguug

SEQ ID NO: 3881139 - RNA, 16 nt, Human
auguuugcacuuguga

SEQ ID NO: 3881140 - RNA, 13 nt, Human
auguuugcccaaa

SEQ ID NO: 3881141 - RNA, 14 nt, Human
auguuugccucugc

SEQ ID NO: 3881142 - RNA, 15 nt, Human
auguuugccucugcc

SEQ ID NO: 3881143 - RNA, 17 nt, Human
auguuugccucugccuc

SEQ ID NO: 3881144 - RNA, 18 nt, Human
auguuugccucugccucu

SEQ ID NO: 3881145 - RNA, 22 nt, Human
auguuuggcauguaaauguaaa

SEQ ID NO: 3881146 - RNA, 23 nt, Human
auguuuggcugcuagaacauggu

SEQ ID NO: 3881147 - RNA, 23 nt, Human
auguuugggagacugcugaguca

SEQ ID NO: 3881148 - RNA, 18 nt, Human
auguuugggcagaaggga

SEQ ID NO: 3881149 - RNA, 17 nt, Human
auguuugguaccaagaa

SEQ ID NO: 3881150 - RNA, 20 nt, Human
auguuuggugcauagaacug

SEQ ID NO: 3881151 - RNA, 14 nt, Human
auguuuguacaaga

SEQ ID NO: 3881152 - RNA, 23 nt, Human
auguuuguccugaacacuuuugu

SEQ ID NO: 3881153 - RNA, 20 nt, Human
auguuugucucaguuggaaa

SEQ ID NO: 3881154 - RNA, 19 nt, Human
auguuugugcaguaacuug

SEQ ID NO: 3881155 - RNA, 22 nt, Human
auguuugugcaguaacuuggga

SEQ ID NO: 3881156 - RNA, 15 nt, Human
auguuuguggccuca

SEQ ID NO: 3881157 - RNA, 17 nt, Human
auguuuguggccucaga

SEQ ID NO: 3881158 - RNA, 22 nt, Human
auguuuuaaagaauaugacuuu

SEQ ID NO: 3881159 - RNA, 20 nt, Human
auguuuuaaauauagaauuu

SEQ ID NO: 3881160 - RNA, 15 nt, Human
auguuuuaacaaaaa

SEQ ID NO: 3881161 - RNA, 16 nt, Human
auguuuuaagaggcag

SEQ ID NO: 3881162 - RNA, 16 nt, Human
auguuuuacacuguac

SEQ ID NO: 3881163 - RNA, 12 nt, Human
auguuuucaaau

SEQ ID NO: 3881164 - RNA, 19 nt, Human
auguuuucagcuaggaaca

SEQ ID NO: 3881165 - RNA, 15 nt, Human
auguuuucaggcuag

SEQ ID NO: 3881166 - RNA, 16 nt, Human
auguuuuccagcuccu

SEQ ID NO: 3881167 - RNA, 23 nt, Human
auguuuuccuuugucaucauugu

SEQ ID NO: 3881168 - RNA, 20 nt, Human
auguuuucugaaaauauaac

SEQ ID NO: 3881169 - RNA, 12 nt, Human
auguuuugauaa

SEQ ID NO: 3881170 - RNA, 20 nt, Human
auguuuugauaaaguaguaa

SEQ ID NO: 3881171 - RNA, 21 nt, Human
auguuuugauaaaguaguaaa

SEQ ID NO: 3881172 - RNA, 23 nt, Human
auguuuuggccaaugcaccuaaa

SEQ ID NO: 3881173 - RNA, 20 nt, Human
auguuuugguaucuguucuu

SEQ ID NO: 3881174 - RNA, 23 nt, Human
auguuuugguccacuuuuccagu

SEQ ID NO: 3881175 - RNA, 17 nt, Human
auguuuuguaaacuuug

SEQ ID NO: 3881176 - RNA, 16 nt, Human
auguuuugugcauuug

SEQ ID NO: 3881177 - RNA, 20 nt, Human
auguuuuguuucugaaaauu

SEQ ID NO: 3881178 - RNA, 12 nt, Human
auguuuuuaaaa

SEQ ID NO: 3881179 - RNA, 18 nt, Human
auguuuuuaaaaguuuca

SEQ ID NO: 3881180 - RNA, 20 nt, Human
auguuuuuaaaaguuucaau

SEQ ID NO: 3881181 - RNA, 17 nt, Human
auguuuuuaaauauauu

SEQ ID NO: 3881182 - RNA, 16 nt, Human
auguuuuuaauaaaag

SEQ ID NO: 3881183 - RNA, 13 nt, Human
auguuuuuaauau

SEQ ID NO: 3881184 - RNA, 13 nt, Human
auguuuuuaaugu

SEQ ID NO: 3881185 - RNA, 19 nt, Human
auguuuuuaauguauagua

SEQ ID NO: 3881186 - RNA, 14 nt, Human
auguuuuuauacaa

SEQ ID NO: 3881187 - RNA, 20 nt, Human
auguuuuuauuaagauuauu

SEQ ID NO: 3881188 - RNA, 22 nt, Human
auguuuuucugccagggagcuu

SEQ ID NO: 3881189 - RNA, 14 nt, Human
auguuuuugaaggc

SEQ ID NO: 3881190 - RNA, 19 nt, Human
auguuuuugaaggcagaaa

SEQ ID NO: 3881191 - RNA, 21 nt, Human
auguuuuuguuuucuuugaau

SEQ ID NO: 3881192 - RNA, 19 nt, Human
auguuuuuuagaucaaaua

SEQ ID NO: 3881193 - RNA, 18 nt, Human
auguuuuuugccacagcu

SEQ ID NO: 3881194 - RNA, 22 nt, Human
auguuuuuugccacagcuuuug

SEQ ID NO: 3881195 - RNA, 15 nt, Human
auuaaaaaaaaauug

SEQ ID NO: 3881196 - RNA, 17 nt, Human
auuaaaaaaaaauugua

SEQ ID NO: 3881197 - RNA, 19 nt, Human
auuaaaaaaaacaaaaaga

SEQ ID NO: 3881198 - RNA, 20 nt, Human
auuaaaaaaaacaaaaagaa

SEQ ID NO: 3881199 - RNA, 22 nt, Human
auuaaaaaagagacauccaaau

SEQ ID NO: 3881200 - RNA, 14 nt, Human
auuaaaaaagauaa

SEQ ID NO: 3881201 - RNA, 18 nt, Human
auuaaaaaagauaaacac

SEQ ID NO: 3881202 - RNA, 13 nt, Human
auuaaaaaagucu

SEQ ID NO: 3881203 - RNA, 22 nt, Human
auuaaaaacuaguaguucucuu

SEQ ID NO: 3881204 - RNA, 13 nt, Human
auuaaaaacugag

SEQ ID NO: 3881205 - RNA, 20 nt, Human
auuaaaaacugagugacucu

SEQ ID NO: 3881206 - RNA, 21 nt, Human
auuaaaaagaugguugccaag

SEQ ID NO: 3881207 - RNA, 16 nt, Human
auuaaaaagauucuuu

SEQ ID NO: 3881208 - RNA, 19 nt, Human
auuaaaaagguuuacagaa

SEQ ID NO: 3881209 - RNA, 12 nt, Human
auuaaaaagucu

SEQ ID NO: 3881210 - RNA, 13 nt, Human
auuaaaaagucuu

SEQ ID NO: 3881211 - RNA, 15 nt, Human
auuaaaaagucuuuu

SEQ ID NO: 3881212 - RNA, 22 nt, Human
auuaaaaaugaaauuauuuaua

SEQ ID NO: 3881213 - RNA, 13 nt, Human
auuaaaaauggua

SEQ ID NO: 3881214 - RNA, 20 nt, Human
auuaaaaauuggcuaguuga

SEQ ID NO: 3881215 - RNA, 13 nt, Human
auuaaaacaaugu

SEQ ID NO: 3881216 - RNA, 18 nt, Human
auuaaaacugaagucuga

SEQ ID NO: 3881217 - RNA, 20 nt, Human
auuaaaacugaagucugaaa

SEQ ID NO: 3881218 - RNA, 21 nt, Human
auuaaaacugaagucugaaau

SEQ ID NO: 3881219 - RNA, 22 nt, Human
auugucuccuauauauuucuau

SEQ ID NO: 3881220 - RNA, 23 nt, Human
auugucuccuauauauuucuauu

SEQ ID NO: 3881221 - RNA, 23 nt, Human
auugucugaaaagugaagacaga

SEQ ID NO: 3881222 - RNA, 23 nt, Human
auugucuuaauggaugaaaucau

SEQ ID NO: 3881223 - RNA, 20 nt, Human
auugucuuuaaaaacuguuu

SEQ ID NO: 3881224 - RNA, 17 nt, Human
auugucuuuauaugaac

SEQ ID NO: 3881225 - RNA, 14 nt, Human
auugugaacucauu

SEQ ID NO: 3881226 - RNA, 15 nt, Human
auugugaacucauug

SEQ ID NO: 3881227 - RNA, 17 nt, Human
auugugaacucauugcu

SEQ ID NO: 3881228 - RNA, 16 nt, Human
auugugaacugacagg

SEQ ID NO: 3881229 - RNA, 15 nt, Human
auugugaaguacaua

SEQ ID NO: 3881230 - RNA, 17 nt, Human
auugugaccaaguuaua

SEQ ID NO: 3881231 - RNA, 17 nt, Human
auugugaucagaccaua

SEQ ID NO: 3881232 - RNA, 14 nt, Human
auugugauguauau

SEQ ID NO: 3881233 - RNA, 13 nt, Human
auugugauguguc

SEQ ID NO: 3881234 - RNA, 16 nt, Human
auugugauuagacaga

SEQ ID NO: 3881235 - RNA, 18 nt, Human
auugugauucugccuuug

SEQ ID NO: 3881236 - RNA, 17 nt, Human
auugugauuugacuguu

SEQ ID NO: 3881237 - RNA, 15 nt, Human
auugugcaaauggaa

SEQ ID NO: 3881238 - RNA, 15 nt, Human
auugugcaauguaaa

SEQ ID NO: 3881239 - RNA, 18 nt, Human
auugugcaauguaaauau

SEQ ID NO: 3881240 - RNA, 20 nt, Human
auugugcaauguaaauauuu

SEQ ID NO: 3881241 - RNA, 15 nt, Human
auugugcaaugugua

SEQ ID NO: 3881242 - RNA, 21 nt, Human
auugugcaauguguauaaaca

SEQ ID NO: 3881243 - RNA, 22 nt, Human
auugugcaauguguauaaacaa

SEQ ID NO: 3881244 - RNA, 15 nt, Human
auugugcauucuaga

SEQ ID NO: 3881245 - RNA, 15 nt, Human
auugugcucagagac

SEQ ID NO: 3881246 - RNA, 15 nt, Human
auugugcuucacagu

SEQ ID NO: 3881247 - RNA, 24 nt, Human
auugugcuucacaguagagccagc

SEQ ID NO: 3881248 - RNA, 14 nt, Human
auugugcuucuccc

SEQ ID NO: 3881249 - RNA, 15 nt, Human
auugugcuucuuucu

SEQ ID NO: 3881250 - RNA, 13 nt, Human
auugugggaaggg

SEQ ID NO: 3881251 - RNA, 19 nt, Human
auugugggcauaaacuguu

SEQ ID NO: 3881252 - RNA, 21 nt, Human
auuguggggaugaugaaauaa

SEQ ID NO: 3881253 - RNA, 22 nt, Human
auugugguuauuuuuauacagu

SEQ ID NO: 3881254 - RNA, 20 nt, Human
auugugguuuauauauuuaa

SEQ ID NO: 3881255 - RNA, 23 nt, Human
auuguguaacaauuuuaaugcua

SEQ ID NO: 3881256 - RNA, 14 nt, Human
auuguguagccuuu

SEQ ID NO: 3881257 - RNA, 16 nt, Human
auuguguagccuuuuu

SEQ ID NO: 3881258 - RNA, 22 nt, Human
auuguguagccuuuuuguauaa

SEQ ID NO: 3881259 - RNA, 14 nt, Human
auugugucucuugg

SEQ ID NO: 3881260 - RNA, 18 nt, Human
auugugucucuugguccu

SEQ ID NO: 3881261 - RNA, 21 nt, Human
auugugucucuugguccugcu

SEQ ID NO: 3881262 - RNA, 15 nt, Human
auugugucuuuugca

SEQ ID NO: 3881263 - RNA, 14 nt, Human
auugugugaacuug

SEQ ID NO: 3881264 - RNA, 18 nt, Human
auugugugauauuucaga

SEQ ID NO: 3881265 - RNA, 16 nt, Human
auuguguguuauuuaa

SEQ ID NO: 3881266 - RNA, 18 nt, Human
auuguguguuauuuaaau

SEQ ID NO: 3881267 - RNA, 20 nt, Human
auuguguuaccuguagauuc

SEQ ID NO: 3881268 - RNA, 20 nt, Human
auuguguucccauuucagcu

SEQ ID NO: 3881269 - RNA, 14 nt, Human
auuguguuccuuuu

SEQ ID NO: 3881270 - RNA, 17 nt, Human
auuguguugugaauguu

SEQ ID NO: 3881271 - RNA, 15 nt, Human
auuguguuuacauuu

SEQ ID NO: 3881272 - RNA, 18 nt, Human
auuguguuuacauuuuau

SEQ ID NO: 3881273 - RNA, 22 nt, Human
auuguguuuacauuuuauggug

SEQ ID NO: 3881274 - RNA, 15 nt, Human
auuguguuugucauu

SEQ ID NO: 3881275 - RNA, 18 nt, Human
auuguguuugucauuagc

SEQ ID NO: 3881276 - RNA, 22 nt, Human
auuguguuugucauuagccuga

SEQ ID NO: 3881277 - RNA, 13 nt, Human
auuguguuugugu

SEQ ID NO: 3881278 - RNA, 22 nt, Human
auuguuaagucuaaauauuucc

SEQ ID NO: 3881279 - RNA, 15 nt, Human
auuguuaauugcuga

SEQ ID NO: 3881280 - RNA, 19 nt, Human
auuguuaauugcugaggca

SEQ ID NO: 3881281 - RNA, 17 nt, Human
auuguuacucuuacgaa

SEQ ID NO: 3881282 - RNA, 14 nt, Human
auuguuauuaaaug

SEQ ID NO: 3881283 - RNA, 15 nt, Human
auuguucaaacaaua

SEQ ID NO: 3881284 - RNA, 12 nt, Human
auuguucauuuu

SEQ ID NO: 3881285 - RNA, 17 nt, Human
auuguuccaagacauug

SEQ ID NO: 3881286 - RNA, 24 nt, Human
auuguuccagcaguuuucaaguca

SEQ ID NO: 3881287 - RNA, 17 nt, Human
auuguuccuaaguucuu

SEQ ID NO: 3881288 - RNA, 14 nt, Human
auuguucuuuucaa

SEQ ID NO: 3881289 - RNA, 18 nt, Human
auuguugacaacugugac

SEQ ID NO: 3881290 - RNA, 19 nt, Human
auuguugagcuauugcugu

SEQ ID NO: 3881291 - RNA, 20 nt, Human
auuguugagguggucugaau

SEQ ID NO: 3881292 - RNA, 14 nt, Human
auuguugcauugcu

SEQ ID NO: 3881293 - RNA, 16 nt, Human
auuguugcauugcuuu

SEQ ID NO: 3881294 - RNA, 16 nt, Human
auuguugcucccugug

SEQ ID NO: 3881295 - RNA, 21 nt, Human
auuguuguacacagaaauaca

SEQ ID NO: 3881296 - RNA, 14 nt, Human
auuguuguauaauu

SEQ ID NO: 3881297 - RNA, 15 nt, Human
auuguuguauaauuu

SEQ ID NO: 3881298 - RNA, 14 nt, Human
auuguuguucuguu

SEQ ID NO: 3881299 - RNA, 19 nt, Human
auuguuguuugccauacuu

SEQ ID NO: 3881300 - RNA, 22 nt, Human
auuguuguuugccauacuuugu

SEQ ID NO: 3881301 - RNA, 18 nt, Human
auuguuguuuguauguau

SEQ ID NO: 3881302 - RNA, 20 nt, Human
auuguuguuuguauguauaa

SEQ ID NO: 3881303 - RNA, 22 nt, Human
auuguuuaaaaaccgaauaaau

SEQ ID NO: 3881304 - RNA, 22 nt, Human
auuguuuaaaaaucuuaaugua

SEQ ID NO: 3881305 - RNA, 19 nt, Human
auuguuuaaaaucauuucu

SEQ ID NO: 3881306 - RNA, 16 nt, Human
auuguuuaaaauguaa

SEQ ID NO: 3881307 - RNA, 20 nt, Human
auuguuuaaagcaacugucu

SEQ ID NO: 3881308 - RNA, 17 nt, Human
auuguuuaucuagaugu

SEQ ID NO: 3881309 - RNA, 20 nt, Human
auuguuuaucuagauguaaa

SEQ ID NO: 3881310 - RNA, 13 nt, Human
auuguuuauguaa

SEQ ID NO: 3881311 - RNA, 14 nt, Human
auuguuuauucuuu

SEQ ID NO: 3881312 - RNA, 15 nt, Human
auuguuuauuuauca

SEQ ID NO: 3881313 - RNA, 18 nt, Human
auuguuuauuuaucagug

SEQ ID NO: 3881314 - RNA, 19 nt, Human
auuguuucuauacaaauau

SEQ ID NO: 3881315 - RNA, 17 nt, Human
auuguuucugcauucau

SEQ ID NO: 3881316 - RNA, 19 nt, Human
auuguuucuuuaagaaagu

SEQ ID NO: 3881317 - RNA, 20 nt, Human
auuguuucuuuaagaaagua

SEQ ID NO: 3881318 - RNA, 17 nt, Human
auuguuugaaacaaaga

SEQ ID NO: 3881319 - RNA, 12 nt, Human
auuguuugcugc

SEQ ID NO: 3881320 - RNA, 15 nt, Human
auuguuugcugcuau

SEQ ID NO: 3881321 - RNA, 19 nt, Human
auuguuugcuuauuguucc

SEQ ID NO: 3881322 - RNA, 21 nt, Human
auuguuugcuuauuguuccaa

SEQ ID NO: 3881323 - RNA, 18 nt, Human
auuguuuggcuuccuccu

SEQ ID NO: 3881324 - RNA, 17 nt, Human
auuguuugguaaauguu

SEQ ID NO: 3881325 - RNA, 16 nt, Human
auuguuugucuuuaac

SEQ ID NO: 3881326 - RNA, 13 nt, Human
auuguuuuaaucu

SEQ ID NO: 3881327 - RNA, 18 nt, Human
auuguuuuaaucugaaau

SEQ ID NO: 3881328 - RNA, 14 nt, Human
auuguuuuacaaua

SEQ ID NO: 3881329 - RNA, 18 nt, Human
auuguuuuacaauaguuc

SEQ ID NO: 3881330 - RNA, 19 nt, Human
auuguuuuacaauaguucu

SEQ ID NO: 3881331 - RNA, 18 nt, Human
auuguuuuaucaugacau

SEQ ID NO: 3881332 - RNA, 18 nt, Human
auuguuuucuauuuaugc

SEQ ID NO: 3881333 - RNA, 15 nt, Human
auuguuuugaauauu

SEQ ID NO: 3881334 - RNA, 17 nt, Human
auuguuuugaauauuac

SEQ ID NO: 3881335 - RNA, 20 nt, Human
auuguuuugagcuuuccaug

SEQ ID NO: 3881336 - RNA, 18 nt, Human
auuguuuugguuugcuac

SEQ ID NO: 3881337 - RNA, 14 nt, Human
auuguuuuucuuuc

SEQ ID NO: 3881338 - RNA, 15 nt, Human
auuguuuuucuuucu

SEQ ID NO: 3881339 - RNA, 19 nt, Human
auuguuuuucuuucuacaa

SEQ ID NO: 3881340 - RNA, 19 nt, Human
auuuaaaaaaaaaagagga

SEQ ID NO: 3881341 - RNA, 17 nt, Human
auuuaaaaaaaaaccug

SEQ ID NO: 3881342 - RNA, 14 nt, Human
auuuaaaaaaaauc

SEQ ID NO: 3881343 - RNA, 13 nt, Human
auuuaaaaaacua

SEQ ID NO: 3881344 - RNA, 20 nt, Human
auuuaaaaacaaaaggcaau

SEQ ID NO: 3881345 - RNA, 14 nt, Human
auuuaaaaacugga

SEQ ID NO: 3881346 - RNA, 16 nt, Human
auuuaaaaacuggaac

SEQ ID NO: 3881347 - RNA, 18 nt, Human
auuuaaaaauaagucaac

SEQ ID NO: 3881348 - RNA, 19 nt, Human
auuuaaaaauaagucaaca

SEQ ID NO: 3881349 - RNA, 18 nt, Human
auuuaaaaauauuuuugg

SEQ ID NO: 3881350 - RNA, 16 nt, Human
auuuaaaaaugucuug

SEQ ID NO: 3881351 - RNA, 15 nt, Human
auuuaaaacagacac

SEQ ID NO: 3881352 - RNA, 23 nt, Human
auuuaaaacagacacuggcaugg

SEQ ID NO: 3881353 - RNA, 14 nt, Human
auuuaaaacaugua

SEQ ID NO: 3881354 - RNA, 15 nt, Human
auuuaaaacauguaa

SEQ ID NO: 3881355 - RNA, 17 nt, Human
auuuaaaacuguaauuu

SEQ ID NO: 3881356 - RNA, 15 nt, Human
auuuaaaagccugcu

SEQ ID NO: 3881357 - RNA, 17 nt, Human
auuuaaaagccugcuca

SEQ ID NO: 3881358 - RNA, 20 nt, Human
auuuaaaaguaaaaugucuu

SEQ ID NO: 3881359 - RNA, 15 nt, Human
auuuaaaauagcaaa

SEQ ID NO: 3881360 - RNA, 18 nt, Human
auuuaaaauagcaaaaga

SEQ ID NO: 3881361 - RNA, 20 nt, Human
auuuaaaauugugauguguc

SEQ ID NO: 3881362 - RNA, 15 nt, Human
auuuaaacaaacaaa

SEQ ID NO: 3881363 - RNA, 18 nt, Human
auuuaaacagauguccau

SEQ ID NO: 3881364 - RNA, 15 nt, Human
auuugugagauuccu

SEQ ID NO: 3881365 - RNA, 21 nt, Human
auuugugaugacaacuggaau

SEQ ID NO: 3881366 - RNA, 17 nt, Human
auuugugauguacugua

SEQ ID NO: 3881367 - RNA, 16 nt, Human
auuugugcauuuucua

SEQ ID NO: 3881368 - RNA, 21 nt, Human
auuugugccgacacuguucuc

SEQ ID NO: 3881369 - RNA, 22 nt, Human
auuuguggguuuuuauuuccua

SEQ ID NO: 3881370 - RNA, 18 nt, Human
auuuguguaauaaagugu

SEQ ID NO: 3881371 - RNA, 20 nt, Human
auuuguguaauaaaguguuu

SEQ ID NO: 3881372 - RNA, 22 nt, Human
auuuguguauuuaacagggagg

SEQ ID NO: 3881373 - RNA, 21 nt, Human
auuuguguggagucauuucug

SEQ ID NO: 3881374 - RNA, 23 nt, Human
auuuguguggagucauuucugau

SEQ ID NO: 3881375 - RNA, 14 nt, Human
auuugugugugugc

SEQ ID NO: 3881376 - RNA, 14 nt, Human
auuuguguugaaga

SEQ ID NO: 3881377 - RNA, 13 nt, Human
auuuguguuuuaa

SEQ ID NO: 3881378 - RNA, 20 nt, Human
auuuguguuuuaauuuaaac

SEQ ID NO: 3881379 - RNA, 22 nt, Human
auuuguuaaaauacaguucugu

SEQ ID NO: 3881380 - RNA, 16 nt, Human
auuuguuaaauauuua

SEQ ID NO: 3881381 - RNA, 13 nt, Human
auuuguuaaauug

SEQ ID NO: 3881382 - RNA, 14 nt, Human
auuuguuauaauga

SEQ ID NO: 3881383 - RNA, 16 nt, Human
auuuguuauucuuaag

SEQ ID NO: 3881384 - RNA, 16 nt, Human
auuuguuauuuugcaa

SEQ ID NO: 3881385 - RNA, 12 nt, Human
auuuguucaagu

SEQ ID NO: 3881386 - RNA, 12 nt, Human
auuuguucaugu

SEQ ID NO: 3881387 - RNA, 15 nt, Human
auuuguucugggagu

SEQ ID NO: 3881388 - RNA, 13 nt, Human
auuuguucuugua

SEQ ID NO: 3881389 - RNA, 20 nt, Human
auuuguugaaauuauguaug

SEQ ID NO: 3881390 - RNA, 16 nt, Human
auuuguugauucucuc

SEQ ID NO: 3881391 - RNA, 20 nt, Human
auuuguuggggcuuuacaua

SEQ ID NO: 3881392 - RNA, 12 nt, Human
auuuguuuaaaa

SEQ ID NO: 3881393 - RNA, 17 nt, Human
auuuguuuaaaaaguaa

SEQ ID NO: 3881394 - RNA, 13 nt, Human
auuuguuuaaaag

SEQ ID NO: 3881395 - RNA, 19 nt, Human
auuuguuuauguaauuuca

SEQ ID NO: 3881396 - RNA, 23 nt, Human
auuuguuugguuauagugcaaua

SEQ ID NO: 3881397 - RNA, 15 nt, Human
auuuguuugugcuuc

SEQ ID NO: 3881398 - RNA, 17 nt, Human
auuuguuuucacuuuuu

SEQ ID NO: 3881399 - RNA, 13 nt, Human
auuuguuuucccg

SEQ ID NO: 3881400 - RNA, 19 nt, Human
auuuguuuucccgccaagc

SEQ ID NO: 3881401 - RNA, 21 nt, Human
auuuguuuugacggaugauug

SEQ ID NO: 3881402 - RNA, 21 nt, Human
auuuguuuugccaauuugcac

SEQ ID NO: 3881403 - RNA, 23 nt, Human
auuuguuuugccaauuugcacau

SEQ ID NO: 3881404 - RNA, 15 nt, Human
auuuguuuuggauau

SEQ ID NO: 3881405 - RNA, 16 nt, Human
auuuguuuuguuuaca

SEQ ID NO: 3881406 - RNA, 15 nt, Human
auuuguuuuucauuc

SEQ ID NO: 3881407 - RNA, 14 nt, Human
auuuuaaaaaauga

SEQ ID NO: 3881408 - RNA, 16 nt, Human
auuuuaaaaaaugaaa

SEQ ID NO: 3881409 - RNA, 18 nt, Human
auuuuaaaaagucuucac

SEQ ID NO: 3881410 - RNA, 15 nt, Human
auuuuaaaaauacau

SEQ ID NO: 3881411 - RNA, 13 nt, Human
auuuuaaaaaugg

SEQ ID NO: 3881412 - RNA, 15 nt, Human
auuuuaaaaauggug

SEQ ID NO: 3881413 - RNA, 18 nt, Human
auuuuaaaacaauaggau

SEQ ID NO: 3881414 - RNA, 23 nt, Human
auuuuaaaagaaugauuaugaau

SEQ ID NO: 3881415 - RNA, 16 nt, Human
auuuuaaaauaaacuu

SEQ ID NO: 3881416 - RNA, 19 nt, Human
auuuuaaaauaaacuuucu

SEQ ID NO: 3881417 - RNA, 18 nt, Human
auuuuaaaauguacaugu

SEQ ID NO: 3881418 - RNA, 14 nt, Human
auuuuaaaauuuca

SEQ ID NO: 3881419 - RNA, 16 nt, Human
auuuuaaaauuucaua

SEQ ID NO: 3881420 - RNA, 15 nt, Human
auuuuaaacaaaaua

SEQ ID NO: 3881421 - RNA, 21 nt, Human
auuuuaaacuagaugaccuca

SEQ ID NO: 3881422 - RNA, 23 nt, Human
auuuuaaacuagaugaccucauu

SEQ ID NO: 3881423 - RNA, 12 nt, Human
auuuuaaagaca

SEQ ID NO: 3881424 - RNA, 15 nt, Human
auuuuaaagaccccu

SEQ ID NO: 3881425 - RNA, 14 nt, Human
auuuuaaauaaaag

SEQ ID NO: 3881426 - RNA, 19 nt, Human
auuuuaaaucuaaaucuau

SEQ ID NO: 3881427 - RNA, 15 nt, Human
auuuuaaauggacag

SEQ ID NO: 3881428 - RNA, 13 nt, Human
auuuuaaaugugu

SEQ ID NO: 3881429 - RNA, 13 nt, Human
auuuuaaauuaua

SEQ ID NO: 3881430 - RNA, 17 nt, Human
auuuuaaauuauaagga

SEQ ID NO: 3881431 - RNA, 13 nt, Human
auuuuaacaagaa

SEQ ID NO: 3881432 - RNA, 17 nt, Human
auuuuaacaagaagaug

SEQ ID NO: 3881433 - RNA, 14 nt, Human
auuuuaacaauaac

SEQ ID NO: 3881434 - RNA, 15 nt, Human
auuuuaacaauaacu

SEQ ID NO: 3881435 - RNA, 16 nt, Human
auuuuaacaauaacua

SEQ ID NO: 3881436 - RNA, 15 nt, Human
auuuuaacacacaua

SEQ ID NO: 3881437 - RNA, 20 nt, Human
auuuuaacacacauaaagga

SEQ ID NO: 3881438 - RNA, 21 nt, Human
auuuuaacacacauaaaggau

SEQ ID NO: 3881439 - RNA, 13 nt, Human
auuuuaacaugga

SEQ ID NO: 3881440 - RNA, 18 nt, Human
auuuuaacuaaauuuuaa

SEQ ID NO: 3881441 - RNA, 19 nt, Human
auuuuaacuuaacugaaau

SEQ ID NO: 3881442 - RNA, 19 nt, Human
auuuuaagacguguuugug

SEQ ID NO: 3881443 - RNA, 14 nt, Human
auuuuaagcacucu

SEQ ID NO: 3881444 - RNA, 14 nt, Human
auuuuaagcauuac

SEQ ID NO: 3881445 - RNA, 15 nt, Human
auuuuaagcauuacu

SEQ ID NO: 3881446 - RNA, 15 nt, Human
auuuuaagcauugug

SEQ ID NO: 3881447 - RNA, 19 nt, Human
auuuuaagcauugugagua

SEQ ID NO: 3881448 - RNA, 16 nt, Human
auuuuaagccuuuguu

SEQ ID NO: 3881449 - RNA, 22 nt, Human
auuuuaagccuuuguugaacug

SEQ ID NO: 3881450 - RNA, 23 nt, Human
auuuuaagccuuuguugaacugu

SEQ ID NO: 3881451 - RNA, 16 nt, Human
auuuuaagcuaggaaa

SEQ ID NO: 3881452 - RNA, 19 nt, Human
auuuuaaguauugcaucug

SEQ ID NO: 3881453 - RNA, 22 nt, Human
auuuuaaguauugcaucuguau

SEQ ID NO: 3881454 - RNA, 23 nt, Human
auuuuaaguauugcaucuguaua

SEQ ID NO: 3881455 - RNA, 12 nt, Human
auuuuaagugcu

SEQ ID NO: 3881456 - RNA, 14 nt, Human
auuuuaagugcuuu

SEQ ID NO: 3881457 - RNA, 20 nt, Human
auuuuaagugcuuuguaaug

SEQ ID NO: 3881458 - RNA, 13 nt, Human
auuuuaaucuaau

SEQ ID NO: 3881459 - RNA, 22 nt, Human
auuuuaauguacuaauauuucu

SEQ ID NO: 3881460 - RNA, 16 nt, Human
auuuuaaugugaugau

SEQ ID NO: 3881461 - RNA, 13 nt, Human
auuuuaauuauua

SEQ ID NO: 3881462 - RNA, 15 nt, Human
auuuuaauucaguug

SEQ ID NO: 3881463 - RNA, 12 nt, Human
auuuuaauucau

SEQ ID NO: 3881464 - RNA, 13 nt, Human
auuuuaauuguca

SEQ ID NO: 3881465 - RNA, 15 nt, Human
auuuuaauugucaug

SEQ ID NO: 3881466 - RNA, 15 nt, Human
auuuuaauuuaguaa

SEQ ID NO: 3881467 - RNA, 20 nt, Human
auuuuaauuuaguaaauguu

SEQ ID NO: 3881468 - RNA, 18 nt, Human
auuuuaauuuaugaguuu

SEQ ID NO: 3881469 - RNA, 13 nt, Human
auuuuaauuucaa

SEQ ID NO: 3881470 - RNA, 18 nt, Human
auuuuaauuuuaaccaaa

SEQ ID NO: 3881471 - RNA, 17 nt, Human
auuuuaauuuuuaaaug

SEQ ID NO: 3881472 - RNA, 19 nt, Human
auuuuaauuuuugcuuuua

SEQ ID NO: 3881473 - RNA, 13 nt, Human
auuuuacaauuga

SEQ ID NO: 3881474 - RNA, 17 nt, Human
auuuuacaauugaaaug

SEQ ID NO: 3881475 - RNA, 12 nt, Human
auuuuacaauuu

SEQ ID NO: 3881476 - RNA, 18 nt, Human
auuuuacacagaaacacu

SEQ ID NO: 3881477 - RNA, 23 nt, Human
auuuuacacagaaacacugccuu

SEQ ID NO: 3881478 - RNA, 19 nt, Human
auuuuacacauuagauuuu

SEQ ID NO: 3881479 - RNA, 21 nt, Human
auuuuacacgcuuuugugaug

SEQ ID NO: 3881480 - RNA, 13 nt, Human
auuuuacagagcg

SEQ ID NO: 3881481 - RNA, 14 nt, Human
auuuuacaguuaag

SEQ ID NO: 3881482 - RNA, 13 nt, Human
auuuuacaugaag

SEQ ID NO: 3881483 - RNA, 20 nt, Human
auuuuaccaaguuauauaaa

SEQ ID NO: 3881484 - RNA, 22 nt, Human
auuuuaccaaguuauauaaaga

SEQ ID NO: 3881485 - RNA, 17 nt, Human
auuuuacuacuguggaa

SEQ ID NO: 3881486 - RNA, 22 nt, Human
auuuuacuacuguggaaaaaua

SEQ ID NO: 3881487 - RNA, 15 nt, Human
auuuuacugucuuaa

SEQ ID NO: 3881488 - RNA, 18 nt, Human
auuuuacuucuagagaua

SEQ ID NO: 3881489 - RNA, 17 nt, Human
auuuuacuuuuuggaaa

SEQ ID NO: 3881490 - RNA, 15 nt, Human
auuuuagaaauauuc

SEQ ID NO: 3881491 - RNA, 16 nt, Human
auuuuagaauaaauuc

SEQ ID NO: 3881492 - RNA, 13 nt, Human
auuuuagcagaga

SEQ ID NO: 3881493 - RNA, 18 nt, Human
auuuuagcgugcucacug

SEQ ID NO: 3881494 - RNA, 16 nt, Human
auuuuagcugcagaac

SEQ ID NO: 3881495 - RNA, 13 nt, Human
auuuuaggaaagg

SEQ ID NO: 3881496 - RNA, 15 nt, Human
auuuuaggaaaggau

SEQ ID NO: 3881497 - RNA, 21 nt, Human
auuuuaggaaaugaaugugug

SEQ ID NO: 3881498 - RNA, 17 nt, Human
auuuuaggaacuucaga

SEQ ID NO: 3881499 - RNA, 19 nt, Human
auuuuaggaacuucagaga

SEQ ID NO: 3881500 - RNA, 18 nt, Human
auuuuaggagcuaaggcu

SEQ ID NO: 3881501 - RNA, 20 nt, Human
auuuuaggagcuaaggcucu

SEQ ID NO: 3881502 - RNA, 21 nt, Human
auuuuaggagcuaaggcucua

SEQ ID NO: 3881503 - RNA, 15 nt, Human
auuuuagguguugau

SEQ ID NO: 3881504 - RNA, 17 nt, Human
auuuuaguauauuuaua

SEQ ID NO: 3881505 - RNA, 13 nt, Human
auuuuaguauuca

SEQ ID NO: 3881506 - RNA, 16 nt, Human
auuuuaguauucauuc

SEQ ID NO: 3881507 - RNA, 19 nt, Human
auuuuaguauucauucugc

SEQ ID NO: 3881508 - RNA, 20 nt, Human
auuuuaguauucauucugca

SEQ ID NO: 3881509 - RNA, 14 nt, Human
auuuuagucacuuu

SEQ ID NO: 3881510 - RNA, 19 nt, Human
caacuuuuuauugccuucu

SEQ ID NO: 3881511 - RNA, 15 nt, Human
caagaaaaaaaaaug

SEQ ID NO: 3881512 - RNA, 16 nt, Human
caagaaaaaaaaaugc

SEQ ID NO: 3881513 - RNA, 19 nt, Human
caagaaaaaaaaaugccau

SEQ ID NO: 3881514 - RNA, 20 nt, Human
caagaaaaauaaagaaaaga

SEQ ID NO: 3881515 - RNA, 21 nt, Human
caagaaaacaggcacugcccu

SEQ ID NO: 3881516 - RNA, 12 nt, Human
caagaaaacaua

SEQ ID NO: 3881517 - RNA, 18 nt, Human
caagaaaauaagagcuca

SEQ ID NO: 3881518 - RNA, 12 nt, Human
caagaaaaucag

SEQ ID NO: 3881519 - RNA, 12 nt, Human
caagaaacagcc

SEQ ID NO: 3881520 - RNA, 18 nt, Human
caagaaacagccagcaag

SEQ ID NO: 3881521 - RNA, 15 nt, Human
caagaaagaaacccg

SEQ ID NO: 3881522 - RNA, 15 nt, Human
caagaaagccagucu

SEQ ID NO: 3881523 - RNA, 16 nt, Human
caagaaagccagucuu

SEQ ID NO: 3881524 - RNA, 20 nt, Human
caagaaagcucacuguagcu

SEQ ID NO: 3881525 - RNA, 12 nt, Human
caagaaaggaga

SEQ ID NO: 3881526 - RNA, 21 nt, Human
caagaaagggccaggagaugg

SEQ ID NO: 3881527 - RNA, 22 nt, Human
caagaaagggccaggagaugga

SEQ ID NO: 3881528 - RNA, 15 nt, Human
caagaaaucccuguu

SEQ ID NO: 3881529 - RNA, 15 nt, Human
caagaaaugaaagca

SEQ ID NO: 3881530 - RNA, 17 nt, Human
caagaaaugaaagcagg

SEQ ID NO: 3881531 - RNA, 19 nt, Human
caagaaaugaaagcaggga

SEQ ID NO: 3881532 - RNA, 13 nt, Human
caagaaauuugau

SEQ ID NO: 3881533 - RNA, 17 nt, Human
caagaacacacacauau

SEQ ID NO: 3881534 - RNA, 13 nt, Human
caagaacagcagg

SEQ ID NO: 3881535 - RNA, 10 nt, Human
caagaaccug

SEQ ID NO: 3881536 - RNA, 21 nt, Human
caagaacucaucacuguggcu

SEQ ID NO: 3881537 - RNA, 14 nt, Human
caagaacuuguuua

SEQ ID NO: 3881538 - RNA, 19 nt, Human
caagaagaagggcacccua

SEQ ID NO: 3881539 - RNA, 20 nt, Human
caagaagaucacgcuccccg

SEQ ID NO: 3881540 - RNA, 21 nt, Human
caagaagaucacgcuccccgc

SEQ ID NO: 3881541 - RNA, 12 nt, Human
caagaagaugaa

SEQ ID NO: 3881542 - RNA, 13 nt, Human
caagaagaugaau

SEQ ID NO: 3881543 - RNA, 18 nt, Human
caagaagaugaauggcgu

SEQ ID NO: 3881544 - RNA, 21 nt, Human
caagaagcaauguuauaaagu

SEQ ID NO: 3881545 - RNA, 14 nt, Human
caagaagcaguggc

SEQ ID NO: 3881546 - RNA, 18 nt, Human
caagaagcaguggccuua

SEQ ID NO: 3881547 - RNA, 15 nt, Human
caagaagcccaggaa

SEQ ID NO: 3881548 - RNA, 21 nt, Human
caagaagcgugagacgccacc

SEQ ID NO: 3881549 - RNA, 12 nt, Human
caagaaggauuu

SEQ ID NO: 3881550 - RNA, 14 nt, Human
caagaaggcugggg

SEQ ID NO: 3881551 - RNA, 18 nt, Human
caagaagggacugagaga

SEQ ID NO: 3881552 - RNA, 12 nt, Human
caagaagggcug

SEQ ID NO: 3881553 - RNA, 16 nt, Human
caagaagggcugcaug

SEQ ID NO: 3881554 - RNA, 22 nt, Human
caagaaggguuuuccacccugg

SEQ ID NO: 3881555 - RNA, 23 nt, Human
caagaaggguuuuccacccugga

SEQ ID NO: 3881556 - RNA, 20 nt, Human
caagaaguagcagugucugu

SEQ ID NO: 3881557 - RNA, 17 nt, Human
caagaauaaucacgcuu

SEQ ID NO: 3881558 - RNA, 20 nt, Human
caagaauaaucacgcuuucc

SEQ ID NO: 3881559 - RNA, 23 nt, Human
caagaauaaucacgcuuuccuga

SEQ ID NO: 3881560 - RNA, 15 nt, Human
caagaauacuacuua

SEQ ID NO: 3881561 - RNA, 18 nt, Human
caagaauagcaucuguac

SEQ ID NO: 3881562 - RNA, 18 nt, Human
caagaauauccuuuaaaa

SEQ ID NO: 3881563 - RNA, 13 nt, Human
caagaauauugca

SEQ ID NO: 3881564 - RNA, 15 nt, Human
caagaauauugcaaa

SEQ ID NO: 3881565 - RNA, 20 nt, Human
caagaauauugcaaaauaca

SEQ ID NO: 3881566 - RNA, 23 nt, Human
caagaauauugcaaaauacauga

SEQ ID NO: 3881567 - RNA, 16 nt, Human
caagaauauugucccu

SEQ ID NO: 3881568 - RNA, 19 nt, Human
caagaaucagugcaaagau

SEQ ID NO: 3881569 - RNA, 13 nt, Human
caagaaugaaggu

SEQ ID NO: 3881570 - RNA, 15 nt, Human
caagaaugcauugau

SEQ ID NO: 3881571 - RNA, 16 nt, Human
caagaaugcauugaua

SEQ ID NO: 3881572 - RNA, 15 nt, Human
caagaaugcugaaac

SEQ ID NO: 3881573 - RNA, 17 nt, Human
caagaaugcugaaacca

SEQ ID NO: 3881574 - RNA, 19 nt, Human
caagaauucuccaaaacaa

SEQ ID NO: 3881575 - RNA, 21 nt, Human
caagaauucuccaaaacaauu

SEQ ID NO: 3881576 - RNA, 22 nt, Human
caagaauugaagcaggacuaaa

SEQ ID NO: 3881577 - RNA, 21 nt, Human
caagaauuggaagcugcccug

SEQ ID NO: 3881578 - RNA, 20 nt, Human
caagaauuucuaggacugaa

SEQ ID NO: 3881579 - RNA, 23 nt, Human
caagaauuucuaggacugaauua

SEQ ID NO: 3881580 - RNA, 22 nt, Human
caagaauuugaucguuccaguu

SEQ ID NO: 3881581 - RNA, 14 nt, Human
caagacaaaccaag

SEQ ID NO: 3881582 - RNA, 14 nt, Human
caagacaaaucaac

SEQ ID NO: 3881583 - RNA, 15 nt, Human
caagacaaaucaaca

SEQ ID NO: 3881584 - RNA, 20 nt, Human
caagacaaaucaacagaagc

SEQ ID NO: 3881585 - RNA, 16 nt, Human
caagacaacauuguaa

SEQ ID NO: 3881586 - RNA, 15 nt, Human
caagacacaucccua

SEQ ID NO: 3881587 - RNA, 17 nt, Human
caagacagaagcugaag

SEQ ID NO: 3881588 - RNA, 18 nt, Human
caagacagaagcugaagu

SEQ ID NO: 3881589 - RNA, 17 nt, Human
caagacaugucuguucu

SEQ ID NO: 3881590 - RNA, 15 nt, Human
caagacauuaaaucu

SEQ ID NO: 3881591 - RNA, 16 nt, Human
caagaccacguuucua

SEQ ID NO: 3881592 - RNA, 22 nt, Human
caagaccagacucgccaacaug

SEQ ID NO: 3881593 - RNA, 14 nt, Human
caagaccagccugg

SEQ ID NO: 3881594 - RNA, 15 nt, Human
caagaccagccuggc

SEQ ID NO: 3881595 - RNA, 18 nt, Human
caagacccuugugguccc

SEQ ID NO: 3881596 - RNA, 23 nt, Human
caagacccuuguggucccacccc

SEQ ID NO: 3881597 - RNA, 23 nt, Human
caagaccucagggcacaaagaug

SEQ ID NO: 3881598 - RNA, 14 nt, Human
caagaccuguuggu

SEQ ID NO: 3881599 - RNA, 17 nt, Human
caagaccuguugguucc

SEQ ID NO: 3881600 - RNA, 16 nt, Human
caagaccuucuccuuc

SEQ ID NO: 3881601 - RNA, 17 nt, Human
caagaccuucuccuuca

SEQ ID NO: 3881602 - RNA, 21 nt, Human
caagaccuucuccuucaccuu

SEQ ID NO: 3881603 - RNA, 22 nt, Human
caagacucugucuaaaaaacaa

SEQ ID NO: 3881604 - RNA, 23 nt, Human
caagacucugucuaaaaaacaaa

SEQ ID NO: 3881605 - RNA, 19 nt, Human
caagacugcacaucaaaau

SEQ ID NO: 3881606 - RNA, 19 nt, Human
caagacugcuguggccagg

SEQ ID NO: 3881607 - RNA, 22 nt, Human
caagacugcuguggccaggagg

SEQ ID NO: 3881608 - RNA, 16 nt, Human
caagacuguugcucaa

SEQ ID NO: 3881609 - RNA, 17 nt, Human
caagacuuauuuucaca

SEQ ID NO: 3881610 - RNA, 20 nt, Human
caagacuucucuuugccuca

SEQ ID NO: 3881611 - RNA, 20 nt, Human
caagacuuggcaacagaagc

SEQ ID NO: 3881612 - RNA, 18 nt, Human
caagacuuuucuuugaag

SEQ ID NO: 3881613 - RNA, 21 nt, Human
caagagaaaggccugcacaca

SEQ ID NO: 3881614 - RNA, 16 nt, Human
caagagaagcauucuc

SEQ ID NO: 3881615 - RNA, 19 nt, Human
caagagacccuucaaacuu

SEQ ID NO: 3881616 - RNA, 12 nt, Human
caagagacucug

SEQ ID NO: 3881617 - RNA, 12 nt, Human
caagagacugag

SEQ ID NO: 3881618 - RNA, 13 nt, Human
caagagacugagu

SEQ ID NO: 3881619 - RNA, 19 nt, Human
caagagagaaccuaacugu

SEQ ID NO: 3881620 - RNA, 13 nt, Human
caagagagauguu

SEQ ID NO: 3881621 - RNA, 15 nt, Human
caagagagauguuuu

SEQ ID NO: 3881622 - RNA, 16 nt, Human
caagagaugggaauga

SEQ ID NO: 3881623 - RNA, 16 nt, Human
caagagcacacuuggc

SEQ ID NO: 3881624 - RNA, 20 nt, Human
caagagcagccuguggcauc

SEQ ID NO: 3881625 - RNA, 16 nt, Human
caagagcaucaugccu

SEQ ID NO: 3881626 - RNA, 20 nt, Human
caagagccauguagaagcug

SEQ ID NO: 3881627 - RNA, 21 nt, Human
caagagccauguagaagcugc

SEQ ID NO: 3881628 - RNA, 13 nt, Human
caagagcccagca

SEQ ID NO: 3881629 - RNA, 22 nt, Human
caagagcccccuugacaccggg

SEQ ID NO: 3881630 - RNA, 21 nt, Human
caagagccugaucucuuccug

SEQ ID NO: 3881631 - RNA, 12 nt, Human
caagagccuuaa

SEQ ID NO: 3881632 - RNA, 12 nt, Human
caagagccuugg

SEQ ID NO: 3881633 - RNA, 12 nt, Human
caagagcugagg

SEQ ID NO: 3881634 - RNA, 13 nt, Human
caagagcugcccu

SEQ ID NO: 3881635 - RNA, 14 nt, Human
caagagcugcccuc

SEQ ID NO: 3881636 - RNA, 19 nt, Human
caagaggaaguucagaucu

SEQ ID NO: 3881637 - RNA, 20 nt, Human
caagaggaaguucagaucuu

SEQ ID NO: 3881638 - RNA, 15 nt, Human
caagaggaaugaaaa

SEQ ID NO: 3881639 - RNA, 21 nt, Human
caagaggagcccccacccugu

SEQ ID NO: 3881640 - RNA, 15 nt, Human
caagaggcaagcuga

SEQ ID NO: 3881641 - RNA, 20 nt, Human
caagaggcaagcugaaauuu

SEQ ID NO: 3881642 - RNA, 19 nt, Human
caagaggccguggcugcug

SEQ ID NO: 3881643 - RNA, 17 nt, Human
caagagggacgccuggg

SEQ ID NO: 3881644 - RNA, 15 nt, Human
caagagggcacuggu

SEQ ID NO: 3881645 - RNA, 21 nt, Human
caagaggggguggaggggugu

SEQ ID NO: 3881646 - RNA, 21 nt, Human
caagagggguggagacugcuu

SEQ ID NO: 3881647 - RNA, 23 nt, Human
caagagggguggagacugcuucc

SEQ ID NO: 3881648 - RNA, 16 nt, Human
caagagggucugagga

SEQ ID NO: 3881649 - RNA, 17 nt, Human
caagagggucugaggaa

SEQ ID NO: 3881650 - RNA, 15 nt, Human
caagagguacagggu

SEQ ID NO: 3881651 - RNA, 21 nt, Human
caagagguacaggguuuuuac

SEQ ID NO: 3881652 - RNA, 22 nt, Human
caagagguuuggcuccugccca

SEQ ID NO: 3881653 - RNA, 23 nt, Human
caagagguuuggcuccugcccac

SEQ ID NO: 3881654 - RNA, 22 nt, Human
caagaguaguuauauaauuguu

SEQ ID NO: 3881655 - RNA, 22 nt, Human
caagugaaaaaggaggaagaga

SEQ ID NO: 3881656 - RNA, 13 nt, Human
caagugaacacau

SEQ ID NO: 3881657 - RNA, 12 nt, Human
caagugaagguu

SEQ ID NO: 3881658 - RNA, 21 nt, Human
caagugaagguuuacaauuua

SEQ ID NO: 3881659 - RNA, 19 nt, Human
caagugaauuuuucucuaa

SEQ ID NO: 3881660 - RNA, 15 nt, Human
caagugacaucucuu

SEQ ID NO: 3881661 - RNA, 14 nt, Human
caagugagacccug

SEQ ID NO: 3881662 - RNA, 15 nt, Human
caagugagacccugu

SEQ ID NO: 3881663 - RNA, 17 nt, Human
caagugagagcugggug

SEQ ID NO: 3881664 - RNA, 18 nt, Human
caagugagagcugggugu

SEQ ID NO: 3881665 - RNA, 18 nt, Human
caagugauucucaugccu

SEQ ID NO: 3881666 - RNA, 16 nt, Human
caagugauucuccugc

SEQ ID NO: 3881667 - RNA, 17 nt, Human
caagugauucuccugcc

SEQ ID NO: 3881668 - RNA, 18 nt, Human
caagugauucuccugccu

SEQ ID NO: 3881669 - RNA, 15 nt, Human
caagugauugaaaau

SEQ ID NO: 3881670 - RNA, 19 nt, Human
caagugauugaaaauagua

SEQ ID NO: 3881671 - RNA, 20 nt, Human
caagugcacggggcacagcg

SEQ ID NO: 3881672 - RNA, 14 nt, Human
caagugcaggcugg

SEQ ID NO: 3881673 - RNA, 13 nt, Human
caagugccagagg

SEQ ID NO: 3881674 - RNA, 15 nt, Human
caagugccagaggug

SEQ ID NO: 3881675 - RNA, 17 nt, Human
caagugccagagguggg

SEQ ID NO: 3881676 - RNA, 18 nt, Human
caagugccgcaaauugua

SEQ ID NO: 3881677 - RNA, 16 nt, Human
caagugccugcuuuua

SEQ ID NO: 3881678 - RNA, 17 nt, Human
caagugcugaacagugg

SEQ ID NO: 3881679 - RNA, 18 nt, Human
caagugcugaacagugga

SEQ ID NO: 3881680 - RNA, 20 nt, Human
caagugcugccccugccugu

SEQ ID NO: 3881681 - RNA, 14 nt, Human
caagugcuggaguc

SEQ ID NO: 3881682 - RNA, 21 nt, Human
caaguggaccuuaggccuucc

SEQ ID NO: 3881683 - RNA, 23 nt, Human
caaguggaccuuaggccuuccuc

SEQ ID NO: 3881684 - RNA, 15 nt, Human
caaguggacucaggg

SEQ ID NO: 3881685 - RNA, 18 nt, Human
caaguggacucagggcag

SEQ ID NO: 3881686 - RNA, 23 nt, Human
caaguggacucagggcagcgcca

SEQ ID NO: 3881687 - RNA, 20 nt, Human
caaguggcaaagcuguucuu

SEQ ID NO: 3881688 - RNA, 23 nt, Human
caaguggcagagcuuggacugga

SEQ ID NO: 3881689 - RNA, 19 nt, Human
caaguggcucccacacccu

SEQ ID NO: 3881690 - RNA, 17 nt, Human
caaguggggcucgccau

SEQ ID NO: 3881691 - RNA, 15 nt, Human
caaguggggugcugg

SEQ ID NO: 3881692 - RNA, 18 nt, Human
caaguggggugcugggag

SEQ ID NO: 3881693 - RNA, 21 nt, Human
caaguggggugcugggaggag

SEQ ID NO: 3881694 - RNA, 19 nt, Human
caaguggguacccccagga

SEQ ID NO: 3881695 - RNA, 21 nt, Human
caagugguuuccacaugcucu

SEQ ID NO: 3881696 - RNA, 23 nt, Human
caaguguaaaauauuuugaauca

SEQ ID NO: 3881697 - RNA, 12 nt, Human
caaguguaauga

SEQ ID NO: 3881698 - RNA, 15 nt, Human
caaguguaaugaaua

SEQ ID NO: 3881699 - RNA, 18 nt, Human
caaguguauaucagaaaa

SEQ ID NO: 3881700 - RNA, 14 nt, Human
caagugucuuccau

SEQ ID NO: 3881701 - RNA, 14 nt, Human
caagugugaacaaa

SEQ ID NO: 3881702 - RNA, 17 nt, Human
caagugugcauauugua

SEQ ID NO: 3881703 - RNA, 21 nt, Human
caagugugcauauuguacacu

SEQ ID NO: 3881704 - RNA, 23 nt, Human
caagugugcauauuguacacuuu

SEQ ID NO: 3881705 - RNA, 22 nt, Human
caagugugguagagugugccug

SEQ ID NO: 3881706 - RNA, 23 nt, Human
caagugugguagggacuuaaaaa

SEQ ID NO: 3881707 - RNA, 22 nt, Human
caagugugugccaccaugccuc

SEQ ID NO: 3881708 - RNA, 11 nt, Human
caagugugugu

SEQ ID NO: 3881709 - RNA, 16 nt, Human
caaguguucacaaccu

SEQ ID NO: 3881710 - RNA, 12 nt, Human
caaguuaaaugu

SEQ ID NO: 3881711 - RNA, 14 nt, Human
caaguuaagagaaa

SEQ ID NO: 3881712 - RNA, 17 nt, Human
caaguuaagagaaacuu

SEQ ID NO: 3881713 - RNA, 15 nt, Human
caaguuaagauucuu

SEQ ID NO: 3881714 - RNA, 16 nt, Human
caaguuagaaaacaua

SEQ ID NO: 3881715 - RNA, 17 nt, Human
caaguuagcucaggagg

SEQ ID NO: 3881716 - RNA, 12 nt, Human
caaguucaaucu

SEQ ID NO: 3881717 - RNA, 22 nt, Human
caaguucacaccugcagauucu

SEQ ID NO: 3881718 - RNA, 17 nt, Human
caaguucaugcagcugu

SEQ ID NO: 3881719 - RNA, 20 nt, Human
caaguuccucuaacuuggcu

SEQ ID NO: 3881720 - RNA, 21 nt, Human
caaguuccucuaacuuggcuc

SEQ ID NO: 3881721 - RNA, 14 nt, Human
caaguucuaagauu

SEQ ID NO: 3881722 - RNA, 20 nt, Human
caaguucuaagauucuaaug

SEQ ID NO: 3881723 - RNA, 16 nt, Human
caaguucuagagaaga

SEQ ID NO: 3881724 - RNA, 13 nt, Human
caaguucuauuua

SEQ ID NO: 3881725 - RNA, 17 nt, Human
caaguugaagacuuugu

SEQ ID NO: 3881726 - RNA, 18 nt, Human
caaguuggaugcggccau

SEQ ID NO: 3881727 - RNA, 15 nt, Human
caaguuguaaauaau

SEQ ID NO: 3881728 - RNA, 19 nt, Human
caaguugugccaaauuauu

SEQ ID NO: 3881729 - RNA, 22 nt, Human
caaguuguuccuuaagucagaa

SEQ ID NO: 3881730 - RNA, 16 nt, Human
caaguuguuucauuga

SEQ ID NO: 3881731 - RNA, 13 nt, Human
caaguuguuugag

SEQ ID NO: 3881732 - RNA, 13 nt, Human
caaguuucaucca

SEQ ID NO: 3881733 - RNA, 20 nt, Human
caaguuucauccagaacuac

SEQ ID NO: 3881734 - RNA, 22 nt, Human
caaguuuccaagcaaauguuac

SEQ ID NO: 3881735 - RNA, 13 nt, Human
caaguuuuaaagu

SEQ ID NO: 3881736 - RNA, 15 nt, Human
caaguuuuaaaguuc

SEQ ID NO: 3881737 - RNA, 20 nt, Human
caaguuuucauaagcacacu

SEQ ID NO: 3881738 - RNA, 16 nt, Human
caaguuuucccugaag

SEQ ID NO: 3881739 - RNA, 17 nt, Human
caaguuuucuuccauga

SEQ ID NO: 3881740 - RNA, 11 nt, Human
caaguuuugug

SEQ ID NO: 3881741 - RNA, 17 nt, Human
caaguuuugugaaauuu

SEQ ID NO: 3881742 - RNA, 17 nt, Human
caauaaaaaauuaugac

SEQ ID NO: 3881743 - RNA, 16 nt, Human
caauaaaaauggcuca

SEQ ID NO: 3881744 - RNA, 20 nt, Human
caauaaaaauguuuaacggu

SEQ ID NO: 3881745 - RNA, 14 nt, Human
caauaaaacauuaa

SEQ ID NO: 3881746 - RNA, 15 nt, Human
caauaaaagcccagg

SEQ ID NO: 3881747 - RNA, 18 nt, Human
caauaaaagcccaggagc

SEQ ID NO: 3881748 - RNA, 22 nt, Human
caauaaaagcccaggagcccau

SEQ ID NO: 3881749 - RNA, 17 nt, Human
caauaaaauauuauuga

SEQ ID NO: 3881750 - RNA, 21 nt, Human
caauaaaauauuauugaacua

SEQ ID NO: 3881751 - RNA, 15 nt, Human
caauaaaaucaugua

SEQ ID NO: 3881752 - RNA, 23 nt, Human
caauaaaauccauacauuugugu

SEQ ID NO: 3881753 - RNA, 20 nt, Human
caauaaaaugugauuuuucu

SEQ ID NO: 3881754 - RNA, 18 nt, Human
caauaaaauuauuugcag

SEQ ID NO: 3881755 - RNA, 20 nt, Human
caauaaaauuuuuuuaaagu

SEQ ID NO: 3881756 - RNA, 18 nt, Human
caauaaaauuuuuuuuca

SEQ ID NO: 3881757 - RNA, 16 nt, Human
caauaaacaacagcug

SEQ ID NO: 3881758 - RNA, 15 nt, Human
caauaaacccucaga

SEQ ID NO: 3881759 - RNA, 19 nt, Human
caauaaacgauuuaauucu

SEQ ID NO: 3881760 - RNA, 19 nt, Human
caauaaagaaaacuuccau

SEQ ID NO: 3881761 - RNA, 13 nt, Human
caauaaagaagag

SEQ ID NO: 3881762 - RNA, 12 nt, Human
caauaaagagau

SEQ ID NO: 3881763 - RNA, 16 nt, Human
caauaaagcacugagc

SEQ ID NO: 3881764 - RNA, 14 nt, Human
caauaaagcauuua

SEQ ID NO: 3881765 - RNA, 15 nt, Human
caauaaagcauuuau

SEQ ID NO: 3881766 - RNA, 15 nt, Human
caauaaagccuucaa

SEQ ID NO: 3881767 - RNA, 17 nt, Human
caauaaagcugcugaga

SEQ ID NO: 3881768 - RNA, 14 nt, Human
caauaaagcuuguu

SEQ ID NO: 3881769 - RNA, 13 nt, Human
caauaaaguauuu

SEQ ID NO: 3881770 - RNA, 17 nt, Human
caauaaaguauuuaauu

SEQ ID NO: 3881771 - RNA, 17 nt, Human
caauaaaucugacccag

SEQ ID NO: 3881772 - RNA, 23 nt, Human
caauaaaugguauagcaaauguu

SEQ ID NO: 3881773 - RNA, 13 nt, Human
caauaaauugcua

SEQ ID NO: 3881774 - RNA, 13 nt, Human
caauaaauuuuga

SEQ ID NO: 3881775 - RNA, 18 nt, Human
caauaaauuuugaaaagu

SEQ ID NO: 3881776 - RNA, 17 nt, Human
caauaacacuaaaauuu

SEQ ID NO: 3881777 - RNA, 14 nt, Human
caauaacagcugca

SEQ ID NO: 3881778 - RNA, 15 nt, Human
caauaacagcugcaa

SEQ ID NO: 3881779 - RNA, 15 nt, Human
caauaacguuuaagc

SEQ ID NO: 3881780 - RNA, 15 nt, Human
caauaacuacugugu

SEQ ID NO: 3881781 - RNA, 16 nt, Human
caauaacuacuguguu

SEQ ID NO: 3881782 - RNA, 22 nt, Human
caauaacuacuguguuccuggc

SEQ ID NO: 3881783 - RNA, 18 nt, Human
caauaacuccucccaggg

SEQ ID NO: 3881784 - RNA, 18 nt, Human
caauaacuggaacacucu

SEQ ID NO: 3881785 - RNA, 13 nt, Human
caauaacuucuga

SEQ ID NO: 3881786 - RNA, 20 nt, Human
caauaagaauuuagggagaa

SEQ ID NO: 3881787 - RNA, 12 nt, Human
caauaagccuug

SEQ ID NO: 3881788 - RNA, 11 nt, Human
caauaauaaaa

SEQ ID NO: 3881789 - RNA, 19 nt, Human
caauaauaaauauuuuugc

SEQ ID NO: 3881790 - RNA, 21 nt, Human
caauaauauuguuguauaauu

SEQ ID NO: 3881791 - RNA, 22 nt, Human
caauaauauuguuguauaauuu

SEQ ID NO: 3881792 - RNA, 15 nt, Human
caauaauggaaaaaa

SEQ ID NO: 3881793 - RNA, 18 nt, Human
caauaauggucccaucca

SEQ ID NO: 3881794 - RNA, 23 nt, Human
caauaauggucccauccaggcag

SEQ ID NO: 3881795 - RNA, 21 nt, Human
caauaauuauuugucucagau

SEQ ID NO: 3881796 - RNA, 19 nt, Human
caauaauucauauucuuca

SEQ ID NO: 3881797 - RNA, 16 nt, Human
caauaauugcagaacu

SEQ ID NO: 3881798 - RNA, 14 nt, Human
caauacaaauggau

SEQ ID NO: 3881799 - RNA, 21 nt, Human
caauacaaauggauuuuggga

SEQ ID NO: 3881800 - RNA, 21 nt, Human
cacuccucugacucagggcuc

SEQ ID NO: 3881801 - RNA, 23 nt, Human
cacuccucugacucagggcuccu

SEQ ID NO: 3881802 - RNA, 16 nt, Human
cacuccugagaccccu

SEQ ID NO: 3881803 - RNA, 21 nt, Human
cacuccugagaccccuggccu

SEQ ID NO: 3881804 - RNA, 22 nt, Human
cacuccugagaccccuggccuc

SEQ ID NO: 3881805 - RNA, 11 nt, Human
cacuccugcuc

SEQ ID NO: 3881806 - RNA, 16 nt, Human
cacuccugcuguaaau

SEQ ID NO: 3881807 - RNA, 19 nt, Human
cacuccugcuuaaucuuca

SEQ ID NO: 3881808 - RNA, 17 nt, Human
cacuccuuccugccacc

SEQ ID NO: 3881809 - RNA, 18 nt, Human
cacuccuuccugccaccu

SEQ ID NO: 3881810 - RNA, 24 nt, Human
cacuccuuccugccaccugcugcu

SEQ ID NO: 3881811 - RNA, 15 nt, Human
cacuccuuuuaaaga

SEQ ID NO: 3881812 - RNA, 16 nt, Human
cacucgcauugacaca

SEQ ID NO: 3881813 - RNA, 15 nt, Human
cacucgcccgcccac

SEQ ID NO: 3881814 - RNA, 23 nt, Human
cacucgcccgcccacuguccugg

SEQ ID NO: 3881815 - RNA, 22 nt, Human
cacucgggaggcugagacagga

SEQ ID NO: 3881816 - RNA, 20 nt, Human
cacucggguuucucuguggc

SEQ ID NO: 3881817 - RNA, 15 nt, Human
cacucguguguuucu

SEQ ID NO: 3881818 - RNA, 18 nt, Human
cacucuaaaagguucagg

SEQ ID NO: 3881819 - RNA, 16 nt, Human
cacucuaagauguuau

SEQ ID NO: 3881820 - RNA, 17 nt, Human
cacucuaagucauguau

SEQ ID NO: 3881821 - RNA, 14 nt, Human
cacucuacuuagca

SEQ ID NO: 3881822 - RNA, 11 nt, Human
cacucuagauu

SEQ ID NO: 3881823 - RNA, 13 nt, Human
cacucuagccugg

SEQ ID NO: 3881824 - RNA, 15 nt, Human
cacucuagggcagug

SEQ ID NO: 3881825 - RNA, 17 nt, Human
cacucuaggggucaggc

SEQ ID NO: 3881826 - RNA, 18 nt, Human
cacucuagguuuuacaga

SEQ ID NO: 3881827 - RNA, 19 nt, Human
cacucuagucaaugacaug

SEQ ID NO: 3881828 - RNA, 15 nt, Human
cacucucagaggccc

SEQ ID NO: 3881829 - RNA, 22 nt, Human
cacucucaggaaaugcugaccc

SEQ ID NO: 3881830 - RNA, 14 nt, Human
cacucuccccacac

SEQ ID NO: 3881831 - RNA, 16 nt, Human
cacucuccugggcccc

SEQ ID NO: 3881832 - RNA, 19 nt, Human
cacucuccugggccccucc

SEQ ID NO: 3881833 - RNA, 21 nt, Human
cacucuccugggccccucccu

SEQ ID NO: 3881834 - RNA, 15 nt, Human
cacucuccuugcagu

SEQ ID NO: 3881835 - RNA, 20 nt, Human
cacucuccuugcuacccaga

SEQ ID NO: 3881836 - RNA, 12 nt, Human
cacucuccuugg

SEQ ID NO: 3881837 - RNA, 15 nt, Human
cacucucuaccagau

SEQ ID NO: 3881838 - RNA, 13 nt, Human
cacucucugaaga

SEQ ID NO: 3881839 - RNA, 14 nt, Human
cacucucugaagau

SEQ ID NO: 3881840 - RNA, 20 nt, Human
cacucugacgcaaaaccacu

SEQ ID NO: 3881841 - RNA, 15 nt, Human
cacucugcaggaaau

SEQ ID NO: 3881842 - RNA, 13 nt, Human
cacucugccaggg

SEQ ID NO: 3881843 - RNA, 23 nt, Human
cacucugccccccccccccaucu

SEQ ID NO: 3881844 - RNA, 19 nt, Human
cacucugccucugccugca

SEQ ID NO: 3881845 - RNA, 15 nt, Human
cacucugcucgccuu

SEQ ID NO: 3881846 - RNA, 14 nt, Human
cacucugcucugau

SEQ ID NO: 3881847 - RNA, 15 nt, Human
cacucugcucugccc

SEQ ID NO: 3881848 - RNA, 11 nt, Human
cacucugcugc

SEQ ID NO: 3881849 - RNA, 13 nt, Human
cacucugcuucuc

SEQ ID NO: 3881850 - RNA, 16 nt, Human
cacucugcuucucuga

SEQ ID NO: 3881851 - RNA, 16 nt, Human
cacucugcuuguuauu

SEQ ID NO: 3881852 - RNA, 19 nt, Human
cacucugcuuugacugagc

SEQ ID NO: 3881853 - RNA, 21 nt, Human
cacucugcuuugacugagcag

SEQ ID NO: 3881854 - RNA, 19 nt, Human
cacucuggauucagccuuc

SEQ ID NO: 3881855 - RNA, 13 nt, Human
cacucuggcagca

SEQ ID NO: 3881856 - RNA, 14 nt, Human
cacucuggcagcac

SEQ ID NO: 3881857 - RNA, 13 nt, Human
cacucuggcagcc

SEQ ID NO: 3881858 - RNA, 14 nt, Human
cacucuggcagcca

SEQ ID NO: 3881859 - RNA, 15 nt, Human
cacucuggcagcuca

SEQ ID NO: 3881860 - RNA, 20 nt, Human
cacucugggcacacucugcc

SEQ ID NO: 3881861 - RNA, 14 nt, Human
cacucuguaauuga

SEQ ID NO: 3881862 - RNA, 23 nt, Human
cacucuguaauugaauauuauuc

SEQ ID NO: 3881863 - RNA, 18 nt, Human
cacucugucgagccuggg

SEQ ID NO: 3881864 - RNA, 19 nt, Human
cacucugucgcccagucug

SEQ ID NO: 3881865 - RNA, 14 nt, Human
cacucugugcccau

SEQ ID NO: 3881866 - RNA, 23 nt, Human
cacucugugucugaguggcuuca

SEQ ID NO: 3881867 - RNA, 17 nt, Human
cacucuguuauuuagac

SEQ ID NO: 3881868 - RNA, 20 nt, Human
cacucuguucauuccuccag

SEQ ID NO: 3881869 - RNA, 22 nt, Human
cacucuuaaagcaaaaaaugaa

SEQ ID NO: 3881870 - RNA, 11 nt, Human
cacucuuaggc

SEQ ID NO: 3881871 - RNA, 19 nt, Human
cacucuuaugcuguaccca

SEQ ID NO: 3881872 - RNA, 20 nt, Human
cacucuuauugcccacgcug

SEQ ID NO: 3881873 - RNA, 14 nt, Human
cacucuucauggug

SEQ ID NO: 3881874 - RNA, 14 nt, Human
cacucuuccugagu

SEQ ID NO: 3881875 - RNA, 19 nt, Human
cacucuuggagccugcaga

SEQ ID NO: 3881876 - RNA, 14 nt, Human
cacucuuguuucuc

SEQ ID NO: 3881877 - RNA, 15 nt, Human
cacucuuuaccuuua

SEQ ID NO: 3881878 - RNA, 20 nt, Human
cacucuuuauagugcacaaa

SEQ ID NO: 3881879 - RNA, 12 nt, Human
cacucuuuguaa

SEQ ID NO: 3881880 - RNA, 14 nt, Human
cacucuuuuauaca

SEQ ID NO: 3881881 - RNA, 15 nt, Human
cacucuuuuauacaa

SEQ ID NO: 3881882 - RNA, 12 nt, Human
cacugaaaaaau

SEQ ID NO: 3881883 - RNA, 17 nt, Human
cacugaaaaaauauaug

SEQ ID NO: 3881884 - RNA, 11 nt, Human
cacugaaaaau

SEQ ID NO: 3881885 - RNA, 23 nt, Human
cacugaaaaaucuaagugauaua

SEQ ID NO: 3881886 - RNA, 15 nt, Human
cacugaaaacaucug

SEQ ID NO: 3881887 - RNA, 16 nt, Human
cacugaaaacaucugg

SEQ ID NO: 3881888 - RNA, 22 nt, Human
cacugaaaauuggacagauugc

SEQ ID NO: 3881889 - RNA, 14 nt, Human
cacugaaaccuuua

SEQ ID NO: 3881890 - RNA, 21 nt, Human
cacugaaacuucaagcaccag

SEQ ID NO: 3881891 - RNA, 13 nt, Human
cacugaaaggaaa

SEQ ID NO: 3881892 - RNA, 18 nt, Human
cacugaaaguuuuguaaa

SEQ ID NO: 3881893 - RNA, 23 nt, Human
cacugaaauaaccguaaagguuu

SEQ ID NO: 3881894 - RNA, 15 nt, Human
cacugaacaaacuaa

SEQ ID NO: 3881895 - RNA, 22 nt, Human
cacugaacaaacuaaaggugca

SEQ ID NO: 3881896 - RNA, 13 nt, Human
cacugaaccuggg

SEQ ID NO: 3881897 - RNA, 11 nt, Human
cacugaagaag

SEQ ID NO: 3881898 - RNA, 23 nt, Human
cacugaagaagcaccaaucauga

SEQ ID NO: 3881899 - RNA, 14 nt, Human
cacugaagauagaa

SEQ ID NO: 3881900 - RNA, 14 nt, Human
cacugaagccugcg

SEQ ID NO: 3881901 - RNA, 17 nt, Human
cacugaagccugcguug

SEQ ID NO: 3881902 - RNA, 18 nt, Human
cacugaaggccuggccca

SEQ ID NO: 3881903 - RNA, 20 nt, Human
cacugaaggcuuucagggcc

SEQ ID NO: 3881904 - RNA, 22 nt, Human
cacugaaggcuuucagggccuc

SEQ ID NO: 3881905 - RNA, 19 nt, Human
cacugaaguagugugcagu

SEQ ID NO: 3881906 - RNA, 20 nt, Human
cacugaaucuguacagagcc

SEQ ID NO: 3881907 - RNA, 21 nt, Human
cacugaaugccucaaugugac

SEQ ID NO: 3881908 - RNA, 23 nt, Human
cacugaauuaaugacagagccag

SEQ ID NO: 3881909 - RNA, 15 nt, Human
cacugaauuuauaaa

SEQ ID NO: 3881910 - RNA, 22 nt, Human
cacugaauuuuuaugugugauu

SEQ ID NO: 3881911 - RNA, 15 nt, Human
cacugacacaaagga

SEQ ID NO: 3881912 - RNA, 20 nt, Human
cacugacacugguauuccug

SEQ ID NO: 3881913 - RNA, 23 nt, Human
cacugacacugguauuccugccu

SEQ ID NO: 3881914 - RNA, 17 nt, Human
cacugacagauuuccau

SEQ ID NO: 3881915 - RNA, 22 nt, Human
cacugacagauuuccauccuag

SEQ ID NO: 3881916 - RNA, 13 nt, Human
cacugacagccuc

SEQ ID NO: 3881917 - RNA, 17 nt, Human
cacugacagccucccac

SEQ ID NO: 3881918 - RNA, 20 nt, Human
cacugacagccucccacccc

SEQ ID NO: 3881919 - RNA, 15 nt, Human
cacugaccagaacua

SEQ ID NO: 3881920 - RNA, 14 nt, Human
cacugacccacagc

SEQ ID NO: 3881921 - RNA, 14 nt, Human
cacugacccuucca

SEQ ID NO: 3881922 - RNA, 19 nt, Human
cacugacccuuccagacau

SEQ ID NO: 3881923 - RNA, 14 nt, Human
cacugacuccugug

SEQ ID NO: 3881924 - RNA, 13 nt, Human
cacugacucugga

SEQ ID NO: 3881925 - RNA, 19 nt, Human
cacugagaauguaagaacu

SEQ ID NO: 3881926 - RNA, 20 nt, Human
cacugagaauguaagaacua

SEQ ID NO: 3881927 - RNA, 17 nt, Human
cacugagacagcccggg

SEQ ID NO: 3881928 - RNA, 22 nt, Human
cacugagacagcccgggcucug

SEQ ID NO: 3881929 - RNA, 22 nt, Human
cacugagaggacagagagaaau

SEQ ID NO: 3881930 - RNA, 17 nt, Human
cacugagcacuguuuuc

SEQ ID NO: 3881931 - RNA, 13 nt, Human
cacugagcagagu

SEQ ID NO: 3881932 - RNA, 13 nt, Human
cacugagcccccc

SEQ ID NO: 3881933 - RNA, 12 nt, Human
cacugagcucca

SEQ ID NO: 3881934 - RNA, 14 nt, Human
cacugaggcaggga

SEQ ID NO: 3881935 - RNA, 14 nt, Human
cacugagggcaguc

SEQ ID NO: 3881936 - RNA, 14 nt, Human
cacugagggccaca

SEQ ID NO: 3881937 - RNA, 18 nt, Human
cacugagggccacacuau

SEQ ID NO: 3881938 - RNA, 21 nt, Human
cacugaguuuuccauggcagg

SEQ ID NO: 3881939 - RNA, 18 nt, Human
cacugauauauuuuccag

SEQ ID NO: 3881940 - RNA, 15 nt, Human
cacugauauucagaa

SEQ ID NO: 3881941 - RNA, 14 nt, Human
cacugauccagccc

SEQ ID NO: 3881942 - RNA, 16 nt, Human
cacugauccagcccug

SEQ ID NO: 3881943 - RNA, 12 nt, Human
cacugaugcugc

SEQ ID NO: 3881944 - RNA, 23 nt, Human
cacugaugcuguucucuucuuca

SEQ ID NO: 3881945 - RNA, 20 nt, Human
cacugauggaaacaaagugg

SEQ ID NO: 3881946 - RNA, 22 nt, Human
cagcaacuugucuuuuucugga

SEQ ID NO: 3881947 - RNA, 11 nt, Human
cagcaagaaaa

SEQ ID NO: 3881948 - RNA, 22 nt, Human
cagcaagaaaaaaaaaugccau

SEQ ID NO: 3881949 - RNA, 16 nt, Human
cagcaagaagggaguu

SEQ ID NO: 3881950 - RNA, 20 nt, Human
cagcaagacuucucuuugcc

SEQ ID NO: 3881951 - RNA, 22 nt, Human
cagcaaggaggcuggcuggggc

SEQ ID NO: 3881952 - RNA, 17 nt, Human
cagcaaggcaccugcag

SEQ ID NO: 3881953 - RNA, 13 nt, Human
cagcaaggccacc

SEQ ID NO: 3881954 - RNA, 14 nt, Human
cagcaaggccaccu

SEQ ID NO: 3881955 - RNA, 15 nt, Human
cagcaaggccaccuc

SEQ ID NO: 3881956 - RNA, 16 nt, Human
cagcaaggccaccucu

SEQ ID NO: 3881957 - RNA, 19 nt, Human
cagcaaggccaccucuucc

SEQ ID NO: 3881958 - RNA, 14 nt, Human
cagcaaggcccgag

SEQ ID NO: 3881959 - RNA, 19 nt, Human
cagcaaggcccgagcagcu

SEQ ID NO: 3881960 - RNA, 16 nt, Human
cagcaaggcccugcug

SEQ ID NO: 3881961 - RNA, 18 nt, Human
cagcaaggcccugcugcc

SEQ ID NO: 3881962 - RNA, 19 nt, Human
cagcaaggcgcuaacuugc

SEQ ID NO: 3881963 - RNA, 20 nt, Human
cagcaaggcgcuaacuugcu

SEQ ID NO: 3881964 - RNA, 12 nt, Human
cagcaaggggcu

SEQ ID NO: 3881965 - RNA, 14 nt, Human
cagcaaggggcucu

SEQ ID NO: 3881966 - RNA, 16 nt, Human
cagcaaggggcucugc

SEQ ID NO: 3881967 - RNA, 18 nt, Human
cagcaaggucuugcucuc

SEQ ID NO: 3881968 - RNA, 15 nt, Human
cagcaagguggagug

SEQ ID NO: 3881969 - RNA, 15 nt, Human
cagcaagugagagcu

SEQ ID NO: 3881970 - RNA, 17 nt, Human
cagcaauagagacggga

SEQ ID NO: 3881971 - RNA, 16 nt, Human
cagcaauauguaaaua

SEQ ID NO: 3881972 - RNA, 17 nt, Human
cagcaauauuuaaggag

SEQ ID NO: 3881973 - RNA, 19 nt, Human
cagcaauauuuaaggagau

SEQ ID NO: 3881974 - RNA, 16 nt, Human
cagcaauuuaaauguu

SEQ ID NO: 3881975 - RNA, 13 nt, Human
cagcaauuucuaa

SEQ ID NO: 3881976 - RNA, 23 nt, Human
cagcaauuucuaauuuuuaagaa

SEQ ID NO: 3881977 - RNA, 12 nt, Human
cagcacaaaaug

SEQ ID NO: 3881978 - RNA, 11 nt, Human
cagcacaaaca

SEQ ID NO: 3881979 - RNA, 13 nt, Human
cagcacaaacaca

SEQ ID NO: 3881980 - RNA, 18 nt, Human
cagcacaaccuucaagcu

SEQ ID NO: 3881981 - RNA, 21 nt, Human
cagcacaaccuucaagcugcu

SEQ ID NO: 3881982 - RNA, 16 nt, Human
cagcacaaggccaucu

SEQ ID NO: 3881983 - RNA, 21 nt, Human
cagcacagauaaaaaguggaa

SEQ ID NO: 3881984 - RNA, 15 nt, Human
cagcacagcucccug

SEQ ID NO: 3881985 - RNA, 15 nt, Human
cagcacagcuugacc

SEQ ID NO: 3881986 - RNA, 21 nt, Human
cagcacagcuugaccugaggc

SEQ ID NO: 3881987 - RNA, 19 nt, Human
cagcacaucucaacaggcc

SEQ ID NO: 3881988 - RNA, 15 nt, Human
cagcacaugcuggcc

SEQ ID NO: 3881989 - RNA, 20 nt, Human
cagcacaugcuggccagccu

SEQ ID NO: 3881990 - RNA, 22 nt, Human
cagcacaugcuggccagccugg

SEQ ID NO: 3881991 - RNA, 19 nt, Human
cagcaccaaaucaaaaucu

SEQ ID NO: 3881992 - RNA, 23 nt, Human
cagcaccaaaucaaaaucucucc

SEQ ID NO: 3881993 - RNA, 16 nt, Human
cagcaccaccaggucu

SEQ ID NO: 3881994 - RNA, 22 nt, Human
cagcaccaccaggucucccggg

SEQ ID NO: 3881995 - RNA, 21 nt, Human
cagcaccacccuagucccuuc

SEQ ID NO: 3881996 - RNA, 22 nt, Human
cagcaccacccuagucccuucc

SEQ ID NO: 3881997 - RNA, 14 nt, Human
cagcaccagaaugu

SEQ ID NO: 3881998 - RNA, 18 nt, Human
cagcacccagcaacucca

SEQ ID NO: 3881999 - RNA, 16 nt, Human
cagcaccccuuccaug

SEQ ID NO: 3882000 - RNA, 19 nt, Human
cagcaccccuuccaugugg

SEQ ID NO: 3882001 - RNA, 22 nt, Human
cagcaccccuuccauguggaga

SEQ ID NO: 3882002 - RNA, 16 nt, Human
cagcacccgggcucag

SEQ ID NO: 3882003 - RNA, 12 nt, Human
cagcacccugca

SEQ ID NO: 3882004 - RNA, 14 nt, Human
cagcaccgccucuu

SEQ ID NO: 3882005 - RNA, 17 nt, Human
cagcaccggaccagccu

SEQ ID NO: 3882006 - RNA, 15 nt, Human
cagcaccuacagugu

SEQ ID NO: 3882007 - RNA, 16 nt, Human
cagcaccucagccugc

SEQ ID NO: 3882008 - RNA, 17 nt, Human
cagcaccucagccugca

SEQ ID NO: 3882009 - RNA, 18 nt, Human
cagcaccuccaggccugu

SEQ ID NO: 3882010 - RNA, 15 nt, Human
cagcaccuccucagc

SEQ ID NO: 3882011 - RNA, 18 nt, Human
cagcaccuccucagccug

SEQ ID NO: 3882012 - RNA, 19 nt, Human
cagcaccuccucagccuga

SEQ ID NO: 3882013 - RNA, 12 nt, Human
cagcaccugccc

SEQ ID NO: 3882014 - RNA, 13 nt, Human
cagcaccugcccu

SEQ ID NO: 3882015 - RNA, 13 nt, Human
cagcaccugccuc

SEQ ID NO: 3882016 - RNA, 23 nt, Human
cagcaccuguaagaaacagagca

SEQ ID NO: 3882017 - RNA, 13 nt, Human
cagcaccuugugc

SEQ ID NO: 3882018 - RNA, 17 nt, Human
cagcaccuugugccugg

SEQ ID NO: 3882019 - RNA, 16 nt, Human
cagcacgauuucuguu

SEQ ID NO: 3882020 - RNA, 14 nt, Human
cagcacggacaaua

SEQ ID NO: 3882021 - RNA, 18 nt, Human
cagcacggacaauaaacc

SEQ ID NO: 3882022 - RNA, 19 nt, Human
cagcacggacaauaaaccu

SEQ ID NO: 3882023 - RNA, 18 nt, Human
cagcacgggggccaagga

SEQ ID NO: 3882024 - RNA, 14 nt, Human
cagcacuaaagcag

SEQ ID NO: 3882025 - RNA, 17 nt, Human
cagcacuaaagcagugg

SEQ ID NO: 3882026 - RNA, 11 nt, Human
cagcacuacuc

SEQ ID NO: 3882027 - RNA, 16 nt, Human
cagcacuacugggugu

SEQ ID NO: 3882028 - RNA, 15 nt, Human
cagcacuagccaaac

SEQ ID NO: 3882029 - RNA, 21 nt, Human
cagcacuagccaaaccucacc

SEQ ID NO: 3882030 - RNA, 19 nt, Human
cagcacuaugcuuuccuuc

SEQ ID NO: 3882031 - RNA, 15 nt, Human
cagcacucacacagg

SEQ ID NO: 3882032 - RNA, 22 nt, Human
cagcacucacacaggacccccu

SEQ ID NO: 3882033 - RNA, 12 nt, Human
cagcacugaaaa

SEQ ID NO: 3882034 - RNA, 14 nt, Human
cagcacugaaaaua

SEQ ID NO: 3882035 - RNA, 11 nt, Human
cagcacugagg

SEQ ID NO: 3882036 - RNA, 15 nt, Human
cagcacugaggaaga

SEQ ID NO: 3882037 - RNA, 14 nt, Human
cagcacugauuuca

SEQ ID NO: 3882038 - RNA, 14 nt, Human
cagcacugccugcu

SEQ ID NO: 3882039 - RNA, 18 nt, Human
cagcacugccugcuccca

SEQ ID NO: 3882040 - RNA, 19 nt, Human
cagcacugcuugaggaaaa

SEQ ID NO: 3882041 - RNA, 12 nt, Human
cagcacuggcuc

SEQ ID NO: 3882042 - RNA, 16 nt, Human
cagcacuggcucucuc

SEQ ID NO: 3882043 - RNA, 20 nt, Human
cagcacuggcucucuccagg

SEQ ID NO: 3882044 - RNA, 13 nt, Human
cagcacugucccu

SEQ ID NO: 3882045 - RNA, 15 nt, Human
cagcacugucucagu

SEQ ID NO: 3882046 - RNA, 14 nt, Human
cagcacuuggcccu

SEQ ID NO: 3882047 - RNA, 13 nt, Human
cagcacuuguaua

SEQ ID NO: 3882048 - RNA, 17 nt, Human
cagcacuuguccagcug

SEQ ID NO: 3882049 - RNA, 19 nt, Human
cagcacuuguccagcugag

SEQ ID NO: 3882050 - RNA, 17 nt, Human
cagcacuugucucauuu

SEQ ID NO: 3882051 - RNA, 20 nt, Human
cagcacuugucucauuuuaa

SEQ ID NO: 3882052 - RNA, 23 nt, Human
cagcacuugucucauuuuaaugu

SEQ ID NO: 3882053 - RNA, 19 nt, Human
cagcacuuucuucuuccca

SEQ ID NO: 3882054 - RNA, 20 nt, Human
cagcacuuugggaggccaag

SEQ ID NO: 3882055 - RNA, 22 nt, Human
cagcacuuugggaggccaagga

SEQ ID NO: 3882056 - RNA, 20 nt, Human
cagcacuuugggaggcugag

SEQ ID NO: 3882057 - RNA, 22 nt, Human
cagcacuuugggaggcugaggc

SEQ ID NO: 3882058 - RNA, 23 nt, Human
cagcacuuugggaggcugaggcg

SEQ ID NO: 3882059 - RNA, 23 nt, Human
cagcacuuugggaggcugaggug

SEQ ID NO: 3882060 - RNA, 15 nt, Human
cagcagaaaugccuu

SEQ ID NO: 3882061 - RNA, 21 nt, Human
cagcagaauggugaucacucc

SEQ ID NO: 3882062 - RNA, 23 nt, Human
cagcagaauugaccgacagcuuu

SEQ ID NO: 3882063 - RNA, 12 nt, Human
cagcagacacau

SEQ ID NO: 3882064 - RNA, 15 nt, Human
cagcagacagagcca

SEQ ID NO: 3882065 - RNA, 17 nt, Human
cagcagacauugucagc

SEQ ID NO: 3882066 - RNA, 15 nt, Human
cagcagacucagcuc

SEQ ID NO: 3882067 - RNA, 23 nt, Human
cagcagacucagcucugacauuc

SEQ ID NO: 3882068 - RNA, 11 nt, Human
cagcagacuga

SEQ ID NO: 3882069 - RNA, 15 nt, Human
cagcagaggcacugg

SEQ ID NO: 3882070 - RNA, 22 nt, Human
cagcagaggcccagauauuaga

SEQ ID NO: 3882071 - RNA, 13 nt, Human
cagcagaggcggu

SEQ ID NO: 3882072 - RNA, 10 nt, Human
cagcagagug

SEQ ID NO: 3882073 - RNA, 11 nt, Human
cagcagagugc

SEQ ID NO: 3882074 - RNA, 24 nt, Human
cagcagauaacaaugcagcaaggc

SEQ ID NO: 3882075 - RNA, 15 nt, Human
cagcagaucccagcu

SEQ ID NO: 3882076 - RNA, 17 nt, Human
cagcagaucccagcuca

SEQ ID NO: 3882077 - RNA, 19 nt, Human
cagcagauuauucacugau

SEQ ID NO: 3882078 - RNA, 16 nt, Human
cagcagauuggaagga

SEQ ID NO: 3882079 - RNA, 23 nt, Human
cagcagauuggaaggagacacag

SEQ ID NO: 3882080 - RNA, 13 nt, Human
cagcagauuuuag

SEQ ID NO: 3882081 - RNA, 16 nt, Human
cagcagcagcccugcc

SEQ ID NO: 3882082 - RNA, 12 nt, Human
cagcagcaggug

SEQ ID NO: 3882083 - RNA, 12 nt, Human
cagcagcaucuc

SEQ ID NO: 3882084 - RNA, 16 nt, Human
cagcagccagccaaac

SEQ ID NO: 3882085 - RNA, 13 nt, Human
cagcagccagccc

SEQ ID NO: 3882086 - RNA, 15 nt, Human
cagcagccagcucuc

SEQ ID NO: 3882087 - RNA, 19 nt, Human
cagcagccagcucucagcc

SEQ ID NO: 3882088 - RNA, 21 nt, Human
cagcagccagcucucagccaa

SEQ ID NO: 3882089 - RNA, 18 nt, Human
cagcagccaucauaggaa

SEQ ID NO: 3882090 - RNA, 22 nt, Human
cagcagccaucauaggaaggga

SEQ ID NO: 3882091 - RNA, 19 nt, Human
cagcagcccaagcuucccu

SEQ ID NO: 3882092 - RNA, 15 nt, Human
cagccugucucuucc

SEQ ID NO: 3882093 - RNA, 19 nt, Human
cagccugucucuuccauau

SEQ ID NO: 3882094 - RNA, 14 nt, Human
cagccugugcugcc

SEQ ID NO: 3882095 - RNA, 12 nt, Human
cagccuguggcg

SEQ ID NO: 3882096 - RNA, 18 nt, Human
cagccuguggcggugccu

SEQ ID NO: 3882097 - RNA, 19 nt, Human
cagccuguggcggugccug

SEQ ID NO: 3882098 - RNA, 14 nt, Human
cagccugugucuuu

SEQ ID NO: 3882099 - RNA, 23 nt, Human
cagccuucagacagagaggacug

SEQ ID NO: 3882100 - RNA, 20 nt, Human
cagccuucccccucccaggg

SEQ ID NO: 3882101 - RNA, 19 nt, Human
cagccuuccucugcagcug

SEQ ID NO: 3882102 - RNA, 20 nt, Human
cagccuuccucugcagcuga

SEQ ID NO: 3882103 - RNA, 21 nt, Human
cagccuuccucugcagcugac

SEQ ID NO: 3882104 - RNA, 18 nt, Human
cagccuucuuccauccca

SEQ ID NO: 3882105 - RNA, 21 nt, Human
cagccuucuuuuucuggacuc

SEQ ID NO: 3882106 - RNA, 20 nt, Human
cagccuugaccauucuccac

SEQ ID NO: 3882107 - RNA, 21 nt, Human
cagccuugaccauucuccacc

SEQ ID NO: 3882108 - RNA, 19 nt, Human
cagccuugagcccuggcug

SEQ ID NO: 3882109 - RNA, 13 nt, Human
cagccuugccaga

SEQ ID NO: 3882110 - RNA, 15 nt, Human
cagccuugccagaga

SEQ ID NO: 3882111 - RNA, 19 nt, Human
cagccuuugaucagguggg

SEQ ID NO: 3882112 - RNA, 22 nt, Human
cagccuuugaucagguggggag

SEQ ID NO: 3882113 - RNA, 17 nt, Human
cagccuuugccuccccg

SEQ ID NO: 3882114 - RNA, 16 nt, Human
cagccuuuguucccca

SEQ ID NO: 3882115 - RNA, 23 nt, Human
cagccuuuguuccccacuggagc

SEQ ID NO: 3882116 - RNA, 20 nt, Human
cagccuuuuuguuucaauga

SEQ ID NO: 3882117 - RNA, 21 nt, Human
cagcgaaaggauguaaacagu

SEQ ID NO: 3882118 - RNA, 14 nt, Human
cagcgaagggagug

SEQ ID NO: 3882119 - RNA, 16 nt, Human
cagcgaaguagcuugc

SEQ ID NO: 3882120 - RNA, 18 nt, Human
cagcgaaguagcuugcuc

SEQ ID NO: 3882121 - RNA, 16 nt, Human
cagcgaccaccccugc

SEQ ID NO: 3882122 - RNA, 16 nt, Human
cagcgaccgcccccuc

SEQ ID NO: 3882123 - RNA, 13 nt, Human
cagcgagaggcag

SEQ ID NO: 3882124 - RNA, 18 nt, Human
cagcgagaggcagagaaa

SEQ ID NO: 3882125 - RNA, 16 nt, Human
cagcgagcccuggugg

SEQ ID NO: 3882126 - RNA, 21 nt, Human
cagcgagcccugguggcagug

SEQ ID NO: 3882127 - RNA, 12 nt, Human
cagcgagccugc

SEQ ID NO: 3882128 - RNA, 21 nt, Human
cagcgagcgcccagcuccuga

SEQ ID NO: 3882129 - RNA, 18 nt, Human
cagcgaggaggcuccaga

SEQ ID NO: 3882130 - RNA, 14 nt, Human
cagcgagggcagcu

SEQ ID NO: 3882131 - RNA, 22 nt, Human
cagcgaguuguggaaagccucu

SEQ ID NO: 3882132 - RNA, 22 nt, Human
cagcgauguaugcagcuaucug

SEQ ID NO: 3882133 - RNA, 23 nt, Human
cagcgauguaugcagcuaucugg

SEQ ID NO: 3882134 - RNA, 20 nt, Human
cagcgauucccucucccagg

SEQ ID NO: 3882135 - RNA, 23 nt, Human
cagcgauucccucucccaggccc

SEQ ID NO: 3882136 - RNA, 14 nt, Human
cagcgccaagcaac

SEQ ID NO: 3882137 - RNA, 19 nt, Human
cagcgccaggcugaccaca

SEQ ID NO: 3882138 - RNA, 13 nt, Human
cagcgccuuuccc

SEQ ID NO: 3882139 - RNA, 14 nt, Human
cagcgccuuuccca

SEQ ID NO: 3882140 - RNA, 22 nt, Human
cagcgccuuucccaacucuagc

SEQ ID NO: 3882141 - RNA, 22 nt, Human
cagcgcggacauccccugcugg

SEQ ID NO: 3882142 - RNA, 20 nt, Human
cagcgcugucaggauugcga

SEQ ID NO: 3882143 - RNA, 21 nt, Human
cagcgcugucaggauugcgag

SEQ ID NO: 3882144 - RNA, 16 nt, Human
cagcgcuugaagccug

SEQ ID NO: 3882145 - RNA, 22 nt, Human
cagcggagguguggagccgagg

SEQ ID NO: 3882146 - RNA, 17 nt, Human
cagcggagucuguccug

SEQ ID NO: 3882147 - RNA, 14 nt, Human
cagcggcaucaggc

SEQ ID NO: 3882148 - RNA, 13 nt, Human
cagcggccccucc

SEQ ID NO: 3882149 - RNA, 18 nt, Human
cagcggccccucccacac

SEQ ID NO: 3882150 - RNA, 14 nt, Human
cagcggccccugca

SEQ ID NO: 3882151 - RNA, 16 nt, Human
cagcggcuggacuugg

SEQ ID NO: 3882152 - RNA, 18 nt, Human
cagcggcuggacuuggag

SEQ ID NO: 3882153 - RNA, 20 nt, Human
cagcggcuggugcagggccu

SEQ ID NO: 3882154 - RNA, 18 nt, Human
cagcgggagccucccugc

SEQ ID NO: 3882155 - RNA, 20 nt, Human
cagcgggagccucccugccu

SEQ ID NO: 3882156 - RNA, 13 nt, Human
cagcgggcagguu

SEQ ID NO: 3882157 - RNA, 14 nt, Human
cagcggggacagcu

SEQ ID NO: 3882158 - RNA, 20 nt, Human
cagcggggccuggcgggaug

SEQ ID NO: 3882159 - RNA, 15 nt, Human
cagcgguuuggggag

SEQ ID NO: 3882160 - RNA, 15 nt, Human
cagcguacucaucau

SEQ ID NO: 3882161 - RNA, 21 nt, Human
cagcguauauauaagaaagac

SEQ ID NO: 3882162 - RNA, 21 nt, Human
cagcgucagcugcucccuggc

SEQ ID NO: 3882163 - RNA, 14 nt, Human
cagcgucccuggcg

SEQ ID NO: 3882164 - RNA, 16 nt, Human
cagcguccuccucugu

SEQ ID NO: 3882165 - RNA, 19 nt, Human
cagcgucggucugugcccc

SEQ ID NO: 3882166 - RNA, 22 nt, Human
cagcguggagggguaggggcug

SEQ ID NO: 3882167 - RNA, 23 nt, Human
cagcguggagggguaggggcugg

SEQ ID NO: 3882168 - RNA, 12 nt, Human
cagcguggccuu

SEQ ID NO: 3882169 - RNA, 13 nt, Human
cagcguggccuug

SEQ ID NO: 3882170 - RNA, 18 nt, Human
cagcguggccuuguucug

SEQ ID NO: 3882171 - RNA, 19 nt, Human
cagcguuucuaugacacau

SEQ ID NO: 3882172 - RNA, 22 nt, Human
cagcuaaagaaguuugaacauu

SEQ ID NO: 3882173 - RNA, 12 nt, Human
cagcuaaagcaa

SEQ ID NO: 3882174 - RNA, 19 nt, Human
cagcuaaagcaauaugcau

SEQ ID NO: 3882175 - RNA, 18 nt, Human
cagcuaaagcccaaccuc

SEQ ID NO: 3882176 - RNA, 14 nt, Human
cagcuaagaaccug

SEQ ID NO: 3882177 - RNA, 19 nt, Human
cagcuaagaaccuggaacu

SEQ ID NO: 3882178 - RNA, 21 nt, Human
cagcuaaggaggggaaaaaaa

SEQ ID NO: 3882179 - RNA, 21 nt, Human
cagcuaagggaagacauuucu

SEQ ID NO: 3882180 - RNA, 21 nt, Human
cagcuaauaacugaucucguu

SEQ ID NO: 3882181 - RNA, 19 nt, Human
cagcuaaucagcauucuca

SEQ ID NO: 3882182 - RNA, 14 nt, Human
cagcuaaucuguag

SEQ ID NO: 3882183 - RNA, 16 nt, Human
cagcuaaucuguaggg

SEQ ID NO: 3882184 - RNA, 17 nt, Human
cagcuaaucuguagggc

SEQ ID NO: 3882185 - RNA, 19 nt, Human
cagcuaaucuguagggcug

SEQ ID NO: 3882186 - RNA, 21 nt, Human
cagcuaaucuguagggcugga

SEQ ID NO: 3882187 - RNA, 15 nt, Human
cagcuaaugggacac

SEQ ID NO: 3882188 - RNA, 20 nt, Human
cagcuacagcuuucuugcuc

SEQ ID NO: 3882189 - RNA, 15 nt, Human
cagcuaccaugacaa

SEQ ID NO: 3882190 - RNA, 18 nt, Human
cagcuacccacuauccuu

SEQ ID NO: 3882191 - RNA, 24 nt, Human
cagcuacccaggaggcugaggugg

SEQ ID NO: 3882192 - RNA, 24 nt, Human
cagcuacccuuuuucuccagcugg

SEQ ID NO: 3882193 - RNA, 21 nt, Human
cagcuaccucaaccaaugcca

SEQ ID NO: 3882194 - RNA, 19 nt, Human
cagcuacuaaugauguuuu

SEQ ID NO: 3882195 - RNA, 19 nt, Human
cagcuacucaagaggcuga

SEQ ID NO: 3882196 - RNA, 23 nt, Human
cagcuacucaagaggcugaggca

SEQ ID NO: 3882197 - RNA, 14 nt, Human
cagcuacucagaag

SEQ ID NO: 3882198 - RNA, 16 nt, Human
cagcuacucagaagcc

SEQ ID NO: 3882199 - RNA, 19 nt, Human
cagcuacucagaagccuga

SEQ ID NO: 3882200 - RNA, 13 nt, Human
cagcuacucagga

SEQ ID NO: 3882201 - RNA, 19 nt, Human
cagcuacucgggaggcuga

SEQ ID NO: 3882202 - RNA, 15 nt, Human
cagcuacuuccuccu

SEQ ID NO: 3882203 - RNA, 15 nt, Human
cagcuacuugggaag

SEQ ID NO: 3882204 - RNA, 19 nt, Human
cagcuacuugggaggcuga

SEQ ID NO: 3882205 - RNA, 23 nt, Human
cagcuagaaauaagcccaacaga

SEQ ID NO: 3882206 - RNA, 13 nt, Human
cagcuagagcuuc

SEQ ID NO: 3882207 - RNA, 15 nt, Human
cagcuagcaaaagaa

SEQ ID NO: 3882208 - RNA, 19 nt, Human
cagcuagcaaaagaaguaa

SEQ ID NO: 3882209 - RNA, 16 nt, Human
cagcuaggaagagcag

SEQ ID NO: 3882210 - RNA, 20 nt, Human
cagcuaggaagagcaggacu

SEQ ID NO: 3882211 - RNA, 19 nt, Human
cagcuagguggggccuaga

SEQ ID NO: 3882212 - RNA, 15 nt, Human
cagcuagugacccac

SEQ ID NO: 3882213 - RNA, 21 nt, Human
cagcuagugacccacaugcca

SEQ ID NO: 3882214 - RNA, 22 nt, Human
cagcuagugacccacaugccau

SEQ ID NO: 3882215 - RNA, 15 nt, Human
cagcuauaccugugc

SEQ ID NO: 3882216 - RNA, 16 nt, Human
cagcuauaccugugcc

SEQ ID NO: 3882217 - RNA, 19 nt, Human
cagcuauaccugugccucg

SEQ ID NO: 3882218 - RNA, 17 nt, Human
cagcuaugggagcccca

SEQ ID NO: 3882219 - RNA, 20 nt, Human
cagcuaugggagccccaggg

SEQ ID NO: 3882220 - RNA, 22 nt, Human
cagcuaugggagccccaggguc

SEQ ID NO: 3882221 - RNA, 15 nt, Human
cagcuauuuugugaa

SEQ ID NO: 3882222 - RNA, 18 nt, Human
cagcuauuuuuacuagaa

SEQ ID NO: 3882223 - RNA, 19 nt, Human
cagcucaaggaaaggccug

SEQ ID NO: 3882224 - RNA, 20 nt, Human
cagcucaaggaaaggccuga

SEQ ID NO: 3882225 - RNA, 22 nt, Human
cagcucaagucuucccugauca

SEQ ID NO: 3882226 - RNA, 13 nt, Human
cagcucacagugc

SEQ ID NO: 3882227 - RNA, 13 nt, Human
cagcucaccagcc

SEQ ID NO: 3882228 - RNA, 20 nt, Human
cagcucaccagccccagugc

SEQ ID NO: 3882229 - RNA, 12 nt, Human
cagcucaccccc

SEQ ID NO: 3882230 - RNA, 19 nt, Human
cagcucaccccccacacuc

SEQ ID NO: 3882231 - RNA, 20 nt, Human
cagcucaccccccacacuca

SEQ ID NO: 3882232 - RNA, 22 nt, Human
cagcucaccccccacacucacu

SEQ ID NO: 3882233 - RNA, 15 nt, Human
cagcucaccucuccc

SEQ ID NO: 3882234 - RNA, 17 nt, Human
cagcucaccucucccuu

SEQ ID NO: 3882235 - RNA, 23 nt, Human
caguaccccauggagcugggcua

SEQ ID NO: 3882236 - RNA, 24 nt, Human
caguacccucucagcuccaggugg

SEQ ID NO: 3882237 - RNA, 16 nt, Human
caguacccugguugug

SEQ ID NO: 3882238 - RNA, 17 nt, Human
caguacccugguugugu

SEQ ID NO: 3882239 - RNA, 20 nt, Human
caguaccuauaaaguaaagc

SEQ ID NO: 3882240 - RNA, 14 nt, Human
caguaccugagggu

SEQ ID NO: 3882241 - RNA, 21 nt, Human
caguaccugagggucuguagg

SEQ ID NO: 3882242 - RNA, 22 nt, Human
caguaccuggguccccagcccu

SEQ ID NO: 3882243 - RNA, 13 nt, Human
caguaccuugcuu

SEQ ID NO: 3882244 - RNA, 16 nt, Human
caguacuucagcaaga

SEQ ID NO: 3882245 - RNA, 23 nt, Human
caguacuugugaaacacagcugu

SEQ ID NO: 3882246 - RNA, 20 nt, Human
caguacuuuggaggccccua

SEQ ID NO: 3882247 - RNA, 23 nt, Human
caguacuuuuuuaaauauuuucu

SEQ ID NO: 3882248 - RNA, 13 nt, Human
caguagaaaauau

SEQ ID NO: 3882249 - RNA, 12 nt, Human
caguagacaagc

SEQ ID NO: 3882250 - RNA, 17 nt, Human
caguagagccagcuugg

SEQ ID NO: 3882251 - RNA, 15 nt, Human
caguagagucaucuc

SEQ ID NO: 3882252 - RNA, 18 nt, Human
caguagauugcagaaaau

SEQ ID NO: 3882253 - RNA, 14 nt, Human
caguagauuuucuu

SEQ ID NO: 3882254 - RNA, 18 nt, Human
caguagcacaaguuauuu

SEQ ID NO: 3882255 - RNA, 14 nt, Human
caguagcaggcccg

SEQ ID NO: 3882256 - RNA, 20 nt, Human
caguagcugggaccacaggu

SEQ ID NO: 3882257 - RNA, 22 nt, Human
caguaggacaaggugcaggcag

SEQ ID NO: 3882258 - RNA, 24 nt, Human
caguaggacaaggugcaggcaggc

SEQ ID NO: 3882259 - RNA, 17 nt, Human
caguaggacuccuuauu

SEQ ID NO: 3882260 - RNA, 12 nt, Human
caguaggagccc

SEQ ID NO: 3882261 - RNA, 14 nt, Human
caguaggagcccag

SEQ ID NO: 3882262 - RNA, 21 nt, Human
caguaggagcccagcucugaa

SEQ ID NO: 3882263 - RNA, 16 nt, Human
caguagucucugugcu

SEQ ID NO: 3882264 - RNA, 22 nt, Human
caguagugagaagaauauuguu

SEQ ID NO: 3882265 - RNA, 22 nt, Human
caguaguucacauacaaaucau

SEQ ID NO: 3882266 - RNA, 19 nt, Human
caguaguuugcauuucaga

SEQ ID NO: 3882267 - RNA, 21 nt, Human
caguaguuugcauuucagaaa

SEQ ID NO: 3882268 - RNA, 14 nt, Human
caguauaaacaaag

SEQ ID NO: 3882269 - RNA, 22 nt, Human
caguauaauucuguacugauuu

SEQ ID NO: 3882270 - RNA, 23 nt, Human
caguauaauugaguuuucagugg

SEQ ID NO: 3882271 - RNA, 22 nt, Human
caguauacaagauaagcuucca

SEQ ID NO: 3882272 - RNA, 22 nt, Human
caguauagaauaggcacuuuaa

SEQ ID NO: 3882273 - RNA, 14 nt, Human
caguauauuaguau

SEQ ID NO: 3882274 - RNA, 15 nt, Human
caguauauuuaaacu

SEQ ID NO: 3882275 - RNA, 14 nt, Human
caguauauuuauag

SEQ ID NO: 3882276 - RNA, 15 nt, Human
caguauauuuauagu

SEQ ID NO: 3882277 - RNA, 14 nt, Human
caguauauuuuauu

SEQ ID NO: 3882278 - RNA, 16 nt, Human
caguauauuuuauuuc

SEQ ID NO: 3882279 - RNA, 19 nt, Human
caguauauuuuauuucaau

SEQ ID NO: 3882280 - RNA, 22 nt, Human
caguauauuuuauuucaaugua

SEQ ID NO: 3882281 - RNA, 24 nt, Human
caguaucaggccugccagacggca

SEQ ID NO: 3882282 - RNA, 15 nt, Human
caguaucaugaagcc

SEQ ID NO: 3882283 - RNA, 16 nt, Human
caguaucaugcccugu

SEQ ID NO: 3882284 - RNA, 12 nt, Human
caguaucccaca

SEQ ID NO: 3882285 - RNA, 15 nt, Human
caguaucccacaucc

SEQ ID NO: 3882286 - RNA, 15 nt, Human
caguaucggcacugu

SEQ ID NO: 3882287 - RNA, 18 nt, Human
caguaucuauauaugugu

SEQ ID NO: 3882288 - RNA, 13 nt, Human
caguaucucaggg

SEQ ID NO: 3882289 - RNA, 15 nt, Human
caguaucucuucagu

SEQ ID NO: 3882290 - RNA, 21 nt, Human
caguaugagucaaugugcagu

SEQ ID NO: 3882291 - RNA, 23 nt, Human
caguaugagucaaugugcagugu

SEQ ID NO: 3882292 - RNA, 20 nt, Human
caguauggggguuguaaauu

SEQ ID NO: 3882293 - RNA, 21 nt, Human
caguauggggguuguaaauug

SEQ ID NO: 3882294 - RNA, 16 nt, Human
caguaugguacauuuu

SEQ ID NO: 3882295 - RNA, 20 nt, Human
caguaugguacauuuuucaa

SEQ ID NO: 3882296 - RNA, 23 nt, Human
caguaugguacauuuuucaacuu

SEQ ID NO: 3882297 - RNA, 15 nt, Human
caguauguauucuuu

SEQ ID NO: 3882298 - RNA, 19 nt, Human
caguauguucaaagucaaa

SEQ ID NO: 3882299 - RNA, 13 nt, Human
caguauguuguca

SEQ ID NO: 3882300 - RNA, 15 nt, Human
caguauguugucaaa

SEQ ID NO: 3882301 - RNA, 15 nt, Human
caguauguuuuacac

SEQ ID NO: 3882302 - RNA, 19 nt, Human
caguauuaaaggggggagg

SEQ ID NO: 3882303 - RNA, 19 nt, Human
caguauuacuucugcuaca

SEQ ID NO: 3882304 - RNA, 14 nt, Human
caguauugaagcau

SEQ ID NO: 3882305 - RNA, 21 nt, Human
caguauugaagcauuuuauaa

SEQ ID NO: 3882306 - RNA, 16 nt, Human
caguauugagcugccu

SEQ ID NO: 3882307 - RNA, 19 nt, Human
caguauuguacaaaguauu

SEQ ID NO: 3882308 - RNA, 21 nt, Human
caguauuguacaaaguauuaa

SEQ ID NO: 3882309 - RNA, 22 nt, Human
caguauuguacaaaguauuaag

SEQ ID NO: 3882310 - RNA, 16 nt, Human
caguauuuagaagcca

SEQ ID NO: 3882311 - RNA, 19 nt, Human
caguauuuauuuuguaauu

SEQ ID NO: 3882312 - RNA, 19 nt, Human
caguauuucauugccugug

SEQ ID NO: 3882313 - RNA, 16 nt, Human
caguauuuccacuugu

SEQ ID NO: 3882314 - RNA, 13 nt, Human
caguauuuguaau

SEQ ID NO: 3882315 - RNA, 15 nt, Human
caguauuuguaauua

SEQ ID NO: 3882316 - RNA, 15 nt, Human
caguauuugugggga

SEQ ID NO: 3882317 - RNA, 13 nt, Human
caguauuuuagug

SEQ ID NO: 3882318 - RNA, 23 nt, Human
caguauuuuaguggacccugaaa

SEQ ID NO: 3882319 - RNA, 23 nt, Human
caguauuuucccaauagcacuuu

SEQ ID NO: 3882320 - RNA, 19 nt, Human
caguauuuuggagaaauua

SEQ ID NO: 3882321 - RNA, 18 nt, Human
caguauuuuguguccucc

SEQ ID NO: 3882322 - RNA, 14 nt, Human
caguauuuuuaaag

SEQ ID NO: 3882323 - RNA, 18 nt, Human
caguauuuuuaaaggcau

SEQ ID NO: 3882324 - RNA, 14 nt, Human
caguauuuuugcug

SEQ ID NO: 3882325 - RNA, 19 nt, Human
caguauuuuugcugcuucu

SEQ ID NO: 3882326 - RNA, 24 nt, Human
cagucaaaaccaagucacuuaggu

SEQ ID NO: 3882327 - RNA, 14 nt, Human
cagucaagaagaaa

SEQ ID NO: 3882328 - RNA, 15 nt, Human
cagucaauuaacaau

SEQ ID NO: 3882329 - RNA, 16 nt, Human
cagucacagccacccc

SEQ ID NO: 3882330 - RNA, 15 nt, Human
cagucacauuccaag

SEQ ID NO: 3882331 - RNA, 12 nt, Human
cagucaccccag

SEQ ID NO: 3882332 - RNA, 18 nt, Human
cagucaccccggccaccu

SEQ ID NO: 3882333 - RNA, 15 nt, Human
cagucaccucaugga

SEQ ID NO: 3882334 - RNA, 15 nt, Human
cagucacucuaguca

SEQ ID NO: 3882335 - RNA, 24 nt, Human
cagucacucuagucaaugacauga

SEQ ID NO: 3882336 - RNA, 12 nt, Human
cagucacugcca

SEQ ID NO: 3882337 - RNA, 18 nt, Human
cagucacugccacuuugc

SEQ ID NO: 3882338 - RNA, 21 nt, Human
cagucacuucggccagagcug

SEQ ID NO: 3882339 - RNA, 17 nt, Human
cagucagauuuccaguc

SEQ ID NO: 3882340 - RNA, 12 nt, Human
cagucagccucu

SEQ ID NO: 3882341 - RNA, 18 nt, Human
cagucagccucucuccca

SEQ ID NO: 3882342 - RNA, 22 nt, Human
cagucaggaaagagaacuucca

SEQ ID NO: 3882343 - RNA, 12 nt, Human
cagucaggauga

SEQ ID NO: 3882344 - RNA, 14 nt, Human
cagucaggcccagg

SEQ ID NO: 3882345 - RNA, 22 nt, Human
cagucaggcucucugggcugac

SEQ ID NO: 3882346 - RNA, 17 nt, Human
cagucaggggcagcuga

SEQ ID NO: 3882347 - RNA, 17 nt, Human
cagucagugcaaauguc

SEQ ID NO: 3882348 - RNA, 15 nt, Human
cagucauaacuaaau

SEQ ID NO: 3882349 - RNA, 14 nt, Human
cagucaucaucagg

SEQ ID NO: 3882350 - RNA, 15 nt, Human
cagucaucaucaggg

SEQ ID NO: 3882351 - RNA, 20 nt, Human
cagucaucguaggugauuug

SEQ ID NO: 3882352 - RNA, 18 nt, Human
cagucaucuugaccaagc

SEQ ID NO: 3882353 - RNA, 24 nt, Human
cagucaucuugaccaagcaggaag

SEQ ID NO: 3882354 - RNA, 14 nt, Human
cagucaugcauaaa

SEQ ID NO: 3882355 - RNA, 16 nt, Human
cagucaugcauaaaua

SEQ ID NO: 3882356 - RNA, 24 nt, Human
cagucauggcaccaaagccaccag

SEQ ID NO: 3882357 - RNA, 20 nt, Human
cagucauucagauaugauuc

SEQ ID NO: 3882358 - RNA, 22 nt, Human
cagucauucagcagcaaauuuu

SEQ ID NO: 3882359 - RNA, 17 nt, Human
cagucauuggcugucuc

SEQ ID NO: 3882360 - RNA, 21 nt, Human
cagucauuuugcagaggcuau

SEQ ID NO: 3882361 - RNA, 20 nt, Human
cagucauuuuucagaccuuu

SEQ ID NO: 3882362 - RNA, 21 nt, Human
cagucauuuuucagaccuuuu

SEQ ID NO: 3882363 - RNA, 21 nt, Human
cagucauuuuuguuucuaccu

SEQ ID NO: 3882364 - RNA, 23 nt, Human
cagucauuuuuguuucuaccucc

SEQ ID NO: 3882365 - RNA, 21 nt, Human
caguccaaauguccuccagaa

SEQ ID NO: 3882366 - RNA, 22 nt, Human
caguccaaauguccuccagaag

SEQ ID NO: 3882367 - RNA, 23 nt, Human
caguccaaggaaaccacagcugc

SEQ ID NO: 3882368 - RNA, 22 nt, Human
caguccaagggguccccuccag

SEQ ID NO: 3882369 - RNA, 17 nt, Human
caguccacccugccugc

SEQ ID NO: 3882370 - RNA, 23 nt, Human
caguccaggaugcuaacaucuaa

SEQ ID NO: 3882371 - RNA, 18 nt, Human
caguccaguccuaucugg

SEQ ID NO: 3882372 - RNA, 22 nt, Human
caguccaguccuaucugggcuu

SEQ ID NO: 3882373 - RNA, 23 nt, Human
caguccaguccuaucugggcuuc

SEQ ID NO: 3882374 - RNA, 16 nt, Human
caguccauagcagaga

SEQ ID NO: 3882375 - RNA, 12 nt, Human
caguccaugcau

SEQ ID NO: 3882376 - RNA, 17 nt, Human
caguccauuuauauaug

SEQ ID NO: 3882377 - RNA, 18 nt, Human
caguccauuuauauauga

SEQ ID NO: 3882378 - RNA, 15 nt, Human
caguucacacccugc

SEQ ID NO: 3882379 - RNA, 16 nt, Human
caguucacacccugca

SEQ ID NO: 3882380 - RNA, 16 nt, Human
caguucaccugcacuu

SEQ ID NO: 3882381 - RNA, 14 nt, Human
caguucacuugcag

SEQ ID NO: 3882382 - RNA, 15 nt, Human
caguucagagcugcc

SEQ ID NO: 3882383 - RNA, 17 nt, Human
caguucagagcugcccu

SEQ ID NO: 3882384 - RNA, 21 nt, Human
caguucagagcugcccucucc

SEQ ID NO: 3882385 - RNA, 23 nt, Human
caguucagagcugcccucuccug

SEQ ID NO: 3882386 - RNA, 14 nt, Human
caguucagcuuggg

SEQ ID NO: 3882387 - RNA, 15 nt, Human
caguucagcuugggg

SEQ ID NO: 3882388 - RNA, 18 nt, Human
caguucaguaccuggagg

SEQ ID NO: 3882389 - RNA, 22 nt, Human
caguucaguaccuggaggagga

SEQ ID NO: 3882390 - RNA, 20 nt, Human
caguucaguggcagggcuca

SEQ ID NO: 3882391 - RNA, 22 nt, Human
caguucaguggcagggcucagg

SEQ ID NO: 3882392 - RNA, 14 nt, Human
caguucaucuuuug

SEQ ID NO: 3882393 - RNA, 22 nt, Human
caguucauguauguucagaaga

SEQ ID NO: 3882394 - RNA, 16 nt, Human
caguucauguuugcuu

SEQ ID NO: 3882395 - RNA, 12 nt, Human
caguuccaagaa

SEQ ID NO: 3882396 - RNA, 21 nt, Human
caguucccagaaggcauauca

SEQ ID NO: 3882397 - RNA, 15 nt, Human
caguucccagaauca

SEQ ID NO: 3882398 - RNA, 17 nt, Human
caguucccccaaccuca

SEQ ID NO: 3882399 - RNA, 18 nt, Human
caguucccccaaccucag

SEQ ID NO: 3882400 - RNA, 18 nt, Human
caguucccuuggccucag

SEQ ID NO: 3882401 - RNA, 20 nt, Human
caguucccuuggccucagaa

SEQ ID NO: 3882402 - RNA, 16 nt, Human
caguuccucccaggaa

SEQ ID NO: 3882403 - RNA, 17 nt, Human
caguuccucuuugcaug

SEQ ID NO: 3882404 - RNA, 19 nt, Human
caguuccugcagcagagcc

SEQ ID NO: 3882405 - RNA, 15 nt, Human
caguuccugggaaca

SEQ ID NO: 3882406 - RNA, 15 nt, Human
caguuccuuuagaaa

SEQ ID NO: 3882407 - RNA, 15 nt, Human
caguuccuuucaaag

SEQ ID NO: 3882408 - RNA, 15 nt, Human
caguuccuuugugug

SEQ ID NO: 3882409 - RNA, 22 nt, Human
caguuccuuuguguguacucac

SEQ ID NO: 3882410 - RNA, 14 nt, Human
caguucgcagccac

SEQ ID NO: 3882411 - RNA, 15 nt, Human
caguucgcagccacc

SEQ ID NO: 3882412 - RNA, 17 nt, Human
caguucgccuggagccc

SEQ ID NO: 3882413 - RNA, 18 nt, Human
caguucgccuggagcccu

SEQ ID NO: 3882414 - RNA, 22 nt, Human
caguucggugagcuacaaaugc

SEQ ID NO: 3882415 - RNA, 15 nt, Human
caguucuaaccuccu

SEQ ID NO: 3882416 - RNA, 17 nt, Human
caguucuagucucucug

SEQ ID NO: 3882417 - RNA, 17 nt, Human
caguucuaguuugcauu

SEQ ID NO: 3882418 - RNA, 13 nt, Human
caguucucuccuu

SEQ ID NO: 3882419 - RNA, 14 nt, Human
caguucugaagaag

SEQ ID NO: 3882420 - RNA, 14 nt, Human
caguucugaagaau

SEQ ID NO: 3882421 - RNA, 18 nt, Human
caguucugcuccucucca

SEQ ID NO: 3882422 - RNA, 20 nt, Human
caguucugcuccucuccagg

SEQ ID NO: 3882423 - RNA, 22 nt, Human
caguucugcuccucuccaggca

SEQ ID NO: 3882424 - RNA, 21 nt, Human
caguucuguuauauccccugc

SEQ ID NO: 3882425 - RNA, 18 nt, Human
caguucuucgacuguugu

SEQ ID NO: 3882426 - RNA, 19 nt, Human
caguucuucgggaagagag

SEQ ID NO: 3882427 - RNA, 22 nt, Human
caguucuucgggaagagaggag

SEQ ID NO: 3882428 - RNA, 24 nt, Human
caguucuucgggaagagaggaguu

SEQ ID NO: 3882429 - RNA, 19 nt, Human
caguucuugccacuuuuuu

SEQ ID NO: 3882430 - RNA, 15 nt, Human
caguucuuguguggu

SEQ ID NO: 3882431 - RNA, 21 nt, Human
caguucuuuaagaagaucuuu

SEQ ID NO: 3882432 - RNA, 16 nt, Human
caguucuuugggccag

SEQ ID NO: 3882433 - RNA, 20 nt, Human
caguucuuuuguuguaaaga

SEQ ID NO: 3882434 - RNA, 18 nt, Human
caguugaaaaacagcuga

SEQ ID NO: 3882435 - RNA, 19 nt, Human
caguugaaaaacagcugag

SEQ ID NO: 3882436 - RNA, 19 nt, Human
caguugaagggaggggcug

SEQ ID NO: 3882437 - RNA, 14 nt, Human
caguugaauuucau

SEQ ID NO: 3882438 - RNA, 20 nt, Human
caguugagucgucaucacuu

SEQ ID NO: 3882439 - RNA, 16 nt, Human
caguugauuuucugga

SEQ ID NO: 3882440 - RNA, 15 nt, Human
caguugcaauaauac

SEQ ID NO: 3882441 - RNA, 13 nt, Human
caguugcacuugg

SEQ ID NO: 3882442 - RNA, 11 nt, Human
caguugcagcc

SEQ ID NO: 3882443 - RNA, 20 nt, Human
caguugcagcccuugugaug

SEQ ID NO: 3882444 - RNA, 11 nt, Human
caguugcaguc

SEQ ID NO: 3882445 - RNA, 18 nt, Human
caguugcauguaguaaca

SEQ ID NO: 3882446 - RNA, 12 nt, Human
caguugccacca

SEQ ID NO: 3882447 - RNA, 21 nt, Human
caguugccaccaccucugugg

SEQ ID NO: 3882448 - RNA, 22 nt, Human
caguugccaccaccucuguggc

SEQ ID NO: 3882449 - RNA, 14 nt, Human
caguugcccagccu

SEQ ID NO: 3882450 - RNA, 17 nt, Human
caguugcgcguucugaa

SEQ ID NO: 3882451 - RNA, 23 nt, Human
caguugcucaaaaagaaaucaau

SEQ ID NO: 3882452 - RNA, 16 nt, Human
caguugcucuaugcuu

SEQ ID NO: 3882453 - RNA, 19 nt, Human
caguugcugguaaaaugaa

SEQ ID NO: 3882454 - RNA, 22 nt, Human
caguugcugucagucuugaccu

SEQ ID NO: 3882455 - RNA, 13 nt, Human
caguuggacuuuu

SEQ ID NO: 3882456 - RNA, 22 nt, Human
caguuggagcuccagccugaca

SEQ ID NO: 3882457 - RNA, 16 nt, Human
caguuggccuucagaa

SEQ ID NO: 3882458 - RNA, 16 nt, Human
caguugggagcacugg

SEQ ID NO: 3882459 - RNA, 21 nt, Human
caguugggagcacuggagugc

SEQ ID NO: 3882460 - RNA, 17 nt, Human
caguugggugagaacaa

SEQ ID NO: 3882461 - RNA, 11 nt, Human
caguuggguuu

SEQ ID NO: 3882462 - RNA, 16 nt, Human
caguuggguuuuuuaa

SEQ ID NO: 3882463 - RNA, 18 nt, Human
caguuggguuuuuuaagg

SEQ ID NO: 3882464 - RNA, 14 nt, Human
caguugguaacuuu

SEQ ID NO: 3882465 - RNA, 15 nt, Human
caguugguguguuuu

SEQ ID NO: 3882466 - RNA, 22 nt, Human
caguugguguucaaauagcacu

SEQ ID NO: 3882467 - RNA, 17 nt, Human
caguugguugugucuuu

SEQ ID NO: 3882468 - RNA, 18 nt, Human
caguugguugugucuuuu

SEQ ID NO: 3882469 - RNA, 14 nt, Human
caguuguaucagca

SEQ ID NO: 3882470 - RNA, 22 nt, Human
caguugucucugaugcagcuua

SEQ ID NO: 3882471 - RNA, 13 nt, Human
caguugucucugu

SEQ ID NO: 3882472 - RNA, 22 nt, Human
caguuguggugugaguaucaga

SEQ ID NO: 3882473 - RNA, 17 nt, Human
caguuguguuuguugcu

SEQ ID NO: 3882474 - RNA, 21 nt, Human
caguuguuaaguccuuggcuu

SEQ ID NO: 3882475 - RNA, 22 nt, Human
caguuguuagugugucuuagug

SEQ ID NO: 3882476 - RNA, 14 nt, Human
caguuguuauuuau

SEQ ID NO: 3882477 - RNA, 21 nt, Human
caguuguuauuuauugaaaug

SEQ ID NO: 3882478 - RNA, 14 nt, Human
caguuuaaaagcac

SEQ ID NO: 3882479 - RNA, 23 nt, Human
caguuuacagacgcugcugucac

SEQ ID NO: 3882480 - RNA, 18 nt, Human
caguuuaccaguugccuu

SEQ ID NO: 3882481 - RNA, 14 nt, Human
caguuuauauuuaa

SEQ ID NO: 3882482 - RNA, 18 nt, Human
caguuuaucaugaagccu

SEQ ID NO: 3882483 - RNA, 16 nt, Human
caguuuaucauucaag

SEQ ID NO: 3882484 - RNA, 20 nt, Human
caguuuaugcagugcugcuu

SEQ ID NO: 3882485 - RNA, 16 nt, Human
caguuuauguuguaca

SEQ ID NO: 3882486 - RNA, 23 nt, Human
caguuuauuccagagcugccagu

SEQ ID NO: 3882487 - RNA, 15 nt, Human
caguuucacagaaaa

SEQ ID NO: 3882488 - RNA, 17 nt, Human
caguuucacagaaaaua

SEQ ID NO: 3882489 - RNA, 14 nt, Human
caguuucuaaaauu

SEQ ID NO: 3882490 - RNA, 18 nt, Human
caguuugaaauucugaau

SEQ ID NO: 3882491 - RNA, 16 nt, Human
caguuugagacaggag

SEQ ID NO: 3882492 - RNA, 18 nt, Human
caguuugagacaggagac

SEQ ID NO: 3882493 - RNA, 21 nt, Human
caguuugaggauuaguuuaga

SEQ ID NO: 3882494 - RNA, 20 nt, Human
caguuugauaacuagggaag

SEQ ID NO: 3882495 - RNA, 11 nt, Human
caguuugcaaa

SEQ ID NO: 3882496 - RNA, 15 nt, Human
caguuugcaaaaaau

SEQ ID NO: 3882497 - RNA, 14 nt, Human
caguuugcagagua

SEQ ID NO: 3882498 - RNA, 21 nt, Human
caguuugccggauacaaacug

SEQ ID NO: 3882499 - RNA, 12 nt, Human
caguuugcugua

SEQ ID NO: 3882500 - RNA, 12 nt, Human
caguuugcuuug

SEQ ID NO: 3882501 - RNA, 14 nt, Human
caguuugcuuugcc

SEQ ID NO: 3882502 - RNA, 17 nt, Human
caguuuggcaaacucuc

SEQ ID NO: 3882503 - RNA, 22 nt, Human
caguuuggguaaaauacuuuua

SEQ ID NO: 3882504 - RNA, 15 nt, Human
caguuuggugucaac

SEQ ID NO: 3882505 - RNA, 11 nt, Human
caguuugguug

SEQ ID NO: 3882506 - RNA, 13 nt, Human
caguuuguauaua

SEQ ID NO: 3882507 - RNA, 14 nt, Human
caguuuguauauac

SEQ ID NO: 3882508 - RNA, 16 nt, Human
caguuugucuuggaua

SEQ ID NO: 3882509 - RNA, 16 nt, Human
caguuugugugucuua

SEQ ID NO: 3882510 - RNA, 15 nt, Human
caguuuguuggaaag

SEQ ID NO: 3882511 - RNA, 13 nt, Human
caguuuuaacugu

SEQ ID NO: 3882512 - RNA, 14 nt, Human
caguuuuaacugug

SEQ ID NO: 3882513 - RNA, 18 nt, Human
caguuuuaacuguggaua

SEQ ID NO: 3882514 - RNA, 23 nt, Human
caguuuuaacuguggauauuguu

SEQ ID NO: 3882515 - RNA, 16 nt, Human
caguuuuaugcucuuu

SEQ ID NO: 3882516 - RNA, 18 nt, Human
caguuuuaugcucuuuuu

SEQ ID NO: 3882517 - RNA, 14 nt, Human
caguuuucagaaaa

SEQ ID NO: 3882518 - RNA, 15 nt, Human
caguuuucauaguau

SEQ ID NO: 3882519 - RNA, 15 nt, Human
caguuuuccaugaaa

SEQ ID NO: 3882520 - RNA, 19 nt, Human
caguuuuccuaugcuuuga

SEQ ID NO: 3882521 - RNA, 13 nt, Human
caguuuuccuucu

SEQ ID NO: 3882522 - RNA, 15 nt, Human
caguuuucugagaaa

SEQ ID NO: 3882523 - RNA, 16 nt, Human
cauguauaaaugugau

SEQ ID NO: 3882524 - RNA, 18 nt, Human
cauguauaauauuuuuaa

SEQ ID NO: 3882525 - RNA, 19 nt, Human
cauguauaguuuucccuau

SEQ ID NO: 3882526 - RNA, 16 nt, Human
cauguauccuuucaca

SEQ ID NO: 3882527 - RNA, 20 nt, Human
cauguaucuaugcauuuucu

SEQ ID NO: 3882528 - RNA, 22 nt, Human
cauguauggaaucccacuguau

SEQ ID NO: 3882529 - RNA, 12 nt, Human
cauguauggcca

SEQ ID NO: 3882530 - RNA, 14 nt, Human
cauguauggccagg

SEQ ID NO: 3882531 - RNA, 15 nt, Human
cauguauggccagga

SEQ ID NO: 3882532 - RNA, 22 nt, Human
cauguaugucuuggacacugua

SEQ ID NO: 3882533 - RNA, 13 nt, Human
cauguauguuucu

SEQ ID NO: 3882534 - RNA, 21 nt, Human
cauguauguuuugguaucugu

SEQ ID NO: 3882535 - RNA, 22 nt, Human
cauguauguuuugguaucuguu

SEQ ID NO: 3882536 - RNA, 12 nt, Human
cauguauuaaau

SEQ ID NO: 3882537 - RNA, 20 nt, Human
cauguauuaaauuacauuug

SEQ ID NO: 3882538 - RNA, 22 nt, Human
cauguauuaaauuacauuugua

SEQ ID NO: 3882539 - RNA, 17 nt, Human
cauguauugcacauugu

SEQ ID NO: 3882540 - RNA, 18 nt, Human
cauguauugcacauugua

SEQ ID NO: 3882541 - RNA, 21 nt, Human
cauguauugcacauuguaaaa

SEQ ID NO: 3882542 - RNA, 15 nt, Human
cauguauuggccugg

SEQ ID NO: 3882543 - RNA, 16 nt, Human
cauguauuggccugga

SEQ ID NO: 3882544 - RNA, 15 nt, Human
cauguauuugagcau

SEQ ID NO: 3882545 - RNA, 15 nt, Human
cauguauuuggugau

SEQ ID NO: 3882546 - RNA, 14 nt, Human
caugucaaacaaau

SEQ ID NO: 3882547 - RNA, 15 nt, Human
caugucaaacaaaua

SEQ ID NO: 3882548 - RNA, 20 nt, Human
caugucaaacaugagaugug

SEQ ID NO: 3882549 - RNA, 19 nt, Human
caugucaaacgugaaaaug

SEQ ID NO: 3882550 - RNA, 22 nt, Human
caugucaacagcguuccuagag

SEQ ID NO: 3882551 - RNA, 22 nt, Human
caugucaacuucuggcuccuca

SEQ ID NO: 3882552 - RNA, 14 nt, Human
caugucaagauuca

SEQ ID NO: 3882553 - RNA, 17 nt, Human
caugucaagauucagcu

SEQ ID NO: 3882554 - RNA, 20 nt, Human
caugucaaggguucaagauu

SEQ ID NO: 3882555 - RNA, 20 nt, Human
caugucaccggauccugggu

SEQ ID NO: 3882556 - RNA, 20 nt, Human
caugucaccguggaccuucc

SEQ ID NO: 3882557 - RNA, 14 nt, Human
caugucagcaaaaa

SEQ ID NO: 3882558 - RNA, 16 nt, Human
caugucagcaaaaagc

SEQ ID NO: 3882559 - RNA, 17 nt, Human
caugucagcaaaaagca

SEQ ID NO: 3882560 - RNA, 18 nt, Human
caugucagcaucagcuca

SEQ ID NO: 3882561 - RNA, 19 nt, Human
cauguccaaacguccucuu

SEQ ID NO: 3882562 - RNA, 13 nt, Human
cauguccaaagag

SEQ ID NO: 3882563 - RNA, 14 nt, Human
cauguccaaagagg

SEQ ID NO: 3882564 - RNA, 18 nt, Human
cauguccaaagaggcugc

SEQ ID NO: 3882565 - RNA, 19 nt, Human
cauguccaaagaggcugcc

SEQ ID NO: 3882566 - RNA, 22 nt, Human
cauguccagcaccuugugccug

SEQ ID NO: 3882567 - RNA, 23 nt, Human
cauguccagcaccuugugccugg

SEQ ID NO: 3882568 - RNA, 20 nt, Human
cauguccccaaaccugcaag

SEQ ID NO: 3882569 - RNA, 15 nt, Human
cauguccuaugugug

SEQ ID NO: 3882570 - RNA, 16 nt, Human
cauguccuauguguga

SEQ ID NO: 3882571 - RNA, 15 nt, Human
cauguccuguaaagg

SEQ ID NO: 3882572 - RNA, 19 nt, Human
cauguccuuguguguuuug

SEQ ID NO: 3882573 - RNA, 22 nt, Human
cauguccuuguguguuuugaga

SEQ ID NO: 3882574 - RNA, 21 nt, Human
cauguccuuugcgccugugac

SEQ ID NO: 3882575 - RNA, 22 nt, Human
caugucgcuagccagugcucca

SEQ ID NO: 3882576 - RNA, 21 nt, Human
caugucguggacacacacaga

SEQ ID NO: 3882577 - RNA, 17 nt, Human
caugucuauucagcuuc

SEQ ID NO: 3882578 - RNA, 17 nt, Human
caugucugcagugugcc

SEQ ID NO: 3882579 - RNA, 20 nt, Human
caugucugcagugugccccc

SEQ ID NO: 3882580 - RNA, 15 nt, Human
caugucugcauuucg

SEQ ID NO: 3882581 - RNA, 23 nt, Human
caugucugcauuucgguggcuag

SEQ ID NO: 3882582 - RNA, 12 nt, Human
caugucuggcua

SEQ ID NO: 3882583 - RNA, 13 nt, Human
caugucuuaauga

SEQ ID NO: 3882584 - RNA, 15 nt, Human
caugucuuaaugaag

SEQ ID NO: 3882585 - RNA, 21 nt, Human
caugucuuaaugaaguuugaa

SEQ ID NO: 3882586 - RNA, 22 nt, Human
caugucuuaaugaaguuugaau

SEQ ID NO: 3882587 - RNA, 23 nt, Human
caugucuucucacaagccagcca

SEQ ID NO: 3882588 - RNA, 15 nt, Human
caugucuucucccug

SEQ ID NO: 3882589 - RNA, 17 nt, Human
caugucuuguacaugug

SEQ ID NO: 3882590 - RNA, 21 nt, Human
caugucuuucuccaaaguuau

SEQ ID NO: 3882591 - RNA, 15 nt, Human
caugucuuuuaaaau

SEQ ID NO: 3882592 - RNA, 17 nt, Human
caugugaaaaucaaaua

SEQ ID NO: 3882593 - RNA, 15 nt, Human
caugugaaaucauuc

SEQ ID NO: 3882594 - RNA, 17 nt, Human
caugugaaaucauucau

SEQ ID NO: 3882595 - RNA, 15 nt, Human
caugugaacccggga

SEQ ID NO: 3882596 - RNA, 16 nt, Human
caugugaccacucugu

SEQ ID NO: 3882597 - RNA, 12 nt, Human
caugugacucug

SEQ ID NO: 3882598 - RNA, 16 nt, Human
caugugacucugaagc

SEQ ID NO: 3882599 - RNA, 17 nt, Human
caugugacucugaagcu

SEQ ID NO: 3882600 - RNA, 14 nt, Human
caugugacucuuuc

SEQ ID NO: 3882601 - RNA, 16 nt, Human
caugugacucuuucca

SEQ ID NO: 3882602 - RNA, 17 nt, Human
caugugacucuuuccaa

SEQ ID NO: 3882603 - RNA, 20 nt, Human
caugugagcaugucacuucc

SEQ ID NO: 3882604 - RNA, 15 nt, Human
caugugauacauuuu

SEQ ID NO: 3882605 - RNA, 16 nt, Human
caugugauacauuuuu

SEQ ID NO: 3882606 - RNA, 18 nt, Human
caugugauccuuuuaugu

SEQ ID NO: 3882607 - RNA, 19 nt, Human
caugugauccuuuuauguu

SEQ ID NO: 3882608 - RNA, 18 nt, Human
caugugaucucauuguuc

SEQ ID NO: 3882609 - RNA, 20 nt, Human
caugugaugagaggaaauca

SEQ ID NO: 3882610 - RNA, 18 nt, Human
caugugauggacacucca

SEQ ID NO: 3882611 - RNA, 20 nt, Human
caugugauggacacuccagg

SEQ ID NO: 3882612 - RNA, 22 nt, Human
caugugauggacacuccaggga

SEQ ID NO: 3882613 - RNA, 11 nt, Human
caugugcacau

SEQ ID NO: 3882614 - RNA, 15 nt, Human
caugugcacaugcac

SEQ ID NO: 3882615 - RNA, 15 nt, Human
caugugcauaguuuc

SEQ ID NO: 3882616 - RNA, 20 nt, Human
caugugccacaacgccuggc

SEQ ID NO: 3882617 - RNA, 22 nt, Human
caugugccagggcaaugaugaa

SEQ ID NO: 3882618 - RNA, 14 nt, Human
caugugcccaguua

SEQ ID NO: 3882619 - RNA, 22 nt, Human
caugugccuauagucccagcua

SEQ ID NO: 3882620 - RNA, 16 nt, Human
caugugccugcaccag

SEQ ID NO: 3882621 - RNA, 17 nt, Human
caugugccugcaccagg

SEQ ID NO: 3882622 - RNA, 17 nt, Human
caugugcuacaggggcc

SEQ ID NO: 3882623 - RNA, 21 nt, Human
cauguggaaagugaauuugaa

SEQ ID NO: 3882624 - RNA, 15 nt, Human
cauguggagaaagga

SEQ ID NO: 3882625 - RNA, 19 nt, Human
cauguggagaaaggaguga

SEQ ID NO: 3882626 - RNA, 15 nt, Human
cauguggagucagcc

SEQ ID NO: 3882627 - RNA, 14 nt, Human
cauguggccugugg

SEQ ID NO: 3882628 - RNA, 12 nt, Human
caugugggagcu

SEQ ID NO: 3882629 - RNA, 14 nt, Human
cauguggggccagg

SEQ ID NO: 3882630 - RNA, 17 nt, Human
cauguggggccagguca

SEQ ID NO: 3882631 - RNA, 23 nt, Human
cauguggggccaggucacccuuu

SEQ ID NO: 3882632 - RNA, 15 nt, Human
caugugggucuucca

SEQ ID NO: 3882633 - RNA, 22 nt, Human
caugugguggcacaggcccccu

SEQ ID NO: 3882634 - RNA, 22 nt, Human
caugugguuaaugccauggaca

SEQ ID NO: 3882635 - RNA, 20 nt, Human
caugugguuugguuccucuc

SEQ ID NO: 3882636 - RNA, 16 nt, Human
cauguguaaucaauaa

SEQ ID NO: 3882637 - RNA, 16 nt, Human
cauguguagccuaugu

SEQ ID NO: 3882638 - RNA, 14 nt, Human
cauguguauaaaaa

SEQ ID NO: 3882639 - RNA, 18 nt, Human
cauguguaugggcaaaaa

SEQ ID NO: 3882640 - RNA, 23 nt, Human
caugugucaacaccccugugugg

SEQ ID NO: 3882641 - RNA, 18 nt, Human
cauguguccaucccagcg

SEQ ID NO: 3882642 - RNA, 21 nt, Human
cauguguccugguucccguuu

SEQ ID NO: 3882643 - RNA, 21 nt, Human
caugugugagugugugcaagu

SEQ ID NO: 3882644 - RNA, 21 nt, Human
caugugugguacaugguguuu

SEQ ID NO: 3882645 - RNA, 14 nt, Human
cauguguguauaag

SEQ ID NO: 3882646 - RNA, 14 nt, Human
cauguguguauaua

SEQ ID NO: 3882647 - RNA, 22 nt, Human
cauguguguccacgacugucuc

SEQ ID NO: 3882648 - RNA, 15 nt, Human
caugugugugcaagu

SEQ ID NO: 3882649 - RNA, 15 nt, Human
caugugugugcucag

SEQ ID NO: 3882650 - RNA, 23 nt, Human
cauguguguuaacccagugcuuu

SEQ ID NO: 3882651 - RNA, 15 nt, Human
cauguguuaaucuua

SEQ ID NO: 3882652 - RNA, 13 nt, Human
cauguguucccuu

SEQ ID NO: 3882653 - RNA, 22 nt, Human
cauguguucccuuugucuuuca

SEQ ID NO: 3882654 - RNA, 22 nt, Human
cauguuaaaccaugggauaaau

SEQ ID NO: 3882655 - RNA, 21 nt, Human
cauguuaaccccuccacucuu

SEQ ID NO: 3882656 - RNA, 16 nt, Human
cauguuaauccuagcu

SEQ ID NO: 3882657 - RNA, 17 nt, Human
cauguuacuggauaaau

SEQ ID NO: 3882658 - RNA, 14 nt, Human
cauguuaggaaaau

SEQ ID NO: 3882659 - RNA, 14 nt, Human
cauguuaguaauac

SEQ ID NO: 3882660 - RNA, 20 nt, Human
cauguuaguaauaccucuaa

SEQ ID NO: 3882661 - RNA, 24 nt, Human
cauguuaguaauaccucuaauagu

SEQ ID NO: 3882662 - RNA, 24 nt, Human
cauguuaguuaccuuauaguuacu

SEQ ID NO: 3882663 - RNA, 20 nt, Human
cauguuauauauuuuuugua

SEQ ID NO: 3882664 - RNA, 20 nt, Human
cauguuauauuuaaugcauu

SEQ ID NO: 3882665 - RNA, 21 nt, Human
cauguuaugauaaaaaauuuu

SEQ ID NO: 3882666 - RNA, 16 nt, Human
cauguuccaauaaaca

SEQ ID NO: 3882667 - RNA, 14 nt, Human
cauuggcuauuuaa

SEQ ID NO: 3882668 - RNA, 19 nt, Human
cauugggcagcgcccuucc

SEQ ID NO: 3882669 - RNA, 23 nt, Human
cauugggcagcgcccuuccucuc

SEQ ID NO: 3882670 - RNA, 18 nt, Human
cauuggggcucccagcca

SEQ ID NO: 3882671 - RNA, 20 nt, Human
cauugggugagguaauaaac

SEQ ID NO: 3882672 - RNA, 15 nt, Human
cauugguuaauuuuu

SEQ ID NO: 3882673 - RNA, 17 nt, Human
cauugguucccuuugcu

SEQ ID NO: 3882674 - RNA, 14 nt, Human
cauugguucuugua

SEQ ID NO: 3882675 - RNA, 18 nt, Human
cauugguucuuguauuaa

SEQ ID NO: 3882676 - RNA, 22 nt, Human
cauugguucuuguauuaagaau

SEQ ID NO: 3882677 - RNA, 20 nt, Human
cauuguaaaagcauuuugua

SEQ ID NO: 3882678 - RNA, 15 nt, Human
cauuguaacuuggau

SEQ ID NO: 3882679 - RNA, 21 nt, Human
cauuguaauguuacugaucau

SEQ ID NO: 3882680 - RNA, 19 nt, Human
cauuguaauguugugaaua

SEQ ID NO: 3882681 - RNA, 14 nt, Human
cauuguagaaaagc

SEQ ID NO: 3882682 - RNA, 17 nt, Human
cauuguagagcuucugg

SEQ ID NO: 3882683 - RNA, 18 nt, Human
cauuguagugcuuugaga

SEQ ID NO: 3882684 - RNA, 20 nt, Human
cauuguagugcuuugagaga

SEQ ID NO: 3882685 - RNA, 24 nt, Human
cauuguagugcuuugagagagaaa

SEQ ID NO: 3882686 - RNA, 16 nt, Human
cauuguauaaaaauag

SEQ ID NO: 3882687 - RNA, 24 nt, Human
cauuguauagauauaaugaacaaa

SEQ ID NO: 3882688 - RNA, 15 nt, Human
cauuguauauaugug

SEQ ID NO: 3882689 - RNA, 16 nt, Human
cauuguaucgauguua

SEQ ID NO: 3882690 - RNA, 17 nt, Human
cauuguaucgauguuau

SEQ ID NO: 3882691 - RNA, 21 nt, Human
cauuguaucgauguuauguaa

SEQ ID NO: 3882692 - RNA, 22 nt, Human
cauuguaucgauguuauguaaa

SEQ ID NO: 3882693 - RNA, 16 nt, Human
cauuguaugauguguu

SEQ ID NO: 3882694 - RNA, 20 nt, Human
cauuguaugauguguuguga

SEQ ID NO: 3882695 - RNA, 22 nt, Human
cauuguccagagcugcuucccc

SEQ ID NO: 3882696 - RNA, 18 nt, Human
cauugucccucugcccca

SEQ ID NO: 3882697 - RNA, 19 nt, Human
cauugucccugaagagaag

SEQ ID NO: 3882698 - RNA, 13 nt, Human
cauugucuucgga

SEQ ID NO: 3882699 - RNA, 21 nt, Human
cauugucuuuauaugaacaua

SEQ ID NO: 3882700 - RNA, 17 nt, Human
cauugugaaccaaugca

SEQ ID NO: 3882701 - RNA, 19 nt, Human
cauugugaguaaaucagau

SEQ ID NO: 3882702 - RNA, 16 nt, Human
cauugugcauucuaga

SEQ ID NO: 3882703 - RNA, 17 nt, Human
cauuguggcacauucuu

SEQ ID NO: 3882704 - RNA, 16 nt, Human
cauuguggcuccuauc

SEQ ID NO: 3882705 - RNA, 19 nt, Human
cauuguggcugucagcagg

SEQ ID NO: 3882706 - RNA, 21 nt, Human
cauuguggcugucagcaggaa

SEQ ID NO: 3882707 - RNA, 15 nt, Human
cauugugggaagggg

SEQ ID NO: 3882708 - RNA, 14 nt, Human
cauuguuagcacua

SEQ ID NO: 3882709 - RNA, 17 nt, Human
cauuguuauauaaucau

SEQ ID NO: 3882710 - RNA, 17 nt, Human
cauuguucaaaaggaac

SEQ ID NO: 3882711 - RNA, 19 nt, Human
cauuguucaccuuuguagc

SEQ ID NO: 3882712 - RNA, 16 nt, Human
cauuguugaggugguc

SEQ ID NO: 3882713 - RNA, 18 nt, Human
cauuguugagguggucug

SEQ ID NO: 3882714 - RNA, 16 nt, Human
cauuguugcucccugu

SEQ ID NO: 3882715 - RNA, 13 nt, Human
cauuguuggcagc

SEQ ID NO: 3882716 - RNA, 17 nt, Human
cauuguuucguaacaca

SEQ ID NO: 3882717 - RNA, 21 nt, Human
cauuguuucugugggcgggcc

SEQ ID NO: 3882718 - RNA, 19 nt, Human
cauuguuugaaacaaagaa

SEQ ID NO: 3882719 - RNA, 14 nt, Human
cauuguuugcugcu

SEQ ID NO: 3882720 - RNA, 16 nt, Human
cauuguuugcugcuau

SEQ ID NO: 3882721 - RNA, 17 nt, Human
cauuguuugcuuauugu

SEQ ID NO: 3882722 - RNA, 21 nt, Human
cauuguuugcuuauuguucca

SEQ ID NO: 3882723 - RNA, 18 nt, Human
cauuguuugucugucuuc

SEQ ID NO: 3882724 - RNA, 12 nt, Human
cauuguuuugaa

SEQ ID NO: 3882725 - RNA, 19 nt, Human
cauuguuuugaauauuacu

SEQ ID NO: 3882726 - RNA, 14 nt, Human
cauuguuuugccaa

SEQ ID NO: 3882727 - RNA, 20 nt, Human
cauuguuuugccaacauugc

SEQ ID NO: 3882728 - RNA, 15 nt, Human
cauuuaaaaaaaauc

SEQ ID NO: 3882729 - RNA, 22 nt, Human
cauuuaaaaagguuuaaaacua

SEQ ID NO: 3882730 - RNA, 17 nt, Human
cauuuaaaacagacacu

SEQ ID NO: 3882731 - RNA, 19 nt, Human
cauuuaaaacauuaaaaua

SEQ ID NO: 3882732 - RNA, 13 nt, Human
cauuuaaaagaca

SEQ ID NO: 3882733 - RNA, 17 nt, Human
cauuuaaaaugauuaga

SEQ ID NO: 3882734 - RNA, 22 nt, Human
cauuuaaaauugcuauguuacu

SEQ ID NO: 3882735 - RNA, 21 nt, Human
cauuuaaacagauguccauca

SEQ ID NO: 3882736 - RNA, 14 nt, Human
cauuuaaagcauug

SEQ ID NO: 3882737 - RNA, 16 nt, Human
cauuuaaagcauugcu

SEQ ID NO: 3882738 - RNA, 17 nt, Human
cauuuaaagcauugcug

SEQ ID NO: 3882739 - RNA, 17 nt, Human
cauuuaaauuuuuuggc

SEQ ID NO: 3882740 - RNA, 18 nt, Human
cauuuaaauuuuuuggca

SEQ ID NO: 3882741 - RNA, 22 nt, Human
cauuuaaggaugggguuaugaa

SEQ ID NO: 3882742 - RNA, 17 nt, Human
cauuuaagggaaaaaua

SEQ ID NO: 3882743 - RNA, 12 nt, Human
cauuuaaguuuc

SEQ ID NO: 3882744 - RNA, 17 nt, Human
cauuuaauaauauacuu

SEQ ID NO: 3882745 - RNA, 19 nt, Human
cauuuaauaauuauaugcu

SEQ ID NO: 3882746 - RNA, 22 nt, Human
cauuuaauggggaggacaaaau

SEQ ID NO: 3882747 - RNA, 24 nt, Human
cauuuaauguagccaugggaccaa

SEQ ID NO: 3882748 - RNA, 16 nt, Human
cauuuacaaacugaag

SEQ ID NO: 3882749 - RNA, 14 nt, Human
cauuuacaacccgg

SEQ ID NO: 3882750 - RNA, 23 nt, Human
cauuuacaacccgguucacucuu

SEQ ID NO: 3882751 - RNA, 20 nt, Human
cauuuacaguccuucaaaau

SEQ ID NO: 3882752 - RNA, 16 nt, Human
cauuuacauguuuuaa

SEQ ID NO: 3882753 - RNA, 22 nt, Human
cauuuacccuucuuuucugacu

SEQ ID NO: 3882754 - RNA, 17 nt, Human
cauuuacuaaacauaug

SEQ ID NO: 3882755 - RNA, 15 nt, Human
cauuuacuguggcuu

SEQ ID NO: 3882756 - RNA, 16 nt, Human
cauuuacuuaagacuu

SEQ ID NO: 3882757 - RNA, 15 nt, Human
cauuuagaaaaguga

SEQ ID NO: 3882758 - RNA, 12 nt, Human
cauuuagaaaau

SEQ ID NO: 3882759 - RNA, 20 nt, Human
cauuuagaagaaagauguuu

SEQ ID NO: 3882760 - RNA, 20 nt, Human
cauuuagaauggugauuuua

SEQ ID NO: 3882761 - RNA, 22 nt, Human
cauuuagauccugguuucauaa

SEQ ID NO: 3882762 - RNA, 16 nt, Human
cauuuagccuguccug

SEQ ID NO: 3882763 - RNA, 21 nt, Human
cauuuagcuggccacauggcg

SEQ ID NO: 3882764 - RNA, 17 nt, Human
cauuuagggaguauucu

SEQ ID NO: 3882765 - RNA, 16 nt, Human
cauuuaggugaggaag

SEQ ID NO: 3882766 - RNA, 18 nt, Human
cauuuaggugaggaagca

SEQ ID NO: 3882767 - RNA, 15 nt, Human
cauuuagguuucuga

SEQ ID NO: 3882768 - RNA, 15 nt, Human
cauuuagucauguga

SEQ ID NO: 3882769 - RNA, 20 nt, Human
cauuuaguccaaugucuuuu

SEQ ID NO: 3882770 - RNA, 18 nt, Human
cauuuauaaagcuaaaau

SEQ ID NO: 3882771 - RNA, 17 nt, Human
cauuuauaauugcaucu

SEQ ID NO: 3882772 - RNA, 18 nt, Human
cauuuauacaaauuagaa

SEQ ID NO: 3882773 - RNA, 20 nt, Human
cauuuauacaaauuagaaaa

SEQ ID NO: 3882774 - RNA, 11 nt, Human
cauuuauacuc

SEQ ID NO: 3882775 - RNA, 12 nt, Human
cauuuauauaug

SEQ ID NO: 3882776 - RNA, 13 nt, Human
cauuuauauauug

SEQ ID NO: 3882777 - RNA, 13 nt, Human
cauuuauauugau

SEQ ID NO: 3882778 - RNA, 21 nt, Human
cauuuauauugauaagaucuu

SEQ ID NO: 3882779 - RNA, 22 nt, Human
cauuuauccacaggaaaguguu

SEQ ID NO: 3882780 - RNA, 20 nt, Human
cauuuauccaccuccaucuu

SEQ ID NO: 3882781 - RNA, 16 nt, Human
cauuuaucuauaauuu

SEQ ID NO: 3882782 - RNA, 15 nt, Human
cauuuaucuugaagg

SEQ ID NO: 3882783 - RNA, 17 nt, Human
cauuuaucuuucuacag

SEQ ID NO: 3882784 - RNA, 17 nt, Human
cauuuaugagcucuuca

SEQ ID NO: 3882785 - RNA, 20 nt, Human
cauuuaugagcucuucaugu

SEQ ID NO: 3882786 - RNA, 20 nt, Human
cauuuaugauuuaauaaaau

SEQ ID NO: 3882787 - RNA, 19 nt, Human
cauuuaugguaaucauauu

SEQ ID NO: 3882788 - RNA, 22 nt, Human
cauuuaugguaaucauauuaga

SEQ ID NO: 3882789 - RNA, 21 nt, Human
cauuuaugugucaguucauuu

SEQ ID NO: 3882790 - RNA, 13 nt, Human
cauuuauuguuua

SEQ ID NO: 3882791 - RNA, 15 nt, Human
cauuuauuuuaagca

SEQ ID NO: 3882792 - RNA, 21 nt, Human
cauuuauuuuaagcacucuua

SEQ ID NO: 3882793 - RNA, 13 nt, Human
cauuuauuuuaug

SEQ ID NO: 3882794 - RNA, 14 nt, Human
cauuuauuuuauga

SEQ ID NO: 3882795 - RNA, 17 nt, Human
cauuuauuuuaugagaa

SEQ ID NO: 3882796 - RNA, 18 nt, Human
cauuuauuuuaugagaaa

SEQ ID NO: 3882797 - RNA, 14 nt, Human
cauuuauuuugaca

SEQ ID NO: 3882798 - RNA, 20 nt, Human
cauuuauuuuuuuuaaagaa

SEQ ID NO: 3882799 - RNA, 15 nt, Human
cauuucaaaaugcuu

SEQ ID NO: 3882800 - RNA, 16 nt, Human
cauuucaauucucaaa

SEQ ID NO: 3882801 - RNA, 20 nt, Human
cauuucacaaaacagccuuu

SEQ ID NO: 3882802 - RNA, 12 nt, Human
cauuucacauua

SEQ ID NO: 3882803 - RNA, 16 nt, Human
cauuucacauuauucu

SEQ ID NO: 3882804 - RNA, 19 nt, Human
cauuucaccccucccuuuc

SEQ ID NO: 3882805 - RNA, 22 nt, Human
cauuucaccccucccuuucucc

SEQ ID NO: 3882806 - RNA, 19 nt, Human
cauuucacuugucaggagu

SEQ ID NO: 3882807 - RNA, 23 nt, Human
cauuucagaaguuaguuuguaua

SEQ ID NO: 3882808 - RNA, 15 nt, Human
cauuucaggagcagc

SEQ ID NO: 3882809 - RNA, 19 nt, Human
cauuucauauucuuucaau

SEQ ID NO: 3882810 - RNA, 18 nt, Human
cauuucaucauuguuucu

SEQ ID NO: 3882811 - RNA, 17 nt, Human
ccacugaaaaaauauau

SEQ ID NO: 3882812 - RNA, 18 nt, Human
ccacugaagauagaagaa

SEQ ID NO: 3882813 - RNA, 15 nt, Human
ccacugaagcuggga

SEQ ID NO: 3882814 - RNA, 16 nt, Human
ccacugaagcugggau

SEQ ID NO: 3882815 - RNA, 12 nt, Human
ccacugagcucc

SEQ ID NO: 3882816 - RNA, 19 nt, Human
ccacugaggagcuuuguuu

SEQ ID NO: 3882817 - RNA, 13 nt, Human
ccacugagggcag

SEQ ID NO: 3882818 - RNA, 23 nt, Human
ccacugauauucagaauuaugau

SEQ ID NO: 3882819 - RNA, 19 nt, Human
ccacugaugcuguucucuu

SEQ ID NO: 3882820 - RNA, 21 nt, Human
ccacugauggaaacaaagugg

SEQ ID NO: 3882821 - RNA, 16 nt, Human
ccacugcacagagcuc

SEQ ID NO: 3882822 - RNA, 13 nt, Human
ccacugcaccccc

SEQ ID NO: 3882823 - RNA, 14 nt, Human
ccacugcacccccu

SEQ ID NO: 3882824 - RNA, 18 nt, Human
ccacugcaccccgucuca

SEQ ID NO: 3882825 - RNA, 17 nt, Human
ccacugcacuccagccu

SEQ ID NO: 3882826 - RNA, 23 nt, Human
ccacugcacuccagccuggguga

SEQ ID NO: 3882827 - RNA, 13 nt, Human
ccacugcaggccc

SEQ ID NO: 3882828 - RNA, 23 nt, Human
ccacugccacacgucugacccuc

SEQ ID NO: 3882829 - RNA, 14 nt, Human
ccacugccagcagc

SEQ ID NO: 3882830 - RNA, 20 nt, Human
ccacugccagcagcagcagg

SEQ ID NO: 3882831 - RNA, 16 nt, Human
ccacugcccacuggcc

SEQ ID NO: 3882832 - RNA, 20 nt, Human
ccacugcccccugcugccau

SEQ ID NO: 3882833 - RNA, 19 nt, Human
ccacugccccuucauugau

SEQ ID NO: 3882834 - RNA, 17 nt, Human
ccacugcccgagcuggu

SEQ ID NO: 3882835 - RNA, 20 nt, Human
ccacugcccgagcuggugca

SEQ ID NO: 3882836 - RNA, 23 nt, Human
ccacugcccgagcuggugcauua

SEQ ID NO: 3882837 - RNA, 15 nt, Human
ccacugccucagguu

SEQ ID NO: 3882838 - RNA, 15 nt, Human
ccacugccucucccu

SEQ ID NO: 3882839 - RNA, 16 nt, Human
ccacugccucucccuc

SEQ ID NO: 3882840 - RNA, 16 nt, Human
ccacugccucugccuu

SEQ ID NO: 3882841 - RNA, 13 nt, Human
ccacugccucuuc

SEQ ID NO: 3882842 - RNA, 11 nt, Human
ccacugccugc

SEQ ID NO: 3882843 - RNA, 15 nt, Human
ccacugccugcccac

SEQ ID NO: 3882844 - RNA, 16 nt, Human
ccacugccugcccacc

SEQ ID NO: 3882845 - RNA, 12 nt, Human
ccacugccuucg

SEQ ID NO: 3882846 - RNA, 18 nt, Human
ccacugccuucgcuucuu

SEQ ID NO: 3882847 - RNA, 20 nt, Human
ccacugcucccuaagccagc

SEQ ID NO: 3882848 - RNA, 12 nt, Human
ccacugcucugg

SEQ ID NO: 3882849 - RNA, 13 nt, Human
ccacugcucuggu

SEQ ID NO: 3882850 - RNA, 18 nt, Human
ccacugcugauauuuucu

SEQ ID NO: 3882851 - RNA, 19 nt, Human
ccacugcugauauuuucuc

SEQ ID NO: 3882852 - RNA, 18 nt, Human
ccacugcugcaguagggg

SEQ ID NO: 3882853 - RNA, 14 nt, Human
ccacugcuuuuccc

SEQ ID NO: 3882854 - RNA, 22 nt, Human
ccacugcuuuuggucuguguga

SEQ ID NO: 3882855 - RNA, 15 nt, Human
ccacuggaagggcag

SEQ ID NO: 3882856 - RNA, 13 nt, Human
ccacuggacugac

SEQ ID NO: 3882857 - RNA, 18 nt, Human
ccacuggacugaccuggu

SEQ ID NO: 3882858 - RNA, 21 nt, Human
ccacuggacuugagcuuggca

SEQ ID NO: 3882859 - RNA, 18 nt, Human
ccacuggagcagaagggg

SEQ ID NO: 3882860 - RNA, 11 nt, Human
ccacuggaggu

SEQ ID NO: 3882861 - RNA, 14 nt, Human
ccacuggccaccag

SEQ ID NO: 3882862 - RNA, 16 nt, Human
ccacuggcugcuaaca

SEQ ID NO: 3882863 - RNA, 11 nt, Human
ccacuggcugu

SEQ ID NO: 3882864 - RNA, 19 nt, Human
ccacuggcugugggcuccc

SEQ ID NO: 3882865 - RNA, 21 nt, Human
ccacuggcugugggcucccuu

SEQ ID NO: 3882866 - RNA, 14 nt, Human
ccacuggggcucag

SEQ ID NO: 3882867 - RNA, 18 nt, Human
ccacugggguccagggag

SEQ ID NO: 3882868 - RNA, 19 nt, Human
ccacuggguguaaacacau

SEQ ID NO: 3882869 - RNA, 15 nt, Human
ccacugguucuucuu

SEQ ID NO: 3882870 - RNA, 14 nt, Human
ccacuguaaaauga

SEQ ID NO: 3882871 - RNA, 20 nt, Human
ccacuguacuugcucuugau

SEQ ID NO: 3882872 - RNA, 14 nt, Human
ccacugucacccuc

SEQ ID NO: 3882873 - RNA, 24 nt, Human
ccacugucacuguuucucugcugu

SEQ ID NO: 3882874 - RNA, 11 nt, Human
ccacuguccug

SEQ ID NO: 3882875 - RNA, 14 nt, Human
ccacugucuucuuc

SEQ ID NO: 3882876 - RNA, 14 nt, Human
ccacugugaagaga

SEQ ID NO: 3882877 - RNA, 18 nt, Human
ccacugugcagguuccca

SEQ ID NO: 3882878 - RNA, 15 nt, Human
ccacugugccucaga

SEQ ID NO: 3882879 - RNA, 16 nt, Human
ccacugugccucagag

SEQ ID NO: 3882880 - RNA, 21 nt, Human
ccacugugccuuugcaaauca

SEQ ID NO: 3882881 - RNA, 22 nt, Human
ccacugugccuuugcaaaucag

SEQ ID NO: 3882882 - RNA, 17 nt, Human
ccacugugcugaauucu

SEQ ID NO: 3882883 - RNA, 19 nt, Human
ccacugugcugaauucugc

SEQ ID NO: 3882884 - RNA, 13 nt, Human
ccacugugguggc

SEQ ID NO: 3882885 - RNA, 14 nt, Human
ccacuguuaucaaa

SEQ ID NO: 3882886 - RNA, 18 nt, Human
ccacuguuucucuugagc

SEQ ID NO: 3882887 - RNA, 23 nt, Human
ccacuguuucucuugagcuggcc

SEQ ID NO: 3882888 - RNA, 18 nt, Human
ccacuguuucuugcuugu

SEQ ID NO: 3882889 - RNA, 15 nt, Human
ccacuguuuggaaau

SEQ ID NO: 3882890 - RNA, 21 nt, Human
ccacuuaaaaaauguccauga

SEQ ID NO: 3882891 - RNA, 15 nt, Human
ccacuuaauguaugu

SEQ ID NO: 3882892 - RNA, 17 nt, Human
ccacuuaauguauguua

SEQ ID NO: 3882893 - RNA, 20 nt, Human
ccacuuaauguauguuacca

SEQ ID NO: 3882894 - RNA, 13 nt, Human
ccacuuaccuuca

SEQ ID NO: 3882895 - RNA, 19 nt, Human
ccacuuaccuucaauaaag

SEQ ID NO: 3882896 - RNA, 20 nt, Human
ccacuuagccuuucuuuucu

SEQ ID NO: 3882897 - RNA, 15 nt, Human
ccacuucaaaacaaa

SEQ ID NO: 3882898 - RNA, 13 nt, Human
ccacuucaauaga

SEQ ID NO: 3882899 - RNA, 13 nt, Human
ccacuucagcuga

SEQ ID NO: 3882900 - RNA, 21 nt, Human
ccacuucaggguucuccucuc

SEQ ID NO: 3882901 - RNA, 21 nt, Human
ccacuucauucuugaaagcug

SEQ ID NO: 3882902 - RNA, 13 nt, Human
ccacuuccagggg

SEQ ID NO: 3882903 - RNA, 19 nt, Human
ccacuuccaggggaaccug

SEQ ID NO: 3882904 - RNA, 19 nt, Human
ccacuuccccuccuacccc

SEQ ID NO: 3882905 - RNA, 13 nt, Human
ccacuucccuggg

SEQ ID NO: 3882906 - RNA, 14 nt, Human
ccacuucccugggc

SEQ ID NO: 3882907 - RNA, 14 nt, Human
ccacuucugacagc

SEQ ID NO: 3882908 - RNA, 13 nt, Human
ccacuucugcacu

SEQ ID NO: 3882909 - RNA, 13 nt, Human
ccacuucugccag

SEQ ID NO: 3882910 - RNA, 19 nt, Human
ccacuucugccagaugucc

SEQ ID NO: 3882911 - RNA, 15 nt, Human
ccacuucuuccuuuc

SEQ ID NO: 3882912 - RNA, 23 nt, Human
ccacuugacacuauucacuaaaa

SEQ ID NO: 3882913 - RNA, 15 nt, Human
ccacuugaggccuga

SEQ ID NO: 3882914 - RNA, 19 nt, Human
ccacuugaggccugaucug

SEQ ID NO: 3882915 - RNA, 24 nt, Human
ccacuugaggccugaucugcccau

SEQ ID NO: 3882916 - RNA, 16 nt, Human
ccacuugccucuuccu

SEQ ID NO: 3882917 - RNA, 17 nt, Human
ccacuugccucuuccuu

SEQ ID NO: 3882918 - RNA, 12 nt, Human
ccacuuggccaa

SEQ ID NO: 3882919 - RNA, 17 nt, Human
ccacuuggccaagcagg

SEQ ID NO: 3882920 - RNA, 19 nt, Human
ccacuuggucugugagaug

SEQ ID NO: 3882921 - RNA, 22 nt, Human
ccacuuggucugugagaugcua

SEQ ID NO: 3882922 - RNA, 20 nt, Human
ccacuuguagauuugauuuu

SEQ ID NO: 3882923 - RNA, 15 nt, Human
ccacuuguccgcugg

SEQ ID NO: 3882924 - RNA, 21 nt, Human
ccacuuguccgcuggguggua

SEQ ID NO: 3882925 - RNA, 18 nt, Human
ccacuuguccuuagccug

SEQ ID NO: 3882926 - RNA, 22 nt, Human
ccacuuguccuuagccuggacc

SEQ ID NO: 3882927 - RNA, 24 nt, Human
ccacuuucaaucuucaauccuuga

SEQ ID NO: 3882928 - RNA, 13 nt, Human
ccacuuucagcug

SEQ ID NO: 3882929 - RNA, 14 nt, Human
ccacuuucagcugu

SEQ ID NO: 3882930 - RNA, 16 nt, Human
ccacuuucagcugucu

SEQ ID NO: 3882931 - RNA, 17 nt, Human
ccacuuucagcugucuu

SEQ ID NO: 3882932 - RNA, 19 nt, Human
ccacuuucuagccagagga

SEQ ID NO: 3882933 - RNA, 13 nt, Human
ccacuuucuuucu

SEQ ID NO: 3882934 - RNA, 19 nt, Human
ccacuuugcacauuuugau

SEQ ID NO: 3882935 - RNA, 21 nt, Human
ccacuuugcacgacgcccucu

SEQ ID NO: 3882936 - RNA, 13 nt, Human
ccacuuuguccau

SEQ ID NO: 3882937 - RNA, 14 nt, Human
ccacuuuguuggaa

SEQ ID NO: 3882938 - RNA, 14 nt, Human
ccacuuuuuagaaa

SEQ ID NO: 3882939 - RNA, 15 nt, Human
ccacuuuuugcagcu

SEQ ID NO: 3882940 - RNA, 17 nt, Human
ccacuuuuugcagcuuu

SEQ ID NO: 3882941 - RNA, 16 nt, Human
ccagaaaacaaaacug

SEQ ID NO: 3882942 - RNA, 15 nt, Human
ccagaaaaccccagc

SEQ ID NO: 3882943 - RNA, 14 nt, Human
ccagaaaaggacag

SEQ ID NO: 3882944 - RNA, 21 nt, Human
ccagaaacacccacaggcaug

SEQ ID NO: 3882945 - RNA, 20 nt, Human
ccagaaacaccuagaucaga

SEQ ID NO: 3882946 - RNA, 18 nt, Human
ccagaaaccuuuguuugc

SEQ ID NO: 3882947 - RNA, 14 nt, Human
ccagaaaggagacu

SEQ ID NO: 3882948 - RNA, 15 nt, Human
ccagaaaggauauuu

SEQ ID NO: 3882949 - RNA, 16 nt, Human
ccagaaaggauauuua

SEQ ID NO: 3882950 - RNA, 22 nt, Human
ccagaaauccaucuaaauaccu

SEQ ID NO: 3882951 - RNA, 18 nt, Human
ccagaaauggugagaugu

SEQ ID NO: 3882952 - RNA, 22 nt, Human
ccagaaaugucuaaaugcugaa

SEQ ID NO: 3882953 - RNA, 13 nt, Human
ccagaaauuagaa

SEQ ID NO: 3882954 - RNA, 10 nt, Human
ccagaaauuc

SEQ ID NO: 3882955 - RNA, 20 nt, Human
ccagaacacggcucacgcuu

SEQ ID NO: 3882956 - RNA, 22 nt, Human
ccagaaccacacuugaaaccuu

SEQ ID NO: 3882957 - RNA, 21 nt, Human
ccagagcuacccgcagaguuc

SEQ ID NO: 3882958 - RNA, 12 nt, Human
ccagagcucugg

SEQ ID NO: 3882959 - RNA, 16 nt, Human
ccagagcucuggagcc

SEQ ID NO: 3882960 - RNA, 21 nt, Human
ccagagcucuggagccaccug

SEQ ID NO: 3882961 - RNA, 22 nt, Human
ccagagcucuggagccaccugu

SEQ ID NO: 3882962 - RNA, 14 nt, Human
ccagagcugccacc

SEQ ID NO: 3882963 - RNA, 16 nt, Human
ccagagcugccaccug

SEQ ID NO: 3882964 - RNA, 19 nt, Human
ccagagcugccaccugccu

SEQ ID NO: 3882965 - RNA, 13 nt, Human
ccagagcugccag

SEQ ID NO: 3882966 - RNA, 18 nt, Human
ccagagcugguggaccca

SEQ ID NO: 3882967 - RNA, 22 nt, Human
ccagagcugguggacccaggga

SEQ ID NO: 3882968 - RNA, 20 nt, Human
ccagagcuguuuauggccuc

SEQ ID NO: 3882969 - RNA, 17 nt, Human
ccagaggaaccugaggc

SEQ ID NO: 3882970 - RNA, 23 nt, Human
ccagaggaacuguccagagagca

SEQ ID NO: 3882971 - RNA, 19 nt, Human
ccagaggaaggggccagag

SEQ ID NO: 3882972 - RNA, 17 nt, Human
ccagaggaauccuggca

SEQ ID NO: 3882973 - RNA, 15 nt, Human
ccagaggacucccaa

SEQ ID NO: 3882974 - RNA, 16 nt, Human
ccagaggagccaccag

SEQ ID NO: 3882975 - RNA, 17 nt, Human
ccagaggagccaccagu

SEQ ID NO: 3882976 - RNA, 21 nt, Human
ccagaggagccaccaguucuc

SEQ ID NO: 3882977 - RNA, 21 nt, Human
ccagaggagcugggagccggg

SEQ ID NO: 3882978 - RNA, 22 nt, Human
ccagaggagcugggagccgggc

SEQ ID NO: 3882979 - RNA, 22 nt, Human
ccagaggagggcagcagaaggg

SEQ ID NO: 3882980 - RNA, 15 nt, Human
ccagaggcacagccg

SEQ ID NO: 3882981 - RNA, 17 nt, Human
ccagaggcacagccggg

SEQ ID NO: 3882982 - RNA, 18 nt, Human
ccagaggcagcuucuuug

SEQ ID NO: 3882983 - RNA, 19 nt, Human
ccagaggcagcuucuuugc

SEQ ID NO: 3882984 - RNA, 15 nt, Human
ccagaggcccccagc

SEQ ID NO: 3882985 - RNA, 19 nt, Human
ccagaggcccccagcccag

SEQ ID NO: 3882986 - RNA, 17 nt, Human
ccagagggagugacaga

SEQ ID NO: 3882987 - RNA, 15 nt, Human
ccagagggccugcaa

SEQ ID NO: 3882988 - RNA, 16 nt, Human
ccagagggccugcaag

SEQ ID NO: 3882989 - RNA, 17 nt, Human
ccagagggccugcaagg

SEQ ID NO: 3882990 - RNA, 19 nt, Human
ccagagggccugcaaggga

SEQ ID NO: 3882991 - RNA, 20 nt, Human
ccagagggccugcaagggag

SEQ ID NO: 3882992 - RNA, 14 nt, Human
ccagaggggaagga

SEQ ID NO: 3882993 - RNA, 23 nt, Human
ccagaggggccugccaccuggac

SEQ ID NO: 3882994 - RNA, 23 nt, Human
ccagagggguggguuccucuucc

SEQ ID NO: 3882995 - RNA, 16 nt, Human
ccagagggugggcuuc

SEQ ID NO: 3882996 - RNA, 17 nt, Human
ccagagguaacagaaca

SEQ ID NO: 3882997 - RNA, 21 nt, Human
ccagagguaacagaacagcuu

SEQ ID NO: 3882998 - RNA, 17 nt, Human
ccagagguccagcccau

SEQ ID NO: 3882999 - RNA, 16 nt, Human
ccagaggucuggcccu

SEQ ID NO: 3883000 - RNA, 18 nt, Human
ccagaggugggcaggugg

SEQ ID NO: 3883001 - RNA, 17 nt, Human
ccagagguugugcacug

SEQ ID NO: 3883002 - RNA, 19 nt, Human
ccagagguugugcacuguu

SEQ ID NO: 3883003 - RNA, 21 nt, Human
ccagaguccccccacucccag

SEQ ID NO: 3883004 - RNA, 22 nt, Human
ccagaguccccccacucccagc

SEQ ID NO: 3883005 - RNA, 17 nt, Human
ccagagucccugccugg

SEQ ID NO: 3883006 - RNA, 18 nt, Human
ccagagucccugccugga

SEQ ID NO: 3883007 - RNA, 19 nt, Human
ccagagucccugccuggac

SEQ ID NO: 3883008 - RNA, 22 nt, Human
ccagagucccugccuggaccag

SEQ ID NO: 3883009 - RNA, 18 nt, Human
ccagagugcugaaggaau

SEQ ID NO: 3883010 - RNA, 13 nt, Human
ccagaguggccug

SEQ ID NO: 3883011 - RNA, 15 nt, Human
ccagaguggccuggc

SEQ ID NO: 3883012 - RNA, 18 nt, Human
ccagaguggccuggccag

SEQ ID NO: 3883013 - RNA, 19 nt, Human
ccagaguggccuggccagg

SEQ ID NO: 3883014 - RNA, 22 nt, Human
ccagaguggccuggccaggagc

SEQ ID NO: 3883015 - RNA, 21 nt, Human
ccagaguggggaugacaugca

SEQ ID NO: 3883016 - RNA, 12 nt, Human
ccagagugugaa

SEQ ID NO: 3883017 - RNA, 18 nt, Human
ccagaguuccccaugcag

SEQ ID NO: 3883018 - RNA, 21 nt, Human
ccagaguuccccaugcagaca

SEQ ID NO: 3883019 - RNA, 13 nt, Human
ccagaguuccugc

SEQ ID NO: 3883020 - RNA, 15 nt, Human
ccagaguugcuggga

SEQ ID NO: 3883021 - RNA, 22 nt, Human
ccagauaaaauuauagauggga

SEQ ID NO: 3883022 - RNA, 13 nt, Human
ccagauaacuuuu

SEQ ID NO: 3883023 - RNA, 22 nt, Human
ccagauacggacagagaccaag

SEQ ID NO: 3883024 - RNA, 19 nt, Human
ccagaucaccaaucuagau

SEQ ID NO: 3883025 - RNA, 21 nt, Human
ccagaucaccagcccggccug

SEQ ID NO: 3883026 - RNA, 18 nt, Human
ccagaucacugccacacu

SEQ ID NO: 3883027 - RNA, 13 nt, Human
ccagaucagccag

SEQ ID NO: 3883028 - RNA, 15 nt, Human
ccagaucagccagaa

SEQ ID NO: 3883029 - RNA, 13 nt, Human
ccagaucagucag

SEQ ID NO: 3883030 - RNA, 17 nt, Human
ccagaucauguuuuggu

SEQ ID NO: 3883031 - RNA, 20 nt, Human
ccagaucauguuuuggugaa

SEQ ID NO: 3883032 - RNA, 16 nt, Human
ccagauccagccuggg

SEQ ID NO: 3883033 - RNA, 17 nt, Human
ccagauccucacaacca

SEQ ID NO: 3883034 - RNA, 23 nt, Human
ccagaucugauuuguaacccacu

SEQ ID NO: 3883035 - RNA, 14 nt, Human
ccagaucugcaccg

SEQ ID NO: 3883036 - RNA, 19 nt, Human
ccagaucuggucccuugca

SEQ ID NO: 3883037 - RNA, 16 nt, Human
ccagaucuuucagaaa

SEQ ID NO: 3883038 - RNA, 15 nt, Human
ccagaugcaccagcc

SEQ ID NO: 3883039 - RNA, 15 nt, Human
ccagaugcagggcag

SEQ ID NO: 3883040 - RNA, 18 nt, Human
ccagaugccccuuucugg

SEQ ID NO: 3883041 - RNA, 18 nt, Human
ccagaugccuucuccaga

SEQ ID NO: 3883042 - RNA, 17 nt, Human
ccagaugcgucccaaga

SEQ ID NO: 3883043 - RNA, 16 nt, Human
ccagauggacuccagc

SEQ ID NO: 3883044 - RNA, 16 nt, Human
ccagauggucauccag

SEQ ID NO: 3883045 - RNA, 18 nt, Human
ccagaugugacaguguug

SEQ ID NO: 3883046 - RNA, 15 nt, Human
ccagauuccccugug

SEQ ID NO: 3883047 - RNA, 18 nt, Human
ccagauuccccuguguca

SEQ ID NO: 3883048 - RNA, 18 nt, Human
ccagauucuuuccugagg

SEQ ID NO: 3883049 - RNA, 20 nt, Human
ccagauucuuuccugaggcu

SEQ ID NO: 3883050 - RNA, 18 nt, Human
ccagauugacgacaagug

SEQ ID NO: 3883051 - RNA, 19 nt, Human
ccagauugacgacaagugc

SEQ ID NO: 3883052 - RNA, 21 nt, Human
ccagauugacgacaagugcug

SEQ ID NO: 3883053 - RNA, 20 nt, Human
ccagauugcaacaggcuggg

SEQ ID NO: 3883054 - RNA, 23 nt, Human
ccagauugcaacaggcugggcuu

SEQ ID NO: 3883055 - RNA, 19 nt, Human
ccagauuggcucacacuga

SEQ ID NO: 3883056 - RNA, 22 nt, Human
ccagauuguaucaugugcuaga

SEQ ID NO: 3883057 - RNA, 14 nt, Human
ccagauuuaaauaa

SEQ ID NO: 3883058 - RNA, 15 nt, Human
ccagauuucacucuc

SEQ ID NO: 3883059 - RNA, 14 nt, Human
ccagauuuuccuga

SEQ ID NO: 3883060 - RNA, 18 nt, Human
ccagauuuugcuguauau

SEQ ID NO: 3883061 - RNA, 13 nt, Human
ccagauuuuuaau

SEQ ID NO: 3883062 - RNA, 16 nt, Human
ccagauuuuuacacau

SEQ ID NO: 3883063 - RNA, 18 nt, Human
ccagauuuuucggaggcc

SEQ ID NO: 3883064 - RNA, 24 nt, Human
ccagauuuuuuacagcugccugca

SEQ ID NO: 3883065 - RNA, 21 nt, Human
ccagcaaagagugggcugcau

SEQ ID NO: 3883066 - RNA, 19 nt, Human
ccagcaaagccccaugcug

SEQ ID NO: 3883067 - RNA, 22 nt, Human
ccagcaaagccccaugcuggag

SEQ ID NO: 3883068 - RNA, 16 nt, Human
ccagcaaagcccccag

SEQ ID NO: 3883069 - RNA, 23 nt, Human
ccagcaaagcccccagagcccag

SEQ ID NO: 3883070 - RNA, 19 nt, Human
ccagcaacacagccugggc

SEQ ID NO: 3883071 - RNA, 22 nt, Human
ccagcaacacagccugggcccc

SEQ ID NO: 3883072 - RNA, 15 nt, Human
ccagcaacccuccua

SEQ ID NO: 3883073 - RNA, 11 nt, Human
ccagcaacuga

SEQ ID NO: 3883074 - RNA, 14 nt, Human
ccagcaacuucuuc

SEQ ID NO: 3883075 - RNA, 14 nt, Human
ccagcaacuugaac

SEQ ID NO: 3883076 - RNA, 17 nt, Human
ccagcaagagaaccccg

SEQ ID NO: 3883077 - RNA, 16 nt, Human
ccagcaagguggagug

SEQ ID NO: 3883078 - RNA, 15 nt, Human
ccagcaagugagagc

SEQ ID NO: 3883079 - RNA, 16 nt, Human
ccagcaagugagagcu

SEQ ID NO: 3883080 - RNA, 17 nt, Human
ccagcaagugagagcug

SEQ ID NO: 3883081 - RNA, 20 nt, Human
ccagcaagugagagcugggu

SEQ ID NO: 3883082 - RNA, 16 nt, Human
ccagcaauauaucuga

SEQ ID NO: 3883083 - RNA, 17 nt, Human
ccagcaaugauguccag

SEQ ID NO: 3883084 - RNA, 16 nt, Human
ccagcaauucuccugc

SEQ ID NO: 3883085 - RNA, 19 nt, Human
ccagcaauucuccugccuc

SEQ ID NO: 3883086 - RNA, 16 nt, Human
ccagcacacucccgag

SEQ ID NO: 3883087 - RNA, 17 nt, Human
ccagcacacucccgaga

SEQ ID NO: 3883088 - RNA, 15 nt, Human
ccagcacacugggag

SEQ ID NO: 3883089 - RNA, 22 nt, Human
ccagcacagcuuagauuucaua

SEQ ID NO: 3883090 - RNA, 19 nt, Human
ccagcaccaccaggucucc

SEQ ID NO: 3883091 - RNA, 23 nt, Human
ccagcaccaccaggucucccggg

SEQ ID NO: 3883092 - RNA, 13 nt, Human
ccagcaccacccu

SEQ ID NO: 3883093 - RNA, 20 nt, Human
ccagcaccacccuccuuccc

SEQ ID NO: 3883094 - RNA, 18 nt, Human
ccagcacccagcaacucc

SEQ ID NO: 3883095 - RNA, 18 nt, Human
ccagcaccggaccagccu

SEQ ID NO: 3883096 - RNA, 19 nt, Human
ccagcaccggaccagccug

SEQ ID NO: 3883097 - RNA, 21 nt, Human
ccagcaccggaccagccuggc

SEQ ID NO: 3883098 - RNA, 20 nt, Human
ccagcaccuugugccugggg

SEQ ID NO: 3883099 - RNA, 17 nt, Human
ccagcacugaggaagaa

SEQ ID NO: 3883100 - RNA, 20 nt, Human
ccagcccucccuguccuccu

SEQ ID NO: 3883101 - RNA, 13 nt, Human
ccagcccugcugg

SEQ ID NO: 3883102 - RNA, 15 nt, Human
ccagcccugcuggcc

SEQ ID NO: 3883103 - RNA, 13 nt, Human
ccagcccuggcuc

SEQ ID NO: 3883104 - RNA, 17 nt, Human
ccagcccuggcucugca

SEQ ID NO: 3883105 - RNA, 15 nt, Human
ccagcccuguggaag

SEQ ID NO: 3883106 - RNA, 20 nt, Human
ccagcccuuucagcugcagc

SEQ ID NO: 3883107 - RNA, 17 nt, Human
ccagccgacccccucuc

SEQ ID NO: 3883108 - RNA, 18 nt, Human
ccagccgacccccucucc

SEQ ID NO: 3883109 - RNA, 17 nt, Human
ccagccgagauagccaa

SEQ ID NO: 3883110 - RNA, 18 nt, Human
ccagccgccaugcuccug

SEQ ID NO: 3883111 - RNA, 19 nt, Human
ccagccgccaugcuccugg

SEQ ID NO: 3883112 - RNA, 19 nt, Human
ccagccgcgcaucagacug

SEQ ID NO: 3883113 - RNA, 19 nt, Human
ccagccgcucuccugccac

SEQ ID NO: 3883114 - RNA, 14 nt, Human
ccagccgcugcccg

SEQ ID NO: 3883115 - RNA, 16 nt, Human
ccagccgcugcccggc

SEQ ID NO: 3883116 - RNA, 23 nt, Human
ccagccgcuuggcgaugccagcc

SEQ ID NO: 3883117 - RNA, 16 nt, Human
ccagccggccaaugga

SEQ ID NO: 3883118 - RNA, 17 nt, Human
ccagccggccaauggaa

SEQ ID NO: 3883119 - RNA, 14 nt, Human
ccagccggccucuc

SEQ ID NO: 3883120 - RNA, 13 nt, Human
ccagccucagcgc

SEQ ID NO: 3883121 - RNA, 20 nt, Human
ccagccucaguccuccccuc

SEQ ID NO: 3883122 - RNA, 19 nt, Human
ccagccucaucucuuuguu

SEQ ID NO: 3883123 - RNA, 17 nt, Human
ccagccucccugaagcc

SEQ ID NO: 3883124 - RNA, 16 nt, Human
ccagccucgucuucau

SEQ ID NO: 3883125 - RNA, 15 nt, Human
ccagccucuagggac

SEQ ID NO: 3883126 - RNA, 15 nt, Human
ccagccucuccccug

SEQ ID NO: 3883127 - RNA, 19 nt, Human
ccagccucuguuccccuag

SEQ ID NO: 3883128 - RNA, 13 nt, Human
ccagccucuuucc

SEQ ID NO: 3883129 - RNA, 20 nt, Human
ccagccugcccaagcccagg

SEQ ID NO: 3883130 - RNA, 23 nt, Human
ccagccugcccaagcccaggcca

SEQ ID NO: 3883131 - RNA, 13 nt, Human
ccagccugcgccu

SEQ ID NO: 3883132 - RNA, 16 nt, Human
ccagccugcgccugcu

SEQ ID NO: 3883133 - RNA, 17 nt, Human
ccagccugcgccugcug

SEQ ID NO: 3883134 - RNA, 10 nt, Human
ccagccugcu

SEQ ID NO: 3883135 - RNA, 19 nt, Human
ccagccugcuagcuagcuc

SEQ ID NO: 3883136 - RNA, 13 nt, Human
ccagccuggaugc

SEQ ID NO: 3883137 - RNA, 17 nt, Human
ccagccuggaugccauc

SEQ ID NO: 3883138 - RNA, 19 nt, Human
ccagccuggccacgcagcc

SEQ ID NO: 3883139 - RNA, 15 nt, Human
ccagccuggcccagc

SEQ ID NO: 3883140 - RNA, 19 nt, Human
ccagccuggcccagcuccc

SEQ ID NO: 3883141 - RNA, 20 nt, Human
ccagccuggcccagcucccc

SEQ ID NO: 3883142 - RNA, 17 nt, Human
ccagccuggccuccugc

SEQ ID NO: 3883143 - RNA, 18 nt, Human
ccagccuggccuccugcc

SEQ ID NO: 3883144 - RNA, 20 nt, Human
ccagccuggccuccugccuc

SEQ ID NO: 3883145 - RNA, 13 nt, Human
ccagccuggcuuc

SEQ ID NO: 3883146 - RNA, 17 nt, Human
ccagccugggaggcaca

SEQ ID NO: 3883147 - RNA, 18 nt, Human
ccagccugggaggcacag

SEQ ID NO: 3883148 - RNA, 19 nt, Human
ccagccugggcaacagagc

SEQ ID NO: 3883149 - RNA, 18 nt, Human
ccagccugggcagccagg

SEQ ID NO: 3883150 - RNA, 22 nt, Human
ccagccugggcagccaggcugc

SEQ ID NO: 3883151 - RNA, 17 nt, Human
ccagccugggccuaugg

SEQ ID NO: 3883152 - RNA, 21 nt, Human
ccagccugggccuauggagag

SEQ ID NO: 3883153 - RNA, 22 nt, Human
ccagccugggccuauggagagc

SEQ ID NO: 3883154 - RNA, 19 nt, Human
ccagccuggggccuggcag

SEQ ID NO: 3883155 - RNA, 21 nt, Human
ccagccuggggcugaggcuga

SEQ ID NO: 3883156 - RNA, 10 nt, Human
ccagccuguc

SEQ ID NO: 3883157 - RNA, 19 nt, Human
ccagccuucuuugcuugcc

SEQ ID NO: 3883158 - RNA, 21 nt, Human
ccagccuugagcccuggcugu

SEQ ID NO: 3883159 - RNA, 18 nt, Human
ccagccuuucucccaggc

SEQ ID NO: 3883160 - RNA, 23 nt, Human
ccagccuuuguuccccacuggag

SEQ ID NO: 3883161 - RNA, 14 nt, Human
ccagcgagcccugg

SEQ ID NO: 3883162 - RNA, 22 nt, Human
ccagcgagcgcccagcuccuga

SEQ ID NO: 3883163 - RNA, 20 nt, Human
ccagcgaucucuccacugug

SEQ ID NO: 3883164 - RNA, 23 nt, Human
ccagcgauucccucucccaggcc

SEQ ID NO: 3883165 - RNA, 17 nt, Human
ccagcgcccgcugggcu

SEQ ID NO: 3883166 - RNA, 22 nt, Human
ccagcgcccgcugggcugagcc

SEQ ID NO: 3883167 - RNA, 14 nt, Human
ccagcgccucccuc

SEQ ID NO: 3883168 - RNA, 20 nt, Human
ccagcgccucccuccacccc

SEQ ID NO: 3883169 - RNA, 23 nt, Human
ccagcgccucccuccaccccagg

SEQ ID NO: 3883170 - RNA, 15 nt, Human
ccagcgcggacaucc

SEQ ID NO: 3883171 - RNA, 13 nt, Human
ccagcgcucugcc

SEQ ID NO: 3883172 - RNA, 21 nt, Human
ccagcgcuugaagccugaacc

SEQ ID NO: 3883173 - RNA, 14 nt, Human
ccagcggacacacg

SEQ ID NO: 3883174 - RNA, 17 nt, Human
ccagcggacaguggcag

SEQ ID NO: 3883175 - RNA, 18 nt, Human
ccagcggacaguggcagg

SEQ ID NO: 3883176 - RNA, 15 nt, Human
ccagcggcccuguca

SEQ ID NO: 3883177 - RNA, 13 nt, Human
ccagcggcugagu

SEQ ID NO: 3883178 - RNA, 21 nt, Human
ccagcggcuggugcagggccu

SEQ ID NO: 3883179 - RNA, 23 nt, Human
ccagcgggaauggcagcugccac

SEQ ID NO: 3883180 - RNA, 22 nt, Human
ccagcguauauauaagaaagac

SEQ ID NO: 3883181 - RNA, 15 nt, Human
ccagcgucccagucu

SEQ ID NO: 3883182 - RNA, 16 nt, Human
ccagcgucggucugug

SEQ ID NO: 3883183 - RNA, 18 nt, Human
ccagcgucggucugugcc

SEQ ID NO: 3883184 - RNA, 23 nt, Human
ccagcguggcgcaguggcccuga

SEQ ID NO: 3883185 - RNA, 19 nt, Human
ccagcuaagaaccuggaac

SEQ ID NO: 3883186 - RNA, 15 nt, Human
ccagcuaaggggugg

SEQ ID NO: 3883187 - RNA, 20 nt, Human
ccagcuacaccuuucuccuu

SEQ ID NO: 3883188 - RNA, 15 nt, Human
ccagcuacccugugu

SEQ ID NO: 3883189 - RNA, 21 nt, Human
ccagcuacccuuuuucuccag

SEQ ID NO: 3883190 - RNA, 14 nt, Human
ccagcuacucagaa

SEQ ID NO: 3883191 - RNA, 14 nt, Human
ccagcuacucagga

SEQ ID NO: 3883192 - RNA, 15 nt, Human
ccagcuacuugggag

SEQ ID NO: 3883193 - RNA, 20 nt, Human
ccagcuagugacccacaugc

SEQ ID NO: 3883194 - RNA, 16 nt, Human
ccagcuauaccugugc

SEQ ID NO: 3883195 - RNA, 22 nt, Human
ccagcuauguuauauugaaaaa

SEQ ID NO: 3883196 - RNA, 22 nt, Human
ccagcuauugauauaaauaaaa

SEQ ID NO: 3883197 - RNA, 13 nt, Human
ccagcucacagug

SEQ ID NO: 3883198 - RNA, 13 nt, Human
ccagcucaccccc

SEQ ID NO: 3883199 - RNA, 20 nt, Human
ccagcucagaacccagggcu

SEQ ID NO: 3883200 - RNA, 13 nt, Human
ccagcucagcacu

SEQ ID NO: 3883201 - RNA, 12 nt, Human
ccagcucagcag

SEQ ID NO: 3883202 - RNA, 15 nt, Human
ccagcucaggggcag

SEQ ID NO: 3883203 - RNA, 16 nt, Human
ccagcucauucauuuu

SEQ ID NO: 3883204 - RNA, 17 nt, Human
ccagcucauucauuuua

SEQ ID NO: 3883205 - RNA, 15 nt, Human
ccagcuccaaccugc

SEQ ID NO: 3883206 - RNA, 20 nt, Human
ccagcuccaaccugcaaaga

SEQ ID NO: 3883207 - RNA, 13 nt, Human
ccagcuccacccc

SEQ ID NO: 3883208 - RNA, 13 nt, Human
ccagcuccagggc

SEQ ID NO: 3883209 - RNA, 14 nt, Human
ccagcuccagggcc

SEQ ID NO: 3883210 - RNA, 16 nt, Human
ccagcuccagggccag

SEQ ID NO: 3883211 - RNA, 12 nt, Human
ccagcucccagg

SEQ ID NO: 3883212 - RNA, 23 nt, Human
ccagcucccaggaccacaggcuc

SEQ ID NO: 3883213 - RNA, 19 nt, Human
ccagcuccccccaccuccc

SEQ ID NO: 3883214 - RNA, 15 nt, Human
ccagcucccccggga

SEQ ID NO: 3883215 - RNA, 14 nt, Human
ccagcucccucuau

SEQ ID NO: 3883216 - RNA, 22 nt, Human
ccagcucccugugcccccaggg

SEQ ID NO: 3883217 - RNA, 17 nt, Human
ccagcucccuucuuccc

SEQ ID NO: 3883218 - RNA, 18 nt, Human
ccagcuccggccuguccu

SEQ ID NO: 3883219 - RNA, 18 nt, Human
ccagcuccucacucaccu

SEQ ID NO: 3883220 - RNA, 23 nt, Human
ccagcuccucauccagggcucug

SEQ ID NO: 3883221 - RNA, 23 nt, Human
ccagcuccugacacugcuggaga

SEQ ID NO: 3883222 - RNA, 14 nt, Human
ccagcucucccucu

SEQ ID NO: 3883223 - RNA, 20 nt, Human
ccagcucugaaaccaguguu

SEQ ID NO: 3883224 - RNA, 20 nt, Human
ccagcucugccgucucugga

SEQ ID NO: 3883225 - RNA, 19 nt, Human
ccagcucuggaggggaggg

SEQ ID NO: 3883226 - RNA, 21 nt, Human
ccagcucugguccauagagag

SEQ ID NO: 3883227 - RNA, 14 nt, Human
ccagcucuguauca

SEQ ID NO: 3883228 - RNA, 18 nt, Human
ccagcucuguaucaggac

SEQ ID NO: 3883229 - RNA, 21 nt, Human
ccagcucuguaucaggaccca

SEQ ID NO: 3883230 - RNA, 12 nt, Human
ccagcucuguuc

SEQ ID NO: 3883231 - RNA, 14 nt, Human
ccagcucuguucuu

SEQ ID NO: 3883232 - RNA, 16 nt, Human
ccagcucuuuccuccu

SEQ ID NO: 3883233 - RNA, 17 nt, Human
ccagcucuuuccuccuu

SEQ ID NO: 3883234 - RNA, 17 nt, Human
ccagcugacaucuugaa

SEQ ID NO: 3883235 - RNA, 14 nt, Human
ccagcugacuaaac

SEQ ID NO: 3883236 - RNA, 23 nt, Human
ccagcugacuaaacuuuuuuucu

SEQ ID NO: 3883237 - RNA, 16 nt, Human
ccagcugaugacucaa

SEQ ID NO: 3883238 - RNA, 15 nt, Human
ccagcugcaaagugu

SEQ ID NO: 3883239 - RNA, 17 nt, Human
ccagcugcaccagagca

SEQ ID NO: 3883240 - RNA, 17 nt, Human
ccagcugcaccccuucc

SEQ ID NO: 3883241 - RNA, 19 nt, Human
ccagcugcaccccuuccug

SEQ ID NO: 3883242 - RNA, 21 nt, Human
ccagcugcaccccuuccuggg

SEQ ID NO: 3883243 - RNA, 23 nt, Human
ccagcugcaccccuuccugggca

SEQ ID NO: 3883244 - RNA, 19 nt, Human
ccaggagccccgaggccuu

SEQ ID NO: 3883245 - RNA, 20 nt, Human
ccaggagccccgaggccuuc

SEQ ID NO: 3883246 - RNA, 13 nt, Human
ccaggagccuccu

SEQ ID NO: 3883247 - RNA, 17 nt, Human
ccaggagccugcccagc

SEQ ID NO: 3883248 - RNA, 16 nt, Human
ccaggagccugugccu

SEQ ID NO: 3883249 - RNA, 17 nt, Human
ccaggagccugugccuc

SEQ ID NO: 3883250 - RNA, 14 nt, Human
ccaggagcuccagu

SEQ ID NO: 3883251 - RNA, 20 nt, Human
ccaggagcuccccuccccaa

SEQ ID NO: 3883252 - RNA, 16 nt, Human
ccaggagcugcccaga

SEQ ID NO: 3883253 - RNA, 16 nt, Human
ccaggagcugggcaga

SEQ ID NO: 3883254 - RNA, 22 nt, Human
ccaggagcuucuuguuuccuug

SEQ ID NO: 3883255 - RNA, 21 nt, Human
ccaggaggcagggaggcagcc

SEQ ID NO: 3883256 - RNA, 22 nt, Human
ccaggaggcagggaggcagccg

SEQ ID NO: 3883257 - RNA, 22 nt, Human
ccaggaggcggaccuuguagug

SEQ ID NO: 3883258 - RNA, 17 nt, Human
ccaggagggacaaagga

SEQ ID NO: 3883259 - RNA, 24 nt, Human
ccaggagggacaaaggagccugug

SEQ ID NO: 3883260 - RNA, 22 nt, Human
ccaggagggaggcaggggaggg

SEQ ID NO: 3883261 - RNA, 16 nt, Human
ccaggagggcacugga

SEQ ID NO: 3883262 - RNA, 18 nt, Human
ccaggagggcauccauac

SEQ ID NO: 3883263 - RNA, 22 nt, Human
ccaggaggggaacacugcccuc

SEQ ID NO: 3883264 - RNA, 18 nt, Human
ccaggaggucgaccccaa

SEQ ID NO: 3883265 - RNA, 22 nt, Human
ccaggaggugggagugaggagc

SEQ ID NO: 3883266 - RNA, 17 nt, Human
ccaggaguucugcucau

SEQ ID NO: 3883267 - RNA, 18 nt, Human
ccaggaguuugagaccag

SEQ ID NO: 3883268 - RNA, 17 nt, Human
ccaggaguuuggccaga

SEQ ID NO: 3883269 - RNA, 16 nt, Human
ccaggauagagacugg

SEQ ID NO: 3883270 - RNA, 18 nt, Human
ccaggaucagauugcaug

SEQ ID NO: 3883271 - RNA, 19 nt, Human
ccaggaucagauugcaugu

SEQ ID NO: 3883272 - RNA, 21 nt, Human
ccaggaucccaagccuccugc

SEQ ID NO: 3883273 - RNA, 17 nt, Human
ccaggaucccaggggcc

SEQ ID NO: 3883274 - RNA, 16 nt, Human
ccaggauggcgcagga

SEQ ID NO: 3883275 - RNA, 22 nt, Human
ccaggauguacaaggacagccc

SEQ ID NO: 3883276 - RNA, 17 nt, Human
ccaggauugaagagcau

SEQ ID NO: 3883277 - RNA, 18 nt, Human
ccaggauugaagagcauu

SEQ ID NO: 3883278 - RNA, 13 nt, Human
ccaggauuucuaa

SEQ ID NO: 3883279 - RNA, 17 nt, Human
ccaggauuugcacagaa

SEQ ID NO: 3883280 - RNA, 23 nt, Human
ccaggauuuuaacaaaagcaaga

SEQ ID NO: 3883281 - RNA, 15 nt, Human
ccaggcacacacugu

SEQ ID NO: 3883282 - RNA, 16 nt, Human
ccaggcacacacugug

SEQ ID NO: 3883283 - RNA, 16 nt, Human
ccaggcacagcugagu

SEQ ID NO: 3883284 - RNA, 11 nt, Human
ccaggcacagg

SEQ ID NO: 3883285 - RNA, 12 nt, Human
ccaggcacaggc

SEQ ID NO: 3883286 - RNA, 16 nt, Human
ccaggcacaggcaggg

SEQ ID NO: 3883287 - RNA, 17 nt, Human
ccaggcacaggcagggc

SEQ ID NO: 3883288 - RNA, 15 nt, Human
ccaggcaccaucucc

SEQ ID NO: 3883289 - RNA, 16 nt, Human
ccaggcacccaaaccc

SEQ ID NO: 3883290 - RNA, 21 nt, Human
ccaggcacccuucuuuccucu

SEQ ID NO: 3883291 - RNA, 22 nt, Human
ccaggcacccuucuuuccucuu

SEQ ID NO: 3883292 - RNA, 12 nt, Human
ccaggcacugca

SEQ ID NO: 3883293 - RNA, 13 nt, Human
ccaggcacugcaa

SEQ ID NO: 3883294 - RNA, 16 nt, Human
ccaggcacugcugccc

SEQ ID NO: 3883295 - RNA, 19 nt, Human
ccaggcacugcugcccagc

SEQ ID NO: 3883296 - RNA, 15 nt, Human
ccaggcagauccagg

SEQ ID NO: 3883297 - RNA, 18 nt, Human
ccaggcagauccaggacu

SEQ ID NO: 3883298 - RNA, 13 nt, Human
ccaggcagaucug

SEQ ID NO: 3883299 - RNA, 17 nt, Human
ccaggcagaucugugcc

SEQ ID NO: 3883300 - RNA, 18 nt, Human
ccaggcagaucugugccc

SEQ ID NO: 3883301 - RNA, 20 nt, Human
ccaggcagaucugugcccca

SEQ ID NO: 3883302 - RNA, 15 nt, Human
ccaggcagcagacac

SEQ ID NO: 3883303 - RNA, 16 nt, Human
ccaggcagccucuggg

SEQ ID NO: 3883304 - RNA, 22 nt, Human
ccaggcagccucugucaggccu

SEQ ID NO: 3883305 - RNA, 20 nt, Human
ccaggcagcugucacugcug

SEQ ID NO: 3883306 - RNA, 18 nt, Human
ccaggcaggagcccuucu

SEQ ID NO: 3883307 - RNA, 18 nt, Human
ccaggcaggcuaaggcgu

SEQ ID NO: 3883308 - RNA, 13 nt, Human
ccaggcagggaga

SEQ ID NO: 3883309 - RNA, 19 nt, Human
ccaggcagggccaacccuu

SEQ ID NO: 3883310 - RNA, 15 nt, Human
ccaggcagggguggg

SEQ ID NO: 3883311 - RNA, 21 nt, Human
ccaggcaggggugggggugga

SEQ ID NO: 3883312 - RNA, 21 nt, Human
ccaggcagucgggggcuggcc

SEQ ID NO: 3883313 - RNA, 19 nt, Human
ccaggcauuccccaggagg

SEQ ID NO: 3883314 - RNA, 14 nt, Human
ccaggccacaagac

SEQ ID NO: 3883315 - RNA, 14 nt, Human
ccaggccaccagga

SEQ ID NO: 3883316 - RNA, 16 nt, Human
ccaggccaccuccaga

SEQ ID NO: 3883317 - RNA, 17 nt, Human
ccaggccaccuccccag

SEQ ID NO: 3883318 - RNA, 21 nt, Human
ccaggccagagggagugacag

SEQ ID NO: 3883319 - RNA, 11 nt, Human
ccaggccagcc

SEQ ID NO: 3883320 - RNA, 13 nt, Human
ccaggccagccuc

SEQ ID NO: 3883321 - RNA, 14 nt, Human
ccaggccagccucc

SEQ ID NO: 3883322 - RNA, 15 nt, Human
ccaggccagcugccu

SEQ ID NO: 3883323 - RNA, 13 nt, Human
ccaggccaggacu

SEQ ID NO: 3883324 - RNA, 17 nt, Human
ccaggccaggacucugc

SEQ ID NO: 3883325 - RNA, 19 nt, Human
ccaggccaggacucugcag

SEQ ID NO: 3883326 - RNA, 16 nt, Human
ccaggccauggaggca

SEQ ID NO: 3883327 - RNA, 14 nt, Human
ccaggcccaaggcu

SEQ ID NO: 3883328 - RNA, 15 nt, Human
ccaggcccacucagg

SEQ ID NO: 3883329 - RNA, 22 nt, Human
ccaggcccacugugccucagag

SEQ ID NO: 3883330 - RNA, 21 nt, Human
ccaggccccaaaaccacagcc

SEQ ID NO: 3883331 - RNA, 13 nt, Human
ccaggccccauga

SEQ ID NO: 3883332 - RNA, 18 nt, Human
ccaggccccaugaccucc

SEQ ID NO: 3883333 - RNA, 20 nt, Human
ccaggcccccaagccugcag

SEQ ID NO: 3883334 - RNA, 22 nt, Human
ccaggcccccaccacacauccc

SEQ ID NO: 3883335 - RNA, 23 nt, Human
ccaggcccccaccacacauccca

SEQ ID NO: 3883336 - RNA, 19 nt, Human
ccaggccccgaggacccag

SEQ ID NO: 3883337 - RNA, 21 nt, Human
ccaggccccgaggacccagac

SEQ ID NO: 3883338 - RNA, 23 nt, Human
ccaggccccgaggacccagaccc

SEQ ID NO: 3883339 - RNA, 21 nt, Human
ccaggccccuggaggcugccu

SEQ ID NO: 3883340 - RNA, 22 nt, Human
ccaggcccgucuguccaucugc

SEQ ID NO: 3883341 - RNA, 13 nt, Human
ccaggcccucugc

SEQ ID NO: 3883342 - RNA, 19 nt, Human
ccaggcccucugcccacuc

SEQ ID NO: 3883343 - RNA, 23 nt, Human
ccaggcccucugcccacucccug

SEQ ID NO: 3883344 - RNA, 17 nt, Human
ccaggccggccagccuc

SEQ ID NO: 3883345 - RNA, 15 nt, Human
ccaggccguccuccc

SEQ ID NO: 3883346 - RNA, 19 nt, Human
ccaggccguccucccgggc

SEQ ID NO: 3883347 - RNA, 21 nt, Human
ccaggccucagucucccuucu

SEQ ID NO: 3883348 - RNA, 13 nt, Human
ccaggccuccagc

SEQ ID NO: 3883349 - RNA, 14 nt, Human
ccaggccuccagcu

SEQ ID NO: 3883350 - RNA, 15 nt, Human
ccaggccuccagcuc

SEQ ID NO: 3883351 - RNA, 17 nt, Human
ccaggccuccagcucag

SEQ ID NO: 3883352 - RNA, 23 nt, Human
ccaggccucucccuccuccagga

SEQ ID NO: 3883353 - RNA, 17 nt, Human
ccaggccucuguguccu

SEQ ID NO: 3883354 - RNA, 12 nt, Human
ccaggccugccu

SEQ ID NO: 3883355 - RNA, 13 nt, Human
ccaggccugggcc

SEQ ID NO: 3883356 - RNA, 17 nt, Human
ccaggccugggccagag

SEQ ID NO: 3883357 - RNA, 16 nt, Human
ccaggccugggucugu

SEQ ID NO: 3883358 - RNA, 18 nt, Human
ccaggccugggucugugu

SEQ ID NO: 3883359 - RNA, 22 nt, Human
ccaggcgggagcgguggcccug

SEQ ID NO: 3883360 - RNA, 23 nt, Human
ccaggcuaguccggacccaccuc

SEQ ID NO: 3883361 - RNA, 18 nt, Human
ccaggcucacucacagag

SEQ ID NO: 3883362 - RNA, 20 nt, Human
ccaggcucacucacagaguc

SEQ ID NO: 3883363 - RNA, 13 nt, Human
ccaggcuccgccc

SEQ ID NO: 3883364 - RNA, 23 nt, Human
ccaggcuccgcccuuaguccccc

SEQ ID NO: 3883365 - RNA, 16 nt, Human
ccaggcuccucccucc

SEQ ID NO: 3883366 - RNA, 14 nt, Human
ccaggcuccuuccu

SEQ ID NO: 3883367 - RNA, 22 nt, Human
ccaggcuccuuccugucuuccu

SEQ ID NO: 3883368 - RNA, 22 nt, Human
ccaggcucugugcugacccucc

SEQ ID NO: 3883369 - RNA, 23 nt, Human
ccaggcucugugcugacccuccu

SEQ ID NO: 3883370 - RNA, 23 nt, Human
ccaggcucuuuggggucagccag

SEQ ID NO: 3883371 - RNA, 20 nt, Human
ccaggcugaagcagguuccc

SEQ ID NO: 3883372 - RNA, 17 nt, Human
ccaggcugagccucagu

SEQ ID NO: 3883373 - RNA, 17 nt, Human
ccaggcugcauagaagg

SEQ ID NO: 3883374 - RNA, 20 nt, Human
ccaggcugccaaggccagag

SEQ ID NO: 3883375 - RNA, 18 nt, Human
ccaggcugccguggggcc

SEQ ID NO: 3883376 - RNA, 23 nt, Human
ccaggcugccucccuuguggcag

SEQ ID NO: 3883377 - RNA, 17 nt, Human
ccaggcugcucagggcu

SEQ ID NO: 3883378 - RNA, 19 nt, Human
ccaggcugcucagggcugg

SEQ ID NO: 3883379 - RNA, 23 nt, Human
ccaggcugcucucaaaccccuga

SEQ ID NO: 3883380 - RNA, 18 nt, Human
ccaggcuggacaugcuga

SEQ ID NO: 3883381 - RNA, 16 nt, Human
ccaggcuggccagccc

SEQ ID NO: 3883382 - RNA, 22 nt, Human
ccaggcuggccagccccacagc

SEQ ID NO: 3883383 - RNA, 23 nt, Human
ccaggcuggccagccccacagcc

SEQ ID NO: 3883384 - RNA, 16 nt, Human
ccaggcuggcgcagcc

SEQ ID NO: 3883385 - RNA, 17 nt, Human
ccaggcuggcgcagcca

SEQ ID NO: 3883386 - RNA, 19 nt, Human
ccaggcuggcgcagccaag

SEQ ID NO: 3883387 - RNA, 22 nt, Human
cccagauuggcucacacugaga

SEQ ID NO: 3883388 - RNA, 16 nt, Human
cccagauuucagucuu

SEQ ID NO: 3883389 - RNA, 17 nt, Human
cccagcaacccuccuau

SEQ ID NO: 3883390 - RNA, 16 nt, Human
cccagcaacuccaacu

SEQ ID NO: 3883391 - RNA, 18 nt, Human
cccagcaagugagagcug

SEQ ID NO: 3883392 - RNA, 19 nt, Human
cccagcacagcuugaccug

SEQ ID NO: 3883393 - RNA, 19 nt, Human
cccagcacaugugcugccc

SEQ ID NO: 3883394 - RNA, 18 nt, Human
cccagcaccaccaggucu

SEQ ID NO: 3883395 - RNA, 19 nt, Human
cccagcaccaccaggucuc

SEQ ID NO: 3883396 - RNA, 12 nt, Human
cccagcacccgg

SEQ ID NO: 3883397 - RNA, 19 nt, Human
cccagcacccgggcucagg

SEQ ID NO: 3883398 - RNA, 22 nt, Human
cccagcacccgggcucagggac

SEQ ID NO: 3883399 - RNA, 17 nt, Human
cccagcaccucagccug

SEQ ID NO: 3883400 - RNA, 18 nt, Human
cccagcaccucagccugc

SEQ ID NO: 3883401 - RNA, 14 nt, Human
cccagcaccugccu

SEQ ID NO: 3883402 - RNA, 17 nt, Human
cccagcaccugccuccu

SEQ ID NO: 3883403 - RNA, 16 nt, Human
cccagcacuuggagag

SEQ ID NO: 3883404 - RNA, 17 nt, Human
cccagcacuuugggagg

SEQ ID NO: 3883405 - RNA, 20 nt, Human
cccagcacuuugggaggccu

SEQ ID NO: 3883406 - RNA, 20 nt, Human
cccagcacuuugggaggcug

SEQ ID NO: 3883407 - RNA, 22 nt, Human
cccagcagggucuuuucaucug

SEQ ID NO: 3883408 - RNA, 12 nt, Human
cccagcaguucu

SEQ ID NO: 3883409 - RNA, 19 nt, Human
cccagcaucacuccccaag

SEQ ID NO: 3883410 - RNA, 20 nt, Human
cccagcauuccagccccucu

SEQ ID NO: 3883411 - RNA, 16 nt, Human
cccagcauucucaggc

SEQ ID NO: 3883412 - RNA, 17 nt, Human
cccagcauucucaggca

SEQ ID NO: 3883413 - RNA, 15 nt, Human
cccagcauugcuggu

SEQ ID NO: 3883414 - RNA, 12 nt, Human
cccagccacccc

SEQ ID NO: 3883415 - RNA, 16 nt, Human
cccagccacuccccag

SEQ ID NO: 3883416 - RNA, 22 nt, Human
cccagccagauggacuccagcc

SEQ ID NO: 3883417 - RNA, 16 nt, Human
cccagccagcaguuca

SEQ ID NO: 3883418 - RNA, 16 nt, Human
cccagccaggcccagc

SEQ ID NO: 3883419 - RNA, 13 nt, Human
cccagccaucugc

SEQ ID NO: 3883420 - RNA, 18 nt, Human
cccagccaugccagcugg

SEQ ID NO: 3883421 - RNA, 18 nt, Human
cccagccauuaccaugga

SEQ ID NO: 3883422 - RNA, 13 nt, Human
cccagcccaaguc

SEQ ID NO: 3883423 - RNA, 18 nt, Human
cccagcccacccuccugu

SEQ ID NO: 3883424 - RNA, 14 nt, Human
cccagcccacuucu

SEQ ID NO: 3883425 - RNA, 11 nt, Human
cccagcccaga

SEQ ID NO: 3883426 - RNA, 13 nt, Human
cccagcccagaga

SEQ ID NO: 3883427 - RNA, 15 nt, Human
cccagcccagagaca

SEQ ID NO: 3883428 - RNA, 16 nt, Human
cccagcccagcugcuc

SEQ ID NO: 3883429 - RNA, 22 nt, Human
cccagcccagcugcucugccca

SEQ ID NO: 3883430 - RNA, 17 nt, Human
cccagccccaaugaaca

SEQ ID NO: 3883431 - RNA, 16 nt, Human
cccagccccacuuacc

SEQ ID NO: 3883432 - RNA, 13 nt, Human
cccagccccaucc

SEQ ID NO: 3883433 - RNA, 14 nt, Human
cccagccccauccu

SEQ ID NO: 3883434 - RNA, 15 nt, Human
cccagccccauccuc

SEQ ID NO: 3883435 - RNA, 16 nt, Human
cccagccccgacucca

SEQ ID NO: 3883436 - RNA, 20 nt, Human
cccagccccgacuccagcca

SEQ ID NO: 3883437 - RNA, 22 nt, Human
cccagccccgacuccagccagc

SEQ ID NO: 3883438 - RNA, 19 nt, Human
cccagccccuacugcugug

SEQ ID NO: 3883439 - RNA, 16 nt, Human
cccagccccuagaaac

SEQ ID NO: 3883440 - RNA, 21 nt, Human
cccagccccuagaaacccaag

SEQ ID NO: 3883441 - RNA, 13 nt, Human
cccagccccuagc

SEQ ID NO: 3883442 - RNA, 16 nt, Human
cccagccccuccccca

SEQ ID NO: 3883443 - RNA, 20 nt, Human
cccagccccugccccucaug

SEQ ID NO: 3883444 - RNA, 12 nt, Human
cccagcccugcu

SEQ ID NO: 3883445 - RNA, 15 nt, Human
cccagcccugcuggc

SEQ ID NO: 3883446 - RNA, 16 nt, Human
cccagcccugcuggcc

SEQ ID NO: 3883447 - RNA, 19 nt, Human
cccagcccugcuggccgcc

SEQ ID NO: 3883448 - RNA, 17 nt, Human
cccagcccugcugggga

SEQ ID NO: 3883449 - RNA, 15 nt, Human
cccagcccuggcucu

SEQ ID NO: 3883450 - RNA, 19 nt, Human
cccagcccuggucucagca

SEQ ID NO: 3883451 - RNA, 18 nt, Human
cccagccggccaauggaa

SEQ ID NO: 3883452 - RNA, 14 nt, Human
cccagccggccucu

SEQ ID NO: 3883453 - RNA, 19 nt, Human
cccagccggccucucuggc

SEQ ID NO: 3883454 - RNA, 23 nt, Human
cccagccggccucucuggccucc

SEQ ID NO: 3883455 - RNA, 12 nt, Human
cccagccuauga

SEQ ID NO: 3883456 - RNA, 23 nt, Human
cccagccuaugagcauccugagc

SEQ ID NO: 3883457 - RNA, 23 nt, Human
cccagccucaaauccaggacccu

SEQ ID NO: 3883458 - RNA, 11 nt, Human
cccagccucag

SEQ ID NO: 3883459 - RNA, 14 nt, Human
cccagccucagcgc

SEQ ID NO: 3883460 - RNA, 15 nt, Human
cccagccucagcgcg

SEQ ID NO: 3883461 - RNA, 22 nt, Human
cccagccucagcgcggcccucc

SEQ ID NO: 3883462 - RNA, 18 nt, Human
cccagccuccaagcucca

SEQ ID NO: 3883463 - RNA, 17 nt, Human
cccagccucccugaagc

SEQ ID NO: 3883464 - RNA, 12 nt, Human
cccagccucucu

SEQ ID NO: 3883465 - RNA, 15 nt, Human
cccagccucuggcau

SEQ ID NO: 3883466 - RNA, 21 nt, Human
cccagccucuucuagagccgu

SEQ ID NO: 3883467 - RNA, 21 nt, Human
cccagccugcuagcuagcuca

SEQ ID NO: 3883468 - RNA, 10 nt, Human
cccagccugg

SEQ ID NO: 3883469 - RNA, 14 nt, Human
cccagccuggaugc

SEQ ID NO: 3883470 - RNA, 12 nt, Human
cccagccuggcc

SEQ ID NO: 3883471 - RNA, 23 nt, Human
cccagccuggccacgcagccagg

SEQ ID NO: 3883472 - RNA, 14 nt, Human
cccagccuggccca

SEQ ID NO: 3883473 - RNA, 16 nt, Human
cccagccuggcccagc

SEQ ID NO: 3883474 - RNA, 17 nt, Human
cccagccuggcccagcu

SEQ ID NO: 3883475 - RNA, 22 nt, Human
cccagccuggcccagcuccccc

SEQ ID NO: 3883476 - RNA, 12 nt, Human
cccagccugggc

SEQ ID NO: 3883477 - RNA, 12 nt, Human
cccagccuguca

SEQ ID NO: 3883478 - RNA, 14 nt, Human
cccagccugucaga

SEQ ID NO: 3883479 - RNA, 19 nt, Human
cccagccugucagauccag

SEQ ID NO: 3883480 - RNA, 21 nt, Human
cccagccuuggcaucuagagc

SEQ ID NO: 3883481 - RNA, 19 nt, Human
cccagcgagcccugguggc

SEQ ID NO: 3883482 - RNA, 15 nt, Human
cccagcgcucugccu

SEQ ID NO: 3883483 - RNA, 18 nt, Human
cccagcggacaguggcag

SEQ ID NO: 3883484 - RNA, 15 nt, Human
cccagcggccccucc

SEQ ID NO: 3883485 - RNA, 20 nt, Human
cccagcggccccucccacac

SEQ ID NO: 3883486 - RNA, 15 nt, Human
cccagcggcuggugc

SEQ ID NO: 3883487 - RNA, 22 nt, Human
cccagcgggcagguucugccug

SEQ ID NO: 3883488 - RNA, 15 nt, Human
cccagcuaaauaauc

SEQ ID NO: 3883489 - RNA, 19 nt, Human
cccagcuaagaaccuggaa

SEQ ID NO: 3883490 - RNA, 22 nt, Human
cccagcuaagaaccuggaacuu

SEQ ID NO: 3883491 - RNA, 19 nt, Human
cccagcuaaucuguagggc

SEQ ID NO: 3883492 - RNA, 23 nt, Human
cccagcuaaucuguagggcugga

SEQ ID NO: 3883493 - RNA, 23 nt, Human
cccagcuacucagaagccugagg

SEQ ID NO: 3883494 - RNA, 13 nt, Human
cccagcuaggaag

SEQ ID NO: 3883495 - RNA, 12 nt, Human
cccagcucaggg

SEQ ID NO: 3883496 - RNA, 12 nt, Human
cccagcucccac

SEQ ID NO: 3883497 - RNA, 15 nt, Human
cccagcuccccaaga

SEQ ID NO: 3883498 - RNA, 16 nt, Human
cccagcucccccggga

SEQ ID NO: 3883499 - RNA, 19 nt, Human
cccagcucccccgggaggg

SEQ ID NO: 3883500 - RNA, 15 nt, Human
cccagcucccuagga

SEQ ID NO: 3883501 - RNA, 11 nt, Human
cccagcuccug

SEQ ID NO: 3883502 - RNA, 13 nt, Human
cccagcucucccu

SEQ ID NO: 3883503 - RNA, 18 nt, Human
cccagcucucccucuggc

SEQ ID NO: 3883504 - RNA, 14 nt, Human
cccagcucugaaac

SEQ ID NO: 3883505 - RNA, 22 nt, Human
cccagcucugaaaccaguguua

SEQ ID NO: 3883506 - RNA, 20 nt, Human
cccagcucugcuugccgaaa

SEQ ID NO: 3883507 - RNA, 13 nt, Human
cccagcucuggug

SEQ ID NO: 3883508 - RNA, 22 nt, Human
cccagcucuggugagucuuggc

SEQ ID NO: 3883509 - RNA, 15 nt, Human
cccagcugacaugga

SEQ ID NO: 3883510 - RNA, 23 nt, Human
cccagcugcaccugccagccugg

SEQ ID NO: 3883511 - RNA, 14 nt, Human
cccagcugccccuc

SEQ ID NO: 3883512 - RNA, 17 nt, Human
cccagcugccccucccu

SEQ ID NO: 3883513 - RNA, 14 nt, Human
cccagcugcucugc

SEQ ID NO: 3883514 - RNA, 15 nt, Human
cccagcugcucugcc

SEQ ID NO: 3883515 - RNA, 17 nt, Human
cccagcugcucugccca

SEQ ID NO: 3883516 - RNA, 14 nt, Human
cccagcugggcucu

SEQ ID NO: 3883517 - RNA, 17 nt, Human
cccagcugggcucugcc

SEQ ID NO: 3883518 - RNA, 22 nt, Human
cccagcugggcucugccacccu

SEQ ID NO: 3883519 - RNA, 24 nt, Human
cccagcugggcucugccacccuac

SEQ ID NO: 3883520 - RNA, 20 nt, Human
cccagcuggggccaggcugg

SEQ ID NO: 3883521 - RNA, 17 nt, Human
cccagcugggucaggca

SEQ ID NO: 3883522 - RNA, 19 nt, Human
cccagcugggucaggcagg

SEQ ID NO: 3883523 - RNA, 16 nt, Human
cccagcuggugggaag

SEQ ID NO: 3883524 - RNA, 23 nt, Human
cccagcugucugugucagccugu

SEQ ID NO: 3883525 - RNA, 18 nt, Human
cccagcugugagccuugg

SEQ ID NO: 3883526 - RNA, 11 nt, Human
cccagcuguuu

SEQ ID NO: 3883527 - RNA, 17 nt, Human
cccagcuuccagcagga

SEQ ID NO: 3883528 - RNA, 15 nt, Human
cccagcuugaaaccu

SEQ ID NO: 3883529 - RNA, 14 nt, Human
cccagcuugggcag

SEQ ID NO: 3883530 - RNA, 19 nt, Human
cccagcuugggcccagcug

SEQ ID NO: 3883531 - RNA, 21 nt, Human
cccaggaaaggcuccaggagc

SEQ ID NO: 3883532 - RNA, 22 nt, Human
cccaggaaaggcuccaggagca

SEQ ID NO: 3883533 - RNA, 15 nt, Human
cccagguggcugugg

SEQ ID NO: 3883534 - RNA, 22 nt, Human
cccagguguuaacauuccaaga

SEQ ID NO: 3883535 - RNA, 21 nt, Human
cccagguuggcucugccaguc

SEQ ID NO: 3883536 - RNA, 19 nt, Human
cccagguuucuggucucua

SEQ ID NO: 3883537 - RNA, 22 nt, Human
cccagguuucuggucucuaggc

SEQ ID NO: 3883538 - RNA, 14 nt, Human
cccaguaagccacu

SEQ ID NO: 3883539 - RNA, 16 nt, Human
cccaguagaccuuguu

SEQ ID NO: 3883540 - RNA, 16 nt, Human
cccagucagccucucu

SEQ ID NO: 3883541 - RNA, 18 nt, Human
cccagucagccucucucc

SEQ ID NO: 3883542 - RNA, 22 nt, Human
cccagucagccucucucccagu

SEQ ID NO: 3883543 - RNA, 23 nt, Human
cccaguccaaauguccuccagaa

SEQ ID NO: 3883544 - RNA, 13 nt, Human
cccaguccccacc

SEQ ID NO: 3883545 - RNA, 14 nt, Human
cccaguccccaccc

SEQ ID NO: 3883546 - RNA, 18 nt, Human
cccaguccccaccccugc

SEQ ID NO: 3883547 - RNA, 19 nt, Human
cccaguccccaccccugcc

SEQ ID NO: 3883548 - RNA, 13 nt, Human
cccaguccccgug

SEQ ID NO: 3883549 - RNA, 16 nt, Human
cccagucccgccccuc

SEQ ID NO: 3883550 - RNA, 16 nt, Human
cccaguccuggccugg

SEQ ID NO: 3883551 - RNA, 21 nt, Human
cccaguccuggccuggcuucu

SEQ ID NO: 3883552 - RNA, 23 nt, Human
cccaguccuggccuggcuucucc

SEQ ID NO: 3883553 - RNA, 21 nt, Human
cccagucucucuuaaaguugg

SEQ ID NO: 3883554 - RNA, 15 nt, Human
cccagucucuggcag

SEQ ID NO: 3883555 - RNA, 19 nt, Human
cccagucuggaaugcagug

SEQ ID NO: 3883556 - RNA, 20 nt, Human
cccagucuggaaugcagugg

SEQ ID NO: 3883557 - RNA, 11 nt, Human
cccagucuguc

SEQ ID NO: 3883558 - RNA, 17 nt, Human
cccagucuguuccccau

SEQ ID NO: 3883559 - RNA, 13 nt, Human
cccagugacacuu

SEQ ID NO: 3883560 - RNA, 18 nt, Human
cccagugacacuucagag

SEQ ID NO: 3883561 - RNA, 14 nt, Human
cccagugacagcua

SEQ ID NO: 3883562 - RNA, 15 nt, Human
cccagugacagcuag

SEQ ID NO: 3883563 - RNA, 21 nt, Human
cccagugagcacucccaaguc

SEQ ID NO: 3883564 - RNA, 21 nt, Human
cccagugagcagccuggagcc

SEQ ID NO: 3883565 - RNA, 14 nt, Human
cccagugcacccac

SEQ ID NO: 3883566 - RNA, 10 nt, Human
cccagugcag

SEQ ID NO: 3883567 - RNA, 11 nt, Human
cccagugcaga

SEQ ID NO: 3883568 - RNA, 22 nt, Human
cccagugcaugguggccagagg

SEQ ID NO: 3883569 - RNA, 21 nt, Human
cccagugcccacaggaucagu

SEQ ID NO: 3883570 - RNA, 14 nt, Human
cccagugcccucuc

SEQ ID NO: 3883571 - RNA, 18 nt, Human
cccagugcccucuccccu

SEQ ID NO: 3883572 - RNA, 15 nt, Human
cccagugcccugggg

SEQ ID NO: 3883573 - RNA, 15 nt, Human
cccagugccgagaag

SEQ ID NO: 3883574 - RNA, 20 nt, Human
cccaguggcagggcacaggg

SEQ ID NO: 3883575 - RNA, 23 nt, Human
cccaguggcagggcacagggccu

SEQ ID NO: 3883576 - RNA, 18 nt, Human
cccaguggcugcugccca

SEQ ID NO: 3883577 - RNA, 21 nt, Human
cccaguggcugcugcccaggc

SEQ ID NO: 3883578 - RNA, 17 nt, Human
cccagugggaggggcag

SEQ ID NO: 3883579 - RNA, 18 nt, Human
cccagugggaggggcagg

SEQ ID NO: 3883580 - RNA, 22 nt, Human
cccagugggaggggcaggcuga

SEQ ID NO: 3883581 - RNA, 21 nt, Human
cccagugucaaguugugcuug

SEQ ID NO: 3883582 - RNA, 22 nt, Human
cccagugucaaguugugcuugu

SEQ ID NO: 3883583 - RNA, 15 nt, Human
cccagugucuuccug

SEQ ID NO: 3883584 - RNA, 17 nt, Human
cccagugucuuccugug

SEQ ID NO: 3883585 - RNA, 18 nt, Human
cccaguguuguuuguaaa

SEQ ID NO: 3883586 - RNA, 14 nt, Human
cccaguuagcucuc

SEQ ID NO: 3883587 - RNA, 19 nt, Human
cccaguucaggagucccaa

SEQ ID NO: 3883588 - RNA, 22 nt, Human
cccaguucaggagucccaagga

SEQ ID NO: 3883589 - RNA, 21 nt, Human
cccaguuccuguggcucccuc

SEQ ID NO: 3883590 - RNA, 19 nt, Human
cccaguucgccuggagccc

SEQ ID NO: 3883591 - RNA, 13 nt, Human
cccaguucugcuc

SEQ ID NO: 3883592 - RNA, 14 nt, Human
cccaguucugcucc

SEQ ID NO: 3883593 - RNA, 16 nt, Human
cccaguucugcuccuc

SEQ ID NO: 3883594 - RNA, 19 nt, Human
cccaguugcacucagguga

SEQ ID NO: 3883595 - RNA, 17 nt, Human
cccaguuggagcuccag

SEQ ID NO: 3883596 - RNA, 14 nt, Human
cccaguugggugga

SEQ ID NO: 3883597 - RNA, 13 nt, Human
cccaguuguauuu

SEQ ID NO: 3883598 - RNA, 19 nt, Human
cccaguuucuaaacuggag

SEQ ID NO: 3883599 - RNA, 21 nt, Human
cccaguuucuaaacuggagac

SEQ ID NO: 3883600 - RNA, 23 nt, Human
cccaguuucuaaacuggagacug

SEQ ID NO: 3883601 - RNA, 15 nt, Human
cccaguuugcagaaa

SEQ ID NO: 3883602 - RNA, 16 nt, Human
cccaguuugcagaaaa

SEQ ID NO: 3883603 - RNA, 23 nt, Human
cccauaaggggucaaaauuugcu

SEQ ID NO: 3883604 - RNA, 15 nt, Human
cccauagaaacauga

SEQ ID NO: 3883605 - RNA, 22 nt, Human
cccauagaucuucugaaaugaa

SEQ ID NO: 3883606 - RNA, 19 nt, Human
cccauagugaccggcugcu

SEQ ID NO: 3883607 - RNA, 11 nt, Human
cccauaucaug

SEQ ID NO: 3883608 - RNA, 15 nt, Human
cccauaugccugggc

SEQ ID NO: 3883609 - RNA, 19 nt, Human
cccauauuguaaaacaggu

SEQ ID NO: 3883610 - RNA, 16 nt, Human
cccauauuucaucgug

SEQ ID NO: 3883611 - RNA, 22 nt, Human
cccaucacaggguugggcccag

SEQ ID NO: 3883612 - RNA, 21 nt, Human
cccaucacugcgccacugcuc

SEQ ID NO: 3883613 - RNA, 15 nt, Human
cccaucacuggagca

SEQ ID NO: 3883614 - RNA, 14 nt, Human
cccaucaggguagg

SEQ ID NO: 3883615 - RNA, 22 nt, Human
cccaucauuacccuucccugca

SEQ ID NO: 3883616 - RNA, 15 nt, Human
cccaucauucaugcu

SEQ ID NO: 3883617 - RNA, 14 nt, Human
cccauccaggcagu

SEQ ID NO: 3883618 - RNA, 13 nt, Human
cccauccagggcc

SEQ ID NO: 3883619 - RNA, 21 nt, Human
cccauccaguucaugagaauc

SEQ ID NO: 3883620 - RNA, 13 nt, Human
cccaucccacacc

SEQ ID NO: 3883621 - RNA, 15 nt, Human
cccaucccaucccau

SEQ ID NO: 3883622 - RNA, 16 nt, Human
cccaucccaucccauc

SEQ ID NO: 3883623 - RNA, 14 nt, Human
cccaucccaugcug

SEQ ID NO: 3883624 - RNA, 13 nt, Human
cccauccccagcg

SEQ ID NO: 3883625 - RNA, 18 nt, Human
cccauccccagcgauucc

SEQ ID NO: 3883626 - RNA, 17 nt, Human
cccaucccccugcccuc

SEQ ID NO: 3883627 - RNA, 16 nt, Human
cccaucccuccccagu

SEQ ID NO: 3883628 - RNA, 12 nt, Human
cccaucccugcc

SEQ ID NO: 3883629 - RNA, 13 nt, Human
cccaucccugccu

SEQ ID NO: 3883630 - RNA, 17 nt, Human
cccauccuaccaaugca

SEQ ID NO: 3883631 - RNA, 17 nt, Human
cccauccuacccucggg

SEQ ID NO: 3883632 - RNA, 14 nt, Human
cccauccuagaggc

SEQ ID NO: 3883633 - RNA, 18 nt, Human
cccauccuccagcaggga

SEQ ID NO: 3883634 - RNA, 16 nt, Human
cccauccuccagcuuc

SEQ ID NO: 3883635 - RNA, 12 nt, Human
cccauccucccc

SEQ ID NO: 3883636 - RNA, 13 nt, Human
cccauccuccccu

SEQ ID NO: 3883637 - RNA, 14 nt, Human
cccauccuccccuu

SEQ ID NO: 3883638 - RNA, 15 nt, Human
cccauccuccccuuc

SEQ ID NO: 3883639 - RNA, 16 nt, Human
cccauccuccccuucc

SEQ ID NO: 3883640 - RNA, 18 nt, Human
cccauccuccccuucccu

SEQ ID NO: 3883641 - RNA, 18 nt, Human
cccauccuguggucacug

SEQ ID NO: 3883642 - RNA, 19 nt, Human
cccaucgguguccauuuau

SEQ ID NO: 3883643 - RNA, 20 nt, Human
cccaucgguguccauuuaua

SEQ ID NO: 3883644 - RNA, 22 nt, Human
cccaucguugcccccauuucug

SEQ ID NO: 3883645 - RNA, 13 nt, Human
cccaucucacaca

SEQ ID NO: 3883646 - RNA, 13 nt, Human
cccaucucaggac

SEQ ID NO: 3883647 - RNA, 16 nt, Human
cccaucucaggccaga

SEQ ID NO: 3883648 - RNA, 20 nt, Human
cccaucucaugccccuggcu

SEQ ID NO: 3883649 - RNA, 22 nt, Human
cccaucucaugccccuggcugg

SEQ ID NO: 3883650 - RNA, 16 nt, Human
cccaucuccccucagc

SEQ ID NO: 3883651 - RNA, 14 nt, Human
cccaucucccugcu

SEQ ID NO: 3883652 - RNA, 19 nt, Human
cccaucucuacaaaaagca

SEQ ID NO: 3883653 - RNA, 21 nt, Human
cccaucucucccuccccugcc

SEQ ID NO: 3883654 - RNA, 19 nt, Human
cccaucugcaccccuucuc

SEQ ID NO: 3883655 - RNA, 16 nt, Human
cccaucugccagauca

SEQ ID NO: 3883656 - RNA, 12 nt, Human
cccaucugccca

SEQ ID NO: 3883657 - RNA, 14 nt, Human
cccaucugcccagg

SEQ ID NO: 3883658 - RNA, 18 nt, Human
cccaucugccccacaguc

SEQ ID NO: 3883659 - RNA, 17 nt, Human
cccaucugucugccaac

SEQ ID NO: 3883660 - RNA, 13 nt, Human
cccaucugugaau

SEQ ID NO: 3883661 - RNA, 16 nt, Human
cccaucugugaauaag

SEQ ID NO: 3883662 - RNA, 15 nt, Human
cccaucuucgggacc

SEQ ID NO: 3883663 - RNA, 18 nt, Human
cccaucuucgggaccagg

SEQ ID NO: 3883664 - RNA, 24 nt, Human
cccaucuugccuccauggugccuc

SEQ ID NO: 3883665 - RNA, 12 nt, Human
cccaucuuguuu

SEQ ID NO: 3883666 - RNA, 12 nt, Human
cccaugaagcca

SEQ ID NO: 3883667 - RNA, 19 nt, Human
cccaugacccaccccugug

SEQ ID NO: 3883668 - RNA, 20 nt, Human
cccaugacccaccccugugc

SEQ ID NO: 3883669 - RNA, 21 nt, Human
cccaugacccaccccugugcu

SEQ ID NO: 3883670 - RNA, 22 nt, Human
cccaugacccaccccugugcuc

SEQ ID NO: 3883671 - RNA, 15 nt, Human
cccaugaccuccagc

SEQ ID NO: 3883672 - RNA, 20 nt, Human
cccaugaccuuauccuuccu

SEQ ID NO: 3883673 - RNA, 22 nt, Human
cccaugaccuuauccuuccucu

SEQ ID NO: 3883674 - RNA, 15 nt, Human
cccaugagccucagc

SEQ ID NO: 3883675 - RNA, 22 nt, Human
cccaugagccucagcauccugg

SEQ ID NO: 3883676 - RNA, 13 nt, Human
cccaugagcuccu

SEQ ID NO: 3883677 - RNA, 23 nt, Human
cccaugaguuggggucuggcagc

SEQ ID NO: 3883678 - RNA, 23 nt, Human
ccccaccccuggaagagcccagu

SEQ ID NO: 3883679 - RNA, 15 nt, Human
ccccaccccuugcuc

SEQ ID NO: 3883680 - RNA, 18 nt, Human
ccccaccccuugcucuca

SEQ ID NO: 3883681 - RNA, 16 nt, Human
ccccacccucccugga

SEQ ID NO: 3883682 - RNA, 21 nt, Human
ccccacccuccuggccucaga

SEQ ID NO: 3883683 - RNA, 15 nt, Human
ccccacccucgggga

SEQ ID NO: 3883684 - RNA, 23 nt, Human
ccccacccucggggauguguccu

SEQ ID NO: 3883685 - RNA, 23 nt, Human
ccccacccucguggacaccugcc

SEQ ID NO: 3883686 - RNA, 16 nt, Human
ccccacccugccucac

SEQ ID NO: 3883687 - RNA, 14 nt, Human
ccccacccugggcc

SEQ ID NO: 3883688 - RNA, 15 nt, Human
ccccacccugggccc

SEQ ID NO: 3883689 - RNA, 15 nt, Human
ccccacccugggcuc

SEQ ID NO: 3883690 - RNA, 17 nt, Human
ccccacccuguuccugc

SEQ ID NO: 3883691 - RNA, 18 nt, Human
ccccacccuguuccugcu

SEQ ID NO: 3883692 - RNA, 20 nt, Human
ccccacccuguuccugcugc

SEQ ID NO: 3883693 - RNA, 14 nt, Human
ccccacccuuuggg

SEQ ID NO: 3883694 - RNA, 13 nt, Human
ccccaccugcagg

SEQ ID NO: 3883695 - RNA, 14 nt, Human
ccccaccuggcccu

SEQ ID NO: 3883696 - RNA, 15 nt, Human
ccccacgccacagcc

SEQ ID NO: 3883697 - RNA, 19 nt, Human
ccccacgugacagugccug

SEQ ID NO: 3883698 - RNA, 14 nt, Human
ccccacuacugcag

SEQ ID NO: 3883699 - RNA, 23 nt, Human
ccccacuacugcagcaccuccag

SEQ ID NO: 3883700 - RNA, 13 nt, Human
ccccacucacaga

SEQ ID NO: 3883701 - RNA, 13 nt, Human
ccccacucccagc

SEQ ID NO: 3883702 - RNA, 15 nt, Human
ccccacucccagcau

SEQ ID NO: 3883703 - RNA, 14 nt, Human
ccccacuccccacc

SEQ ID NO: 3883704 - RNA, 16 nt, Human
ccccacuccucugcug

SEQ ID NO: 3883705 - RNA, 11 nt, Human
ccccacucuca

SEQ ID NO: 3883706 - RNA, 12 nt, Human
ccccacucucag

SEQ ID NO: 3883707 - RNA, 14 nt, Human
ccccacucucagag

SEQ ID NO: 3883708 - RNA, 20 nt, Human
ccccacucucagaggcccca

SEQ ID NO: 3883709 - RNA, 15 nt, Human
ccccacucugcucug

SEQ ID NO: 3883710 - RNA, 15 nt, Human
ccccacugacagccu

SEQ ID NO: 3883711 - RNA, 14 nt, Human
ccccacugaccaga

SEQ ID NO: 3883712 - RNA, 11 nt, Human
ccccacugaug

SEQ ID NO: 3883713 - RNA, 13 nt, Human
ccccacugaugcu

SEQ ID NO: 3883714 - RNA, 14 nt, Human
ccccacugaugcug

SEQ ID NO: 3883715 - RNA, 16 nt, Human
ccccacugcaggcccc

SEQ ID NO: 3883716 - RNA, 15 nt, Human
ccccacugccagcag

SEQ ID NO: 3883717 - RNA, 16 nt, Human
ccccacugccagcagc

SEQ ID NO: 3883718 - RNA, 15 nt, Human
ccccacugccugccc

SEQ ID NO: 3883719 - RNA, 12 nt, Human
ccccacuggagc

SEQ ID NO: 3883720 - RNA, 14 nt, Human
ccccacuggcugug

SEQ ID NO: 3883721 - RNA, 21 nt, Human
ccccacuggcugugggcuccc

SEQ ID NO: 3883722 - RNA, 14 nt, Human
ccccacuugccucu

SEQ ID NO: 3883723 - RNA, 15 nt, Human
ccccagaacucugcc

SEQ ID NO: 3883724 - RNA, 18 nt, Human
ccccagacuagauguagu

SEQ ID NO: 3883725 - RNA, 10 nt, Human
ccccagagac

SEQ ID NO: 3883726 - RNA, 17 nt, Human
ccccagagccacacaug

SEQ ID NO: 3883727 - RNA, 16 nt, Human
ccccagagcccaggcu

SEQ ID NO: 3883728 - RNA, 16 nt, Human
ccccagagcccccggg

SEQ ID NO: 3883729 - RNA, 21 nt, Human
ccccagagccccuccuccagc

SEQ ID NO: 3883730 - RNA, 22 nt, Human
ccccagagugugggaagggaga

SEQ ID NO: 3883731 - RNA, 15 nt, Human
ccccagauugcaaca

SEQ ID NO: 3883732 - RNA, 22 nt, Human
ccccagcaaagcccccagagcc

SEQ ID NO: 3883733 - RNA, 19 nt, Human
ccccagcaagugagagcug

SEQ ID NO: 3883734 - RNA, 21 nt, Human
ccccagcaagugagagcuggg

SEQ ID NO: 3883735 - RNA, 13 nt, Human
ccccagcacccgg

SEQ ID NO: 3883736 - RNA, 18 nt, Human
ccccagcaccucagccug

SEQ ID NO: 3883737 - RNA, 19 nt, Human
ccccagcacuaaagcagug

SEQ ID NO: 3883738 - RNA, 13 nt, Human
ccccagcacugag

SEQ ID NO: 3883739 - RNA, 16 nt, Human
ccccagcagccugggg

SEQ ID NO: 3883740 - RNA, 12 nt, Human
ccccagcaggug

SEQ ID NO: 3883741 - RNA, 12 nt, Human
ccccagcaucac

SEQ ID NO: 3883742 - RNA, 18 nt, Human
ccccagcauucucaggca

SEQ ID NO: 3883743 - RNA, 19 nt, Human
ccccagcauucucaggcac

SEQ ID NO: 3883744 - RNA, 9 nt, Human
ccccagcca

SEQ ID NO: 3883745 - RNA, 11 nt, Human
ccccagccaga

SEQ ID NO: 3883746 - RNA, 22 nt, Human
ccccagccaugccagcuggccu

SEQ ID NO: 3883747 - RNA, 16 nt, Human
ccccagcccaagucca

SEQ ID NO: 3883748 - RNA, 13 nt, Human
ccccagcccagag

SEQ ID NO: 3883749 - RNA, 12 nt, Human
ccccagcccagg

SEQ ID NO: 3883750 - RNA, 15 nt, Human
ccccagcccagggug

SEQ ID NO: 3883751 - RNA, 14 nt, Human
ccccagccccacuu

SEQ ID NO: 3883752 - RNA, 16 nt, Human
ccccagccccauccca

SEQ ID NO: 3883753 - RNA, 22 nt, Human
ccccagcccccaaagcagcccu

SEQ ID NO: 3883754 - RNA, 17 nt, Human
ccccagcccccuuuggg

SEQ ID NO: 3883755 - RNA, 23 nt, Human
ccccagcccccuuugggcccagg

SEQ ID NO: 3883756 - RNA, 19 nt, Human
ccccagccccgacuccagc

SEQ ID NO: 3883757 - RNA, 22 nt, Human
ccccagccccucccccaucucc

SEQ ID NO: 3883758 - RNA, 20 nt, Human
ccccagcccuaaucucaccc

SEQ ID NO: 3883759 - RNA, 19 nt, Human
ccccagcccuccuuaucaa

SEQ ID NO: 3883760 - RNA, 17 nt, Human
ccccagcccugcugggg

SEQ ID NO: 3883761 - RNA, 20 nt, Human
ccccagcccugcuggggauc

SEQ ID NO: 3883762 - RNA, 16 nt, Human
ccccagcccuggcucu

SEQ ID NO: 3883763 - RNA, 13 nt, Human
ccccagcccugug

SEQ ID NO: 3883764 - RNA, 20 nt, Human
ccccagcccuuccucugcuc

SEQ ID NO: 3883765 - RNA, 16 nt, Human
ccccagccgcucggag

SEQ ID NO: 3883766 - RNA, 21 nt, Human
ccccagccgcuuggcgaugcc

SEQ ID NO: 3883767 - RNA, 21 nt, Human
ccccagccuaagaugaagagg

SEQ ID NO: 3883768 - RNA, 14 nt, Human
ccccagccuaugag

SEQ ID NO: 3883769 - RNA, 13 nt, Human
ccccagccucccu

SEQ ID NO: 3883770 - RNA, 13 nt, Human
ccccagccucucu

SEQ ID NO: 3883771 - RNA, 14 nt, Human
ccccagccucuggc

SEQ ID NO: 3883772 - RNA, 16 nt, Human
ccccagccucuggcau

SEQ ID NO: 3883773 - RNA, 18 nt, Human
ccccagccugcgccugcu

SEQ ID NO: 3883774 - RNA, 20 nt, Human
ccccagccugcuagcuagcu

SEQ ID NO: 3883775 - RNA, 13 nt, Human
ccccagccuggcc

SEQ ID NO: 3883776 - RNA, 16 nt, Human
ccccagccuggccacg

SEQ ID NO: 3883777 - RNA, 22 nt, Human
ccccagccuggccacgcagcca

SEQ ID NO: 3883778 - RNA, 12 nt, Human
ccccagccuggg

SEQ ID NO: 3883779 - RNA, 13 nt, Human
ccccagccugggc

SEQ ID NO: 3883780 - RNA, 20 nt, Human
ccccagccugggccuaugga

SEQ ID NO: 3883781 - RNA, 11 nt, Human
ccccagccugu

SEQ ID NO: 3883782 - RNA, 19 nt, Human
ccccagcgagagucccugc

SEQ ID NO: 3883783 - RNA, 17 nt, Human
ccccagcuaagaaccug

SEQ ID NO: 3883784 - RNA, 11 nt, Human
ccccagcuacc

SEQ ID NO: 3883785 - RNA, 13 nt, Human
ccccagcucaggg

SEQ ID NO: 3883786 - RNA, 17 nt, Human
ccccagcucaggggcag

SEQ ID NO: 3883787 - RNA, 21 nt, Human
ccccagcucaggggcagcuca

SEQ ID NO: 3883788 - RNA, 13 nt, Human
ccccagcucccac

SEQ ID NO: 3883789 - RNA, 11 nt, Human
ccccagcuccg

SEQ ID NO: 3883790 - RNA, 12 nt, Human
ccccagcucugg

SEQ ID NO: 3883791 - RNA, 16 nt, Human
ccccagcugacaugga

SEQ ID NO: 3883792 - RNA, 13 nt, Human
ccccagcugcuug

SEQ ID NO: 3883793 - RNA, 10 nt, Human
ccccagcugg

SEQ ID NO: 3883794 - RNA, 11 nt, Human
ccccagcuggc

SEQ ID NO: 3883795 - RNA, 12 nt, Human
ccccagcuggga

SEQ ID NO: 3883796 - RNA, 21 nt, Human
ccccagcuggggccaggcugg

SEQ ID NO: 3883797 - RNA, 22 nt, Human
ccccagcuggggccaggcuggg

SEQ ID NO: 3883798 - RNA, 18 nt, Human
ccccagcuucacuucuga

SEQ ID NO: 3883799 - RNA, 17 nt, Human
ccccagcuuccagcagg

SEQ ID NO: 3883800 - RNA, 18 nt, Human
ccccagcuuccagcagga

SEQ ID NO: 3883801 - RNA, 21 nt, Human
ccccagcuuccagcaggaggg

SEQ ID NO: 3883802 - RNA, 15 nt, Human
ccccagcuugggcag

SEQ ID NO: 3883803 - RNA, 11 nt, Human
ccccaggacca

SEQ ID NO: 3883804 - RNA, 15 nt, Human
ccccaggaccagcuc

SEQ ID NO: 3883805 - RNA, 19 nt, Human
ccccaggaccagcucagga

SEQ ID NO: 3883806 - RNA, 21 nt, Human
ccccaggaccuggcugccaua

SEQ ID NO: 3883807 - RNA, 13 nt, Human
ccccaggacuggg

SEQ ID NO: 3883808 - RNA, 21 nt, Human
ccccaggaggccagccuugac

SEQ ID NO: 3883809 - RNA, 11 nt, Human
ccccaggcagg

SEQ ID NO: 3883810 - RNA, 16 nt, Human
ccccaggcccacucag

SEQ ID NO: 3883811 - RNA, 17 nt, Human
ccccaggccucuguguc

SEQ ID NO: 3883812 - RNA, 13 nt, Human
ccccaggcugaag

SEQ ID NO: 3883813 - RNA, 19 nt, Human
ccccaggcuggacaugcug

SEQ ID NO: 3883814 - RNA, 22 nt, Human
ccccaggcuggacaugcugacu

SEQ ID NO: 3883815 - RNA, 22 nt, Human
ccccagggaagcagcagccucg

SEQ ID NO: 3883816 - RNA, 14 nt, Human
ccccagggcacagg

SEQ ID NO: 3883817 - RNA, 17 nt, Human
ccccagggcacaggagc

SEQ ID NO: 3883818 - RNA, 12 nt, Human
ccccagggcacg

SEQ ID NO: 3883819 - RNA, 20 nt, Human
ccccagggcacuucacagag

SEQ ID NO: 3883820 - RNA, 12 nt, Human
ccccagggcagc

SEQ ID NO: 3883821 - RNA, 21 nt, Human
ccccagggccugagccuggcc

SEQ ID NO: 3883822 - RNA, 16 nt, Human
ccccaggguccuggga

SEQ ID NO: 3883823 - RNA, 17 nt, Human
ccccaggguccugggag

SEQ ID NO: 3883824 - RNA, 16 nt, Human
ccccagggucuucccu

SEQ ID NO: 3883825 - RNA, 22 nt, Human
ccccaggguugaggggaccaag

SEQ ID NO: 3883826 - RNA, 13 nt, Human
cccccugcagcua

SEQ ID NO: 3883827 - RNA, 14 nt, Human
cccccugcaggaag

SEQ ID NO: 3883828 - RNA, 14 nt, Human
cccccugccagugc

SEQ ID NO: 3883829 - RNA, 22 nt, Human
cccccugccccccagccucugg

SEQ ID NO: 3883830 - RNA, 19 nt, Human
cccccugccccuucuacac

SEQ ID NO: 3883831 - RNA, 20 nt, Human
cccccugcccucguggccag

SEQ ID NO: 3883832 - RNA, 24 nt, Human
cccccugccggccggggcugagac

SEQ ID NO: 3883833 - RNA, 17 nt, Human
cccccuggccuccccca

SEQ ID NO: 3883834 - RNA, 15 nt, Human
cccccuggccucugu

SEQ ID NO: 3883835 - RNA, 21 nt, Human
cccccuggggcuucuccugac

SEQ ID NO: 3883836 - RNA, 23 nt, Human
cccccuggggcuucuccugaccc

SEQ ID NO: 3883837 - RNA, 15 nt, Human
cccccugguccccuc

SEQ ID NO: 3883838 - RNA, 17 nt, Human
cccccugguccccuccu

SEQ ID NO: 3883839 - RNA, 16 nt, Human
cccccuggucucuggu

SEQ ID NO: 3883840 - RNA, 20 nt, Human
cccccugguggacaguccug

SEQ ID NO: 3883841 - RNA, 21 nt, Human
cccccugguggacaguccugg

SEQ ID NO: 3883842 - RNA, 21 nt, Human
cccccuguccccucagcucca

SEQ ID NO: 3883843 - RNA, 22 nt, Human
cccccugugccuugucacgcca

SEQ ID NO: 3883844 - RNA, 13 nt, Human
cccccuucuccca

SEQ ID NO: 3883845 - RNA, 14 nt, Human
cccccuucucccac

SEQ ID NO: 3883846 - RNA, 16 nt, Human
cccccuucucugcucc

SEQ ID NO: 3883847 - RNA, 17 nt, Human
cccccuucucugcucca

SEQ ID NO: 3883848 - RNA, 22 nt, Human
cccccuucugggcaucuguucu

SEQ ID NO: 3883849 - RNA, 18 nt, Human
cccccuugccagacaugu

SEQ ID NO: 3883850 - RNA, 18 nt, Human
cccccuuucagaugucuu

SEQ ID NO: 3883851 - RNA, 22 nt, Human
cccccuuucagaugucuucugc

SEQ ID NO: 3883852 - RNA, 15 nt, Human
cccccuuucccgggc

SEQ ID NO: 3883853 - RNA, 19 nt, Human
cccccuuugggcccaggga

SEQ ID NO: 3883854 - RNA, 20 nt, Human
cccccuuugggcccagggac

SEQ ID NO: 3883855 - RNA, 17 nt, Human
ccccgacuccagccagc

SEQ ID NO: 3883856 - RNA, 14 nt, Human
ccccgagccuggcu

SEQ ID NO: 3883857 - RNA, 17 nt, Human
ccccgaggacccagacc

SEQ ID NO: 3883858 - RNA, 12 nt, Human
ccccgaggcccu

SEQ ID NO: 3883859 - RNA, 22 nt, Human
ccccgagggaugaugccacacc

SEQ ID NO: 3883860 - RNA, 21 nt, Human
ccccgaguuuccccagacacc

SEQ ID NO: 3883861 - RNA, 14 nt, Human
ccccgcagacaccu

SEQ ID NO: 3883862 - RNA, 17 nt, Human
ccccgcagaccucccca

SEQ ID NO: 3883863 - RNA, 19 nt, Human
ccccgcagaccuccccagc

SEQ ID NO: 3883864 - RNA, 21 nt, Human
ccccgcagaccuccccagccc

SEQ ID NO: 3883865 - RNA, 16 nt, Human
ccccgcauccccugcc

SEQ ID NO: 3883866 - RNA, 23 nt, Human
ccccgcccagcugcaccugccag

SEQ ID NO: 3883867 - RNA, 14 nt, Human
ccccgcccaggcug

SEQ ID NO: 3883868 - RNA, 19 nt, Human
ccccgcccaggcuggccag

SEQ ID NO: 3883869 - RNA, 20 nt, Human
ccccgccccacauuccgaca

SEQ ID NO: 3883870 - RNA, 12 nt, Human
ccccgcccccag

SEQ ID NO: 3883871 - RNA, 17 nt, Human
ccccgcccccugcccuc

SEQ ID NO: 3883872 - RNA, 18 nt, Human
ccccgccugcccucaugg

SEQ ID NO: 3883873 - RNA, 13 nt, Human
ccccgccuggcca

SEQ ID NO: 3883874 - RNA, 21 nt, Human
ccccgccuuccgccccuuccc

SEQ ID NO: 3883875 - RNA, 22 nt, Human
ccccgcgaccauguggccacaa

SEQ ID NO: 3883876 - RNA, 21 nt, Human
ccccgcguggaacucgugucu

SEQ ID NO: 3883877 - RNA, 21 nt, Human
ccccgcucugcaugcggccca

SEQ ID NO: 3883878 - RNA, 14 nt, Human
ccccggaguucagu

SEQ ID NO: 3883879 - RNA, 17 nt, Human
ccccggcacccucuggc

SEQ ID NO: 3883880 - RNA, 18 nt, Human
ccccggcagcagccccca

SEQ ID NO: 3883881 - RNA, 17 nt, Human
ccccggcaggcccugca

SEQ ID NO: 3883882 - RNA, 15 nt, Human
ccccggccaccucug

SEQ ID NO: 3883883 - RNA, 16 nt, Human
ccccggccaccucugc

SEQ ID NO: 3883884 - RNA, 13 nt, Human
ccccggccaccug

SEQ ID NO: 3883885 - RNA, 19 nt, Human
ccccggccccagccagagu

SEQ ID NO: 3883886 - RNA, 13 nt, Human
ccccggcccuggg

SEQ ID NO: 3883887 - RNA, 17 nt, Human
ccccggcuuccuuuccc

SEQ ID NO: 3883888 - RNA, 23 nt, Human
ccccgggaggggcccgcuugccu

SEQ ID NO: 3883889 - RNA, 15 nt, Human
ccccggucccuugag

SEQ ID NO: 3883890 - RNA, 15 nt, Human
ccccgguggcugggc

SEQ ID NO: 3883891 - RNA, 17 nt, Human
ccccgguggcugggcag

SEQ ID NO: 3883892 - RNA, 15 nt, Human
ccccgucaagaguga

SEQ ID NO: 3883893 - RNA, 13 nt, Human
ccccgucucuguu

SEQ ID NO: 3883894 - RNA, 15 nt, Human
ccccgucugccuggc

SEQ ID NO: 3883895 - RNA, 19 nt, Human
ccccgugcagacuggaggg

SEQ ID NO: 3883896 - RNA, 21 nt, Human
ccccguuccugacaucacagc

SEQ ID NO: 3883897 - RNA, 20 nt, Human
ccccuaaaagaaacccugca

SEQ ID NO: 3883898 - RNA, 13 nt, Human
ccccuaccccaca

SEQ ID NO: 3883899 - RNA, 20 nt, Human
ccccuaccccacaccaggcc

SEQ ID NO: 3883900 - RNA, 17 nt, Human
ccccuaccccuggcugu

SEQ ID NO: 3883901 - RNA, 14 nt, Human
ccccuacugcugug

SEQ ID NO: 3883902 - RNA, 17 nt, Human
ccccuagaaacccaagc

SEQ ID NO: 3883903 - RNA, 18 nt, Human
ccccuagaaacccaagcu

SEQ ID NO: 3883904 - RNA, 21 nt, Human
ccccuagaaacccaagcuccu

SEQ ID NO: 3883905 - RNA, 13 nt, Human
ccccuagcccagg

SEQ ID NO: 3883906 - RNA, 17 nt, Human
ccccuagccgguuccug

SEQ ID NO: 3883907 - RNA, 20 nt, Human
ccccuagcgcuaucucccug

SEQ ID NO: 3883908 - RNA, 21 nt, Human
ccccuagcuuagagccucccu

SEQ ID NO: 3883909 - RNA, 13 nt, Human
ccccuaguucccu

SEQ ID NO: 3883910 - RNA, 15 nt, Human
ccccuaguucccucu

SEQ ID NO: 3883911 - RNA, 14 nt, Human
ccccuauccuuggc

SEQ ID NO: 3883912 - RNA, 15 nt, Human
ccccuauccuuggca

SEQ ID NO: 3883913 - RNA, 23 nt, Human
ccccucaacucuccuccagaguc

SEQ ID NO: 3883914 - RNA, 20 nt, Human
ccccucacagccucugaccc

SEQ ID NO: 3883915 - RNA, 13 nt, Human
ccccucaccuccu

SEQ ID NO: 3883916 - RNA, 13 nt, Human
ccccucagcucca

SEQ ID NO: 3883917 - RNA, 17 nt, Human
ccccucagcuccagacg

SEQ ID NO: 3883918 - RNA, 14 nt, Human
ccccucagcucggc

SEQ ID NO: 3883919 - RNA, 16 nt, Human
ccccucagggucccug

SEQ ID NO: 3883920 - RNA, 18 nt, Human
ccccucaguugugcagcu

SEQ ID NO: 3883921 - RNA, 20 nt, Human
ccccucauagcccucacccu

SEQ ID NO: 3883922 - RNA, 20 nt, Human
ccccucaucucucugcccaa

SEQ ID NO: 3883923 - RNA, 14 nt, Human
ccccuccaaccugg

SEQ ID NO: 3883924 - RNA, 23 nt, Human
ccccuccaaucccaccaacccuc

SEQ ID NO: 3883925 - RNA, 16 nt, Human
ccccuccaauccugcc

SEQ ID NO: 3883926 - RNA, 13 nt, Human
ccccuccaccugc

SEQ ID NO: 3883927 - RNA, 22 nt, Human
ccccuccagcuuguggagcccc

SEQ ID NO: 3883928 - RNA, 12 nt, Human
ccccucccacca

SEQ ID NO: 3883929 - RNA, 12 nt, Human
ccccucccagag

SEQ ID NO: 3883930 - RNA, 12 nt, Human
ccccucccagcu

SEQ ID NO: 3883931 - RNA, 13 nt, Human
ccccucccagcug

SEQ ID NO: 3883932 - RNA, 22 nt, Human
ccccucccagcugacaguccuc

SEQ ID NO: 3883933 - RNA, 13 nt, Human
ccccucccaucug

SEQ ID NO: 3883934 - RNA, 13 nt, Human
ccccucccauuag

SEQ ID NO: 3883935 - RNA, 13 nt, Human
ccccuccccaugc

SEQ ID NO: 3883936 - RNA, 21 nt, Human
ccccucccccaacccccaccc

SEQ ID NO: 3883937 - RNA, 14 nt, Human
ccccucccccagcc

SEQ ID NO: 3883938 - RNA, 18 nt, Human
ccccucccccagccacuc

SEQ ID NO: 3883939 - RNA, 15 nt, Human
ccccucccccguccu

SEQ ID NO: 3883940 - RNA, 20 nt, Human
ccccucccccguccuggagg

SEQ ID NO: 3883941 - RNA, 20 nt, Human
ccccucccccugagauucag

SEQ ID NO: 3883942 - RNA, 19 nt, Human
ccccuccccuaaugccugc

SEQ ID NO: 3883943 - RNA, 18 nt, Human
ccccuccccugcugcagg

SEQ ID NO: 3883944 - RNA, 22 nt, Human
ccccucccgucuacucauuccc

SEQ ID NO: 3883945 - RNA, 12 nt, Human
ccccucccuacc

SEQ ID NO: 3883946 - RNA, 14 nt, Human
ccccucccuggaug

SEQ ID NO: 3883947 - RNA, 15 nt, Human
ccccucccuggccug

SEQ ID NO: 3883948 - RNA, 13 nt, Human
ccccucccuggcu

SEQ ID NO: 3883949 - RNA, 22 nt, Human
ccccucccuggcucccaugacc

SEQ ID NO: 3883950 - RNA, 13 nt, Human
ccccucccuguca

SEQ ID NO: 3883951 - RNA, 16 nt, Human
ccccuccgcccugcca

SEQ ID NO: 3883952 - RNA, 18 nt, Human
ccccuccgcccugccacu

SEQ ID NO: 3883953 - RNA, 13 nt, Human
ccccuccgccucc

SEQ ID NO: 3883954 - RNA, 17 nt, Human
ccccuccggacuggugc

SEQ ID NO: 3883955 - RNA, 19 nt, Human
ccccuccuaccccucccag

SEQ ID NO: 3883956 - RNA, 19 nt, Human
ccccuccuaguuugggagg

SEQ ID NO: 3883957 - RNA, 15 nt, Human
ccccuccuccacucu

SEQ ID NO: 3883958 - RNA, 17 nt, Human
ccccuccuccagccccu

SEQ ID NO: 3883959 - RNA, 19 nt, Human
ccccuccucuagcuguggg

SEQ ID NO: 3883960 - RNA, 15 nt, Human
ccccuccucucccau

SEQ ID NO: 3883961 - RNA, 15 nt, Human
ccccuccucucugcc

SEQ ID NO: 3883962 - RNA, 11 nt, Human
ccccuccucug

SEQ ID NO: 3883963 - RNA, 13 nt, Human
ccccuccucugcu

SEQ ID NO: 3883964 - RNA, 14 nt, Human
ccccuccucugcuu

SEQ ID NO: 3883965 - RNA, 14 nt, Human
ccccuccugcugca

SEQ ID NO: 3883966 - RNA, 22 nt, Human
ccccuccugcugcagaggggca

SEQ ID NO: 3883967 - RNA, 18 nt, Human
ccccuccuggggccaggc

SEQ ID NO: 3883968 - RNA, 16 nt, Human
ccccuccuucccagcu

SEQ ID NO: 3883969 - RNA, 15 nt, Human
ccccuccuuccuuga

SEQ ID NO: 3883970 - RNA, 20 nt, Human
ccccuccuuccuugaccagc

SEQ ID NO: 3883971 - RNA, 13 nt, Human
ccgcauucccuga

SEQ ID NO: 3883972 - RNA, 19 nt, Human
ccgccaccgcggguguggg

SEQ ID NO: 3883973 - RNA, 20 nt, Human
ccgccacuggggcucagagc

SEQ ID NO: 3883974 - RNA, 11 nt, Human
ccgccagccuc

SEQ ID NO: 3883975 - RNA, 21 nt, Human
ccgccagggcccacacccccu

SEQ ID NO: 3883976 - RNA, 19 nt, Human
ccgccauugccaccaggag

SEQ ID NO: 3883977 - RNA, 14 nt, Human
ccgcccaaggccuu

SEQ ID NO: 3883978 - RNA, 22 nt, Human
ccgcccagcugcaccugccagc

SEQ ID NO: 3883979 - RNA, 16 nt, Human
ccgcccaggcuggcca

SEQ ID NO: 3883980 - RNA, 20 nt, Human
ccgcccaggcuggccagccc

SEQ ID NO: 3883981 - RNA, 13 nt, Human
ccgccccacauuc

SEQ ID NO: 3883982 - RNA, 14 nt, Human
ccgccccagccucu

SEQ ID NO: 3883983 - RNA, 15 nt, Human
ccgccccagccucug

SEQ ID NO: 3883984 - RNA, 12 nt, Human
ccgcccccagcc

SEQ ID NO: 3883985 - RNA, 20 nt, Human
ccgcccccagcccccuccug

SEQ ID NO: 3883986 - RNA, 14 nt, Human
ccgcccccagccua

SEQ ID NO: 3883987 - RNA, 19 nt, Human
ccgccccccacacuucccu

SEQ ID NO: 3883988 - RNA, 20 nt, Human
ccgccccccacacuucccug

SEQ ID NO: 3883989 - RNA, 12 nt, Human
ccgcccccuccu

SEQ ID NO: 3883990 - RNA, 14 nt, Human
ccgcccccuccuga

SEQ ID NO: 3883991 - RNA, 17 nt, Human
ccgccccugagcccacu

SEQ ID NO: 3883992 - RNA, 17 nt, Human
ccgccccuuccccgagg

SEQ ID NO: 3883993 - RNA, 18 nt, Human
ccgccccuucccuucccu

SEQ ID NO: 3883994 - RNA, 16 nt, Human
ccgcccgggcccagag

SEQ ID NO: 3883995 - RNA, 15 nt, Human
ccgcccugcuccucc

SEQ ID NO: 3883996 - RNA, 16 nt, Human
ccgcccuguacccucu

SEQ ID NO: 3883997 - RNA, 19 nt, Human
ccgccgacuuuguaccccc

SEQ ID NO: 3883998 - RNA, 14 nt, Human
ccgccgccucgccc

SEQ ID NO: 3883999 - RNA, 18 nt, Human
ccgccgcuuuucuccucu

SEQ ID NO: 3884000 - RNA, 14 nt, Human
ccgccgugaccccu

SEQ ID NO: 3884001 - RNA, 16 nt, Human
ccgccgugaccccugc

SEQ ID NO: 3884002 - RNA, 18 nt, Human
ccgccuaguuuacuguuu

SEQ ID NO: 3884003 - RNA, 12 nt, Human
ccgccuccagga

SEQ ID NO: 3884004 - RNA, 15 nt, Human
ccgccucccagccug

SEQ ID NO: 3884005 - RNA, 17 nt, Human
ccgccuccuacagccca

SEQ ID NO: 3884006 - RNA, 20 nt, Human
ccgccucgaccucucucaaa

SEQ ID NO: 3884007 - RNA, 23 nt, Human
ccgccucuccucgguucaagguc

SEQ ID NO: 3884008 - RNA, 14 nt, Human
ccgccucugcuggc

SEQ ID NO: 3884009 - RNA, 11 nt, Human
ccgccugccag

SEQ ID NO: 3884010 - RNA, 14 nt, Human
ccgccugcccaccu

SEQ ID NO: 3884011 - RNA, 20 nt, Human
ccgccugcccaccugccugg

SEQ ID NO: 3884012 - RNA, 22 nt, Human
ccgccugcccgucucucuccca

SEQ ID NO: 3884013 - RNA, 15 nt, Human
ccgccuggaggagau

SEQ ID NO: 3884014 - RNA, 16 nt, Human
ccgccuggcagaacug

SEQ ID NO: 3884015 - RNA, 21 nt, Human
ccgccuggcagaacugagcuc

SEQ ID NO: 3884016 - RNA, 15 nt, Human
ccgccuggccaggag

SEQ ID NO: 3884017 - RNA, 20 nt, Human
ccgccuggccaggagcaggc

SEQ ID NO: 3884018 - RNA, 23 nt, Human
ccgccuuccgccccuucccuucc

SEQ ID NO: 3884019 - RNA, 22 nt, Human
ccgccuugcccagccuggaugc

SEQ ID NO: 3884020 - RNA, 12 nt, Human
ccgccuuuugua

SEQ ID NO: 3884021 - RNA, 22 nt, Human
ccgcgccaaauaaugucucugu

SEQ ID NO: 3884022 - RNA, 21 nt, Human
ccgcgcuccgggcuuucacgg

SEQ ID NO: 3884023 - RNA, 15 nt, Human
ccgcggagccugcau

SEQ ID NO: 3884024 - RNA, 16 nt, Human
ccgcgggcacugccgc

SEQ ID NO: 3884025 - RNA, 21 nt, Human
ccgcggggcugucggcgcugc

SEQ ID NO: 3884026 - RNA, 17 nt, Human
ccgcggguuccgcaggc

SEQ ID NO: 3884027 - RNA, 19 nt, Human
ccgcggguuccgcaggcag

SEQ ID NO: 3884028 - RNA, 17 nt, Human
ccgcgucuacccuggga

SEQ ID NO: 3884029 - RNA, 22 nt, Human
ccgcgugcggaggggacagagc

SEQ ID NO: 3884030 - RNA, 22 nt, Human
ccgcguguccccggggcccagg

SEQ ID NO: 3884031 - RNA, 17 nt, Human
ccgcguuguaaaauaua

SEQ ID NO: 3884032 - RNA, 16 nt, Human
ccgcguuuagaccaag

SEQ ID NO: 3884033 - RNA, 18 nt, Human
ccgcuaaaagaaacuuuc

SEQ ID NO: 3884034 - RNA, 20 nt, Human
ccgcuacaccacucuggcag

SEQ ID NO: 3884035 - RNA, 21 nt, Human
ccgcuacaccacucuggcagc

SEQ ID NO: 3884036 - RNA, 19 nt, Human
ccgcuagaggccugaggau

SEQ ID NO: 3884037 - RNA, 21 nt, Human
ccgcuaggcucgccuucccuc

SEQ ID NO: 3884038 - RNA, 16 nt, Human
ccgcucaccuagagcc

SEQ ID NO: 3884039 - RNA, 20 nt, Human
ccgcucaccuagagccagac

SEQ ID NO: 3884040 - RNA, 11 nt, Human
ccgcucagccc

SEQ ID NO: 3884041 - RNA, 12 nt, Human
ccgcucagcccu

SEQ ID NO: 3884042 - RNA, 15 nt, Human
ccgcucagcccuccc

SEQ ID NO: 3884043 - RNA, 20 nt, Human
ccgcucaggcugaccacuuu

SEQ ID NO: 3884044 - RNA, 16 nt, Human
ccgcuccccagcccag

SEQ ID NO: 3884045 - RNA, 14 nt, Human
ccgcuccugucugc

SEQ ID NO: 3884046 - RNA, 17 nt, Human
ccgcuccugucugccag

SEQ ID NO: 3884047 - RNA, 15 nt, Human
ccgcucggaggcccc

SEQ ID NO: 3884048 - RNA, 16 nt, Human
ccgcucggaggcccca

SEQ ID NO: 3884049 - RNA, 20 nt, Human
ccgcucuacaucuucugccu

SEQ ID NO: 3884050 - RNA, 14 nt, Human
ccgcucuccugcca

SEQ ID NO: 3884051 - RNA, 14 nt, Human
ccgcucucuuccug

SEQ ID NO: 3884052 - RNA, 15 nt, Human
ccgcucucuuccugc

SEQ ID NO: 3884053 - RNA, 17 nt, Human
ccgcucucuuccugccc

SEQ ID NO: 3884054 - RNA, 19 nt, Human
ccgcucucuuccugccccu

SEQ ID NO: 3884055 - RNA, 22 nt, Human
ccgcucucuuccugccccucuu

SEQ ID NO: 3884056 - RNA, 21 nt, Human
ccgcucugcaugcggcccagc

SEQ ID NO: 3884057 - RNA, 23 nt, Human
ccgcugagcgaggagaugcuccu

SEQ ID NO: 3884058 - RNA, 13 nt, Human
ccgcugaguggac

SEQ ID NO: 3884059 - RNA, 17 nt, Human
ccgcugaguggacugga

SEQ ID NO: 3884060 - RNA, 19 nt, Human
ccgcugaguggacuggagu

SEQ ID NO: 3884061 - RNA, 13 nt, Human
ccgcugauucuca

SEQ ID NO: 3884062 - RNA, 22 nt, Human
ccgcugauucucagggucucug

SEQ ID NO: 3884063 - RNA, 14 nt, Human
ccgcugccacccac

SEQ ID NO: 3884064 - RNA, 17 nt, Human
ccgcugccacccaccuc

SEQ ID NO: 3884065 - RNA, 20 nt, Human
ccgcugccacccaccucccu

SEQ ID NO: 3884066 - RNA, 13 nt, Human
ccgcugccagccu

SEQ ID NO: 3884067 - RNA, 15 nt, Human
ccgcugccagccuug

SEQ ID NO: 3884068 - RNA, 20 nt, Human
ccgcugcccggcgcccucug

SEQ ID NO: 3884069 - RNA, 22 nt, Human
ccgcugcccggcgcccucuguc

SEQ ID NO: 3884070 - RNA, 23 nt, Human
ccgcugccgugccgccugcacuc

SEQ ID NO: 3884071 - RNA, 14 nt, Human
ccgcugcuccacgc

SEQ ID NO: 3884072 - RNA, 14 nt, Human
ccgcugcugugcaa

SEQ ID NO: 3884073 - RNA, 12 nt, Human
ccgcuggcuggg

SEQ ID NO: 3884074 - RNA, 15 nt, Human
ccgcuggcugggggc

SEQ ID NO: 3884075 - RNA, 22 nt, Human
ccgcuggcugggggccucacuc

SEQ ID NO: 3884076 - RNA, 19 nt, Human
ccgcugggcugagccccua

SEQ ID NO: 3884077 - RNA, 21 nt, Human
ccgcugggcugagccccuacc

SEQ ID NO: 3884078 - RNA, 16 nt, Human
ccgcuguaagcuccuu

SEQ ID NO: 3884079 - RNA, 18 nt, Human
ccgcuguucacccacagg

SEQ ID NO: 3884080 - RNA, 19 nt, Human
ccgcuguucacccacaggg

SEQ ID NO: 3884081 - RNA, 21 nt, Human
ccgcuguucacccacagggcu

SEQ ID NO: 3884082 - RNA, 15 nt, Human
ccgcuucugccugca

SEQ ID NO: 3884083 - RNA, 14 nt, Human
ccgcuugccucggc

SEQ ID NO: 3884084 - RNA, 18 nt, Human
ccgcuugccucggcuccu

SEQ ID NO: 3884085 - RNA, 23 nt, Human
ccgcuuggagcuauuuuccaggc

SEQ ID NO: 3884086 - RNA, 21 nt, Human
ccgcuuggcgaugccagccaa

SEQ ID NO: 3884087 - RNA, 17 nt, Human
ccgcuuguccagcgccu

SEQ ID NO: 3884088 - RNA, 11 nt, Human
ccggaaagaag

SEQ ID NO: 3884089 - RNA, 13 nt, Human
ccggaagcuccug

SEQ ID NO: 3884090 - RNA, 15 nt, Human
ccggaagcuccuggu

SEQ ID NO: 3884091 - RNA, 19 nt, Human
ccggaauccuguccucagc

SEQ ID NO: 3884092 - RNA, 22 nt, Human
ccggaauccuguccucagcuuc

SEQ ID NO: 3884093 - RNA, 13 nt, Human
ccggaccagccug

SEQ ID NO: 3884094 - RNA, 14 nt, Human
ccggacccaccuca

SEQ ID NO: 3884095 - RNA, 12 nt, Human
ccggacuggugc

SEQ ID NO: 3884096 - RNA, 18 nt, Human
ccggacuggugcccuccu

SEQ ID NO: 3884097 - RNA, 23 nt, Human
ccggacuuagaaaaccagcucag

SEQ ID NO: 3884098 - RNA, 16 nt, Human
ccggacuuuucugcaa

SEQ ID NO: 3884099 - RNA, 14 nt, Human
ccggagaggaccgg

SEQ ID NO: 3884100 - RNA, 17 nt, Human
ccggagauuggacggcc

SEQ ID NO: 3884101 - RNA, 19 nt, Human
ccggagauuggacggccug

SEQ ID NO: 3884102 - RNA, 21 nt, Human
ccggagauuggacggccugau

SEQ ID NO: 3884103 - RNA, 16 nt, Human
ccggagcuaacacugg

SEQ ID NO: 3884104 - RNA, 21 nt, Human
ccggagcugccccucucuggg

SEQ ID NO: 3884105 - RNA, 23 nt, Human
ccggagcuggaggauccccucca

SEQ ID NO: 3884106 - RNA, 20 nt, Human
ccggaggcggugggccuggu

SEQ ID NO: 3884107 - RNA, 13 nt, Human
ccggagggcugcg

SEQ ID NO: 3884108 - RNA, 14 nt, Human
ccggaggggccugg

SEQ ID NO: 3884109 - RNA, 15 nt, Human
ccggaggggccuggc

SEQ ID NO: 3884110 - RNA, 16 nt, Human
ccggaggggccuggca

SEQ ID NO: 3884111 - RNA, 21 nt, Human
ccggaggggccuggcagccgu

SEQ ID NO: 3884112 - RNA, 17 nt, Human
ccggagguagagguugu

SEQ ID NO: 3884113 - RNA, 22 nt, Human
ccggagugucuggaauuguggc

SEQ ID NO: 3884114 - RNA, 20 nt, Human
ccggauggcggacaccuggc

SEQ ID NO: 3884115 - RNA, 13 nt, Human
ccggaugugcuuu

SEQ ID NO: 3884116 - RNA, 17 nt, Human
ccgugaugcucaggcuu

SEQ ID NO: 3884117 - RNA, 13 nt, Human
ccgugcagacugg

SEQ ID NO: 3884118 - RNA, 18 nt, Human
ccgugcagcuucuguccu

SEQ ID NO: 3884119 - RNA, 19 nt, Human
ccgugcagcuucuguccug

SEQ ID NO: 3884120 - RNA, 11 nt, Human
ccgugccaaag

SEQ ID NO: 3884121 - RNA, 14 nt, Human
ccgugccaagucca

SEQ ID NO: 3884122 - RNA, 12 nt, Human
ccgugcccaggg

SEQ ID NO: 3884123 - RNA, 20 nt, Human
ccgugcccaggggcccacag

SEQ ID NO: 3884124 - RNA, 14 nt, Human
ccgugcccugcucg

SEQ ID NO: 3884125 - RNA, 21 nt, Human
ccgugccgccugcacuccuca

SEQ ID NO: 3884126 - RNA, 14 nt, Human
ccgugccuccacca

SEQ ID NO: 3884127 - RNA, 17 nt, Human
ccgugccuucagcucua

SEQ ID NO: 3884128 - RNA, 16 nt, Human
ccgugcuaaggacuug

SEQ ID NO: 3884129 - RNA, 16 nt, Human
ccgugcucgccccagc

SEQ ID NO: 3884130 - RNA, 14 nt, Human
ccgugcugacagcu

SEQ ID NO: 3884131 - RNA, 18 nt, Human
ccgugcugacagcugcuc

SEQ ID NO: 3884132 - RNA, 19 nt, Human
ccgugcugacagcugcucc

SEQ ID NO: 3884133 - RNA, 21 nt, Human
ccgugcugacagcugcuccua

SEQ ID NO: 3884134 - RNA, 15 nt, Human
ccgugcuuccucagu

SEQ ID NO: 3884135 - RNA, 15 nt, Human
ccguggaccuuccug

SEQ ID NO: 3884136 - RNA, 20 nt, Human
ccguggaggaggaaggcaag

SEQ ID NO: 3884137 - RNA, 12 nt, Human
ccguggaggcug

SEQ ID NO: 3884138 - RNA, 15 nt, Human
ccguggaggcugcuc

SEQ ID NO: 3884139 - RNA, 19 nt, Human
ccguggauugcacguggcc

SEQ ID NO: 3884140 - RNA, 23 nt, Human
ccguggcaucaccuuaggcaggg

SEQ ID NO: 3884141 - RNA, 13 nt, Human
ccguggccccagc

SEQ ID NO: 3884142 - RNA, 14 nt, Human
ccguggcccuuccu

SEQ ID NO: 3884143 - RNA, 17 nt, Human
ccguggcccuuccugga

SEQ ID NO: 3884144 - RNA, 20 nt, Human
ccguggcccuuccuggacag

SEQ ID NO: 3884145 - RNA, 14 nt, Human
ccguggcuucccgc

SEQ ID NO: 3884146 - RNA, 22 nt, Human
ccgugggcaauugucugaaaag

SEQ ID NO: 3884147 - RNA, 14 nt, Human
ccgugggccauggc

SEQ ID NO: 3884148 - RNA, 15 nt, Human
ccgugggccauggca

SEQ ID NO: 3884149 - RNA, 12 nt, Human
ccgugggcgggg

SEQ ID NO: 3884150 - RNA, 19 nt, Human
ccgugggcggggccuugcg

SEQ ID NO: 3884151 - RNA, 18 nt, Human
ccguggguugcuaacuga

SEQ ID NO: 3884152 - RNA, 19 nt, Human
ccguguacauagugcauug

SEQ ID NO: 3884153 - RNA, 12 nt, Human
ccguguccaccc

SEQ ID NO: 3884154 - RNA, 19 nt, Human
ccguguccccugacagggc

SEQ ID NO: 3884155 - RNA, 22 nt, Human
ccgugugagaagugaaugcugg

SEQ ID NO: 3884156 - RNA, 23 nt, Human
ccgugugagaagugaaugcuggg

SEQ ID NO: 3884157 - RNA, 18 nt, Human
ccgugugagugugacagg

SEQ ID NO: 3884158 - RNA, 20 nt, Human
ccgugugagugugacagggc

SEQ ID NO: 3884159 - RNA, 22 nt, Human
ccgugugagugugacagggcca

SEQ ID NO: 3884160 - RNA, 13 nt, Human
ccgugugcccucg

SEQ ID NO: 3884161 - RNA, 14 nt, Human
ccguguggccccuu

SEQ ID NO: 3884162 - RNA, 15 nt, Human
ccguguggccccuuc

SEQ ID NO: 3884163 - RNA, 22 nt, Human
ccgugugguaagcaacauggcu

SEQ ID NO: 3884164 - RNA, 19 nt, Human
ccguuauaaagugugccac

SEQ ID NO: 3884165 - RNA, 20 nt, Human
ccguuccaccccaagagaac

SEQ ID NO: 3884166 - RNA, 24 nt, Human
ccguuccugacaucacagcagccu

SEQ ID NO: 3884167 - RNA, 15 nt, Human
ccguucugcuggccu

SEQ ID NO: 3884168 - RNA, 23 nt, Human
ccguucugcuggccuggaucucc

SEQ ID NO: 3884169 - RNA, 18 nt, Human
ccguugauguuggcuggg

SEQ ID NO: 3884170 - RNA, 14 nt, Human
ccguugcugacuua

SEQ ID NO: 3884171 - RNA, 15 nt, Human
ccguugcugacuuag

SEQ ID NO: 3884172 - RNA, 20 nt, Human
ccguugucucccuggcccuc

SEQ ID NO: 3884173 - RNA, 21 nt, Human
ccguuugauuugucacugcuu

SEQ ID NO: 3884174 - RNA, 15 nt, Human
ccguuuuccccauga

SEQ ID NO: 3884175 - RNA, 17 nt, Human
ccguuuuccccaugaca

SEQ ID NO: 3884176 - RNA, 12 nt, Human
ccuaaaaaagau

SEQ ID NO: 3884177 - RNA, 11 nt, Human
ccuaaaaauaa

SEQ ID NO: 3884178 - RNA, 13 nt, Human
ccuaaaacaaaag

SEQ ID NO: 3884179 - RNA, 14 nt, Human
ccuaaaagcaaaau

SEQ ID NO: 3884180 - RNA, 13 nt, Human
ccuaaaaggccca

SEQ ID NO: 3884181 - RNA, 15 nt, Human
ccuaaaaggcccaga

SEQ ID NO: 3884182 - RNA, 14 nt, Human
ccuaaaaguaaaca

SEQ ID NO: 3884183 - RNA, 22 nt, Human
ccuaaaagugggcuugauucug

SEQ ID NO: 3884184 - RNA, 15 nt, Human
ccuaaaauucagugg

SEQ ID NO: 3884185 - RNA, 16 nt, Human
ccuaaaauucagugga

SEQ ID NO: 3884186 - RNA, 14 nt, Human
ccuaaaauuugccc

SEQ ID NO: 3884187 - RNA, 21 nt, Human
ccuaaaccaaaaacugaaagu

SEQ ID NO: 3884188 - RNA, 11 nt, Human
ccuaaacugua

SEQ ID NO: 3884189 - RNA, 12 nt, Human
ccuaaagaaaaa

SEQ ID NO: 3884190 - RNA, 14 nt, Human
ccuaaagcagccag

SEQ ID NO: 3884191 - RNA, 19 nt, Human
ccuaaagccucaaaacaaa

SEQ ID NO: 3884192 - RNA, 18 nt, Human
ccuaaauccauuuggaaa

SEQ ID NO: 3884193 - RNA, 20 nt, Human
ccuaaauccauuuggaaauc

SEQ ID NO: 3884194 - RNA, 14 nt, Human
ccuaaauggccuca

SEQ ID NO: 3884195 - RNA, 15 nt, Human
ccuaaauuauuuacu

SEQ ID NO: 3884196 - RNA, 20 nt, Human
ccuaaauuuuccuguccucu

SEQ ID NO: 3884197 - RNA, 21 nt, Human
ccuaacaacauuguagccuca

SEQ ID NO: 3884198 - RNA, 13 nt, Human
ccuaacaccagcg

SEQ ID NO: 3884199 - RNA, 21 nt, Human
ccuaacaucugaccuggcauc

SEQ ID NO: 3884200 - RNA, 18 nt, Human
ccuaaccagggccagaag

SEQ ID NO: 3884201 - RNA, 19 nt, Human
ccuaacccagaaaaucuga

SEQ ID NO: 3884202 - RNA, 16 nt, Human
ccuaaccccuuccaga

SEQ ID NO: 3884203 - RNA, 18 nt, Human
ccuaaccccuuccagauc

SEQ ID NO: 3884204 - RNA, 13 nt, Human
ccuaacucauacu

SEQ ID NO: 3884205 - RNA, 15 nt, Human
ccuaacucuucuuuc

SEQ ID NO: 3884206 - RNA, 15 nt, Human
ccuaagacugugaca

SEQ ID NO: 3884207 - RNA, 12 nt, Human
ccuaagagauuc

SEQ ID NO: 3884208 - RNA, 14 nt, Human
ccuaagaggcugcc

SEQ ID NO: 3884209 - RNA, 15 nt, Human
ccuaagaggcugccc

SEQ ID NO: 3884210 - RNA, 12 nt, Human
ccuaagaguguu

SEQ ID NO: 3884211 - RNA, 21 nt, Human
ccuaagauuuauuuuguuaaa

SEQ ID NO: 3884212 - RNA, 15 nt, Human
ccuaagcagaaagug

SEQ ID NO: 3884213 - RNA, 17 nt, Human
ccuaagcauugccuggc

SEQ ID NO: 3884214 - RNA, 13 nt, Human
ccuaagccaaggg

SEQ ID NO: 3884215 - RNA, 14 nt, Human
ccuaagccagccug

SEQ ID NO: 3884216 - RNA, 15 nt, Human
ccuaagccagccugg

SEQ ID NO: 3884217 - RNA, 19 nt, Human
ccuaagccagccuggucca

SEQ ID NO: 3884218 - RNA, 17 nt, Human
ccuaaggaucucucagg

SEQ ID NO: 3884219 - RNA, 21 nt, Human
ccuaaggcaucuaucugugcu

SEQ ID NO: 3884220 - RNA, 22 nt, Human
ccuaaggcaugugugaaacaua

SEQ ID NO: 3884221 - RNA, 12 nt, Human
ccuaaggcugca

SEQ ID NO: 3884222 - RNA, 12 nt, Human
ccuaaguacugu

SEQ ID NO: 3884223 - RNA, 20 nt, Human
ccuaaguaucaaguauagaa

SEQ ID NO: 3884224 - RNA, 16 nt, Human
ccuaaguauuaaaaca

SEQ ID NO: 3884225 - RNA, 17 nt, Human
ccuaaguauuaaaacau

SEQ ID NO: 3884226 - RNA, 21 nt, Human
ccuaaguauuaaaacauugga

SEQ ID NO: 3884227 - RNA, 16 nt, Human
ccuaagucccugcccc

SEQ ID NO: 3884228 - RNA, 18 nt, Human
ccuaagucccugcccccu

SEQ ID NO: 3884229 - RNA, 18 nt, Human
ccuaaguccuuuaugugg

SEQ ID NO: 3884230 - RNA, 14 nt, Human
ccuaaguggcugcu

SEQ ID NO: 3884231 - RNA, 15 nt, Human
ccuaaguggcugcug

SEQ ID NO: 3884232 - RNA, 17 nt, Human
ccuaaguuaccuuucua

SEQ ID NO: 3884233 - RNA, 17 nt, Human
ccuaaguucuuagauau

SEQ ID NO: 3884234 - RNA, 18 nt, Human
ccuaaguucuuagauauc

SEQ ID NO: 3884235 - RNA, 14 nt, Human
ccuaauaaaaaggu

SEQ ID NO: 3884236 - RNA, 12 nt, Human
ccuaauaaaacu

SEQ ID NO: 3884237 - RNA, 15 nt, Human
ccuaauaaaacugau

SEQ ID NO: 3884238 - RNA, 21 nt, Human
ccuaauaaaacugaugugaaa

SEQ ID NO: 3884239 - RNA, 23 nt, Human
ccuaauaaaacugaugugaaacu

SEQ ID NO: 3884240 - RNA, 18 nt, Human
ccuaauaaacauccuuca

SEQ ID NO: 3884241 - RNA, 12 nt, Human
ccuaauaaagcu

SEQ ID NO: 3884242 - RNA, 23 nt, Human
ccuaauaaagcuguguggcaguc

SEQ ID NO: 3884243 - RNA, 21 nt, Human
ccuaauaaaguucuguacuca

SEQ ID NO: 3884244 - RNA, 13 nt, Human
ccuaauccaggca

SEQ ID NO: 3884245 - RNA, 15 nt, Human
ccuaauccaggcaga

SEQ ID NO: 3884246 - RNA, 19 nt, Human
ccuaauccaggcagaucca

SEQ ID NO: 3884247 - RNA, 18 nt, Human
ccuaauccccuucucccc

SEQ ID NO: 3884248 - RNA, 13 nt, Human
ccuaaucucugua

SEQ ID NO: 3884249 - RNA, 21 nt, Human
ccuaaugaaagugaugacaua

SEQ ID NO: 3884250 - RNA, 12 nt, Human
ccuaaugcugca

SEQ ID NO: 3884251 - RNA, 18 nt, Human
ccuaauguggcagcuguc

SEQ ID NO: 3884252 - RNA, 19 nt, Human
ccuaauguuuaugagccag

SEQ ID NO: 3884253 - RNA, 21 nt, Human
ccuaauuaauauauuaaaauu

SEQ ID NO: 3884254 - RNA, 14 nt, Human
ccuaauuaauuuca

SEQ ID NO: 3884255 - RNA, 20 nt, Human
ccuaauucaauucaaagcug

SEQ ID NO: 3884256 - RNA, 20 nt, Human
ccuaauucagccauguacag

SEQ ID NO: 3884257 - RNA, 14 nt, Human
ccuaauuccacagc

SEQ ID NO: 3884258 - RNA, 15 nt, Human
ccuaauucuucuguc

SEQ ID NO: 3884259 - RNA, 22 nt, Human
ccuacaagauuuagaaaaaagu

SEQ ID NO: 3884260 - RNA, 15 nt, Human
ccuacacacugucau

SEQ ID NO: 3884261 - RNA, 11 nt, Human
ccuacacagga

SEQ ID NO: 3884262 - RNA, 20 nt, Human
ccuaggccacuccuccaaag

SEQ ID NO: 3884263 - RNA, 15 nt, Human
ccuaggccaggugca

SEQ ID NO: 3884264 - RNA, 23 nt, Human
ccuaggccucaacuccucccaua

SEQ ID NO: 3884265 - RNA, 18 nt, Human
ccuaggccucagccagag

SEQ ID NO: 3884266 - RNA, 19 nt, Human
ccuaggccucagccagaga

SEQ ID NO: 3884267 - RNA, 13 nt, Human
ccuaggccugggc

SEQ ID NO: 3884268 - RNA, 14 nt, Human
ccuaggcgggcggu

SEQ ID NO: 3884269 - RNA, 16 nt, Human
ccuaggcuaggguggg

SEQ ID NO: 3884270 - RNA, 15 nt, Human
ccuaggcuccacccc

SEQ ID NO: 3884271 - RNA, 18 nt, Human
ccuagggaacagaaauug

SEQ ID NO: 3884272 - RNA, 16 nt, Human
ccuagguagcccccuc

SEQ ID NO: 3884273 - RNA, 13 nt, Human
ccuaggucuauuu

SEQ ID NO: 3884274 - RNA, 14 nt, Human
ccuaggucuccagu

SEQ ID NO: 3884275 - RNA, 15 nt, Human
ccuaggugacagagu

SEQ ID NO: 3884276 - RNA, 20 nt, Human
ccuagguucccggucccgag

SEQ ID NO: 3884277 - RNA, 21 nt, Human
ccuagguucccggucccgagu

SEQ ID NO: 3884278 - RNA, 14 nt, Human
ccuaguaagaagac

SEQ ID NO: 3884279 - RNA, 18 nt, Human
ccuagucccuuccacacc

SEQ ID NO: 3884280 - RNA, 19 nt, Human
ccuagucccuuccacaccc

SEQ ID NO: 3884281 - RNA, 16 nt, Human
ccuagucccuuccccu

SEQ ID NO: 3884282 - RNA, 19 nt, Human
ccuagugaaggcuucucuc

SEQ ID NO: 3884283 - RNA, 21 nt, Human
ccuagugaaggcuucucucug

SEQ ID NO: 3884284 - RNA, 18 nt, Human
ccuagugacccggaggcc

SEQ ID NO: 3884285 - RNA, 17 nt, Human
ccuaguggcuguccagu

SEQ ID NO: 3884286 - RNA, 19 nt, Human
ccuaguggcuguccagugc

SEQ ID NO: 3884287 - RNA, 23 nt, Human
ccuaguggcuguccagugcccau

SEQ ID NO: 3884288 - RNA, 17 nt, Human
ccuaguggggucucccu

SEQ ID NO: 3884289 - RNA, 20 nt, Human
ccuaguggggucucccucuc

SEQ ID NO: 3884290 - RNA, 20 nt, Human
ccuaguuaaagaaaggaaaa

SEQ ID NO: 3884291 - RNA, 18 nt, Human
ccuaguucaucccuucuc

SEQ ID NO: 3884292 - RNA, 21 nt, Human
ccuaguucaucccuucucuuc

SEQ ID NO: 3884293 - RNA, 22 nt, Human
ccuaguucaucccuucucuucc

SEQ ID NO: 3884294 - RNA, 23 nt, Human
ccuaguuccaccaucaagccacc

SEQ ID NO: 3884295 - RNA, 20 nt, Human
ccuaguucccucugcucagc

SEQ ID NO: 3884296 - RNA, 15 nt, Human
ccuaguucuagaaaa

SEQ ID NO: 3884297 - RNA, 13 nt, Human
ccuaguuuccucu

SEQ ID NO: 3884298 - RNA, 14 nt, Human
ccuaguuuccucuc

SEQ ID NO: 3884299 - RNA, 13 nt, Human
ccuaguuuuccau

SEQ ID NO: 3884300 - RNA, 15 nt, Human
ccuaguuuuccaugc

SEQ ID NO: 3884301 - RNA, 15 nt, Human
ccuaguuuucuccuc

SEQ ID NO: 3884302 - RNA, 19 nt, Human
ccuaguuuucuuuccuccu

SEQ ID NO: 3884303 - RNA, 20 nt, Human
ccuauaaaacaggucaauac

SEQ ID NO: 3884304 - RNA, 18 nt, Human
ccuauaacacugugaaga

SEQ ID NO: 3884305 - RNA, 16 nt, Human
ccuauaacugcccagc

SEQ ID NO: 3884306 - RNA, 14 nt, Human
ccuauaacuugaug

SEQ ID NO: 3884307 - RNA, 12 nt, Human
ccuauaaggaag

SEQ ID NO: 3884308 - RNA, 23 nt, Human
ccuauaaucugucaaaacacugu

SEQ ID NO: 3884309 - RNA, 12 nt, Human
ccuauaaugaag

SEQ ID NO: 3884310 - RNA, 14 nt, Human
ccuauaaugugugu

SEQ ID NO: 3884311 - RNA, 12 nt, Human
ccuauaccauuu

SEQ ID NO: 3884312 - RNA, 23 nt, Human
ccuauaccauuuccguaauucuu

SEQ ID NO: 3884313 - RNA, 20 nt, Human
ccuauaccccuuacuuagca

SEQ ID NO: 3884314 - RNA, 13 nt, Human
ccuauagucccag

SEQ ID NO: 3884315 - RNA, 13 nt, Human
ccuauauauuucu

SEQ ID NO: 3884316 - RNA, 18 nt, Human
ccuauauuguuuucagug

SEQ ID NO: 3884317 - RNA, 22 nt, Human
ccuauauuguuuucaguguaca

SEQ ID NO: 3884318 - RNA, 15 nt, Human
ccuauauuuacagug

SEQ ID NO: 3884319 - RNA, 14 nt, Human
ccuauauuuuccug

SEQ ID NO: 3884320 - RNA, 16 nt, Human
ccuaucaccuccccuc

SEQ ID NO: 3884321 - RNA, 21 nt, Human
ccuaucagccugucucuucca

SEQ ID NO: 3884322 - RNA, 12 nt, Human
ccuaucagugug

SEQ ID NO: 3884323 - RNA, 16 nt, Human
ccuaucagugugcccc

SEQ ID NO: 3884324 - RNA, 24 nt, Human
ccuaucagugugccccccauccug

SEQ ID NO: 3884325 - RNA, 13 nt, Human
ccuauccacccag

SEQ ID NO: 3884326 - RNA, 14 nt, Human
ccuauccacccagc

SEQ ID NO: 3884327 - RNA, 17 nt, Human
ccuauccacccagccca

SEQ ID NO: 3884328 - RNA, 13 nt, Human
ccuaucccaccuc

SEQ ID NO: 3884329 - RNA, 17 nt, Human
ccuauccgcugccagcc

SEQ ID NO: 3884330 - RNA, 18 nt, Human
ccuauccgcugccagccu

SEQ ID NO: 3884331 - RNA, 19 nt, Human
ccuauccugguuuuuguag

SEQ ID NO: 3884332 - RNA, 16 nt, Human
ccuauccuuggcacca

SEQ ID NO: 3884333 - RNA, 17 nt, Human
ccuauccuuggcaccaa

SEQ ID NO: 3884334 - RNA, 16 nt, Human
ccuaucuaucuuccaa

SEQ ID NO: 3884335 - RNA, 21 nt, Human
ccuaucuaucuuccaaaugca

SEQ ID NO: 3884336 - RNA, 16 nt, Human
ccuaucuccugacaga

SEQ ID NO: 3884337 - RNA, 16 nt, Human
ccuaucugggcuuccu

SEQ ID NO: 3884338 - RNA, 20 nt, Human
ccuaucugggcuuccuggag

SEQ ID NO: 3884339 - RNA, 22 nt, Human
ccuaucugggcuuccuggagca

SEQ ID NO: 3884340 - RNA, 13 nt, Human
ccuaucuuugcca

SEQ ID NO: 3884341 - RNA, 19 nt, Human
ccuaucuuugccacccuca

SEQ ID NO: 3884342 - RNA, 20 nt, Human
ccuaucuuugccacccucau

SEQ ID NO: 3884343 - RNA, 16 nt, Human
ccuaugaccauaaaau

SEQ ID NO: 3884344 - RNA, 16 nt, Human
ccuaugacuugggcac

SEQ ID NO: 3884345 - RNA, 15 nt, Human
ccuaugagcauccug

SEQ ID NO: 3884346 - RNA, 16 nt, Human
ccuaugagcauccuga

SEQ ID NO: 3884347 - RNA, 20 nt, Human
ccuaugagcauccugagccc

SEQ ID NO: 3884348 - RNA, 11 nt, Human
ccuaugaugua

SEQ ID NO: 3884349 - RNA, 15 nt, Human
ccuaugauguauacu

SEQ ID NO: 3884350 - RNA, 18 nt, Human
ccuaugauguauacugcc

SEQ ID NO: 3884351 - RNA, 14 nt, Human
ccuaugcacauaug

SEQ ID NO: 3884352 - RNA, 19 nt, Human
ccuaugcagagguccacaa

SEQ ID NO: 3884353 - RNA, 11 nt, Human
ccuaugcaugg

SEQ ID NO: 3884354 - RNA, 19 nt, Human
ccuaugcaugguuucagca

SEQ ID NO: 3884355 - RNA, 21 nt, Human
ccuaugcaugguuucagcacu

SEQ ID NO: 3884356 - RNA, 21 nt, Human
ccuaugcuauugacaauaaaa

SEQ ID NO: 3884357 - RNA, 22 nt, Human
ccuauggaaacccgaggguuga

SEQ ID NO: 3884358 - RNA, 16 nt, Human
ccuauggaauuuauaa

SEQ ID NO: 3884359 - RNA, 21 nt, Human
ccuauggagagcccugggacc

SEQ ID NO: 3884360 - RNA, 12 nt, Human
ccuauggccuca

SEQ ID NO: 3884361 - RNA, 19 nt, Human
ccuauggcuggccacugca

SEQ ID NO: 3884362 - RNA, 23 nt, Human
ccuauggcuggccacugcacaga

SEQ ID NO: 3884363 - RNA, 19 nt, Human
ccuaugggccugccgggcu

SEQ ID NO: 3884364 - RNA, 17 nt, Human
ccuauggggauggucca

SEQ ID NO: 3884365 - RNA, 22 nt, Human
ccuaugguauaaugguugacug

SEQ ID NO: 3884366 - RNA, 19 nt, Human
ccuauguagacaauauaag

SEQ ID NO: 3884367 - RNA, 18 nt, Human
ccuauguaguccgugcug

SEQ ID NO: 3884368 - RNA, 14 nt, Human
ccuauguccuaagg

SEQ ID NO: 3884369 - RNA, 19 nt, Human
ccuauguccuaaggacaca

SEQ ID NO: 3884370 - RNA, 23 nt, Human
ccuauguccuaaggacacacuaa

SEQ ID NO: 3884371 - RNA, 17 nt, Human
ccuaugugauuuuaacu

SEQ ID NO: 3884372 - RNA, 20 nt, Human
ccuaugugauuuuaacucug

SEQ ID NO: 3884373 - RNA, 23 nt, Human
ccuaugugauuuuaacucugucu

SEQ ID NO: 3884374 - RNA, 19 nt, Human
ccuauuaguguuauaugaa

SEQ ID NO: 3884375 - RNA, 14 nt, Human
ccuauucccacacc

SEQ ID NO: 3884376 - RNA, 22 nt, Human
ccuauucccacaccuccacagu

SEQ ID NO: 3884377 - RNA, 22 nt, Human
ccuauucuauugcaguuauaga

SEQ ID NO: 3884378 - RNA, 19 nt, Human
ccuauucucaccaggaagg

SEQ ID NO: 3884379 - RNA, 15 nt, Human
ccuauucucgggcug

SEQ ID NO: 3884380 - RNA, 15 nt, Human
ccuauucuuucgaaa

SEQ ID NO: 3884381 - RNA, 16 nt, Human
ccuauugcuagagcuc

SEQ ID NO: 3884382 - RNA, 12 nt, Human
ccuauuguugau

SEQ ID NO: 3884383 - RNA, 12 nt, Human
ccuauuucagaa

SEQ ID NO: 3884384 - RNA, 15 nt, Human
ccuauuucaucacaa

SEQ ID NO: 3884385 - RNA, 16 nt, Human
ccuauuuccagaaaua

SEQ ID NO: 3884386 - RNA, 15 nt, Human
ccuauuucucuuucu

SEQ ID NO: 3884387 - RNA, 14 nt, Human
ccuauuugacuuac

SEQ ID NO: 3884388 - RNA, 15 nt, Human
ccuauuuuuaaauaa

SEQ ID NO: 3884389 - RNA, 23 nt, Human
ccuauuuuugacauggaaaugaa

SEQ ID NO: 3884390 - RNA, 23 nt, Human
ccuauuuuuuuagauugagaaau

SEQ ID NO: 3884391 - RNA, 16 nt, Human
ccucaaaagcacccuu

SEQ ID NO: 3884392 - RNA, 21 nt, Human
ccucaaagcaagcauucagaa

SEQ ID NO: 3884393 - RNA, 15 nt, Human
ccucaaagcuuccau

SEQ ID NO: 3884394 - RNA, 21 nt, Human
ccucaaauaaaaagugcuuuu

SEQ ID NO: 3884395 - RNA, 16 nt, Human
ccucaaauccaggacc

SEQ ID NO: 3884396 - RNA, 16 nt, Human
ccucaaaugacccaaa

SEQ ID NO: 3884397 - RNA, 16 nt, Human
ccucaacaagggagag

SEQ ID NO: 3884398 - RNA, 18 nt, Human
ccucaacaagggagagac

SEQ ID NO: 3884399 - RNA, 21 nt, Human
ccucaacaagggagagaccuc

SEQ ID NO: 3884400 - RNA, 14 nt, Human
ccucaaccccuccc

SEQ ID NO: 3884401 - RNA, 19 nt, Human
ccucaacccucccucagcc

SEQ ID NO: 3884402 - RNA, 22 nt, Human
ccucaacccucccucagccccu

SEQ ID NO: 3884403 - RNA, 12 nt, Human
ccucaaccuccu

SEQ ID NO: 3884404 - RNA, 15 nt, Human
ccucaaccuccuggg

SEQ ID NO: 3884405 - RNA, 13 nt, Human
ccucaaccuguga

SEQ ID NO: 3884406 - RNA, 18 nt, Human
ccucaacguauuguuucg

SEQ ID NO: 3884407 - RNA, 22 nt, Human
ccucagggagcagggaaggccu

SEQ ID NO: 3884408 - RNA, 15 nt, Human
ccucagggcaaagcc

SEQ ID NO: 3884409 - RNA, 17 nt, Human
ccucagggcaaagccag

SEQ ID NO: 3884410 - RNA, 15 nt, Human
ccucagggcucccag

SEQ ID NO: 3884411 - RNA, 16 nt, Human
ccucagggcuccuugu

SEQ ID NO: 3884412 - RNA, 22 nt, Human
ccucagguaaucgaccugccuc

SEQ ID NO: 3884413 - RNA, 19 nt, Human
ccucaggucagggugagga

SEQ ID NO: 3884414 - RNA, 18 nt, Human
ccucaggugagaagcaga

SEQ ID NO: 3884415 - RNA, 16 nt, Human
ccucagguggccaugc

SEQ ID NO: 3884416 - RNA, 24 nt, Human
ccucagguguuuuuuaugaagugc

SEQ ID NO: 3884417 - RNA, 23 nt, Human
ccucagguuccuauggcuggcca

SEQ ID NO: 3884418 - RNA, 17 nt, Human
ccucagguugcugguug

SEQ ID NO: 3884419 - RNA, 18 nt, Human
ccucagguugcugguugc

SEQ ID NO: 3884420 - RNA, 15 nt, Human
ccucaguaagacgac

SEQ ID NO: 3884421 - RNA, 21 nt, Human
ccucaguaaguaucuggagga

SEQ ID NO: 3884422 - RNA, 19 nt, Human
ccucaguagucccugcaca

SEQ ID NO: 3884423 - RNA, 15 nt, Human
ccucaguauauuuaa

SEQ ID NO: 3884424 - RNA, 16 nt, Human
ccucaguccauuuaua

SEQ ID NO: 3884425 - RNA, 18 nt, Human
ccucaguccauuuauaua

SEQ ID NO: 3884426 - RNA, 20 nt, Human
ccucaguccauuuauauaug

SEQ ID NO: 3884427 - RNA, 16 nt, Human
ccucaguccuccccuc

SEQ ID NO: 3884428 - RNA, 19 nt, Human
ccucagucuggcccuuccu

SEQ ID NO: 3884429 - RNA, 18 nt, Human
ccucagugacccuggcuc

SEQ ID NO: 3884430 - RNA, 23 nt, Human
ccucaguggacuuuccacccccu

SEQ ID NO: 3884431 - RNA, 12 nt, Human
ccucagugucau

SEQ ID NO: 3884432 - RNA, 21 nt, Human
ccucaguucccuuggccucag

SEQ ID NO: 3884433 - RNA, 19 nt, Human
ccucaguucuugccacuuu

SEQ ID NO: 3884434 - RNA, 15 nt, Human
ccucaguugugcagc

SEQ ID NO: 3884435 - RNA, 17 nt, Human
ccucaguugugcagcuu

SEQ ID NO: 3884436 - RNA, 22 nt, Human
ccucauaguaugguggcugggu

SEQ ID NO: 3884437 - RNA, 12 nt, Human
ccucauauuuaa

SEQ ID NO: 3884438 - RNA, 13 nt, Human
ccucauauuuaaa

SEQ ID NO: 3884439 - RNA, 16 nt, Human
ccucaucaaggacacg

SEQ ID NO: 3884440 - RNA, 15 nt, Human
ccucaucaggaugaa

SEQ ID NO: 3884441 - RNA, 22 nt, Human
ccucauccaccccaucccuccc

SEQ ID NO: 3884442 - RNA, 14 nt, Human
ccucauccagggcu

SEQ ID NO: 3884443 - RNA, 15 nt, Human
ccucauccagggcuc

SEQ ID NO: 3884444 - RNA, 20 nt, Human
ccucaucccgagcaccucca

SEQ ID NO: 3884445 - RNA, 15 nt, Human
ccucauccgaggcag

SEQ ID NO: 3884446 - RNA, 13 nt, Human
ccucaucucauuc

SEQ ID NO: 3884447 - RNA, 21 nt, Human
ccucaucuccccaucauuggu

SEQ ID NO: 3884448 - RNA, 17 nt, Human
ccucaucucucugccca

SEQ ID NO: 3884449 - RNA, 13 nt, Human
ccucaucugcuca

SEQ ID NO: 3884450 - RNA, 17 nt, Human
ccucaucugucccuccg

SEQ ID NO: 3884451 - RNA, 17 nt, Human
ccucaucuucuucacca

SEQ ID NO: 3884452 - RNA, 20 nt, Human
ccucaucuugaagggcccag

SEQ ID NO: 3884453 - RNA, 23 nt, Human
ccucaugaauguaaauuuguacu

SEQ ID NO: 3884454 - RNA, 18 nt, Human
ccucaugcaucuccaccu

SEQ ID NO: 3884455 - RNA, 21 nt, Human
ccucaugcugccaauauccua

SEQ ID NO: 3884456 - RNA, 23 nt, Human
ccucauggaauuggagcucgugg

SEQ ID NO: 3884457 - RNA, 16 nt, Human
ccucauggccccucug

SEQ ID NO: 3884458 - RNA, 22 nt, Human
ccucauggccccucugaccugc

SEQ ID NO: 3884459 - RNA, 18 nt, Human
ccucaugugaucacaauu

SEQ ID NO: 3884460 - RNA, 12 nt, Human
ccucauuaaauu

SEQ ID NO: 3884461 - RNA, 17 nt, Human
ccucauuaaugacacuu

SEQ ID NO: 3884462 - RNA, 19 nt, Human
ccucauuacggcuccucuc

SEQ ID NO: 3884463 - RNA, 15 nt, Human
ccucauucaggaaaa

SEQ ID NO: 3884464 - RNA, 21 nt, Human
ccucauuccaccuucccaugc

SEQ ID NO: 3884465 - RNA, 15 nt, Human
ccuccaaaagcacuu

SEQ ID NO: 3884466 - RNA, 17 nt, Human
ccuccaaaaugugccua

SEQ ID NO: 3884467 - RNA, 19 nt, Human
ccuccaaagcuucccacgg

SEQ ID NO: 3884468 - RNA, 19 nt, Human
ccuccaaauggagaagcug

SEQ ID NO: 3884469 - RNA, 12 nt, Human
ccuccaacccug

SEQ ID NO: 3884470 - RNA, 14 nt, Human
ccuccaacccugcc

SEQ ID NO: 3884471 - RNA, 16 nt, Human
ccuccaagaccuucuc

SEQ ID NO: 3884472 - RNA, 19 nt, Human
ccuccaagaccuucuccuu

SEQ ID NO: 3884473 - RNA, 20 nt, Human
ccuccaagaccuucuccuuc

SEQ ID NO: 3884474 - RNA, 11 nt, Human
ccuccaagccu

SEQ ID NO: 3884475 - RNA, 21 nt, Human
ccuccaaguccacaguggaac

SEQ ID NO: 3884476 - RNA, 16 nt, Human
ccuccaauccugcccc

SEQ ID NO: 3884477 - RNA, 14 nt, Human
ccuccacaccugcg

SEQ ID NO: 3884478 - RNA, 16 nt, Human
ccuccacaccugcggc

SEQ ID NO: 3884479 - RNA, 17 nt, Human
ccuccacaccugcggcc

SEQ ID NO: 3884480 - RNA, 15 nt, Human
ccuccacagccgcag

SEQ ID NO: 3884481 - RNA, 14 nt, Human
ccuccacagcgagg

SEQ ID NO: 3884482 - RNA, 20 nt, Human
ccuccacagcgagggcagcu

SEQ ID NO: 3884483 - RNA, 16 nt, Human
ccuccacauccuccac

SEQ ID NO: 3884484 - RNA, 15 nt, Human
ccuccaccaccacug

SEQ ID NO: 3884485 - RNA, 21 nt, Human
ccuccaccaccacuggccacc

SEQ ID NO: 3884486 - RNA, 14 nt, Human
ccuccaccccagga

SEQ ID NO: 3884487 - RNA, 15 nt, Human
ccuccaccccaggac

SEQ ID NO: 3884488 - RNA, 13 nt, Human
ccuccacccucug

SEQ ID NO: 3884489 - RNA, 22 nt, Human
ccuccacccucugagcuuugca

SEQ ID NO: 3884490 - RNA, 18 nt, Human
ccuccaccgcagaaggaa

SEQ ID NO: 3884491 - RNA, 13 nt, Human
ccuccaccucccu

SEQ ID NO: 3884492 - RNA, 22 nt, Human
ccuccaccucccugcaauaaaa

SEQ ID NO: 3884493 - RNA, 21 nt, Human
ccuccaccuuccauuuucccc

SEQ ID NO: 3884494 - RNA, 14 nt, Human
ccuccacucucccc

SEQ ID NO: 3884495 - RNA, 13 nt, Human
ccuccacugcccu

SEQ ID NO: 3884496 - RNA, 15 nt, Human
ccuccacugcccucu

SEQ ID NO: 3884497 - RNA, 12 nt, Human
ccuccacuguca

SEQ ID NO: 3884498 - RNA, 13 nt, Human
ccuccacugucac

SEQ ID NO: 3884499 - RNA, 21 nt, Human
ccuccagaacucacuggggcc

SEQ ID NO: 3884500 - RNA, 22 nt, Human
ccuccagaacucacuggggccu

SEQ ID NO: 3884501 - RNA, 18 nt, Human
ccuccagaagccucuggc

SEQ ID NO: 3884502 - RNA, 21 nt, Human
ccuccagaagccucuggcuag

SEQ ID NO: 3884503 - RNA, 18 nt, Human
ccuccagagccccacagc

SEQ ID NO: 3884504 - RNA, 12 nt, Human
ccuccagccccu

SEQ ID NO: 3884505 - RNA, 15 nt, Human
ccuccagccccuguc

SEQ ID NO: 3884506 - RNA, 18 nt, Human
ccuccagccccuguccca

SEQ ID NO: 3884507 - RNA, 21 nt, Human
ccuccagccccugucccaccc

SEQ ID NO: 3884508 - RNA, 16 nt, Human
ccuccagcccgggagc

SEQ ID NO: 3884509 - RNA, 18 nt, Human
ccuccagcccgggagccu

SEQ ID NO: 3884510 - RNA, 19 nt, Human
ccuccagcccgggagccua

SEQ ID NO: 3884511 - RNA, 21 nt, Human
ccuccagccugcccaagccca

SEQ ID NO: 3884512 - RNA, 14 nt, Human
ccuccagcugcacc

SEQ ID NO: 3884513 - RNA, 16 nt, Human
ccuccagcugcaccag

SEQ ID NO: 3884514 - RNA, 20 nt, Human
ccuccagcuucaggcaggcc

SEQ ID NO: 3884515 - RNA, 19 nt, Human
ccuccagcuuguggagccc

SEQ ID NO: 3884516 - RNA, 22 nt, Human
ccuccagcuuguggagccccac

SEQ ID NO: 3884517 - RNA, 15 nt, Human
ccuccaggaaccaca

SEQ ID NO: 3884518 - RNA, 23 nt, Human
ccuccaggagcuucuuguuuccu

SEQ ID NO: 3884519 - RNA, 18 nt, Human
ccuccaggccugccuccc

SEQ ID NO: 3884520 - RNA, 19 nt, Human
ccuccagggccacgugcca

SEQ ID NO: 3884521 - RNA, 21 nt, Human
ccuccagggccacgugccagg

SEQ ID NO: 3884522 - RNA, 20 nt, Human
ccuccaggguggcagcaaca

SEQ ID NO: 3884523 - RNA, 21 nt, Human
ccuccaggguggcagcaacaa

SEQ ID NO: 3884524 - RNA, 14 nt, Human
ccuccaggugugca

SEQ ID NO: 3884525 - RNA, 17 nt, Human
ccuccagguuuuucaau

SEQ ID NO: 3884526 - RNA, 20 nt, Human
ccuccagguuuuucaauuaa

SEQ ID NO: 3884527 - RNA, 22 nt, Human
ccuccagguuuuucaauuaaac

SEQ ID NO: 3884528 - RNA, 16 nt, Human
ccuccaguaccuugcu

SEQ ID NO: 3884529 - RNA, 14 nt, Human
ccuccaucccgaca

SEQ ID NO: 3884530 - RNA, 15 nt, Human
ccuccaucccgacau

SEQ ID NO: 3884531 - RNA, 14 nt, Human
ccuccaucccuggc

SEQ ID NO: 3884532 - RNA, 17 nt, Human
ccuccaucccuggcccc

SEQ ID NO: 3884533 - RNA, 17 nt, Human
ccuccauccuacccccu

SEQ ID NO: 3884534 - RNA, 21 nt, Human
ccuccauccuauccacugggc

SEQ ID NO: 3884535 - RNA, 13 nt, Human
ccuccauccugag

SEQ ID NO: 3884536 - RNA, 21 nt, Human
ccuccaucuguacuuggucca

SEQ ID NO: 3884537 - RNA, 15 nt, Human
ccuccaugcugccuc

SEQ ID NO: 3884538 - RNA, 11 nt, Human
ccuccauggga

SEQ ID NO: 3884539 - RNA, 12 nt, Human
ccuccaugggcc

SEQ ID NO: 3884540 - RNA, 18 nt, Human
ccuccauggugccucugg

SEQ ID NO: 3884541 - RNA, 12 nt, Human
ccuccauguggg

SEQ ID NO: 3884542 - RNA, 20 nt, Human
ccuccauuccuggagcccga

SEQ ID NO: 3884543 - RNA, 16 nt, Human
ccucccaaagugcugg

SEQ ID NO: 3884544 - RNA, 23 nt, Human
ccucccaaagugcugggauuaca

SEQ ID NO: 3884545 - RNA, 14 nt, Human
ccucccaacucacc

SEQ ID NO: 3884546 - RNA, 17 nt, Human
ccucccaacucacccca

SEQ ID NO: 3884547 - RNA, 21 nt, Human
ccucccaacucaccccagccc

SEQ ID NO: 3884548 - RNA, 23 nt, Human
ccucccaacucaccccagcccca

SEQ ID NO: 3884549 - RNA, 14 nt, Human
ccucccaagcaguu

SEQ ID NO: 3884550 - RNA, 23 nt, Human
ccucccaaggagaacaaauauuc

SEQ ID NO: 3884551 - RNA, 21 nt, Human
ccuggccuauccgcugccagc

SEQ ID NO: 3884552 - RNA, 22 nt, Human
ccuggccucagacugcacccag

SEQ ID NO: 3884553 - RNA, 11 nt, Human
ccuggccucca

SEQ ID NO: 3884554 - RNA, 19 nt, Human
ccuggccuccaggcccguc

SEQ ID NO: 3884555 - RNA, 14 nt, Human
ccuggccuccccca

SEQ ID NO: 3884556 - RNA, 17 nt, Human
ccuggccucccccacuu

SEQ ID NO: 3884557 - RNA, 18 nt, Human
ccuggccuccccugccac

SEQ ID NO: 3884558 - RNA, 23 nt, Human
ccuggccuccggcgucagccucc

SEQ ID NO: 3884559 - RNA, 13 nt, Human
ccuggccuccugc

SEQ ID NO: 3884560 - RNA, 15 nt, Human
ccuggccuccugccu

SEQ ID NO: 3884561 - RNA, 21 nt, Human
ccuggccuccugccucuacug

SEQ ID NO: 3884562 - RNA, 14 nt, Human
ccuggccucugcac

SEQ ID NO: 3884563 - RNA, 15 nt, Human
ccuggccucugcacu

SEQ ID NO: 3884564 - RNA, 21 nt, Human
ccuggccucugcacuccccug

SEQ ID NO: 3884565 - RNA, 22 nt, Human
ccuggccucugcacuccccugc

SEQ ID NO: 3884566 - RNA, 15 nt, Human
ccuggccugagcugg

SEQ ID NO: 3884567 - RNA, 20 nt, Human
ccuggccugagcugggauga

SEQ ID NO: 3884568 - RNA, 12 nt, Human
ccuggccugcug

SEQ ID NO: 3884569 - RNA, 16 nt, Human
ccuggccuggcacaca

SEQ ID NO: 3884570 - RNA, 19 nt, Human
ccuggccuggcacacauca

SEQ ID NO: 3884571 - RNA, 14 nt, Human
ccuggccuggcccu

SEQ ID NO: 3884572 - RNA, 22 nt, Human
ccuggccuuguccucagccagu

SEQ ID NO: 3884573 - RNA, 20 nt, Human
ccuggcgacugccccugccu

SEQ ID NO: 3884574 - RNA, 22 nt, Human
ccuggcgcaggugggcuggacu

SEQ ID NO: 3884575 - RNA, 18 nt, Human
ccuggcggccccaacucg

SEQ ID NO: 3884576 - RNA, 13 nt, Human
ccuggcgggaugg

SEQ ID NO: 3884577 - RNA, 22 nt, Human
ccuggcuaauaaggcuuuagug

SEQ ID NO: 3884578 - RNA, 17 nt, Human
ccuggcucagagccagu

SEQ ID NO: 3884579 - RNA, 22 nt, Human
ccuggcuccaaacccucgaggc

SEQ ID NO: 3884580 - RNA, 15 nt, Human
ccuggcuccaggcca

SEQ ID NO: 3884581 - RNA, 16 nt, Human
ccuggcuccaggccag

SEQ ID NO: 3884582 - RNA, 17 nt, Human
ccuggcuccaggccagg

SEQ ID NO: 3884583 - RNA, 18 nt, Human
ccuggcucccacaggcag

SEQ ID NO: 3884584 - RNA, 19 nt, Human
ccuggcucccacaggcagc

SEQ ID NO: 3884585 - RNA, 17 nt, Human
ccuggcucccacaggcc

SEQ ID NO: 3884586 - RNA, 15 nt, Human
ccuggcucccaggac

SEQ ID NO: 3884587 - RNA, 14 nt, Human
ccuggcucccauga

SEQ ID NO: 3884588 - RNA, 21 nt, Human
ccuggcucccaugaccauacu

SEQ ID NO: 3884589 - RNA, 14 nt, Human
ccuggcucccucac

SEQ ID NO: 3884590 - RNA, 12 nt, Human
ccuggcuccgcu

SEQ ID NO: 3884591 - RNA, 20 nt, Human
ccuggcuccuugugccagag

SEQ ID NO: 3884592 - RNA, 14 nt, Human
ccuggcucucaccu

SEQ ID NO: 3884593 - RNA, 15 nt, Human
ccuggcucucaccuc

SEQ ID NO: 3884594 - RNA, 21 nt, Human
ccuggcucucaccucuagguc

SEQ ID NO: 3884595 - RNA, 15 nt, Human
ccuggcucugcuguc

SEQ ID NO: 3884596 - RNA, 12 nt, Human
ccuggcucugug

SEQ ID NO: 3884597 - RNA, 20 nt, Human
ccuggcucuguggcuugcua

SEQ ID NO: 3884598 - RNA, 20 nt, Human
ccuggcucuugugcuggaug

SEQ ID NO: 3884599 - RNA, 14 nt, Human
ccuggcugaaggac

SEQ ID NO: 3884600 - RNA, 16 nt, Human
ccuggcugagguuccu

SEQ ID NO: 3884601 - RNA, 12 nt, Human
ccuggcugcccu

SEQ ID NO: 3884602 - RNA, 13 nt, Human
ccuggcugcccug

SEQ ID NO: 3884603 - RNA, 18 nt, Human
ccuggcugcccuggcccu

SEQ ID NO: 3884604 - RNA, 20 nt, Human
ccuggcugcccuggcccuga

SEQ ID NO: 3884605 - RNA, 22 nt, Human
ccuggcugcggggcgggcacac

SEQ ID NO: 3884606 - RNA, 20 nt, Human
ccuggcugcugaucgccuuc

SEQ ID NO: 3884607 - RNA, 14 nt, Human
ccuggcugcugccc

SEQ ID NO: 3884608 - RNA, 16 nt, Human
ccuggcugcugccccc

SEQ ID NO: 3884609 - RNA, 17 nt, Human
ccuggcugcugccccca

SEQ ID NO: 3884610 - RNA, 21 nt, Human
ccuggcuggagaauguggaga

SEQ ID NO: 3884611 - RNA, 19 nt, Human
ccuggcuggcugagggcag

SEQ ID NO: 3884612 - RNA, 24 nt, Human
ccuggcugggacguggcucagcca

SEQ ID NO: 3884613 - RNA, 18 nt, Human
ccuggcugggacugggaa

SEQ ID NO: 3884614 - RNA, 22 nt, Human
ccuggcugguaagggccaaguc

SEQ ID NO: 3884615 - RNA, 13 nt, Human
ccuggcuguacug

SEQ ID NO: 3884616 - RNA, 13 nt, Human
ccuggcuucuccu

SEQ ID NO: 3884617 - RNA, 15 nt, Human
ccuggcuucuggagc

SEQ ID NO: 3884618 - RNA, 22 nt, Human
ccuggcuucuggagcccuuggg

SEQ ID NO: 3884619 - RNA, 18 nt, Human
ccuggcuuguaacuccac

SEQ ID NO: 3884620 - RNA, 16 nt, Human
ccuggcuuguuuauuu

SEQ ID NO: 3884621 - RNA, 21 nt, Human
ccuggcuuucauuuucucuca

SEQ ID NO: 3884622 - RNA, 16 nt, Human
ccuggcuuugcccaac

SEQ ID NO: 3884623 - RNA, 17 nt, Human
ccuggcuuugcccaacc

SEQ ID NO: 3884624 - RNA, 21 nt, Human
ccuggcuuuucacugcuggcu

SEQ ID NO: 3884625 - RNA, 22 nt, Human
ccuggcuuuucacugcuggcug

SEQ ID NO: 3884626 - RNA, 24 nt, Human
ccuggcuuuucacugcuggcugcc

SEQ ID NO: 3884627 - RNA, 18 nt, Human
ccugggaaauauucccua

SEQ ID NO: 3884628 - RNA, 22 nt, Human
ccugggaaggccucuuggagac

SEQ ID NO: 3884629 - RNA, 14 nt, Human
ccugggaauguauu

SEQ ID NO: 3884630 - RNA, 18 nt, Human
ccugggacaacugcuccc

SEQ ID NO: 3884631 - RNA, 19 nt, Human
ccugggacaacugcuccca

SEQ ID NO: 3884632 - RNA, 23 nt, Human
ccugggacaacugcucccaccuc

SEQ ID NO: 3884633 - RNA, 23 nt, Human
ccugggaccgcuacaccacucug

SEQ ID NO: 3884634 - RNA, 19 nt, Human
ccugggaccuccccugagg

SEQ ID NO: 3884635 - RNA, 22 nt, Human
ccugggagaaucgcuccugcag

SEQ ID NO: 3884636 - RNA, 14 nt, Human
ccugggagacagac

SEQ ID NO: 3884637 - RNA, 12 nt, Human
ccugggaggaga

SEQ ID NO: 3884638 - RNA, 16 nt, Human
ccugggaggcacagca

SEQ ID NO: 3884639 - RNA, 14 nt, Human
ccugggaggcggag

SEQ ID NO: 3884640 - RNA, 18 nt, Human
ccugggaguggguggagg

SEQ ID NO: 3884641 - RNA, 18 nt, Human
ccugggauaggggcagag

SEQ ID NO: 3884642 - RNA, 23 nt, Human
ccugggauaggggcagaggaggc

SEQ ID NO: 3884643 - RNA, 13 nt, Human
ccugggcaaagcc

SEQ ID NO: 3884644 - RNA, 18 nt, Human
ccugggcacacgcugcuc

SEQ ID NO: 3884645 - RNA, 19 nt, Human
ccugggcacacgcugcucu

SEQ ID NO: 3884646 - RNA, 17 nt, Human
ccugggcaccuggggag

SEQ ID NO: 3884647 - RNA, 13 nt, Human
ccugggcagaaag

SEQ ID NO: 3884648 - RNA, 14 nt, Human
ccugggcagaagga

SEQ ID NO: 3884649 - RNA, 17 nt, Human
ccugggcagccaggcug

SEQ ID NO: 3884650 - RNA, 23 nt, Human
ccugggcagccaggcugccaagg

SEQ ID NO: 3884651 - RNA, 13 nt, Human
ccugggcagcugc

SEQ ID NO: 3884652 - RNA, 16 nt, Human
ccugggcagcugccuc

SEQ ID NO: 3884653 - RNA, 17 nt, Human
ccugggcagcugccucc

SEQ ID NO: 3884654 - RNA, 20 nt, Human
ccugggcagcugccuccccu

SEQ ID NO: 3884655 - RNA, 22 nt, Human
ccugggcagcugccuccccucc

SEQ ID NO: 3884656 - RNA, 14 nt, Human
ccugggcaggaggg

SEQ ID NO: 3884657 - RNA, 14 nt, Human
ccugggcauugcuu

SEQ ID NO: 3884658 - RNA, 23 nt, Human
ccugggccacagggcgagacucc

SEQ ID NO: 3884659 - RNA, 17 nt, Human
ccugggcccaucucccu

SEQ ID NO: 3884660 - RNA, 18 nt, Human
ccugggcccaucucccug

SEQ ID NO: 3884661 - RNA, 20 nt, Human
ccugggcccaucucccugcu

SEQ ID NO: 3884662 - RNA, 22 nt, Human
ccugggcccaucucccugcuuu

SEQ ID NO: 3884663 - RNA, 15 nt, Human
ccugggccccaccac

SEQ ID NO: 3884664 - RNA, 23 nt, Human
ccugggccccaccaccuaggcca

SEQ ID NO: 3884665 - RNA, 22 nt, Human
ccugggccccucaucugcucag

SEQ ID NO: 3884666 - RNA, 19 nt, Human
ccugggccccucccuaccu

SEQ ID NO: 3884667 - RNA, 22 nt, Human
ccugggccccucccuaccucaa

SEQ ID NO: 3884668 - RNA, 14 nt, Human
ccugggcccucucu

SEQ ID NO: 3884669 - RNA, 15 nt, Human
ccugggcccucucug

SEQ ID NO: 3884670 - RNA, 14 nt, Human
ccugggcccugggc

SEQ ID NO: 3884671 - RNA, 15 nt, Human
ccugggcccugggcu

SEQ ID NO: 3884672 - RNA, 18 nt, Human
ccugggcccugggcugga

SEQ ID NO: 3884673 - RNA, 15 nt, Human
ccugggcccuggggc

SEQ ID NO: 3884674 - RNA, 22 nt, Human
ccugggcccuggggccuguacu

SEQ ID NO: 3884675 - RNA, 16 nt, Human
ccugggccgcugccac

SEQ ID NO: 3884676 - RNA, 18 nt, Human
ccugggccuauggagagc

SEQ ID NO: 3884677 - RNA, 22 nt, Human
ccugggccuauggagagcccug

SEQ ID NO: 3884678 - RNA, 23 nt, Human
ccugggccuauggagagcccugg

SEQ ID NO: 3884679 - RNA, 17 nt, Human
ccugggccugcugcuga

SEQ ID NO: 3884680 - RNA, 12 nt, Human
ccugggccuggc

SEQ ID NO: 3884681 - RNA, 17 nt, Human
ccugggccuugggcucc

SEQ ID NO: 3884682 - RNA, 18 nt, Human
ccugggccuugggcuccg

SEQ ID NO: 3884683 - RNA, 17 nt, Human
ccugggcgcccuggaag

SEQ ID NO: 3884684 - RNA, 24 nt, Human
ccugggcucugccccagcucuggc

SEQ ID NO: 3884685 - RNA, 18 nt, Human
ccugggcucugggagcag

SEQ ID NO: 3884686 - RNA, 12 nt, Human
ccugggcucugu

SEQ ID NO: 3884687 - RNA, 22 nt, Human
ccugggcucugugggcugcacu

SEQ ID NO: 3884688 - RNA, 13 nt, Human
ccugggcugggaa

SEQ ID NO: 3884689 - RNA, 13 nt, Human
ccugggcugugcu

SEQ ID NO: 3884690 - RNA, 20 nt, Human
ccugggcuguuggcacucac

SEQ ID NO: 3884691 - RNA, 22 nt, Human
ccugggcuguuggcacucacag

SEQ ID NO: 3884692 - RNA, 19 nt, Human
ccugggcuuggccugcugu

SEQ ID NO: 3884693 - RNA, 22 nt, Human
ccugggcuuuuguuuugcuuuu

SEQ ID NO: 3884694 - RNA, 13 nt, Human
ccuggggaaggag

SEQ ID NO: 3884695 - RNA, 15 nt, Human
ccugugccugacccu

SEQ ID NO: 3884696 - RNA, 19 nt, Human
ccugugcuacuuugccuuu

SEQ ID NO: 3884697 - RNA, 15 nt, Human
ccugugcucagcccu

SEQ ID NO: 3884698 - RNA, 16 nt, Human
ccugugcucagcccug

SEQ ID NO: 3884699 - RNA, 17 nt, Human
ccugugcuccgugccuc

SEQ ID NO: 3884700 - RNA, 19 nt, Human
ccugugcuccgugccucca

SEQ ID NO: 3884701 - RNA, 21 nt, Human
ccugugcugcccgucuucagc

SEQ ID NO: 3884702 - RNA, 12 nt, Human
ccugugcuggug

SEQ ID NO: 3884703 - RNA, 17 nt, Human
ccugugcugguguccug

SEQ ID NO: 3884704 - RNA, 17 nt, Human
ccuguggaacccagcag

SEQ ID NO: 3884705 - RNA, 22 nt, Human
ccuguggaacccagcaguucug

SEQ ID NO: 3884706 - RNA, 19 nt, Human
ccuguggaaggcagagaaa

SEQ ID NO: 3884707 - RNA, 24 nt, Human
ccuguggaagggacuaggagcacu

SEQ ID NO: 3884708 - RNA, 19 nt, Human
ccuguggaaucuggaguga

SEQ ID NO: 3884709 - RNA, 16 nt, Human
ccuguggagcucagcc

SEQ ID NO: 3884710 - RNA, 17 nt, Human
ccuguggagcucagccc

SEQ ID NO: 3884711 - RNA, 12 nt, Human
ccuguggauauu

SEQ ID NO: 3884712 - RNA, 19 nt, Human
ccuguggcaggcagcgcca

SEQ ID NO: 3884713 - RNA, 18 nt, Human
ccuguggcaguaaagaga

SEQ ID NO: 3884714 - RNA, 18 nt, Human
ccuguggcauaaauugca

SEQ ID NO: 3884715 - RNA, 17 nt, Human
ccuguggccaugacccu

SEQ ID NO: 3884716 - RNA, 22 nt, Human
ccuguggccaugacccugccuc

SEQ ID NO: 3884717 - RNA, 23 nt, Human
ccuguggccaugacccugccucu

SEQ ID NO: 3884718 - RNA, 15 nt, Human
ccuguggccccaccc

SEQ ID NO: 3884719 - RNA, 18 nt, Human
ccuguggccccacccugg

SEQ ID NO: 3884720 - RNA, 20 nt, Human
ccuguggccccacccugggc

SEQ ID NO: 3884721 - RNA, 13 nt, Human
ccuguggcccugu

SEQ ID NO: 3884722 - RNA, 22 nt, Human
ccuguggcccuguccugccaug

SEQ ID NO: 3884723 - RNA, 15 nt, Human
ccuguggccugccag

SEQ ID NO: 3884724 - RNA, 16 nt, Human
ccuguggccugccagu

SEQ ID NO: 3884725 - RNA, 15 nt, Human
ccuguggccuguguc

SEQ ID NO: 3884726 - RNA, 18 nt, Human
ccuguggcggugccuggg

SEQ ID NO: 3884727 - RNA, 19 nt, Human
ccuguggcggugccugggu

SEQ ID NO: 3884728 - RNA, 23 nt, Human
ccuguggcucuacaacugagucc

SEQ ID NO: 3884729 - RNA, 19 nt, Human
ccugugggaccccaggccc

SEQ ID NO: 3884730 - RNA, 14 nt, Human
ccugugggagccug

SEQ ID NO: 3884731 - RNA, 15 nt, Human
ccugugggagccugc

SEQ ID NO: 3884732 - RNA, 22 nt, Human
ccuguggggaucucaggggcug

SEQ ID NO: 3884733 - RNA, 22 nt, Human
ccugugggggaagagcacagcc

SEQ ID NO: 3884734 - RNA, 16 nt, Human
ccuguggucacugacu

SEQ ID NO: 3884735 - RNA, 12 nt, Human
ccuguggugcaa

SEQ ID NO: 3884736 - RNA, 20 nt, Human
ccugugguuuccaaggagcu

SEQ ID NO: 3884737 - RNA, 13 nt, Human
ccuguguaacagc

SEQ ID NO: 3884738 - RNA, 15 nt, Human
ccuguguaacagcuc

SEQ ID NO: 3884739 - RNA, 15 nt, Human
ccuguguagcuguga

SEQ ID NO: 3884740 - RNA, 19 nt, Human
ccuguguagcugugaccug

SEQ ID NO: 3884741 - RNA, 22 nt, Human
ccuguguagcugugaccugcug

SEQ ID NO: 3884742 - RNA, 23 nt, Human
ccuguguagcugugaccugcuga

SEQ ID NO: 3884743 - RNA, 14 nt, Human
ccuguguauggaaa

SEQ ID NO: 3884744 - RNA, 20 nt, Human
ccuguguauggaaaaaccau

SEQ ID NO: 3884745 - RNA, 21 nt, Human
ccugugucaauccagauggug

SEQ ID NO: 3884746 - RNA, 22 nt, Human
ccugugucaguuuauguuuugg

SEQ ID NO: 3884747 - RNA, 19 nt, Human
ccuguguccaugcgcucag

SEQ ID NO: 3884748 - RNA, 21 nt, Human
ccuguguccaugugaucucau

SEQ ID NO: 3884749 - RNA, 13 nt, Human
ccugugucccaug

SEQ ID NO: 3884750 - RNA, 14 nt, Human
ccugugucccauga

SEQ ID NO: 3884751 - RNA, 19 nt, Human
ccugugucccaugacccac

SEQ ID NO: 3884752 - RNA, 21 nt, Human
ccugugucccaugacccaccc

SEQ ID NO: 3884753 - RNA, 22 nt, Human
ccugugucccaugacccacccc

SEQ ID NO: 3884754 - RNA, 23 nt, Human
ccugugucugcgaaguccuaugg

SEQ ID NO: 3884755 - RNA, 23 nt, Human
ccugugucuucuccaccacgcug

SEQ ID NO: 3884756 - RNA, 18 nt, Human
ccugugugauugacagcu

SEQ ID NO: 3884757 - RNA, 15 nt, Human
ccugugugcuugguc

SEQ ID NO: 3884758 - RNA, 15 nt, Human
ccuguguggagaggg

SEQ ID NO: 3884759 - RNA, 21 nt, Human
ccuguguggagagggaaugug

SEQ ID NO: 3884760 - RNA, 22 nt, Human
ccuguguggagagggaauguga

SEQ ID NO: 3884761 - RNA, 20 nt, Human
ccuguguggccacuucuguc

SEQ ID NO: 3884762 - RNA, 19 nt, Human
ccugugugguacucugaaa

SEQ ID NO: 3884763 - RNA, 19 nt, Human
ccuguguguacucugucca

SEQ ID NO: 3884764 - RNA, 21 nt, Human
ccuguguguccaaaacugccu

SEQ ID NO: 3884765 - RNA, 20 nt, Human
ccuguguguuaagcucugcu

SEQ ID NO: 3884766 - RNA, 13 nt, Human
ccuguguuaauuu

SEQ ID NO: 3884767 - RNA, 23 nt, Human
ccuguguuaauuuaaguuuugac

SEQ ID NO: 3884768 - RNA, 19 nt, Human
ccuguguucuuccuggccg

SEQ ID NO: 3884769 - RNA, 13 nt, Human
ccuguguuucuag

SEQ ID NO: 3884770 - RNA, 18 nt, Human
ccuguguuucuugccuca

SEQ ID NO: 3884771 - RNA, 20 nt, Human
ccuguuaauguauuuguuca

SEQ ID NO: 3884772 - RNA, 21 nt, Human
ccuguuaccuaauuagagcag

SEQ ID NO: 3884773 - RNA, 23 nt, Human
ccuguuaccuaauuagagcagau

SEQ ID NO: 3884774 - RNA, 18 nt, Human
ccuguuaccuacuuugac

SEQ ID NO: 3884775 - RNA, 22 nt, Human
ccuguuacuugaaauaccagug

SEQ ID NO: 3884776 - RNA, 23 nt, Human
ccuguuagcuccucacuguggua

SEQ ID NO: 3884777 - RNA, 19 nt, Human
ccuguuauuuucaaguagc

SEQ ID NO: 3884778 - RNA, 15 nt, Human
ccuguucagcauucu

SEQ ID NO: 3884779 - RNA, 13 nt, Human
ccuguucagcucc

SEQ ID NO: 3884780 - RNA, 12 nt, Human
ccuguucccauu

SEQ ID NO: 3884781 - RNA, 13 nt, Human
ccuguuccccaga

SEQ ID NO: 3884782 - RNA, 23 nt, Human
ccuguuccccagagaaaggggag

SEQ ID NO: 3884783 - RNA, 22 nt, Human
ccuguucccccgccgcuuuucu

SEQ ID NO: 3884784 - RNA, 14 nt, Human
ccuguuccccucuc

SEQ ID NO: 3884785 - RNA, 15 nt, Human
ccuguuccccucucc

SEQ ID NO: 3884786 - RNA, 18 nt, Human
ccuguuccccucucccuu

SEQ ID NO: 3884787 - RNA, 15 nt, Human
ccuguuccugcugcu

SEQ ID NO: 3884788 - RNA, 13 nt, Human
ccuguucugaacu

SEQ ID NO: 3884789 - RNA, 12 nt, Human
ccuguucuggca

SEQ ID NO: 3884790 - RNA, 24 nt, Human
ccuguucuuccuccagcugcacca

SEQ ID NO: 3884791 - RNA, 22 nt, Human
ccuguugaauuuuguucucugg

SEQ ID NO: 3884792 - RNA, 19 nt, Human
ccuguugacacaggucuuu

SEQ ID NO: 3884793 - RNA, 23 nt, Human
ccuguugauuaauuucugccauu

SEQ ID NO: 3884794 - RNA, 15 nt, Human
ccuguugcacccagc

SEQ ID NO: 3884795 - RNA, 18 nt, Human
ccuguugcacccagcccu

SEQ ID NO: 3884796 - RNA, 21 nt, Human
ccuguugcacccagcccuggu

SEQ ID NO: 3884797 - RNA, 23 nt, Human
ccuguugcacccagcccuggucu

SEQ ID NO: 3884798 - RNA, 22 nt, Human
ccuguugcccuuucuguaccau

SEQ ID NO: 3884799 - RNA, 21 nt, Human
ccuguugcgugacacucuccu

SEQ ID NO: 3884800 - RNA, 17 nt, Human
ccuguugcuuacaauuu

SEQ ID NO: 3884801 - RNA, 20 nt, Human
ccuguuggacccgcucugga

SEQ ID NO: 3884802 - RNA, 17 nt, Human
ccuguuggauuuguuua

SEQ ID NO: 3884803 - RNA, 24 nt, Human
ccuguuggauuuguuuaaaaggau

SEQ ID NO: 3884804 - RNA, 18 nt, Human
ccuguugggccaggagcc

SEQ ID NO: 3884805 - RNA, 19 nt, Human
ccuguugggccaggagccu

SEQ ID NO: 3884806 - RNA, 22 nt, Human
ccuguugguuccaagcccugga

SEQ ID NO: 3884807 - RNA, 13 nt, Human
ccuguugugccac

SEQ ID NO: 3884808 - RNA, 14 nt, Human
ccuguuuaaauauu

SEQ ID NO: 3884809 - RNA, 12 nt, Human
ccuguuuccuga

SEQ ID NO: 3884810 - RNA, 15 nt, Human
ccuguuucugaaaag

SEQ ID NO: 3884811 - RNA, 17 nt, Human
ccuguuucugaaaagaa

SEQ ID NO: 3884812 - RNA, 16 nt, Human
ccuguuucugcagcca

SEQ ID NO: 3884813 - RNA, 14 nt, Human
ccuguuucuggcac

SEQ ID NO: 3884814 - RNA, 23 nt, Human
ccuguuugaagccugcccuuguc

SEQ ID NO: 3884815 - RNA, 20 nt, Human
ccuguuuggccucucuaucc

SEQ ID NO: 3884816 - RNA, 19 nt, Human
ccuguuuuauacuguacuu

SEQ ID NO: 3884817 - RNA, 13 nt, Human
ccuguuuuccccc

SEQ ID NO: 3884818 - RNA, 15 nt, Human
ccuguuuucugagcc

SEQ ID NO: 3884819 - RNA, 16 nt, Human
ccuguuuucugagccc

SEQ ID NO: 3884820 - RNA, 16 nt, Human
ccuguuuuguacauag

SEQ ID NO: 3884821 - RNA, 14 nt, Human
ccuguuuuuauuau

SEQ ID NO: 3884822 - RNA, 15 nt, Human
ccuguuuuuauuauu

SEQ ID NO: 3884823 - RNA, 13 nt, Human
ccuguuuuucaca

SEQ ID NO: 3884824 - RNA, 16 nt, Human
ccuguuuuuguuaacu

SEQ ID NO: 3884825 - RNA, 23 nt, Human
ccuguuuuuguuucuuguuuuga

SEQ ID NO: 3884826 - RNA, 14 nt, Human
ccuguuuuuuuucu

SEQ ID NO: 3884827 - RNA, 17 nt, Human
ccuguuuuuuuucuuuu

SEQ ID NO: 3884828 - RNA, 23 nt, Human
ccuuaaaacuuuaaucccacuug

SEQ ID NO: 3884829 - RNA, 12 nt, Human
ccuuaaaaugga

SEQ ID NO: 3884830 - RNA, 23 nt, Human
ccuuaaagaaagucgaauuaaua

SEQ ID NO: 3884831 - RNA, 14 nt, Human
ccuuaaaggggaga

SEQ ID NO: 3884832 - RNA, 13 nt, Human
ccuuaaauuaaac

SEQ ID NO: 3884833 - RNA, 18 nt, Human
ccuuaaauuaaacaauuu

SEQ ID NO: 3884834 - RNA, 17 nt, Human
ccuuaagagucauccag

SEQ ID NO: 3884835 - RNA, 16 nt, Human
ccuuaagcccuggccc

SEQ ID NO: 3884836 - RNA, 18 nt, Human
ccuuaagcccuggccccc

SEQ ID NO: 3884837 - RNA, 15 nt, Human
ccuuaagcugcagga

SEQ ID NO: 3884838 - RNA, 13 nt, Human
ccuucucugaaca

SEQ ID NO: 3884839 - RNA, 19 nt, Human
ccuucucugaacacaggca

SEQ ID NO: 3884840 - RNA, 22 nt, Human
ccuucucugaacacaggcagcu

SEQ ID NO: 3884841 - RNA, 13 nt, Human
ccuucucugccca

SEQ ID NO: 3884842 - RNA, 14 nt, Human
ccuucucugcucca

SEQ ID NO: 3884843 - RNA, 17 nt, Human
ccuucucugcuccacca

SEQ ID NO: 3884844 - RNA, 17 nt, Human
ccuucucugucucaugu

SEQ ID NO: 3884845 - RNA, 18 nt, Human
ccuucucuguucauuucc

SEQ ID NO: 3884846 - RNA, 19 nt, Human
ccuucucuguucauuuccu

SEQ ID NO: 3884847 - RNA, 14 nt, Human
ccuucucuuaauuu

SEQ ID NO: 3884848 - RNA, 16 nt, Human
ccuucugacccaugcu

SEQ ID NO: 3884849 - RNA, 18 nt, Human
ccuucugacggcccugca

SEQ ID NO: 3884850 - RNA, 20 nt, Human
ccuucugagcuggccucuca

SEQ ID NO: 3884851 - RNA, 16 nt, Human
ccuucugccugagcuu

SEQ ID NO: 3884852 - RNA, 17 nt, Human
ccuucugcucagcucug

SEQ ID NO: 3884853 - RNA, 20 nt, Human
ccuucugcuggauaaaauga

SEQ ID NO: 3884854 - RNA, 22 nt, Human
ccuucuggaauaaggagaauga

SEQ ID NO: 3884855 - RNA, 18 nt, Human
ccuucuggauucuuggcc

SEQ ID NO: 3884856 - RNA, 12 nt, Human
ccuucuggccuu

SEQ ID NO: 3884857 - RNA, 12 nt, Human
ccuucugggaaa

SEQ ID NO: 3884858 - RNA, 20 nt, Human
ccuucugggcaucuguucug

SEQ ID NO: 3884859 - RNA, 17 nt, Human
ccuucuguaguuuuauc

SEQ ID NO: 3884860 - RNA, 19 nt, Human
ccuucugucccucacagca

SEQ ID NO: 3884861 - RNA, 21 nt, Human
ccuucuguccuggugucacuu

SEQ ID NO: 3884862 - RNA, 13 nt, Human
ccuucugugccca

SEQ ID NO: 3884863 - RNA, 18 nt, Human
ccuucugugcccagcuca

SEQ ID NO: 3884864 - RNA, 19 nt, Human
ccuucugugcccagcucag

SEQ ID NO: 3884865 - RNA, 20 nt, Human
ccuucugugcccagcucagu

SEQ ID NO: 3884866 - RNA, 14 nt, Human
ccuucuguggggac

SEQ ID NO: 3884867 - RNA, 19 nt, Human
ccuucuuauucucacucca

SEQ ID NO: 3884868 - RNA, 14 nt, Human
ccuucuucacccag

SEQ ID NO: 3884869 - RNA, 17 nt, Human
ccuucuucacccagcua

SEQ ID NO: 3884870 - RNA, 14 nt, Human
ccuucuucauguuc

SEQ ID NO: 3884871 - RNA, 18 nt, Human
ccuucuuccaucccagga

SEQ ID NO: 3884872 - RNA, 19 nt, Human
ccuucuucuuuuugcuguu

SEQ ID NO: 3884873 - RNA, 20 nt, Human
ccuucuucuuuuugcuguug

SEQ ID NO: 3884874 - RNA, 22 nt, Human
ccuucuucuuuuugcuguuguu

SEQ ID NO: 3884875 - RNA, 19 nt, Human
ccuucuugcauccuuccua

SEQ ID NO: 3884876 - RNA, 16 nt, Human
ccuucuugccuucaga

SEQ ID NO: 3884877 - RNA, 21 nt, Human
ccuucuugcugcccugcccca

SEQ ID NO: 3884878 - RNA, 19 nt, Human
ccuucuuucuacccugcug

SEQ ID NO: 3884879 - RNA, 15 nt, Human
ccuucuuugaagaag

SEQ ID NO: 3884880 - RNA, 20 nt, Human
ccuucuuugauaauguuaaa

SEQ ID NO: 3884881 - RNA, 18 nt, Human
ccuucuuugcuugccucu

SEQ ID NO: 3884882 - RNA, 22 nt, Human
ccuucuuuuaugagcagaagga

SEQ ID NO: 3884883 - RNA, 24 nt, Human
ccuucuuuuaugagcagaaggaaa

SEQ ID NO: 3884884 - RNA, 14 nt, Human
ccuucuuuuucugg

SEQ ID NO: 3884885 - RNA, 15 nt, Human
ccuucuuuuucugga

SEQ ID NO: 3884886 - RNA, 15 nt, Human
ccuugaaaacacugu

SEQ ID NO: 3884887 - RNA, 20 nt, Human
ccuugaaaacuuuaugcuaa

SEQ ID NO: 3884888 - RNA, 16 nt, Human
ccuugaaccacuuccc

SEQ ID NO: 3884889 - RNA, 19 nt, Human
ccuugaaccacuucccuca

SEQ ID NO: 3884890 - RNA, 14 nt, Human
ccuugaacuccugg

SEQ ID NO: 3884891 - RNA, 14 nt, Human
ccuugaacugggua

SEQ ID NO: 3884892 - RNA, 17 nt, Human
ccuugaacuuugaccuc

SEQ ID NO: 3884893 - RNA, 17 nt, Human
ccuugaagaaccucuca

SEQ ID NO: 3884894 - RNA, 18 nt, Human
ccuugaagaacugcaggc

SEQ ID NO: 3884895 - RNA, 23 nt, Human
ccuugaagauaucuugaaaugaa

SEQ ID NO: 3884896 - RNA, 14 nt, Human
ccuugaagccacug

SEQ ID NO: 3884897 - RNA, 22 nt, Human
ccuugaagccacugaagcuggg

SEQ ID NO: 3884898 - RNA, 16 nt, Human
ccuugaaggagaauca

SEQ ID NO: 3884899 - RNA, 17 nt, Human
ccuugaaugaugccaug

SEQ ID NO: 3884900 - RNA, 15 nt, Human
ccuugaaugcugcca

SEQ ID NO: 3884901 - RNA, 17 nt, Human
ccuugaaugcugccagu

SEQ ID NO: 3884902 - RNA, 19 nt, Human
ccuugaaugcugccagugu

SEQ ID NO: 3884903 - RNA, 22 nt, Human
ccuugaaugcugccagugugga

SEQ ID NO: 3884904 - RNA, 12 nt, Human
ccuugaaugugg

SEQ ID NO: 3884905 - RNA, 15 nt, Human
ccuugacagggcaca

SEQ ID NO: 3884906 - RNA, 14 nt, Human
ccuugacaucaguu

SEQ ID NO: 3884907 - RNA, 12 nt, Human
ccuugaccaggc

SEQ ID NO: 3884908 - RNA, 15 nt, Human
ccuugaccaggccug

SEQ ID NO: 3884909 - RNA, 19 nt, Human
ccuugaccauucuccaccu

SEQ ID NO: 3884910 - RNA, 22 nt, Human
ccuugaccauucuccaccugcc

SEQ ID NO: 3884911 - RNA, 13 nt, Human
ccuugaccuuccu

SEQ ID NO: 3884912 - RNA, 16 nt, Human
ccuugaccuuuguaca

SEQ ID NO: 3884913 - RNA, 17 nt, Human
ccuugaccuuuguacag

SEQ ID NO: 3884914 - RNA, 21 nt, Human
ccuugaccuuuguacagccca

SEQ ID NO: 3884915 - RNA, 20 nt, Human
ccuugacgucaagucuccuu

SEQ ID NO: 3884916 - RNA, 21 nt, Human
ccuugacuguugauguacuga

SEQ ID NO: 3884917 - RNA, 20 nt, Human
ccuugacuuugaacuaauga

SEQ ID NO: 3884918 - RNA, 14 nt, Human
ccuugagaaaccuu

SEQ ID NO: 3884919 - RNA, 19 nt, Human
ccuugagaaaccuuauugu

SEQ ID NO: 3884920 - RNA, 18 nt, Human
ccuugagaccucagccau

SEQ ID NO: 3884921 - RNA, 19 nt, Human
ccuugagaccucagccaug

SEQ ID NO: 3884922 - RNA, 11 nt, Human
ccuugagcccu

SEQ ID NO: 3884923 - RNA, 18 nt, Human
ccuugagcccuccccagg

SEQ ID NO: 3884924 - RNA, 15 nt, Human
ccuugagcccuggcu

SEQ ID NO: 3884925 - RNA, 22 nt, Human
ccuugagcccuggcuguucugu

SEQ ID NO: 3884926 - RNA, 18 nt, Human
ccuugaggaaacaacagc

SEQ ID NO: 3884927 - RNA, 22 nt, Human
ccuugaggaggggcagguaaac

SEQ ID NO: 3884928 - RNA, 17 nt, Human
ccuugagggcaagagcc

SEQ ID NO: 3884929 - RNA, 13 nt, Human
ccuugagggcugc

SEQ ID NO: 3884930 - RNA, 22 nt, Human
ccuugaggggagccaggagggg

SEQ ID NO: 3884931 - RNA, 14 nt, Human
ccuugaggucucag

SEQ ID NO: 3884932 - RNA, 12 nt, Human
ccuugaggucuu

SEQ ID NO: 3884933 - RNA, 13 nt, Human
ccuugaggucuuu

SEQ ID NO: 3884934 - RNA, 23 nt, Human
ccuugaggucuuuugacaugugg

SEQ ID NO: 3884935 - RNA, 22 nt, Human
ccuugagugggguuaucucugu

SEQ ID NO: 3884936 - RNA, 16 nt, Human
ccuugauaauauauug

SEQ ID NO: 3884937 - RNA, 22 nt, Human
ccuugaugaaauaacacagcag

SEQ ID NO: 3884938 - RNA, 23 nt, Human
ccuugaugauugacaacacccau

SEQ ID NO: 3884939 - RNA, 14 nt, Human
ccuugaugcacaga

SEQ ID NO: 3884940 - RNA, 14 nt, Human
ccuugaugugccug

SEQ ID NO: 3884941 - RNA, 22 nt, Human
ccuugauuggaagggcuuuuca

SEQ ID NO: 3884942 - RNA, 18 nt, Human
ccuugauugguguugcca

SEQ ID NO: 3884943 - RNA, 13 nt, Human
ccuugauuucaaa

SEQ ID NO: 3884944 - RNA, 21 nt, Human
ccuugauuuuagccuucucug

SEQ ID NO: 3884945 - RNA, 17 nt, Human
ccuugcacacaucaucu

SEQ ID NO: 3884946 - RNA, 22 nt, Human
ccuugcacacuccccugcacug

SEQ ID NO: 3884947 - RNA, 18 nt, Human
ccuugcaccccucacucu

SEQ ID NO: 3884948 - RNA, 13 nt, Human
ccuugcaccugca

SEQ ID NO: 3884949 - RNA, 14 nt, Human
ccuugcagaacugc

SEQ ID NO: 3884950 - RNA, 18 nt, Human
ccuugcagaacugccauu

SEQ ID NO: 3884951 - RNA, 20 nt, Human
ccuugcagcacucacacagg

SEQ ID NO: 3884952 - RNA, 20 nt, Human
ccuugcaguucagcaccacc

SEQ ID NO: 3884953 - RNA, 23 nt, Human
ccuugcaguucagcaccacccua

SEQ ID NO: 3884954 - RNA, 17 nt, Human
ccuugccaccccacccu

SEQ ID NO: 3884955 - RNA, 19 nt, Human
ccuugccaccccacccucc

SEQ ID NO: 3884956 - RNA, 15 nt, Human
ccuugccacuuugca

SEQ ID NO: 3884957 - RNA, 13 nt, Human
ccuugccagacau

SEQ ID NO: 3884958 - RNA, 15 nt, Human
ccuugccagcugcug

SEQ ID NO: 3884959 - RNA, 24 nt, Human
ccuugccagcugcugagccgcaga

SEQ ID NO: 3884960 - RNA, 21 nt, Human
ccuugccaggguuucgagaag

SEQ ID NO: 3884961 - RNA, 19 nt, Human
ccuugccaggucccuuuca

SEQ ID NO: 3884962 - RNA, 17 nt, Human
ccuugcccacuccugcu

SEQ ID NO: 3884963 - RNA, 22 nt, Human
ccuugcccacuccugcucugcu

SEQ ID NO: 3884964 - RNA, 23 nt, Human
ccuugcccacuccugcucugcuc

SEQ ID NO: 3884965 - RNA, 12 nt, Human
ccuugcccagag

SEQ ID NO: 3884966 - RNA, 14 nt, Human
ccuugcccagagau

SEQ ID NO: 3884967 - RNA, 23 nt, Human
ccuugcccagagaugccuccacc

SEQ ID NO: 3884968 - RNA, 14 nt, Human
ccuugcccagccug

SEQ ID NO: 3884969 - RNA, 17 nt, Human
ccuugcccagggcucag

SEQ ID NO: 3884970 - RNA, 16 nt, Human
ccuugccccccuggcc

SEQ ID NO: 3884971 - RNA, 17 nt, Human
ccuugccccccuggccu

SEQ ID NO: 3884972 - RNA, 22 nt, Human
ccuugcccugaccucccagccc

SEQ ID NO: 3884973 - RNA, 18 nt, Human
ccuugcccuugcccugac

SEQ ID NO: 3884974 - RNA, 15 nt, Human
ccuugccucaaugcc

SEQ ID NO: 3884975 - RNA, 16 nt, Human
ccuugccucaaugcca

SEQ ID NO: 3884976 - RNA, 12 nt, Human
ccuugccucccc

SEQ ID NO: 3884977 - RNA, 14 nt, Human
ccuugccuccccau

SEQ ID NO: 3884978 - RNA, 14 nt, Human
ccuugccuccugug

SEQ ID NO: 3884979 - RNA, 23 nt, Human
ccuugccugaacauccuuccuuc

SEQ ID NO: 3884980 - RNA, 17 nt, Human
ccuugccugguacagua

SEQ ID NO: 3884981 - RNA, 20 nt, Human
ccuugccuuucgaggccuga

SEQ ID NO: 3884982 - RNA, 15 nt, Human
ggcugggggccucag

SEQ ID NO: 3884983 - RNA, 16 nt, Human
ggcugggggccucagu

SEQ ID NO: 3884984 - RNA, 17 nt, Human
ggcugggggccucagug

SEQ ID NO: 3884985 - RNA, 19 nt, Human
ggcugggggccucagugcc

SEQ ID NO: 3884986 - RNA, 16 nt, Human
ggcugggguggccugu

SEQ ID NO: 3884987 - RNA, 14 nt, Human
ggcugggucgcccu

SEQ ID NO: 3884988 - RNA, 17 nt, Human
ggcugggugcccacagc

SEQ ID NO: 3884989 - RNA, 21 nt, Human
ggcuggguucuacccaggugc

SEQ ID NO: 3884990 - RNA, 19 nt, Human
ggcugguaacaguucaugu

SEQ ID NO: 3884991 - RNA, 20 nt, Human
ggcugguacaacggaggccu

SEQ ID NO: 3884992 - RNA, 16 nt, Human
ggcugguaucucagaa

SEQ ID NO: 3884993 - RNA, 19 nt, Human
ggcugguauugguggcuuu

SEQ ID NO: 3884994 - RNA, 13 nt, Human
ggcuggucucaaa

SEQ ID NO: 3884995 - RNA, 10 nt, Human
ggcuggugcc

SEQ ID NO: 3884996 - RNA, 18 nt, Human
ggcuggugccagccuucc

SEQ ID NO: 3884997 - RNA, 19 nt, Human
ggcuggugcuguggccagg

SEQ ID NO: 3884998 - RNA, 14 nt, Human
ggcugguggcaagu

SEQ ID NO: 3884999 - RNA, 16 nt, Human
ggcuggugucaccuga

SEQ ID NO: 3885000 - RNA, 16 nt, Human
ggcuggugugguacag

SEQ ID NO: 3885001 - RNA, 23 nt, Human
ggcuggugugguacagagaagcc

SEQ ID NO: 3885002 - RNA, 21 nt, Human
ggcugguuuuguaagaugcug

SEQ ID NO: 3885003 - RNA, 17 nt, Human
ggcuguaacugccaggc

SEQ ID NO: 3885004 - RNA, 18 nt, Human
ggcuguaacugccaggcu

SEQ ID NO: 3885005 - RNA, 15 nt, Human
ggcuguacccaggaa

SEQ ID NO: 3885006 - RNA, 15 nt, Human
ggcuguagaaggaga

SEQ ID NO: 3885007 - RNA, 21 nt, Human
ggcuguaggacucgcagucag

SEQ ID NO: 3885008 - RNA, 20 nt, Human
ggcuguaucccaugagccuc

SEQ ID NO: 3885009 - RNA, 15 nt, Human
ggcugucaauuacag

SEQ ID NO: 3885010 - RNA, 16 nt, Human
ggcugucagcaggaag

SEQ ID NO: 3885011 - RNA, 15 nt, Human
ggcugucccggaggc

SEQ ID NO: 3885012 - RNA, 22 nt, Human
ggcuguccuguacauuguggga

SEQ ID NO: 3885013 - RNA, 13 nt, Human
ggcuguccuuucc

SEQ ID NO: 3885014 - RNA, 13 nt, Human
ggcugucggcgcu

SEQ ID NO: 3885015 - RNA, 14 nt, Human
ggcugucugaggcu

SEQ ID NO: 3885016 - RNA, 19 nt, Human
ggcugucuucucaggcucu

SEQ ID NO: 3885017 - RNA, 22 nt, Human
ggcugucuucucaggcucugcc

SEQ ID NO: 3885018 - RNA, 13 nt, Human
ggcugugaggccc

SEQ ID NO: 3885019 - RNA, 13 nt, Human
ggcugugccucug

SEQ ID NO: 3885020 - RNA, 13 nt, Human
ggcugugcucaga

SEQ ID NO: 3885021 - RNA, 14 nt, Human
ggcugugcucagag

SEQ ID NO: 3885022 - RNA, 15 nt, Human
ggcugugcucagaga

SEQ ID NO: 3885023 - RNA, 20 nt, Human
ggcugugcucccugguucug

SEQ ID NO: 3885024 - RNA, 12 nt, Human
ggcugugcuggg

SEQ ID NO: 3885025 - RNA, 17 nt, Human
ggcugugcuugaaggcc

SEQ ID NO: 3885026 - RNA, 20 nt, Human
ggcugugcuugaaggcccug

SEQ ID NO: 3885027 - RNA, 21 nt, Human
ggcugugcuugaaggcccugc

SEQ ID NO: 3885028 - RNA, 23 nt, Human
ggcugugcuugaaggcccugcug

SEQ ID NO: 3885029 - RNA, 17 nt, Human
ggcuguggaccauggag

SEQ ID NO: 3885030 - RNA, 23 nt, Human
ggcuguggagacaaugucugcag

SEQ ID NO: 3885031 - RNA, 21 nt, Human
ggcuguggcauccagaguccc

SEQ ID NO: 3885032 - RNA, 21 nt, Human
ggcugugggccucaaggacuu

SEQ ID NO: 3885033 - RNA, 18 nt, Human
ggcugugggcucccuucc

SEQ ID NO: 3885034 - RNA, 24 nt, Human
ggcugugguagggggugucucagg

SEQ ID NO: 3885035 - RNA, 22 nt, Human
ggcuguguaagauuuguuuuua

SEQ ID NO: 3885036 - RNA, 20 nt, Human
ggcuguguucuggugaggcc

SEQ ID NO: 3885037 - RNA, 18 nt, Human
ggcuguucugcacugaaa

SEQ ID NO: 3885038 - RNA, 21 nt, Human
ggcuguucugugguuccucug

SEQ ID NO: 3885039 - RNA, 17 nt, Human
ggcuguugaagucaccu

SEQ ID NO: 3885040 - RNA, 13 nt, Human
ggcuguugcaugg

SEQ ID NO: 3885041 - RNA, 23 nt, Human
ggcuguuggcacucacagaccug

SEQ ID NO: 3885042 - RNA, 17 nt, Human
ggcuguuggcagugagu

SEQ ID NO: 3885043 - RNA, 15 nt, Human
ggcuguuggcugggg

SEQ ID NO: 3885044 - RNA, 16 nt, Human
ggcuguuggcuggggg

SEQ ID NO: 3885045 - RNA, 13 nt, Human
ggcuuaauaaaaa

SEQ ID NO: 3885046 - RNA, 14 nt, Human
ggcuuaauaaaaau

SEQ ID NO: 3885047 - RNA, 14 nt, Human
ggcuuaaucauuuu

SEQ ID NO: 3885048 - RNA, 14 nt, Human
ggcuuaauguuuau

SEQ ID NO: 3885049 - RNA, 16 nt, Human
ggcuuaauguuuauuc

SEQ ID NO: 3885050 - RNA, 21 nt, Human
ggcuuaauuauugauguuuuc

SEQ ID NO: 3885051 - RNA, 17 nt, Human
ggcuuacacguggagga

SEQ ID NO: 3885052 - RNA, 16 nt, Human
ggcuuacggcccuggc

SEQ ID NO: 3885053 - RNA, 18 nt, Human
ggcuuagacccucaugcu

SEQ ID NO: 3885054 - RNA, 21 nt, Human
ggcuuagacuucgacucagga

SEQ ID NO: 3885055 - RNA, 15 nt, Human
ggcuuagucacugag

SEQ ID NO: 3885056 - RNA, 17 nt, Human
ggcuuauaauucuuuca

SEQ ID NO: 3885057 - RNA, 14 nt, Human
ggcuuauauucaac

SEQ ID NO: 3885058 - RNA, 16 nt, Human
ggcuuauauuugugua

SEQ ID NO: 3885059 - RNA, 17 nt, Human
ggcuuauuuuaauguga

SEQ ID NO: 3885060 - RNA, 22 nt, Human
ggcuucaaccuugagacagcuu

SEQ ID NO: 3885061 - RNA, 20 nt, Human
ggcuucacggaagagccuug

SEQ ID NO: 3885062 - RNA, 15 nt, Human
ggcuucacuccugcu

SEQ ID NO: 3885063 - RNA, 19 nt, Human
ggcuucacuguauaaauag

SEQ ID NO: 3885064 - RNA, 11 nt, Human
ggcuucagccu

SEQ ID NO: 3885065 - RNA, 16 nt, Human
ggcuucagcuccagcc

SEQ ID NO: 3885066 - RNA, 13 nt, Human
ggcuucaggucca

SEQ ID NO: 3885067 - RNA, 18 nt, Human
ggcuucagucucauauuu

SEQ ID NO: 3885068 - RNA, 19 nt, Human
ggcuucaguggcagcugcu

SEQ ID NO: 3885069 - RNA, 9 nt, Human
ggcuucaua

SEQ ID NO: 3885070 - RNA, 18 nt, Human
ggcuucauuagagcaggc

SEQ ID NO: 3885071 - RNA, 21 nt, Human
ggcuuccagaaaaccccagca

SEQ ID NO: 3885072 - RNA, 20 nt, Human
ggcuuccagagaguccucug

SEQ ID NO: 3885073 - RNA, 12 nt, Human
ggcuuccaggua

SEQ ID NO: 3885074 - RNA, 17 nt, Human
ggcuucccaguggcugc

SEQ ID NO: 3885075 - RNA, 22 nt, Human
ggcuucccaguggcugcugccc

SEQ ID NO: 3885076 - RNA, 18 nt, Human
ggcuucccauccccagcg

SEQ ID NO: 3885077 - RNA, 14 nt, Human
ggcuucccgcucag

SEQ ID NO: 3885078 - RNA, 12 nt, Human
ggcuuccuccuc

SEQ ID NO: 3885079 - RNA, 21 nt, Human
ggcuuccucuagaagccaagg

SEQ ID NO: 3885080 - RNA, 20 nt, Human
ggcuuccugaggggagacag

SEQ ID NO: 3885081 - RNA, 12 nt, Human
ggcuuccuggag

SEQ ID NO: 3885082 - RNA, 14 nt, Human
ggcuuccuggugcu

SEQ ID NO: 3885083 - RNA, 17 nt, Human
ggcuucggacaaaauau

SEQ ID NO: 3885084 - RNA, 21 nt, Human
ggcuucucauacguccaccau

SEQ ID NO: 3885085 - RNA, 17 nt, Human
ggcuucuccgccagccu

SEQ ID NO: 3885086 - RNA, 23 nt, Human
ggcuucuccgccagccuccucug

SEQ ID NO: 3885087 - RNA, 12 nt, Human
ggcuucucucuc

SEQ ID NO: 3885088 - RNA, 14 nt, Human
ggcuucucucugug

SEQ ID NO: 3885089 - RNA, 15 nt, Human
ggcuucucugaggaa

SEQ ID NO: 3885090 - RNA, 11 nt, Human
ggcuucugaug

SEQ ID NO: 3885091 - RNA, 19 nt, Human
ggcuucugaugaaucuugc

SEQ ID NO: 3885092 - RNA, 14 nt, Human
ggcuucugcacccu

SEQ ID NO: 3885093 - RNA, 21 nt, Human
ggcuucugcacccuccacccu

SEQ ID NO: 3885094 - RNA, 22 nt, Human
ggcuucugcacccuccacccug

SEQ ID NO: 3885095 - RNA, 20 nt, Human
ggcuucugcuggggccuggg

SEQ ID NO: 3885096 - RNA, 18 nt, Human
ggcuucuggagcccuugg

SEQ ID NO: 3885097 - RNA, 12 nt, Human
ggcuucuguggg

SEQ ID NO: 3885098 - RNA, 13 nt, Human
ggcuucugugggg

SEQ ID NO: 3885099 - RNA, 19 nt, Human
ggcuucuguggggccccuc

SEQ ID NO: 3885100 - RNA, 20 nt, Human
ggcuucuguuucuaguugag

SEQ ID NO: 3885101 - RNA, 18 nt, Human
ggcuucuuuucuuuguau

SEQ ID NO: 3885102 - RNA, 14 nt, Human
ggcuugaagcugug

SEQ ID NO: 3885103 - RNA, 17 nt, Human
ggcuugacucaggauuu

SEQ ID NO: 3885104 - RNA, 15 nt, Human
ggcuugcacucucuu

SEQ ID NO: 3885105 - RNA, 13 nt, Human
ggcuugccugcag

SEQ ID NO: 3885106 - RNA, 13 nt, Human
ggcuugcugagag

SEQ ID NO: 3885107 - RNA, 13 nt, Human
ggcuugcugcaga

SEQ ID NO: 3885108 - RNA, 11 nt, Human
ggcuugcugcc

SEQ ID NO: 3885109 - RNA, 12 nt, Human
ggcuuggcccug

SEQ ID NO: 3885110 - RNA, 13 nt, Human
ggcuuggcccugg

SEQ ID NO: 3885111 - RNA, 16 nt, Human
ggcuuggcccuggcag

SEQ ID NO: 3885112 - RNA, 17 nt, Human
ggcuuggccuaucuccu

SEQ ID NO: 3885113 - RNA, 14 nt, Human
ggcuugggaccgcc

SEQ ID NO: 3885114 - RNA, 16 nt, Human
ggcuugggccuaggcu

SEQ ID NO: 3885115 - RNA, 17 nt, Human
ggcuuggggaccagagc

SEQ ID NO: 3885116 - RNA, 18 nt, Human
ggcuuggggaccagagcu

SEQ ID NO: 3885117 - RNA, 21 nt, Human
ggcuuggggaccagagcugcc

SEQ ID NO: 3885118 - RNA, 21 nt, Human
ggcuugguggcucacgccugu

SEQ ID NO: 3885119 - RNA, 17 nt, Human
ggcuuguaacuccacca

SEQ ID NO: 3885120 - RNA, 15 nt, Human
ggcuugucagagcug

SEQ ID NO: 3885121 - RNA, 17 nt, Human
ggcuugucagagcuggg

SEQ ID NO: 3885122 - RNA, 14 nt, Human
ggcuuguggggccu

SEQ ID NO: 3885123 - RNA, 15 nt, Human
ggcuuguuuauuuug

SEQ ID NO: 3885124 - RNA, 14 nt, Human
ggcuuuauccucuu

SEQ ID NO: 3885125 - RNA, 17 nt, Human
ggcuuuauuuuuuugaa

SEQ ID NO: 3885126 - RNA, 12 nt, Human
ggcuuucagcuu

SEQ ID NO: 3885127 - RNA, 16 nt, Human
ggcuuucaugaggagg

SEQ ID NO: 3885128 - RNA, 21 nt, Human
gggcaggccaccuggcucuca

SEQ ID NO: 3885129 - RNA, 13 nt, Human
gggcaggcccugc

SEQ ID NO: 3885130 - RNA, 11 nt, Human
gggcagggagc

SEQ ID NO: 3885131 - RNA, 15 nt, Human
gggcagggagcuggg

SEQ ID NO: 3885132 - RNA, 20 nt, Human
gggcagggcaucuccugugc

SEQ ID NO: 3885133 - RNA, 14 nt, Human
gggcagggccgccc

SEQ ID NO: 3885134 - RNA, 22 nt, Human
gggcagggccgcccgggcccag

SEQ ID NO: 3885135 - RNA, 23 nt, Human
gggcagggccgcccgggcccaga

SEQ ID NO: 3885136 - RNA, 11 nt, Human
gggcagggcug

SEQ ID NO: 3885137 - RNA, 16 nt, Human
gggcagggcugugcuu

SEQ ID NO: 3885138 - RNA, 13 nt, Human
gggcaggggcugg

SEQ ID NO: 3885139 - RNA, 14 nt, Human
gggcagggugaccc

SEQ ID NO: 3885140 - RNA, 13 nt, Human
gggcaggugggag

SEQ ID NO: 3885141 - RNA, 14 nt, Human
gggcagguggggug

SEQ ID NO: 3885142 - RNA, 17 nt, Human
gggcagguugguggggg

SEQ ID NO: 3885143 - RNA, 20 nt, Human
gggcaguaccugagggucug

SEQ ID NO: 3885144 - RNA, 17 nt, Human
gggcagucauuauccag

SEQ ID NO: 3885145 - RNA, 17 nt, Human
gggcagucugagagagg

SEQ ID NO: 3885146 - RNA, 18 nt, Human
gggcagucugagagaggc

SEQ ID NO: 3885147 - RNA, 20 nt, Human
gggcagucugagagaggcca

SEQ ID NO: 3885148 - RNA, 19 nt, Human
gggcagugcuuggcccagg

SEQ ID NO: 3885149 - RNA, 20 nt, Human
gggcagugcuuggcccagga

SEQ ID NO: 3885150 - RNA, 22 nt, Human
gggcagugcuuggcccaggagu

SEQ ID NO: 3885151 - RNA, 23 nt, Human
gggcagugcuuggcccaggaguu

SEQ ID NO: 3885152 - RNA, 21 nt, Human
gggcagugggacccauagauc

SEQ ID NO: 3885153 - RNA, 22 nt, Human
gggcagugguaagcucuggcuu

SEQ ID NO: 3885154 - RNA, 16 nt, Human
gggcaguucgcagcca

SEQ ID NO: 3885155 - RNA, 19 nt, Human
gggcaguucgcagccaccc

SEQ ID NO: 3885156 - RNA, 21 nt, Human
gggcaguucgcagccacccug

SEQ ID NO: 3885157 - RNA, 22 nt, Human
gggcauagaugcaggugagccc

SEQ ID NO: 3885158 - RNA, 13 nt, Human
gggcaucaugcau

SEQ ID NO: 3885159 - RNA, 20 nt, Human
gggcauccauaccagcucgc

SEQ ID NO: 3885160 - RNA, 14 nt, Human
gggcaucuauggga

SEQ ID NO: 3885161 - RNA, 22 nt, Human
gggcaucucugggcuggaugag

SEQ ID NO: 3885162 - RNA, 17 nt, Human
gggcaucugccccuccc

SEQ ID NO: 3885163 - RNA, 19 nt, Human
gggcaucugccccuccccc

SEQ ID NO: 3885164 - RNA, 21 nt, Human
gggcaucuggccuggccagug

SEQ ID NO: 3885165 - RNA, 20 nt, Human
gggcaugagcauuggauaca

SEQ ID NO: 3885166 - RNA, 15 nt, Human
gggcauggccaggug

SEQ ID NO: 3885167 - RNA, 21 nt, Human
gggcauggggugggccucugg

SEQ ID NO: 3885168 - RNA, 19 nt, Human
gggcaugguauuugagaca

SEQ ID NO: 3885169 - RNA, 19 nt, Human
gggcauguauuggccugga

SEQ ID NO: 3885170 - RNA, 18 nt, Human
gggcauucucucuccaag

SEQ ID NO: 3885171 - RNA, 17 nt, Human
gggccaaacgcugagcc

SEQ ID NO: 3885172 - RNA, 22 nt, Human
gggccaacuugagggcccagag

SEQ ID NO: 3885173 - RNA, 17 nt, Human
gggccaagacuuggcaa

SEQ ID NO: 3885174 - RNA, 16 nt, Human
gggccaaggaccugag

SEQ ID NO: 3885175 - RNA, 15 nt, Human
gggccaagucccacc

SEQ ID NO: 3885176 - RNA, 21 nt, Human
gggccaauucaauacaaacaa

SEQ ID NO: 3885177 - RNA, 19 nt, Human
gggccacaugggaggcuca

SEQ ID NO: 3885178 - RNA, 20 nt, Human
gggccaccaggaucagccag

SEQ ID NO: 3885179 - RNA, 15 nt, Human
gggccaccuccccag

SEQ ID NO: 3885180 - RNA, 17 nt, Human
gggccacgcuccagcug

SEQ ID NO: 3885181 - RNA, 21 nt, Human
gggccacuccuuccugcccca

SEQ ID NO: 3885182 - RNA, 15 nt, Human
gggccacucugccuc

SEQ ID NO: 3885183 - RNA, 14 nt, Human
gggccagagccagg

SEQ ID NO: 3885184 - RNA, 15 nt, Human
gggccagagccaggg

SEQ ID NO: 3885185 - RNA, 13 nt, Human
gggccagauccag

SEQ ID NO: 3885186 - RNA, 17 nt, Human
gggccagauccagccug

SEQ ID NO: 3885187 - RNA, 19 nt, Human
gggccagauccagccuggg

SEQ ID NO: 3885188 - RNA, 12 nt, Human
gggccagccagg

SEQ ID NO: 3885189 - RNA, 15 nt, Human
gggccagccaggcgg

SEQ ID NO: 3885190 - RNA, 18 nt, Human
gggccagccaggcgggcu

SEQ ID NO: 3885191 - RNA, 12 nt, Human
gggccagccccu

SEQ ID NO: 3885192 - RNA, 12 nt, Human
gggccaggagcc

SEQ ID NO: 3885193 - RNA, 14 nt, Human
gggccaggcugggu

SEQ ID NO: 3885194 - RNA, 16 nt, Human
gggccagggcccugca

SEQ ID NO: 3885195 - RNA, 21 nt, Human
gggccagggcugcccugagaa

SEQ ID NO: 3885196 - RNA, 18 nt, Human
gggccagucccugaggca

SEQ ID NO: 3885197 - RNA, 21 nt, Human
gggccagucccugaggcaggu

SEQ ID NO: 3885198 - RNA, 15 nt, Human
gggccagucugggcu

SEQ ID NO: 3885199 - RNA, 23 nt, Human
gggccaguuggucccccuuccau

SEQ ID NO: 3885200 - RNA, 23 nt, Human
gggccaugcugaggccugggccg

SEQ ID NO: 3885201 - RNA, 15 nt, Human
gggccauguccaaag

SEQ ID NO: 3885202 - RNA, 16 nt, Human
gggccauguccaaaga

SEQ ID NO: 3885203 - RNA, 23 nt, Human
gggccauguccaaagaggcugcc

SEQ ID NO: 3885204 - RNA, 14 nt, Human
gggccauuugcaau

SEQ ID NO: 3885205 - RNA, 18 nt, Human
gggcccaagacagaugcc

SEQ ID NO: 3885206 - RNA, 18 nt, Human
gggcccaaggcggccccu

SEQ ID NO: 3885207 - RNA, 21 nt, Human
gggcccacccaagcaggaggc

SEQ ID NO: 3885208 - RNA, 13 nt, Human
gggcccaccuggc

SEQ ID NO: 3885209 - RNA, 14 nt, Human
gggcccaccuggcc

SEQ ID NO: 3885210 - RNA, 18 nt, Human
gggcccaccuggccaccu

SEQ ID NO: 3885211 - RNA, 15 nt, Human
gggcccagagcccag

SEQ ID NO: 3885212 - RNA, 12 nt, Human
gggcccagagga

SEQ ID NO: 3885213 - RNA, 11 nt, Human
gggcccagccc

SEQ ID NO: 3885214 - RNA, 13 nt, Human
gggcccagccccc

SEQ ID NO: 3885215 - RNA, 22 nt, Human
gggcccagcccccacagugcug

SEQ ID NO: 3885216 - RNA, 14 nt, Human
gggcccaggaccag

SEQ ID NO: 3885217 - RNA, 18 nt, Human
gggcccaggaccagcugg

SEQ ID NO: 3885218 - RNA, 19 nt, Human
gggcccaggaccagcuggg

SEQ ID NO: 3885219 - RNA, 13 nt, Human
gggcccaggaggg

SEQ ID NO: 3885220 - RNA, 14 nt, Human
gggcccaggcaaau

SEQ ID NO: 3885221 - RNA, 12 nt, Human
gggccccaccug

SEQ ID NO: 3885222 - RNA, 11 nt, Human
gggccccagcu

SEQ ID NO: 3885223 - RNA, 18 nt, Human
gggccccagucagccucu

SEQ ID NO: 3885224 - RNA, 19 nt, Human
gggccccagucagccucuc

SEQ ID NO: 3885225 - RNA, 15 nt, Human
gggccccccugcccu

SEQ ID NO: 3885226 - RNA, 17 nt, Human
gggccccccugcccugu

SEQ ID NO: 3885227 - RNA, 17 nt, Human
gggccccucacccugcc

SEQ ID NO: 3885228 - RNA, 21 nt, Human
gggccccucaucgcguccucc

SEQ ID NO: 3885229 - RNA, 10 nt, Human
gggccccucc

SEQ ID NO: 3885230 - RNA, 16 nt, Human
gggccccucucagccc

SEQ ID NO: 3885231 - RNA, 17 nt, Human
gggccccucucagcccu

SEQ ID NO: 3885232 - RNA, 13 nt, Human
gggccccugccag

SEQ ID NO: 3885233 - RNA, 22 nt, Human
gggccccugccucucugcaggu

SEQ ID NO: 3885234 - RNA, 21 nt, Human
gggccccugcuucuccagccu

SEQ ID NO: 3885235 - RNA, 22 nt, Human
gggcccgcgauguggaacugcu

SEQ ID NO: 3885236 - RNA, 13 nt, Human
gggcccgcuugcc

SEQ ID NO: 3885237 - RNA, 20 nt, Human
gggcccgcuugccucggcuc

SEQ ID NO: 3885238 - RNA, 23 nt, Human
gggcccggcccgcgccacaggac

SEQ ID NO: 3885239 - RNA, 20 nt, Human
gggcccguugucucccuggc

SEQ ID NO: 3885240 - RNA, 21 nt, Human
gggcccguugucucccuggcc

SEQ ID NO: 3885241 - RNA, 23 nt, Human
gggcccuccgacagcccccucug

SEQ ID NO: 3885242 - RNA, 16 nt, Human
gggcccucucugcucu

SEQ ID NO: 3885243 - RNA, 12 nt, Human
gggcccugagcu

SEQ ID NO: 3885244 - RNA, 12 nt, Human
gggcccugcaug

SEQ ID NO: 3885245 - RNA, 14 nt, Human
gggcccugcaugua

SEQ ID NO: 3885246 - RNA, 13 nt, Human
gggcccugccucc

SEQ ID NO: 3885247 - RNA, 18 nt, Human
gggcccugggccugccuc

SEQ ID NO: 3885248 - RNA, 13 nt, Human
gggcccugggcug

SEQ ID NO: 3885249 - RNA, 15 nt, Human
gggcccugggcugga

SEQ ID NO: 3885250 - RNA, 18 nt, Human
gggccgaauccccucccu

SEQ ID NO: 3885251 - RNA, 17 nt, Human
gggccgaugcccagaga

SEQ ID NO: 3885252 - RNA, 13 nt, Human
gggccgcaggcgg

SEQ ID NO: 3885253 - RNA, 23 nt, Human
gggccgcaggcgggaaaagcagc

SEQ ID NO: 3885254 - RNA, 14 nt, Human
gggccgccagggag

SEQ ID NO: 3885255 - RNA, 23 nt, Human
gggccgccagggagaccuggaca

SEQ ID NO: 3885256 - RNA, 17 nt, Human
gggccgccgccucuuuc

SEQ ID NO: 3885257 - RNA, 23 nt, Human
gggccgcguggugccauccccag

SEQ ID NO: 3885258 - RNA, 21 nt, Human
gggccgcuccgcuccccugcu

SEQ ID NO: 3885259 - RNA, 13 nt, Human
gggccgcugccac

SEQ ID NO: 3885260 - RNA, 21 nt, Human
gggccgcugccacccaccucc

SEQ ID NO: 3885261 - RNA, 15 nt, Human
gggccggccaggugg

SEQ ID NO: 3885262 - RNA, 21 nt, Human
gggccggccaggugggcgggc

SEQ ID NO: 3885263 - RNA, 12 nt, Human
gggccggcccug

SEQ ID NO: 3885264 - RNA, 16 nt, Human
gggccggggaacuggc

SEQ ID NO: 3885265 - RNA, 19 nt, Human
gggccggggaacuggccaa

SEQ ID NO: 3885266 - RNA, 17 nt, Human
gggccggggcuucugug

SEQ ID NO: 3885267 - RNA, 17 nt, Human
gggccgugcccaggggc

SEQ ID NO: 3885268 - RNA, 20 nt, Human
gggccuagauccacacacag

SEQ ID NO: 3885269 - RNA, 23 nt, Human
gggccuagauccacacacagagg

SEQ ID NO: 3885270 - RNA, 23 nt, Human
gggccuaucagugugccccccau

SEQ ID NO: 3885271 - RNA, 18 nt, Human
gggccuauggagagcccu

SEQ ID NO: 3885272 - RNA, 19 nt, Human
gggccuauggagagcccug

SEQ ID NO: 3885273 - RNA, 16 nt, Human
gggcuggaggagccca

SEQ ID NO: 3885274 - RNA, 18 nt, Human
gggcuggaggagcccagg

SEQ ID NO: 3885275 - RNA, 22 nt, Human
gggcuggaggagcccaggccag

SEQ ID NO: 3885276 - RNA, 23 nt, Human
gggcuggaggagcccaggccagg

SEQ ID NO: 3885277 - RNA, 14 nt, Human
gggcuggaggccca

SEQ ID NO: 3885278 - RNA, 17 nt, Human
gggcuggccaguuggaa

SEQ ID NO: 3885279 - RNA, 16 nt, Human
gggcuggcccagcccu

SEQ ID NO: 3885280 - RNA, 18 nt, Human
gggcuggccccagggcac

SEQ ID NO: 3885281 - RNA, 13 nt, Human
gggcuggcucccu

SEQ ID NO: 3885282 - RNA, 14 nt, Human
gggcuggcuccuga

SEQ ID NO: 3885283 - RNA, 16 nt, Human
gggcugggagcucugc

SEQ ID NO: 3885284 - RNA, 13 nt, Human
gggcugggcagcu

SEQ ID NO: 3885285 - RNA, 14 nt, Human
gggcugggcagcug

SEQ ID NO: 3885286 - RNA, 18 nt, Human
gggcugggcccucucuuc

SEQ ID NO: 3885287 - RNA, 11 nt, Human
gggcugggugu

SEQ ID NO: 3885288 - RNA, 20 nt, Human
gggcuggguucuacccaggu

SEQ ID NO: 3885289 - RNA, 22 nt, Human
gggcuggguucuacccaggugc

SEQ ID NO: 3885290 - RNA, 22 nt, Human
gggcuggguuggcgcacccucc

SEQ ID NO: 3885291 - RNA, 20 nt, Human
gggcuggugccagccuuccu

SEQ ID NO: 3885292 - RNA, 16 nt, Human
gggcuguaacugccag

SEQ ID NO: 3885293 - RNA, 22 nt, Human
gggcuguaacugccaggcucuc

SEQ ID NO: 3885294 - RNA, 16 nt, Human
gggcugucaucugugc

SEQ ID NO: 3885295 - RNA, 17 nt, Human
gggcugucaucugugca

SEQ ID NO: 3885296 - RNA, 24 nt, Human
gggcuguccacuagaccagugagc

SEQ ID NO: 3885297 - RNA, 12 nt, Human
gggcugugaucg

SEQ ID NO: 3885298 - RNA, 16 nt, Human
gggcuguuggcacuca

SEQ ID NO: 3885299 - RNA, 15 nt, Human
gggcuuaagaaaucu

SEQ ID NO: 3885300 - RNA, 17 nt, Human
gggcuucagggcaggug

SEQ ID NO: 3885301 - RNA, 18 nt, Human
gggcuucaguggcagcug

SEQ ID NO: 3885302 - RNA, 20 nt, Human
gggcuucaguggcagcugcu

SEQ ID NO: 3885303 - RNA, 20 nt, Human
gggcuucauccuccucagau

SEQ ID NO: 3885304 - RNA, 23 nt, Human
gggcuuccauuugugugugugca

SEQ ID NO: 3885305 - RNA, 16 nt, Human
gggcuucccaagggcu

SEQ ID NO: 3885306 - RNA, 16 nt, Human
gggcuucugcacccuc

SEQ ID NO: 3885307 - RNA, 17 nt, Human
gggcuucugcacccucc

SEQ ID NO: 3885308 - RNA, 21 nt, Human
gggcuucugcacccuccaccc

SEQ ID NO: 3885309 - RNA, 23 nt, Human
gggcuucugugcaccugggcucu

SEQ ID NO: 3885310 - RNA, 16 nt, Human
gggcuucugugcccag

SEQ ID NO: 3885311 - RNA, 15 nt, Human
gggcuugaagccaaa

SEQ ID NO: 3885312 - RNA, 13 nt, Human
gggcuuggccugc

SEQ ID NO: 3885313 - RNA, 20 nt, Human
gggcuugggccuaggcugca

SEQ ID NO: 3885314 - RNA, 20 nt, Human
gggcuuggggaccagagcug

SEQ ID NO: 3885315 - RNA, 21 nt, Human
gggcuuggggaccagagcugc

SEQ ID NO: 3885316 - RNA, 13 nt, Human
gggcuuuaaaauu

SEQ ID NO: 3885317 - RNA, 21 nt, Human
gggcuuuccugugccagguga

SEQ ID NO: 3885318 - RNA, 15 nt, Human
gggcuuucuggggcc

SEQ ID NO: 3885319 - RNA, 15 nt, Human
gggcuuugugugaag

SEQ ID NO: 3885320 - RNA, 14 nt, Human
gggcuuuuuucuuu

SEQ ID NO: 3885321 - RNA, 19 nt, Human
ggggaaaaucagccugcuc

SEQ ID NO: 3885322 - RNA, 22 nt, Human
ggggaaccugccaugccaggaa

SEQ ID NO: 3885323 - RNA, 16 nt, Human
ggggaacguucucuuu

SEQ ID NO: 3885324 - RNA, 19 nt, Human
ggggaagagagccugcagg

SEQ ID NO: 3885325 - RNA, 19 nt, Human
ggggaagagauccaaagac

SEQ ID NO: 3885326 - RNA, 13 nt, Human
ggggaaggagcca

SEQ ID NO: 3885327 - RNA, 21 nt, Human
ggggaaggagccaguuugccg

SEQ ID NO: 3885328 - RNA, 13 nt, Human
ggggaaggcaggg

SEQ ID NO: 3885329 - RNA, 17 nt, Human
ggggaaggccaagggga

SEQ ID NO: 3885330 - RNA, 14 nt, Human
ggggaaggggcggu

SEQ ID NO: 3885331 - RNA, 14 nt, Human
ggggaaugaggggg

SEQ ID NO: 3885332 - RNA, 22 nt, Human
ggggaauguuugccucugccuc

SEQ ID NO: 3885333 - RNA, 13 nt, Human
ggggacaggccuc

SEQ ID NO: 3885334 - RNA, 17 nt, Human
ggggacaggccucaccu

SEQ ID NO: 3885335 - RNA, 16 nt, Human
ggggacagggcuggcc

SEQ ID NO: 3885336 - RNA, 24 nt, Human
ggggacagggcuggcccagcccug

SEQ ID NO: 3885337 - RNA, 21 nt, Human
ggggaccaggagugggugggg

SEQ ID NO: 3885338 - RNA, 21 nt, Human
ggggacccaauguaggagcug

SEQ ID NO: 3885339 - RNA, 14 nt, Human
ggggacccaggcuc

SEQ ID NO: 3885340 - RNA, 15 nt, Human
ggggacccccgcccc

SEQ ID NO: 3885341 - RNA, 11 nt, Human
ggggacccugu

SEQ ID NO: 3885342 - RNA, 23 nt, Human
ggggacgcugguagagauggagg

SEQ ID NO: 3885343 - RNA, 21 nt, Human
ggggacucugagcgggaggca

SEQ ID NO: 3885344 - RNA, 23 nt, Human
ggggacucugagcgggaggcaga

SEQ ID NO: 3885345 - RNA, 15 nt, Human
ggggacucugggcua

SEQ ID NO: 3885346 - RNA, 22 nt, Human
ggggacucugggcuauggacac

SEQ ID NO: 3885347 - RNA, 18 nt, Human
ggggacugcugcugccug

SEQ ID NO: 3885348 - RNA, 18 nt, Human
ggggacuuggccucucuc

SEQ ID NO: 3885349 - RNA, 18 nt, Human
ggggagaaaguacuucuu

SEQ ID NO: 3885350 - RNA, 19 nt, Human
ggggagaacuuacauugug

SEQ ID NO: 3885351 - RNA, 17 nt, Human
ggggagacugggcugag

SEQ ID NO: 3885352 - RNA, 18 nt, Human
ggggagagcaggcuggca

SEQ ID NO: 3885353 - RNA, 14 nt, Human
ggggagcacccuga

SEQ ID NO: 3885354 - RNA, 14 nt, Human
ggggagcagagaca

SEQ ID NO: 3885355 - RNA, 14 nt, Human
ggggagcaggcagc

SEQ ID NO: 3885356 - RNA, 11 nt, Human
ggggagcccac

SEQ ID NO: 3885357 - RNA, 19 nt, Human
ggggagcccacuguccugg

SEQ ID NO: 3885358 - RNA, 22 nt, Human
ggggagccccuucugcucagcu

SEQ ID NO: 3885359 - RNA, 19 nt, Human
ggggagcgggucugcuccc

SEQ ID NO: 3885360 - RNA, 12 nt, Human
ggggagcuggac

SEQ ID NO: 3885361 - RNA, 15 nt, Human
ggggagcugggccug

SEQ ID NO: 3885362 - RNA, 18 nt, Human
ggggaggaaacucaccug

SEQ ID NO: 3885363 - RNA, 23 nt, Human
ggggaggaccugacccuacuccc

SEQ ID NO: 3885364 - RNA, 14 nt, Human
ggggaggagggggc

SEQ ID NO: 3885365 - RNA, 19 nt, Human
ggggaggaucacuggagcc

SEQ ID NO: 3885366 - RNA, 22 nt, Human
ggggaggcggacguuccagccg

SEQ ID NO: 3885367 - RNA, 14 nt, Human
ggggagggauucug

SEQ ID NO: 3885368 - RNA, 14 nt, Human
ggggagggcugcga

SEQ ID NO: 3885369 - RNA, 20 nt, Human
ggggaggggcgcuggcccag

SEQ ID NO: 3885370 - RNA, 18 nt, Human
ggggaggggcugugggcg

SEQ ID NO: 3885371 - RNA, 15 nt, Human
ggggagggggauccg

SEQ ID NO: 3885372 - RNA, 22 nt, Human
ggggagggguugccacaggccu

SEQ ID NO: 3885373 - RNA, 13 nt, Human
ggggaggguaggc

SEQ ID NO: 3885374 - RNA, 15 nt, Human
ggggagucaccuucc

SEQ ID NO: 3885375 - RNA, 11 nt, Human
ggggaguggaa

SEQ ID NO: 3885376 - RNA, 19 nt, Human
ggggagugggacagagucu

SEQ ID NO: 3885377 - RNA, 17 nt, Human
ggggaucacagccucug

SEQ ID NO: 3885378 - RNA, 21 nt, Human
ggggauccccgccuggccagg

SEQ ID NO: 3885379 - RNA, 22 nt, Human
ggggauccccgccuggccagga

SEQ ID NO: 3885380 - RNA, 23 nt, Human
ggggaucccucccccccaugcac

SEQ ID NO: 3885381 - RNA, 14 nt, Human
ggggaugugggagg

SEQ ID NO: 3885382 - RNA, 18 nt, Human
ggggaugugggagggagc

SEQ ID NO: 3885383 - RNA, 20 nt, Human
ggggauucuuccaucugauu

SEQ ID NO: 3885384 - RNA, 22 nt, Human
ggggcaagaagaucacgcuccc

SEQ ID NO: 3885385 - RNA, 14 nt, Human
ggggcacaagacug

SEQ ID NO: 3885386 - RNA, 22 nt, Human
ggggcacaagacugacgccagg

SEQ ID NO: 3885387 - RNA, 17 nt, Human
ggggcacaguccaggaa

SEQ ID NO: 3885388 - RNA, 21 nt, Human
ggggcacaugcugagucuccc

SEQ ID NO: 3885389 - RNA, 15 nt, Human
ggggcagagccagga

SEQ ID NO: 3885390 - RNA, 16 nt, Human
ggggcagagccaggaa

SEQ ID NO: 3885391 - RNA, 17 nt, Human
ggggcagagcccugcuc

SEQ ID NO: 3885392 - RNA, 21 nt, Human
ggggcagccaaacccaugagg

SEQ ID NO: 3885393 - RNA, 15 nt, Human
ggggcagcccuugcu

SEQ ID NO: 3885394 - RNA, 17 nt, Human
ggggcagccugcguggc

SEQ ID NO: 3885395 - RNA, 20 nt, Human
ggggcagcgggggccaggga

SEQ ID NO: 3885396 - RNA, 13 nt, Human
ggggcagcugacc

SEQ ID NO: 3885397 - RNA, 19 nt, Human
ggggcagcugccagagaag

SEQ ID NO: 3885398 - RNA, 14 nt, Human
ggggcaggcacagc

SEQ ID NO: 3885399 - RNA, 11 nt, Human
ggggcaggcag

SEQ ID NO: 3885400 - RNA, 21 nt, Human
ggggcaggcccugcacugucc

SEQ ID NO: 3885401 - RNA, 23 nt, Human
ggggcaggcccugcacuguccug

SEQ ID NO: 3885402 - RNA, 14 nt, Human
ggggcaggcugggc

SEQ ID NO: 3885403 - RNA, 16 nt, Human
ggggcaggcugggcca

SEQ ID NO: 3885404 - RNA, 21 nt, Human
ggggcagggaaggggaggcag

SEQ ID NO: 3885405 - RNA, 13 nt, Human
ggggcagggagcu

SEQ ID NO: 3885406 - RNA, 11 nt, Human
ggggcagucug

SEQ ID NO: 3885407 - RNA, 18 nt, Human
ggggcagucugagagagg

SEQ ID NO: 3885408 - RNA, 17 nt, Human
ggggcagucuggagggg

SEQ ID NO: 3885409 - RNA, 13 nt, Human
ggggcaguggcaa

SEQ ID NO: 3885410 - RNA, 15 nt, Human
ggggcaucuggccug

SEQ ID NO: 3885411 - RNA, 15 nt, Human
ggggcaugaccagau

SEQ ID NO: 3885412 - RNA, 19 nt, Human
ggggcauguauuggccugg

SEQ ID NO: 3885413 - RNA, 14 nt, Human
ggggcauugcugac

SEQ ID NO: 3885414 - RNA, 16 nt, Human
ggggccacacagaaac

SEQ ID NO: 3885415 - RNA, 20 nt, Human
ggggccacagccagaacccc

SEQ ID NO: 3885416 - RNA, 19 nt, Human
ggggccaccaaagcugccc

SEQ ID NO: 3885417 - RNA, 16 nt, Human
ggggccaccugccugc

SEQ ID NO: 3885418 - RNA, 16 nt, Human
guaccucaucccauga

SEQ ID NO: 3885419 - RNA, 15 nt, Human
guaccuccccugccu

SEQ ID NO: 3885420 - RNA, 16 nt, Human
guaccuccccugccuu

SEQ ID NO: 3885421 - RNA, 14 nt, Human
guaccuccucucag

SEQ ID NO: 3885422 - RNA, 18 nt, Human
guaccuccucucaguguu

SEQ ID NO: 3885423 - RNA, 19 nt, Human
guaccuccucucaguguuu

SEQ ID NO: 3885424 - RNA, 14 nt, Human
guaccucuggcuga

SEQ ID NO: 3885425 - RNA, 15 nt, Human
guaccucuggcugac

SEQ ID NO: 3885426 - RNA, 13 nt, Human
guaccucuugagc

SEQ ID NO: 3885427 - RNA, 22 nt, Human
guaccucuugagccuugaacuu

SEQ ID NO: 3885428 - RNA, 12 nt, Human
guaccugaaaag

SEQ ID NO: 3885429 - RNA, 23 nt, Human
guaccugaaaaguaacuuggcuu

SEQ ID NO: 3885430 - RNA, 17 nt, Human
guaccuggugaccccuu

SEQ ID NO: 3885431 - RNA, 23 nt, Human
guaccuugcuucuuacugauaau

SEQ ID NO: 3885432 - RNA, 19 nt, Human
guaccuuuuaacaccugau

SEQ ID NO: 3885433 - RNA, 17 nt, Human
guacggauuuucaguua

SEQ ID NO: 3885434 - RNA, 15 nt, Human
guacgucugacaggc

SEQ ID NO: 3885435 - RNA, 12 nt, Human
guacgugacccu

SEQ ID NO: 3885436 - RNA, 16 nt, Human
guacguugugcauuug

SEQ ID NO: 3885437 - RNA, 17 nt, Human
guacguuuguaugugug

SEQ ID NO: 3885438 - RNA, 13 nt, Human
guacuaaagccaa

SEQ ID NO: 3885439 - RNA, 13 nt, Human
guacuaagcauuu

SEQ ID NO: 3885440 - RNA, 15 nt, Human
guacuacaauuuaaa

SEQ ID NO: 3885441 - RNA, 15 nt, Human
guacuaccuguguau

SEQ ID NO: 3885442 - RNA, 15 nt, Human
guacuacuagauguc

SEQ ID NO: 3885443 - RNA, 21 nt, Human
guacuagagauauuuuguaaa

SEQ ID NO: 3885444 - RNA, 13 nt, Human
guacuaguacugu

SEQ ID NO: 3885445 - RNA, 19 nt, Human
guacuaguggcauggagaa

SEQ ID NO: 3885446 - RNA, 16 nt, Human
guacuaguuacacauc

SEQ ID NO: 3885447 - RNA, 13 nt, Human
guacuaguuuuag

SEQ ID NO: 3885448 - RNA, 14 nt, Human
guacuauaucuguu

SEQ ID NO: 3885449 - RNA, 17 nt, Human
guacuauaucuguuuua

SEQ ID NO: 3885450 - RNA, 19 nt, Human
guacuaucuuaucucagau

SEQ ID NO: 3885451 - RNA, 17 nt, Human
guacuauguaucaauga

SEQ ID NO: 3885452 - RNA, 18 nt, Human
guacuccacacugcacaa

SEQ ID NO: 3885453 - RNA, 19 nt, Human
guacuccacauauuucagu

SEQ ID NO: 3885454 - RNA, 15 nt, Human
guacucuaacuuaag

SEQ ID NO: 3885455 - RNA, 14 nt, Human
guacucuccuagag

SEQ ID NO: 3885456 - RNA, 15 nt, Human
guacucuccuagaga

SEQ ID NO: 3885457 - RNA, 23 nt, Human
guacucuccuagagacagaagca

SEQ ID NO: 3885458 - RNA, 12 nt, Human
guacucuggccu

SEQ ID NO: 3885459 - RNA, 15 nt, Human
guacucuggccucug

SEQ ID NO: 3885460 - RNA, 12 nt, Human
guacugaauuuu

SEQ ID NO: 3885461 - RNA, 18 nt, Human
guacugaauuuuuuugua

SEQ ID NO: 3885462 - RNA, 19 nt, Human
guacugaccccaucaccua

SEQ ID NO: 3885463 - RNA, 17 nt, Human
guacugacuuugcuugc

SEQ ID NO: 3885464 - RNA, 15 nt, Human
guacugauucaauuu

SEQ ID NO: 3885465 - RNA, 16 nt, Human
guacugauucaauuug

SEQ ID NO: 3885466 - RNA, 15 nt, Human
guacugauuucagua

SEQ ID NO: 3885467 - RNA, 13 nt, Human
guacugcagccuc

SEQ ID NO: 3885468 - RNA, 23 nt, Human
guacugccccccaugaggaagga

SEQ ID NO: 3885469 - RNA, 20 nt, Human
guacugcucaggcugcagcu

SEQ ID NO: 3885470 - RNA, 23 nt, Human
guacugcucaggcugcagcugga

SEQ ID NO: 3885471 - RNA, 16 nt, Human
guacuggagaaaaugg

SEQ ID NO: 3885472 - RNA, 14 nt, Human
guacuggcauggua

SEQ ID NO: 3885473 - RNA, 16 nt, Human
guacuguaagaauaau

SEQ ID NO: 3885474 - RNA, 18 nt, Human
guacuguaauaauaccuc

SEQ ID NO: 3885475 - RNA, 20 nt, Human
guacuguaauaauaccucaa

SEQ ID NO: 3885476 - RNA, 15 nt, Human
guacuguacagcugg

SEQ ID NO: 3885477 - RNA, 19 nt, Human
guacuguacagcuggcucu

SEQ ID NO: 3885478 - RNA, 13 nt, Human
guacuguacuaau

SEQ ID NO: 3885479 - RNA, 14 nt, Human
guacuguacuaauu

SEQ ID NO: 3885480 - RNA, 14 nt, Human
guacuguaugauca

SEQ ID NO: 3885481 - RNA, 17 nt, Human
guacuguaugaucaaau

SEQ ID NO: 3885482 - RNA, 20 nt, Human
guacuguaugaucaaauguu

SEQ ID NO: 3885483 - RNA, 22 nt, Human
guacuguaugaucaaauguuua

SEQ ID NO: 3885484 - RNA, 23 nt, Human
guacuguguacagaauucugcua

SEQ ID NO: 3885485 - RNA, 14 nt, Human
guacuguguacugu

SEQ ID NO: 3885486 - RNA, 18 nt, Human
guacuguuacugggcccu

SEQ ID NO: 3885487 - RNA, 14 nt, Human
guacuguucugugu

SEQ ID NO: 3885488 - RNA, 18 nt, Human
guacuguucugugucuuu

SEQ ID NO: 3885489 - RNA, 15 nt, Human
guacuguuuaauguu

SEQ ID NO: 3885490 - RNA, 20 nt, Human
guacuuagaguuucuguuug

SEQ ID NO: 3885491 - RNA, 22 nt, Human
guacuucaaauccuugaagauu

SEQ ID NO: 3885492 - RNA, 21 nt, Human
guacuucacugucaggaagaa

SEQ ID NO: 3885493 - RNA, 23 nt, Human
guacuucagcaagagagaaccua

SEQ ID NO: 3885494 - RNA, 22 nt, Human
guacuucccgggccagggcugc

SEQ ID NO: 3885495 - RNA, 21 nt, Human
guacuuccugaguggccaggg

SEQ ID NO: 3885496 - RNA, 22 nt, Human
guacuugcccugaccaugcauu

SEQ ID NO: 3885497 - RNA, 15 nt, Human
guacuugcucuugau

SEQ ID NO: 3885498 - RNA, 16 nt, Human
guacuugcucuugaug

SEQ ID NO: 3885499 - RNA, 19 nt, Human
guacuugcucuugaugccu

SEQ ID NO: 3885500 - RNA, 21 nt, Human
guacuugguccaacugcaacu

SEQ ID NO: 3885501 - RNA, 11 nt, Human
guacuugucaa

SEQ ID NO: 3885502 - RNA, 14 nt, Human
guacuugucaaaga

SEQ ID NO: 3885503 - RNA, 15 nt, Human
guacuugucaaagaa

SEQ ID NO: 3885504 - RNA, 20 nt, Human
guacuugugaaacacagcug

SEQ ID NO: 3885505 - RNA, 16 nt, Human
guacuuguggacacag

SEQ ID NO: 3885506 - RNA, 20 nt, Human
guacuuguggacacagcucu

SEQ ID NO: 3885507 - RNA, 21 nt, Human
guacuuguggacacagcucuu

SEQ ID NO: 3885508 - RNA, 16 nt, Human
guacuuguuucucugu

SEQ ID NO: 3885509 - RNA, 15 nt, Human
guacuuuaucaugaa

SEQ ID NO: 3885510 - RNA, 20 nt, Human
guacuuuaucaugaaugcuu

SEQ ID NO: 3885511 - RNA, 17 nt, Human
guacuuucuauuuuaau

SEQ ID NO: 3885512 - RNA, 15 nt, Human
guacuuucuguuaaa

SEQ ID NO: 3885513 - RNA, 21 nt, Human
guacuuucuguuaugggcuuu

SEQ ID NO: 3885514 - RNA, 21 nt, Human
guacuuugauucacauguuuu

SEQ ID NO: 3885515 - RNA, 20 nt, Human
guacuuugucuaagaaacau

SEQ ID NO: 3885516 - RNA, 10 nt, Human
guacuuugug

SEQ ID NO: 3885517 - RNA, 17 nt, Human
guacuuuuaaaaacaua

SEQ ID NO: 3885518 - RNA, 20 nt, Human
guacuuuuaugauguauauu

SEQ ID NO: 3885519 - RNA, 22 nt, Human
guacuuuuaugauguauauuua

SEQ ID NO: 3885520 - RNA, 23 nt, Human
guacuuuuauuuuacacagaaac

SEQ ID NO: 3885521 - RNA, 17 nt, Human
guacuuuucauucucuu

SEQ ID NO: 3885522 - RNA, 21 nt, Human
guacuuuucccauuuguaauu

SEQ ID NO: 3885523 - RNA, 18 nt, Human
guacuuuugagugugugu

SEQ ID NO: 3885524 - RNA, 23 nt, Human
guacuuuuuaguaauuucuuuuu

SEQ ID NO: 3885525 - RNA, 14 nt, Human
guacuuuuugugaa

SEQ ID NO: 3885526 - RNA, 21 nt, Human
guacuuuuuuaaauauuuucu

SEQ ID NO: 3885527 - RNA, 12 nt, Human
guagaaaaauuu

SEQ ID NO: 3885528 - RNA, 18 nt, Human
guagaaagacagagcugg

SEQ ID NO: 3885529 - RNA, 21 nt, Human
guagaaagacagagcugggau

SEQ ID NO: 3885530 - RNA, 21 nt, Human
guagaaaggccuuuaaaauuu

SEQ ID NO: 3885531 - RNA, 16 nt, Human
guagaaauaauaugca

SEQ ID NO: 3885532 - RNA, 17 nt, Human
guagaaauaauaugcau

SEQ ID NO: 3885533 - RNA, 20 nt, Human
guagaaauaucugaaaaugu

SEQ ID NO: 3885534 - RNA, 21 nt, Human
guagaaauaucugaaaaugua

SEQ ID NO: 3885535 - RNA, 23 nt, Human
guagaaauaucugaaaauguaug

SEQ ID NO: 3885536 - RNA, 20 nt, Human
guagaaaucccccuuucucu

SEQ ID NO: 3885537 - RNA, 18 nt, Human
guagaacacuaauucaua

SEQ ID NO: 3885538 - RNA, 14 nt, Human
guagaaccucaccu

SEQ ID NO: 3885539 - RNA, 17 nt, Human
guagaacucacucuggg

SEQ ID NO: 3885540 - RNA, 21 nt, Human
guagaacucacucugggcugu

SEQ ID NO: 3885541 - RNA, 16 nt, Human
guagaacugucuguga

SEQ ID NO: 3885542 - RNA, 20 nt, Human
guagaagauuugaugcugga

SEQ ID NO: 3885543 - RNA, 18 nt, Human
guagaagcauuccuucuu

SEQ ID NO: 3885544 - RNA, 19 nt, Human
guagaaggguuauauuuua

SEQ ID NO: 3885545 - RNA, 18 nt, Human
guagaaguucuaguguuu

SEQ ID NO: 3885546 - RNA, 22 nt, Human
guagaaguucuaguguuuucaa

SEQ ID NO: 3885547 - RNA, 14 nt, Human
guagaaguuuuugu

SEQ ID NO: 3885548 - RNA, 11 nt, Human
guagaauauuc

SEQ ID NO: 3885549 - RNA, 18 nt, Human
guagaaugaccuuguaau

SEQ ID NO: 3885550 - RNA, 20 nt, Human
guagaaugaccuuguaaugu

SEQ ID NO: 3885551 - RNA, 16 nt, Human
guagaauguaaagcuu

SEQ ID NO: 3885552 - RNA, 19 nt, Human
guagaauguauuguaccuu

SEQ ID NO: 3885553 - RNA, 23 nt, Human
guagaauguauuguaccuuuuaa

SEQ ID NO: 3885554 - RNA, 15 nt, Human
guagaauugcauuga

SEQ ID NO: 3885555 - RNA, 22 nt, Human
guagacaagcaauuagacaaga

SEQ ID NO: 3885556 - RNA, 21 nt, Human
guagacacacuaucauaguua

SEQ ID NO: 3885557 - RNA, 15 nt, Human
guagacauuucucuu

SEQ ID NO: 3885558 - RNA, 14 nt, Human
guagaccccuggcu

SEQ ID NO: 3885559 - RNA, 20 nt, Human
guagaccuagggaggaccuu

SEQ ID NO: 3885560 - RNA, 19 nt, Human
guagaccugucuccuggcg

SEQ ID NO: 3885561 - RNA, 19 nt, Human
guagaccuuguuacuucug

SEQ ID NO: 3885562 - RNA, 21 nt, Human
guauucucuccuguaccucuu

SEQ ID NO: 3885563 - RNA, 11 nt, Human
guauucucuga

SEQ ID NO: 3885564 - RNA, 12 nt, Human
guauucucugag

SEQ ID NO: 3885565 - RNA, 12 nt, Human
guauucucuuuu

SEQ ID NO: 3885566 - RNA, 18 nt, Human
guauucucuuuucaagaa

SEQ ID NO: 3885567 - RNA, 19 nt, Human
guauucucuuuucaagaag

SEQ ID NO: 3885568 - RNA, 18 nt, Human
guauucugggguauggcg

SEQ ID NO: 3885569 - RNA, 17 nt, Human
guauucuguucuggagg

SEQ ID NO: 3885570 - RNA, 20 nt, Human
guauucuuaaaaugcaauau

SEQ ID NO: 3885571 - RNA, 15 nt, Human
guauucuucaaccuc

SEQ ID NO: 3885572 - RNA, 11 nt, Human
guauucuuuga

SEQ ID NO: 3885573 - RNA, 14 nt, Human
guauucuuugaugu

SEQ ID NO: 3885574 - RNA, 18 nt, Human
guauucuuugauguuaac

SEQ ID NO: 3885575 - RNA, 10 nt, Human
guauugaagc

SEQ ID NO: 3885576 - RNA, 22 nt, Human
guauugaagcauuuuauaaauc

SEQ ID NO: 3885577 - RNA, 13 nt, Human
guauugacaaaau

SEQ ID NO: 3885578 - RNA, 19 nt, Human
guauugacaaaauguuauu

SEQ ID NO: 3885579 - RNA, 20 nt, Human
guauugacaaaauguuauuu

SEQ ID NO: 3885580 - RNA, 13 nt, Human
guauugcacauug

SEQ ID NO: 3885581 - RNA, 23 nt, Human
guauugcaucuguauaaguaaga

SEQ ID NO: 3885582 - RNA, 16 nt, Human
guauugccaaacauua

SEQ ID NO: 3885583 - RNA, 12 nt, Human
guauuggcaaag

SEQ ID NO: 3885584 - RNA, 12 nt, Human
guauuggccugg

SEQ ID NO: 3885585 - RNA, 15 nt, Human
guauuggccuggagg

SEQ ID NO: 3885586 - RNA, 22 nt, Human
guauuggcuagagguucaaaga

SEQ ID NO: 3885587 - RNA, 17 nt, Human
guauugguggcuuuccu

SEQ ID NO: 3885588 - RNA, 19 nt, Human
guauuguaaauuauauuug

SEQ ID NO: 3885589 - RNA, 20 nt, Human
guauuguaaauuauauuugu

SEQ ID NO: 3885590 - RNA, 10 nt, Human
guauuguaca

SEQ ID NO: 3885591 - RNA, 21 nt, Human
guauuguacaaaguauuaagc

SEQ ID NO: 3885592 - RNA, 23 nt, Human
guauuguacaaaguauuaagcau

SEQ ID NO: 3885593 - RNA, 13 nt, Human
guauuguauuuau

SEQ ID NO: 3885594 - RNA, 17 nt, Human
guauuguauuuauucaa

SEQ ID NO: 3885595 - RNA, 18 nt, Human
guauuguauuuauucaau

SEQ ID NO: 3885596 - RNA, 21 nt, Human
guauuguccuauuaguguuau

SEQ ID NO: 3885597 - RNA, 18 nt, Human
guauuguucccagugaca

SEQ ID NO: 3885598 - RNA, 20 nt, Human
guauuguuugggauccuauu

SEQ ID NO: 3885599 - RNA, 16 nt, Human
guauuuaacaaaaagu

SEQ ID NO: 3885600 - RNA, 20 nt, Human
guauuuaacaaaaagugcuu

SEQ ID NO: 3885601 - RNA, 20 nt, Human
guauuuaacagaaauuguau

SEQ ID NO: 3885602 - RNA, 14 nt, Human
guauuuaagcaaau

SEQ ID NO: 3885603 - RNA, 12 nt, Human
guauuuaagccu

SEQ ID NO: 3885604 - RNA, 20 nt, Human
guauuuaauagguuuggaca

SEQ ID NO: 3885605 - RNA, 18 nt, Human
guauuuaauuagugcuaa

SEQ ID NO: 3885606 - RNA, 12 nt, Human
guauuuauaaua

SEQ ID NO: 3885607 - RNA, 20 nt, Human
guauuuaucuauuguaagau

SEQ ID NO: 3885608 - RNA, 22 nt, Human
guauuuauggguggauuuaucc

SEQ ID NO: 3885609 - RNA, 11 nt, Human
guauuuauuca

SEQ ID NO: 3885610 - RNA, 14 nt, Human
guauuuauucaaua

SEQ ID NO: 3885611 - RNA, 17 nt, Human
guauuuauucaauaaag

SEQ ID NO: 3885612 - RNA, 20 nt, Human
guauuuauucaauaaaguau

SEQ ID NO: 3885613 - RNA, 23 nt, Human
guauuuauucaauaaaguauuua

SEQ ID NO: 3885614 - RNA, 15 nt, Human
guauuuauuccauau

SEQ ID NO: 3885615 - RNA, 19 nt, Human
guauuuauuuaguauuuau

SEQ ID NO: 3885616 - RNA, 16 nt, Human
guauuuauuuauguac

SEQ ID NO: 3885617 - RNA, 18 nt, Human
guauuuauuuuccucccc

SEQ ID NO: 3885618 - RNA, 19 nt, Human
guauuuauuuuccucccca

SEQ ID NO: 3885619 - RNA, 17 nt, Human
guauuuauuuuguaauu

SEQ ID NO: 3885620 - RNA, 13 nt, Human
guauuucagugua

SEQ ID NO: 3885621 - RNA, 15 nt, Human
guauuucauguggcu

SEQ ID NO: 3885622 - RNA, 17 nt, Human
guauuucauguggcugu

SEQ ID NO: 3885623 - RNA, 18 nt, Human
guauuucauguggcugua

SEQ ID NO: 3885624 - RNA, 16 nt, Human
guauuuccagugcaau

SEQ ID NO: 3885625 - RNA, 14 nt, Human
guauuugaaacuga

SEQ ID NO: 3885626 - RNA, 14 nt, Human
guauuugaauuaaa

SEQ ID NO: 3885627 - RNA, 18 nt, Human
guauuugaauuaaaacuu

SEQ ID NO: 3885628 - RNA, 22 nt, Human
guauuugaauuaaaacuucuua

SEQ ID NO: 3885629 - RNA, 15 nt, Human
guauuugagacauuc

SEQ ID NO: 3885630 - RNA, 13 nt, Human
guauuugcaguuc

SEQ ID NO: 3885631 - RNA, 22 nt, Human
guauuugcuuuuuuguuuuggc

SEQ ID NO: 3885632 - RNA, 16 nt, Human
guauuuggauaucugu

SEQ ID NO: 3885633 - RNA, 21 nt, Human
guauuugggaaacuugucacu

SEQ ID NO: 3885634 - RNA, 23 nt, Human
guauuuguuaauuuagaaaacuu

SEQ ID NO: 3885635 - RNA, 14 nt, Human
guauuuguucaugu

SEQ ID NO: 3885636 - RNA, 12 nt, Human
guauuuguuugc

SEQ ID NO: 3885637 - RNA, 18 nt, Human
guauuuuaaaagaaugau

SEQ ID NO: 3885638 - RNA, 20 nt, Human
guauuuuaaaagaaugauua

SEQ ID NO: 3885639 - RNA, 23 nt, Human
guauuuuaaaauagcguucuugu

SEQ ID NO: 3885640 - RNA, 14 nt, Human
guauuuuacuaaua

SEQ ID NO: 3885641 - RNA, 19 nt, Human
guauuuuaggcagggauuu

SEQ ID NO: 3885642 - RNA, 15 nt, Human
guauuuuaguauauu

SEQ ID NO: 3885643 - RNA, 22 nt, Human
guauuuuauaaaauuaaagaaa

SEQ ID NO: 3885644 - RNA, 19 nt, Human
guauuuuauaauucuggga

SEQ ID NO: 3885645 - RNA, 22 nt, Human
guauuuuaucuuugauucuccu

SEQ ID NO: 3885646 - RNA, 13 nt, Human
guauuuuauguau

SEQ ID NO: 3885647 - RNA, 16 nt, Human
guauuuuauguuauau

SEQ ID NO: 3885648 - RNA, 22 nt, Human
guauuuuauguuauauauaaau

SEQ ID NO: 3885649 - RNA, 17 nt, Human
guauuuuauuguaacag

SEQ ID NO: 3885650 - RNA, 16 nt, Human
guauuuuccaagugug

SEQ ID NO: 3885651 - RNA, 20 nt, Human
guauuuuccaagugugcaua

SEQ ID NO: 3885652 - RNA, 16 nt, Human
guauuuuccuguaaaa

SEQ ID NO: 3885653 - RNA, 19 nt, Human
guauuuucuucucugugag

SEQ ID NO: 3885654 - RNA, 15 nt, Human
guauuuucuuucucu

SEQ ID NO: 3885655 - RNA, 18 nt, Human
guauuuucuuucucuacu

SEQ ID NO: 3885656 - RNA, 18 nt, Human
guauuuugugugaccaac

SEQ ID NO: 3885657 - RNA, 22 nt, Human
guauuuuuaauggggguagcag

SEQ ID NO: 3885658 - RNA, 14 nt, Human
guauuuuuauaaau

SEQ ID NO: 3885659 - RNA, 13 nt, Human
guauuuuuaucca

SEQ ID NO: 3885660 - RNA, 13 nt, Human
guauuuuucuuga

SEQ ID NO: 3885661 - RNA, 12 nt, Human
guauuuuugaca

SEQ ID NO: 3885662 - RNA, 20 nt, Human
guauuuuugacagaauaugu

SEQ ID NO: 3885663 - RNA, 15 nt, Human
guauuuuuuaaagcu

SEQ ID NO: 3885664 - RNA, 17 nt, Human
guauuuuuuaaugcuaa

SEQ ID NO: 3885665 - RNA, 14 nt, Human
guauuuuuuccuuu

SEQ ID NO: 3885666 - RNA, 17 nt, Human
guauuuuuuugcaagug

SEQ ID NO: 3885667 - RNA, 14 nt, Human
gucaaaaagaacca

SEQ ID NO: 3885668 - RNA, 19 nt, Human
gucaaaaagaaccacuugu

SEQ ID NO: 3885669 - RNA, 23 nt, Human
gucaaaaauuaaaccggaccauc

SEQ ID NO: 3885670 - RNA, 14 nt, Human
gucaaaacacugug

SEQ ID NO: 3885671 - RNA, 14 nt, Human
gucaaaacuuuaaa

SEQ ID NO: 3885672 - RNA, 17 nt, Human
gucaaaaguagaacuuu

SEQ ID NO: 3885673 - RNA, 23 nt, Human
gucaaaaguagaacuuuguauag

SEQ ID NO: 3885674 - RNA, 16 nt, Human
gucaaaaguuggacua

SEQ ID NO: 3885675 - RNA, 16 nt, Human
gucaaacaugaagugu

SEQ ID NO: 3885676 - RNA, 17 nt, Human
gucaaacauuaguacuu

SEQ ID NO: 3885677 - RNA, 16 nt, Human
gucaaaccauaaacuu

SEQ ID NO: 3885678 - RNA, 13 nt, Human
gucaaaccgcacu

SEQ ID NO: 3885679 - RNA, 21 nt, Human
gucaaaccgcacucacccaug

SEQ ID NO: 3885680 - RNA, 14 nt, Human
gucaaacgugaaaa

SEQ ID NO: 3885681 - RNA, 15 nt, Human
gucaaacgugaaaau

SEQ ID NO: 3885682 - RNA, 21 nt, Human
gucaaacuuggauacuuggau

SEQ ID NO: 3885683 - RNA, 16 nt, Human
gucaaagcaaggaucu

SEQ ID NO: 3885684 - RNA, 19 nt, Human
gucaaaguggugagaggca

SEQ ID NO: 3885685 - RNA, 16 nt, Human
gucaaaugaugugcaa

SEQ ID NO: 3885686 - RNA, 22 nt, Human
gucaaaugguaggcauuuccua

SEQ ID NO: 3885687 - RNA, 18 nt, Human
gucaacaaacuauuucuu

SEQ ID NO: 3885688 - RNA, 22 nt, Human
gucaacaaaucuaggaaaauau

SEQ ID NO: 3885689 - RNA, 21 nt, Human
gucaacaaguaugaauaaaga

SEQ ID NO: 3885690 - RNA, 19 nt, Human
gucaacacuuaaggguuuu

SEQ ID NO: 3885691 - RNA, 13 nt, Human
gucaacagaauga

SEQ ID NO: 3885692 - RNA, 15 nt, Human
gucaacagaaugaaa

SEQ ID NO: 3885693 - RNA, 16 nt, Human
gucaacagaaugaaaa

SEQ ID NO: 3885694 - RNA, 19 nt, Human
gucaacagagaaggcagga

SEQ ID NO: 3885695 - RNA, 17 nt, Human
gucaacauuucucaugu

SEQ ID NO: 3885696 - RNA, 15 nt, Human
gucaaccagacagag

SEQ ID NO: 3885697 - RNA, 21 nt, Human
gucaacgagacguuuccuacc

SEQ ID NO: 3885698 - RNA, 17 nt, Human
gucaacucuuuguuauu

SEQ ID NO: 3885699 - RNA, 15 nt, Human
gucaacuucuggcuc

SEQ ID NO: 3885700 - RNA, 17 nt, Human
gucaacuucuggcuccu

SEQ ID NO: 3885701 - RNA, 20 nt, Human
gucaacuugagcauguuacu

SEQ ID NO: 3885702 - RNA, 12 nt, Human
gucaagaagaaa

SEQ ID NO: 3885703 - RNA, 15 nt, Human
gucaagaagaaaaag

SEQ ID NO: 3885704 - RNA, 17 nt, Human
gucaagaagaagaugga

SEQ ID NO: 3885705 - RNA, 19 nt, Human
gucaagagugaauucccuc

SEQ ID NO: 3885706 - RNA, 20 nt, Human
gucaagcugcucugagccac

SEQ ID NO: 3885707 - RNA, 13 nt, Human
gugaggcucugcc

SEQ ID NO: 3885708 - RNA, 16 nt, Human
gugaggcucugcccuu

SEQ ID NO: 3885709 - RNA, 21 nt, Human
gugaggcuuaacaaugucuug

SEQ ID NO: 3885710 - RNA, 17 nt, Human
gugagggagggcuguca

SEQ ID NO: 3885711 - RNA, 13 nt, Human
gugagggagggga

SEQ ID NO: 3885712 - RNA, 17 nt, Human
gugagggggggcucccu

SEQ ID NO: 3885713 - RNA, 21 nt, Human
gugagggguauaucugggcug

SEQ ID NO: 3885714 - RNA, 16 nt, Human
gugagggucccaugug

SEQ ID NO: 3885715 - RNA, 14 nt, Human
gugaggguccugca

SEQ ID NO: 3885716 - RNA, 23 nt, Human
gugaggguccugcagccugcagg

SEQ ID NO: 3885717 - RNA, 24 nt, Human
gugaggguccugcagccugcagga

SEQ ID NO: 3885718 - RNA, 12 nt, Human
gugagguccugg

SEQ ID NO: 3885719 - RNA, 13 nt, Human
gugagguccuggg

SEQ ID NO: 3885720 - RNA, 16 nt, Human
gugagguccugggggc

SEQ ID NO: 3885721 - RNA, 20 nt, Human
gugagguccugggggccuga

SEQ ID NO: 3885722 - RNA, 15 nt, Human
gugagguuucccaau

SEQ ID NO: 3885723 - RNA, 13 nt, Human
gugaguaaauauu

SEQ ID NO: 3885724 - RNA, 14 nt, Human
gugaguaagagcug

SEQ ID NO: 3885725 - RNA, 15 nt, Human
gugaguaagagcugg

SEQ ID NO: 3885726 - RNA, 16 nt, Human
gugaguaagagcuggu

SEQ ID NO: 3885727 - RNA, 17 nt, Human
gugaguacuacaguccu

SEQ ID NO: 3885728 - RNA, 14 nt, Human
gugaguccuccaga

SEQ ID NO: 3885729 - RNA, 17 nt, Human
gugaguccuccagaacu

SEQ ID NO: 3885730 - RNA, 17 nt, Human
gugaguccuggcauggg

SEQ ID NO: 3885731 - RNA, 18 nt, Human
gugagucuuggcggcagc

SEQ ID NO: 3885732 - RNA, 19 nt, Human
gugagucuuggcggcagca

SEQ ID NO: 3885733 - RNA, 20 nt, Human
gugagucuuggcggcagcag

SEQ ID NO: 3885734 - RNA, 18 nt, Human
gugagugacgaugaugua

SEQ ID NO: 3885735 - RNA, 14 nt, Human
gugagugagccugg

SEQ ID NO: 3885736 - RNA, 18 nt, Human
gugagugagccuggcucu

SEQ ID NO: 3885737 - RNA, 16 nt, Human
gugaguguaaguguga

SEQ ID NO: 3885738 - RNA, 14 nt, Human
gugagugugacagg

SEQ ID NO: 3885739 - RNA, 19 nt, Human
gugagugugacagggccag

SEQ ID NO: 3885740 - RNA, 16 nt, Human
gugaguguggcucccc

SEQ ID NO: 3885741 - RNA, 22 nt, Human
gugaguguguccaagugugugu

SEQ ID NO: 3885742 - RNA, 17 nt, Human
gugaguuacagcgagag

SEQ ID NO: 3885743 - RNA, 20 nt, Human
gugaguuuaguaaggcugug

SEQ ID NO: 3885744 - RNA, 21 nt, Human
gugaguuuggucuggacugac

SEQ ID NO: 3885745 - RNA, 12 nt, Human
gugaguuuguuu

SEQ ID NO: 3885746 - RNA, 13 nt, Human
gugaguuuguuuc

SEQ ID NO: 3885747 - RNA, 13 nt, Human
gugauaaaaucau

SEQ ID NO: 3885748 - RNA, 21 nt, Human
gugauaaaaucauaaguauuu

SEQ ID NO: 3885749 - RNA, 17 nt, Human
gugauaaaucagucaag

SEQ ID NO: 3885750 - RNA, 12 nt, Human
gugauaaggaca

SEQ ID NO: 3885751 - RNA, 21 nt, Human
gugauaaggacaugaugcuuu

SEQ ID NO: 3885752 - RNA, 15 nt, Human
gugauacaaugcugu

SEQ ID NO: 3885753 - RNA, 15 nt, Human
gugauacauuuuuua

SEQ ID NO: 3885754 - RNA, 13 nt, Human
gugauagcacuuu

SEQ ID NO: 3885755 - RNA, 12 nt, Human
gugauagcauug

SEQ ID NO: 3885756 - RNA, 17 nt, Human
gugauaguucacccccu

SEQ ID NO: 3885757 - RNA, 16 nt, Human
gugauauauguauuaa

SEQ ID NO: 3885758 - RNA, 13 nt, Human
gugauauauuuaa

SEQ ID NO: 3885759 - RNA, 19 nt, Human
gugauaugcacaauguaga

SEQ ID NO: 3885760 - RNA, 17 nt, Human
gugauauggagcaagag

SEQ ID NO: 3885761 - RNA, 20 nt, Human
gugauauucuuuguuaauuu

SEQ ID NO: 3885762 - RNA, 22 nt, Human
gugauauucuuuguuaauuugg

SEQ ID NO: 3885763 - RNA, 17 nt, Human
gugauauuucagaaaua

SEQ ID NO: 3885764 - RNA, 13 nt, Human
gugauauuucucu

SEQ ID NO: 3885765 - RNA, 13 nt, Human
gugaucaaagcca

SEQ ID NO: 3885766 - RNA, 16 nt, Human
gugaucaauaaaaugu

SEQ ID NO: 3885767 - RNA, 19 nt, Human
gugaucaauaaaaugugau

SEQ ID NO: 3885768 - RNA, 17 nt, Human
gugaucaauauuuuuau

SEQ ID NO: 3885769 - RNA, 17 nt, Human
gugaucaauuaaaugua

SEQ ID NO: 3885770 - RNA, 14 nt, Human
gugaucacuuucug

SEQ ID NO: 3885771 - RNA, 18 nt, Human
gugauccacccaccucag

SEQ ID NO: 3885772 - RNA, 23 nt, Human
gugauccacccaccucagccucc

SEQ ID NO: 3885773 - RNA, 21 nt, Human
gugaucccuagcugugaccuc

SEQ ID NO: 3885774 - RNA, 15 nt, Human
gugauccucccaccu

SEQ ID NO: 3885775 - RNA, 18 nt, Human
gugauccucccaccucag

SEQ ID NO: 3885776 - RNA, 22 nt, Human
gugauccucccaccucagccuc

SEQ ID NO: 3885777 - RNA, 22 nt, Human
gugaucgaugauucaggugcag

SEQ ID NO: 3885778 - RNA, 14 nt, Human
gugaucucagauca

SEQ ID NO: 3885779 - RNA, 23 nt, Human
gugaucucauuguucaauuccca

SEQ ID NO: 3885780 - RNA, 14 nt, Human
gugaucucauuuaa

SEQ ID NO: 3885781 - RNA, 19 nt, Human
gugaucugcugcagagcag

SEQ ID NO: 3885782 - RNA, 13 nt, Human
gugaucugucuug

SEQ ID NO: 3885783 - RNA, 21 nt, Human
gugaucuuaauauauuugaaa

SEQ ID NO: 3885784 - RNA, 12 nt, Human
gugaucuuauuu

SEQ ID NO: 3885785 - RNA, 15 nt, Human
gugaucuuuuaaagu

SEQ ID NO: 3885786 - RNA, 15 nt, Human
gugaugaacuuucuc

SEQ ID NO: 3885787 - RNA, 14 nt, Human
gugaugaauacugu

SEQ ID NO: 3885788 - RNA, 13 nt, Human
gugaugacauauu

SEQ ID NO: 3885789 - RNA, 14 nt, Human
gugaugagaggaaa

SEQ ID NO: 3885790 - RNA, 14 nt, Human
gugaugagggcagc

SEQ ID NO: 3885791 - RNA, 15 nt, Human
gugaugaggggaggg

SEQ ID NO: 3885792 - RNA, 15 nt, Human
gugaugccacacaga

SEQ ID NO: 3885793 - RNA, 19 nt, Human
gugaugccacacagagugg

SEQ ID NO: 3885794 - RNA, 15 nt, Human
gugaugcgcaguugc

SEQ ID NO: 3885795 - RNA, 22 nt, Human
gugaugcgcaugucacggaggg

SEQ ID NO: 3885796 - RNA, 22 nt, Human
gugaugcuaaagguuguauugc

SEQ ID NO: 3885797 - RNA, 16 nt, Human
gugauggggcccugcc

SEQ ID NO: 3885798 - RNA, 17 nt, Human
gugauggggcccugccu

SEQ ID NO: 3885799 - RNA, 16 nt, Human
gugaugguguagcccu

SEQ ID NO: 3885800 - RNA, 22 nt, Human
gugaugguuccccuguucacuc

SEQ ID NO: 3885801 - RNA, 16 nt, Human
gugaugucauacagag

SEQ ID NO: 3885802 - RNA, 17 nt, Human
gugaugucauacagaga

SEQ ID NO: 3885803 - RNA, 14 nt, Human
gugaugucaucugu

SEQ ID NO: 3885804 - RNA, 16 nt, Human
gugaugugacauuugu

SEQ ID NO: 3885805 - RNA, 13 nt, Human
gugauguuagugu

SEQ ID NO: 3885806 - RNA, 22 nt, Human
gugauguucuaaggcucugaga

SEQ ID NO: 3885807 - RNA, 15 nt, Human
gugauguuuuuauga

SEQ ID NO: 3885808 - RNA, 19 nt, Human
gugauuagaggcagaucug

SEQ ID NO: 3885809 - RNA, 14 nt, Human
gugauucaaucugu

SEQ ID NO: 3885810 - RNA, 16 nt, Human
gugauucaaucuguaa

SEQ ID NO: 3885811 - RNA, 20 nt, Human
gugauucacagugugaaucu

SEQ ID NO: 3885812 - RNA, 22 nt, Human
gugauuccacuacaccuggcug

SEQ ID NO: 3885813 - RNA, 15 nt, Human
gugauuccgcaguga

SEQ ID NO: 3885814 - RNA, 21 nt, Human
gugauuccuaagccacuugaa

SEQ ID NO: 3885815 - RNA, 19 nt, Human
gugauuccuuugaagagga

SEQ ID NO: 3885816 - RNA, 20 nt, Human
gugauucucaugccucagcc

SEQ ID NO: 3885817 - RNA, 13 nt, Human
gugauucuccugc

SEQ ID NO: 3885818 - RNA, 14 nt, Human
gugauucuccugcc

SEQ ID NO: 3885819 - RNA, 16 nt, Human
gugauucuccugccuc

SEQ ID NO: 3885820 - RNA, 18 nt, Human
gugauucuccugccucag

SEQ ID NO: 3885821 - RNA, 23 nt, Human
gugauucuccugccucagccucc

SEQ ID NO: 3885822 - RNA, 17 nt, Human
gugauugacagcuuugc

SEQ ID NO: 3885823 - RNA, 19 nt, Human
gugauugcagcuuuauguu

SEQ ID NO: 3885824 - RNA, 16 nt, Human
gugauugggacagagg

SEQ ID NO: 3885825 - RNA, 14 nt, Human
gugauuguggaaug

SEQ ID NO: 3885826 - RNA, 19 nt, Human
gugauuguggaauggagau

SEQ ID NO: 3885827 - RNA, 17 nt, Human
gugauuuaagggcccag

SEQ ID NO: 3885828 - RNA, 15 nt, Human
gugauuuaauagugu

SEQ ID NO: 3885829 - RNA, 19 nt, Human
gugauuuaauaguguuaau

SEQ ID NO: 3885830 - RNA, 18 nt, Human
gugauuuacgcucauugu

SEQ ID NO: 3885831 - RNA, 18 nt, Human
gugauuuagaacuguaug

SEQ ID NO: 3885832 - RNA, 19 nt, Human
gugauuucagagagggcag

SEQ ID NO: 3885833 - RNA, 20 nt, Human
gugauuucccguggccccag

SEQ ID NO: 3885834 - RNA, 14 nt, Human
gugauuugaaaaau

SEQ ID NO: 3885835 - RNA, 23 nt, Human
gugauuugaaaaauauaaaauua

SEQ ID NO: 3885836 - RNA, 21 nt, Human
gugauuugacuguuuuuaccc

SEQ ID NO: 3885837 - RNA, 22 nt, Human
gugauuugacuguuuuuaccca

SEQ ID NO: 3885838 - RNA, 13 nt, Human
gugauuuggaucu

SEQ ID NO: 3885839 - RNA, 15 nt, Human
gugauuuuuuuuuag

SEQ ID NO: 3885840 - RNA, 23 nt, Human
gugauuuuuuuuuuuuuccuguc

SEQ ID NO: 3885841 - RNA, 18 nt, Human
gugcaaaaauuuuuggau

SEQ ID NO: 3885842 - RNA, 19 nt, Human
gugcaaaagcuucaaauua

SEQ ID NO: 3885843 - RNA, 16 nt, Human
gugcaaaaggcuugca

SEQ ID NO: 3885844 - RNA, 19 nt, Human
gugcaaacccacucagaga

SEQ ID NO: 3885845 - RNA, 12 nt, Human
gugcaaagccac

SEQ ID NO: 3885846 - RNA, 19 nt, Human
gugcaaaugucagauacaa

SEQ ID NO: 3885847 - RNA, 23 nt, Human
gugcaaaugucagauacaaugua

SEQ ID NO: 3885848 - RNA, 14 nt, Human
gugcaacaggguau

SEQ ID NO: 3885849 - RNA, 19 nt, Human
gugcaagagacucuggccu

SEQ ID NO: 3885850 - RNA, 12 nt, Human
gugcaagagagg

SEQ ID NO: 3885851 - RNA, 15 nt, Human
gugcaagccccugcu

SEQ ID NO: 3885852 - RNA, 15 nt, Human
gugcaaggaccuaaa

SEQ ID NO: 3885853 - RNA, 12 nt, Human
guggagcaggcc

SEQ ID NO: 3885854 - RNA, 14 nt, Human
guggagcccaggag

SEQ ID NO: 3885855 - RNA, 15 nt, Human
guggagcccaggagu

SEQ ID NO: 3885856 - RNA, 14 nt, Human
guggagcucagccc

SEQ ID NO: 3885857 - RNA, 15 nt, Human
guggagcucagcccc

SEQ ID NO: 3885858 - RNA, 17 nt, Human
guggaggagcagugcag

SEQ ID NO: 3885859 - RNA, 19 nt, Human
guggaggaggaaggcaaga

SEQ ID NO: 3885860 - RNA, 15 nt, Human
guggaggaggccugg

SEQ ID NO: 3885861 - RNA, 13 nt, Human
guggaggcugcuc

SEQ ID NO: 3885862 - RNA, 13 nt, Human
guggaggcuuccu

SEQ ID NO: 3885863 - RNA, 15 nt, Human
guggaggcuuccugc

SEQ ID NO: 3885864 - RNA, 23 nt, Human
guggagggacaaguggacucagg

SEQ ID NO: 3885865 - RNA, 12 nt, Human
guggagggaggg

SEQ ID NO: 3885866 - RNA, 23 nt, Human
guggagggcacauuccuugccug

SEQ ID NO: 3885867 - RNA, 22 nt, Human
guggagggguaggggcugggaa

SEQ ID NO: 3885868 - RNA, 21 nt, Human
guggagguuaaggcugaggaa

SEQ ID NO: 3885869 - RNA, 15 nt, Human
guggagucauucuca

SEQ ID NO: 3885870 - RNA, 14 nt, Human
guggagucauuucu

SEQ ID NO: 3885871 - RNA, 20 nt, Human
guggagucccuuuugcauca

SEQ ID NO: 3885872 - RNA, 19 nt, Human
guggagugcaguggugcga

SEQ ID NO: 3885873 - RNA, 13 nt, Human
guggaguggaugc

SEQ ID NO: 3885874 - RNA, 16 nt, Human
guggauaacaaagaua

SEQ ID NO: 3885875 - RNA, 16 nt, Human
guggauauaaaaugug

SEQ ID NO: 3885876 - RNA, 14 nt, Human
guggauauuguuac

SEQ ID NO: 3885877 - RNA, 16 nt, Human
guggauauuuguauaa

SEQ ID NO: 3885878 - RNA, 19 nt, Human
guggaucuccaaggaccag

SEQ ID NO: 3885879 - RNA, 23 nt, Human
guggaucuccaaggaccagguua

SEQ ID NO: 3885880 - RNA, 18 nt, Human
guggaucuguccaaggaa

SEQ ID NO: 3885881 - RNA, 15 nt, Human
guggaugauguuucg

SEQ ID NO: 3885882 - RNA, 14 nt, Human
guggaugccucaga

SEQ ID NO: 3885883 - RNA, 18 nt, Human
guggaugccugguggcag

SEQ ID NO: 3885884 - RNA, 21 nt, Human
guggauggaaggggcugacag

SEQ ID NO: 3885885 - RNA, 15 nt, Human
guggauggccccagc

SEQ ID NO: 3885886 - RNA, 19 nt, Human
guggauggccccagcacag

SEQ ID NO: 3885887 - RNA, 18 nt, Human
guggauuaaacuuaugaa

SEQ ID NO: 3885888 - RNA, 21 nt, Human
guggauuaaacuuaugaaugu

SEQ ID NO: 3885889 - RNA, 22 nt, Human
guggauucuuguuuugcuuccc

SEQ ID NO: 3885890 - RNA, 13 nt, Human
guggauugagggu

SEQ ID NO: 3885891 - RNA, 19 nt, Human
guggauugcacguggccuc

SEQ ID NO: 3885892 - RNA, 19 nt, Human
guggauuuaacagaaaugu

SEQ ID NO: 3885893 - RNA, 14 nt, Human
guggauuucaguuu

SEQ ID NO: 3885894 - RNA, 13 nt, Human
guggcaaauauaa

SEQ ID NO: 3885895 - RNA, 15 nt, Human
guggcaaauauaaaa

SEQ ID NO: 3885896 - RNA, 21 nt, Human
guggcaagcugugacuucucc

SEQ ID NO: 3885897 - RNA, 16 nt, Human
guggcaaggcugugcu

SEQ ID NO: 3885898 - RNA, 16 nt, Human
guggcaaucugugggc

SEQ ID NO: 3885899 - RNA, 16 nt, Human
guggcacaggcccccu

SEQ ID NO: 3885900 - RNA, 23 nt, Human
guggcacauuuuuuuuuuuaauu

SEQ ID NO: 3885901 - RNA, 13 nt, Human
guggcaccagcag

SEQ ID NO: 3885902 - RNA, 14 nt, Human
guggcaccagcagc

SEQ ID NO: 3885903 - RNA, 19 nt, Human
guggcaccagcagccugga

SEQ ID NO: 3885904 - RNA, 19 nt, Human
guggcaccaggcgcugccc

SEQ ID NO: 3885905 - RNA, 14 nt, Human
guggcaccugucug

SEQ ID NO: 3885906 - RNA, 16 nt, Human
guggcacugagccccc

SEQ ID NO: 3885907 - RNA, 19 nt, Human
guggcacuugccuggguca

SEQ ID NO: 3885908 - RNA, 19 nt, Human
guggcacuuuuucauuugc

SEQ ID NO: 3885909 - RNA, 17 nt, Human
guggcagaaguguuuca

SEQ ID NO: 3885910 - RNA, 21 nt, Human
guggcagauaaucagccucuu

SEQ ID NO: 3885911 - RNA, 19 nt, Human
guggcagauuuuacaaaag

SEQ ID NO: 3885912 - RNA, 22 nt, Human
guggcagauuuuacaaaagaug

SEQ ID NO: 3885913 - RNA, 13 nt, Human
guggcagcaacaa

SEQ ID NO: 3885914 - RNA, 16 nt, Human
guggcagcccagccag

SEQ ID NO: 3885915 - RNA, 22 nt, Human
guggcagcucaccucucccuug

SEQ ID NO: 3885916 - RNA, 23 nt, Human
guggcagcugcgguccacccagg

SEQ ID NO: 3885917 - RNA, 19 nt, Human
guggcagcugcuuuugucu

SEQ ID NO: 3885918 - RNA, 22 nt, Human
guggcaggcagaggcccaggcu

SEQ ID NO: 3885919 - RNA, 12 nt, Human
guggcaggcagc

SEQ ID NO: 3885920 - RNA, 20 nt, Human
guggcagggcacagggccug

SEQ ID NO: 3885921 - RNA, 16 nt, Human
guggcagggcucagga

SEQ ID NO: 3885922 - RNA, 17 nt, Human
guggcagggcucaggau

SEQ ID NO: 3885923 - RNA, 17 nt, Human
guggcaguaaagagaaa

SEQ ID NO: 3885924 - RNA, 11 nt, Human
guggcagucug

SEQ ID NO: 3885925 - RNA, 16 nt, Human
guggcagugggagcug

SEQ ID NO: 3885926 - RNA, 15 nt, Human
guggcaguuuggcaa

SEQ ID NO: 3885927 - RNA, 14 nt, Human
guggcaucaccuua

SEQ ID NO: 3885928 - RNA, 19 nt, Human
guggcaucaucucagcuca

SEQ ID NO: 3885929 - RNA, 14 nt, Human
guggcauccagagu

SEQ ID NO: 3885930 - RNA, 20 nt, Human
guggcaucuuugccuugggc

SEQ ID NO: 3885931 - RNA, 16 nt, Human
guggcaugugcuguga

SEQ ID NO: 3885932 - RNA, 15 nt, Human
guggcauguggccug

SEQ ID NO: 3885933 - RNA, 19 nt, Human
guggcauguggccuguggc

SEQ ID NO: 3885934 - RNA, 16 nt, Human
guggcauuggcagcag

SEQ ID NO: 3885935 - RNA, 22 nt, Human
guggcauuggcagcaggugcug

SEQ ID NO: 3885936 - RNA, 17 nt, Human
guggccaagaagcagug

SEQ ID NO: 3885937 - RNA, 14 nt, Human
guggccaaguucuu

SEQ ID NO: 3885938 - RNA, 13 nt, Human
guggccacucagc

SEQ ID NO: 3885939 - RNA, 21 nt, Human
guggccagaccagagcucugg

SEQ ID NO: 3885940 - RNA, 14 nt, Human
guggccagcccggc

SEQ ID NO: 3885941 - RNA, 15 nt, Human
guggccagcccggcu

SEQ ID NO: 3885942 - RNA, 16 nt, Human
guggccagcccggcug

SEQ ID NO: 3885943 - RNA, 15 nt, Human
guggccagccuggau

SEQ ID NO: 3885944 - RNA, 12 nt, Human
guggccaggagg

SEQ ID NO: 3885945 - RNA, 21 nt, Human
guggccaggcugccuggccuu

SEQ ID NO: 3885946 - RNA, 18 nt, Human
guggccaucccugugagg

SEQ ID NO: 3885947 - RNA, 23 nt, Human
guggccauucuuuuuuucuuggc

SEQ ID NO: 3885948 - RNA, 12 nt, Human
guggccccaccc

SEQ ID NO: 3885949 - RNA, 18 nt, Human
guggccccacccugggcc

SEQ ID NO: 3885950 - RNA, 15 nt, Human
guggccccagccugg

SEQ ID NO: 3885951 - RNA, 18 nt, Human
guggccccagccuggccc

SEQ ID NO: 3885952 - RNA, 20 nt, Human
guggccccagccuggcccag

SEQ ID NO: 3885953 - RNA, 17 nt, Human
guggccccguuucuggu

SEQ ID NO: 3885954 - RNA, 19 nt, Human
guggcccgacagccuggca

SEQ ID NO: 3885955 - RNA, 18 nt, Human
guggcccugcccucuccu

SEQ ID NO: 3885956 - RNA, 13 nt, Human
guggcccuggccu

SEQ ID NO: 3885957 - RNA, 17 nt, Human
guggcccuggccugcug

SEQ ID NO: 3885958 - RNA, 23 nt, Human
guggcccuuaugacugccaagac

SEQ ID NO: 3885959 - RNA, 14 nt, Human
guggcccuuccugg

SEQ ID NO: 3885960 - RNA, 23 nt, Human
guggcccuuucggauccagggag

SEQ ID NO: 3885961 - RNA, 21 nt, Human
guggccuaaccugccgagagu

SEQ ID NO: 3885962 - RNA, 19 nt, Human
guggccuacaaaucaguaa

SEQ ID NO: 3885963 - RNA, 19 nt, Human
guggccucaacccucccuc

SEQ ID NO: 3885964 - RNA, 12 nt, Human
guggccucagaa

SEQ ID NO: 3885965 - RNA, 22 nt, Human
guggccucagcucaaugcaguu

SEQ ID NO: 3885966 - RNA, 14 nt, Human
guggccucccaacu

SEQ ID NO: 3885967 - RNA, 17 nt, Human
guggccuccuugcuugu

SEQ ID NO: 3885968 - RNA, 21 nt, Human
guggccuccuugcuuguuaca

SEQ ID NO: 3885969 - RNA, 13 nt, Human
guggccucugugg

SEQ ID NO: 3885970 - RNA, 18 nt, Human
guggccugacucccccag

SEQ ID NO: 3885971 - RNA, 12 nt, Human
guggccuggcca

SEQ ID NO: 3885972 - RNA, 13 nt, Human
guggccuggccag

SEQ ID NO: 3885973 - RNA, 16 nt, Human
guggccuggccaggag

SEQ ID NO: 3885974 - RNA, 18 nt, Human
guggccuggccaggagcu

SEQ ID NO: 3885975 - RNA, 19 nt, Human
guggccuggcuccgcugug

SEQ ID NO: 3885976 - RNA, 16 nt, Human
guggccuggcuugucu

SEQ ID NO: 3885977 - RNA, 12 nt, Human
guggccugggcc

SEQ ID NO: 3885978 - RNA, 15 nt, Human
guggccugggccucc

SEQ ID NO: 3885979 - RNA, 14 nt, Human
guggccuggucccu

SEQ ID NO: 3885980 - RNA, 16 nt, Human
guggccuguggccugu

SEQ ID NO: 3885981 - RNA, 15 nt, Human
guggccuguguggcc

SEQ ID NO: 3885982 - RNA, 17 nt, Human
guggccuuccccagcau

SEQ ID NO: 3885983 - RNA, 19 nt, Human
guggccuuccccagccucu

SEQ ID NO: 3885984 - RNA, 20 nt, Human
guggccuuccccagccucuu

SEQ ID NO: 3885985 - RNA, 17 nt, Human
guggcgaaaucccugcu

SEQ ID NO: 3885986 - RNA, 22 nt, Human
guggcgaaaucccugcucacug

SEQ ID NO: 3885987 - RNA, 17 nt, Human
guggcgccgucuccagg

SEQ ID NO: 3885988 - RNA, 22 nt, Human
guggcgccgucuccaggggcug

SEQ ID NO: 3885989 - RNA, 16 nt, Human
guggcgcgcaccugua

SEQ ID NO: 3885990 - RNA, 14 nt, Human
guggcggugccugg

SEQ ID NO: 3885991 - RNA, 17 nt, Human
guggcggugccugggug

SEQ ID NO: 3885992 - RNA, 16 nt, Human
guggcguuuguaauga

SEQ ID NO: 3885993 - RNA, 21 nt, Human
guggcuaaaggucccaaggca

SEQ ID NO: 3885994 - RNA, 17 nt, Human
guggcuaacuuggguua

SEQ ID NO: 3885995 - RNA, 16 nt, Human
guggcuaaugguguaa

SEQ ID NO: 3885996 - RNA, 20 nt, Human
guggcuacucugugccagag

SEQ ID NO: 3885997 - RNA, 18 nt, Human
guggcuagucaagcuccu

SEQ ID NO: 3885998 - RNA, 17 nt, Human
ucagcagugagagcaga

SEQ ID NO: 3885999 - RNA, 14 nt, Human
ucagcaguugcugg

SEQ ID NO: 3886000 - RNA, 22 nt, Human
ucagcaguugcugguaaaauga

SEQ ID NO: 3886001 - RNA, 21 nt, Human
ucagcaguuguuauuacaucc

SEQ ID NO: 3886002 - RNA, 23 nt, Human
ucagcauauuuguauaguugcuu

SEQ ID NO: 3886003 - RNA, 18 nt, Human
ucagcauccucaguuccu

SEQ ID NO: 3886004 - RNA, 19 nt, Human
ucagcaugaauuuguaaug

SEQ ID NO: 3886005 - RNA, 19 nt, Human
ucagcaugucuauucagcu

SEQ ID NO: 3886006 - RNA, 20 nt, Human
ucagcauucucacuccuacc

SEQ ID NO: 3886007 - RNA, 23 nt, Human
ucagcauucucacuccuaccugg

SEQ ID NO: 3886008 - RNA, 18 nt, Human
ucagcauucuuagccugu

SEQ ID NO: 3886009 - RNA, 18 nt, Human
ucagcauugauauuugug

SEQ ID NO: 3886010 - RNA, 13 nt, Human
ucagcauuucuuu

SEQ ID NO: 3886011 - RNA, 11 nt, Human
ucagcauuuga

SEQ ID NO: 3886012 - RNA, 17 nt, Human
ucagcauuugaucuguu

SEQ ID NO: 3886013 - RNA, 16 nt, Human
ucagccaaauguaauu

SEQ ID NO: 3886014 - RNA, 15 nt, Human
ucagccaagcacagu

SEQ ID NO: 3886015 - RNA, 23 nt, Human
ucagccaccauccuauugcaaag

SEQ ID NO: 3886016 - RNA, 20 nt, Human
ucagccacccugaggccucu

SEQ ID NO: 3886017 - RNA, 17 nt, Human
ucagccacccugaguug

SEQ ID NO: 3886018 - RNA, 21 nt, Human
ucagccacuaagaaccccucu

SEQ ID NO: 3886019 - RNA, 23 nt, Human
ucagccagcacuuguccagcuga

SEQ ID NO: 3886020 - RNA, 12 nt, Human
ucagccagccuc

SEQ ID NO: 3886021 - RNA, 13 nt, Human
ucagccaggacca

SEQ ID NO: 3886022 - RNA, 23 nt, Human
ucagccaggaccauaccgggucu

SEQ ID NO: 3886023 - RNA, 20 nt, Human
ucagccagugaccaaccuuu

SEQ ID NO: 3886024 - RNA, 18 nt, Human
ucagccaucaacaagagu

SEQ ID NO: 3886025 - RNA, 17 nt, Human
ucagccaucaacuaaag

SEQ ID NO: 3886026 - RNA, 16 nt, Human
ucagccauucacugcc

SEQ ID NO: 3886027 - RNA, 22 nt, Human
ucagcccaaaccaccagaagcc

SEQ ID NO: 3886028 - RNA, 12 nt, Human
ucagcccacccc

SEQ ID NO: 3886029 - RNA, 18 nt, Human
ucagcccaccccccucau

SEQ ID NO: 3886030 - RNA, 12 nt, Human
ucagcccagaag

SEQ ID NO: 3886031 - RNA, 16 nt, Human
ucagcccagaagaaaa

SEQ ID NO: 3886032 - RNA, 18 nt, Human
ucagccccaccccagggc

SEQ ID NO: 3886033 - RNA, 19 nt, Human
ucagccccaccccagggca

SEQ ID NO: 3886034 - RNA, 23 nt, Human
ucagccccaccccagggcagcca

SEQ ID NO: 3886035 - RNA, 16 nt, Human
ucagcccccagccccu

SEQ ID NO: 3886036 - RNA, 20 nt, Human
ucagcccccagccccucccc

SEQ ID NO: 3886037 - RNA, 19 nt, Human
ucagccccgagcugucccc

SEQ ID NO: 3886038 - RNA, 16 nt, Human
ucagccccgcguggaa

SEQ ID NO: 3886039 - RNA, 16 nt, Human
ucagccccuaggagua

SEQ ID NO: 3886040 - RNA, 13 nt, Human
ucagccccuccuc

SEQ ID NO: 3886041 - RNA, 15 nt, Human
ucagccccuccucug

SEQ ID NO: 3886042 - RNA, 20 nt, Human
ucagccccucuugcccccca

SEQ ID NO: 3886043 - RNA, 22 nt, Human
ucagccccugauccugugaagu

SEQ ID NO: 3886044 - RNA, 18 nt, Human
ucagcccucccugccccu

SEQ ID NO: 3886045 - RNA, 19 nt, Human
ucagcccucccugccccuc

SEQ ID NO: 3886046 - RNA, 23 nt, Human
ucagcccugaggugaaagggagc

SEQ ID NO: 3886047 - RNA, 13 nt, Human
ucagcccuggagg

SEQ ID NO: 3886048 - RNA, 12 nt, Human
ucagcccugggc

SEQ ID NO: 3886049 - RNA, 18 nt, Human
ucagcccugggccccacc

SEQ ID NO: 3886050 - RNA, 19 nt, Human
ucagccuagccgaccucag

SEQ ID NO: 3886051 - RNA, 20 nt, Human
ucagccuagccgaccucagc

SEQ ID NO: 3886052 - RNA, 22 nt, Human
ucagccuagccgaccucagccu

SEQ ID NO: 3886053 - RNA, 20 nt, Human
ucagccuaguggcuuguccu

SEQ ID NO: 3886054 - RNA, 16 nt, Human
ucagccuccagccucu

SEQ ID NO: 3886055 - RNA, 18 nt, Human
ucagccuccagccucugu

SEQ ID NO: 3886056 - RNA, 23 nt, Human
ucagccuccauccuacccccugu

SEQ ID NO: 3886057 - RNA, 12 nt, Human
ucagccucccaa

SEQ ID NO: 3886058 - RNA, 16 nt, Human
ucagccucccacagug

SEQ ID NO: 3886059 - RNA, 21 nt, Human
ucagccucccacagugcuggg

SEQ ID NO: 3886060 - RNA, 12 nt, Human
ucagccucccga

SEQ ID NO: 3886061 - RNA, 19 nt, Human
ucagccuccucaucugggg

SEQ ID NO: 3886062 - RNA, 22 nt, Human
ucagccuccugaguagcuggga

SEQ ID NO: 3886063 - RNA, 13 nt, Human
ucagccuccugug

SEQ ID NO: 3886064 - RNA, 20 nt, Human
ucagccuccuguguagcugg

SEQ ID NO: 3886065 - RNA, 23 nt, Human
ucagccucgcaggccucccugcc

SEQ ID NO: 3886066 - RNA, 16 nt, Human
ucagccucucucccag

SEQ ID NO: 3886067 - RNA, 19 nt, Human
ucagccucucucccagucu

SEQ ID NO: 3886068 - RNA, 17 nt, Human
ucagccugaaccccagg

SEQ ID NO: 3886069 - RNA, 19 nt, Human
ucagccugaaccccagggc

SEQ ID NO: 3886070 - RNA, 10 nt, Human
ucagccugag

SEQ ID NO: 3886071 - RNA, 11 nt, Human
ucagccugagu

SEQ ID NO: 3886072 - RNA, 12 nt, Human
ucagccugcaca

SEQ ID NO: 3886073 - RNA, 16 nt, Human
ucagccugcuccagcu

SEQ ID NO: 3886074 - RNA, 19 nt, Human
ucagccugcuccagcuguu

SEQ ID NO: 3886075 - RNA, 21 nt, Human
ucagccugcugcccaggcugu

SEQ ID NO: 3886076 - RNA, 22 nt, Human
ucagccugcugcccaggcugug

SEQ ID NO: 3886077 - RNA, 12 nt, Human
ucagccuggcca

SEQ ID NO: 3886078 - RNA, 19 nt, Human
ucagccugggcgcuggucc

SEQ ID NO: 3886079 - RNA, 14 nt, Human
ucagccuggugggc

SEQ ID NO: 3886080 - RNA, 19 nt, Human
ucagccuggugggccuccu

SEQ ID NO: 3886081 - RNA, 16 nt, Human
ucagccugugcugccc

SEQ ID NO: 3886082 - RNA, 16 nt, Human
ucagccuuacauuugu

SEQ ID NO: 3886083 - RNA, 15 nt, Human
ucagccuuagcucuc

SEQ ID NO: 3886084 - RNA, 23 nt, Human
ucagccuuccccuugcccagggc

SEQ ID NO: 3886085 - RNA, 15 nt, Human
ucagccuucuuuuuc

SEQ ID NO: 3886086 - RNA, 18 nt, Human
ucagccuucuuuuucugg

SEQ ID NO: 3886087 - RNA, 20 nt, Human
ucagccuucuuuuucuggac

SEQ ID NO: 3886088 - RNA, 21 nt, Human
ucagccuucuuuuucuggacu

SEQ ID NO: 3886089 - RNA, 14 nt, Human
ucagccuugccaga

SEQ ID NO: 3886090 - RNA, 20 nt, Human
ucagcgacuccguuggccac

SEQ ID NO: 3886091 - RNA, 21 nt, Human
ucagcgcugucaggauugcga

SEQ ID NO: 3886092 - RNA, 22 nt, Human
ucagcggccccuugacucuggg

SEQ ID NO: 3886093 - RNA, 15 nt, Human
ucagcggggacagcu

SEQ ID NO: 3886094 - RNA, 13 nt, Human
ucagcguggccuu

SEQ ID NO: 3886095 - RNA, 14 nt, Human
ucagcguggccuug

SEQ ID NO: 3886096 - RNA, 14 nt, Human
ucagcuaagcucac

SEQ ID NO: 3886097 - RNA, 15 nt, Human
ucagcuacugauuuu

SEQ ID NO: 3886098 - RNA, 19 nt, Human
ucagcuacuuaagagaaau

SEQ ID NO: 3886099 - RNA, 19 nt, Human
ucagcuaggaacaaaucuu

SEQ ID NO: 3886100 - RNA, 13 nt, Human
ucagcucacgcuu

SEQ ID NO: 3886101 - RNA, 16 nt, Human
ucagcucacugcaacc

SEQ ID NO: 3886102 - RNA, 14 nt, Human
ucagcucacuguuc

SEQ ID NO: 3886103 - RNA, 12 nt, Human
ucagcucagagc

SEQ ID NO: 3886104 - RNA, 18 nt, Human
ucagcucagcgccagccu

SEQ ID NO: 3886105 - RNA, 16 nt, Human
ucagcuccagccccuu

SEQ ID NO: 3886106 - RNA, 15 nt, Human
ucagcuccagcucac

SEQ ID NO: 3886107 - RNA, 22 nt, Human
ucagcuccagggaauccaagcc

SEQ ID NO: 3886108 - RNA, 19 nt, Human
ucagcuccagguggcucug

SEQ ID NO: 3886109 - RNA, 13 nt, Human
ucagcucccacaa

SEQ ID NO: 3886110 - RNA, 18 nt, Human
ucagcucccacaagccuc

SEQ ID NO: 3886111 - RNA, 16 nt, Human
ucagcucccauuucua

SEQ ID NO: 3886112 - RNA, 13 nt, Human
ucagcuccccaga

SEQ ID NO: 3886113 - RNA, 15 nt, Human
ucagcucccccuguc

SEQ ID NO: 3886114 - RNA, 18 nt, Human
ucagcucggcucagcucg

SEQ ID NO: 3886115 - RNA, 15 nt, Human
ucagcucucaucuga

SEQ ID NO: 3886116 - RNA, 14 nt, Human
ucagcucucuguau

SEQ ID NO: 3886117 - RNA, 16 nt, Human
ucagcucugaaagaga

SEQ ID NO: 3886118 - RNA, 16 nt, Human
ucagcucugacauucu

SEQ ID NO: 3886119 - RNA, 22 nt, Human
ucagcucugacauucugauucg

SEQ ID NO: 3886120 - RNA, 16 nt, Human
ucagcucuggcucaca

SEQ ID NO: 3886121 - RNA, 17 nt, Human
ucagcucugggagagga

SEQ ID NO: 3886122 - RNA, 12 nt, Human
ucagcugagccu

SEQ ID NO: 3886123 - RNA, 18 nt, Human
ucagcugagccuucugag

SEQ ID NO: 3886124 - RNA, 21 nt, Human
ucagcugcccccgcucauggg

SEQ ID NO: 3886125 - RNA, 15 nt, Human
ucagcugcuacuacu

SEQ ID NO: 3886126 - RNA, 15 nt, Human
ucagcugcucccugg

SEQ ID NO: 3886127 - RNA, 19 nt, Human
ucagcugcucccuggcauu

SEQ ID NO: 3886128 - RNA, 12 nt, Human
ucagcugcuucu

SEQ ID NO: 3886129 - RNA, 15 nt, Human
ucagcugcuucuccc

SEQ ID NO: 3886130 - RNA, 16 nt, Human
ucagcuguaguccuca

SEQ ID NO: 3886131 - RNA, 14 nt, Human
ucagcuguccuccc

SEQ ID NO: 3886132 - RNA, 17 nt, Human
ucagcuguccucccucc

SEQ ID NO: 3886133 - RNA, 15 nt, Human
ucagcuguccugcag

SEQ ID NO: 3886134 - RNA, 17 nt, Human
ucagcuguccugcagca

SEQ ID NO: 3886135 - RNA, 18 nt, Human
ucagcuguccugcagcaa

SEQ ID NO: 3886136 - RNA, 14 nt, Human
ucagcugucuuuug

SEQ ID NO: 3886137 - RNA, 12 nt, Human
ucagcugugaac

SEQ ID NO: 3886138 - RNA, 15 nt, Human
ucagcuguucagauu

SEQ ID NO: 3886139 - RNA, 16 nt, Human
ucagcuguuugucaua

SEQ ID NO: 3886140 - RNA, 18 nt, Human
ucagcuuccccaguagcu

SEQ ID NO: 3886141 - RNA, 15 nt, Human
ucagcuuccuaccca

SEQ ID NO: 3886142 - RNA, 20 nt, Human
ucagcuucuauccuugacuu

SEQ ID NO: 3886143 - RNA, 21 nt, Human
ucccagggagcaagggcaggg

SEQ ID NO: 3886144 - RNA, 17 nt, Human
ucccagggccagggccc

SEQ ID NO: 3886145 - RNA, 22 nt, Human
ucccagggcuacucacucaagu

SEQ ID NO: 3886146 - RNA, 12 nt, Human
ucccaggggacc

SEQ ID NO: 3886147 - RNA, 16 nt, Human
ucccaggguagcccgc

SEQ ID NO: 3886148 - RNA, 22 nt, Human
ucccaggguagcccgccugcca

SEQ ID NO: 3886149 - RNA, 21 nt, Human
ucccagguguuaacauuccaa

SEQ ID NO: 3886150 - RNA, 21 nt, Human
ucccagguuggcucugccagu

SEQ ID NO: 3886151 - RNA, 23 nt, Human
ucccagguuggcucugccagucc

SEQ ID NO: 3886152 - RNA, 16 nt, Human
ucccaguagaaaauau

SEQ ID NO: 3886153 - RNA, 20 nt, Human
ucccaguccaaauguccucc

SEQ ID NO: 3886154 - RNA, 15 nt, Human
ucccagugacacuuc

SEQ ID NO: 3886155 - RNA, 20 nt, Human
ucccagugacacuucagaga

SEQ ID NO: 3886156 - RNA, 15 nt, Human
ucccaguggcugcug

SEQ ID NO: 3886157 - RNA, 22 nt, Human
ucccaguggcugcugcccaggc

SEQ ID NO: 3886158 - RNA, 14 nt, Human
ucccagugggaggg

SEQ ID NO: 3886159 - RNA, 15 nt, Human
ucccagugggagggg

SEQ ID NO: 3886160 - RNA, 17 nt, Human
ucccagugucuuccugu

SEQ ID NO: 3886161 - RNA, 20 nt, Human
ucccagugucuuccuguggg

SEQ ID NO: 3886162 - RNA, 22 nt, Human
ucccauaaccgcugauucucag

SEQ ID NO: 3886163 - RNA, 22 nt, Human
ucccauaauuuucuucaugcaa

SEQ ID NO: 3886164 - RNA, 21 nt, Human
ucccauagauacucucuucuu

SEQ ID NO: 3886165 - RNA, 15 nt, Human
ucccauaggcccagu

SEQ ID NO: 3886166 - RNA, 18 nt, Human
ucccauagucccugccac

SEQ ID NO: 3886167 - RNA, 16 nt, Human
ucccauaugccugggc

SEQ ID NO: 3886168 - RNA, 22 nt, Human
ucccauaugccugggcagaagg

SEQ ID NO: 3886169 - RNA, 14 nt, Human
ucccaucaaaacuc

SEQ ID NO: 3886170 - RNA, 20 nt, Human
ucccaucacguguacuggcu

SEQ ID NO: 3886171 - RNA, 23 nt, Human
ucccaucauuacccuucccugca

SEQ ID NO: 3886172 - RNA, 14 nt, Human
ucccauccaggcag

SEQ ID NO: 3886173 - RNA, 14 nt, Human
ucccauccagggcc

SEQ ID NO: 3886174 - RNA, 16 nt, Human
ucccaucccagcugaa

SEQ ID NO: 3886175 - RNA, 19 nt, Human
ucccaucccaucccauccc

SEQ ID NO: 3886176 - RNA, 18 nt, Human
ucccaucccaucccgcuc

SEQ ID NO: 3886177 - RNA, 14 nt, Human
ucccauccccagcg

SEQ ID NO: 3886178 - RNA, 17 nt, Human
ucccaucccccugcccu

SEQ ID NO: 3886179 - RNA, 13 nt, Human
ucccauccccugg

SEQ ID NO: 3886180 - RNA, 15 nt, Human
ucccauccccuggac

SEQ ID NO: 3886181 - RNA, 18 nt, Human
ucccauccucuucuuuua

SEQ ID NO: 3886182 - RNA, 15 nt, Human
ucccauccugugugu

SEQ ID NO: 3886183 - RNA, 13 nt, Human
ucccaucgcuguc

SEQ ID NO: 3886184 - RNA, 17 nt, Human
ucccaucuaagcugcag

SEQ ID NO: 3886185 - RNA, 18 nt, Human
ucccaucuaagcugcagc

SEQ ID NO: 3886186 - RNA, 20 nt, Human
ucccaucuaagcugcagcuu

SEQ ID NO: 3886187 - RNA, 19 nt, Human
ucccaucucacacaugagc

SEQ ID NO: 3886188 - RNA, 23 nt, Human
ucccaucucacacaugagcauca

SEQ ID NO: 3886189 - RNA, 14 nt, Human
ucccaucucuuccu

SEQ ID NO: 3886190 - RNA, 15 nt, Human
ucccaucucuuccuu

SEQ ID NO: 3886191 - RNA, 16 nt, Human
ucccaucucuuccuug

SEQ ID NO: 3886192 - RNA, 13 nt, Human
ucccaucugcacc

SEQ ID NO: 3886193 - RNA, 13 nt, Human
ucccaucugcuuc

SEQ ID NO: 3886194 - RNA, 17 nt, Human
ucccaucuggucauuug

SEQ ID NO: 3886195 - RNA, 21 nt, Human
ucccaucugugaaaggaaaga

SEQ ID NO: 3886196 - RNA, 21 nt, Human
ucccaucuuaacucuuugccu

SEQ ID NO: 3886197 - RNA, 21 nt, Human
ucccaucuuuuuaaccucugu

SEQ ID NO: 3886198 - RNA, 11 nt, Human
ucccaugaagc

SEQ ID NO: 3886199 - RNA, 14 nt, Human
ucccaugacccacc

SEQ ID NO: 3886200 - RNA, 16 nt, Human
ucccaugacccacccc

SEQ ID NO: 3886201 - RNA, 21 nt, Human
ucccaugacccaccccugugc

SEQ ID NO: 3886202 - RNA, 14 nt, Human
ucccaugacccagg

SEQ ID NO: 3886203 - RNA, 15 nt, Human
ucccaugagccucag

SEQ ID NO: 3886204 - RNA, 17 nt, Human
ucccaugagccucagca

SEQ ID NO: 3886205 - RNA, 18 nt, Human
ucccaugagccucagcau

SEQ ID NO: 3886206 - RNA, 20 nt, Human
ucccaugagccucagcaucc

SEQ ID NO: 3886207 - RNA, 22 nt, Human
ucccaugagccucagcauccug

SEQ ID NO: 3886208 - RNA, 23 nt, Human
ucccaugagcuccuuaaggcucu

SEQ ID NO: 3886209 - RNA, 16 nt, Human
ucccaugaucccugug

SEQ ID NO: 3886210 - RNA, 13 nt, Human
ucccaugauuuca

SEQ ID NO: 3886211 - RNA, 14 nt, Human
ucccaugauuucau

SEQ ID NO: 3886212 - RNA, 16 nt, Human
ucccaugauuucaugu

SEQ ID NO: 3886213 - RNA, 19 nt, Human
ucccaugauuucauguacu

SEQ ID NO: 3886214 - RNA, 15 nt, Human
ucccaugcaggcccu

SEQ ID NO: 3886215 - RNA, 12 nt, Human
ucccaugcccug

SEQ ID NO: 3886216 - RNA, 21 nt, Human
ucccauggacacuccagugcc

SEQ ID NO: 3886217 - RNA, 13 nt, Human
ucccauggagccc

SEQ ID NO: 3886218 - RNA, 15 nt, Human
ucccauggagcccca

SEQ ID NO: 3886219 - RNA, 23 nt, Human
ucccaugggcagaggaccaggcu

SEQ ID NO: 3886220 - RNA, 15 nt, Human
ucccauguagccccc

SEQ ID NO: 3886221 - RNA, 15 nt, Human
ucccaugucacugca

SEQ ID NO: 3886222 - RNA, 14 nt, Human
ucccauguucaagc

SEQ ID NO: 3886223 - RNA, 16 nt, Human
ucccauuagcaaaaau

SEQ ID NO: 3886224 - RNA, 21 nt, Human
ucccauuaggacaaucagucc

SEQ ID NO: 3886225 - RNA, 16 nt, Human
ucccauuauucaaagu

SEQ ID NO: 3886226 - RNA, 19 nt, Human
ucccauuauucaaaguugc

SEQ ID NO: 3886227 - RNA, 16 nt, Human
ucccauucaagauucc

SEQ ID NO: 3886228 - RNA, 13 nt, Human
ucccauucccugg

SEQ ID NO: 3886229 - RNA, 17 nt, Human
ucccauuccugaagaac

SEQ ID NO: 3886230 - RNA, 15 nt, Human
ucccauucuuggccc

SEQ ID NO: 3886231 - RNA, 14 nt, Human
ucccauugaaaaug

SEQ ID NO: 3886232 - RNA, 13 nt, Human
ucccauugcccug

SEQ ID NO: 3886233 - RNA, 16 nt, Human
ucccauugucccucug

SEQ ID NO: 3886234 - RNA, 18 nt, Human
ucccauugucccucugcc

SEQ ID NO: 3886235 - RNA, 24 nt, Human
ucccauuucuaaaggccucuuccu

SEQ ID NO: 3886236 - RNA, 14 nt, Human
ucccauuucuacuc

SEQ ID NO: 3886237 - RNA, 16 nt, Human
ucccauuucucacuga

SEQ ID NO: 3886238 - RNA, 15 nt, Human
ucccauuuguaauuu

SEQ ID NO: 3886239 - RNA, 19 nt, Human
ucccauuuucagacugcuu

SEQ ID NO: 3886240 - RNA, 21 nt, Human
ucccauuuucagacugcuuua

SEQ ID NO: 3886241 - RNA, 18 nt, Human
ucccauuuuggaauuugc

SEQ ID NO: 3886242 - RNA, 16 nt, Human
uccccaaaaaccucac

SEQ ID NO: 3886243 - RNA, 19 nt, Human
uccccaaaagcgugagcuu

SEQ ID NO: 3886244 - RNA, 16 nt, Human
uccccaaaccugcaag

SEQ ID NO: 3886245 - RNA, 18 nt, Human
uccccaaagucuuaaaau

SEQ ID NO: 3886246 - RNA, 14 nt, Human
uccccaaauccgaa

SEQ ID NO: 3886247 - RNA, 20 nt, Human
uccccaacagcgcccaaagg

SEQ ID NO: 3886248 - RNA, 15 nt, Human
uccccaacaguguga

SEQ ID NO: 3886249 - RNA, 21 nt, Human
uccccaacccccauucucauc

SEQ ID NO: 3886250 - RNA, 23 nt, Human
uccccaacccccauucucaucug

SEQ ID NO: 3886251 - RNA, 17 nt, Human
uccccaacccugccccu

SEQ ID NO: 3886252 - RNA, 19 nt, Human
uccccaacccugccccugc

SEQ ID NO: 3886253 - RNA, 18 nt, Human
uccccaacugaccaccuu

SEQ ID NO: 3886254 - RNA, 19 nt, Human
uccccaaggcccccugccu

SEQ ID NO: 3886255 - RNA, 23 nt, Human
uccccaaggcccccugccugccc

SEQ ID NO: 3886256 - RNA, 23 nt, Human
uccccaauaucuugcuugaacuu

SEQ ID NO: 3886257 - RNA, 17 nt, Human
uccccaaugagacuugc

SEQ ID NO: 3886258 - RNA, 21 nt, Human
uccccaaugagacuugccuuc

SEQ ID NO: 3886259 - RNA, 10 nt, Human
uccccacacu

SEQ ID NO: 3886260 - RNA, 17 nt, Human
uccccacagcgucccug

SEQ ID NO: 3886261 - RNA, 17 nt, Human
uccccaccagaugcuga

SEQ ID NO: 3886262 - RNA, 20 nt, Human
uccccaccagaugcugaaaa

SEQ ID NO: 3886263 - RNA, 13 nt, Human
uccccacccacca

SEQ ID NO: 3886264 - RNA, 22 nt, Human
uccccacccaccaacccucagg

SEQ ID NO: 3886265 - RNA, 21 nt, Human
uccccaccccuaccccuggcu

SEQ ID NO: 3886266 - RNA, 23 nt, Human
uccccaccccuaccccuggcugu

SEQ ID NO: 3886267 - RNA, 17 nt, Human
uccccacccuccccuuc

SEQ ID NO: 3886268 - RNA, 16 nt, Human
uccccacccuccuggc

SEQ ID NO: 3886269 - RNA, 22 nt, Human
uccccacccuccuggccucaga

SEQ ID NO: 3886270 - RNA, 17 nt, Human
uccccaccuccaggcuu

SEQ ID NO: 3886271 - RNA, 13 nt, Human
uccccaccuggga

SEQ ID NO: 3886272 - RNA, 14 nt, Human
uccccaccugggac

SEQ ID NO: 3886273 - RNA, 15 nt, Human
uccccacgagggcug

SEQ ID NO: 3886274 - RNA, 20 nt, Human
uccccacgagggcuggcugg

SEQ ID NO: 3886275 - RNA, 18 nt, Human
uccccacgcccuccccuc

SEQ ID NO: 3886276 - RNA, 19 nt, Human
uccccacggccgcuccagg

SEQ ID NO: 3886277 - RNA, 20 nt, Human
uccccacggccgcuccaggg

SEQ ID NO: 3886278 - RNA, 23 nt, Human
uccccacggggccucgggaccuc

SEQ ID NO: 3886279 - RNA, 15 nt, Human
uccccacugccuacu

SEQ ID NO: 3886280 - RNA, 20 nt, Human
uccccacugccuacugcauc

SEQ ID NO: 3886281 - RNA, 13 nt, Human
uccccacuggagc

SEQ ID NO: 3886282 - RNA, 15 nt, Human
uccccacuggagcag

SEQ ID NO: 3886283 - RNA, 19 nt, Human
uccccacuuguccgcuggg

SEQ ID NO: 3886284 - RNA, 19 nt, Human
uccccagaacucugccugc

SEQ ID NO: 3886285 - RNA, 17 nt, Human
uccccagaauggaggca

SEQ ID NO: 3886286 - RNA, 15 nt, Human
uccccagacuuguug

SEQ ID NO: 3886287 - RNA, 19 nt, Human
ucccuccacguucaccccu

SEQ ID NO: 3886288 - RNA, 23 nt, Human
ucccuccacuccuuccugccacc

SEQ ID NO: 3886289 - RNA, 13 nt, Human
ucccuccagcaca

SEQ ID NO: 3886290 - RNA, 22 nt, Human
ucccuccagcacaaacacaagg

SEQ ID NO: 3886291 - RNA, 14 nt, Human
ucccucccaccucu

SEQ ID NO: 3886292 - RNA, 16 nt, Human
ucccucccaccucugu

SEQ ID NO: 3886293 - RNA, 23 nt, Human
ucccucccagaggagccaccagu

SEQ ID NO: 3886294 - RNA, 13 nt, Human
ucccucccagcuc

SEQ ID NO: 3886295 - RNA, 18 nt, Human
ucccucccccugccccuu

SEQ ID NO: 3886296 - RNA, 12 nt, Human
ucccucccccuu

SEQ ID NO: 3886297 - RNA, 13 nt, Human
ucccuccccugcc

SEQ ID NO: 3886298 - RNA, 14 nt, Human
ucccuccccugccc

SEQ ID NO: 3886299 - RNA, 15 nt, Human
ucccuccccugcccu

SEQ ID NO: 3886300 - RNA, 13 nt, Human
ucccuccccuugc

SEQ ID NO: 3886301 - RNA, 14 nt, Human
ucccucccuccacc

SEQ ID NO: 3886302 - RNA, 15 nt, Human
ucccucccuccaccu

SEQ ID NO: 3886303 - RNA, 17 nt, Human
ucccucccucuuucccu

SEQ ID NO: 3886304 - RNA, 12 nt, Human
ucccucccugcu

SEQ ID NO: 3886305 - RNA, 18 nt, Human
ucccucccuuccucuuuc

SEQ ID NO: 3886306 - RNA, 18 nt, Human
ucccuccgauccuuccuc

SEQ ID NO: 3886307 - RNA, 12 nt, Human
ucccuccucacc

SEQ ID NO: 3886308 - RNA, 14 nt, Human
ucccuccucaccuc

SEQ ID NO: 3886309 - RNA, 16 nt, Human
ucccuccucaccucug

SEQ ID NO: 3886310 - RNA, 18 nt, Human
ucccuccucaccucugga

SEQ ID NO: 3886311 - RNA, 10 nt, Human
ucccuccucc

SEQ ID NO: 3886312 - RNA, 17 nt, Human
ucccuccuccaggccug

SEQ ID NO: 3886313 - RNA, 16 nt, Human
ucccuccucccauguc

SEQ ID NO: 3886314 - RNA, 14 nt, Human
ucccuccugcuuug

SEQ ID NO: 3886315 - RNA, 22 nt, Human
ucccuccugcuuugcgugcccg

SEQ ID NO: 3886316 - RNA, 11 nt, Human
ucccuccuggg

SEQ ID NO: 3886317 - RNA, 12 nt, Human
ucccuccuuggu

SEQ ID NO: 3886318 - RNA, 15 nt, Human
ucccuccuuuaguga

SEQ ID NO: 3886319 - RNA, 16 nt, Human
ucccucuaaugagacu

SEQ ID NO: 3886320 - RNA, 17 nt, Human
ucccucuacugggagcc

SEQ ID NO: 3886321 - RNA, 18 nt, Human
ucccucuacugggagccu

SEQ ID NO: 3886322 - RNA, 22 nt, Human
ucccucuacugggagccuaccc

SEQ ID NO: 3886323 - RNA, 19 nt, Human
ucccucucaggcaugccug

SEQ ID NO: 3886324 - RNA, 10 nt, Human
ucccucucau

SEQ ID NO: 3886325 - RNA, 17 nt, Human
ucccucucaucucaggu

SEQ ID NO: 3886326 - RNA, 17 nt, Human
ucccucucccaggcccc

SEQ ID NO: 3886327 - RNA, 14 nt, Human
ucccucuccuaacu

SEQ ID NO: 3886328 - RNA, 14 nt, Human
ucccucuccugccu

SEQ ID NO: 3886329 - RNA, 16 nt, Human
ucccucuccugccuac

SEQ ID NO: 3886330 - RNA, 12 nt, Human
ucccucucggaa

SEQ ID NO: 3886331 - RNA, 14 nt, Human
ucccucucguaaga

SEQ ID NO: 3886332 - RNA, 15 nt, Human
ucccucucucacucc

SEQ ID NO: 3886333 - RNA, 17 nt, Human
ucccucugaccugcagg

SEQ ID NO: 3886334 - RNA, 19 nt, Human
ucccucugaccugcaggcc

SEQ ID NO: 3886335 - RNA, 13 nt, Human
ucccucugcucag

SEQ ID NO: 3886336 - RNA, 14 nt, Human
ucccucugcucagc

SEQ ID NO: 3886337 - RNA, 18 nt, Human
ucccucugcucagccaag

SEQ ID NO: 3886338 - RNA, 15 nt, Human
ucccucugcuccugg

SEQ ID NO: 3886339 - RNA, 18 nt, Human
ucccucugcuccuggagc

SEQ ID NO: 3886340 - RNA, 20 nt, Human
ucccucuggcccugccuucu

SEQ ID NO: 3886341 - RNA, 17 nt, Human
ucccucuggggcuguuc

SEQ ID NO: 3886342 - RNA, 16 nt, Human
ucccucuggucccaca

SEQ ID NO: 3886343 - RNA, 21 nt, Human
ucccucuuagucuagguccuu

SEQ ID NO: 3886344 - RNA, 16 nt, Human
ucccucuucacucccc

SEQ ID NO: 3886345 - RNA, 21 nt, Human
ucccucuuccuucccugcugu

SEQ ID NO: 3886346 - RNA, 13 nt, Human
ucccucuuggucu

SEQ ID NO: 3886347 - RNA, 12 nt, Human
ucccucuuguuu

SEQ ID NO: 3886348 - RNA, 20 nt, Human
ucccucuuguuuuguuuguc

SEQ ID NO: 3886349 - RNA, 22 nt, Human
ucccucuuguuuuguuugucuc

SEQ ID NO: 3886350 - RNA, 11 nt, Human
ucccucuuucc

SEQ ID NO: 3886351 - RNA, 13 nt, Human
ucccucuuucccu

SEQ ID NO: 3886352 - RNA, 18 nt, Human
ucccucuuucccucccuu

SEQ ID NO: 3886353 - RNA, 21 nt, Human
ucccucuuucccucccuuccu

SEQ ID NO: 3886354 - RNA, 10 nt, Human
ucccucuuuu

SEQ ID NO: 3886355 - RNA, 14 nt, Human
ucccucuuuucuua

SEQ ID NO: 3886356 - RNA, 16 nt, Human
ucccugaaaacccaga

SEQ ID NO: 3886357 - RNA, 18 nt, Human
ucccugaaaacccagaga

SEQ ID NO: 3886358 - RNA, 13 nt, Human
ucccugaaacacg

SEQ ID NO: 3886359 - RNA, 15 nt, Human
ucccugaaccauccc

SEQ ID NO: 3886360 - RNA, 14 nt, Human
ucccugaacuuccu

SEQ ID NO: 3886361 - RNA, 17 nt, Human
ucccugaagccagccuu

SEQ ID NO: 3886362 - RNA, 18 nt, Human
ucccugaaggccccgccc

SEQ ID NO: 3886363 - RNA, 23 nt, Human
ucccugaaggccccgcccaggcu

SEQ ID NO: 3886364 - RNA, 16 nt, Human
ucccugaaguuaugug

SEQ ID NO: 3886365 - RNA, 16 nt, Human
ucccugacacugcggg

SEQ ID NO: 3886366 - RNA, 14 nt, Human
ucccugacccgucu

SEQ ID NO: 3886367 - RNA, 16 nt, Human
ucccugacccugcaga

SEQ ID NO: 3886368 - RNA, 17 nt, Human
ucccugaccucccucua

SEQ ID NO: 3886369 - RNA, 21 nt, Human
ucccugaccucccucuaauuu

SEQ ID NO: 3886370 - RNA, 16 nt, Human
ucccugacucauucug

SEQ ID NO: 3886371 - RNA, 13 nt, Human
ucccugagauggg

SEQ ID NO: 3886372 - RNA, 16 nt, Human
ucccugagcaggaaag

SEQ ID NO: 3886373 - RNA, 15 nt, Human
ucccugaggacugau

SEQ ID NO: 3886374 - RNA, 22 nt, Human
ucccugaggcagguccccagac

SEQ ID NO: 3886375 - RNA, 19 nt, Human
ucccugauaacaaccugga

SEQ ID NO: 3886376 - RNA, 15 nt, Human
ucccugaucccugau

SEQ ID NO: 3886377 - RNA, 15 nt, Human
ucccugaucccuucc

SEQ ID NO: 3886378 - RNA, 19 nt, Human
ucccugauugaccugcucc

SEQ ID NO: 3886379 - RNA, 15 nt, Human
ucccugcaaccaacu

SEQ ID NO: 3886380 - RNA, 17 nt, Human
ucccugcacagugacuu

SEQ ID NO: 3886381 - RNA, 22 nt, Human
ucccugcacagugacuucugag

SEQ ID NO: 3886382 - RNA, 23 nt, Human
ucccugcacagugacuucugaga

SEQ ID NO: 3886383 - RNA, 22 nt, Human
ucccugcacuaaagccagccug

SEQ ID NO: 3886384 - RNA, 13 nt, Human
ucccugcacuugc

SEQ ID NO: 3886385 - RNA, 16 nt, Human
ucccugcaucugacca

SEQ ID NO: 3886386 - RNA, 23 nt, Human
ucccugcauggcauccuccagcc

SEQ ID NO: 3886387 - RNA, 17 nt, Human
ucccugcauuucugagu

SEQ ID NO: 3886388 - RNA, 13 nt, Human
ucccugccagcuc

SEQ ID NO: 3886389 - RNA, 16 nt, Human
ucccugcccaggccgg

SEQ ID NO: 3886390 - RNA, 16 nt, Human
ucccugcccauuucau

SEQ ID NO: 3886391 - RNA, 13 nt, Human
ucccugccccaaa

SEQ ID NO: 3886392 - RNA, 17 nt, Human
ucccugcccucaucucu

SEQ ID NO: 3886393 - RNA, 18 nt, Human
ucccugccucaggccucu

SEQ ID NO: 3886394 - RNA, 16 nt, Human
ucccugccuccugccg

SEQ ID NO: 3886395 - RNA, 15 nt, Human
ucccugccuggcccc

SEQ ID NO: 3886396 - RNA, 23 nt, Human
ucccugccugguccucacacuca

SEQ ID NO: 3886397 - RNA, 16 nt, Human
ucccugcgccuuuccu

SEQ ID NO: 3886398 - RNA, 15 nt, Human
ucccugcuaaucucc

SEQ ID NO: 3886399 - RNA, 23 nt, Human
ucccugcuagggguuuuaggucu

SEQ ID NO: 3886400 - RNA, 15 nt, Human
ucccugcucacugca

SEQ ID NO: 3886401 - RNA, 17 nt, Human
ucccugcuguccccucu

SEQ ID NO: 3886402 - RNA, 18 nt, Human
ucccuggaaggacaucca

SEQ ID NO: 3886403 - RNA, 17 nt, Human
ucccuggaccagaugcu

SEQ ID NO: 3886404 - RNA, 19 nt, Human
ucccuggaccagaugcuga

SEQ ID NO: 3886405 - RNA, 21 nt, Human
ucccuggagccuccacugccu

SEQ ID NO: 3886406 - RNA, 21 nt, Human
ucccuggaguguggcugagga

SEQ ID NO: 3886407 - RNA, 20 nt, Human
ucccuggaucuaccuggagg

SEQ ID NO: 3886408 - RNA, 20 nt, Human
ucccuggaugacauuaaaga

SEQ ID NO: 3886409 - RNA, 18 nt, Human
ucccuggauuuuuaccag

SEQ ID NO: 3886410 - RNA, 20 nt, Human
ucccuggcccccucccugga

SEQ ID NO: 3886411 - RNA, 15 nt, Human
ucccuggcggcccca

SEQ ID NO: 3886412 - RNA, 16 nt, Human
ucccuggcucucagaa

SEQ ID NO: 3886413 - RNA, 18 nt, Human
ucccuggcucucagaagg

SEQ ID NO: 3886414 - RNA, 20 nt, Human
ucccuggcugcccuggcccu

SEQ ID NO: 3886415 - RNA, 21 nt, Human
ucccuggcugcccuggcccug

SEQ ID NO: 3886416 - RNA, 23 nt, Human
ucccuggcugcccuggcccugag

SEQ ID NO: 3886417 - RNA, 12 nt, Human
ucccuggcuucc

SEQ ID NO: 3886418 - RNA, 14 nt, Human
ucccuggcuucugu

SEQ ID NO: 3886419 - RNA, 15 nt, Human
ucccuggcuucugug

SEQ ID NO: 3886420 - RNA, 18 nt, Human
ucccuggcuuguaacucc

SEQ ID NO: 3886421 - RNA, 22 nt, Human
ucccuggcuuguaacuccacca

SEQ ID NO: 3886422 - RNA, 19 nt, Human
ucccugggaggaaauuuga

SEQ ID NO: 3886423 - RNA, 12 nt, Human
ucccugggccug

SEQ ID NO: 3886424 - RNA, 19 nt, Human
ucccugggccugcugcuga

SEQ ID NO: 3886425 - RNA, 16 nt, Human
ucccugggccuugggc

SEQ ID NO: 3886426 - RNA, 19 nt, Human
ucccugggccuugggcucc

SEQ ID NO: 3886427 - RNA, 16 nt, Human
ucccugggcugugcua

SEQ ID NO: 3886428 - RNA, 20 nt, Human
ucccugggcugugcuaccug

SEQ ID NO: 3886429 - RNA, 19 nt, Human
ucccugggggaagcccugg

SEQ ID NO: 3886430 - RNA, 20 nt, Human
ucccuggguagcgggggagg

SEQ ID NO: 3886431 - RNA, 12 nt, Human
ucccuggucccu

SEQ ID NO: 3886432 - RNA, 13 nt, Human
ucccuggucccuu

SEQ ID NO: 3886433 - RNA, 12 nt, Human
uccuaguuccac

SEQ ID NO: 3886434 - RNA, 22 nt, Human
uccuaguuccaccaucaagcca

SEQ ID NO: 3886435 - RNA, 15 nt, Human
uccuaguucuagaaa

SEQ ID NO: 3886436 - RNA, 16 nt, Human
uccuaguucuagaaaa

SEQ ID NO: 3886437 - RNA, 19 nt, Human
uccuaguucuagaaaaaca

SEQ ID NO: 3886438 - RNA, 16 nt, Human
uccuaguuugaccuca

SEQ ID NO: 3886439 - RNA, 18 nt, Human
uccuaguuugaccucaca

SEQ ID NO: 3886440 - RNA, 16 nt, Human
uccuaguuuuccuacu

SEQ ID NO: 3886441 - RNA, 14 nt, Human
uccuauaacuugau

SEQ ID NO: 3886442 - RNA, 21 nt, Human
uccuauaaggaagauuuggaa

SEQ ID NO: 3886443 - RNA, 22 nt, Human
uccuauaaucugucaaaacacu

SEQ ID NO: 3886444 - RNA, 13 nt, Human
uccuauaccauuu

SEQ ID NO: 3886445 - RNA, 17 nt, Human
uccuauauauuucuauu

SEQ ID NO: 3886446 - RNA, 23 nt, Human
uccuauaucauuaaaagaacaua

SEQ ID NO: 3886447 - RNA, 21 nt, Human
uccuauauuguuuucagugua

SEQ ID NO: 3886448 - RNA, 14 nt, Human
uccuaucaccuccc

SEQ ID NO: 3886449 - RNA, 22 nt, Human
uccuaucagccugucucuucca

SEQ ID NO: 3886450 - RNA, 16 nt, Human
uccuaucugggcuucc

SEQ ID NO: 3886451 - RNA, 18 nt, Human
uccuaucugggcuuccug

SEQ ID NO: 3886452 - RNA, 19 nt, Human
uccuaucugggcuuccugg

SEQ ID NO: 3886453 - RNA, 17 nt, Human
uccuaucuguguuuuga

SEQ ID NO: 3886454 - RNA, 22 nt, Human
uccuaucuucauaucuaucaga

SEQ ID NO: 3886455 - RNA, 17 nt, Human
uccuaugaaugcuuugc

SEQ ID NO: 3886456 - RNA, 15 nt, Human
uccuaugauguauac

SEQ ID NO: 3886457 - RNA, 20 nt, Human
uccuaugcaugguuucagca

SEQ ID NO: 3886458 - RNA, 21 nt, Human
uccuaugcaugguuucagcac

SEQ ID NO: 3886459 - RNA, 21 nt, Human
uccuaugcuauugacaauaaa

SEQ ID NO: 3886460 - RNA, 22 nt, Human
uccuaugcuauugacaauaaaa

SEQ ID NO: 3886461 - RNA, 23 nt, Human
uccuaugugauuuuaacucuguc

SEQ ID NO: 3886462 - RNA, 12 nt, Human
uccuauguguaa

SEQ ID NO: 3886463 - RNA, 11 nt, Human
uccuauguuug

SEQ ID NO: 3886464 - RNA, 18 nt, Human
uccuauguuuuuguucaa

SEQ ID NO: 3886465 - RNA, 15 nt, Human
uccuauucuauaaaa

SEQ ID NO: 3886466 - RNA, 14 nt, Human
uccuauucuauugc

SEQ ID NO: 3886467 - RNA, 14 nt, Human
uccuauucucacca

SEQ ID NO: 3886468 - RNA, 20 nt, Human
uccuauucucaccaggaagg

SEQ ID NO: 3886469 - RNA, 18 nt, Human
uccuauugugauuugacu

SEQ ID NO: 3886470 - RNA, 22 nt, Human
uccuauugugauuugacuguuu

SEQ ID NO: 3886471 - RNA, 16 nt, Human
uccuauuucaguacuu

SEQ ID NO: 3886472 - RNA, 18 nt, Human
uccuauuuggggcuugca

SEQ ID NO: 3886473 - RNA, 16 nt, Human
uccuauuuguuuucau

SEQ ID NO: 3886474 - RNA, 14 nt, Human
uccuauuuuuuuaa

SEQ ID NO: 3886475 - RNA, 22 nt, Human
uccuauuuuuuuaaaaucacua

SEQ ID NO: 3886476 - RNA, 15 nt, Human
uccucaaacacugca

SEQ ID NO: 3886477 - RNA, 16 nt, Human
uccucaaagaaagugu

SEQ ID NO: 3886478 - RNA, 19 nt, Human
uccucaaagaaaguguauu

SEQ ID NO: 3886479 - RNA, 17 nt, Human
uccucaacacccaacug

SEQ ID NO: 3886480 - RNA, 15 nt, Human
uccucaaggggccau

SEQ ID NO: 3886481 - RNA, 14 nt, Human
uccucaauccagcu

SEQ ID NO: 3886482 - RNA, 21 nt, Human
uccucaauuauuauucacauu

SEQ ID NO: 3886483 - RNA, 15 nt, Human
uccucacacuuuugg

SEQ ID NO: 3886484 - RNA, 22 nt, Human
uccucacacuuuuggaaccaug

SEQ ID NO: 3886485 - RNA, 19 nt, Human
uccucacagucccacugug

SEQ ID NO: 3886486 - RNA, 14 nt, Human
uccucaccacaugc

SEQ ID NO: 3886487 - RNA, 13 nt, Human
uccucacccccag

SEQ ID NO: 3886488 - RNA, 15 nt, Human
uccucaccccugucc

SEQ ID NO: 3886489 - RNA, 17 nt, Human
uccucaccccuguccuc

SEQ ID NO: 3886490 - RNA, 16 nt, Human
uccucaccucuggacu

SEQ ID NO: 3886491 - RNA, 21 nt, Human
uccucaccucuggacuggcua

SEQ ID NO: 3886492 - RNA, 22 nt, Human
uccucaccucuggacuggcuag

SEQ ID NO: 3886493 - RNA, 14 nt, Human
uccucacucccagu

SEQ ID NO: 3886494 - RNA, 17 nt, Human
uccucacucccuuccca

SEQ ID NO: 3886495 - RNA, 19 nt, Human
uccucacucccuucccaua

SEQ ID NO: 3886496 - RNA, 19 nt, Human
uccucacugcccuccccag

SEQ ID NO: 3886497 - RNA, 17 nt, Human
uccucacugcucccuga

SEQ ID NO: 3886498 - RNA, 20 nt, Human
uccucacugcucccugaagc

SEQ ID NO: 3886499 - RNA, 13 nt, Human
uccucacuggcca

SEQ ID NO: 3886500 - RNA, 17 nt, Human
uccucacuggccauccc

SEQ ID NO: 3886501 - RNA, 15 nt, Human
uccucacuggguggg

SEQ ID NO: 3886502 - RNA, 22 nt, Human
uccucacuggguggggugagga

SEQ ID NO: 3886503 - RNA, 14 nt, Human
uccucagaaagugu

SEQ ID NO: 3886504 - RNA, 20 nt, Human
uccucagagaauuucuacca

SEQ ID NO: 3886505 - RNA, 20 nt, Human
uccucagaucuucugugggu

SEQ ID NO: 3886506 - RNA, 20 nt, Human
uccucagccuccucaucugg

SEQ ID NO: 3886507 - RNA, 12 nt, Human
uccucagccuga

SEQ ID NO: 3886508 - RNA, 14 nt, Human
uccucagccugaac

SEQ ID NO: 3886509 - RNA, 21 nt, Human
uccucagccugaaccccaggg

SEQ ID NO: 3886510 - RNA, 18 nt, Human
uccucagccuugccagag

SEQ ID NO: 3886511 - RNA, 21 nt, Human
uccucagccuugccagagauc

SEQ ID NO: 3886512 - RNA, 14 nt, Human
uccucagcuuaucu

SEQ ID NO: 3886513 - RNA, 12 nt, Human
uccucaggacca

SEQ ID NO: 3886514 - RNA, 22 nt, Human
uccucaggagccgaagcccagg

SEQ ID NO: 3886515 - RNA, 22 nt, Human
uccucagguggccaugccucag

SEQ ID NO: 3886516 - RNA, 18 nt, Human
uccucaguuccugcagca

SEQ ID NO: 3886517 - RNA, 16 nt, Human
uccucauaaaaagcaa

SEQ ID NO: 3886518 - RNA, 21 nt, Human
uccucauauggcccaguguca

SEQ ID NO: 3886519 - RNA, 14 nt, Human
uccucauccacccc

SEQ ID NO: 3886520 - RNA, 15 nt, Human
uccucauccacccca

SEQ ID NO: 3886521 - RNA, 18 nt, Human
uccucauccaccccaucc

SEQ ID NO: 3886522 - RNA, 18 nt, Human
uccucauccagggcucug

SEQ ID NO: 3886523 - RNA, 22 nt, Human
uccucaucccguguucuccuuu

SEQ ID NO: 3886524 - RNA, 17 nt, Human
uccucauccucagaugc

SEQ ID NO: 3886525 - RNA, 20 nt, Human
uccucauccucagaugcuca

SEQ ID NO: 3886526 - RNA, 23 nt, Human
uccucaucucuaacagcucagga

SEQ ID NO: 3886527 - RNA, 15 nt, Human
uccucaugaauguaa

SEQ ID NO: 3886528 - RNA, 19 nt, Human
uccucauggcagccuacuc

SEQ ID NO: 3886529 - RNA, 17 nt, Human
uccucauuagcauuuug

SEQ ID NO: 3886530 - RNA, 18 nt, Human
uccucauuagcauuuugc

SEQ ID NO: 3886531 - RNA, 18 nt, Human
uccuccaaaggcccccua

SEQ ID NO: 3886532 - RNA, 23 nt, Human
uccuccaaaggcccccuacgcca

SEQ ID NO: 3886533 - RNA, 20 nt, Human
uccuccaagacacuguggac

SEQ ID NO: 3886534 - RNA, 14 nt, Human
uccuccaagccagc

SEQ ID NO: 3886535 - RNA, 20 nt, Human
uccuccaccaccgcccgucu

SEQ ID NO: 3886536 - RNA, 21 nt, Human
uccuccaccgccauggcuucc

SEQ ID NO: 3886537 - RNA, 22 nt, Human
uccuccaccgccauggcuucca

SEQ ID NO: 3886538 - RNA, 23 nt, Human
uccuccaccgccauggcuuccaa

SEQ ID NO: 3886539 - RNA, 19 nt, Human
uccuccacguucugcucau

SEQ ID NO: 3886540 - RNA, 16 nt, Human
uccuccacucuccccc

SEQ ID NO: 3886541 - RNA, 19 nt, Human
uccuccacucucccccacc

SEQ ID NO: 3886542 - RNA, 10 nt, Human
uccuccagaa

SEQ ID NO: 3886543 - RNA, 18 nt, Human
uccuccagaacucuuccu

SEQ ID NO: 3886544 - RNA, 14 nt, Human
uccuccagaagccu

SEQ ID NO: 3886545 - RNA, 21 nt, Human
uccuccagaagccucuggcua

SEQ ID NO: 3886546 - RNA, 22 nt, Human
uccuccagaagccucuggcuag

SEQ ID NO: 3886547 - RNA, 20 nt, Human
uccuccagcagggaaaaugc

SEQ ID NO: 3886548 - RNA, 12 nt, Human
uccuccagcccc

SEQ ID NO: 3886549 - RNA, 13 nt, Human
uccuccagccccu

SEQ ID NO: 3886550 - RNA, 15 nt, Human
uccuccagccccugu

SEQ ID NO: 3886551 - RNA, 14 nt, Human
uccuccagcugcac

SEQ ID NO: 3886552 - RNA, 15 nt, Human
uccuccagcugcacc

SEQ ID NO: 3886553 - RNA, 13 nt, Human
uccuccagcuucu

SEQ ID NO: 3886554 - RNA, 14 nt, Human
uccuccagcuucug

SEQ ID NO: 3886555 - RNA, 17 nt, Human
uccuccaggccugccuc

SEQ ID NO: 3886556 - RNA, 19 nt, Human
uccuccagggcucaacacu

SEQ ID NO: 3886557 - RNA, 20 nt, Human
uccuccaggguggcagcaac

SEQ ID NO: 3886558 - RNA, 20 nt, Human
uccuccaggugcacaagcuc

SEQ ID NO: 3886559 - RNA, 12 nt, Human
uccuccagguuu

SEQ ID NO: 3886560 - RNA, 18 nt, Human
uccuccagguuuuucaau

SEQ ID NO: 3886561 - RNA, 19 nt, Human
uccuccagguuuuucaauu

SEQ ID NO: 3886562 - RNA, 22 nt, Human
uccuccagugugggcuugacca

SEQ ID NO: 3886563 - RNA, 16 nt, Human
uccuccauacucagga

SEQ ID NO: 3886564 - RNA, 15 nt, Human
uccuccauccuccuc

SEQ ID NO: 3886565 - RNA, 19 nt, Human
uccuccaucuccaagaaug

SEQ ID NO: 3886566 - RNA, 22 nt, Human
uccucccaaaaguaucgggggc

SEQ ID NO: 3886567 - RNA, 20 nt, Human
uccucccaauuucagacucc

SEQ ID NO: 3886568 - RNA, 20 nt, Human
uccucccacccggcugcaga

SEQ ID NO: 3886569 - RNA, 13 nt, Human
uccucccaccuca

SEQ ID NO: 3886570 - RNA, 21 nt, Human
uccucccaccucagccucccg

SEQ ID NO: 3886571 - RNA, 13 nt, Human
uccucccaggcgc

SEQ ID NO: 3886572 - RNA, 19 nt, Human
uccucccaggcgccccuuc

SEQ ID NO: 3886573 - RNA, 21 nt, Human
uccucccaggcgccccuuccc

SEQ ID NO: 3886574 - RNA, 21 nt, Human
uccucccauagauacucucuu

SEQ ID NO: 3886575 - RNA, 19 nt, Human
uccucccauccccuggacu

SEQ ID NO: 3886576 - RNA, 23 nt, Human
uccucccauccccuggacuggga

SEQ ID NO: 3886577 - RNA, 13 nt, Human
ucuauuuauguuu

SEQ ID NO: 3886578 - RNA, 14 nt, Human
ucuauuuauuaagu

SEQ ID NO: 3886579 - RNA, 22 nt, Human
ucuauuuauuuacugagcuucu

SEQ ID NO: 3886580 - RNA, 15 nt, Human
ucuauuuauuuguga

SEQ ID NO: 3886581 - RNA, 19 nt, Human
ucuauuucccccuuucuuc

SEQ ID NO: 3886582 - RNA, 15 nt, Human
ucuauuuccuggaau

SEQ ID NO: 3886583 - RNA, 16 nt, Human
ucuauuucuccuccau

SEQ ID NO: 3886584 - RNA, 18 nt, Human
ucuauuugaauuauuucu

SEQ ID NO: 3886585 - RNA, 15 nt, Human
ucuauuuuaaaauaa

SEQ ID NO: 3886586 - RNA, 12 nt, Human
ucuauuuuaaga

SEQ ID NO: 3886587 - RNA, 11 nt, Human
ucuauuuuaca

SEQ ID NO: 3886588 - RNA, 14 nt, Human
ucuauuuuagaaua

SEQ ID NO: 3886589 - RNA, 11 nt, Human
ucuauuuucua

SEQ ID NO: 3886590 - RNA, 13 nt, Human
ucuauuuucucau

SEQ ID NO: 3886591 - RNA, 13 nt, Human
ucuauuuugaugc

SEQ ID NO: 3886592 - RNA, 23 nt, Human
ucuauuuugaugcagcauuugau

SEQ ID NO: 3886593 - RNA, 14 nt, Human
ucuauuuuuguaga

SEQ ID NO: 3886594 - RNA, 20 nt, Human
ucuauuuuuugaaaagcaga

SEQ ID NO: 3886595 - RNA, 15 nt, Human
ucucaaaaauacaaa

SEQ ID NO: 3886596 - RNA, 21 nt, Human
ucucaaaacuggacagucacu

SEQ ID NO: 3886597 - RNA, 13 nt, Human
ucucaaaagaacu

SEQ ID NO: 3886598 - RNA, 14 nt, Human
ucucaaaagcauuu

SEQ ID NO: 3886599 - RNA, 18 nt, Human
ucucaaaagcauuuauca

SEQ ID NO: 3886600 - RNA, 21 nt, Human
ucucaaaagcauuuaucauuc

SEQ ID NO: 3886601 - RNA, 19 nt, Human
ucucaaacacaguuacacu

SEQ ID NO: 3886602 - RNA, 22 nt, Human
ucucaaacacaguuacacuugu

SEQ ID NO: 3886603 - RNA, 23 nt, Human
ucucaaaccuugaugugccugug

SEQ ID NO: 3886604 - RNA, 22 nt, Human
ucucaaacgguacacagacuau

SEQ ID NO: 3886605 - RNA, 23 nt, Human
ucucaaacucccgaccucaggug

SEQ ID NO: 3886606 - RNA, 21 nt, Human
ucucaaacuccugaccucagg

SEQ ID NO: 3886607 - RNA, 21 nt, Human
ucucaaacucuugaccucagg

SEQ ID NO: 3886608 - RNA, 21 nt, Human
ucucaaagaaauuuccacuca

SEQ ID NO: 3886609 - RNA, 21 nt, Human
ucucaacaaagcacaguguua

SEQ ID NO: 3886610 - RNA, 23 nt, Human
ucucaacacccaguuuccuuggg

SEQ ID NO: 3886611 - RNA, 16 nt, Human
ucucaacaggccucag

SEQ ID NO: 3886612 - RNA, 17 nt, Human
ucucaacaggccucagg

SEQ ID NO: 3886613 - RNA, 17 nt, Human
ucucaacccaggagcau

SEQ ID NO: 3886614 - RNA, 18 nt, Human
ucucaagagggcacuggu

SEQ ID NO: 3886615 - RNA, 20 nt, Human
ucucaagccgcaucccagac

SEQ ID NO: 3886616 - RNA, 22 nt, Human
ucucaagccgcaucccagacuu

SEQ ID NO: 3886617 - RNA, 14 nt, Human
ucucaaguaauaua

SEQ ID NO: 3886618 - RNA, 21 nt, Human
ucucaaguucuaagauucuaa

SEQ ID NO: 3886619 - RNA, 22 nt, Human
ucucaauaaaauuauagcucua

SEQ ID NO: 3886620 - RNA, 13 nt, Human
ucucaaugaaaua

SEQ ID NO: 3886621 - RNA, 21 nt, Human
ucucaaugaaccauaaauuca

SEQ ID NO: 3886622 - RNA, 16 nt, Human
ucucaauuccaacagu

SEQ ID NO: 3886623 - RNA, 17 nt, Human
ucucaauugcuuuguaa

SEQ ID NO: 3886624 - RNA, 13 nt, Human
ucucaauuuuugg

SEQ ID NO: 3886625 - RNA, 22 nt, Human
ucucaauuuuugguugaauaaa

SEQ ID NO: 3886626 - RNA, 21 nt, Human
ucucacacaugagcaucaggc

SEQ ID NO: 3886627 - RNA, 18 nt, Human
ucucacacucuaacugua

SEQ ID NO: 3886628 - RNA, 14 nt, Human
ucucacacuggcgu

SEQ ID NO: 3886629 - RNA, 19 nt, Human
ucucacacugguucucaau

SEQ ID NO: 3886630 - RNA, 14 nt, Human
ucucacagacagga

SEQ ID NO: 3886631 - RNA, 21 nt, Human
ucucacagacaggaccccugc

SEQ ID NO: 3886632 - RNA, 16 nt, Human
ucucacagaugugacu

SEQ ID NO: 3886633 - RNA, 11 nt, Human
ucucacagcac

SEQ ID NO: 3886634 - RNA, 18 nt, Human
ucucacagcacacucagc

SEQ ID NO: 3886635 - RNA, 20 nt, Human
ucucacagcacaugcuggcc

SEQ ID NO: 3886636 - RNA, 23 nt, Human
ucucacagcacaugcuggccagc

SEQ ID NO: 3886637 - RNA, 21 nt, Human
ucucacagcuccaagaauuuc

SEQ ID NO: 3886638 - RNA, 12 nt, Human
ucucacaguggg

SEQ ID NO: 3886639 - RNA, 19 nt, Human
ucucacagugggagccagg

SEQ ID NO: 3886640 - RNA, 23 nt, Human
ucucacagugggagccagggcug

SEQ ID NO: 3886641 - RNA, 19 nt, Human
ucucacaugauuccagcca

SEQ ID NO: 3886642 - RNA, 22 nt, Human
ucucacauggaaugaggguuug

SEQ ID NO: 3886643 - RNA, 23 nt, Human
ucucacauggugcuacgccugca

SEQ ID NO: 3886644 - RNA, 16 nt, Human
ucucaccagcugcaaa

SEQ ID NO: 3886645 - RNA, 20 nt, Human
ucucaccagcugcaaagugu

SEQ ID NO: 3886646 - RNA, 15 nt, Human
ucucaccagcugcug

SEQ ID NO: 3886647 - RNA, 12 nt, Human
ucucaccaggaa

SEQ ID NO: 3886648 - RNA, 14 nt, Human
ucucaccaggcagc

SEQ ID NO: 3886649 - RNA, 18 nt, Human
ucucaccaggcagccucu

SEQ ID NO: 3886650 - RNA, 19 nt, Human
ucucaccaggcagccucug

SEQ ID NO: 3886651 - RNA, 15 nt, Human
ucucaccauuuggau

SEQ ID NO: 3886652 - RNA, 18 nt, Human
ucucaccauuuggauccu

SEQ ID NO: 3886653 - RNA, 17 nt, Human
ucucaccccaucccaca

SEQ ID NO: 3886654 - RNA, 21 nt, Human
ucucaccccaucccacacccu

SEQ ID NO: 3886655 - RNA, 12 nt, Human
ucucacccugga

SEQ ID NO: 3886656 - RNA, 16 nt, Human
ucucacccuggaggca

SEQ ID NO: 3886657 - RNA, 13 nt, Human
ucucaccucagcc

SEQ ID NO: 3886658 - RNA, 16 nt, Human
ucucaccuccugcugg

SEQ ID NO: 3886659 - RNA, 21 nt, Human
ucucaccucuagguccccaua

SEQ ID NO: 3886660 - RNA, 15 nt, Human
ucucaccuguacucu

SEQ ID NO: 3886661 - RNA, 16 nt, Human
ucucaccuuccaaauc

SEQ ID NO: 3886662 - RNA, 22 nt, Human
ucucacggccacacagcugccg

SEQ ID NO: 3886663 - RNA, 23 nt, Human
ucucacgggcaugggcacucccu

SEQ ID NO: 3886664 - RNA, 14 nt, Human
ucucacuaaaucuu

SEQ ID NO: 3886665 - RNA, 17 nt, Human
ucucacuccaccaccca

SEQ ID NO: 3886666 - RNA, 15 nt, Human
ucucacuccccuccu

SEQ ID NO: 3886667 - RNA, 18 nt, Human
ucucacuccuaccuggua

SEQ ID NO: 3886668 - RNA, 12 nt, Human
ucucacucuguc

SEQ ID NO: 3886669 - RNA, 18 nt, Human
ucucacucugucgcccag

SEQ ID NO: 3886670 - RNA, 11 nt, Human
ucucacugagc

SEQ ID NO: 3886671 - RNA, 16 nt, Human
ucucacugagcacugu

SEQ ID NO: 3886672 - RNA, 17 nt, Human
ucucacugagcacuguu

SEQ ID NO: 3886673 - RNA, 21 nt, Human
ucucacugugggaaggccagc

SEQ ID NO: 3886674 - RNA, 16 nt, Human
ucucacuguucccucu

SEQ ID NO: 3886675 - RNA, 18 nt, Human
ucucacuguucccucugc

SEQ ID NO: 3886676 - RNA, 22 nt, Human
ucucacuguucccucugcuccu

SEQ ID NO: 3886677 - RNA, 17 nt, Human
ucucacuguugcccagg

SEQ ID NO: 3886678 - RNA, 21 nt, Human
ucucacuguugcccaggcugg

SEQ ID NO: 3886679 - RNA, 19 nt, Human
ucucacuguuuguuuuuau

SEQ ID NO: 3886680 - RNA, 15 nt, Human
ucucacuuuucucca

SEQ ID NO: 3886681 - RNA, 20 nt, Human
ucucacuuuucuccaugagu

SEQ ID NO: 3886682 - RNA, 17 nt, Human
ucucagaaagugccuga

SEQ ID NO: 3886683 - RNA, 12 nt, Human
ucucagaagcac

SEQ ID NO: 3886684 - RNA, 19 nt, Human
ucucagaagguauuccuuu

SEQ ID NO: 3886685 - RNA, 19 nt, Human
ucucagaaucuacccaaag

SEQ ID NO: 3886686 - RNA, 20 nt, Human
ucucagaaucuacccaaagg

SEQ ID NO: 3886687 - RNA, 17 nt, Human
ucucagaaucucaaaua

SEQ ID NO: 3886688 - RNA, 18 nt, Human
ucucagacuuuuguacau

SEQ ID NO: 3886689 - RNA, 21 nt, Human
ucucagagcuacuugggccau

SEQ ID NO: 3886690 - RNA, 14 nt, Human
ucucagaggcccca

SEQ ID NO: 3886691 - RNA, 23 nt, Human
ucucagauauuuauauuuuuauu

SEQ ID NO: 3886692 - RNA, 14 nt, Human
ucucagaucacugc

SEQ ID NO: 3886693 - RNA, 17 nt, Human
ucucagaucacugcaac

SEQ ID NO: 3886694 - RNA, 17 nt, Human
ucucagauccuuguuuc

SEQ ID NO: 3886695 - RNA, 18 nt, Human
ucucagauccuuguuuca

SEQ ID NO: 3886696 - RNA, 19 nt, Human
ucucagauccuuguuucaa

SEQ ID NO: 3886697 - RNA, 19 nt, Human
ucucagauguuaaaauaaa

SEQ ID NO: 3886698 - RNA, 14 nt, Human
ucucagauuuuauu

SEQ ID NO: 3886699 - RNA, 16 nt, Human
ucucagauuuuauuau

SEQ ID NO: 3886700 - RNA, 12 nt, Human
ucucagcagagu

SEQ ID NO: 3886701 - RNA, 13 nt, Human
ucucagcagagug

SEQ ID NO: 3886702 - RNA, 23 nt, Human
ucucagcagcgaccaccccugcc

SEQ ID NO: 3886703 - RNA, 15 nt, Human
ucucagcccagaaga

SEQ ID NO: 3886704 - RNA, 20 nt, Human
ucucagcccagaagaaaauu

SEQ ID NO: 3886705 - RNA, 12 nt, Human
ucucagccccuu

SEQ ID NO: 3886706 - RNA, 20 nt, Human
ucucagccccuuucccuugu

SEQ ID NO: 3886707 - RNA, 13 nt, Human
ucucagccuccca

SEQ ID NO: 3886708 - RNA, 21 nt, Human
ucucagcuccagguggcucug

SEQ ID NO: 3886709 - RNA, 19 nt, Human
ucucagcuuugagaagccu

SEQ ID NO: 3886710 - RNA, 23 nt, Human
ucucaggaaaucaaauaugcaaa

SEQ ID NO: 3886711 - RNA, 19 nt, Human
ucucaggacacaggccugu

SEQ ID NO: 3886712 - RNA, 20 nt, Human
ucucaggacacaggccugug

SEQ ID NO: 3886713 - RNA, 13 nt, Human
ucucaggagccau

SEQ ID NO: 3886714 - RNA, 20 nt, Human
ucucaggcaccagucccugu

SEQ ID NO: 3886715 - RNA, 20 nt, Human
ucucaggcaugaacauguac

SEQ ID NO: 3886716 - RNA, 18 nt, Human
ucucaggccaccugcccc

SEQ ID NO: 3886717 - RNA, 19 nt, Human
ucucaggccaccugccccc

SEQ ID NO: 3886718 - RNA, 17 nt, Human
ucucaggccagagccaa

SEQ ID NO: 3886719 - RNA, 23 nt, Human
ucucaggccggcagccccagccu

SEQ ID NO: 3886720 - RNA, 14 nt, Human
ucucaggcucugcc

SEQ ID NO: 3886721 - RNA, 14 nt, Human
ucuccugccuacuc

SEQ ID NO: 3886722 - RNA, 17 nt, Human
ucuccugccuacucacg

SEQ ID NO: 3886723 - RNA, 12 nt, Human
ucuccugccuca

SEQ ID NO: 3886724 - RNA, 17 nt, Human
ucuccugccucagccuc

SEQ ID NO: 3886725 - RNA, 17 nt, Human
ucuccugccuuccuccu

SEQ ID NO: 3886726 - RNA, 20 nt, Human
ucuccugccuuccuccuggg

SEQ ID NO: 3886727 - RNA, 16 nt, Human
ucuccugccuuugccu

SEQ ID NO: 3886728 - RNA, 21 nt, Human
ucuccuggaagugcuaauuuu

SEQ ID NO: 3886729 - RNA, 17 nt, Human
ucuccuggaggauugca

SEQ ID NO: 3886730 - RNA, 21 nt, Human
ucuccuggccuauccgcugcc

SEQ ID NO: 3886731 - RNA, 23 nt, Human
ucuccuggccuauccgcugccag

SEQ ID NO: 3886732 - RNA, 12 nt, Human
ucuccuggcuuc

SEQ ID NO: 3886733 - RNA, 15 nt, Human
ucuccuggcuuccca

SEQ ID NO: 3886734 - RNA, 18 nt, Human
ucuccuggcuucccaucc

SEQ ID NO: 3886735 - RNA, 23 nt, Human
ucuccuggcuucccauccccagc

SEQ ID NO: 3886736 - RNA, 16 nt, Human
ucuccugggcagcugc

SEQ ID NO: 3886737 - RNA, 15 nt, Human
ucuccugggccccuc

SEQ ID NO: 3886738 - RNA, 23 nt, Human
ucuccuguaagccaaagaaauga

SEQ ID NO: 3886739 - RNA, 14 nt, Human
ucuccuguccaacc

SEQ ID NO: 3886740 - RNA, 17 nt, Human
ucuccuguccucccuca

SEQ ID NO: 3886741 - RNA, 19 nt, Human
ucuccuguuuauucccauc

SEQ ID NO: 3886742 - RNA, 20 nt, Human
ucuccuguuuauucccaucu

SEQ ID NO: 3886743 - RNA, 17 nt, Human
ucuccuguuucccuucc

SEQ ID NO: 3886744 - RNA, 14 nt, Human
ucuccuguuuuucu

SEQ ID NO: 3886745 - RNA, 15 nt, Human
ucuccuuagaagugg

SEQ ID NO: 3886746 - RNA, 18 nt, Human
ucuccuuagucuucucau

SEQ ID NO: 3886747 - RNA, 14 nt, Human
ucuccuucaccuuu

SEQ ID NO: 3886748 - RNA, 15 nt, Human
ucuccuucagcccuc

SEQ ID NO: 3886749 - RNA, 21 nt, Human
ucuccuucaugacagccucca

SEQ ID NO: 3886750 - RNA, 11 nt, Human
ucuccuuccuu

SEQ ID NO: 3886751 - RNA, 14 nt, Human
ucuccuuccuuacc

SEQ ID NO: 3886752 - RNA, 18 nt, Human
ucuccuuccuuacccaaa

SEQ ID NO: 3886753 - RNA, 13 nt, Human
ucuccuugcaguu

SEQ ID NO: 3886754 - RNA, 23 nt, Human
ucuccuugcuccuggccuugcug

SEQ ID NO: 3886755 - RNA, 23 nt, Human
ucuccuuggugucgggcaugaca

SEQ ID NO: 3886756 - RNA, 19 nt, Human
ucuccuuguggccugggcc

SEQ ID NO: 3886757 - RNA, 20 nt, Human
ucuccuuguggccugggccu

SEQ ID NO: 3886758 - RNA, 13 nt, Human
ucuccuuguguua

SEQ ID NO: 3886759 - RNA, 14 nt, Human
ucuccuuguucuga

SEQ ID NO: 3886760 - RNA, 16 nt, Human
ucuccuuguucugaua

SEQ ID NO: 3886761 - RNA, 15 nt, Human
ucuccuuuaauugua

SEQ ID NO: 3886762 - RNA, 20 nt, Human
ucuccuuuagggacagcuua

SEQ ID NO: 3886763 - RNA, 14 nt, Human
ucuccuuucagggc

SEQ ID NO: 3886764 - RNA, 12 nt, Human
ucuccuuugaaa

SEQ ID NO: 3886765 - RNA, 19 nt, Human
ucuccuuugcacugagggc

SEQ ID NO: 3886766 - RNA, 23 nt, Human
ucuccuuugcacugagggccaca

SEQ ID NO: 3886767 - RNA, 17 nt, Human
ucuccuuugcaggcuca

SEQ ID NO: 3886768 - RNA, 20 nt, Human
ucuccuuuguacuuugugcu

SEQ ID NO: 3886769 - RNA, 14 nt, Human
ucuccuuuguauau

SEQ ID NO: 3886770 - RNA, 22 nt, Human
ucuccuuuguauucugucuuca

SEQ ID NO: 3886771 - RNA, 18 nt, Human
ucuccuuuucuuuuguua

SEQ ID NO: 3886772 - RNA, 17 nt, Human
ucucgaacuccugaccu

SEQ ID NO: 3886773 - RNA, 14 nt, Human
ucucgaugcaauga

SEQ ID NO: 3886774 - RNA, 23 nt, Human
ucucgcauaggaccuuuccacca

SEQ ID NO: 3886775 - RNA, 16 nt, Human
ucucgcaucuucccaa

SEQ ID NO: 3886776 - RNA, 13 nt, Human
ucucgccaagcag

SEQ ID NO: 3886777 - RNA, 21 nt, Human
ucucgcggccucuucucucag

SEQ ID NO: 3886778 - RNA, 15 nt, Human
ucucgcucccuccca

SEQ ID NO: 3886779 - RNA, 16 nt, Human
ucucgcucccucccag

SEQ ID NO: 3886780 - RNA, 15 nt, Human
ucucgcucugucacc

SEQ ID NO: 3886781 - RNA, 19 nt, Human
ucucgcucuguugcccagg

SEQ ID NO: 3886782 - RNA, 15 nt, Human
ucucgcuucccugaa

SEQ ID NO: 3886783 - RNA, 21 nt, Human
ucucggaacugcaugcugcug

SEQ ID NO: 3886784 - RNA, 21 nt, Human
ucucggcaacuaagcaguccc

SEQ ID NO: 3886785 - RNA, 23 nt, Human
ucucggcucagugcaaccucugc

SEQ ID NO: 3886786 - RNA, 19 nt, Human
ucucguccucguuuguguu

SEQ ID NO: 3886787 - RNA, 14 nt, Human
ucucgugauugaua

SEQ ID NO: 3886788 - RNA, 18 nt, Human
ucucgugggagagccauc

SEQ ID NO: 3886789 - RNA, 14 nt, Human
ucucguuucaaaaa

SEQ ID NO: 3886790 - RNA, 22 nt, Human
ucucuaaagaguuuauuuuaag

SEQ ID NO: 3886791 - RNA, 23 nt, Human
ucucuaaaugaggggccucaggu

SEQ ID NO: 3886792 - RNA, 22 nt, Human
ucucuaacucagaaacaucagu

SEQ ID NO: 3886793 - RNA, 12 nt, Human
ucucuaacuuca

SEQ ID NO: 3886794 - RNA, 22 nt, Human
ucucuaacuucaaggcccauau

SEQ ID NO: 3886795 - RNA, 19 nt, Human
ucucuaacuucaccauauu

SEQ ID NO: 3886796 - RNA, 18 nt, Human
ucucuaauaauaaauagu

SEQ ID NO: 3886797 - RNA, 13 nt, Human
ucucuacaaaccc

SEQ ID NO: 3886798 - RNA, 22 nt, Human
ucucuacagucucgucucuuuu

SEQ ID NO: 3886799 - RNA, 13 nt, Human
ucucuaccauccc

SEQ ID NO: 3886800 - RNA, 18 nt, Human
ucucuacccaucuuaaaa

SEQ ID NO: 3886801 - RNA, 13 nt, Human
ucucuacucugcu

SEQ ID NO: 3886802 - RNA, 22 nt, Human
ucucuacugaaugucauugaaa

SEQ ID NO: 3886803 - RNA, 22 nt, Human
ucucuacuuuucccuguacuuu

SEQ ID NO: 3886804 - RNA, 13 nt, Human
ucucuagaauuuu

SEQ ID NO: 3886805 - RNA, 22 nt, Human
ucucuagaauuuuaagugcuuu

SEQ ID NO: 3886806 - RNA, 23 nt, Human
ucucuagcuggugguuucacggu

SEQ ID NO: 3886807 - RNA, 13 nt, Human
ucucuaggaaaua

SEQ ID NO: 3886808 - RNA, 19 nt, Human
ucucuaggaaauauuuauu

SEQ ID NO: 3886809 - RNA, 13 nt, Human
ucucuaggaaguc

SEQ ID NO: 3886810 - RNA, 18 nt, Human
ucucuaggccucuccagu

SEQ ID NO: 3886811 - RNA, 15 nt, Human
ucucuaggcugggga

SEQ ID NO: 3886812 - RNA, 16 nt, Human
ucucuagugcugugaa

SEQ ID NO: 3886813 - RNA, 15 nt, Human
ucucuaguuugauua

SEQ ID NO: 3886814 - RNA, 18 nt, Human
ucucuaguuugauuaaau

SEQ ID NO: 3886815 - RNA, 13 nt, Human
ucucuauaaaaaa

SEQ ID NO: 3886816 - RNA, 14 nt, Human
ucucuauaccaaua

SEQ ID NO: 3886817 - RNA, 14 nt, Human
ucucuaucauuaaa

SEQ ID NO: 3886818 - RNA, 17 nt, Human
ucucuaucauuaaaguu

SEQ ID NO: 3886819 - RNA, 15 nt, Human
ucucuaucauuuaau

SEQ ID NO: 3886820 - RNA, 16 nt, Human
ucucuaucauuuaaua

SEQ ID NO: 3886821 - RNA, 21 nt, Human
ucucuauuaccacugaagaua

SEQ ID NO: 3886822 - RNA, 17 nt, Human
ucucuauuccccacccu

SEQ ID NO: 3886823 - RNA, 23 nt, Human
ucucuauuuaaauucuuuuuuaa

SEQ ID NO: 3886824 - RNA, 14 nt, Human
ucucuauuuaauau

SEQ ID NO: 3886825 - RNA, 15 nt, Human
ucucuauuuaauauu

SEQ ID NO: 3886826 - RNA, 13 nt, Human
ucucucaaaucug

SEQ ID NO: 3886827 - RNA, 14 nt, Human
ucucucaaauuguc

SEQ ID NO: 3886828 - RNA, 15 nt, Human
ucucucacagacagg

SEQ ID NO: 3886829 - RNA, 19 nt, Human
ucucucacagacaggaccc

SEQ ID NO: 3886830 - RNA, 17 nt, Human
ucucucacuuguuuuau

SEQ ID NO: 3886831 - RNA, 13 nt, Human
ucucucaggagca

SEQ ID NO: 3886832 - RNA, 17 nt, Human
ucucucaggagcacagg

SEQ ID NO: 3886833 - RNA, 19 nt, Human
ucucucaggagcacaggca

SEQ ID NO: 3886834 - RNA, 19 nt, Human
ucucucaucucuuagcucc

SEQ ID NO: 3886835 - RNA, 12 nt, Human
ucucucaugaac

SEQ ID NO: 3886836 - RNA, 19 nt, Human
ucucuccacuuucagcugu

SEQ ID NO: 3886837 - RNA, 20 nt, Human
ucucuccacuuucagcuguc

SEQ ID NO: 3886838 - RNA, 16 nt, Human
ucucuccagauguuuc

SEQ ID NO: 3886839 - RNA, 18 nt, Human
ucucuccagccccuggau

SEQ ID NO: 3886840 - RNA, 18 nt, Human
ucucuccagcugacuaaa

SEQ ID NO: 3886841 - RNA, 19 nt, Human
ucucuccagcugacuaaac

SEQ ID NO: 3886842 - RNA, 13 nt, Human
ucucuccagugca

SEQ ID NO: 3886843 - RNA, 14 nt, Human
ucucucccaggggc

SEQ ID NO: 3886844 - RNA, 17 nt, Human
ucucucccauggagccc

SEQ ID NO: 3886845 - RNA, 20 nt, Human
ucucucccauggagccccag

SEQ ID NO: 3886846 - RNA, 23 nt, Human
ucucucccauggagccccagccc

SEQ ID NO: 3886847 - RNA, 13 nt, Human
ucucuccccucaa

SEQ ID NO: 3886848 - RNA, 14 nt, Human
ucucucccuccccu

SEQ ID NO: 3886849 - RNA, 12 nt, Human
ucucuccuggcc

SEQ ID NO: 3886850 - RNA, 17 nt, Human
ucucuccuucuuccccc

SEQ ID NO: 3886851 - RNA, 15 nt, Human
ucucuccuuguucug

SEQ ID NO: 3886852 - RNA, 19 nt, Human
ucucuccuuguucugauaa

SEQ ID NO: 3886853 - RNA, 10 nt, Human
ucucuccuuu

SEQ ID NO: 3886854 - RNA, 22 nt, Human
ucucuccuuucuuuuucuucuu

SEQ ID NO: 3886855 - RNA, 14 nt, Human
ucucuccuuugcug

SEQ ID NO: 3886856 - RNA, 17 nt, Human
ucucuccuuuucuuuug

SEQ ID NO: 3886857 - RNA, 18 nt, Human
ucucucgguuccacgucc

SEQ ID NO: 3886858 - RNA, 16 nt, Human
ucucucuauuaccacu

SEQ ID NO: 3886859 - RNA, 17 nt, Human
ucucucucaauuuuugg

SEQ ID NO: 3886860 - RNA, 19 nt, Human
ucucucuccuguacuuuuu

SEQ ID NO: 3886861 - RNA, 14 nt, Human
ucucucucuaaggu

SEQ ID NO: 3886862 - RNA, 14 nt, Human
ucucucucuacaaa

SEQ ID NO: 3886863 - RNA, 16 nt, Human
ucucucucucucaaaa

SEQ ID NO: 3886864 - RNA, 14 nt, Human
ucucucucuguugu

SEQ ID NO: 3886865 - RNA, 15 nt, Human
ucucucucuuagcau

SEQ ID NO: 3886866 - RNA, 14 nt, Human
ucucucugacucuc

SEQ ID NO: 3886867 - RNA, 14 nt, Human
ucugagaaugaaca

SEQ ID NO: 3886868 - RNA, 13 nt, Human
ucugagacucaca

SEQ ID NO: 3886869 - RNA, 22 nt, Human
ucugagacucgcgacaaugcaa

SEQ ID NO: 3886870 - RNA, 19 nt, Human
ucugagagcaaagugaccu

SEQ ID NO: 3886871 - RNA, 17 nt, Human
ucugagagucuagauuc

SEQ ID NO: 3886872 - RNA, 18 nt, Human
ucugagauucaauauuga

SEQ ID NO: 3886873 - RNA, 15 nt, Human
ucugagcaagagcug

SEQ ID NO: 3886874 - RNA, 17 nt, Human
ucugagcaagagcuggc

SEQ ID NO: 3886875 - RNA, 15 nt, Human
ucugagcacacuuua

SEQ ID NO: 3886876 - RNA, 19 nt, Human
ucugagcaccgaauauuga

SEQ ID NO: 3886877 - RNA, 22 nt, Human
ucugagcaccgaauauugagca

SEQ ID NO: 3886878 - RNA, 17 nt, Human
ucugagcagcgagccug

SEQ ID NO: 3886879 - RNA, 19 nt, Human
ucugagcagugaaugauuc

SEQ ID NO: 3886880 - RNA, 22 nt, Human
ucugagcauuagauuucucauu

SEQ ID NO: 3886881 - RNA, 15 nt, Human
ucugagccacagugg

SEQ ID NO: 3886882 - RNA, 17 nt, Human
ucugagccacaguggga

SEQ ID NO: 3886883 - RNA, 15 nt, Human
ucugagccccuggga

SEQ ID NO: 3886884 - RNA, 16 nt, Human
ucugagccccugggac

SEQ ID NO: 3886885 - RNA, 13 nt, Human
ucugagcccgggc

SEQ ID NO: 3886886 - RNA, 21 nt, Human
ucugagcccgguaagagcaaa

SEQ ID NO: 3886887 - RNA, 18 nt, Human
ucugagcccucaaaguga

SEQ ID NO: 3886888 - RNA, 17 nt, Human
ucugagcuauuucaucu

SEQ ID NO: 3886889 - RNA, 13 nt, Human
ucugagcuccagc

SEQ ID NO: 3886890 - RNA, 15 nt, Human
ucugagcugcucuga

SEQ ID NO: 3886891 - RNA, 22 nt, Human
ucugagcuggccucucacugcc

SEQ ID NO: 3886892 - RNA, 22 nt, Human
ucugaggaaucaacagggcagc

SEQ ID NO: 3886893 - RNA, 21 nt, Human
ucugaggaauccagacccggc

SEQ ID NO: 3886894 - RNA, 15 nt, Human
ucugaggaauucugu

SEQ ID NO: 3886895 - RNA, 17 nt, Human
ucugaggaauucuguau

SEQ ID NO: 3886896 - RNA, 14 nt, Human
ucugaggacaagag

SEQ ID NO: 3886897 - RNA, 18 nt, Human
ucugaggacaagagaaaa

SEQ ID NO: 3886898 - RNA, 16 nt, Human
ucugaggccagccugg

SEQ ID NO: 3886899 - RNA, 19 nt, Human
ucugaggccagccuggccu

SEQ ID NO: 3886900 - RNA, 20 nt, Human
ucugaggccagccuggccuc

SEQ ID NO: 3886901 - RNA, 21 nt, Human
ucugaggcucuuucugggcca

SEQ ID NO: 3886902 - RNA, 11 nt, Human
ucugaggcugu

SEQ ID NO: 3886903 - RNA, 17 nt, Human
ucugagggaaauguuuu

SEQ ID NO: 3886904 - RNA, 18 nt, Human
ucugagggaaauguuuug

SEQ ID NO: 3886905 - RNA, 21 nt, Human
ucugagggaggaggccaccuc

SEQ ID NO: 3886906 - RNA, 20 nt, Human
ucugagggcuuguaguucuu

SEQ ID NO: 3886907 - RNA, 21 nt, Human
ucugaggggcuaccaggaaag

SEQ ID NO: 3886908 - RNA, 19 nt, Human
ucugagguccugagcacug

SEQ ID NO: 3886909 - RNA, 21 nt, Human
ucugagguccugagcacugcc

SEQ ID NO: 3886910 - RNA, 23 nt, Human
ucugaggugcacugggaggcucc

SEQ ID NO: 3886911 - RNA, 13 nt, Human
ucugaguacagag

SEQ ID NO: 3886912 - RNA, 16 nt, Human
ucugagucaacuccuu

SEQ ID NO: 3886913 - RNA, 18 nt, Human
ucugagugaaccuguaua

SEQ ID NO: 3886914 - RNA, 24 nt, Human
ucugaguguuuuuacuacaguugu

SEQ ID NO: 3886915 - RNA, 12 nt, Human
ucugaguuaugu

SEQ ID NO: 3886916 - RNA, 19 nt, Human
ucugaguucuguguauuuu

SEQ ID NO: 3886917 - RNA, 21 nt, Human
ucugaguuuaccauuuguaau

SEQ ID NO: 3886918 - RNA, 22 nt, Human
ucugaguuucauucuccugccu

SEQ ID NO: 3886919 - RNA, 20 nt, Human
ucugauaacuagauggugcu

SEQ ID NO: 3886920 - RNA, 22 nt, Human
ucugauaacuagauggugcuga

SEQ ID NO: 3886921 - RNA, 17 nt, Human
ucugauacagaaaaguu

SEQ ID NO: 3886922 - RNA, 16 nt, Human
ucugauacccagagca

SEQ ID NO: 3886923 - RNA, 13 nt, Human
ucugauaugggac

SEQ ID NO: 3886924 - RNA, 17 nt, Human
ucugaucauccacugug

SEQ ID NO: 3886925 - RNA, 21 nt, Human
ucugauccuaguuccaccauc

SEQ ID NO: 3886926 - RNA, 20 nt, Human
ucugaucgugacgcugaaua

SEQ ID NO: 3886927 - RNA, 15 nt, Human
ucugaugaaaaauug

SEQ ID NO: 3886928 - RNA, 14 nt, Human
ucugaugaaucuug

SEQ ID NO: 3886929 - RNA, 16 nt, Human
ucugaugcaagcaaga

SEQ ID NO: 3886930 - RNA, 21 nt, Human
ucugaugcaagcaagaaacac

SEQ ID NO: 3886931 - RNA, 13 nt, Human
ucugaugcagcuu

SEQ ID NO: 3886932 - RNA, 17 nt, Human
ucugaugcagcuuauac

SEQ ID NO: 3886933 - RNA, 13 nt, Human
ucugauggcuucu

SEQ ID NO: 3886934 - RNA, 15 nt, Human
ucugauguaaaugaa

SEQ ID NO: 3886935 - RNA, 15 nt, Human
ucugauguacucuaa

SEQ ID NO: 3886936 - RNA, 13 nt, Human
ucugauuccacuu

SEQ ID NO: 3886937 - RNA, 19 nt, Human
ucugauucccaagcucugc

SEQ ID NO: 3886938 - RNA, 19 nt, Human
ucugauucgaaugacacug

SEQ ID NO: 3886939 - RNA, 22 nt, Human
ucugauugauuugauugggaug

SEQ ID NO: 3886940 - RNA, 21 nt, Human
ucugauuggacauuuucuuca

SEQ ID NO: 3886941 - RNA, 20 nt, Human
ucugauuguaacguugcugu

SEQ ID NO: 3886942 - RNA, 16 nt, Human
ucugauugugauguga

SEQ ID NO: 3886943 - RNA, 13 nt, Human
ucugauuuaauug

SEQ ID NO: 3886944 - RNA, 23 nt, Human
ucugauuuauuuuguaugaaaua

SEQ ID NO: 3886945 - RNA, 20 nt, Human
ucugauuucuuuucaccauu

SEQ ID NO: 3886946 - RNA, 13 nt, Human
ucugauuuuagga

SEQ ID NO: 3886947 - RNA, 21 nt, Human
ucugauuuuauguaaaauuuu

SEQ ID NO: 3886948 - RNA, 22 nt, Human
ucugauuuuauguaaaauuuug

SEQ ID NO: 3886949 - RNA, 14 nt, Human
ucugcaaaaauauu

SEQ ID NO: 3886950 - RNA, 16 nt, Human
ucugcaaaaggagaga

SEQ ID NO: 3886951 - RNA, 20 nt, Human
ucugcaaaaugaggaaugua

SEQ ID NO: 3886952 - RNA, 21 nt, Human
ucugcaaaaugaggaauguau

SEQ ID NO: 3886953 - RNA, 22 nt, Human
ucugcaaaaugaggaauguaua

SEQ ID NO: 3886954 - RNA, 16 nt, Human
ucugcaaagcauguuu

SEQ ID NO: 3886955 - RNA, 16 nt, Human
ucugcaaauagaaaac

SEQ ID NO: 3886956 - RNA, 14 nt, Human
ucugcaacaagcau

SEQ ID NO: 3886957 - RNA, 16 nt, Human
ucugcaacaagcaugc

SEQ ID NO: 3886958 - RNA, 21 nt, Human
ucugcaacuuuaagcagcucu

SEQ ID NO: 3886959 - RNA, 21 nt, Human
ucugcaagaauugaagcagga

SEQ ID NO: 3886960 - RNA, 23 nt, Human
ucugcaaguauacuagggagcca

SEQ ID NO: 3886961 - RNA, 15 nt, Human
ucugcaagucagagg

SEQ ID NO: 3886962 - RNA, 19 nt, Human
ucugcaauucaaaaguucc

SEQ ID NO: 3886963 - RNA, 16 nt, Human
ucugcaauuccccucu

SEQ ID NO: 3886964 - RNA, 20 nt, Human
ucugcaauuccccucugcug

SEQ ID NO: 3886965 - RNA, 14 nt, Human
ucugcacaagcugc

SEQ ID NO: 3886966 - RNA, 14 nt, Human
ucugcacacaaaua

SEQ ID NO: 3886967 - RNA, 20 nt, Human
ucugcacauaaacucuuuua

SEQ ID NO: 3886968 - RNA, 20 nt, Human
ucugcacaugcagcugcacc

SEQ ID NO: 3886969 - RNA, 21 nt, Human
ucugcacaugcagcugcaccc

SEQ ID NO: 3886970 - RNA, 15 nt, Human
ucugcacaugucuug

SEQ ID NO: 3886971 - RNA, 16 nt, Human
ucugcacaugucuugu

SEQ ID NO: 3886972 - RNA, 21 nt, Human
ucugcacaugucuuguacaug

SEQ ID NO: 3886973 - RNA, 14 nt, Human
ucugcacccagaac

SEQ ID NO: 3886974 - RNA, 15 nt, Human
ucugcacccagaaca

SEQ ID NO: 3886975 - RNA, 17 nt, Human
ucugcaccccccugggc

SEQ ID NO: 3886976 - RNA, 18 nt, Human
ucugcaccccccugggcu

SEQ ID NO: 3886977 - RNA, 15 nt, Human
ucugcaccccuucuc

SEQ ID NO: 3886978 - RNA, 18 nt, Human
ucugcaccccuucucucc

SEQ ID NO: 3886979 - RNA, 19 nt, Human
ucugcaccccuucucuccu

SEQ ID NO: 3886980 - RNA, 13 nt, Human
ucugcacccucca

SEQ ID NO: 3886981 - RNA, 16 nt, Human
ucugcacccuccaccc

SEQ ID NO: 3886982 - RNA, 17 nt, Human
ucugcacccuccacccu

SEQ ID NO: 3886983 - RNA, 18 nt, Human
ucugcacccuccacccug

SEQ ID NO: 3886984 - RNA, 19 nt, Human
ucugcacccuccacccugu

SEQ ID NO: 3886985 - RNA, 23 nt, Human
ucugcaccgccggccagcuggga

SEQ ID NO: 3886986 - RNA, 21 nt, Human
ucugcaccuauguagcucugc

SEQ ID NO: 3886987 - RNA, 22 nt, Human
ucugcaccuauguagcucugca

SEQ ID NO: 3886988 - RNA, 16 nt, Human
ucugcaccuuaucuua

SEQ ID NO: 3886989 - RNA, 12 nt, Human
ucugcacuacuc

SEQ ID NO: 3886990 - RNA, 18 nt, Human
ucugcacuacuccucugc

SEQ ID NO: 3886991 - RNA, 19 nt, Human
ucugcacuacuccucugca

SEQ ID NO: 3886992 - RNA, 18 nt, Human
ucugcacuauaugcaaac

SEQ ID NO: 3886993 - RNA, 16 nt, Human
ucugcacuccccugcu

SEQ ID NO: 3886994 - RNA, 20 nt, Human
ucugcacuccccugcugggu

SEQ ID NO: 3886995 - RNA, 12 nt, Human
ucugcacugaaa

SEQ ID NO: 3886996 - RNA, 13 nt, Human
ucugcacugaaaa

SEQ ID NO: 3886997 - RNA, 16 nt, Human
ucugcacugaaaaggu

SEQ ID NO: 3886998 - RNA, 22 nt, Human
ucugcacugagcagagucuugc

SEQ ID NO: 3886999 - RNA, 13 nt, Human
ucugcagaaggaa

SEQ ID NO: 3887000 - RNA, 18 nt, Human
ucugcagacuucccagcu

SEQ ID NO: 3887001 - RNA, 15 nt, Human
ucugcagauaaacag

SEQ ID NO: 3887002 - RNA, 20 nt, Human
ucugcagauagaaagcauua

SEQ ID NO: 3887003 - RNA, 15 nt, Human
ucugcagcccugaga

SEQ ID NO: 3887004 - RNA, 11 nt, Human
ucugcagccuc

SEQ ID NO: 3887005 - RNA, 13 nt, Human
ucugcagccucag

SEQ ID NO: 3887006 - RNA, 19 nt, Human
ucugcaggaaauaggccca

SEQ ID NO: 3887007 - RNA, 22 nt, Human
ucugcaggcaccuuaguggcuu

SEQ ID NO: 3887008 - RNA, 16 nt, Human
ucugcaggcagacacg

SEQ ID NO: 3887009 - RNA, 13 nt, Human
ucugcaggcaggg

SEQ ID NO: 3887010 - RNA, 12 nt, Human
ucugcagguccc

SEQ ID NO: 3887011 - RNA, 13 nt, Human
ucuuuugacaugu

SEQ ID NO: 3887012 - RNA, 17 nt, Human
ucuuuugacauguggaa

SEQ ID NO: 3887013 - RNA, 16 nt, Human
ucuuuugauuauguuu

SEQ ID NO: 3887014 - RNA, 17 nt, Human
ucuuuugccguuauuaa

SEQ ID NO: 3887015 - RNA, 23 nt, Human
ucuuuugccuuuugcaaccagga

SEQ ID NO: 3887016 - RNA, 19 nt, Human
ucuuuugcuacuaaguuca

SEQ ID NO: 3887017 - RNA, 13 nt, Human
ucuuuugcuuuug

SEQ ID NO: 3887018 - RNA, 18 nt, Human
ucuuuugcuuuuggcaaa

SEQ ID NO: 3887019 - RNA, 15 nt, Human
ucuuuuguauguaaa

SEQ ID NO: 3887020 - RNA, 17 nt, Human
ucuuuuguauguaaaug

SEQ ID NO: 3887021 - RNA, 15 nt, Human
ucuuuuguuaaauaa

SEQ ID NO: 3887022 - RNA, 19 nt, Human
ucuuuuguuacucuuggga

SEQ ID NO: 3887023 - RNA, 13 nt, Human
ucuuuuguuacug

SEQ ID NO: 3887024 - RNA, 14 nt, Human
ucuuuuguuacugu

SEQ ID NO: 3887025 - RNA, 16 nt, Human
ucuuuuguuacuguuc

SEQ ID NO: 3887026 - RNA, 17 nt, Human
ucuuuuguuacuguucu

SEQ ID NO: 3887027 - RNA, 22 nt, Human
ucuuuuguuacuguucuugcug

SEQ ID NO: 3887028 - RNA, 20 nt, Human
ucuuuuguucgcauggucac

SEQ ID NO: 3887029 - RNA, 15 nt, Human
ucuuuuguuguuucu

SEQ ID NO: 3887030 - RNA, 13 nt, Human
ucuuuuuaaagcu

SEQ ID NO: 3887031 - RNA, 23 nt, Human
ucuuuuuaaaguguuucuguuau

SEQ ID NO: 3887032 - RNA, 18 nt, Human
ucuuuuuaaaguucaaac

SEQ ID NO: 3887033 - RNA, 16 nt, Human
ucuuuuuaaguaaugu

SEQ ID NO: 3887034 - RNA, 15 nt, Human
ucuuuuuaaguuaau

SEQ ID NO: 3887035 - RNA, 21 nt, Human
ucuuuuuacccauuuguucau

SEQ ID NO: 3887036 - RNA, 16 nt, Human
ucuuuuuauacuauua

SEQ ID NO: 3887037 - RNA, 12 nt, Human
ucuuuuucaguu

SEQ ID NO: 3887038 - RNA, 14 nt, Human
ucuuuuucuggacu

SEQ ID NO: 3887039 - RNA, 14 nt, Human
ucuuuuucuguugu

SEQ ID NO: 3887040 - RNA, 15 nt, Human
ucuuuuucuguugua

SEQ ID NO: 3887041 - RNA, 16 nt, Human
ucuuuuucuguuguaa

SEQ ID NO: 3887042 - RNA, 15 nt, Human
ucuuuuucuucuucc

SEQ ID NO: 3887043 - RNA, 17 nt, Human
ucuuuuugaaguauuua

SEQ ID NO: 3887044 - RNA, 22 nt, Human
ucuuuuugggagagacuuguuu

SEQ ID NO: 3887045 - RNA, 14 nt, Human
ucuuuuuuacucau

SEQ ID NO: 3887046 - RNA, 22 nt, Human
ucuuuuuuacucauugaaaugu

SEQ ID NO: 3887047 - RNA, 20 nt, Human
ucuuuuuuagcauaaaauuu

SEQ ID NO: 3887048 - RNA, 13 nt, Human
ucuuuuuuaugug

SEQ ID NO: 3887049 - RNA, 15 nt, Human
ucuuuuuuauuaauc

SEQ ID NO: 3887050 - RNA, 16 nt, Human
ucuuuuuucaaaagaa

SEQ ID NO: 3887051 - RNA, 17 nt, Human
ucuuuuuucaaaagaaa

SEQ ID NO: 3887052 - RNA, 21 nt, Human
ucuuuuuuggccaucugcucc

SEQ ID NO: 3887053 - RNA, 22 nt, Human
ucuuuuuuguuuguuucuuugu

SEQ ID NO: 3887054 - RNA, 15 nt, Human
ucuuuuuuucuugaa

SEQ ID NO: 3887055 - RNA, 17 nt, Human
ucuuuuuuuguauaguu

SEQ ID NO: 3887056 - RNA, 18 nt, Human
ucuuuuuuuguauaguua

SEQ ID NO: 3887057 - RNA, 20 nt, Human
ucuuuuuuuucuauuucacu

SEQ ID NO: 3887058 - RNA, 16 nt, Human
ucuuuuuuuuuaaguu

SEQ ID NO: 3887059 - RNA, 20 nt, Human
ugaaaaaaaaaaugcugaac

SEQ ID NO: 3887060 - RNA, 15 nt, Human
ugaaaaaaacuucau

SEQ ID NO: 3887061 - RNA, 12 nt, Human
ugaaaaaaauug

SEQ ID NO: 3887062 - RNA, 21 nt, Human
ugaaaaaagaaauucccugga

SEQ ID NO: 3887063 - RNA, 17 nt, Human
ugaaaaaagcaguucuu

SEQ ID NO: 3887064 - RNA, 11 nt, Human
ugaaaaaagcu

SEQ ID NO: 3887065 - RNA, 14 nt, Human
ugaaaaaagcucau

SEQ ID NO: 3887066 - RNA, 19 nt, Human
ugaaaaaagcuuuuaugag

SEQ ID NO: 3887067 - RNA, 12 nt, Human
ugaaaaaauaua

SEQ ID NO: 3887068 - RNA, 22 nt, Human
ugaaaaagaccuuuggagcaaa

SEQ ID NO: 3887069 - RNA, 14 nt, Human
ugaaaaagcaugua

SEQ ID NO: 3887070 - RNA, 18 nt, Human
ugaaaaagcauguacagu

SEQ ID NO: 3887071 - RNA, 20 nt, Human
ugaaaaauauaaaauuauga

SEQ ID NO: 3887072 - RNA, 22 nt, Human
ugaaaaauauaaaauuaugaga

SEQ ID NO: 3887073 - RNA, 21 nt, Human
ugaaaaaucacuugauucaua

SEQ ID NO: 3887074 - RNA, 20 nt, Human
ugaaaaaucugcuguuaacu

SEQ ID NO: 3887075 - RNA, 14 nt, Human
ugaaaaaugaaaga

SEQ ID NO: 3887076 - RNA, 19 nt, Human
ugaaaaaugagauugaaug

SEQ ID NO: 3887077 - RNA, 14 nt, Human
ugaaaaauugcuga

SEQ ID NO: 3887078 - RNA, 22 nt, Human
ugaaaaauugcugacuguagcu

SEQ ID NO: 3887079 - RNA, 18 nt, Human
ugaaaaauuuaagcauug

SEQ ID NO: 3887080 - RNA, 20 nt, Human
ugaaaaauuuaagcauuguu

SEQ ID NO: 3887081 - RNA, 13 nt, Human
ugaaaacacauuu

SEQ ID NO: 3887082 - RNA, 14 nt, Human
ugaaaacacauuug

SEQ ID NO: 3887083 - RNA, 19 nt, Human
ugaaaacacauuugcuuuu

SEQ ID NO: 3887084 - RNA, 18 nt, Human
ugaaaacagaaaacgguu

SEQ ID NO: 3887085 - RNA, 17 nt, Human
ugaaaacagaaauuggu

SEQ ID NO: 3887086 - RNA, 18 nt, Human
ugaaaacagaaauuggua

SEQ ID NO: 3887087 - RNA, 19 nt, Human
ugaaaacaguguguaaaca

SEQ ID NO: 3887088 - RNA, 14 nt, Human
ugaaaacccagaga

SEQ ID NO: 3887089 - RNA, 23 nt, Human
ugaaaacccagagaggaaucaga

SEQ ID NO: 3887090 - RNA, 15 nt, Human
ugaaaacuacauuuu

SEQ ID NO: 3887091 - RNA, 16 nt, Human
ugaaaacuacauuuua

SEQ ID NO: 3887092 - RNA, 17 nt, Human
ugaaaacuacauuuuaa

SEQ ID NO: 3887093 - RNA, 13 nt, Human
ugaaaacuauaca

SEQ ID NO: 3887094 - RNA, 13 nt, Human
ugaaaacucuuug

SEQ ID NO: 3887095 - RNA, 12 nt, Human
ugaaaacuggaa

SEQ ID NO: 3887096 - RNA, 19 nt, Human
ugaaaacuuuaugcuaagu

SEQ ID NO: 3887097 - RNA, 15 nt, Human
ugaaaagacuccaaa

SEQ ID NO: 3887098 - RNA, 16 nt, Human
ugaaaagacuccaaag

SEQ ID NO: 3887099 - RNA, 16 nt, Human
ugaaaagagaaugaug

SEQ ID NO: 3887100 - RNA, 12 nt, Human
ugaaaagagcug

SEQ ID NO: 3887101 - RNA, 23 nt, Human
ugaaaagaggggaccagaagcca

SEQ ID NO: 3887102 - RNA, 22 nt, Human
ugaaaagaggugugcaagagag

SEQ ID NO: 3887103 - RNA, 17 nt, Human
ugaaaagauuuaagcac

SEQ ID NO: 3887104 - RNA, 17 nt, Human
ugaaaagccauguuuaa

SEQ ID NO: 3887105 - RNA, 22 nt, Human
ugaaaagccauguuuaagauuu

SEQ ID NO: 3887106 - RNA, 16 nt, Human
ugaaaagccucuguuu

SEQ ID NO: 3887107 - RNA, 20 nt, Human
ugaaaagccucuguuuugau

SEQ ID NO: 3887108 - RNA, 17 nt, Human
ugaaaagcuagaauuga

SEQ ID NO: 3887109 - RNA, 13 nt, Human
ugaaaagcuauua

SEQ ID NO: 3887110 - RNA, 19 nt, Human
ugaaaagcuucuuaauuaa

SEQ ID NO: 3887111 - RNA, 23 nt, Human
ugaaaaggugaccuugcaacuuc

SEQ ID NO: 3887112 - RNA, 22 nt, Human
ugaaaagguuuaugaaaaagaa

SEQ ID NO: 3887113 - RNA, 20 nt, Human
ugaaaaguaauauuuauuaa

SEQ ID NO: 3887114 - RNA, 14 nt, Human
ugaaaagucaaacu

SEQ ID NO: 3887115 - RNA, 14 nt, Human
ugaaaaguguguau

SEQ ID NO: 3887116 - RNA, 22 nt, Human
ugaaaaguuacuaccugucaag

SEQ ID NO: 3887117 - RNA, 21 nt, Human
ugaaaauaaaaagaucacuuu

SEQ ID NO: 3887118 - RNA, 14 nt, Human
ugaaaauaaagaau

SEQ ID NO: 3887119 - RNA, 18 nt, Human
ugaaaauaacugaauuug

SEQ ID NO: 3887120 - RNA, 21 nt, Human
ugaaaauaacugaauuuggag

SEQ ID NO: 3887121 - RNA, 22 nt, Human
ugaaaauaaucucugauucccu

SEQ ID NO: 3887122 - RNA, 13 nt, Human
ugaaaauaauugu

SEQ ID NO: 3887123 - RNA, 23 nt, Human
ugaaaauacaacuuaaauaauaa

SEQ ID NO: 3887124 - RNA, 20 nt, Human
ugaaaauaguuuauuuuaaa

SEQ ID NO: 3887125 - RNA, 14 nt, Human
ugaaaauauaacca

SEQ ID NO: 3887126 - RNA, 13 nt, Human
ugaaaauauauac

SEQ ID NO: 3887127 - RNA, 16 nt, Human
ugaaaauaucggggag

SEQ ID NO: 3887128 - RNA, 22 nt, Human
ugaaaauauuuguaucacaaau

SEQ ID NO: 3887129 - RNA, 21 nt, Human
ugaaaauauuuuuuauauaua

SEQ ID NO: 3887130 - RNA, 12 nt, Human
ugaaaaucaaau

SEQ ID NO: 3887131 - RNA, 19 nt, Human
ugaaaaugaauaucuauua

SEQ ID NO: 3887132 - RNA, 23 nt, Human
ugaaaaugcaacaacauguauaa

SEQ ID NO: 3887133 - RNA, 13 nt, Human
ugaaaaugcuggc

SEQ ID NO: 3887134 - RNA, 16 nt, Human
ugaaaaugguauuuuc

SEQ ID NO: 3887135 - RNA, 18 nt, Human
ugaaaauguaagcuguuu

SEQ ID NO: 3887136 - RNA, 14 nt, Human
ugaaaaugucaaag

SEQ ID NO: 3887137 - RNA, 21 nt, Human
ugaaaaugucagaaaccaguu

SEQ ID NO: 3887138 - RNA, 22 nt, Human
ugaaaaugugcuauacugcaua

SEQ ID NO: 3887139 - RNA, 13 nt, Human
ugaaaauguucau

SEQ ID NO: 3887140 - RNA, 17 nt, Human
ugaaaauuauuuaaacc

SEQ ID NO: 3887141 - RNA, 16 nt, Human
ugaaaauuauuugaaa

SEQ ID NO: 3887142 - RNA, 18 nt, Human
ugaaaauuauuuuaaaca

SEQ ID NO: 3887143 - RNA, 19 nt, Human
ugaaaauuauuuuaaacaa

SEQ ID NO: 3887144 - RNA, 19 nt, Human
ugaaaauucaaaaaguguu

SEQ ID NO: 3887145 - RNA, 23 nt, Human
ugaaaauucaaaaaguguuuauu

SEQ ID NO: 3887146 - RNA, 19 nt, Human
ugaaaauugccuuucugug

SEQ ID NO: 3887147 - RNA, 20 nt, Human
ugaaaauuuuaaaaauacau

SEQ ID NO: 3887148 - RNA, 14 nt, Human
ugaaaauuuuacca

SEQ ID NO: 3887149 - RNA, 13 nt, Human
ugaaaauuuugau

SEQ ID NO: 3887150 - RNA, 21 nt, Human
ugaaaauuuugauguuuuaag

SEQ ID NO: 3887151 - RNA, 14 nt, Human
ugaaacaaagaguu

SEQ ID NO: 3887152 - RNA, 22 nt, Human
ugaaacaacaaauaggaauugu

SEQ ID NO: 3887153 - RNA, 15 nt, Human
ugaaacaacuuggaa

SEQ ID NO: 3887154 - RNA, 20 nt, Human
ugaaacacaaacaauaguaa

SEQ ID NO: 3887155 - RNA, 17 nt, Human
ugaaacacaccaggcug

SEQ ID NO: 3887156 - RNA, 23 nt, Human
ugaacguuuucuaauugcuuauu

SEQ ID NO: 3887157 - RNA, 17 nt, Human
ugaacuaaacuuucaca

SEQ ID NO: 3887158 - RNA, 15 nt, Human
ugaacuaaagugcug

SEQ ID NO: 3887159 - RNA, 19 nt, Human
ugaacuaaagugcugcacu

SEQ ID NO: 3887160 - RNA, 16 nt, Human
ugaacuaauaaaagca

SEQ ID NO: 3887161 - RNA, 21 nt, Human
ugaacuauggacggugcucca

SEQ ID NO: 3887162 - RNA, 21 nt, Human
ugaacuauguuuagugugauu

SEQ ID NO: 3887163 - RNA, 17 nt, Human
ugaacuauuucuacaca

SEQ ID NO: 3887164 - RNA, 20 nt, Human
ugaacuauuucuacacagug

SEQ ID NO: 3887165 - RNA, 14 nt, Human
ugaacucagccaag

SEQ ID NO: 3887166 - RNA, 15 nt, Human
ugaacuccugaccuc

SEQ ID NO: 3887167 - RNA, 15 nt, Human
ugaacuccuggccuc

SEQ ID NO: 3887168 - RNA, 17 nt, Human
ugaacuccuggccucaa

SEQ ID NO: 3887169 - RNA, 12 nt, Human
ugaacucugaga

SEQ ID NO: 3887170 - RNA, 21 nt, Human
ugaacucuuaaucaaauagca

SEQ ID NO: 3887171 - RNA, 19 nt, Human
ugaacucuuagaaaugaag

SEQ ID NO: 3887172 - RNA, 14 nt, Human
ugaacucuuucugg

SEQ ID NO: 3887173 - RNA, 20 nt, Human
ugaacucuuucuggccugcc

SEQ ID NO: 3887174 - RNA, 22 nt, Human
ugaacucuuucuggccugccuu

SEQ ID NO: 3887175 - RNA, 23 nt, Human
ugaacucuuucuggccugccuuc

SEQ ID NO: 3887176 - RNA, 20 nt, Human
ugaacucuuugaaugacaaa

SEQ ID NO: 3887177 - RNA, 18 nt, Human
ugaacugaaauuaaaacu

SEQ ID NO: 3887178 - RNA, 19 nt, Human
ugaacugaacucugacaac

SEQ ID NO: 3887179 - RNA, 23 nt, Human
ugaacugacaggcagccuggaca

SEQ ID NO: 3887180 - RNA, 15 nt, Human
ugaacugagcuugga

SEQ ID NO: 3887181 - RNA, 13 nt, Human
ugaacugauaaag

SEQ ID NO: 3887182 - RNA, 21 nt, Human
ugaacuggacccuguugcuaa

SEQ ID NO: 3887183 - RNA, 16 nt, Human
ugaacuggaggccagg

SEQ ID NO: 3887184 - RNA, 21 nt, Human
ugaacuggcaauugucuauuu

SEQ ID NO: 3887185 - RNA, 18 nt, Human
ugaacuggucuuccuuuu

SEQ ID NO: 3887186 - RNA, 13 nt, Human
ugaacugguucau

SEQ ID NO: 3887187 - RNA, 16 nt, Human
ugaacuguuaagaaau

SEQ ID NO: 3887188 - RNA, 12 nt, Human
ugaacuuaacau

SEQ ID NO: 3887189 - RNA, 23 nt, Human
ugaacuuaauaacuguguacugu

SEQ ID NO: 3887190 - RNA, 19 nt, Human
ugaacuuacaggugauuaa

SEQ ID NO: 3887191 - RNA, 18 nt, Human
ugaacuuagauuuuacau

SEQ ID NO: 3887192 - RNA, 20 nt, Human
ugaacuuagauuuuacauga

SEQ ID NO: 3887193 - RNA, 19 nt, Human
ugaacuuccugcuuccuca

SEQ ID NO: 3887194 - RNA, 21 nt, Human
ugaacuucgcaucaaaagaca

SEQ ID NO: 3887195 - RNA, 14 nt, Human
ugaacuugaaauuu

SEQ ID NO: 3887196 - RNA, 20 nt, Human
ugaacuugaggacacauguc

SEQ ID NO: 3887197 - RNA, 20 nt, Human
ugaacuugccucuuuuaccu

SEQ ID NO: 3887198 - RNA, 12 nt, Human
ugaacuugguuc

SEQ ID NO: 3887199 - RNA, 21 nt, Human
ugaacuuucucuucauacuuu

SEQ ID NO: 3887200 - RNA, 20 nt, Human
ugaacuuugaccucugcagc

SEQ ID NO: 3887201 - RNA, 17 nt, Human
ugaacuuugggaagccu

SEQ ID NO: 3887202 - RNA, 12 nt, Human
ugaacuuuugua

SEQ ID NO: 3887203 - RNA, 14 nt, Human
ugaacuuuuguacu

SEQ ID NO: 3887204 - RNA, 16 nt, Human
ugaacuuuuguacuga

SEQ ID NO: 3887205 - RNA, 18 nt, Human
ugaagaaaaaauacauuu

SEQ ID NO: 3887206 - RNA, 18 nt, Human
ugaagaaaagugggccag

SEQ ID NO: 3887207 - RNA, 22 nt, Human
ugaagaaaauacuuaaauguua

SEQ ID NO: 3887208 - RNA, 21 nt, Human
ugaagaaaaucacuuaggaaa

SEQ ID NO: 3887209 - RNA, 17 nt, Human
ugaagaaauuauaaaga

SEQ ID NO: 3887210 - RNA, 20 nt, Human
ugaagaaauuauaaagauaa

SEQ ID NO: 3887211 - RNA, 20 nt, Human
ugaagaacaguaacugccau

SEQ ID NO: 3887212 - RNA, 15 nt, Human
ugaagaacugcaggc

SEQ ID NO: 3887213 - RNA, 16 nt, Human
ugaagaacugcaggcc

SEQ ID NO: 3887214 - RNA, 12 nt, Human
ugaagaagccug

SEQ ID NO: 3887215 - RNA, 11 nt, Human
ugaagaaggug

SEQ ID NO: 3887216 - RNA, 18 nt, Human
ugaagaagguggaccuuu

SEQ ID NO: 3887217 - RNA, 20 nt, Human
ugaagaauacuucucauuuu

SEQ ID NO: 3887218 - RNA, 16 nt, Human
ugaagaauagaaacaa

SEQ ID NO: 3887219 - RNA, 18 nt, Human
ugaagaauagaaacaagc

SEQ ID NO: 3887220 - RNA, 22 nt, Human
ugaagaaugcacaagaauggau

SEQ ID NO: 3887221 - RNA, 15 nt, Human
ugaagaauggcgcca

SEQ ID NO: 3887222 - RNA, 23 nt, Human
ugaagaauguuagaguaaugaaa

SEQ ID NO: 3887223 - RNA, 17 nt, Human
ugaagaauuaagauaca

SEQ ID NO: 3887224 - RNA, 20 nt, Human
ugaagacaaaaauacucuaa

SEQ ID NO: 3887225 - RNA, 23 nt, Human
ugaagacaaugacuuacuguaca

SEQ ID NO: 3887226 - RNA, 20 nt, Human
ugaagacaauuugauacaua

SEQ ID NO: 3887227 - RNA, 14 nt, Human
ugaagacagaacca

SEQ ID NO: 3887228 - RNA, 13 nt, Human
ugaagacagaagu

SEQ ID NO: 3887229 - RNA, 13 nt, Human
ugaagacagagcu

SEQ ID NO: 3887230 - RNA, 16 nt, Human
ugaagacagagcuaca

SEQ ID NO: 3887231 - RNA, 15 nt, Human
ugaagacagcccgau

SEQ ID NO: 3887232 - RNA, 14 nt, Human
ugaagacaggacag

SEQ ID NO: 3887233 - RNA, 15 nt, Human
ugaagaccuaaccag

SEQ ID NO: 3887234 - RNA, 23 nt, Human
ugaagaccuaaccagggccagaa

SEQ ID NO: 3887235 - RNA, 22 nt, Human
ugaagaccuuuuucugcacuau

SEQ ID NO: 3887236 - RNA, 20 nt, Human
ugaagacucauucuucugua

SEQ ID NO: 3887237 - RNA, 15 nt, Human
ugaagacuggaagcu

SEQ ID NO: 3887238 - RNA, 19 nt, Human
ugaagagaagcaauuuugg

SEQ ID NO: 3887239 - RNA, 12 nt, Human
ugaagagacaga

SEQ ID NO: 3887240 - RNA, 23 nt, Human
ugaagagacagagacaaguaauu

SEQ ID NO: 3887241 - RNA, 17 nt, Human
ugaagagacaguuauuu

SEQ ID NO: 3887242 - RNA, 23 nt, Human
ugaagagcaagagagcagcaagg

SEQ ID NO: 3887243 - RNA, 18 nt, Human
ugaagagcuguugauggg

SEQ ID NO: 3887244 - RNA, 17 nt, Human
ugaagaggaggggaaga

SEQ ID NO: 3887245 - RNA, 18 nt, Human
ugaagaggaucggaggcu

SEQ ID NO: 3887246 - RNA, 16 nt, Human
ugaagaggaugcugug

SEQ ID NO: 3887247 - RNA, 16 nt, Human
ugaagaggcgggccag

SEQ ID NO: 3887248 - RNA, 18 nt, Human
ugaagaggggcagcccuu

SEQ ID NO: 3887249 - RNA, 20 nt, Human
ugaagaggggcagcccuugc

SEQ ID NO: 3887250 - RNA, 16 nt, Human
ugaagaggugagagua

SEQ ID NO: 3887251 - RNA, 13 nt, Human
ugaagaguaguuu

SEQ ID NO: 3887252 - RNA, 22 nt, Human
ugaagagugacuaguacaaauu

SEQ ID NO: 3887253 - RNA, 18 nt, Human
ugaagagugagagggcau

SEQ ID NO: 3887254 - RNA, 22 nt, Human
ugaagaguugccccgucucugu

SEQ ID NO: 3887255 - RNA, 18 nt, Human
ugaagauaccaucagcaa

SEQ ID NO: 3887256 - RNA, 15 nt, Human
ugaagauacugaaau

SEQ ID NO: 3887257 - RNA, 16 nt, Human
ugaagauacugaaaua

SEQ ID NO: 3887258 - RNA, 18 nt, Human
ugaagauacugaaauaaa

SEQ ID NO: 3887259 - RNA, 12 nt, Human
ugaagauacuuu

SEQ ID NO: 3887260 - RNA, 14 nt, Human
ugaagauagaagaa

SEQ ID NO: 3887261 - RNA, 23 nt, Human
ugaagauauaacuauugcccagg

SEQ ID NO: 3887262 - RNA, 22 nt, Human
ugaagaucauauacgugaaaau

SEQ ID NO: 3887263 - RNA, 21 nt, Human
ugaagaugcagcaaaauguga

SEQ ID NO: 3887264 - RNA, 15 nt, Human
ugaagaugcagcuca

SEQ ID NO: 3887265 - RNA, 21 nt, Human
ugaagaugcugaaacaggaga

SEQ ID NO: 3887266 - RNA, 16 nt, Human
ugaagaugggaacgca

SEQ ID NO: 3887267 - RNA, 20 nt, Human
ugaagaugucaucccauugu

SEQ ID NO: 3887268 - RNA, 15 nt, Human
ugaagauguugagaa

SEQ ID NO: 3887269 - RNA, 15 nt, Human
ugaagauguuugcaa

SEQ ID NO: 3887270 - RNA, 17 nt, Human
ugaagauguuugcaaua

SEQ ID NO: 3887271 - RNA, 18 nt, Human
ugaagauucuccugugcu

SEQ ID NO: 3887272 - RNA, 22 nt, Human
ugaagauuguuuaucuagaugu

SEQ ID NO: 3887273 - RNA, 24 nt, Human
ugaagauuguuuaucuagauguaa

SEQ ID NO: 3887274 - RNA, 15 nt, Human
ugaagcaaacacauu

SEQ ID NO: 3887275 - RNA, 18 nt, Human
ugaagcaaagcaccagcu

SEQ ID NO: 3887276 - RNA, 15 nt, Human
ugaagcaaaucagaa

SEQ ID NO: 3887277 - RNA, 20 nt, Human
ugaagcaaaugucaugcugc

SEQ ID NO: 3887278 - RNA, 23 nt, Human
ugaagcaaaugucaugcugccuu

SEQ ID NO: 3887279 - RNA, 20 nt, Human
ugaagcaaggcgguggacuu

SEQ ID NO: 3887280 - RNA, 17 nt, Human
ugaagcaccaagcucaa

SEQ ID NO: 3887281 - RNA, 12 nt, Human
ugaagcagagug

SEQ ID NO: 3887282 - RNA, 17 nt, Human
ugaagcagaguggcagu

SEQ ID NO: 3887283 - RNA, 19 nt, Human
ugaagcagaugcaaagagg

SEQ ID NO: 3887284 - RNA, 15 nt, Human
ugaagcagccucucc

SEQ ID NO: 3887285 - RNA, 17 nt, Human
ugaagcagcuuuaaaca

SEQ ID NO: 3887286 - RNA, 19 nt, Human
ugaagcagcuuuaaacaaa

SEQ ID NO: 3887287 - RNA, 19 nt, Human
ugaagcagguucccaagcu

SEQ ID NO: 3887288 - RNA, 20 nt, Human
ugaagcagguucccaagcuc

SEQ ID NO: 3887289 - RNA, 14 nt, Human
ugaagcaguauuuu

SEQ ID NO: 3887290 - RNA, 17 nt, Human
ugaagcaguugugucag

SEQ ID NO: 3887291 - RNA, 21 nt, Human
ugaagcauucuccccagugua

SEQ ID NO: 3887292 - RNA, 22 nt, Human
ugaagccaaguggggugcuggg

SEQ ID NO: 3887293 - RNA, 20 nt, Human
ugaagccacagcccaggccu

SEQ ID NO: 3887294 - RNA, 20 nt, Human
ugaagccacugaagcuggga

SEQ ID NO: 3887295 - RNA, 16 nt, Human
ugaagccagccuucuu

SEQ ID NO: 3887296 - RNA, 21 nt, Human
ugaagccagccuucuuccauc

SEQ ID NO: 3887297 - RNA, 11 nt, Human
ugaagccagcu

SEQ ID NO: 3887298 - RNA, 18 nt, Human
ugaagccgacucuggccc

SEQ ID NO: 3887299 - RNA, 14 nt, Human
gauauaaauucugu

SEQ ID NO: 3887300 - RNA, 18 nt, Human
gauauaaauuuuuaagag

SEQ ID NO: 3887301 - RNA, 14 nt, Human
gauauaagugcugu

SEQ ID NO: 3887302 - RNA, 19 nt, Human
gauauaagugcuguauaaa

SEQ ID NO: 3887303 - RNA, 16 nt, Human
gauauaaucuuucaaa

SEQ ID NO: 3887304 - RNA, 14 nt, Human
gauauacuuugugg

SEQ ID NO: 3887305 - RNA, 21 nt, Human
gauauagagucauuguaaugu

SEQ ID NO: 3887306 - RNA, 15 nt, Human
gauauauaaguguac

SEQ ID NO: 3887307 - RNA, 14 nt, Human
gauauauacauagc

SEQ ID NO: 3887308 - RNA, 19 nt, Human
gauauauaggcuauuuucu

SEQ ID NO: 3887309 - RNA, 16 nt, Human
gauauauggauaaugc

SEQ ID NO: 3887310 - RNA, 19 nt, Human
gauauauuuaaaaauauuu

SEQ ID NO: 3887311 - RNA, 15 nt, Human
gauauauuuuucaca

SEQ ID NO: 3887312 - RNA, 19 nt, Human
gauaucacagucuaauuuu

SEQ ID NO: 3887313 - RNA, 22 nt, Human
gauaucccuaugcugccuaggc

SEQ ID NO: 3887314 - RNA, 23 nt, Human
gauaucccuaugcugccuaggcu

SEQ ID NO: 3887315 - RNA, 21 nt, Human
gauaucccugauccuaacuga

SEQ ID NO: 3887316 - RNA, 16 nt, Human
gauauccuuaucagag

SEQ ID NO: 3887317 - RNA, 23 nt, Human
gauaucgacuuguuuuugcacau

SEQ ID NO: 3887318 - RNA, 23 nt, Human
gauaucuauaaaauagauauaaa

SEQ ID NO: 3887319 - RNA, 17 nt, Human
gauaucuguuagaugcu

SEQ ID NO: 3887320 - RNA, 22 nt, Human
gauaucuuuucuuuagagaacu

SEQ ID NO: 3887321 - RNA, 15 nt, Human
gauaucuuuuuauug

SEQ ID NO: 3887322 - RNA, 16 nt, Human
gauaucuuuuuauuga

SEQ ID NO: 3887323 - RNA, 17 nt, Human
gauaugaauauauggca

SEQ ID NO: 3887324 - RNA, 22 nt, Human
gauaugauucaaaugucuauaa

SEQ ID NO: 3887325 - RNA, 24 nt, Human
gauaugauucaaaugucuauaaac

SEQ ID NO: 3887326 - RNA, 14 nt, Human
gauaugauuuaaaa

SEQ ID NO: 3887327 - RNA, 18 nt, Human
gauaugcaguuuuccuua

SEQ ID NO: 3887328 - RNA, 17 nt, Human
gauaugcauauuuguuu

SEQ ID NO: 3887329 - RNA, 16 nt, Human
gauaugcuuaguaaug

SEQ ID NO: 3887330 - RNA, 19 nt, Human
gauauggagaauugcugaa

SEQ ID NO: 3887331 - RNA, 14 nt, Human
gauauggcagaaga

SEQ ID NO: 3887332 - RNA, 15 nt, Human
gauauggcagaagac

SEQ ID NO: 3887333 - RNA, 13 nt, Human
gauaugggacuga

SEQ ID NO: 3887334 - RNA, 17 nt, Human
gauauggguaguauuuu

SEQ ID NO: 3887335 - RNA, 18 nt, Human
gauauguauggguagggu

SEQ ID NO: 3887336 - RNA, 13 nt, Human
gauaugugaacag

SEQ ID NO: 3887337 - RNA, 12 nt, Human
gauauuacuuua

SEQ ID NO: 3887338 - RNA, 15 nt, Human
gauauucagauguau

SEQ ID NO: 3887339 - RNA, 22 nt, Human
gauauuccuauugugcaaugua

SEQ ID NO: 3887340 - RNA, 21 nt, Human
gauauucuaagaaauaucugu

SEQ ID NO: 3887341 - RNA, 16 nt, Human
gauauugaauguuaaa

SEQ ID NO: 3887342 - RNA, 23 nt, Human
gauauugaggccaagaauauugc

SEQ ID NO: 3887343 - RNA, 24 nt, Human
gauauugcugaagaaucuacuuaa

SEQ ID NO: 3887344 - RNA, 14 nt, Human
gauauuguacauaa

SEQ ID NO: 3887345 - RNA, 17 nt, Human
gauauuguacauaaaag

SEQ ID NO: 3887346 - RNA, 20 nt, Human
gauauugugaacauuuguga

SEQ ID NO: 3887347 - RNA, 21 nt, Human
gauauugugaacauuugugau

SEQ ID NO: 3887348 - RNA, 16 nt, Human
gauauugugaaguaca

SEQ ID NO: 3887349 - RNA, 13 nt, Human
gauauuguucaaa

SEQ ID NO: 3887350 - RNA, 22 nt, Human
gauauuuaggagugugugacau

SEQ ID NO: 3887351 - RNA, 13 nt, Human
gauauuuauauau

SEQ ID NO: 3887352 - RNA, 16 nt, Human
gauauuuauauauauu

SEQ ID NO: 3887353 - RNA, 16 nt, Human
gauauuucagaaauac

SEQ ID NO: 3887354 - RNA, 17 nt, Human
gauauuucagaaauaca

SEQ ID NO: 3887355 - RNA, 15 nt, Human
gauauuucuagcuua

SEQ ID NO: 3887356 - RNA, 19 nt, Human
gauauuuggcuuaaauaua

SEQ ID NO: 3887357 - RNA, 14 nt, Human
gauauuuucucuag

SEQ ID NO: 3887358 - RNA, 20 nt, Human
gauauuuucuuccaagcaaa

SEQ ID NO: 3887359 - RNA, 22 nt, Human
gauauuuuuaaagaucuguaag

SEQ ID NO: 3887360 - RNA, 18 nt, Human
gauauuuuucauaaacaa

SEQ ID NO: 3887361 - RNA, 16 nt, Human
gauauuuuuucugaau

SEQ ID NO: 3887362 - RNA, 20 nt, Human
gaucaaaagguuaauaaagu

SEQ ID NO: 3887363 - RNA, 21 nt, Human
gaucaaaaucuguagagcagg

SEQ ID NO: 3887364 - RNA, 16 nt, Human
gaucaaauacuuuaaa

SEQ ID NO: 3887365 - RNA, 17 nt, Human
gaucaaauacuuuaaag

SEQ ID NO: 3887366 - RNA, 19 nt, Human
gaucaaauacuuuaaagga

SEQ ID NO: 3887367 - RNA, 23 nt, Human
gaucaaauucauuuuuuucacug

SEQ ID NO: 3887368 - RNA, 20 nt, Human
gaucaacaucuuuucuugcc

SEQ ID NO: 3887369 - RNA, 21 nt, Human
gaucaaccccuucgcuccugu

SEQ ID NO: 3887370 - RNA, 20 nt, Human
gaucaagcaugaaaggcuuu

SEQ ID NO: 3887371 - RNA, 21 nt, Human
gaucaaguuauuuuuaauuug

SEQ ID NO: 3887372 - RNA, 14 nt, Human
gaucaauaaaaugu

SEQ ID NO: 3887373 - RNA, 19 nt, Human
gaucaauaaaaugugauuu

SEQ ID NO: 3887374 - RNA, 19 nt, Human
gaucaauauuuuuauauca

SEQ ID NO: 3887375 - RNA, 18 nt, Human
gaucaaugacagagccuu

SEQ ID NO: 3887376 - RNA, 20 nt, Human
gaucaauuauaguuucugag

SEQ ID NO: 3887377 - RNA, 21 nt, Human
gaucaauuauaguuucugagg

SEQ ID NO: 3887378 - RNA, 13 nt, Human
gaucacaaaaaca

SEQ ID NO: 3887379 - RNA, 13 nt, Human
gaucacaaaugac

SEQ ID NO: 3887380 - RNA, 20 nt, Human
gaucacaaaugacuuuauua

SEQ ID NO: 3887381 - RNA, 16 nt, Human
gaucacaacgugcauu

SEQ ID NO: 3887382 - RNA, 17 nt, Human
gaucacaacgugcauug

SEQ ID NO: 3887383 - RNA, 12 nt, Human
gaucacaagaug

SEQ ID NO: 3887384 - RNA, 13 nt, Human
gaucacagcugcu

SEQ ID NO: 3887385 - RNA, 15 nt, Human
gaucaccagaauaaa

SEQ ID NO: 3887386 - RNA, 18 nt, Human
gaucacgauguaaauuau

SEQ ID NO: 3887387 - RNA, 15 nt, Human
gaucacgccuggcua

SEQ ID NO: 3887388 - RNA, 13 nt, Human
gaucacgcucccc

SEQ ID NO: 3887389 - RNA, 14 nt, Human
gaucacgcuccccg

SEQ ID NO: 3887390 - RNA, 12 nt, Human
gaucacggcuca

SEQ ID NO: 3887391 - RNA, 20 nt, Human
gaucacggcucacugcagcc

SEQ ID NO: 3887392 - RNA, 18 nt, Human
gaucacugaaauaaaagc

SEQ ID NO: 3887393 - RNA, 13 nt, Human
gaucacugccaca

SEQ ID NO: 3887394 - RNA, 21 nt, Human
gaucacuguuuagauuugcca

SEQ ID NO: 3887395 - RNA, 14 nt, Human
gaucacuuucugaa

SEQ ID NO: 3887396 - RNA, 15 nt, Human
gaucacuuugcucug

SEQ ID NO: 3887397 - RNA, 14 nt, Human
gaucagaaauacag

SEQ ID NO: 3887398 - RNA, 11 nt, Human
gaucagaacag

SEQ ID NO: 3887399 - RNA, 15 nt, Human
gaucagaacagcaga

SEQ ID NO: 3887400 - RNA, 21 nt, Human
gaucagacagaucuggaaugu

SEQ ID NO: 3887401 - RNA, 16 nt, Human
gaucagagcaggaccu

SEQ ID NO: 3887402 - RNA, 17 nt, Human
gaucagaugacuagaaa

SEQ ID NO: 3887403 - RNA, 17 nt, Human
gaucagaugcuccaaga

SEQ ID NO: 3887404 - RNA, 23 nt, Human
gaucagauugcaugugacucuga

SEQ ID NO: 3887405 - RNA, 19 nt, Human
gaucagcaaaccggggccu

SEQ ID NO: 3887406 - RNA, 14 nt, Human
gaucagcaucugug

SEQ ID NO: 3887407 - RNA, 15 nt, Human
gaucagccagaagcc

SEQ ID NO: 3887408 - RNA, 12 nt, Human
gaucagccuggg

SEQ ID NO: 3887409 - RNA, 16 nt, Human
gaucagcuguuuguca

SEQ ID NO: 3887410 - RNA, 20 nt, Human
gaucagcuuucaaagcauuu

SEQ ID NO: 3887411 - RNA, 16 nt, Human
gaucaggcacagguca

SEQ ID NO: 3887412 - RNA, 17 nt, Human
gaucaggcacaggucag

SEQ ID NO: 3887413 - RNA, 14 nt, Human
gaucaggcucugcc

SEQ ID NO: 3887414 - RNA, 23 nt, Human
gaucaguaaaauuauacugugug

SEQ ID NO: 3887415 - RNA, 17 nt, Human
gaucaguauuuaacuaa

SEQ ID NO: 3887416 - RNA, 13 nt, Human
gaucaguggacag

SEQ ID NO: 3887417 - RNA, 14 nt, Human
gaucaguuaacuau

SEQ ID NO: 3887418 - RNA, 23 nt, Human
gaucauagauuucugauuuuaug

SEQ ID NO: 3887419 - RNA, 14 nt, Human
gaucauaguuuuau

SEQ ID NO: 3887420 - RNA, 15 nt, Human
gaucauaguuuuauu

SEQ ID NO: 3887421 - RNA, 16 nt, Human
gaucauaguuuuauuu

SEQ ID NO: 3887422 - RNA, 19 nt, Human
gaucauaguuuuauuuaua

SEQ ID NO: 3887423 - RNA, 15 nt, Human
gaucaucaacaagau

SEQ ID NO: 3887424 - RNA, 13 nt, Human
gaucauccacugu

SEQ ID NO: 3887425 - RNA, 17 nt, Human
gaucauccacugugcca

SEQ ID NO: 3887426 - RNA, 19 nt, Human
gaucauccacugugccaug

SEQ ID NO: 3887427 - RNA, 23 nt, Human
gaucaucccaucuaagcugcagc

SEQ ID NO: 3887428 - RNA, 21 nt, Human
gaucaucgccagaggugcuuc

SEQ ID NO: 3887429 - RNA, 14 nt, Human
gaucaugcauagag

SEQ ID NO: 3887430 - RNA, 12 nt, Human
gaucaugcauug

SEQ ID NO: 3887431 - RNA, 14 nt, Human
gaucauggcucacu

SEQ ID NO: 3887432 - RNA, 21 nt, Human
gaucauggcucacugcagccu

SEQ ID NO: 3887433 - RNA, 14 nt, Human
gaucaugguguaau

SEQ ID NO: 3887434 - RNA, 23 nt, Human
gaucaugguguaauaagacauaa

SEQ ID NO: 3887435 - RNA, 19 nt, Human
gaucauguuguuaaaauua

SEQ ID NO: 3887436 - RNA, 21 nt, Human
gaucauguuguuaaaauuaug

SEQ ID NO: 3887437 - RNA, 18 nt, Human
gaucauguuuuggugaaa

SEQ ID NO: 3887438 - RNA, 14 nt, Human
gaucauugugaaau

SEQ ID NO: 3887439 - RNA, 13 nt, Human
gauccaaaagaag

SEQ ID NO: 3887440 - RNA, 19 nt, Human
gauccaaaagaagccccca

SEQ ID NO: 3887441 - RNA, 20 nt, Human
gauccaaauugugcuucucc

SEQ ID NO: 3887442 - RNA, 20 nt, Human
gauccaacuaaugccuuacu

SEQ ID NO: 3887443 - RNA, 19 nt, Human
gauccaagcuggucccacu

SEQ ID NO: 3887444 - RNA, 15 nt, Human
gauuacauaaucugu

SEQ ID NO: 3887445 - RNA, 14 nt, Human
gauuacaugcaugu

SEQ ID NO: 3887446 - RNA, 14 nt, Human
gauuacauuuuaaa

SEQ ID NO: 3887447 - RNA, 22 nt, Human
gauuaccuaguagucauuucau

SEQ ID NO: 3887448 - RNA, 12 nt, Human
gauuacucuuug

SEQ ID NO: 3887449 - RNA, 18 nt, Human
gauuacuucucuauaaaa

SEQ ID NO: 3887450 - RNA, 21 nt, Human
gauuagaaaugaccaauauua

SEQ ID NO: 3887451 - RNA, 14 nt, Human
gauuagaaggcaag

SEQ ID NO: 3887452 - RNA, 17 nt, Human
gauuagaaugaaaauug

SEQ ID NO: 3887453 - RNA, 15 nt, Human
gauuagaauucugua

SEQ ID NO: 3887454 - RNA, 16 nt, Human
gauuagacagaacacc

SEQ ID NO: 3887455 - RNA, 18 nt, Human
gauuagagaguguugaaa

SEQ ID NO: 3887456 - RNA, 19 nt, Human
gauuagcaaggucauuucu

SEQ ID NO: 3887457 - RNA, 19 nt, Human
gauuagcaaguuacaguga

SEQ ID NO: 3887458 - RNA, 23 nt, Human
gauuagcaggccaaggucugagc

SEQ ID NO: 3887459 - RNA, 15 nt, Human
gauuagcuuuguguu

SEQ ID NO: 3887460 - RNA, 17 nt, Human
gauuagcuuuguguuug

SEQ ID NO: 3887461 - RNA, 14 nt, Human
gauuaguaagucuu

SEQ ID NO: 3887462 - RNA, 19 nt, Human
gauuauaaaauuaaucaca

SEQ ID NO: 3887463 - RNA, 14 nt, Human
gauuauagauucua

SEQ ID NO: 3887464 - RNA, 22 nt, Human
gauuauagauucuaaagauucu

SEQ ID NO: 3887465 - RNA, 14 nt, Human
gauuauauuaugaa

SEQ ID NO: 3887466 - RNA, 17 nt, Human
gauuauauugagacaaa

SEQ ID NO: 3887467 - RNA, 18 nt, Human
gauuauauugagacaaaa

SEQ ID NO: 3887468 - RNA, 12 nt, Human
gauuauccugag

SEQ ID NO: 3887469 - RNA, 20 nt, Human
gauuaucguuuucuuaaagu

SEQ ID NO: 3887470 - RNA, 16 nt, Human
gauuaucuauuugugu

SEQ ID NO: 3887471 - RNA, 14 nt, Human
gauuaugggucaca

SEQ ID NO: 3887472 - RNA, 16 nt, Human
gauuaugggucacagg

SEQ ID NO: 3887473 - RNA, 15 nt, Human
gauuaugguuuugug

SEQ ID NO: 3887474 - RNA, 22 nt, Human
gauuauucacugauuugacaua

SEQ ID NO: 3887475 - RNA, 14 nt, Human
gauuauucaguguc

SEQ ID NO: 3887476 - RNA, 15 nt, Human
gauuauucaguguca

SEQ ID NO: 3887477 - RNA, 15 nt, Human
gauuauucauuuaaa

SEQ ID NO: 3887478 - RNA, 21 nt, Human
gauuauucauuuaaaaugauu

SEQ ID NO: 3887479 - RNA, 22 nt, Human
gauuauucauuuaaaaugauua

SEQ ID NO: 3887480 - RNA, 21 nt, Human
gauuauugaguuccaguugaa

SEQ ID NO: 3887481 - RNA, 17 nt, Human
gauuauuguauuuauuc

SEQ ID NO: 3887482 - RNA, 14 nt, Human
gauuauuuaauaac

SEQ ID NO: 3887483 - RNA, 15 nt, Human
gauuauuuaauaaca

SEQ ID NO: 3887484 - RNA, 21 nt, Human
gauuauuuaauaacauuaccu

SEQ ID NO: 3887485 - RNA, 23 nt, Human
gauuauuuaauaacauuaccuua

SEQ ID NO: 3887486 - RNA, 21 nt, Human
gauuauuuacaagaagaacuc

SEQ ID NO: 3887487 - RNA, 14 nt, Human
gauuauuucacuuu

SEQ ID NO: 3887488 - RNA, 14 nt, Human
gauuauuugcaugu

SEQ ID NO: 3887489 - RNA, 18 nt, Human
gauuauuugcauguuaug

SEQ ID NO: 3887490 - RNA, 18 nt, Human
gauuauuugggagggaaa

SEQ ID NO: 3887491 - RNA, 21 nt, Human
gauuauuuguuauuuguacag

SEQ ID NO: 3887492 - RNA, 11 nt, Human
gauuauuuugg

SEQ ID NO: 3887493 - RNA, 16 nt, Human
gauuauuuuuucagac

SEQ ID NO: 3887494 - RNA, 13 nt, Human
gauucaaaauauu

SEQ ID NO: 3887495 - RNA, 17 nt, Human
gauucaagccauuccaa

SEQ ID NO: 3887496 - RNA, 21 nt, Human
gauucaauauugaauuuuucc

SEQ ID NO: 3887497 - RNA, 22 nt, Human
gauucacaaugaaaugcucucc

SEQ ID NO: 3887498 - RNA, 18 nt, Human
gauucacaccccaccugc

SEQ ID NO: 3887499 - RNA, 12 nt, Human
gauucacacugu

SEQ ID NO: 3887500 - RNA, 22 nt, Human
gauucacauguuuucaaaugga

SEQ ID NO: 3887501 - RNA, 19 nt, Human
gauucaccuccuaaaacaa

SEQ ID NO: 3887502 - RNA, 15 nt, Human
gauucaccuguaaaa

SEQ ID NO: 3887503 - RNA, 16 nt, Human
gauucaccuguaaaac

SEQ ID NO: 3887504 - RNA, 20 nt, Human
gauucaccuguaaaacuuua

SEQ ID NO: 3887505 - RNA, 22 nt, Human
gauucaccuguaaaacuuuauu

SEQ ID NO: 3887506 - RNA, 12 nt, Human
gauucagaaauu

SEQ ID NO: 3887507 - RNA, 14 nt, Human
gauucagacagcug

SEQ ID NO: 3887508 - RNA, 17 nt, Human
gauucagacagcugccu

SEQ ID NO: 3887509 - RNA, 14 nt, Human
gauucagauuucuc

SEQ ID NO: 3887510 - RNA, 12 nt, Human
gauucagccuuc

SEQ ID NO: 3887511 - RNA, 22 nt, Human
gauucaggaaaaggccuggggu

SEQ ID NO: 3887512 - RNA, 13 nt, Human
gauucaggcugcu

SEQ ID NO: 3887513 - RNA, 11 nt, Human
gauucagucuu

SEQ ID NO: 3887514 - RNA, 13 nt, Human
gauucagucuugc

SEQ ID NO: 3887515 - RNA, 17 nt, Human
gauucagucuugccuua

SEQ ID NO: 3887516 - RNA, 23 nt, Human
gauucagucuugccuuacacaaa

SEQ ID NO: 3887517 - RNA, 16 nt, Human
gauucauaguaacuuc

SEQ ID NO: 3887518 - RNA, 12 nt, Human
gauucauauuua

SEQ ID NO: 3887519 - RNA, 22 nt, Human
gauucaucucucagaagggagg

SEQ ID NO: 3887520 - RNA, 17 nt, Human
gauucaugauuuauaaa

SEQ ID NO: 3887521 - RNA, 18 nt, Human
gauucauguuauauuuaa

SEQ ID NO: 3887522 - RNA, 20 nt, Human
gauucauucucauaauuccu

SEQ ID NO: 3887523 - RNA, 22 nt, Human
gauuccaaccccaacuccagua

SEQ ID NO: 3887524 - RNA, 20 nt, Human
gauuccaaguucucaccucu

SEQ ID NO: 3887525 - RNA, 23 nt, Human
gauuccagcacaaccuucaagcu

SEQ ID NO: 3887526 - RNA, 14 nt, Human
gauuccagccauca

SEQ ID NO: 3887527 - RNA, 18 nt, Human
gauuccagcccacauugg

SEQ ID NO: 3887528 - RNA, 17 nt, Human
gauuccagguggcauca

SEQ ID NO: 3887529 - RNA, 19 nt, Human
gauuccaucuccuugucuu

SEQ ID NO: 3887530 - RNA, 15 nt, Human
gauuccaugcuaagc

SEQ ID NO: 3887531 - RNA, 15 nt, Human
gauucccaagcucug

SEQ ID NO: 3887532 - RNA, 19 nt, Human
gauucccaagcucugcucc

SEQ ID NO: 3887533 - RNA, 20 nt, Human
gauucccaagcucugcuccu

SEQ ID NO: 3887534 - RNA, 16 nt, Human
gauucccaccaagguc

SEQ ID NO: 3887535 - RNA, 21 nt, Human
gauucccagagacaggaaaau

SEQ ID NO: 3887536 - RNA, 13 nt, Human
gauucccagagca

SEQ ID NO: 3887537 - RNA, 13 nt, Human
gauucccauugaa

SEQ ID NO: 3887538 - RNA, 14 nt, Human
gauucccauugaaa

SEQ ID NO: 3887539 - RNA, 16 nt, Human
gauucccauugaaaau

SEQ ID NO: 3887540 - RNA, 22 nt, Human
gauuccccauugccuccuccuu

SEQ ID NO: 3887541 - RNA, 21 nt, Human
gauuccccuaaccucauuccc

SEQ ID NO: 3887542 - RNA, 14 nt, Human
gauuccccuguguc

SEQ ID NO: 3887543 - RNA, 21 nt, Human
gauucccuccugcuacucugu

SEQ ID NO: 3887544 - RNA, 17 nt, Human
gauucccucucccaggc

SEQ ID NO: 3887545 - RNA, 15 nt, Human
gauuccggauccuaa

SEQ ID NO: 3887546 - RNA, 22 nt, Human
gauuccggauccuaagcaucua

SEQ ID NO: 3887547 - RNA, 13 nt, Human
gauuccugaccca

SEQ ID NO: 3887548 - RNA, 15 nt, Human
gauuccugacccagg

SEQ ID NO: 3887549 - RNA, 16 nt, Human
gauuccuguuucaagu

SEQ ID NO: 3887550 - RNA, 18 nt, Human
gauuccuuagacucuuuu

SEQ ID NO: 3887551 - RNA, 13 nt, Human
gauuccuuccugu

SEQ ID NO: 3887552 - RNA, 21 nt, Human
gauuccuuuaacaacauguuu

SEQ ID NO: 3887553 - RNA, 20 nt, Human
gauuccuuucccuuuagcac

SEQ ID NO: 3887554 - RNA, 16 nt, Human
gauucgaaugacacug

SEQ ID NO: 3887555 - RNA, 18 nt, Human
gauucgcccaaagccaga

SEQ ID NO: 3887556 - RNA, 17 nt, Human
gauucgguaucccccca

SEQ ID NO: 3887557 - RNA, 18 nt, Human
gauucguggucuuuuccu

SEQ ID NO: 3887558 - RNA, 13 nt, Human
gauucuaaagauu

SEQ ID NO: 3887559 - RNA, 15 nt, Human
gauucuaaagauucu

SEQ ID NO: 3887560 - RNA, 20 nt, Human
gauucuaaagauucuauagu

SEQ ID NO: 3887561 - RNA, 13 nt, Human
gauucuaaauaca

SEQ ID NO: 3887562 - RNA, 14 nt, Human
gauucuaaauacau

SEQ ID NO: 3887563 - RNA, 21 nt, Human
gauucuagaucagaugcucca

SEQ ID NO: 3887564 - RNA, 17 nt, Human
gauucuauaguucuaga

SEQ ID NO: 3887565 - RNA, 19 nt, Human
gauucuauaguucuagaca

SEQ ID NO: 3887566 - RNA, 11 nt, Human
gauucucagau

SEQ ID NO: 3887567 - RNA, 22 nt, Human
gauucucagggucucugcugcc

SEQ ID NO: 3887568 - RNA, 16 nt, Human
gauucucaugccucag

SEQ ID NO: 3887569 - RNA, 21 nt, Human
gauucuccugccucagccucc

SEQ ID NO: 3887570 - RNA, 14 nt, Human
gauucuccugugcu

SEQ ID NO: 3887571 - RNA, 16 nt, Human
gauucuccugugcuag

SEQ ID NO: 3887572 - RNA, 11 nt, Human
gauucuccuuc

SEQ ID NO: 3887573 - RNA, 12 nt, Human
gauucuccuuca

SEQ ID NO: 3887574 - RNA, 17 nt, Human
gauucuccuucagcccu

SEQ ID NO: 3887575 - RNA, 15 nt, Human
gauucucugugucua

SEQ ID NO: 3887576 - RNA, 23 nt, Human
gauucucugugucuaagauucua

SEQ ID NO: 3887577 - RNA, 15 nt, Human
gauucucuugccuca

SEQ ID NO: 3887578 - RNA, 12 nt, Human
gauucugaaucu

SEQ ID NO: 3887579 - RNA, 21 nt, Human
gauucugaccuuaaaugcaac

SEQ ID NO: 3887580 - RNA, 21 nt, Human
gauucugcaguaaaucuuuua

SEQ ID NO: 3887581 - RNA, 19 nt, Human
gauucuggacagucagcuc

SEQ ID NO: 3887582 - RNA, 19 nt, Human
gauucuggauaaagccacu

SEQ ID NO: 3887583 - RNA, 22 nt, Human
gauucuggauaaagccacugaa

SEQ ID NO: 3887584 - RNA, 20 nt, Human
gauucuggcuuuaagccuuc

SEQ ID NO: 3887585 - RNA, 15 nt, Human
gauucugggaggaag

SEQ ID NO: 3887586 - RNA, 22 nt, Human
gauucugguuccagggucccuc

SEQ ID NO: 3887587 - RNA, 15 nt, Human
gauucuuaaaguuga

SEQ ID NO: 3887588 - RNA, 23 nt, Human
gauucuucagcaaaaauauuuua

SEQ ID NO: 3887589 - RNA, 17 nt, Human
gcagcaauuuaaauguu

SEQ ID NO: 3887590 - RNA, 14 nt, Human
gcagcacagagagg

SEQ ID NO: 3887591 - RNA, 15 nt, Human
gcagcacagcugaga

SEQ ID NO: 3887592 - RNA, 17 nt, Human
gcagcacccuauaaauc

SEQ ID NO: 3887593 - RNA, 12 nt, Human
gcagcaccuccu

SEQ ID NO: 3887594 - RNA, 15 nt, Human
gcagcaccuccucag

SEQ ID NO: 3887595 - RNA, 16 nt, Human
gcagcaccuccucagc

SEQ ID NO: 3887596 - RNA, 18 nt, Human
gcagcaccuccucagccu

SEQ ID NO: 3887597 - RNA, 17 nt, Human
gcagcaccugcccuacc

SEQ ID NO: 3887598 - RNA, 19 nt, Human
gcagcacggacaauaaacc

SEQ ID NO: 3887599 - RNA, 16 nt, Human
gcagcacucacacagg

SEQ ID NO: 3887600 - RNA, 15 nt, Human
gcagcagaagggggu

SEQ ID NO: 3887601 - RNA, 15 nt, Human
gcagcagcaggugau

SEQ ID NO: 3887602 - RNA, 14 nt, Human
gcagcagccagccc

SEQ ID NO: 3887603 - RNA, 23 nt, Human
gcagcagccagcccugccuggag

SEQ ID NO: 3887604 - RNA, 14 nt, Human
gcagcagccaucau

SEQ ID NO: 3887605 - RNA, 22 nt, Human
gcagcagccaucauaggaaggg

SEQ ID NO: 3887606 - RNA, 21 nt, Human
gcagcagcccaagcuucccuc

SEQ ID NO: 3887607 - RNA, 14 nt, Human
gcagcagcccugcc

SEQ ID NO: 3887608 - RNA, 23 nt, Human
gcagcagccucgccccuggcaga

SEQ ID NO: 3887609 - RNA, 19 nt, Human
gcagcagggaugcccugga

SEQ ID NO: 3887610 - RNA, 12 nt, Human
gcagcagggcag

SEQ ID NO: 3887611 - RNA, 17 nt, Human
gcagcagggcuacccug

SEQ ID NO: 3887612 - RNA, 13 nt, Human
gcagcagggguug

SEQ ID NO: 3887613 - RNA, 14 nt, Human
gcagcagggguugg

SEQ ID NO: 3887614 - RNA, 18 nt, Human
gcagcaggugcugcuacc

SEQ ID NO: 3887615 - RNA, 19 nt, Human
gcagcaggugcugcuaccc

SEQ ID NO: 3887616 - RNA, 21 nt, Human
gcagcagugaaaacaagugcu

SEQ ID NO: 3887617 - RNA, 22 nt, Human
gcagcagugugaggccagggca

SEQ ID NO: 3887618 - RNA, 17 nt, Human
gcagcauauucaggaag

SEQ ID NO: 3887619 - RNA, 12 nt, Human
gcagcaucuucu

SEQ ID NO: 3887620 - RNA, 17 nt, Human
gcagcaugaccugugac

SEQ ID NO: 3887621 - RNA, 15 nt, Human
gcagcauggucccug

SEQ ID NO: 3887622 - RNA, 13 nt, Human
gcagcauguauag

SEQ ID NO: 3887623 - RNA, 22 nt, Human
gcagcauguugcugaggaguga

SEQ ID NO: 3887624 - RNA, 13 nt, Human
gcagcauuucacu

SEQ ID NO: 3887625 - RNA, 14 nt, Human
gcagccaaccuaag

SEQ ID NO: 3887626 - RNA, 22 nt, Human
gcagccaaggccgaagcucugg

SEQ ID NO: 3887627 - RNA, 19 nt, Human
gcagccacacuucucagga

SEQ ID NO: 3887628 - RNA, 15 nt, Human
gcagccacauuccug

SEQ ID NO: 3887629 - RNA, 13 nt, Human
gcagccaccagcg

SEQ ID NO: 3887630 - RNA, 20 nt, Human
gcagccacccugaggagucu

SEQ ID NO: 3887631 - RNA, 12 nt, Human
gcagccagaggc

SEQ ID NO: 3887632 - RNA, 13 nt, Human
gcagccagcaucu

SEQ ID NO: 3887633 - RNA, 16 nt, Human
gcagccagcccagccc

SEQ ID NO: 3887634 - RNA, 17 nt, Human
gcagccagcccagccca

SEQ ID NO: 3887635 - RNA, 16 nt, Human
gcagccagcccugccu

SEQ ID NO: 3887636 - RNA, 22 nt, Human
gcagccagcccugccuggagga

SEQ ID NO: 3887637 - RNA, 15 nt, Human
gcagccagcucucag

SEQ ID NO: 3887638 - RNA, 13 nt, Human
gcagccaggccac

SEQ ID NO: 3887639 - RNA, 16 nt, Human
gcagccaggccacaag

SEQ ID NO: 3887640 - RNA, 12 nt, Human
gcagccaggcug

SEQ ID NO: 3887641 - RNA, 14 nt, Human
gcagccagggagag

SEQ ID NO: 3887642 - RNA, 16 nt, Human
gcagccagggagagcc

SEQ ID NO: 3887643 - RNA, 21 nt, Human
gcagccagggagagcccagga

SEQ ID NO: 3887644 - RNA, 13 nt, Human
gcagccagugaga

SEQ ID NO: 3887645 - RNA, 16 nt, Human
gcagccagugcccuga

SEQ ID NO: 3887646 - RNA, 13 nt, Human
gcagcccacccug

SEQ ID NO: 3887647 - RNA, 13 nt, Human
gcagcccagagac

SEQ ID NO: 3887648 - RNA, 18 nt, Human
gcagcccagagacuuugu

SEQ ID NO: 3887649 - RNA, 15 nt, Human
gcagcccaugcccac

SEQ ID NO: 3887650 - RNA, 18 nt, Human
gcagcccaugcccaccug

SEQ ID NO: 3887651 - RNA, 22 nt, Human
gcagcccaugcccaccugccca

SEQ ID NO: 3887652 - RNA, 22 nt, Human
gcagccccaaauugucaccugc

SEQ ID NO: 3887653 - RNA, 13 nt, Human
gcagccccagccu

SEQ ID NO: 3887654 - RNA, 17 nt, Human
gcagccccaucugugca

SEQ ID NO: 3887655 - RNA, 18 nt, Human
gcagccccauucugccug

SEQ ID NO: 3887656 - RNA, 19 nt, Human
gcagcccccagcucccacc

SEQ ID NO: 3887657 - RNA, 18 nt, Human
gcagcccguguggccccu

SEQ ID NO: 3887658 - RNA, 24 nt, Human
gcagcccuaaggaucucucaggag

SEQ ID NO: 3887659 - RNA, 18 nt, Human
gcagcccuagagccugcc

SEQ ID NO: 3887660 - RNA, 19 nt, Human
gcagcccucaauugugaaa

SEQ ID NO: 3887661 - RNA, 22 nt, Human
gcagcccugccccacaccuccu

SEQ ID NO: 3887662 - RNA, 14 nt, Human
gcagcccugcuuug

SEQ ID NO: 3887663 - RNA, 24 nt, Human
gcagcccugcuuugggcugcccug

SEQ ID NO: 3887664 - RNA, 16 nt, Human
gcagcccuggagucau

SEQ ID NO: 3887665 - RNA, 19 nt, Human
gcagcccuggcagggggca

SEQ ID NO: 3887666 - RNA, 20 nt, Human
gcagccgccuuaagcugauc

SEQ ID NO: 3887667 - RNA, 18 nt, Human
gcagccgccuucacagca

SEQ ID NO: 3887668 - RNA, 14 nt, Human
gcagccgccuuccu

SEQ ID NO: 3887669 - RNA, 16 nt, Human
gcagccgccuuccuug

SEQ ID NO: 3887670 - RNA, 16 nt, Human
gcagccgcugagcgag

SEQ ID NO: 3887671 - RNA, 18 nt, Human
gcagccggcacagggucu

SEQ ID NO: 3887672 - RNA, 15 nt, Human
gcagccgugccuuca

SEQ ID NO: 3887673 - RNA, 22 nt, Human
gcagccguuugagaagaaaaca

SEQ ID NO: 3887674 - RNA, 22 nt, Human
gcagccucaaccuccugggcua

SEQ ID NO: 3887675 - RNA, 19 nt, Human
gcagccucacaguccuuac

SEQ ID NO: 3887676 - RNA, 23 nt, Human
gcagccucagagacaucagcccu

SEQ ID NO: 3887677 - RNA, 21 nt, Human
gcagccucaggacugggagcc

SEQ ID NO: 3887678 - RNA, 21 nt, Human
gcagccucccauccagggccc

SEQ ID NO: 3887679 - RNA, 14 nt, Human
gcagccucccucug

SEQ ID NO: 3887680 - RNA, 16 nt, Human
gcagccucccucugac

SEQ ID NO: 3887681 - RNA, 14 nt, Human
gcagccuccuccug

SEQ ID NO: 3887682 - RNA, 16 nt, Human
gcagccucgccccugg

SEQ ID NO: 3887683 - RNA, 19 nt, Human
gcagccucgccccuggcag

SEQ ID NO: 3887684 - RNA, 14 nt, Human
gcagccucugaagu

SEQ ID NO: 3887685 - RNA, 19 nt, Human
gcagccucugucaggccuu

SEQ ID NO: 3887686 - RNA, 16 nt, Human
gcagccugcaggaccu

SEQ ID NO: 3887687 - RNA, 14 nt, Human
gcagccugccugga

SEQ ID NO: 3887688 - RNA, 15 nt, Human
gcagccugccuggag

SEQ ID NO: 3887689 - RNA, 24 nt, Human
gcagccugccuugcccacuccugc

SEQ ID NO: 3887690 - RNA, 23 nt, Human
gcagccugcgccaccgcccagag

SEQ ID NO: 3887691 - RNA, 19 nt, Human
gcagccugcguggcugacc

SEQ ID NO: 3887692 - RNA, 16 nt, Human
gcagccugcucuagug

SEQ ID NO: 3887693 - RNA, 23 nt, Human
gcagccugcuucccaccucccug

SEQ ID NO: 3887694 - RNA, 18 nt, Human
gcagccuggacauagaga

SEQ ID NO: 3887695 - RNA, 20 nt, Human
gcagccuggagacccacccc

SEQ ID NO: 3887696 - RNA, 12 nt, Human
gcagccuggcuc

SEQ ID NO: 3887697 - RNA, 19 nt, Human
gcagccuggcucccaggac

SEQ ID NO: 3887698 - RNA, 19 nt, Human
gcagccuggcuccccuggg

SEQ ID NO: 3887699 - RNA, 17 nt, Human
gcagccuuugccucccc

SEQ ID NO: 3887700 - RNA, 20 nt, Human
gcagcgaccaccccugccuc

SEQ ID NO: 3887701 - RNA, 17 nt, Human
gcagcgaccgcccccuc

SEQ ID NO: 3887702 - RNA, 18 nt, Human
gcagcgaccgcccccucc

SEQ ID NO: 3887703 - RNA, 22 nt, Human
gcagcgaccgcccccuccucua

SEQ ID NO: 3887704 - RNA, 22 nt, Human
gcagcgagcuaugaucgcgcca

SEQ ID NO: 3887705 - RNA, 13 nt, Human
gcagcgccaggcu

SEQ ID NO: 3887706 - RNA, 19 nt, Human
gcagcgcccuuccucucca

SEQ ID NO: 3887707 - RNA, 21 nt, Human
gcagcgcccuuccucuccacc

SEQ ID NO: 3887708 - RNA, 22 nt, Human
gcagcgggagccucccugccuc

SEQ ID NO: 3887709 - RNA, 21 nt, Human
gcagcggggcgaagcccaggc

SEQ ID NO: 3887710 - RNA, 21 nt, Human
gcagcuaguccuagugaaccu

SEQ ID NO: 3887711 - RNA, 14 nt, Human
gcagcuaguuuucu

SEQ ID NO: 3887712 - RNA, 18 nt, Human
gcagcucaagagauccca

SEQ ID NO: 3887713 - RNA, 17 nt, Human
gcagcucaccucucccu

SEQ ID NO: 3887714 - RNA, 18 nt, Human
gcagcucagagagggugg

SEQ ID NO: 3887715 - RNA, 19 nt, Human
gcagcucagguuguagugg

SEQ ID NO: 3887716 - RNA, 20 nt, Human
gcagcucauaagagccacag

SEQ ID NO: 3887717 - RNA, 23 nt, Human
gcagcucauagaguccccccucc

SEQ ID NO: 3887718 - RNA, 14 nt, Human
gcagcucaucucug

SEQ ID NO: 3887719 - RNA, 15 nt, Human
gcagcucccauucua

SEQ ID NO: 3887720 - RNA, 21 nt, Human
gcagcucccuggcuucugugg

SEQ ID NO: 3887721 - RNA, 20 nt, Human
gcagcuccuuccuagccuug

SEQ ID NO: 3887722 - RNA, 14 nt, Human
gcagcucuccaguc

SEQ ID NO: 3887723 - RNA, 23 nt, Human
gcagcucuuccuggacaggccag

SEQ ID NO: 3887724 - RNA, 18 nt, Human
gcagcugaaauaugcugg

SEQ ID NO: 3887725 - RNA, 15 nt, Human
gcagcugagcagggc

SEQ ID NO: 3887726 - RNA, 18 nt, Human
gcagcugagcagggccgg

SEQ ID NO: 3887727 - RNA, 14 nt, Human
gcagcugauuuuaa

SEQ ID NO: 3887728 - RNA, 16 nt, Human
gcagcugccuccccuc

SEQ ID NO: 3887729 - RNA, 18 nt, Human
gcagcugccuccccuccu

SEQ ID NO: 3887730 - RNA, 15 nt, Human
gcagcuggacagagg

SEQ ID NO: 3887731 - RNA, 14 nt, Human
gcagcugggcccaa

SEQ ID NO: 3887732 - RNA, 19 nt, Human
gcagcugggcccaacccug

SEQ ID NO: 3887733 - RNA, 22 nt, Human
gcagggcacagggccuggccca

SEQ ID NO: 3887734 - RNA, 12 nt, Human
gcagggcagccc

SEQ ID NO: 3887735 - RNA, 15 nt, Human
gcagggcaggaccag

SEQ ID NO: 3887736 - RNA, 16 nt, Human
gcagggccauggcuca

SEQ ID NO: 3887737 - RNA, 16 nt, Human
gcagggccucacacgg

SEQ ID NO: 3887738 - RNA, 18 nt, Human
gcagggccuugcccagag

SEQ ID NO: 3887739 - RNA, 19 nt, Human
gcagggccuugcccagaga

SEQ ID NO: 3887740 - RNA, 21 nt, Human
gcagggccuugcccagagaug

SEQ ID NO: 3887741 - RNA, 21 nt, Human
gcagggcgggcagagggcugg

SEQ ID NO: 3887742 - RNA, 17 nt, Human
gcagggcuacccugagc

SEQ ID NO: 3887743 - RNA, 21 nt, Human
gcagggcuacccugagcugag

SEQ ID NO: 3887744 - RNA, 12 nt, Human
gcagggcucucc

SEQ ID NO: 3887745 - RNA, 12 nt, Human
gcagggcucuga

SEQ ID NO: 3887746 - RNA, 13 nt, Human
gcagggcuggccc

SEQ ID NO: 3887747 - RNA, 14 nt, Human
gcagggcugugcac

SEQ ID NO: 3887748 - RNA, 13 nt, Human
gcagggcugugcu

SEQ ID NO: 3887749 - RNA, 19 nt, Human
gcaggggagggucagccag

SEQ ID NO: 3887750 - RNA, 21 nt, Human
gcaggggagggucagccaggg

SEQ ID NO: 3887751 - RNA, 15 nt, Human
gcaggggccuccaug

SEQ ID NO: 3887752 - RNA, 14 nt, Human
gcaggggccuggag

SEQ ID NO: 3887753 - RNA, 19 nt, Human
gcaggggcguggagggcgu

SEQ ID NO: 3887754 - RNA, 16 nt, Human
gcaggggcucuggaga

SEQ ID NO: 3887755 - RNA, 20 nt, Human
gcaggggugacggcccucau

SEQ ID NO: 3887756 - RNA, 18 nt, Human
gcagggguggcugccuca

SEQ ID NO: 3887757 - RNA, 15 nt, Human
gcagggguugcagug

SEQ ID NO: 3887758 - RNA, 17 nt, Human
gcagggucuagaaggcu

SEQ ID NO: 3887759 - RNA, 14 nt, Human
gcagggucugggca

SEQ ID NO: 3887760 - RNA, 19 nt, Human
gcagggucuguuuggacug

SEQ ID NO: 3887761 - RNA, 23 nt, Human
gcagggucuuuucaucugggaaa

SEQ ID NO: 3887762 - RNA, 15 nt, Human
gcagggugggaugga

SEQ ID NO: 3887763 - RNA, 14 nt, Human
gcagguaccacuga

SEQ ID NO: 3887764 - RNA, 12 nt, Human
gcaggucccuaa

SEQ ID NO: 3887765 - RNA, 15 nt, Human
gcaggucccuaauaa

SEQ ID NO: 3887766 - RNA, 16 nt, Human
gcaggucccuaauaaa

SEQ ID NO: 3887767 - RNA, 19 nt, Human
gcaggucccuaauaaagcu

SEQ ID NO: 3887768 - RNA, 20 nt, Human
gcaggugaaacccagucacu

SEQ ID NO: 3887769 - RNA, 16 nt, Human
gcaggugacagugagg

SEQ ID NO: 3887770 - RNA, 19 nt, Human
gcaggugaccuucugggaa

SEQ ID NO: 3887771 - RNA, 21 nt, Human
gcaggugccccucucuccauc

SEQ ID NO: 3887772 - RNA, 15 nt, Human
gcaggugccuccagg

SEQ ID NO: 3887773 - RNA, 21 nt, Human
gcaggugcugcuacccucccu

SEQ ID NO: 3887774 - RNA, 18 nt, Human
gcaggugcuggagcacug

SEQ ID NO: 3887775 - RNA, 19 nt, Human
gcaggugcuggagcacugg

SEQ ID NO: 3887776 - RNA, 20 nt, Human
gcaggugcuggagcacuggg

SEQ ID NO: 3887777 - RNA, 20 nt, Human
gcagguggaucuauuucaug

SEQ ID NO: 3887778 - RNA, 21 nt, Human
gcagguggccaaguuccucua

SEQ ID NO: 3887779 - RNA, 17 nt, Human
gcaggugggcuggacuu

SEQ ID NO: 3887780 - RNA, 20 nt, Human
gcaggugguggcacugagcc

SEQ ID NO: 3887781 - RNA, 21 nt, Human
gcaggugguggcacugagccc

SEQ ID NO: 3887782 - RNA, 23 nt, Human
gcaggugguggcacugagccccc

SEQ ID NO: 3887783 - RNA, 13 nt, Human
gcagguuaaaugu

SEQ ID NO: 3887784 - RNA, 13 nt, Human
gcagguuagagaa

SEQ ID NO: 3887785 - RNA, 13 nt, Human
gcagguucccaag

SEQ ID NO: 3887786 - RNA, 19 nt, Human
gcagguucugccugcuuug

SEQ ID NO: 3887787 - RNA, 22 nt, Human
gcagguucuucuuccugaagcu

SEQ ID NO: 3887788 - RNA, 13 nt, Human
gcagguucuuguu

SEQ ID NO: 3887789 - RNA, 23 nt, Human
gcagguucuuguuggugcacagc

SEQ ID NO: 3887790 - RNA, 15 nt, Human
gcagguuggacccca

SEQ ID NO: 3887791 - RNA, 14 nt, Human
gcaguaaagagaaa

SEQ ID NO: 3887792 - RNA, 13 nt, Human
gcaguacauggga

SEQ ID NO: 3887793 - RNA, 14 nt, Human
gcaguaccugaggg

SEQ ID NO: 3887794 - RNA, 21 nt, Human
gcaguagaaauaauaugcauu

SEQ ID NO: 3887795 - RNA, 17 nt, Human
gcaguagaacuccaggc

SEQ ID NO: 3887796 - RNA, 22 nt, Human
gcaguagaaggucggaggcuug

SEQ ID NO: 3887797 - RNA, 13 nt, Human
gcaguagacauuu

SEQ ID NO: 3887798 - RNA, 21 nt, Human
gcaguagaggcuauggacagg

SEQ ID NO: 3887799 - RNA, 20 nt, Human
gcaguagauuuucuuuaaaa

SEQ ID NO: 3887800 - RNA, 17 nt, Human
gcaguagucucugugcu

SEQ ID NO: 3887801 - RNA, 22 nt, Human
gcaguaucggcacuguacaaaa

SEQ ID NO: 3887802 - RNA, 13 nt, Human
gcaguauugagca

SEQ ID NO: 3887803 - RNA, 16 nt, Human
gcaguauuuugugucc

SEQ ID NO: 3887804 - RNA, 17 nt, Human
gcaguauuuuguguccu

SEQ ID NO: 3887805 - RNA, 22 nt, Human
gcagucacucuagucaaugaca

SEQ ID NO: 3887806 - RNA, 13 nt, Human
gcagucacugaau

SEQ ID NO: 3887807 - RNA, 21 nt, Human
gcagucauggagaaccaccua

SEQ ID NO: 3887808 - RNA, 19 nt, Human
gcaguccacuucugacagc

SEQ ID NO: 3887809 - RNA, 22 nt, Human
gcaguccacuucugacagccuc

SEQ ID NO: 3887810 - RNA, 16 nt, Human
gcaguccauuucuacc

SEQ ID NO: 3887811 - RNA, 14 nt, Human
gcaguccccuuccc

SEQ ID NO: 3887812 - RNA, 18 nt, Human
gcaguccugccucagccu

SEQ ID NO: 3887813 - RNA, 13 nt, Human
gcaguccuggagc

SEQ ID NO: 3887814 - RNA, 20 nt, Human
gcagucgggggcuggccuag

SEQ ID NO: 3887815 - RNA, 23 nt, Human
gcagucgggggcuggccuaggag

SEQ ID NO: 3887816 - RNA, 15 nt, Human
gcagucgucgcacag

SEQ ID NO: 3887817 - RNA, 20 nt, Human
gcagucgucgcacagucucu

SEQ ID NO: 3887818 - RNA, 16 nt, Human
gcagucuacccaccuc

SEQ ID NO: 3887819 - RNA, 21 nt, Human
gcagucuccucuuuaaaacaa

SEQ ID NO: 3887820 - RNA, 18 nt, Human
gcagucucggguggcuag

SEQ ID NO: 3887821 - RNA, 17 nt, Human
gcagucucuauaccaau

SEQ ID NO: 3887822 - RNA, 18 nt, Human
gcagucucuauaccaaua

SEQ ID NO: 3887823 - RNA, 20 nt, Human
gcagucucuauaccaauaaa

SEQ ID NO: 3887824 - RNA, 13 nt, Human
gcagucucugccu

SEQ ID NO: 3887825 - RNA, 12 nt, Human
gcagucuggagg

SEQ ID NO: 3887826 - RNA, 17 nt, Human
gcagucuguccaggcuc

SEQ ID NO: 3887827 - RNA, 18 nt, Human
gcagucuuaugcuuccag

SEQ ID NO: 3887828 - RNA, 19 nt, Human
gcagucuuaugcuuccaga

SEQ ID NO: 3887829 - RNA, 22 nt, Human
gcagucuuaugcuuccagaaac

SEQ ID NO: 3887830 - RNA, 18 nt, Human
gcagugaaagacaagcug

SEQ ID NO: 3887831 - RNA, 20 nt, Human
gcagugagaaaaagcuccug

SEQ ID NO: 3887832 - RNA, 23 nt, Human
gcagugagaaaaagcuccugucc

SEQ ID NO: 3887833 - RNA, 21 nt, Human
gcagugagccgcaucuucucc

SEQ ID NO: 3887834 - RNA, 22 nt, Human
gcagugagggguauaucugggc

SEQ ID NO: 3887835 - RNA, 15 nt, Human
gcagugagugagccu

SEQ ID NO: 3887836 - RNA, 21 nt, Human
gcagugagugagccuggcucu

SEQ ID NO: 3887837 - RNA, 22 nt, Human
gcagugauauggcagaagacac

SEQ ID NO: 3887838 - RNA, 13 nt, Human
gcagugaugucac

SEQ ID NO: 3887839 - RNA, 14 nt, Human
gcagugauuaaggu

SEQ ID NO: 3887840 - RNA, 14 nt, Human
gcagugauuuuuau

SEQ ID NO: 3887841 - RNA, 17 nt, Human
gcagugccucuggucug

SEQ ID NO: 3887842 - RNA, 13 nt, Human
gcagugccuugca

SEQ ID NO: 3887843 - RNA, 23 nt, Human
gcagugccuuggggaauuuccuc

SEQ ID NO: 3887844 - RNA, 17 nt, Human
gcagugcucgcuguugc

SEQ ID NO: 3887845 - RNA, 23 nt, Human
gcagugcuuccaaggauggacca

SEQ ID NO: 3887846 - RNA, 17 nt, Human
gcagugcuuggcccagg

SEQ ID NO: 3887847 - RNA, 15 nt, Human
gcaguggacaccagg

SEQ ID NO: 3887848 - RNA, 14 nt, Human
gcaguggacucaga

SEQ ID NO: 3887849 - RNA, 14 nt, Human
gcaguggagaggga

SEQ ID NO: 3887850 - RNA, 16 nt, Human
gcaguggagcccagga

SEQ ID NO: 3887851 - RNA, 17 nt, Human
gcaguggagcccaggag

SEQ ID NO: 3887852 - RNA, 21 nt, Human
gcaguggccccuuaggccagu

SEQ ID NO: 3887853 - RNA, 12 nt, Human
gcaguggccuua

SEQ ID NO: 3887854 - RNA, 16 nt, Human
gcaguggcucacgccu

SEQ ID NO: 3887855 - RNA, 17 nt, Human
gcagugggaaaaaugua

SEQ ID NO: 3887856 - RNA, 15 nt, Human
gcaguggggcugggg

SEQ ID NO: 3887857 - RNA, 11 nt, Human
gcagugggucc

SEQ ID NO: 3887858 - RNA, 19 nt, Human
gcagugggucccacuuccc

SEQ ID NO: 3887859 - RNA, 21 nt, Human
gcagugggucccacuuccccu

SEQ ID NO: 3887860 - RNA, 18 nt, Human
gcagugguaagcucuggc

SEQ ID NO: 3887861 - RNA, 14 nt, Human
gcaguggugcgauc

SEQ ID NO: 3887862 - RNA, 16 nt, Human
gcaguggugcgaucuc

SEQ ID NO: 3887863 - RNA, 21 nt, Human
gcaguggugguuuucuguucu

SEQ ID NO: 3887864 - RNA, 14 nt, Human
gcaguguagauuuu

SEQ ID NO: 3887865 - RNA, 11 nt, Human
gcagugucuuc

SEQ ID NO: 3887866 - RNA, 14 nt, Human
gcagugucuuccau

SEQ ID NO: 3887867 - RNA, 15 nt, Human
gcagugucuuccaua

SEQ ID NO: 3887868 - RNA, 20 nt, Human
gcagugucuuccauaaugua

SEQ ID NO: 3887869 - RNA, 19 nt, Human
gcagugugaaguacaauaa

SEQ ID NO: 3887870 - RNA, 15 nt, Human
gcagugugaggccag

SEQ ID NO: 3887871 - RNA, 20 nt, Human
gcagugugcacuaaggggcc

SEQ ID NO: 3887872 - RNA, 16 nt, Human
gcaguguggccaggcu

SEQ ID NO: 3887873 - RNA, 18 nt, Human
gcagugugucuccugcau

SEQ ID NO: 3887874 - RNA, 13 nt, Human
gcaguguuagcuu

SEQ ID NO: 3887875 - RNA, 14 nt, Human
gcaguguuagcuua

SEQ ID NO: 3887876 - RNA, 17 nt, Human
gcaguguucgcuuggcu

SEQ ID NO: 3887877 - RNA, 18 nt, Human
gcaguuacaugcauacuu

SEQ ID NO: 3887878 - RNA, 20 nt, Human
gcaucauuauuuauguauug

SEQ ID NO: 3887879 - RNA, 17 nt, Human
gcaucauuccaggcccg

SEQ ID NO: 3887880 - RNA, 16 nt, Human
gcauccaccuccuucu

SEQ ID NO: 3887881 - RNA, 22 nt, Human
gcauccacuucuuucagcagac

SEQ ID NO: 3887882 - RNA, 23 nt, Human
gcauccacuucuuucagcagacu

SEQ ID NO: 3887883 - RNA, 18 nt, Human
gcauccagcagucucugc

SEQ ID NO: 3887884 - RNA, 17 nt, Human
gcauccauguguggacu

SEQ ID NO: 3887885 - RNA, 16 nt, Human
gcauccauuccucagg

SEQ ID NO: 3887886 - RNA, 17 nt, Human
gcauccauucuccugag

SEQ ID NO: 3887887 - RNA, 19 nt, Human
gcauccauucuccugagga

SEQ ID NO: 3887888 - RNA, 21 nt, Human
gcaucccagcaccugccuccu

SEQ ID NO: 3887889 - RNA, 13 nt, Human
gcaucccagggga

SEQ ID NO: 3887890 - RNA, 14 nt, Human
gcaucccaggggac

SEQ ID NO: 3887891 - RNA, 15 nt, Human
gcaucccaggggacc

SEQ ID NO: 3887892 - RNA, 16 nt, Human
gcaucccaggggacca

SEQ ID NO: 3887893 - RNA, 19 nt, Human
gcaucccaggggaccacac

SEQ ID NO: 3887894 - RNA, 12 nt, Human
gcaucccccaaa

SEQ ID NO: 3887895 - RNA, 16 nt, Human
gcaucccccaaaguuc

SEQ ID NO: 3887896 - RNA, 20 nt, Human
gcaucccccaaaguucacaa

SEQ ID NO: 3887897 - RNA, 13 nt, Human
gcauccccugccu

SEQ ID NO: 3887898 - RNA, 16 nt, Human
gcauccccugccucca

SEQ ID NO: 3887899 - RNA, 13 nt, Human
gcaucccggagga

SEQ ID NO: 3887900 - RNA, 18 nt, Human
gcaucccuaccgacccag

SEQ ID NO: 3887901 - RNA, 21 nt, Human
gcaucccuaccgacccagggu

SEQ ID NO: 3887902 - RNA, 21 nt, Human
gcaucccucacccauccuaga

SEQ ID NO: 3887903 - RNA, 18 nt, Human
gcaucccugaggagccag

SEQ ID NO: 3887904 - RNA, 22 nt, Human
gcaucccuugaccaggccuggg

SEQ ID NO: 3887905 - RNA, 22 nt, Human
gcaucccuuuuucauaaauuau

SEQ ID NO: 3887906 - RNA, 17 nt, Human
gcauccgcaggugcugg

SEQ ID NO: 3887907 - RNA, 15 nt, Human
gcauccuaagaaaua

SEQ ID NO: 3887908 - RNA, 11 nt, Human
gcauccuaguc

SEQ ID NO: 3887909 - RNA, 23 nt, Human
gcauccuagucucuaucauuaaa

SEQ ID NO: 3887910 - RNA, 21 nt, Human
gcauccucaguuccugcagca

SEQ ID NO: 3887911 - RNA, 15 nt, Human
gcauccuccagcccc

SEQ ID NO: 3887912 - RNA, 14 nt, Human
gcauccucuggagc

SEQ ID NO: 3887913 - RNA, 22 nt, Human
gcauccugagccccgcccucuu

SEQ ID NO: 3887914 - RNA, 14 nt, Human
gcauccuggcaccc

SEQ ID NO: 3887915 - RNA, 22 nt, Human
gcaucggacaagacccccagca

SEQ ID NO: 3887916 - RNA, 14 nt, Human
gcaucggccuaggg

SEQ ID NO: 3887917 - RNA, 17 nt, Human
gcaucggggagccggga

SEQ ID NO: 3887918 - RNA, 12 nt, Human
gcaucuaaacuu

SEQ ID NO: 3887919 - RNA, 19 nt, Human
gcaucuaaacuuuaauaug

SEQ ID NO: 3887920 - RNA, 20 nt, Human
gcaucuaaacuuuaauaugu

SEQ ID NO: 3887921 - RNA, 15 nt, Human
gcaucuaagcccaug

SEQ ID NO: 3887922 - RNA, 19 nt, Human
gcaucuaaguuauaagacu

SEQ ID NO: 3887923 - RNA, 21 nt, Human
gcaucuacuugccagaaccaa

SEQ ID NO: 3887924 - RNA, 23 nt, Human
gcaucuagaggcuuccuucauuu

SEQ ID NO: 3887925 - RNA, 16 nt, Human
gcaucuagguaauuuu

SEQ ID NO: 3887926 - RNA, 22 nt, Human
gcaucuaguuccccuguuuauu

SEQ ID NO: 3887927 - RNA, 20 nt, Human
gcaucuaucuggugauuucu

SEQ ID NO: 3887928 - RNA, 14 nt, Human
gcaucucagcccac

SEQ ID NO: 3887929 - RNA, 18 nt, Human
gcaucuccaccugcuccc

SEQ ID NO: 3887930 - RNA, 12 nt, Human
gcaucuccagga

SEQ ID NO: 3887931 - RNA, 13 nt, Human
gcaucuccaggaa

SEQ ID NO: 3887932 - RNA, 15 nt, Human
gcaucuccugugcau

SEQ ID NO: 3887933 - RNA, 16 nt, Human
gcaucucugggcugga

SEQ ID NO: 3887934 - RNA, 20 nt, Human
gcaucucugggcuggaugag

SEQ ID NO: 3887935 - RNA, 14 nt, Human
gcaucucuguacuu

SEQ ID NO: 3887936 - RNA, 21 nt, Human
gcaucucuugaggccaggagu

SEQ ID NO: 3887937 - RNA, 16 nt, Human
gcaucugaaaauugau

SEQ ID NO: 3887938 - RNA, 14 nt, Human
gcaucugacacaaa

SEQ ID NO: 3887939 - RNA, 16 nt, Human
gcaucugacacaaaaa

SEQ ID NO: 3887940 - RNA, 20 nt, Human
gcaucugaccucuaccuuca

SEQ ID NO: 3887941 - RNA, 17 nt, Human
gcaucugacucacaaga

SEQ ID NO: 3887942 - RNA, 19 nt, Human
gcaucugacucacaagaag

SEQ ID NO: 3887943 - RNA, 12 nt, Human
gcaucugcaccc

SEQ ID NO: 3887944 - RNA, 12 nt, Human
gcaucugccccu

SEQ ID NO: 3887945 - RNA, 18 nt, Human
gcaucugccccuccccca

SEQ ID NO: 3887946 - RNA, 18 nt, Human
gcaucugcuaauaaaacc

SEQ ID NO: 3887947 - RNA, 14 nt, Human
gcaucugggccuug

SEQ ID NO: 3887948 - RNA, 21 nt, Human
gcaucugggccuuggccugga

SEQ ID NO: 3887949 - RNA, 12 nt, Human
gcaucuggggcc

SEQ ID NO: 3887950 - RNA, 11 nt, Human
gcaucuguaua

SEQ ID NO: 3887951 - RNA, 14 nt, Human
gcaucugugauggg

SEQ ID NO: 3887952 - RNA, 16 nt, Human
gcaucuuauagcacuu

SEQ ID NO: 3887953 - RNA, 21 nt, Human
gcaucuuccagaagugugauu

SEQ ID NO: 3887954 - RNA, 23 nt, Human
gcaucuugccuccaggugcagag

SEQ ID NO: 3887955 - RNA, 22 nt, Human
gcaucuuggggggguggccgcu

SEQ ID NO: 3887956 - RNA, 22 nt, Human
gcaucuugguccaggaaaugug

SEQ ID NO: 3887957 - RNA, 20 nt, Human
gcaucuuguggcuuugcaac

SEQ ID NO: 3887958 - RNA, 13 nt, Human
gcaucuuugaugu

SEQ ID NO: 3887959 - RNA, 15 nt, Human
gcaucuuugaugugu

SEQ ID NO: 3887960 - RNA, 15 nt, Human
gcaucuuugccucuc

SEQ ID NO: 3887961 - RNA, 16 nt, Human
gcaucuuuggggaggu

SEQ ID NO: 3887962 - RNA, 18 nt, Human
gcaucuuuuuuucauuuu

SEQ ID NO: 3887963 - RNA, 14 nt, Human
gcaugaaaggcuuu

SEQ ID NO: 3887964 - RNA, 14 nt, Human
gcaugaaauaaaau

SEQ ID NO: 3887965 - RNA, 15 nt, Human
gcaugaaauaaaaua

SEQ ID NO: 3887966 - RNA, 18 nt, Human
gcaugaaauaaaauauau

SEQ ID NO: 3887967 - RNA, 15 nt, Human
gcaugaaaugugaau

SEQ ID NO: 3887968 - RNA, 12 nt, Human
gcaugaaauuuu

SEQ ID NO: 3887969 - RNA, 17 nt, Human
gcaugaacaaguuuuaa

SEQ ID NO: 3887970 - RNA, 15 nt, Human
gcaugaacagugcac

SEQ ID NO: 3887971 - RNA, 14 nt, Human
gcaugaagagaagc

SEQ ID NO: 3887972 - RNA, 15 nt, Human
gcaugaagagcaaaa

SEQ ID NO: 3887973 - RNA, 18 nt, Human
gcaugaagagcaaaaaua

SEQ ID NO: 3887974 - RNA, 18 nt, Human
gcaugaaguaauaugcac

SEQ ID NO: 3887975 - RNA, 20 nt, Human
gcaugaaguaauaugcacac

SEQ ID NO: 3887976 - RNA, 22 nt, Human
gcaugaaguaauaugcacacau

SEQ ID NO: 3887977 - RNA, 23 nt, Human
gcaugaaguaauaugcacacauu

SEQ ID NO: 3887978 - RNA, 15 nt, Human
gcaugaauuuguaau

SEQ ID NO: 3887979 - RNA, 18 nt, Human
gcaugacaagccccaggc

SEQ ID NO: 3887980 - RNA, 19 nt, Human
gcaugacaagccccaggca

SEQ ID NO: 3887981 - RNA, 14 nt, Human
gcaugacagccucu

SEQ ID NO: 3887982 - RNA, 15 nt, Human
gcaugacagccugca

SEQ ID NO: 3887983 - RNA, 18 nt, Human
gcaugacagccugcagca

SEQ ID NO: 3887984 - RNA, 20 nt, Human
gcaugacauaacagugcagg

SEQ ID NO: 3887985 - RNA, 16 nt, Human
gcaugaccugugacca

SEQ ID NO: 3887986 - RNA, 17 nt, Human
gcaugaccugugaccag

SEQ ID NO: 3887987 - RNA, 22 nt, Human
gcaugaccugugaccagcacug

SEQ ID NO: 3887988 - RNA, 21 nt, Human
gcaugacuuguagcauauucu

SEQ ID NO: 3887989 - RNA, 22 nt, Human
gcaugagcauuggauacagcag

SEQ ID NO: 3887990 - RNA, 20 nt, Human
gcaugagggaucacagggcc

SEQ ID NO: 3887991 - RNA, 21 nt, Human
gcaugagggaucacagggccc

SEQ ID NO: 3887992 - RNA, 23 nt, Human
gcaugauccaagcaagacugagg

SEQ ID NO: 3887993 - RNA, 18 nt, Human
gcaugaucugaaaaauac

SEQ ID NO: 3887994 - RNA, 18 nt, Human
gcaugauguuugcccaaa

SEQ ID NO: 3887995 - RNA, 21 nt, Human
gcaugcaaaugagcucugaaa

SEQ ID NO: 3887996 - RNA, 14 nt, Human
gcaugcaccacggg

SEQ ID NO: 3887997 - RNA, 15 nt, Human
gcaugcaccacgggc

SEQ ID NO: 3887998 - RNA, 13 nt, Human
gcaugcagaaagg

SEQ ID NO: 3887999 - RNA, 18 nt, Human
gcaugcagaaagggagca

SEQ ID NO: 3888000 - RNA, 13 nt, Human
gcaugcagcagcu

SEQ ID NO: 3888001 - RNA, 22 nt, Human
gcaugcagcagcuugcugcacc

SEQ ID NO: 3888002 - RNA, 21 nt, Human
gcaugcaucccacugcugacu

SEQ ID NO: 3888003 - RNA, 14 nt, Human
gcaugcaugcaaau

SEQ ID NO: 3888004 - RNA, 14 nt, Human
gcaugcauuuugca

SEQ ID NO: 3888005 - RNA, 18 nt, Human
gcaugccaacaagaaugc

SEQ ID NO: 3888006 - RNA, 20 nt, Human
gcaugcccccucgugccagu

SEQ ID NO: 3888007 - RNA, 14 nt, Human
gcaugccccggcca

SEQ ID NO: 3888008 - RNA, 20 nt, Human
gcaugccccggccaccucug

SEQ ID NO: 3888009 - RNA, 11 nt, Human
gcaugccucug

SEQ ID NO: 3888010 - RNA, 15 nt, Human
gcaugccuggauggg

SEQ ID NO: 3888011 - RNA, 15 nt, Human
gcaugccuucaaauc

SEQ ID NO: 3888012 - RNA, 16 nt, Human
gcaugccuuccagcac

SEQ ID NO: 3888013 - RNA, 15 nt, Human
gcaugcggcccagcc

SEQ ID NO: 3888014 - RNA, 17 nt, Human
gcaugcggcccagcccg

SEQ ID NO: 3888015 - RNA, 15 nt, Human
gcaugcucucugcag

SEQ ID NO: 3888016 - RNA, 21 nt, Human
gcaugcucucugcagccagcc

SEQ ID NO: 3888017 - RNA, 22 nt, Human
gcaugcucucugcagccagccc

SEQ ID NO: 3888018 - RNA, 16 nt, Human
gcaugcugcuggacag

SEQ ID NO: 3888019 - RNA, 15 nt, Human
gcaugcuggggcaag

SEQ ID NO: 3888020 - RNA, 21 nt, Human
gcaugcuguauuaugaaaucg

SEQ ID NO: 3888021 - RNA, 14 nt, Human
gcaugcuuaaauuu

SEQ ID NO: 3888022 - RNA, 19 nt, Human
gcauggaaaaguuucccag

SEQ ID NO: 3888023 - RNA, 22 nt, Human
gcauugagaacugcauauguuu

SEQ ID NO: 3888024 - RNA, 16 nt, Human
gcauugagcuugcaug

SEQ ID NO: 3888025 - RNA, 10 nt, Human
gcauugagua

SEQ ID NO: 3888026 - RNA, 15 nt, Human
gcauugaguauuguu

SEQ ID NO: 3888027 - RNA, 17 nt, Human
gcauugaguauuguuua

SEQ ID NO: 3888028 - RNA, 17 nt, Human
gcauugauauugugaac

SEQ ID NO: 3888029 - RNA, 18 nt, Human
gcauugauauugugaaca

SEQ ID NO: 3888030 - RNA, 23 nt, Human
gcauugccaguaacacaggccac

SEQ ID NO: 3888031 - RNA, 17 nt, Human
gcauugccauguggaag

SEQ ID NO: 3888032 - RNA, 21 nt, Human
gcauugccucggcuggcuccc

SEQ ID NO: 3888033 - RNA, 12 nt, Human
gcauugccuggc

SEQ ID NO: 3888034 - RNA, 14 nt, Human
gcauugcuagauaa

SEQ ID NO: 3888035 - RNA, 18 nt, Human
gcauugcuagauaaaagc

SEQ ID NO: 3888036 - RNA, 12 nt, Human
gcauugcuguua

SEQ ID NO: 3888037 - RNA, 12 nt, Human
gcauugcuuucu

SEQ ID NO: 3888038 - RNA, 20 nt, Human
gcauugcuuuuauuuugaaa

SEQ ID NO: 3888039 - RNA, 21 nt, Human
gcauuggaaacccuauuuccc

SEQ ID NO: 3888040 - RNA, 12 nt, Human
gcauuggauauu

SEQ ID NO: 3888041 - RNA, 18 nt, Human
gcauuggauauuuuuuac

SEQ ID NO: 3888042 - RNA, 19 nt, Human
gcauuggggauguuuuucu

SEQ ID NO: 3888043 - RNA, 12 nt, Human
gcauuguaagcg

SEQ ID NO: 3888044 - RNA, 20 nt, Human
gcauuguauagauauaauga

SEQ ID NO: 3888045 - RNA, 21 nt, Human
gcauuguauagauauaaugaa

SEQ ID NO: 3888046 - RNA, 16 nt, Human
gcauugucccugugcc

SEQ ID NO: 3888047 - RNA, 17 nt, Human
gcauugugaacugacag

SEQ ID NO: 3888048 - RNA, 15 nt, Human
gcauugugggaaggg

SEQ ID NO: 3888049 - RNA, 16 nt, Human
gcauugugggaagggg

SEQ ID NO: 3888050 - RNA, 17 nt, Human
gcauuguuugcuuauug

SEQ ID NO: 3888051 - RNA, 18 nt, Human
gcauuguuugcuuauugu

SEQ ID NO: 3888052 - RNA, 21 nt, Human
gcauuguuugcuuauuguucc

SEQ ID NO: 3888053 - RNA, 23 nt, Human
gcauuguuugcuuauuguuccaa

SEQ ID NO: 3888054 - RNA, 18 nt, Human
gcauuuaaaacagacacu

SEQ ID NO: 3888055 - RNA, 19 nt, Human
gcauuuaauguagccaugg

SEQ ID NO: 3888056 - RNA, 17 nt, Human
gcauuuacugugucuuu

SEQ ID NO: 3888057 - RNA, 18 nt, Human
gcauuuacugugucuuug

SEQ ID NO: 3888058 - RNA, 15 nt, Human
gcauuuacuuugugu

SEQ ID NO: 3888059 - RNA, 18 nt, Human
gcauuuagggaguauucu

SEQ ID NO: 3888060 - RNA, 19 nt, Human
gcauuucacaaaacagccu

SEQ ID NO: 3888061 - RNA, 22 nt, Human
gcauuucacaaaacagccuuug

SEQ ID NO: 3888062 - RNA, 21 nt, Human
gcauuuccaacaccacagaca

SEQ ID NO: 3888063 - RNA, 13 nt, Human
gcauuuccugggu

SEQ ID NO: 3888064 - RNA, 22 nt, Human
gcauuucgguugagaauggaaa

SEQ ID NO: 3888065 - RNA, 12 nt, Human
gcauuucugaag

SEQ ID NO: 3888066 - RNA, 20 nt, Human
gcauuucuugauguugcuua

SEQ ID NO: 3888067 - RNA, 10 nt, Human
gcauuugaau

SEQ ID NO: 3888068 - RNA, 16 nt, Human
gcauuugagaaaugca

SEQ ID NO: 3888069 - RNA, 19 nt, Human
gcauuugaggucuguucuu

SEQ ID NO: 3888070 - RNA, 20 nt, Human
gcauuugaggucuguucuuu

SEQ ID NO: 3888071 - RNA, 23 nt, Human
gcauuugcucuuucaucucugcu

SEQ ID NO: 3888072 - RNA, 17 nt, Human
gcauuugcugaauacag

SEQ ID NO: 3888073 - RNA, 14 nt, Human
gcauuugcuuuugu

SEQ ID NO: 3888074 - RNA, 16 nt, Human
gcauuuggguccagga

SEQ ID NO: 3888075 - RNA, 19 nt, Human
gcauuuggguccaggagga

SEQ ID NO: 3888076 - RNA, 21 nt, Human
gcauuuggugguuucagaaau

SEQ ID NO: 3888077 - RNA, 12 nt, Human
gcauuuguauuu

SEQ ID NO: 3888078 - RNA, 13 nt, Human
gcauuugucaaug

SEQ ID NO: 3888079 - RNA, 19 nt, Human
gcauuuguguguuacaaug

SEQ ID NO: 3888080 - RNA, 19 nt, Human
gcauuuguuuauguaauuu

SEQ ID NO: 3888081 - RNA, 16 nt, Human
gcauuuguuugaacug

SEQ ID NO: 3888082 - RNA, 15 nt, Human
gcauuuuaaaaauga

SEQ ID NO: 3888083 - RNA, 17 nt, Human
gcauuuuaaaaaugaaa

SEQ ID NO: 3888084 - RNA, 12 nt, Human
gcauuuuaccau

SEQ ID NO: 3888085 - RNA, 14 nt, Human
gcauuuucccagau

SEQ ID NO: 3888086 - RNA, 20 nt, Human
gcauuuuccuccaucgcagu

SEQ ID NO: 3888087 - RNA, 15 nt, Human
gcauuuuccucugcu

SEQ ID NO: 3888088 - RNA, 23 nt, Human
gcauuuucugaaacuaaugaaag

SEQ ID NO: 3888089 - RNA, 14 nt, Human
gcauuuugcuauug

SEQ ID NO: 3888090 - RNA, 12 nt, Human
gcauuuuguaau

SEQ ID NO: 3888091 - RNA, 14 nt, Human
gcauuuuguauuug

SEQ ID NO: 3888092 - RNA, 23 nt, Human
gcauuuuguuugguauuguauuu

SEQ ID NO: 3888093 - RNA, 19 nt, Human
gcauuuuuauuucagauuu

SEQ ID NO: 3888094 - RNA, 20 nt, Human
gcauuuuucaauauauugaa

SEQ ID NO: 3888095 - RNA, 21 nt, Human
gcauuuuugauuuaugcaugg

SEQ ID NO: 3888096 - RNA, 14 nt, Human
gcauuuuuguaaau

SEQ ID NO: 3888097 - RNA, 20 nt, Human
gccaaaaaccuuagcucccu

SEQ ID NO: 3888098 - RNA, 19 nt, Human
gccaaaaaggauacauaau

SEQ ID NO: 3888099 - RNA, 17 nt, Human
gccaaaaagugaaauaa

SEQ ID NO: 3888100 - RNA, 14 nt, Human
gccaaaagcugcuc

SEQ ID NO: 3888101 - RNA, 13 nt, Human
gccaaaaggaaaa

SEQ ID NO: 3888102 - RNA, 23 nt, Human
gccaaaaggaaaaagcuccaugu

SEQ ID NO: 3888103 - RNA, 17 nt, Human
gccaaaauauuuggaau

SEQ ID NO: 3888104 - RNA, 13 nt, Human
gccaaacacacag

SEQ ID NO: 3888105 - RNA, 18 nt, Human
gccaaaccaggacccugu

SEQ ID NO: 3888106 - RNA, 21 nt, Human
gccaaaccaggacccugucca

SEQ ID NO: 3888107 - RNA, 15 nt, Human
gccaaacccugucug

SEQ ID NO: 3888108 - RNA, 18 nt, Human
gccaaacccuugucagug

SEQ ID NO: 3888109 - RNA, 16 nt, Human
gccaaaccucuguuca

SEQ ID NO: 3888110 - RNA, 19 nt, Human
gccaaaccucuguucagug

SEQ ID NO: 3888111 - RNA, 19 nt, Human
gccaaacucaccugccccu

SEQ ID NO: 3888112 - RNA, 12 nt, Human
gccaaacugcug

SEQ ID NO: 3888113 - RNA, 14 nt, Human
gccaaacugcugga

SEQ ID NO: 3888114 - RNA, 22 nt, Human
gccaaagaaaugaacauuccaa

SEQ ID NO: 3888115 - RNA, 16 nt, Human
gccaaagaagcagacc

SEQ ID NO: 3888116 - RNA, 12 nt, Human
gccaaagacaaa

SEQ ID NO: 3888117 - RNA, 14 nt, Human
gccaaagacaaaua

SEQ ID NO: 3888118 - RNA, 13 nt, Human
gccaaagccaaag

SEQ ID NO: 3888119 - RNA, 22 nt, Human
gccaaagcuaggccuggccaga

SEQ ID NO: 3888120 - RNA, 20 nt, Human
gccaaaggaagcacaugccu

SEQ ID NO: 3888121 - RNA, 17 nt, Human
gccaaaggaugugauau

SEQ ID NO: 3888122 - RNA, 16 nt, Human
gccaaauaaugucucu

SEQ ID NO: 3888123 - RNA, 15 nt, Human
gccaaauagcaaaga

SEQ ID NO: 3888124 - RNA, 16 nt, Human
gccaaauauauucucu

SEQ ID NO: 3888125 - RNA, 19 nt, Human
gccaaauccgcucucuucc

SEQ ID NO: 3888126 - RNA, 22 nt, Human
gccaaauccgcucucuuccugc

SEQ ID NO: 3888127 - RNA, 23 nt, Human
gccaaauccgcucucuuccugcc

SEQ ID NO: 3888128 - RNA, 16 nt, Human
gccaaauguaauugaa

SEQ ID NO: 3888129 - RNA, 13 nt, Human
gccaaauuuauca

SEQ ID NO: 3888130 - RNA, 19 nt, Human
gccaaauuuaucaaagcau

SEQ ID NO: 3888131 - RNA, 18 nt, Human
gccaacaaagcuguugau

SEQ ID NO: 3888132 - RNA, 16 nt, Human
gccaacaacuucucca

SEQ ID NO: 3888133 - RNA, 14 nt, Human
gccaacaagaaugc

SEQ ID NO: 3888134 - RNA, 20 nt, Human
gccaacaccacagaaauggg

SEQ ID NO: 3888135 - RNA, 14 nt, Human
gccaacaccaggga

SEQ ID NO: 3888136 - RNA, 17 nt, Human
gccaacagaagcuucca

SEQ ID NO: 3888137 - RNA, 14 nt, Human
gccaacagcuacaa

SEQ ID NO: 3888138 - RNA, 17 nt, Human
gccaacagcuacaacag

SEQ ID NO: 3888139 - RNA, 18 nt, Human
gccaacagcuacaacagc

SEQ ID NO: 3888140 - RNA, 22 nt, Human
gccaacagguggcaggaccagg

SEQ ID NO: 3888141 - RNA, 20 nt, Human
gccaacaucgugaaacccug

SEQ ID NO: 3888142 - RNA, 22 nt, Human
gccaacaucgugaaacccuguc

SEQ ID NO: 3888143 - RNA, 13 nt, Human
gccaaccauaccu

SEQ ID NO: 3888144 - RNA, 23 nt, Human
gccaaccauaccuuccuucccug

SEQ ID NO: 3888145 - RNA, 23 nt, Human
gccaacccuucuccucuuguaaa

SEQ ID NO: 3888146 - RNA, 14 nt, Human
gccaaccucgcucc

SEQ ID NO: 3888147 - RNA, 16 nt, Human
gccaaccuguaauaaa

SEQ ID NO: 3888148 - RNA, 21 nt, Human
gccaaccuguaauaaauauga

SEQ ID NO: 3888149 - RNA, 13 nt, Human
gccaacuccucac

SEQ ID NO: 3888150 - RNA, 14 nt, Human
gccaacuccucaca

SEQ ID NO: 3888151 - RNA, 12 nt, Human
gccaacuguugu

SEQ ID NO: 3888152 - RNA, 19 nt, Human
gccaacuucuucagagcug

SEQ ID NO: 3888153 - RNA, 21 nt, Human
gccaacuugagggcccagagc

SEQ ID NO: 3888154 - RNA, 22 nt, Human
gccaacuugagggcccagagca

SEQ ID NO: 3888155 - RNA, 14 nt, Human
gccaacuuggcuuu

SEQ ID NO: 3888156 - RNA, 13 nt, Human
gccaacuuguaaa

SEQ ID NO: 3888157 - RNA, 20 nt, Human
gccaagaaaagggcugacau

SEQ ID NO: 3888158 - RNA, 15 nt, Human
gccaagaaacgucuu

SEQ ID NO: 3888159 - RNA, 21 nt, Human
gccaagaaacgucuucuaaac

SEQ ID NO: 3888160 - RNA, 15 nt, Human
gccaagaauuagauu

SEQ ID NO: 3888161 - RNA, 17 nt, Human
gccaagacaaaucaaca

SEQ ID NO: 3888162 - RNA, 20 nt, Human
gccaagacugcuguggccag

SEQ ID NO: 3888163 - RNA, 22 nt, Human
gccaagacuuggcaacagaagc

SEQ ID NO: 3888164 - RNA, 16 nt, Human
gccaagagcagaggca

SEQ ID NO: 3888165 - RNA, 18 nt, Human
gccaagagcccgucugcu

SEQ ID NO: 3888166 - RNA, 14 nt, Human
gccaagaguggccc

SEQ ID NO: 3888167 - RNA, 18 nt, Human
gccaagauaggaccuugg

SEQ ID NO: 3888168 - RNA, 15 nt, Human
gcccugagguguggg

SEQ ID NO: 3888169 - RNA, 22 nt, Human
gcccugaggugugggggcugca

SEQ ID NO: 3888170 - RNA, 23 nt, Human
gcccugaggugugggggcugcag

SEQ ID NO: 3888171 - RNA, 13 nt, Human
gcccugaucccag

SEQ ID NO: 3888172 - RNA, 15 nt, Human
gcccugaucccagag

SEQ ID NO: 3888173 - RNA, 19 nt, Human
gcccugauugcgcaaaacu

SEQ ID NO: 3888174 - RNA, 14 nt, Human
gcccugauuugcug

SEQ ID NO: 3888175 - RNA, 14 nt, Human
gcccugcaaaagga

SEQ ID NO: 3888176 - RNA, 16 nt, Human
gcccugcacuguccug

SEQ ID NO: 3888177 - RNA, 13 nt, Human
gcccugcagaccc

SEQ ID NO: 3888178 - RNA, 15 nt, Human
gcccugcagacccug

SEQ ID NO: 3888179 - RNA, 16 nt, Human
gcccugcagacccugc

SEQ ID NO: 3888180 - RNA, 17 nt, Human
gcccugcagacccugcc

SEQ ID NO: 3888181 - RNA, 20 nt, Human
gcccugcagacccugcccuu

SEQ ID NO: 3888182 - RNA, 14 nt, Human
gcccugcagccagc

SEQ ID NO: 3888183 - RNA, 15 nt, Human
gcccugcagccagcu

SEQ ID NO: 3888184 - RNA, 13 nt, Human
gcccugcaguguu

SEQ ID NO: 3888185 - RNA, 23 nt, Human
gcccugcaugggccagccccucc

SEQ ID NO: 3888186 - RNA, 14 nt, Human
gcccugcauguagu

SEQ ID NO: 3888187 - RNA, 15 nt, Human
gcccugcauuuucau

SEQ ID NO: 3888188 - RNA, 16 nt, Human
gcccugccaccugucu

SEQ ID NO: 3888189 - RNA, 17 nt, Human
gcccugccaccugucug

SEQ ID NO: 3888190 - RNA, 18 nt, Human
gcccugccaccugucugu

SEQ ID NO: 3888191 - RNA, 20 nt, Human
gcccugcccacaccuccugg

SEQ ID NO: 3888192 - RNA, 14 nt, Human
gcccugcccaccug

SEQ ID NO: 3888193 - RNA, 21 nt, Human
gcccugcccaccuggccucug

SEQ ID NO: 3888194 - RNA, 15 nt, Human
gcccugccccacacc

SEQ ID NO: 3888195 - RNA, 16 nt, Human
gcccugcccuagcucc

SEQ ID NO: 3888196 - RNA, 17 nt, Human
gcccugcccuagcucca

SEQ ID NO: 3888197 - RNA, 18 nt, Human
gcccugcccuagcuccac

SEQ ID NO: 3888198 - RNA, 13 nt, Human
gcccugcccugcc

SEQ ID NO: 3888199 - RNA, 17 nt, Human
gcccugcccugccaccu

SEQ ID NO: 3888200 - RNA, 12 nt, Human
gcccugcccugg

SEQ ID NO: 3888201 - RNA, 20 nt, Human
gcccugcccuucagcauccu

SEQ ID NO: 3888202 - RNA, 12 nt, Human
gcccugccuccu

SEQ ID NO: 3888203 - RNA, 12 nt, Human
gcccugccugag

SEQ ID NO: 3888204 - RNA, 14 nt, Human
gcccugccugaggg

SEQ ID NO: 3888205 - RNA, 16 nt, Human
gcccugccugagggcc

SEQ ID NO: 3888206 - RNA, 19 nt, Human
gcccugccugagggccccu

SEQ ID NO: 3888207 - RNA, 20 nt, Human
gcccugccugagggccccuc

SEQ ID NO: 3888208 - RNA, 22 nt, Human
gcccugccugagggccccucug

SEQ ID NO: 3888209 - RNA, 19 nt, Human
gcccugccuggaggaccug

SEQ ID NO: 3888210 - RNA, 21 nt, Human
gcccugccuggaggaccugag

SEQ ID NO: 3888211 - RNA, 22 nt, Human
gcccugcuccucccuggcugcc

SEQ ID NO: 3888212 - RNA, 15 nt, Human
gcccugcuccugcag

SEQ ID NO: 3888213 - RNA, 18 nt, Human
gcccugcugagucccagg

SEQ ID NO: 3888214 - RNA, 23 nt, Human
gcccugcugagucccaggcugag

SEQ ID NO: 3888215 - RNA, 13 nt, Human
gcccugcugcccu

SEQ ID NO: 3888216 - RNA, 21 nt, Human
gcccugcugccgccucccagc

SEQ ID NO: 3888217 - RNA, 23 nt, Human
gcccugcugccgccucccagccu

SEQ ID NO: 3888218 - RNA, 23 nt, Human
gcccugcuggccgccucaccccc

SEQ ID NO: 3888219 - RNA, 13 nt, Human
gcccugcugggga

SEQ ID NO: 3888220 - RNA, 12 nt, Human
gcccugcuguuu

SEQ ID NO: 3888221 - RNA, 19 nt, Human
gcccugcuuccugcuugcc

SEQ ID NO: 3888222 - RNA, 16 nt, Human
gcccugcuuucagaua

SEQ ID NO: 3888223 - RNA, 22 nt, Human
gcccuggacugugugcucagga

SEQ ID NO: 3888224 - RNA, 15 nt, Human
gcccuggagcagcca

SEQ ID NO: 3888225 - RNA, 19 nt, Human
gcccuggagccaacugcug

SEQ ID NO: 3888226 - RNA, 21 nt, Human
gcccuggagccaacugcugcu

SEQ ID NO: 3888227 - RNA, 14 nt, Human
gcccuggaggcggu

SEQ ID NO: 3888228 - RNA, 15 nt, Human
gcccuggaggcggug

SEQ ID NO: 3888229 - RNA, 18 nt, Human
gcccuggaggugccagca

SEQ ID NO: 3888230 - RNA, 20 nt, Human
gcccuggaggugccagcaaa

SEQ ID NO: 3888231 - RNA, 13 nt, Human
gcccuggaggugg

SEQ ID NO: 3888232 - RNA, 20 nt, Human
gcccuggagguggcugagcc

SEQ ID NO: 3888233 - RNA, 20 nt, Human
gcccuggaugcccaggaauc

SEQ ID NO: 3888234 - RNA, 18 nt, Human
gcccuggauuucagaaag

SEQ ID NO: 3888235 - RNA, 12 nt, Human
gcccuggcagga

SEQ ID NO: 3888236 - RNA, 15 nt, Human
gcccuggcaggcagg

SEQ ID NO: 3888237 - RNA, 16 nt, Human
gcccuggcaggcaggg

SEQ ID NO: 3888238 - RNA, 13 nt, Human
gcccuggccagag

SEQ ID NO: 3888239 - RNA, 13 nt, Human
gcccuggcccuga

SEQ ID NO: 3888240 - RNA, 17 nt, Human
gcccuggcccugaggug

SEQ ID NO: 3888241 - RNA, 18 nt, Human
gcccuggcccugaggugu

SEQ ID NO: 3888242 - RNA, 16 nt, Human
gcccuggccuccccug

SEQ ID NO: 3888243 - RNA, 14 nt, Human
gcccuggccugcug

SEQ ID NO: 3888244 - RNA, 12 nt, Human
gcccuggcucug

SEQ ID NO: 3888245 - RNA, 17 nt, Human
gcccuggcucugcuguc

SEQ ID NO: 3888246 - RNA, 15 nt, Human
gcccuggcugaagga

SEQ ID NO: 3888247 - RNA, 18 nt, Human
gcccuggcugaaggacug

SEQ ID NO: 3888248 - RNA, 20 nt, Human
gcccuggcugaaggacugug

SEQ ID NO: 3888249 - RNA, 11 nt, Human
gcccuggcugc

SEQ ID NO: 3888250 - RNA, 15 nt, Human
gcccuggcugcugcc

SEQ ID NO: 3888251 - RNA, 19 nt, Human
gcccuggcugcugccccca

SEQ ID NO: 3888252 - RNA, 15 nt, Human
gcccuggcuguucug

SEQ ID NO: 3888253 - RNA, 23 nt, Human
gcccugggaaaccccuucucugu

SEQ ID NO: 3888254 - RNA, 11 nt, Human
gcccugggagg

SEQ ID NO: 3888255 - RNA, 14 nt, Human
gcccugggaggcag

SEQ ID NO: 3888256 - RNA, 14 nt, Human
gcccugggaggcuc

SEQ ID NO: 3888257 - RNA, 15 nt, Human
gcccugggaggcucu

SEQ ID NO: 3888258 - RNA, 15 nt, Human
gcccugggccccacc

SEQ ID NO: 3888259 - RNA, 22 nt, Human
gcccugggccccaccaccuagg

SEQ ID NO: 3888260 - RNA, 13 nt, Human
gcccugggccugc

SEQ ID NO: 3888261 - RNA, 20 nt, Human
gcccugggccugccucacca

SEQ ID NO: 3888262 - RNA, 22 nt, Human
gcccugggccugccucaccacg

SEQ ID NO: 3888263 - RNA, 15 nt, Human
gcccugggcucggag

SEQ ID NO: 3888264 - RNA, 19 nt, Human
gcccugggcucggaggcug

SEQ ID NO: 3888265 - RNA, 21 nt, Human
gcccugggcucggaggcugcc

SEQ ID NO: 3888266 - RNA, 11 nt, Human
gcccugggcug

SEQ ID NO: 3888267 - RNA, 12 nt, Human
gcccugggcugg

SEQ ID NO: 3888268 - RNA, 14 nt, Human
gcccugggcuggaa

SEQ ID NO: 3888269 - RNA, 19 nt, Human
gcccuggggcugaucucag

SEQ ID NO: 3888270 - RNA, 13 nt, Human
gcccugguccagg

SEQ ID NO: 3888271 - RNA, 23 nt, Human
gcccugguccagggaagcuggcc

SEQ ID NO: 3888272 - RNA, 18 nt, Human
gcccugguccuuccaggc

SEQ ID NO: 3888273 - RNA, 15 nt, Human
gcccuggugcugcca

SEQ ID NO: 3888274 - RNA, 21 nt, Human
gcccuggugcugccacacuuc

SEQ ID NO: 3888275 - RNA, 13 nt, Human
gcccugguggaga

SEQ ID NO: 3888276 - RNA, 21 nt, Human
gcccugguggagaaagcacug

SEQ ID NO: 3888277 - RNA, 20 nt, Human
gcccugguggcagugggagc

SEQ ID NO: 3888278 - RNA, 21 nt, Human
gcccugguggcagugggagcu

SEQ ID NO: 3888279 - RNA, 22 nt, Human
gcccugguggcagugggagcug

SEQ ID NO: 3888280 - RNA, 14 nt, Human
gcccugguuuccug

SEQ ID NO: 3888281 - RNA, 18 nt, Human
gcccugguuuccugcccu

SEQ ID NO: 3888282 - RNA, 19 nt, Human
gcccugguuuccugcccug

SEQ ID NO: 3888283 - RNA, 20 nt, Human
gcccugguuuccugcccugg

SEQ ID NO: 3888284 - RNA, 23 nt, Human
gcccugguuuccugcccugggag

SEQ ID NO: 3888285 - RNA, 17 nt, Human
gcccugucccucccacc

SEQ ID NO: 3888286 - RNA, 20 nt, Human
gcccugucccucccaccucu

SEQ ID NO: 3888287 - RNA, 13 nt, Human
gcccuguccuggu

SEQ ID NO: 3888288 - RNA, 11 nt, Human
gcccugucugu

SEQ ID NO: 3888289 - RNA, 21 nt, Human
gcccugugcaaccucuuggcc

SEQ ID NO: 3888290 - RNA, 20 nt, Human
gcccugugccccuugacaac

SEQ ID NO: 3888291 - RNA, 16 nt, Human
gcccuguggaagggac

SEQ ID NO: 3888292 - RNA, 17 nt, Human
gcccuguggaagggacu

SEQ ID NO: 3888293 - RNA, 18 nt, Human
gcccugugggaccccagg

SEQ ID NO: 3888294 - RNA, 14 nt, Human
gcccugugugcagg

SEQ ID NO: 3888295 - RNA, 19 nt, Human
gcccuguugacacaggucu

SEQ ID NO: 3888296 - RNA, 21 nt, Human
gcccuguugacacaggucuuu

SEQ ID NO: 3888297 - RNA, 16 nt, Human
gcccuguugugccaca

SEQ ID NO: 3888298 - RNA, 20 nt, Human
gcccuguugugccacagagu

SEQ ID NO: 3888299 - RNA, 20 nt, Human
gcccuuacacuuacuguugu

SEQ ID NO: 3888300 - RNA, 16 nt, Human
gcccuuaccugccagg

SEQ ID NO: 3888301 - RNA, 22 nt, Human
gcccuuaccugccaggaagcca

SEQ ID NO: 3888302 - RNA, 14 nt, Human
gcccuuaccuuccc

SEQ ID NO: 3888303 - RNA, 19 nt, Human
gcccuuacuucuugcccug

SEQ ID NO: 3888304 - RNA, 22 nt, Human
gcccuuagcagggaaacagcua

SEQ ID NO: 3888305 - RNA, 15 nt, Human
gcccuuaguccccca

SEQ ID NO: 3888306 - RNA, 18 nt, Human
gcccuuagucccccaacu

SEQ ID NO: 3888307 - RNA, 18 nt, Human
gcccuuaucugugcucag

SEQ ID NO: 3888308 - RNA, 20 nt, Human
gcccuuaucugugcucagga

SEQ ID NO: 3888309 - RNA, 15 nt, Human
gcccuucaccccagu

SEQ ID NO: 3888310 - RNA, 21 nt, Human
gcccuucaccccaguggccac

SEQ ID NO: 3888311 - RNA, 19 nt, Human
gcccuucacugccuuugcu

SEQ ID NO: 3888312 - RNA, 20 nt, Human
gcccuucacugccuuugcuc

SEQ ID NO: 3888313 - RNA, 22 nt, Human
gccucaguccuccccucacagc

SEQ ID NO: 3888314 - RNA, 23 nt, Human
gccucaguccuccccucacagcc

SEQ ID NO: 3888315 - RNA, 22 nt, Human
gccucagucucccuucucccau

SEQ ID NO: 3888316 - RNA, 12 nt, Human
gccucagugcca

SEQ ID NO: 3888317 - RNA, 14 nt, Human
gccucaguguauuu

SEQ ID NO: 3888318 - RNA, 22 nt, Human
gccucauauuuaaagacaggga

SEQ ID NO: 3888319 - RNA, 21 nt, Human
gccucaucaucagagccuuuc

SEQ ID NO: 3888320 - RNA, 19 nt, Human
gccucauccgaggcagggu

SEQ ID NO: 3888321 - RNA, 16 nt, Human
gccucauguggcugga

SEQ ID NO: 3888322 - RNA, 21 nt, Human
gccucauuuagagaggaaaag

SEQ ID NO: 3888323 - RNA, 19 nt, Human
gccucauuuuuuuccuugc

SEQ ID NO: 3888324 - RNA, 21 nt, Human
gccucauuuuuuuccuugcaa

SEQ ID NO: 3888325 - RNA, 21 nt, Human
gccuccaaccccucgcccagu

SEQ ID NO: 3888326 - RNA, 12 nt, Human
gccuccacagcg

SEQ ID NO: 3888327 - RNA, 14 nt, Human
gccuccacagcgag

SEQ ID NO: 3888328 - RNA, 22 nt, Human
gccuccacagcgagggcagcug

SEQ ID NO: 3888329 - RNA, 23 nt, Human
gccuccacagcgagggcagcugc

SEQ ID NO: 3888330 - RNA, 18 nt, Human
gccuccaccaccacuggc

SEQ ID NO: 3888331 - RNA, 20 nt, Human
gccuccaccaccacuggcca

SEQ ID NO: 3888332 - RNA, 16 nt, Human
gccuccacccucugag

SEQ ID NO: 3888333 - RNA, 19 nt, Human
gccuccacccucugagcuu

SEQ ID NO: 3888334 - RNA, 18 nt, Human
gccuccaccgcugccuaa

SEQ ID NO: 3888335 - RNA, 12 nt, Human
gccuccacuccc

SEQ ID NO: 3888336 - RNA, 14 nt, Human
gccuccacucccac

SEQ ID NO: 3888337 - RNA, 15 nt, Human
gccuccacucccacu

SEQ ID NO: 3888338 - RNA, 18 nt, Human
gccuccacucccacuucc

SEQ ID NO: 3888339 - RNA, 14 nt, Human
gccuccagccucug

SEQ ID NO: 3888340 - RNA, 16 nt, Human
gccuccagccugccca

SEQ ID NO: 3888341 - RNA, 18 nt, Human
gccuccagccugcccaag

SEQ ID NO: 3888342 - RNA, 15 nt, Human
gccuccagcucagca

SEQ ID NO: 3888343 - RNA, 21 nt, Human
gccuccaggccacauggggcu

SEQ ID NO: 3888344 - RNA, 22 nt, Human
gccuccaggccacauggggcug

SEQ ID NO: 3888345 - RNA, 14 nt, Human
gccuccaggcccgu

SEQ ID NO: 3888346 - RNA, 14 nt, Human
gccuccagggcugg

SEQ ID NO: 3888347 - RNA, 16 nt, Human
gccuccagggcuggac

SEQ ID NO: 3888348 - RNA, 19 nt, Human
gccuccagggcuggacuga

SEQ ID NO: 3888349 - RNA, 22 nt, Human
gccuccagggcuggacugaggc

SEQ ID NO: 3888350 - RNA, 23 nt, Human
gccuccagggcuggacugaggcc

SEQ ID NO: 3888351 - RNA, 16 nt, Human
gccuccaggugcagag

SEQ ID NO: 3888352 - RNA, 17 nt, Human
gccuccaggugcagagg

SEQ ID NO: 3888353 - RNA, 15 nt, Human
gccuccauccugagg

SEQ ID NO: 3888354 - RNA, 16 nt, Human
gccuccauccugaggc

SEQ ID NO: 3888355 - RNA, 16 nt, Human
gccuccauggugccuc

SEQ ID NO: 3888356 - RNA, 18 nt, Human
gccuccauggugccucug

SEQ ID NO: 3888357 - RNA, 19 nt, Human
gccuccauggugccucugg

SEQ ID NO: 3888358 - RNA, 17 nt, Human
gccuccauuccuggagc

SEQ ID NO: 3888359 - RNA, 18 nt, Human
gccuccauuccuggagcc

SEQ ID NO: 3888360 - RNA, 16 nt, Human
gccuccauucugacca

SEQ ID NO: 3888361 - RNA, 23 nt, Human
gccucccaacaguggggaagagu

SEQ ID NO: 3888362 - RNA, 18 nt, Human
gccucccaacucacccca

SEQ ID NO: 3888363 - RNA, 20 nt, Human
gccucccaaggagaacaaau

SEQ ID NO: 3888364 - RNA, 14 nt, Human
gccucccacagugc

SEQ ID NO: 3888365 - RNA, 16 nt, Human
gccucccacagugcug

SEQ ID NO: 3888366 - RNA, 18 nt, Human
gccucccacccgaugcug

SEQ ID NO: 3888367 - RNA, 23 nt, Human
gccucccacccgaugcugcuuuc

SEQ ID NO: 3888368 - RNA, 10 nt, Human
gccucccagc

SEQ ID NO: 3888369 - RNA, 14 nt, Human
gccucccaucaccc

SEQ ID NO: 3888370 - RNA, 18 nt, Human
gccuccccaccuccaggc

SEQ ID NO: 3888371 - RNA, 19 nt, Human
gccuccccacggccgcucc

SEQ ID NO: 3888372 - RNA, 22 nt, Human
gccuccccacggccgcuccagg

SEQ ID NO: 3888373 - RNA, 18 nt, Human
gccuccccauuucccauc

SEQ ID NO: 3888374 - RNA, 11 nt, Human
gccucccccac

SEQ ID NO: 3888375 - RNA, 13 nt, Human
gccucccccacuu

SEQ ID NO: 3888376 - RNA, 21 nt, Human
gccucccccuagccauuuuua

SEQ ID NO: 3888377 - RNA, 11 nt, Human
gccuccccucc

SEQ ID NO: 3888378 - RNA, 13 nt, Human
gccuccccuccuc

SEQ ID NO: 3888379 - RNA, 14 nt, Human
gccuccccuccucu

SEQ ID NO: 3888380 - RNA, 19 nt, Human
gccuccccucuccuuccug

SEQ ID NO: 3888381 - RNA, 16 nt, Human
gccuccccugccacca

SEQ ID NO: 3888382 - RNA, 19 nt, Human
gccucccgaauagcuggga

SEQ ID NO: 3888383 - RNA, 19 nt, Human
gccucccgaguagcuggga

SEQ ID NO: 3888384 - RNA, 21 nt, Human
gccucccgaguagcugggacu

SEQ ID NO: 3888385 - RNA, 17 nt, Human
gccucccucacccugag

SEQ ID NO: 3888386 - RNA, 15 nt, Human
gccucccuccacccc

SEQ ID NO: 3888387 - RNA, 17 nt, Human
gccucccuccaccccag

SEQ ID NO: 3888388 - RNA, 19 nt, Human
gccucccuccccagugcaa

SEQ ID NO: 3888389 - RNA, 23 nt, Human
gccucccuccgcggcgggcccug

SEQ ID NO: 3888390 - RNA, 16 nt, Human
gccucccuccugcccc

SEQ ID NO: 3888391 - RNA, 22 nt, Human
gccucccucucucuucugcucc

SEQ ID NO: 3888392 - RNA, 14 nt, Human
gccucccucugacc

SEQ ID NO: 3888393 - RNA, 20 nt, Human
gccucccucugaccugcagg

SEQ ID NO: 3888394 - RNA, 21 nt, Human
gccucccucugaccugcaggc

SEQ ID NO: 3888395 - RNA, 18 nt, Human
gccucccugaagccuuug

SEQ ID NO: 3888396 - RNA, 19 nt, Human
gccucccugacccugcaga

SEQ ID NO: 3888397 - RNA, 16 nt, Human
gccucccugccucagg

SEQ ID NO: 3888398 - RNA, 13 nt, Human
gccucccugguga

SEQ ID NO: 3888399 - RNA, 13 nt, Human
gccucccugucca

SEQ ID NO: 3888400 - RNA, 15 nt, Human
gccucccuucaugca

SEQ ID NO: 3888401 - RNA, 18 nt, Human
gccucccuucaugcaugg

SEQ ID NO: 3888402 - RNA, 20 nt, Human
gccucccuucaugcauggaa

SEQ ID NO: 3888403 - RNA, 16 nt, Human
gccuccgagagggaga

SEQ ID NO: 3888404 - RNA, 14 nt, Human
gccuccggaagcug

SEQ ID NO: 3888405 - RNA, 17 nt, Human
gccuccggcgucagccu

SEQ ID NO: 3888406 - RNA, 15 nt, Human
gccuccgggaccccc

SEQ ID NO: 3888407 - RNA, 20 nt, Human
gccuccgucacuaccuggcu

SEQ ID NO: 3888408 - RNA, 20 nt, Human
gccuccuacagcccaccugg

SEQ ID NO: 3888409 - RNA, 21 nt, Human
gccuccucacccccagcuuug

SEQ ID NO: 3888410 - RNA, 15 nt, Human
gccuccucaucccgu

SEQ ID NO: 3888411 - RNA, 20 nt, Human
gccuccucccucccucuccg

SEQ ID NO: 3888412 - RNA, 13 nt, Human
gccuccuccugac

SEQ ID NO: 3888413 - RNA, 16 nt, Human
gccuccuccuucccaa

SEQ ID NO: 3888414 - RNA, 15 nt, Human
gccuccucguuccuu

SEQ ID NO: 3888415 - RNA, 19 nt, Human
gccuccucguuccuuucuc

SEQ ID NO: 3888416 - RNA, 16 nt, Human
gccuccucuaacaggg

SEQ ID NO: 3888417 - RNA, 13 nt, Human
gccuccucugucc

SEQ ID NO: 3888418 - RNA, 19 nt, Human
gccuccucugucugcccuu

SEQ ID NO: 3888419 - RNA, 21 nt, Human
gccuccucuucaccccggcag

SEQ ID NO: 3888420 - RNA, 21 nt, Human
gccuccugacacaccugcagc

SEQ ID NO: 3888421 - RNA, 16 nt, Human
gccuccugaccugagg

SEQ ID NO: 3888422 - RNA, 16 nt, Human
gccuccugaguagcug

SEQ ID NO: 3888423 - RNA, 12 nt, Human
gccuccugccca

SEQ ID NO: 3888424 - RNA, 18 nt, Human
gccuccugcccuuaccug

SEQ ID NO: 3888425 - RNA, 17 nt, Human
gccuccugccggcuccu

SEQ ID NO: 3888426 - RNA, 12 nt, Human
gccuccugccuc

SEQ ID NO: 3888427 - RNA, 13 nt, Human
gccuccugccucu

SEQ ID NO: 3888428 - RNA, 17 nt, Human
gccuccugccugccccu

SEQ ID NO: 3888429 - RNA, 14 nt, Human
gccuccuggguuca

SEQ ID NO: 3888430 - RNA, 17 nt, Human
gccuccuguggccugcc

SEQ ID NO: 3888431 - RNA, 18 nt, Human
gccuccuguggggaaagg

SEQ ID NO: 3888432 - RNA, 23 nt, Human
gccuccugugugugcgccuacag

SEQ ID NO: 3888433 - RNA, 16 nt, Human
gccuccuuccaccucc

SEQ ID NO: 3888434 - RNA, 20 nt, Human
gccuccuuccaccucccucc

SEQ ID NO: 3888435 - RNA, 18 nt, Human
gccuccuucugagcuccu

SEQ ID NO: 3888436 - RNA, 21 nt, Human
gccuccuucugagcuccuguc

SEQ ID NO: 3888437 - RNA, 20 nt, Human
gccuccuuugugaggaagcc

SEQ ID NO: 3888438 - RNA, 21 nt, Human
gccuccuuugugaggaagccg

SEQ ID NO: 3888439 - RNA, 22 nt, Human
gccuccuuugugaggaagccgc

SEQ ID NO: 3888440 - RNA, 15 nt, Human
gccucgaacuccugg

SEQ ID NO: 3888441 - RNA, 16 nt, Human
gccucgaacuggcugc

SEQ ID NO: 3888442 - RNA, 22 nt, Human
gccucgaacuggcugcaaaggg

SEQ ID NO: 3888443 - RNA, 18 nt, Human
gccucgcaacccgugcca

SEQ ID NO: 3888444 - RNA, 23 nt, Human
gccucgcaacccgugccaagucc

SEQ ID NO: 3888445 - RNA, 18 nt, Human
gccucgcaggccucccug

SEQ ID NO: 3888446 - RNA, 15 nt, Human
gccucgcccaccgca

SEQ ID NO: 3888447 - RNA, 16 nt, Human
gccucgcccaccgcau

SEQ ID NO: 3888448 - RNA, 13 nt, Human
gccucgccccugg

SEQ ID NO: 3888449 - RNA, 19 nt, Human
gccucgcuccccacucugc

SEQ ID NO: 3888450 - RNA, 20 nt, Human
gccucgcuccccacucugcu

SEQ ID NO: 3888451 - RNA, 20 nt, Human
gccucggacuuagcugggag

SEQ ID NO: 3888452 - RNA, 14 nt, Human
gccucggagccuca

SEQ ID NO: 3888453 - RNA, 18 nt, Human
gccucggccccucccaca

SEQ ID NO: 3888454 - RNA, 17 nt, Human
gccucggccucccaaag

SEQ ID NO: 3888455 - RNA, 14 nt, Human
gccucggcuccugc

SEQ ID NO: 3888456 - RNA, 15 nt, Human
gccucggcuccugcu

SEQ ID NO: 3888457 - RNA, 16 nt, Human
gccucggcuccugcug

SEQ ID NO: 3888458 - RNA, 17 nt, Human
gccucggcuggcucccc

SEQ ID NO: 3888459 - RNA, 18 nt, Human
gccucggcuuuucucagc

SEQ ID NO: 3888460 - RNA, 21 nt, Human
gccucgggacaccugcccugc

SEQ ID NO: 3888461 - RNA, 22 nt, Human
gccucgggacaccugcccugcc

SEQ ID NO: 3888462 - RNA, 17 nt, Human
gccucuaaccccaggcc

SEQ ID NO: 3888463 - RNA, 18 nt, Human
gccucuaaccccaggccc

SEQ ID NO: 3888464 - RNA, 23 nt, Human
gccucuaccugacacucccuugg

SEQ ID NO: 3888465 - RNA, 15 nt, Human
gccucuacugggaag

SEQ ID NO: 3888466 - RNA, 17 nt, Human
gccucuacugggaaggc

SEQ ID NO: 3888467 - RNA, 22 nt, Human
gccucuagagcagacuacagcu

SEQ ID NO: 3888468 - RNA, 15 nt, Human
gccucucacacacau

SEQ ID NO: 3888469 - RNA, 23 nt, Human
gccucucaccuguacucuuccga

SEQ ID NO: 3888470 - RNA, 22 nt, Human
gccucucagugcccuccagccc

SEQ ID NO: 3888471 - RNA, 19 nt, Human
gccucucaucaacugaaug

SEQ ID NO: 3888472 - RNA, 12 nt, Human
gccucucauccc

SEQ ID NO: 3888473 - RNA, 19 nt, Human
gccucucauuccagaggaa

SEQ ID NO: 3888474 - RNA, 21 nt, Human
gccucucauuccagaggaagg

SEQ ID NO: 3888475 - RNA, 14 nt, Human
gccucucccaggca

SEQ ID NO: 3888476 - RNA, 20 nt, Human
gccucuccccagguccagcu

SEQ ID NO: 3888477 - RNA, 13 nt, Human
gccucuccccuga

SEQ ID NO: 3888478 - RNA, 13 nt, Human
gccucucccguca

SEQ ID NO: 3888479 - RNA, 21 nt, Human
gccucucccuaggagaagagu

SEQ ID NO: 3888480 - RNA, 14 nt, Human
gccucucccuccuc

SEQ ID NO: 3888481 - RNA, 18 nt, Human
gccucucccugcugcucc

SEQ ID NO: 3888482 - RNA, 15 nt, Human
gccucucccuggccc

SEQ ID NO: 3888483 - RNA, 19 nt, Human
gccucuccgccccugagcc

SEQ ID NO: 3888484 - RNA, 22 nt, Human
gccucuccgccccugagcccac

SEQ ID NO: 3888485 - RNA, 16 nt, Human
gccucuccuuuguaua

SEQ ID NO: 3888486 - RNA, 16 nt, Human
gccucucucccagucu

SEQ ID NO: 3888487 - RNA, 13 nt, Human
gccucucucccuc

SEQ ID NO: 3888488 - RNA, 14 nt, Human
gccucucugcaggu

SEQ ID NO: 3888489 - RNA, 19 nt, Human
gccucucugcaggucccua

SEQ ID NO: 3888490 - RNA, 21 nt, Human
gccucucugcaggucccuaau

SEQ ID NO: 3888491 - RNA, 12 nt, Human
gccucucuggcc

SEQ ID NO: 3888492 - RNA, 13 nt, Human
gccucucuggccu

SEQ ID NO: 3888493 - RNA, 18 nt, Human
gccucucuggccucccac

SEQ ID NO: 3888494 - RNA, 23 nt, Human
gccucucuggccucccacccgau

SEQ ID NO: 3888495 - RNA, 21 nt, Human
gccucucuuccuaucccaucc

SEQ ID NO: 3888496 - RNA, 19 nt, Human
gccucucuugguuuccuuc

SEQ ID NO: 3888497 - RNA, 18 nt, Human
gccucugaaguuggacag

SEQ ID NO: 3888498 - RNA, 14 nt, Human
gccucugaccccuc

SEQ ID NO: 3888499 - RNA, 15 nt, Human
gccucugaccccucc

SEQ ID NO: 3888500 - RNA, 16 nt, Human
gccucugaccccuccu

SEQ ID NO: 3888501 - RNA, 18 nt, Human
gccucugaccccuccuca

SEQ ID NO: 3888502 - RNA, 20 nt, Human
gccucugaccccuccucacu

SEQ ID NO: 3888503 - RNA, 22 nt, Human
gccucugaccccuccucacugg

SEQ ID NO: 3888504 - RNA, 19 nt, Human
gccucugagaagcucugaa

SEQ ID NO: 3888505 - RNA, 14 nt, Human
gccucugagagcau

SEQ ID NO: 3888506 - RNA, 15 nt, Human
gccucugagauuugg

SEQ ID NO: 3888507 - RNA, 18 nt, Human
gccucugauaugggacug

SEQ ID NO: 3888508 - RNA, 19 nt, Human
gccucugauaugggacuga

SEQ ID NO: 3888509 - RNA, 15 nt, Human
gccucugcacucccc

SEQ ID NO: 3888510 - RNA, 16 nt, Human
gccucugcacuccccu

SEQ ID NO: 3888511 - RNA, 18 nt, Human
gccucugcacuccccugc

SEQ ID NO: 3888512 - RNA, 19 nt, Human
gccucugcacuccccugcu

SEQ ID NO: 3888513 - RNA, 23 nt, Human
gccucugccaaaggaugugauau

SEQ ID NO: 3888514 - RNA, 19 nt, Human
gccucugccacacucugac

SEQ ID NO: 3888515 - RNA, 12 nt, Human
gccucugccucu

SEQ ID NO: 3888516 - RNA, 13 nt, Human
gccucugccucug

SEQ ID NO: 3888517 - RNA, 12 nt, Human
gccucugccugu

SEQ ID NO: 3888518 - RNA, 13 nt, Human
gccucugccuguc

SEQ ID NO: 3888519 - RNA, 15 nt, Human
gccucugccuuagag

SEQ ID NO: 3888520 - RNA, 19 nt, Human
gccucugcggagcacacug

SEQ ID NO: 3888521 - RNA, 18 nt, Human
gccucugcugauccuccc

SEQ ID NO: 3888522 - RNA, 19 nt, Human
gccucugcugauccuccca

SEQ ID NO: 3888523 - RNA, 11 nt, Human
gccucugcugc

SEQ ID NO: 3888524 - RNA, 23 nt, Human
gccucuggcuagaggccagcccc

SEQ ID NO: 3888525 - RNA, 12 nt, Human
gccucugggacu

SEQ ID NO: 3888526 - RNA, 14 nt, Human
gccucugggacugg

SEQ ID NO: 3888527 - RNA, 13 nt, Human
gccucugggccuc

SEQ ID NO: 3888528 - RNA, 22 nt, Human
gccucugggucagugguccaca

SEQ ID NO: 3888529 - RNA, 22 nt, Human
gccucugucccggaagagucau

SEQ ID NO: 3888530 - RNA, 17 nt, Human
gccucugucuagcaugc

SEQ ID NO: 3888531 - RNA, 22 nt, Human
gccucugucuagcaugccaaca

SEQ ID NO: 3888532 - RNA, 18 nt, Human
gccucugucuucuggacu

SEQ ID NO: 3888533 - RNA, 19 nt, Human
gccucugucuucuggacug

SEQ ID NO: 3888534 - RNA, 12 nt, Human
gccucugugcug

SEQ ID NO: 3888535 - RNA, 16 nt, Human
gccucugugucacugg

SEQ ID NO: 3888536 - RNA, 19 nt, Human
gccucugugucacuggcug

SEQ ID NO: 3888537 - RNA, 15 nt, Human
gccucuguguccuuc

SEQ ID NO: 3888538 - RNA, 18 nt, Human
gccucuguguccuucccu

SEQ ID NO: 3888539 - RNA, 19 nt, Human
gccucuuaaagcugccugu

SEQ ID NO: 3888540 - RNA, 22 nt, Human
gccucuuaaagcugccuguagu

SEQ ID NO: 3888541 - RNA, 17 nt, Human
gccucuuacuaauguaa

SEQ ID NO: 3888542 - RNA, 19 nt, Human
gccucuuagacuucugcuu

SEQ ID NO: 3888543 - RNA, 17 nt, Human
gccucuuaugggcuggg

SEQ ID NO: 3888544 - RNA, 17 nt, Human
gccucuucaaauuagaa

SEQ ID NO: 3888545 - RNA, 14 nt, Human
gccucuucccccug

SEQ ID NO: 3888546 - RNA, 12 nt, Human
gccucuuccucc

SEQ ID NO: 3888547 - RNA, 12 nt, Human
gccucuucucua

SEQ ID NO: 3888548 - RNA, 22 nt, Human
gccucuugaccaggcugccucc

SEQ ID NO: 3888549 - RNA, 20 nt, Human
gccucuugagcaguggcugg

SEQ ID NO: 3888550 - RNA, 19 nt, Human
gccucuuggaccucugcuc

SEQ ID NO: 3888551 - RNA, 20 nt, Human
gccucuuggaccucugcucu

SEQ ID NO: 3888552 - RNA, 21 nt, Human
gccucuuggaccucugcucug

SEQ ID NO: 3888553 - RNA, 20 nt, Human
gccucuuggagaccuuaccc

SEQ ID NO: 3888554 - RNA, 18 nt, Human
gccucuuguaaagacugg

SEQ ID NO: 3888555 - RNA, 23 nt, Human
gccucuuguaucccuagugcucc

SEQ ID NO: 3888556 - RNA, 12 nt, Human
gccucuuucccu

SEQ ID NO: 3888557 - RNA, 17 nt, Human
gccucuuucccuuccag

SEQ ID NO: 3888558 - RNA, 19 nt, Human
gccucuuugucuaaaacaa

SEQ ID NO: 3888559 - RNA, 18 nt, Human
gccucuuuuaccugcugc

SEQ ID NO: 3888560 - RNA, 12 nt, Human
gccucuuuucuc

SEQ ID NO: 3888561 - RNA, 16 nt, Human
gccugaaauccugguu

SEQ ID NO: 3888562 - RNA, 14 nt, Human
gccugaacauccuu

SEQ ID NO: 3888563 - RNA, 21 nt, Human
gccugaacauccuuccuuccc

SEQ ID NO: 3888564 - RNA, 15 nt, Human
gccugaaccuuccau

SEQ ID NO: 3888565 - RNA, 17 nt, Human
gccugaacuccugccau

SEQ ID NO: 3888566 - RNA, 20 nt, Human
gccugaagaguccucugaau

SEQ ID NO: 3888567 - RNA, 16 nt, Human
gccugaagccagcugc

SEQ ID NO: 3888568 - RNA, 17 nt, Human
gccugaaggggcgucug

SEQ ID NO: 3888569 - RNA, 15 nt, Human
gccugaagucacaca

SEQ ID NO: 3888570 - RNA, 16 nt, Human
gccugaagucacacag

SEQ ID NO: 3888571 - RNA, 22 nt, Human
gccugaagucacacagugaguc

SEQ ID NO: 3888572 - RNA, 18 nt, Human
gccugaaguuggagugag

SEQ ID NO: 3888573 - RNA, 12 nt, Human
gccugaauaaag

SEQ ID NO: 3888574 - RNA, 16 nt, Human
gccugaauaaagagcc

SEQ ID NO: 3888575 - RNA, 23 nt, Human
gccugaauaaagagcccuaaguu

SEQ ID NO: 3888576 - RNA, 18 nt, Human
gccugaaucaugagccug

SEQ ID NO: 3888577 - RNA, 21 nt, Human
gccugaaucaugagccugcug

SEQ ID NO: 3888578 - RNA, 22 nt, Human
gccugaaugcuuauagguggcc

SEQ ID NO: 3888579 - RNA, 21 nt, Human
gccugacaaccacuggucugu

SEQ ID NO: 3888580 - RNA, 13 nt, Human
gccugacagaaac

SEQ ID NO: 3888581 - RNA, 17 nt, Human
gccugacagccagaacu

SEQ ID NO: 3888582 - RNA, 17 nt, Human
gccugacccucaucuuu

SEQ ID NO: 3888583 - RNA, 13 nt, Human
gccugaccuugag

SEQ ID NO: 3888584 - RNA, 19 nt, Human
gccugacuagggagccaug

SEQ ID NO: 3888585 - RNA, 14 nt, Human
gccugacuccccca

SEQ ID NO: 3888586 - RNA, 17 nt, Human
gccugacugccaagcca

SEQ ID NO: 3888587 - RNA, 14 nt, Human
gccugacugcucag

SEQ ID NO: 3888588 - RNA, 13 nt, Human
gccugagacccag

SEQ ID NO: 3888589 - RNA, 14 nt, Human
gccugagacccagg

SEQ ID NO: 3888590 - RNA, 13 nt, Human
gccugagaggcag

SEQ ID NO: 3888591 - RNA, 15 nt, Human
gccugagaggcaggc

SEQ ID NO: 3888592 - RNA, 19 nt, Human
gccugagaggcaggcauag

SEQ ID NO: 3888593 - RNA, 22 nt, Human
gccugagaggcaggcauagagg

SEQ ID NO: 3888594 - RNA, 16 nt, Human
gccugagaggggaagc

SEQ ID NO: 3888595 - RNA, 13 nt, Human
gccugagaguauu

SEQ ID NO: 3888596 - RNA, 18 nt, Human
gccugagauuucaucugc

SEQ ID NO: 3888597 - RNA, 22 nt, Human
gccugagcaacagagugagacc

SEQ ID NO: 3888598 - RNA, 17 nt, Human
gccugagcaccucccag

SEQ ID NO: 3888599 - RNA, 18 nt, Human
gccugagcaccucccagc

SEQ ID NO: 3888600 - RNA, 19 nt, Human
gccugagcaccucccagcc

SEQ ID NO: 3888601 - RNA, 18 nt, Human
gccugagcaguccuuggc

SEQ ID NO: 3888602 - RNA, 13 nt, Human
gcuccuguggccc

SEQ ID NO: 3888603 - RNA, 18 nt, Human
gcuccuguuagcuccuca

SEQ ID NO: 3888604 - RNA, 21 nt, Human
gcuccuuaggguuuucucucu

SEQ ID NO: 3888605 - RNA, 22 nt, Human
gcuccuuaggguuuucucucua

SEQ ID NO: 3888606 - RNA, 18 nt, Human
gcuccuucccaucgcugu

SEQ ID NO: 3888607 - RNA, 14 nt, Human
gcuccuuccuggag

SEQ ID NO: 3888608 - RNA, 13 nt, Human
gcuccuucugucc

SEQ ID NO: 3888609 - RNA, 21 nt, Human
gcuccuucuguccuacucugu

SEQ ID NO: 3888610 - RNA, 13 nt, Human
gcuccuugggagg

SEQ ID NO: 3888611 - RNA, 16 nt, Human
gcuccuugggaggaag

SEQ ID NO: 3888612 - RNA, 19 nt, Human
gcuccuugggaggaagcag

SEQ ID NO: 3888613 - RNA, 22 nt, Human
gcuccuugggaggaagcagaau

SEQ ID NO: 3888614 - RNA, 23 nt, Human
gcuccuugggaggaagcagaaua

SEQ ID NO: 3888615 - RNA, 14 nt, Human
gcuccuugggaggc

SEQ ID NO: 3888616 - RNA, 22 nt, Human
gcuccuugggaggccccacugg

SEQ ID NO: 3888617 - RNA, 14 nt, Human
gcuccuugggcccu

SEQ ID NO: 3888618 - RNA, 14 nt, Human
gcuccuuucuccag

SEQ ID NO: 3888619 - RNA, 12 nt, Human
gcuccuuucuga

SEQ ID NO: 3888620 - RNA, 18 nt, Human
gcuccuuuuucucccucu

SEQ ID NO: 3888621 - RNA, 20 nt, Human
gcuccuuuuucucccucugg

SEQ ID NO: 3888622 - RNA, 14 nt, Human
gcucgaaaacaauu

SEQ ID NO: 3888623 - RNA, 16 nt, Human
gcucgaaucucugugc

SEQ ID NO: 3888624 - RNA, 19 nt, Human
gcucgaaucucugugccuu

SEQ ID NO: 3888625 - RNA, 21 nt, Human
gcucgagcaguccugccucag

SEQ ID NO: 3888626 - RNA, 17 nt, Human
gcucgaugcagacaggg

SEQ ID NO: 3888627 - RNA, 20 nt, Human
gcucgauguggucacagcug

SEQ ID NO: 3888628 - RNA, 16 nt, Human
gcucgcaccccccugu

SEQ ID NO: 3888629 - RNA, 21 nt, Human
gcucgcaccccccuguucuaa

SEQ ID NO: 3888630 - RNA, 20 nt, Human
gcucgcccuccuuucugugc

SEQ ID NO: 3888631 - RNA, 17 nt, Human
gcucgccuucccuccug

SEQ ID NO: 3888632 - RNA, 21 nt, Human
gcucgccuucccuccugcuuu

SEQ ID NO: 3888633 - RNA, 22 nt, Human
gcucgccuucccuccugcuuug

SEQ ID NO: 3888634 - RNA, 13 nt, Human
gcucgcucccugc

SEQ ID NO: 3888635 - RNA, 13 nt, Human
gcucgcuguugcu

SEQ ID NO: 3888636 - RNA, 19 nt, Human
gcucggaggccccaaagga

SEQ ID NO: 3888637 - RNA, 14 nt, Human
gcucggccugcccc

SEQ ID NO: 3888638 - RNA, 13 nt, Human
gcucgggcccagg

SEQ ID NO: 3888639 - RNA, 14 nt, Human
gcucgggcccaggc

SEQ ID NO: 3888640 - RNA, 16 nt, Human
gcucggggugcacagg

SEQ ID NO: 3888641 - RNA, 19 nt, Human
gcucggggugcacaggagg

SEQ ID NO: 3888642 - RNA, 21 nt, Human
gcucggggugcacaggagggg

SEQ ID NO: 3888643 - RNA, 18 nt, Human
gcucgguggacccaggga

SEQ ID NO: 3888644 - RNA, 19 nt, Human
gcucguccccaagugaccu

SEQ ID NO: 3888645 - RNA, 14 nt, Human
gcucuaaaagguaa

SEQ ID NO: 3888646 - RNA, 20 nt, Human
gcucuaaaagguaaugugug

SEQ ID NO: 3888647 - RNA, 23 nt, Human
gcucuaaaagguaauguguggau

SEQ ID NO: 3888648 - RNA, 15 nt, Human
gcucuaacagcccuc

SEQ ID NO: 3888649 - RNA, 15 nt, Human
gcucuaacgccugag

SEQ ID NO: 3888650 - RNA, 21 nt, Human
gcucuaacgccugagcccagg

SEQ ID NO: 3888651 - RNA, 22 nt, Human
gcucuaacgccugagcccaggg

SEQ ID NO: 3888652 - RNA, 15 nt, Human
gcucuaagucucaac

SEQ ID NO: 3888653 - RNA, 18 nt, Human
gcucuaauguuugcauau

SEQ ID NO: 3888654 - RNA, 16 nt, Human
gcucuacaucuucugc

SEQ ID NO: 3888655 - RNA, 15 nt, Human
gcucuacccagggcc

SEQ ID NO: 3888656 - RNA, 19 nt, Human
gcucuacccagggccugca

SEQ ID NO: 3888657 - RNA, 19 nt, Human
gcucuacugaggugcuaug

SEQ ID NO: 3888658 - RNA, 23 nt, Human
gcucuacuuccccauggcccuga

SEQ ID NO: 3888659 - RNA, 19 nt, Human
gcucuagacaacccugcaa

SEQ ID NO: 3888660 - RNA, 14 nt, Human
gcucuagaugagcu

SEQ ID NO: 3888661 - RNA, 18 nt, Human
gcucuagaugagcugggc

SEQ ID NO: 3888662 - RNA, 23 nt, Human
gcucuagauugagagaagagaca

SEQ ID NO: 3888663 - RNA, 23 nt, Human
gcucuaggguugcuggagccuga

SEQ ID NO: 3888664 - RNA, 19 nt, Human
gcucuagguacgaugacag

SEQ ID NO: 3888665 - RNA, 14 nt, Human
gcucuagguggggc

SEQ ID NO: 3888666 - RNA, 12 nt, Human
gcucuagugccu

SEQ ID NO: 3888667 - RNA, 14 nt, Human
gcucuagugggaag

SEQ ID NO: 3888668 - RNA, 19 nt, Human
gcucuaucuugcucuguaa

SEQ ID NO: 3888669 - RNA, 13 nt, Human
gcucuaugagucu

SEQ ID NO: 3888670 - RNA, 18 nt, Human
gcucuaugggcagaucua

SEQ ID NO: 3888671 - RNA, 16 nt, Human
gcucuauguuuacaaa

SEQ ID NO: 3888672 - RNA, 18 nt, Human
gcucuauuaugaauguga

SEQ ID NO: 3888673 - RNA, 18 nt, Human
gcucucaaguuaucaggg

SEQ ID NO: 3888674 - RNA, 19 nt, Human
gcucucaccuugguuccug

SEQ ID NO: 3888675 - RNA, 21 nt, Human
gcucucacggccacacagcug

SEQ ID NO: 3888676 - RNA, 10 nt, Human
gcucucagcc

SEQ ID NO: 3888677 - RNA, 21 nt, Human
gcucucaggccagcugcuugg

SEQ ID NO: 3888678 - RNA, 17 nt, Human
gcucuccaaaccacuuu

SEQ ID NO: 3888679 - RNA, 17 nt, Human
gcucuccaccucagccu

SEQ ID NO: 3888680 - RNA, 18 nt, Human
gcucuccaccucagccuu

SEQ ID NO: 3888681 - RNA, 19 nt, Human
gcucuccaccucagccuug

SEQ ID NO: 3888682 - RNA, 21 nt, Human
gcucuccaccucagccuugga

SEQ ID NO: 3888683 - RNA, 20 nt, Human
gcucuccagucaggaggcau

SEQ ID NO: 3888684 - RNA, 19 nt, Human
gcucuccauucaauuucag

SEQ ID NO: 3888685 - RNA, 17 nt, Human
gcucucccauuuccuga

SEQ ID NO: 3888686 - RNA, 14 nt, Human
gcucucccucuucu

SEQ ID NO: 3888687 - RNA, 22 nt, Human
gcucuccggggccauuugcaau

SEQ ID NO: 3888688 - RNA, 13 nt, Human
gcucuccucuucu

SEQ ID NO: 3888689 - RNA, 19 nt, Human
gcucuccucuugccacugc

SEQ ID NO: 3888690 - RNA, 22 nt, Human
gcucuccucuugccacugccuc

SEQ ID NO: 3888691 - RNA, 15 nt, Human
gcucuccuggcuucc

SEQ ID NO: 3888692 - RNA, 17 nt, Human
gcucuccuggcuuccca

SEQ ID NO: 3888693 - RNA, 21 nt, Human
gcucucggaacugcaugcugc

SEQ ID NO: 3888694 - RNA, 13 nt, Human
gcucucuacccag

SEQ ID NO: 3888695 - RNA, 17 nt, Human
gcucucuacccagccca

SEQ ID NO: 3888696 - RNA, 15 nt, Human
gcucucuaggccucu

SEQ ID NO: 3888697 - RNA, 14 nt, Human
gcucucugcagcca

SEQ ID NO: 3888698 - RNA, 19 nt, Human
gcucucugcagccagccca

SEQ ID NO: 3888699 - RNA, 20 nt, Human
gcucucugcagccagcccag

SEQ ID NO: 3888700 - RNA, 21 nt, Human
gcucucugcagccagcccagc

SEQ ID NO: 3888701 - RNA, 15 nt, Human
gcucucugcccugug

SEQ ID NO: 3888702 - RNA, 18 nt, Human
gcucucugcccuguguac

SEQ ID NO: 3888703 - RNA, 13 nt, Human
gcucucuggccuu

SEQ ID NO: 3888704 - RNA, 19 nt, Human
gcucucuggccuucggccu

SEQ ID NO: 3888705 - RNA, 20 nt, Human
gcucucuggccuucggccuc

SEQ ID NO: 3888706 - RNA, 14 nt, Human
gcucucuuccugcc

SEQ ID NO: 3888707 - RNA, 20 nt, Human
gcucucuuccugccccucuu

SEQ ID NO: 3888708 - RNA, 22 nt, Human
gcucucuuuuucuccaggguca

SEQ ID NO: 3888709 - RNA, 17 nt, Human
gcucugaaagccagcug

SEQ ID NO: 3888710 - RNA, 17 nt, Human
gcucugaaaucuccuuu

SEQ ID NO: 3888711 - RNA, 19 nt, Human
gcucugaagcaaggcggug

SEQ ID NO: 3888712 - RNA, 20 nt, Human
gcucugacagaaagcagaua

SEQ ID NO: 3888713 - RNA, 21 nt, Human
gcucugaccacuugaggccug

SEQ ID NO: 3888714 - RNA, 15 nt, Human
gcucugacccaguga

SEQ ID NO: 3888715 - RNA, 15 nt, Human
gcucugagaggcccu

SEQ ID NO: 3888716 - RNA, 20 nt, Human
gcucugagaggcccuggauc

SEQ ID NO: 3888717 - RNA, 21 nt, Human
gcucugagagucuagauucuc

SEQ ID NO: 3888718 - RNA, 13 nt, Human
gcucugagccagu

SEQ ID NO: 3888719 - RNA, 16 nt, Human
gcucugagccaguuca

SEQ ID NO: 3888720 - RNA, 14 nt, Human
gcucugagcuguca

SEQ ID NO: 3888721 - RNA, 9 nt, Human
gcucugagg

SEQ ID NO: 3888722 - RNA, 18 nt, Human
gcucugaggacugcacca

SEQ ID NO: 3888723 - RNA, 20 nt, Human
gcucugaggcgccccaaccc

SEQ ID NO: 3888724 - RNA, 20 nt, Human
gcucugaggcuuccagagag

SEQ ID NO: 3888725 - RNA, 21 nt, Human
gcucugaggcuuccagagagu

SEQ ID NO: 3888726 - RNA, 17 nt, Human
gcucugagggaaagggc

SEQ ID NO: 3888727 - RNA, 23 nt, Human
gcucugaucauccacugugccau

SEQ ID NO: 3888728 - RNA, 22 nt, Human
gcucugaucccucuacagagcu

SEQ ID NO: 3888729 - RNA, 13 nt, Human
gcucugaugaaaa

SEQ ID NO: 3888730 - RNA, 16 nt, Human
gcucugaugcaucaga

SEQ ID NO: 3888731 - RNA, 18 nt, Human
gcucugcaauuccccucu

SEQ ID NO: 3888732 - RNA, 17 nt, Human
gcucugcaccccucugc

SEQ ID NO: 3888733 - RNA, 15 nt, Human
gcucugcagcccagg

SEQ ID NO: 3888734 - RNA, 18 nt, Human
gcucugcagcccagggac

SEQ ID NO: 3888735 - RNA, 19 nt, Human
gcucugcagcccagggacc

SEQ ID NO: 3888736 - RNA, 15 nt, Human
gcucugcaggcaccu

SEQ ID NO: 3888737 - RNA, 16 nt, Human
gcucugcaggcaccuu

SEQ ID NO: 3888738 - RNA, 16 nt, Human
gcucugcaugcggccc

SEQ ID NO: 3888739 - RNA, 19 nt, Human
gcucugcaugcggcccagc

SEQ ID NO: 3888740 - RNA, 20 nt, Human
gcucugcaugcggcccagcc

SEQ ID NO: 3888741 - RNA, 22 nt, Human
gcucugcaugcggcccagcccg

SEQ ID NO: 3888742 - RNA, 22 nt, Human
gcucugccaacuucuucagagc

SEQ ID NO: 3888743 - RNA, 22 nt, Human
gcucugccacccuaccuguuca

SEQ ID NO: 3888744 - RNA, 23 nt, Human
gcucugccacccuaccuguucag

SEQ ID NO: 3888745 - RNA, 13 nt, Human
gcucugccagucc

SEQ ID NO: 3888746 - RNA, 22 nt, Human
gcugcaggaaucuuuaaaagau

SEQ ID NO: 3888747 - RNA, 20 nt, Human
gcugcaggcuuugccauugu

SEQ ID NO: 3888748 - RNA, 17 nt, Human
gcugcagggcuuuaaaa

SEQ ID NO: 3888749 - RNA, 12 nt, Human
gcugcaggggcu

SEQ ID NO: 3888750 - RNA, 13 nt, Human
gcugcaggggcuc

SEQ ID NO: 3888751 - RNA, 21 nt, Human
gcugcaggggcucuggagaga

SEQ ID NO: 3888752 - RNA, 16 nt, Human
gcugcaguaggggagg

SEQ ID NO: 3888753 - RNA, 20 nt, Human
gcugcagugacgugcaccug

SEQ ID NO: 3888754 - RNA, 21 nt, Human
gcugcaguucuacucaggcug

SEQ ID NO: 3888755 - RNA, 18 nt, Human
gcugcaguugccagucac

SEQ ID NO: 3888756 - RNA, 20 nt, Human
gcugcaguugccagucaccc

SEQ ID NO: 3888757 - RNA, 21 nt, Human
gcugcaguuuugcuaucuggg

SEQ ID NO: 3888758 - RNA, 16 nt, Human
gcugcauacccgggca

SEQ ID NO: 3888759 - RNA, 13 nt, Human
gcugcauagaagg

SEQ ID NO: 3888760 - RNA, 22 nt, Human
gcugcaucuuauagcacuuuga

SEQ ID NO: 3888761 - RNA, 13 nt, Human
gcugcaugauguu

SEQ ID NO: 3888762 - RNA, 19 nt, Human
gcugcaugauguuugccca

SEQ ID NO: 3888763 - RNA, 14 nt, Human
gcugcaugccuggu

SEQ ID NO: 3888764 - RNA, 13 nt, Human
gcugccaaaugcg

SEQ ID NO: 3888765 - RNA, 14 nt, Human
gcugccaagcccca

SEQ ID NO: 3888766 - RNA, 16 nt, Human
gcugccaaggccagag

SEQ ID NO: 3888767 - RNA, 17 nt, Human
gcugccaaggccagagu

SEQ ID NO: 3888768 - RNA, 22 nt, Human
gcugccaaggccagaguggccu

SEQ ID NO: 3888769 - RNA, 14 nt, Human
gcugccaauauccu

SEQ ID NO: 3888770 - RNA, 16 nt, Human
gcugccaauauccuaa

SEQ ID NO: 3888771 - RNA, 20 nt, Human
gcugccaauauccuaauaaa

SEQ ID NO: 3888772 - RNA, 15 nt, Human
gcugccaaugggagc

SEQ ID NO: 3888773 - RNA, 16 nt, Human
gcugccacaccugagc

SEQ ID NO: 3888774 - RNA, 14 nt, Human
gcugccacccaccu

SEQ ID NO: 3888775 - RNA, 21 nt, Human
gcugccacccaccucccugcc

SEQ ID NO: 3888776 - RNA, 12 nt, Human
gcugccaccugc

SEQ ID NO: 3888777 - RNA, 19 nt, Human
gcugccagccgagauagcc

SEQ ID NO: 3888778 - RNA, 21 nt, Human
gcugccagccgagauagccaa

SEQ ID NO: 3888779 - RNA, 16 nt, Human
gcugccagccuugagc

SEQ ID NO: 3888780 - RNA, 23 nt, Human
gcugccagccuugagcccuggcu

SEQ ID NO: 3888781 - RNA, 14 nt, Human
gcugccagugccug

SEQ ID NO: 3888782 - RNA, 17 nt, Human
gcugccauccagguuca

SEQ ID NO: 3888783 - RNA, 18 nt, Human
gcugccauuugauuuuuc

SEQ ID NO: 3888784 - RNA, 18 nt, Human
gcugcccacuguuucucu

SEQ ID NO: 3888785 - RNA, 18 nt, Human
gcugcccaggggagcccu

SEQ ID NO: 3888786 - RNA, 17 nt, Human
gcugcccaucauguggc

SEQ ID NO: 3888787 - RNA, 21 nt, Human
gcugcccaucauguggcccca

SEQ ID NO: 3888788 - RNA, 16 nt, Human
gcugccccaaccugcu

SEQ ID NO: 3888789 - RNA, 19 nt, Human
gcugccccacagguguguu

SEQ ID NO: 3888790 - RNA, 23 nt, Human
gcugccccaucuccccucagcuc

SEQ ID NO: 3888791 - RNA, 19 nt, Human
gcugccccaugaagccaca

SEQ ID NO: 3888792 - RNA, 21 nt, Human
gcugccccaugaagccacagc

SEQ ID NO: 3888793 - RNA, 23 nt, Human
gcugccccauuuauccaccucca

SEQ ID NO: 3888794 - RNA, 14 nt, Human
gcugcccccgcuca

SEQ ID NO: 3888795 - RNA, 21 nt, Human
gcugcccccgcucaugggccc

SEQ ID NO: 3888796 - RNA, 18 nt, Human
gcugcccccggcccccug

SEQ ID NO: 3888797 - RNA, 20 nt, Human
gcugcccccggcccccuggu

SEQ ID NO: 3888798 - RNA, 16 nt, Human
gcugccccggccccuc

SEQ ID NO: 3888799 - RNA, 18 nt, Human
gcugccccucccugccag

SEQ ID NO: 3888800 - RNA, 16 nt, Human
gcugccccucucuggg

SEQ ID NO: 3888801 - RNA, 13 nt, Human
gcugcccgcuccc

SEQ ID NO: 3888802 - RNA, 14 nt, Human
gcugcccgcuccca

SEQ ID NO: 3888803 - RNA, 19 nt, Human
gcugcccgcucccaguguc

SEQ ID NO: 3888804 - RNA, 19 nt, Human
gcugcccggcgcccucugu

SEQ ID NO: 3888805 - RNA, 16 nt, Human
gcugcccgucuucagc

SEQ ID NO: 3888806 - RNA, 20 nt, Human
gcugcccgucuucagccuag

SEQ ID NO: 3888807 - RNA, 21 nt, Human
gcugcccuaaauaacccuuca

SEQ ID NO: 3888808 - RNA, 16 nt, Human
gcugcccuaggcuccg

SEQ ID NO: 3888809 - RNA, 18 nt, Human
gcugcccuaugggccugc

SEQ ID NO: 3888810 - RNA, 21 nt, Human
gcugcccuccuuguccaccca

SEQ ID NO: 3888811 - RNA, 15 nt, Human
gcugcccucuccugg

SEQ ID NO: 3888812 - RNA, 12 nt, Human
gcugcccugaga

SEQ ID NO: 3888813 - RNA, 22 nt, Human
gcugcccugagaagcugcucca

SEQ ID NO: 3888814 - RNA, 19 nt, Human
gcugcccuggugcugccac

SEQ ID NO: 3888815 - RNA, 12 nt, Human
gcugcccuguga

SEQ ID NO: 3888816 - RNA, 13 nt, Human
gcugcccuugggc

SEQ ID NO: 3888817 - RNA, 17 nt, Human
gcugccgaccagagccc

SEQ ID NO: 3888818 - RNA, 15 nt, Human
gcugccgcaccccag

SEQ ID NO: 3888819 - RNA, 18 nt, Human
gcugccgcaccccagagu

SEQ ID NO: 3888820 - RNA, 15 nt, Human
gcugccgggccugau

SEQ ID NO: 3888821 - RNA, 17 nt, Human
gcugccuagcaagcugg

SEQ ID NO: 3888822 - RNA, 19 nt, Human
gcugccuagcaagcuggcc

SEQ ID NO: 3888823 - RNA, 18 nt, Human
gcugccuauugauuuaag

SEQ ID NO: 3888824 - RNA, 13 nt, Human
gcugccucaugcu

SEQ ID NO: 3888825 - RNA, 17 nt, Human
gcugccuccacucccac

SEQ ID NO: 3888826 - RNA, 22 nt, Human
gcugccucccaacaguggggaa

SEQ ID NO: 3888827 - RNA, 15 nt, Human
gcugccuccccaacc

SEQ ID NO: 3888828 - RNA, 20 nt, Human
gcugccucggauccccuucc

SEQ ID NO: 3888829 - RNA, 21 nt, Human
gcugccucggauccccuuccu

SEQ ID NO: 3888830 - RNA, 22 nt, Human
gcugccucggauccccuuccua

SEQ ID NO: 3888831 - RNA, 13 nt, Human
gcugccugaaucc

SEQ ID NO: 3888832 - RNA, 21 nt, Human
gcugccugagucgugaccugc

SEQ ID NO: 3888833 - RNA, 14 nt, Human
gcugccugcccaca

SEQ ID NO: 3888834 - RNA, 19 nt, Human
gcugccugcccgcacagca

SEQ ID NO: 3888835 - RNA, 13 nt, Human
gcugccugcccgu

SEQ ID NO: 3888836 - RNA, 22 nt, Human
gcugccugccgguaaacacgcc

SEQ ID NO: 3888837 - RNA, 13 nt, Human
gcugccugccugu

SEQ ID NO: 3888838 - RNA, 21 nt, Human
gcugccugcgcccaccccgcu

SEQ ID NO: 3888839 - RNA, 21 nt, Human
gcugccugcuuuucacugcug

SEQ ID NO: 3888840 - RNA, 20 nt, Human
gcugccuggaagagcagccc

SEQ ID NO: 3888841 - RNA, 13 nt, Human
gcugccugggauc

SEQ ID NO: 3888842 - RNA, 20 nt, Human
gcugccugggaucccucauc

SEQ ID NO: 3888843 - RNA, 19 nt, Human
gcugccugggcuguuggca

SEQ ID NO: 3888844 - RNA, 14 nt, Human
gcugccugucccca

SEQ ID NO: 3888845 - RNA, 12 nt, Human
gcugccuguuca

SEQ ID NO: 3888846 - RNA, 17 nt, Human
gcugccuguucagcucc

SEQ ID NO: 3888847 - RNA, 20 nt, Human
gcugccuguucagcuccagc

SEQ ID NO: 3888848 - RNA, 15 nt, Human
gcugccuuagaaccu

SEQ ID NO: 3888849 - RNA, 12 nt, Human
gcugccuuagcu

SEQ ID NO: 3888850 - RNA, 14 nt, Human
gcugccuuagcuuc

SEQ ID NO: 3888851 - RNA, 19 nt, Human
gcugccuuauucagggaag

SEQ ID NO: 3888852 - RNA, 21 nt, Human
gcugccuuauucagggaagga

SEQ ID NO: 3888853 - RNA, 15 nt, Human
gcugccuucccuagc

SEQ ID NO: 3888854 - RNA, 20 nt, Human
gcugccuucgguacccacca

SEQ ID NO: 3888855 - RNA, 19 nt, Human
gcugccuucugacggcccu

SEQ ID NO: 3888856 - RNA, 22 nt, Human
gcugccuucugacggcccugca

SEQ ID NO: 3888857 - RNA, 23 nt, Human
gcugccuucugacggcccugcaa

SEQ ID NO: 3888858 - RNA, 14 nt, Human
gcugccuuggcuca

SEQ ID NO: 3888859 - RNA, 17 nt, Human
gcugccuuggcucagac

SEQ ID NO: 3888860 - RNA, 19 nt, Human
gcugccuuggcucagacau

SEQ ID NO: 3888861 - RNA, 20 nt, Human
gcugccuuuggacuuguccc

SEQ ID NO: 3888862 - RNA, 15 nt, Human
gcugcggagcaagag

SEQ ID NO: 3888863 - RNA, 16 nt, Human
gcugcggagcaagagg

SEQ ID NO: 3888864 - RNA, 15 nt, Human
gcugcggcacccuug

SEQ ID NO: 3888865 - RNA, 15 nt, Human
gcugcggccccuccc

SEQ ID NO: 3888866 - RNA, 14 nt, Human
gcugcgguccaccc

SEQ ID NO: 3888867 - RNA, 15 nt, Human
gcugcgguccaccca

SEQ ID NO: 3888868 - RNA, 22 nt, Human
gcugcgguccacccaggagccc

SEQ ID NO: 3888869 - RNA, 22 nt, Human
gcugcgucuggaggggccccug

SEQ ID NO: 3888870 - RNA, 16 nt, Human
gcugcguuuccugugc

SEQ ID NO: 3888871 - RNA, 18 nt, Human
gcugcuaaaucuccuauu

SEQ ID NO: 3888872 - RNA, 22 nt, Human
gcugcuaauauuuuccuccuga

SEQ ID NO: 3888873 - RNA, 23 nt, Human
gcugcuaauauuuuccuccugag

SEQ ID NO: 3888874 - RNA, 15 nt, Human
gcugcuaaucuucag

SEQ ID NO: 3888875 - RNA, 16 nt, Human
gcugcuacaaagaaga

SEQ ID NO: 3888876 - RNA, 17 nt, Human
gcugcuacaaagaagac

SEQ ID NO: 3888877 - RNA, 19 nt, Human
gcugcuacaaagaagacau

SEQ ID NO: 3888878 - RNA, 12 nt, Human
gcugcuacccag

SEQ ID NO: 3888879 - RNA, 18 nt, Human
gcugcuacccucccugcu

SEQ ID NO: 3888880 - RNA, 19 nt, Human
gcugcuacccucccugcug

SEQ ID NO: 3888881 - RNA, 14 nt, Human
gcugcuagaacuuu

SEQ ID NO: 3888882 - RNA, 19 nt, Human
gcugcuagaacuuuuuuaa

SEQ ID NO: 3888883 - RNA, 19 nt, Human
gcugcuagagugacucacu

SEQ ID NO: 3888884 - RNA, 19 nt, Human
gcugcuagcacuuggagcc

SEQ ID NO: 3888885 - RNA, 22 nt, Human
gcugcuauccccaucucccugc

SEQ ID NO: 3888886 - RNA, 18 nt, Human
gcugcuauuuauuuuccu

SEQ ID NO: 3888887 - RNA, 19 nt, Human
gcugcuauuuauuuuccua

SEQ ID NO: 3888888 - RNA, 20 nt, Human
gcugcucagggaaaagcagc

SEQ ID NO: 3888889 - RNA, 19 nt, Human
gcugcucaucugauuuuug

SEQ ID NO: 3888890 - RNA, 19 nt, Human
gcugggguggggaccucag

SEQ ID NO: 3888891 - RNA, 22 nt, Human
gcugggguggggaccucaggcc

SEQ ID NO: 3888892 - RNA, 14 nt, Human
gcugggguuaucug

SEQ ID NO: 3888893 - RNA, 14 nt, Human
gcugggucaggcag

SEQ ID NO: 3888894 - RNA, 18 nt, Human
gcugggucgcccuggacu

SEQ ID NO: 3888895 - RNA, 19 nt, Human
gcugggucgcccuggacug

SEQ ID NO: 3888896 - RNA, 22 nt, Human
gcugggugcgaccccaucugcc

SEQ ID NO: 3888897 - RNA, 23 nt, Human
gcuggguggcaccagcagccugg

SEQ ID NO: 3888898 - RNA, 15 nt, Human
gcuggguggcacugc

SEQ ID NO: 3888899 - RNA, 21 nt, Human
gcuggguggcccauccccccu

SEQ ID NO: 3888900 - RNA, 17 nt, Human
gcugggugguacccucu

SEQ ID NO: 3888901 - RNA, 16 nt, Human
gcuggguucauuugug

SEQ ID NO: 3888902 - RNA, 17 nt, Human
gcuggguucuacccagg

SEQ ID NO: 3888903 - RNA, 15 nt, Human
gcuggguuggaaaac

SEQ ID NO: 3888904 - RNA, 17 nt, Human
gcuggguuggcgcaccc

SEQ ID NO: 3888905 - RNA, 21 nt, Human
gcuggguuggcgcacccuccc

SEQ ID NO: 3888906 - RNA, 15 nt, Human
gcugguaaacuauuu

SEQ ID NO: 3888907 - RNA, 16 nt, Human
gcugguaacaguucau

SEQ ID NO: 3888908 - RNA, 22 nt, Human
gcugguaacaguucauguuugc

SEQ ID NO: 3888909 - RNA, 23 nt, Human
gcugguaagggccaagucccacc

SEQ ID NO: 3888910 - RNA, 23 nt, Human
gcugguaauuuguaucugaagga

SEQ ID NO: 3888911 - RNA, 17 nt, Human
gcugguagagauggagg

SEQ ID NO: 3888912 - RNA, 23 nt, Human
gcugguagagauggaggaggagg

SEQ ID NO: 3888913 - RNA, 13 nt, Human
gcugguagcucag

SEQ ID NO: 3888914 - RNA, 19 nt, Human
gcugguaggcuccugccag

SEQ ID NO: 3888915 - RNA, 13 nt, Human
gcugguaguuagu

SEQ ID NO: 3888916 - RNA, 15 nt, Human
gcugguaucucagaa

SEQ ID NO: 3888917 - RNA, 18 nt, Human
gcugguaucucagaaagu

SEQ ID NO: 3888918 - RNA, 22 nt, Human
gcuggucaaacaaacucucuga

SEQ ID NO: 3888919 - RNA, 15 nt, Human
gcuggucacagccuc

SEQ ID NO: 3888920 - RNA, 18 nt, Human
gcuggucacagccuccuc

SEQ ID NO: 3888921 - RNA, 13 nt, Human
gcuggucacugcc

SEQ ID NO: 3888922 - RNA, 14 nt, Human
gcuggucacuucuu

SEQ ID NO: 3888923 - RNA, 22 nt, Human
gcuggucacuucuucuguccaa

SEQ ID NO: 3888924 - RNA, 22 nt, Human
gcuggucauguguuugaacuuc

SEQ ID NO: 3888925 - RNA, 19 nt, Human
gcugguccagggcuaguga

SEQ ID NO: 3888926 - RNA, 15 nt, Human
gcuggucccacucag

SEQ ID NO: 3888927 - RNA, 23 nt, Human
gcuggucccagccagcaguucag

SEQ ID NO: 3888928 - RNA, 20 nt, Human
gcugguccuauggccucaug

SEQ ID NO: 3888929 - RNA, 17 nt, Human
gcugguccuuucuuccg

SEQ ID NO: 3888930 - RNA, 22 nt, Human
gcuggucguaaacaucucagag

SEQ ID NO: 3888931 - RNA, 18 nt, Human
gcuggucuagucacgcau

SEQ ID NO: 3888932 - RNA, 19 nt, Human
gcuggucucaaacuccuga

SEQ ID NO: 3888933 - RNA, 20 nt, Human
gcuggugcagagcugaagau

SEQ ID NO: 3888934 - RNA, 17 nt, Human
gcuggugcauuacagag

SEQ ID NO: 3888935 - RNA, 20 nt, Human
gcuggugcauuacagagagg

SEQ ID NO: 3888936 - RNA, 13 nt, Human
gcuggugcccgga

SEQ ID NO: 3888937 - RNA, 24 nt, Human
gcuggugcccugcuuucagauacu

SEQ ID NO: 3888938 - RNA, 17 nt, Human
gcuggugcuguggccag

SEQ ID NO: 3888939 - RNA, 16 nt, Human
gcugguggacccaggg

SEQ ID NO: 3888940 - RNA, 14 nt, Human
gcugguggcagagu

SEQ ID NO: 3888941 - RNA, 13 nt, Human
gcugguggcccag

SEQ ID NO: 3888942 - RNA, 17 nt, Human
gcugguggcuaauggug

SEQ ID NO: 3888943 - RNA, 13 nt, Human
gcuggugggaggg

SEQ ID NO: 3888944 - RNA, 19 nt, Human
gcuggugggcaccaagagc

SEQ ID NO: 3888945 - RNA, 18 nt, Human
gcuggugggugccuaggc

SEQ ID NO: 3888946 - RNA, 12 nt, Human
gcugguguagcu

SEQ ID NO: 3888947 - RNA, 15 nt, Human
gcugguguagcuaca

SEQ ID NO: 3888948 - RNA, 17 nt, Human
gcugguguagcuacaga

SEQ ID NO: 3888949 - RNA, 21 nt, Human
gcugguguagcuacagagaaa

SEQ ID NO: 3888950 - RNA, 15 nt, Human
gcuggugucaccuga

SEQ ID NO: 3888951 - RNA, 16 nt, Human
gcuggugucaccugaa

SEQ ID NO: 3888952 - RNA, 18 nt, Human
gcuggugucaccugaaga

SEQ ID NO: 3888953 - RNA, 19 nt, Human
gcugguguccugaccaccc

SEQ ID NO: 3888954 - RNA, 15 nt, Human
gcuggugugguacag

SEQ ID NO: 3888955 - RNA, 20 nt, Human
gcuggugugguacagagaag

SEQ ID NO: 3888956 - RNA, 22 nt, Human
gcuggugugguacagagaagcc

SEQ ID NO: 3888957 - RNA, 23 nt, Human
gcuggugugguacagagaagcca

SEQ ID NO: 3888958 - RNA, 14 nt, Human
gcugguguuaacag

SEQ ID NO: 3888959 - RNA, 17 nt, Human
gcugguguuaacagaag

SEQ ID NO: 3888960 - RNA, 12 nt, Human
gcugguucugua

SEQ ID NO: 3888961 - RNA, 13 nt, Human
gcugguugcugug

SEQ ID NO: 3888962 - RNA, 16 nt, Human
gcugguugcugugugg

SEQ ID NO: 3888963 - RNA, 14 nt, Human
gcugguuuuccuaa

SEQ ID NO: 3888964 - RNA, 23 nt, Human
gcugguuuuccuaaaugcaguga

SEQ ID NO: 3888965 - RNA, 17 nt, Human
gcugguuuuggcaucuc

SEQ ID NO: 3888966 - RNA, 15 nt, Human
gcugguuuuucaguu

SEQ ID NO: 3888967 - RNA, 15 nt, Human
gcuguaaaacgcugu

SEQ ID NO: 3888968 - RNA, 12 nt, Human
gcuguaaaagca

SEQ ID NO: 3888969 - RNA, 19 nt, Human
gcuguaaauuuggcuucug

SEQ ID NO: 3888970 - RNA, 22 nt, Human
gcuguaaauuuggcuucuguug

SEQ ID NO: 3888971 - RNA, 16 nt, Human
gcuguaacuuaaaaua

SEQ ID NO: 3888972 - RNA, 16 nt, Human
gcuguaagaugucugu

SEQ ID NO: 3888973 - RNA, 17 nt, Human
gcuguaaggcaugaagg

SEQ ID NO: 3888974 - RNA, 18 nt, Human
gcuguaaggcaugaagga

SEQ ID NO: 3888975 - RNA, 13 nt, Human
gcuguaaggcucu

SEQ ID NO: 3888976 - RNA, 17 nt, Human
gcuguaaggcucuagau

SEQ ID NO: 3888977 - RNA, 19 nt, Human
gcuguaauguuaauauuga

SEQ ID NO: 3888978 - RNA, 16 nt, Human
gcuguacaaauauaag

SEQ ID NO: 3888979 - RNA, 12 nt, Human
gcuguacacugc

SEQ ID NO: 3888980 - RNA, 16 nt, Human
gcuguacacugcacga

SEQ ID NO: 3888981 - RNA, 17 nt, Human
gcuguacauacuuuuug

SEQ ID NO: 3888982 - RNA, 23 nt, Human
gcuguacugcucaggcugcagcu

SEQ ID NO: 3888983 - RNA, 20 nt, Human
gcuguacuucgucuucuaau

SEQ ID NO: 3888984 - RNA, 13 nt, Human
gcuguagaaggag

SEQ ID NO: 3888985 - RNA, 16 nt, Human
gcuguaguaggcauuu

SEQ ID NO: 3888986 - RNA, 18 nt, Human
gcuguauaaaaucagcca

SEQ ID NO: 3888987 - RNA, 15 nt, Human
gcuguauaaguuauu

SEQ ID NO: 3888988 - RNA, 15 nt, Human
gcuguauagcugcuu

SEQ ID NO: 3888989 - RNA, 23 nt, Human
gcuguaucccaugagccucagca

SEQ ID NO: 3888990 - RNA, 21 nt, Human
gcuguauuuuaaaagaaugau

SEQ ID NO: 3888991 - RNA, 18 nt, Human
gcugucaaguuccuuugg

SEQ ID NO: 3888992 - RNA, 20 nt, Human
gcugucaaugggaccugugg

SEQ ID NO: 3888993 - RNA, 22 nt, Human
gcugucaauuacaggaaguacu

SEQ ID NO: 3888994 - RNA, 23 nt, Human
gcugucaauuacaggaaguacug

SEQ ID NO: 3888995 - RNA, 13 nt, Human
gcugucacaggcg

SEQ ID NO: 3888996 - RNA, 16 nt, Human
gcugucaccaaggaaa

SEQ ID NO: 3888997 - RNA, 22 nt, Human
gcugucaccucucccacgggac

SEQ ID NO: 3888998 - RNA, 18 nt, Human
gcugucaucaauuaaagg

SEQ ID NO: 3888999 - RNA, 13 nt, Human
gcugucaucucag

SEQ ID NO: 3889000 - RNA, 15 nt, Human
gcugucaucugugca

SEQ ID NO: 3889001 - RNA, 15 nt, Human
gcugucauugcuucu

SEQ ID NO: 3889002 - RNA, 16 nt, Human
gcugucauugcuucuu

SEQ ID NO: 3889003 - RNA, 18 nt, Human
gcuguccagaaagguuug

SEQ ID NO: 3889004 - RNA, 15 nt, Human
gcuguccagacagcc

SEQ ID NO: 3889005 - RNA, 14 nt, Human
gcuguccagugccc

SEQ ID NO: 3889006 - RNA, 20 nt, Human
gcugucccauagucccugcc

SEQ ID NO: 3889007 - RNA, 21 nt, Human
gcugucccauagucccugcca

SEQ ID NO: 3889008 - RNA, 14 nt, Human
gcuguccccccacu

SEQ ID NO: 3889009 - RNA, 15 nt, Human
gcuguccccucuugc

SEQ ID NO: 3889010 - RNA, 17 nt, Human
gcuguccccucuugccc

SEQ ID NO: 3889011 - RNA, 18 nt, Human
gcuguccccucuugcccc

SEQ ID NO: 3889012 - RNA, 20 nt, Human
gcuguccccucuugccccaa

SEQ ID NO: 3889013 - RNA, 14 nt, Human
gcugucccggaggc

SEQ ID NO: 3889014 - RNA, 15 nt, Human
gcugucccugucacc

SEQ ID NO: 3889015 - RNA, 19 nt, Human
gcugucccuuacgugaguc

SEQ ID NO: 3889016 - RNA, 14 nt, Human
gcuguccuaggcca

SEQ ID NO: 3889017 - RNA, 13 nt, Human
gcuguccucaggu

SEQ ID NO: 3889018 - RNA, 15 nt, Human
gcuguccucccucca

SEQ ID NO: 3889019 - RNA, 14 nt, Human
gcuguccugaucug

SEQ ID NO: 3889020 - RNA, 15 nt, Human
gcuguccuggagggg

SEQ ID NO: 3889021 - RNA, 22 nt, Human
gcugucgauguaggcauucugg

SEQ ID NO: 3889022 - RNA, 18 nt, Human
gcugucggcgcugcccca

SEQ ID NO: 3889023 - RNA, 20 nt, Human
gcugucuacacuaagagaga

SEQ ID NO: 3889024 - RNA, 14 nt, Human
gcugucucugcucg

SEQ ID NO: 3889025 - RNA, 14 nt, Human
gcugucugcagccu

SEQ ID NO: 3889026 - RNA, 15 nt, Human
gcugucuggcacagc

SEQ ID NO: 3889027 - RNA, 13 nt, Human
gcugucuggccag

SEQ ID NO: 3889028 - RNA, 17 nt, Human
gcugucugggugcuacu

SEQ ID NO: 3889029 - RNA, 13 nt, Human
gcugucuucugga

SEQ ID NO: 3889030 - RNA, 23 nt, Human
gcugucuuguugcggauggaugg

SEQ ID NO: 3889031 - RNA, 16 nt, Human
gcugucuuucuugcuc

SEQ ID NO: 3889032 - RNA, 20 nt, Human
gcugucuuucuugcucccug

SEQ ID NO: 3889033 - RNA, 20 nt, Human
gcugugaacccuggggccug

SEQ ID NO: 3889034 - RNA, 22 nt, Human
gcugugaacccuggggccugac

SEQ ID NO: 3889035 - RNA, 20 nt, Human
gcugugaauuuguguaagga

SEQ ID NO: 3889036 - RNA, 22 nt, Human
gcugugacaauggcaacaauuu

SEQ ID NO: 3889037 - RNA, 22 nt, Human
gcugugaccauuuauaauguua

SEQ ID NO: 3889038 - RNA, 17 nt, Human
gcugugaccugcugagc

SEQ ID NO: 3889039 - RNA, 20 nt, Human
gcugugaccugcugagcucu

SEQ ID NO: 3889040 - RNA, 22 nt, Human
gcugugaccugcugagcucuga

SEQ ID NO: 3889041 - RNA, 16 nt, Human
gcugugacuucuccag

SEQ ID NO: 3889042 - RNA, 18 nt, Human
gcugugagacagugggaa

SEQ ID NO: 3889043 - RNA, 20 nt, Human
gcugugagacagugggaaau

SEQ ID NO: 3889044 - RNA, 23 nt, Human
gcugugagacagugggaaauauu

SEQ ID NO: 3889045 - RNA, 16 nt, Human
gcugugagccccuggu

SEQ ID NO: 3889046 - RNA, 22 nt, Human
gcugugaggccccuggacaagc

SEQ ID NO: 3889047 - RNA, 13 nt, Human
gcugugaggcugu

SEQ ID NO: 3889048 - RNA, 16 nt, Human
gcugugaggcuguccu

SEQ ID NO: 3889049 - RNA, 22 nt, Human
gcugugagucuuugguucuaag

SEQ ID NO: 3889050 - RNA, 18 nt, Human
gcugugaguguaagugug

SEQ ID NO: 3889051 - RNA, 19 nt, Human
gcugugaguucucccugua

SEQ ID NO: 3889052 - RNA, 20 nt, Human
gcugugauacgaugcuucaa

SEQ ID NO: 3889053 - RNA, 19 nt, Human
gcugugcaacggucuccug

SEQ ID NO: 3889054 - RNA, 19 nt, Human
gcugugcacaaaguggcau

SEQ ID NO: 3889055 - RNA, 18 nt, Human
gcugugcagcgcagcugg

SEQ ID NO: 3889056 - RNA, 20 nt, Human
gcugugcagcgcagcuggac

SEQ ID NO: 3889057 - RNA, 19 nt, Human
gcugugccacaggcuuagg

SEQ ID NO: 3889058 - RNA, 20 nt, Human
gcugugccacaggcuuaggg

SEQ ID NO: 3889059 - RNA, 12 nt, Human
gcugugccaccc

SEQ ID NO: 3889060 - RNA, 15 nt, Human
gcugugccacccugg

SEQ ID NO: 3889061 - RNA, 18 nt, Human
gcugugccacccugggcu

SEQ ID NO: 3889062 - RNA, 16 nt, Human
gcugugcccucuugau

SEQ ID NO: 3889063 - RNA, 17 nt, Human
gcugugcgcccagggcu

SEQ ID NO: 3889064 - RNA, 18 nt, Human
gcugugcgcccagggcug

SEQ ID NO: 3889065 - RNA, 21 nt, Human
gcugugcgcugacaaccaccg

SEQ ID NO: 3889066 - RNA, 18 nt, Human
gcugugcggaucucugga

SEQ ID NO: 3889067 - RNA, 16 nt, Human
gcugugcgugugugug

SEQ ID NO: 3889068 - RNA, 16 nt, Human
gcugugcuaugaauuu

SEQ ID NO: 3889069 - RNA, 13 nt, Human
gcugugcucugga

SEQ ID NO: 3889070 - RNA, 15 nt, Human
gcugugcucuggaca

SEQ ID NO: 3889071 - RNA, 18 nt, Human
gcugugcucuggacaggc

SEQ ID NO: 3889072 - RNA, 20 nt, Human
gcuguggagacaaugucugc

SEQ ID NO: 3889073 - RNA, 23 nt, Human
gcuguggaggauugcuaucugga

SEQ ID NO: 3889074 - RNA, 15 nt, Human
gcuguggccaggagg

SEQ ID NO: 3889075 - RNA, 20 nt, Human
gcuguggccaggaggugcca

SEQ ID NO: 3889076 - RNA, 17 nt, Human
gcuguggccagggugag

SEQ ID NO: 3889077 - RNA, 19 nt, Human
gcuguggccuaaccugccg

SEQ ID NO: 3889078 - RNA, 13 nt, Human
gcuguggcuggug

SEQ ID NO: 3889079 - RNA, 14 nt, Human
gcugugggaacgag

SEQ ID NO: 3889080 - RNA, 13 nt, Human
gcugugggcaggu

SEQ ID NO: 3889081 - RNA, 14 nt, Human
gcugugggcaggug

SEQ ID NO: 3889082 - RNA, 12 nt, Human
gcugugggcucc

SEQ ID NO: 3889083 - RNA, 13 nt, Human
gcugugggcuccc

SEQ ID NO: 3889084 - RNA, 14 nt, Human
gcugugggcucccu

SEQ ID NO: 3889085 - RNA, 16 nt, Human
gcuguggggcugguag

SEQ ID NO: 3889086 - RNA, 22 nt, Human
gcuguggggcugguagcucagg

SEQ ID NO: 3889087 - RNA, 18 nt, Human
gcuguggguacagagagg

SEQ ID NO: 3889088 - RNA, 13 nt, Human
gcuguggucucuu

SEQ ID NO: 3889089 - RNA, 13 nt, Human
gcugugguuccug

SEQ ID NO: 3889090 - RNA, 11 nt, Human
gcuguguaaag

SEQ ID NO: 3889091 - RNA, 12 nt, Human
gcuguguaaagu

SEQ ID NO: 3889092 - RNA, 19 nt, Human
gcuguguccuugcaccugc

SEQ ID NO: 3889093 - RNA, 15 nt, Human
gcugugucuaaacug

SEQ ID NO: 3889094 - RNA, 16 nt, Human
gcugugucuaaacugc

SEQ ID NO: 3889095 - RNA, 13 nt, Human
gcugugugcaguc

SEQ ID NO: 3889096 - RNA, 16 nt, Human
gcugugugcucuccaa

SEQ ID NO: 3889097 - RNA, 20 nt, Human
gcugugugucccaggcaggg

SEQ ID NO: 3889098 - RNA, 23 nt, Human
gcugugugucccaggcagggaga

SEQ ID NO: 3889099 - RNA, 18 nt, Human
gcuguguguuaguuccca

SEQ ID NO: 3889100 - RNA, 18 nt, Human
gcuguguuaaauaaaccu

SEQ ID NO: 3889101 - RNA, 17 nt, Human
gcuguguuugcuccccu

SEQ ID NO: 3889102 - RNA, 12 nt, Human
gcuguuaaacug

SEQ ID NO: 3889103 - RNA, 13 nt, Human
gcuguuaaacugu

SEQ ID NO: 3889104 - RNA, 22 nt, Human
gcuguuaaacuguuagcacugu

SEQ ID NO: 3889105 - RNA, 15 nt, Human
gcuguuaaauacagg

SEQ ID NO: 3889106 - RNA, 18 nt, Human
gcuguuaauagaucuuag

SEQ ID NO: 3889107 - RNA, 17 nt, Human
gcuguuacaguuuucuu

SEQ ID NO: 3889108 - RNA, 18 nt, Human
gcuguuaccauucacaau

SEQ ID NO: 3889109 - RNA, 19 nt, Human
gcuguuaugucuguuuaag

SEQ ID NO: 3889110 - RNA, 23 nt, Human
gcuguuauuuagguauuuuucuu

SEQ ID NO: 3889111 - RNA, 16 nt, Human
gcuguucacagccaga

SEQ ID NO: 3889112 - RNA, 21 nt, Human
gcuguuccuguucaguaauaa

SEQ ID NO: 3889113 - RNA, 15 nt, Human
gcuguucuacuuuuu

SEQ ID NO: 3889114 - RNA, 13 nt, Human
gcuguucugcacu

SEQ ID NO: 3889115 - RNA, 14 nt, Human
gcuguucugcacug

SEQ ID NO: 3889116 - RNA, 13 nt, Human
gcuguucuuccug

SEQ ID NO: 3889117 - RNA, 12 nt, Human
gcuguucuucug

SEQ ID NO: 3889118 - RNA, 20 nt, Human
gcuguugaaagcaaaaaugc

SEQ ID NO: 3889119 - RNA, 16 nt, Human
gcuguugaagucucag

SEQ ID NO: 3889120 - RNA, 15 nt, Human
gcuguugaccaggca

SEQ ID NO: 3889121 - RNA, 16 nt, Human
gcuguugagcuguuuu

SEQ ID NO: 3889122 - RNA, 15 nt, Human
gcuguugauugcuaa

SEQ ID NO: 3889123 - RNA, 19 nt, Human
gcuguugauugcuaaaugu

SEQ ID NO: 3889124 - RNA, 20 nt, Human
gcuguugauugcuaaaugua

SEQ ID NO: 3889125 - RNA, 15 nt, Human
gcuguugccucaucu

SEQ ID NO: 3889126 - RNA, 12 nt, Human
gcuguugcugaa

SEQ ID NO: 3889127 - RNA, 19 nt, Human
gcuguugcugaauaggcga

SEQ ID NO: 3889128 - RNA, 12 nt, Human
gcuguugcuuga

SEQ ID NO: 3889129 - RNA, 22 nt, Human
gcuguuggcacucacagaccug

SEQ ID NO: 3889130 - RNA, 15 nt, Human
gcuguuggcuggggg

SEQ ID NO: 3889131 - RNA, 22 nt, Human
gcuguuggcugggggccucagu

SEQ ID NO: 3889132 - RNA, 17 nt, Human
gcuguugucucuucucc

SEQ ID NO: 3889133 - RNA, 14 nt, Human
gcuguuguuaugau

SEQ ID NO: 3889134 - RNA, 15 nt, Human
gcuguuguuaugaug

SEQ ID NO: 3889135 - RNA, 19 nt, Human
gcuguuuaucccuuaagaa

SEQ ID NO: 3889136 - RNA, 15 nt, Human
gcuguuuauggccuc

SEQ ID NO: 3889137 - RNA, 22 nt, Human
gcuguuuauggccucagcugcc

SEQ ID NO: 3889138 - RNA, 23 nt, Human
gcuguuuauggccucagcugccu

SEQ ID NO: 3889139 - RNA, 19 nt, Human
gcuguuugagauucucaaa

SEQ ID NO: 3889140 - RNA, 14 nt, Human
gcuguuugcuucac

SEQ ID NO: 3889141 - RNA, 12 nt, Human
gcuguuuggaaa

SEQ ID NO: 3889142 - RNA, 16 nt, Human
gcuguuugguuuuaaa

SEQ ID NO: 3889143 - RNA, 19 nt, Human
gcuguuugguuuuaaaaua

SEQ ID NO: 3889144 - RNA, 18 nt, Human
gcuguuuuccucccuucu

SEQ ID NO: 3889145 - RNA, 13 nt, Human
gcuguuuuguuau

SEQ ID NO: 3889146 - RNA, 16 nt, Human
gcuguuuuguuauaua

SEQ ID NO: 3889147 - RNA, 19 nt, Human
gcuguuuuguuauauaauu

SEQ ID NO: 3889148 - RNA, 23 nt, Human
gcuguuuuguuauauaauuuaga

SEQ ID NO: 3889149 - RNA, 19 nt, Human
gcuguuuuguugacauucu

SEQ ID NO: 3889150 - RNA, 18 nt, Human
gcuuaaaacuuugaaguu

SEQ ID NO: 3889151 - RNA, 20 nt, Human
gcuuaaaagaaaauguucac

SEQ ID NO: 3889152 - RNA, 22 nt, Human
gcuuaaaauaaacaguugugaa

SEQ ID NO: 3889153 - RNA, 13 nt, Human
gcuuaaaauacaa

SEQ ID NO: 3889154 - RNA, 22 nt, Human
gcuuaaacccauauuguaaaac

SEQ ID NO: 3889155 - RNA, 16 nt, Human
gcuuaaaggugucuuc

SEQ ID NO: 3889156 - RNA, 21 nt, Human
gcuuaaaguugguauuaauaa

SEQ ID NO: 3889157 - RNA, 23 nt, Human
gcuuaaauauaguuccuaagaag

SEQ ID NO: 3889158 - RNA, 14 nt, Human
gcuuaaaugugaau

SEQ ID NO: 3889159 - RNA, 16 nt, Human
gcuuaaauuucuuaug

SEQ ID NO: 3889160 - RNA, 18 nt, Human
gcuuaagccacugccucu

SEQ ID NO: 3889161 - RNA, 12 nt, Human
gcuuaaugaaaa

SEQ ID NO: 3889162 - RNA, 16 nt, Human
gcuuaaugcuacaugu

SEQ ID NO: 3889163 - RNA, 16 nt, Human
gcuuaaugcuucuuuc

SEQ ID NO: 3889164 - RNA, 18 nt, Human
gcuuaauggaguucuugu

SEQ ID NO: 3889165 - RNA, 17 nt, Human
gcuuaauguuuauuccu

SEQ ID NO: 3889166 - RNA, 13 nt, Human
gcuuaauuccaau

SEQ ID NO: 3889167 - RNA, 12 nt, Human
gcuuaauuucua

SEQ ID NO: 3889168 - RNA, 18 nt, Human
gcuuaauuucuaaagaua

SEQ ID NO: 3889169 - RNA, 19 nt, Human
gcuuacaauucccugcugu

SEQ ID NO: 3889170 - RNA, 19 nt, Human
gcuuacaauuuuuuuaauu

SEQ ID NO: 3889171 - RNA, 13 nt, Human
gcuuaccuccuca

SEQ ID NO: 3889172 - RNA, 22 nt, Human
gcuuaccugaccucuugcuguc

SEQ ID NO: 3889173 - RNA, 12 nt, Human
gcuuaccuggcc

SEQ ID NO: 3889174 - RNA, 22 nt, Human
gcuuacguaguucuaccggcuu

SEQ ID NO: 3889175 - RNA, 11 nt, Human
gcuuacucugu

SEQ ID NO: 3889176 - RNA, 21 nt, Human
gcuuacugauauauuuuacaa

SEQ ID NO: 3889177 - RNA, 20 nt, Human
gcuuacuuuggaauacauuu

SEQ ID NO: 3889178 - RNA, 21 nt, Human
gcuuagacccucaugcugcca

SEQ ID NO: 3889179 - RNA, 19 nt, Human
gcuuagaccucagccugug

SEQ ID NO: 3889180 - RNA, 21 nt, Human
guuguggccuuugcgcuccug

SEQ ID NO: 3889181 - RNA, 18 nt, Human
guuguggguaguggggaa

SEQ ID NO: 3889182 - RNA, 15 nt, Human
guugugggugggaga

SEQ ID NO: 3889183 - RNA, 16 nt, Human
guugugggugggagag

SEQ ID NO: 3889184 - RNA, 17 nt, Human
guuguguaagagaaugu

SEQ ID NO: 3889185 - RNA, 12 nt, Human
guuguguguggg

SEQ ID NO: 3889186 - RNA, 14 nt, Human
guugugugugggag

SEQ ID NO: 3889187 - RNA, 23 nt, Human
guuguuaaaauuaugaaucugau

SEQ ID NO: 3889188 - RNA, 16 nt, Human
guuguuaaugaaaaug

SEQ ID NO: 3889189 - RNA, 17 nt, Human
guuguuaaugaaaaugu

SEQ ID NO: 3889190 - RNA, 19 nt, Human
guuguuaaugaaaauguca

SEQ ID NO: 3889191 - RNA, 11 nt, Human
guuguuagaga

SEQ ID NO: 3889192 - RNA, 14 nt, Human
guuguuaucuguuu

SEQ ID NO: 3889193 - RNA, 15 nt, Human
guuguuaugaugugc

SEQ ID NO: 3889194 - RNA, 14 nt, Human
guuguucuguuaac

SEQ ID NO: 3889195 - RNA, 18 nt, Human
guuguugcuucuugugaa

SEQ ID NO: 3889196 - RNA, 16 nt, Human
guuguuguuaaauauc

SEQ ID NO: 3889197 - RNA, 16 nt, Human
guuguuuauaauaaaa

SEQ ID NO: 3889198 - RNA, 13 nt, Human
guuguuucuguuc

SEQ ID NO: 3889199 - RNA, 20 nt, Human
guuguuucuuaauuuggaaa

SEQ ID NO: 3889200 - RNA, 15 nt, Human
guuguuucuuucuag

SEQ ID NO: 3889201 - RNA, 20 nt, Human
guuguuugauucagacagcu

SEQ ID NO: 3889202 - RNA, 13 nt, Human
guuguuuguaaau

SEQ ID NO: 3889203 - RNA, 15 nt, Human
guuguuuguaaauaa

SEQ ID NO: 3889204 - RNA, 21 nt, Human
guuguuuuuguauauugguuu

SEQ ID NO: 3889205 - RNA, 19 nt, Human
guuguuuuuugaaaacaug

SEQ ID NO: 3889206 - RNA, 21 nt, Human
guuuaaaauaaaaugaaaauu

SEQ ID NO: 3889207 - RNA, 19 nt, Human
guuuaaaauguaauuuaaa

SEQ ID NO: 3889208 - RNA, 15 nt, Human
guuuaaagaaagugu

SEQ ID NO: 3889209 - RNA, 18 nt, Human
guuuaaagagucuagauu

SEQ ID NO: 3889210 - RNA, 19 nt, Human
guuuaaaguguauuauaac

SEQ ID NO: 3889211 - RNA, 21 nt, Human
guuuaaaguguauuauaacag

SEQ ID NO: 3889212 - RNA, 20 nt, Human
guuuaaaguucuguguauuu

SEQ ID NO: 3889213 - RNA, 21 nt, Human
guuuaaaguucuguguauuua

SEQ ID NO: 3889214 - RNA, 13 nt, Human
guuuaaauaaagu

SEQ ID NO: 3889215 - RNA, 14 nt, Human
guuuaaauaaagua

SEQ ID NO: 3889216 - RNA, 14 nt, Human
guuuaaauauuuca

SEQ ID NO: 3889217 - RNA, 11 nt, Human
guuuaaaugaa

SEQ ID NO: 3889218 - RNA, 23 nt, Human
guuuaaaugaacaagagaagcau

SEQ ID NO: 3889219 - RNA, 13 nt, Human
guuuaaaugguca

SEQ ID NO: 3889220 - RNA, 21 nt, Human
guuuaacaaaauguaugugag

SEQ ID NO: 3889221 - RNA, 13 nt, Human
guuuaacauaaag

SEQ ID NO: 3889222 - RNA, 15 nt, Human
guuuaacauaaaggu

SEQ ID NO: 3889223 - RNA, 14 nt, Human
guuuaacucagauc

SEQ ID NO: 3889224 - RNA, 19 nt, Human
guuuaacucagaucacuac

SEQ ID NO: 3889225 - RNA, 17 nt, Human
guuuaagaccagccugg

SEQ ID NO: 3889226 - RNA, 12 nt, Human
guuuaagauuua

SEQ ID NO: 3889227 - RNA, 23 nt, Human
guuuaaggaauaugggagaaaua

SEQ ID NO: 3889228 - RNA, 15 nt, Human
guuuaaguagauuuc

SEQ ID NO: 3889229 - RNA, 21 nt, Human
guuuaagugacugauggcuaa

SEQ ID NO: 3889230 - RNA, 22 nt, Human
guuuaauaaagcgaaaaacuca

SEQ ID NO: 3889231 - RNA, 20 nt, Human
guuuaauacucauccuugua

SEQ ID NO: 3889232 - RNA, 17 nt, Human
guuuaauagagaaggaa

SEQ ID NO: 3889233 - RNA, 18 nt, Human
guuuaauauuaaagccau

SEQ ID NO: 3889234 - RNA, 19 nt, Human
guuuaauauuaaagccaug

SEQ ID NO: 3889235 - RNA, 20 nt, Human
guuuaauauuaaagccaugu

SEQ ID NO: 3889236 - RNA, 21 nt, Human
guuuaauauuaccuaaugaaa

SEQ ID NO: 3889237 - RNA, 19 nt, Human
guuuaauccccaguaaaau

SEQ ID NO: 3889238 - RNA, 18 nt, Human
guuuaaugaaugcuuaaa

SEQ ID NO: 3889239 - RNA, 20 nt, Human
guuuaaugguaguuuuacag

SEQ ID NO: 3889240 - RNA, 18 nt, Human
guuuaaugugaacuugua

SEQ ID NO: 3889241 - RNA, 20 nt, Human
guuuaauguucugugauaca

SEQ ID NO: 3889242 - RNA, 19 nt, Human
guuuaauuuuauaaacaaa

SEQ ID NO: 3889243 - RNA, 20 nt, Human
guuuacaaaaauuucuguaa

SEQ ID NO: 3889244 - RNA, 18 nt, Human
guuuacaaguguauauca

SEQ ID NO: 3889245 - RNA, 23 nt, Human
guuuacaaguguauaucagaaaa

SEQ ID NO: 3889246 - RNA, 18 nt, Human
guuuacaauuuacaaagu

SEQ ID NO: 3889247 - RNA, 21 nt, Human
guuuacacacgugcaauuugu

SEQ ID NO: 3889248 - RNA, 14 nt, Human
guuuacagaaaaau

SEQ ID NO: 3889249 - RNA, 18 nt, Human
guuuacaggcccugcucc

SEQ ID NO: 3889250 - RNA, 18 nt, Human
guuuacagggagccuccu

SEQ ID NO: 3889251 - RNA, 17 nt, Human
guuuacagguggacaca

SEQ ID NO: 3889252 - RNA, 13 nt, Human
guuuacaguaaau

SEQ ID NO: 3889253 - RNA, 21 nt, Human
guuuacagucuauuugagacu

SEQ ID NO: 3889254 - RNA, 22 nt, Human
guuuacauagucugaagugaag

SEQ ID NO: 3889255 - RNA, 15 nt, Human
guuuacauuuaaagc

SEQ ID NO: 3889256 - RNA, 22 nt, Human
guuuacauuuuauggugccuag

SEQ ID NO: 3889257 - RNA, 21 nt, Human
guuuacauuuuuauuuaugaa

SEQ ID NO: 3889258 - RNA, 22 nt, Human
guuuacauuuuuauuuaugaag

SEQ ID NO: 3889259 - RNA, 13 nt, Human
guuuaccauuugu

SEQ ID NO: 3889260 - RNA, 16 nt, Human
guuuaccauuuguaau

SEQ ID NO: 3889261 - RNA, 18 nt, Human
guuuaccauuuguaauaa

SEQ ID NO: 3889262 - RNA, 21 nt, Human
guuuaccauuuguaauaaagu

SEQ ID NO: 3889263 - RNA, 13 nt, Human
guuuaccuagaag

SEQ ID NO: 3889264 - RNA, 16 nt, Human
guuuaccugugaaaua

SEQ ID NO: 3889265 - RNA, 12 nt, Human
guuuaccuugua

SEQ ID NO: 3889266 - RNA, 13 nt, Human
guuuaccuuucuc

SEQ ID NO: 3889267 - RNA, 22 nt, Human
guuuacuagggaucccucaucu

SEQ ID NO: 3889268 - RNA, 17 nt, Human
guuuacuaugccugugu

SEQ ID NO: 3889269 - RNA, 18 nt, Human
guuuacuuaucuuaugcc

SEQ ID NO: 3889270 - RNA, 14 nt, Human
guuuacuuuaacuu

SEQ ID NO: 3889271 - RNA, 13 nt, Human
guuuacuuucaaa

SEQ ID NO: 3889272 - RNA, 14 nt, Human
guuuacuuucaaau

SEQ ID NO: 3889273 - RNA, 19 nt, Human
guuuacuuuucagggcauc

SEQ ID NO: 3889274 - RNA, 13 nt, Human
guuuagaaagcuu

SEQ ID NO: 3889275 - RNA, 17 nt, Human
guuuagaaagcuugccc

SEQ ID NO: 3889276 - RNA, 12 nt, Human
guuuagaacagg

SEQ ID NO: 3889277 - RNA, 22 nt, Human
guuuagaagcugagacacaaag

SEQ ID NO: 3889278 - RNA, 14 nt, Human
guuuagaauugaag

SEQ ID NO: 3889279 - RNA, 12 nt, Human
guuuagaccaag

SEQ ID NO: 3889280 - RNA, 20 nt, Human
guuuagaccaaggaacaaaa

SEQ ID NO: 3889281 - RNA, 19 nt, Human
guuuagagaaugagaaaug

SEQ ID NO: 3889282 - RNA, 14 nt, Human
guuuagauaauaca

SEQ ID NO: 3889283 - RNA, 15 nt, Human
guuuagauaauacac

SEQ ID NO: 3889284 - RNA, 12 nt, Human
guuuagauuugc

SEQ ID NO: 3889285 - RNA, 17 nt, Human
guuuagauuuuguguuu

SEQ ID NO: 3889286 - RNA, 12 nt, Human
guuuagcaaaua

SEQ ID NO: 3889287 - RNA, 17 nt, Human
guuuagcagcagccuuu

SEQ ID NO: 3889288 - RNA, 12 nt, Human
guuuagcucuga

SEQ ID NO: 3889289 - RNA, 14 nt, Human
guuuagcucugaga

SEQ ID NO: 3889290 - RNA, 15 nt, Human
guuuagcucugagaa

SEQ ID NO: 3889291 - RNA, 16 nt, Human
guuuagcucugagaac

SEQ ID NO: 3889292 - RNA, 22 nt, Human
guuuaggcuauuuguaaaucug

SEQ ID NO: 3889293 - RNA, 18 nt, Human
guuuaggcugguggccca

SEQ ID NO: 3889294 - RNA, 16 nt, Human
guuuagggaacaauuu

SEQ ID NO: 3889295 - RNA, 18 nt, Human
guuuaguaaggcugugua

SEQ ID NO: 3889296 - RNA, 16 nt, Human
guuuaguaaucauauu

SEQ ID NO: 3889297 - RNA, 14 nt, Human
guuuagucuugucu

SEQ ID NO: 3889298 - RNA, 22 nt, Human
guuuagugcaucuuugccucuc

SEQ ID NO: 3889299 - RNA, 13 nt, Human
guuuaguguaaaa

SEQ ID NO: 3889300 - RNA, 16 nt, Human
guuuaguguaaaaaug

SEQ ID NO: 3889301 - RNA, 20 nt, Human
guuuaguguaaaaaugagaa

SEQ ID NO: 3889302 - RNA, 15 nt, Human
guuuaguuugcauuu

SEQ ID NO: 3889303 - RNA, 14 nt, Human
guuuauaauaaaaa

SEQ ID NO: 3889304 - RNA, 19 nt, Human
guuuauacacuguguaaau

SEQ ID NO: 3889305 - RNA, 20 nt, Human
guuuauagcaaacuuggaau

SEQ ID NO: 3889306 - RNA, 21 nt, Human
guuuauauuuuuucaguuguu

SEQ ID NO: 3889307 - RNA, 16 nt, Human
guuuaucagauacauc

SEQ ID NO: 3889308 - RNA, 15 nt, Human
guuuaucagcaaaaa

SEQ ID NO: 3889309 - RNA, 16 nt, Human
guuuaucaugaagccu

SEQ ID NO: 3889310 - RNA, 17 nt, Human
guuuaucaugaagccug

SEQ ID NO: 3889311 - RNA, 15 nt, Human
guuuaucauucaagu

SEQ ID NO: 3889312 - RNA, 17 nt, Human
guuuaucauucaagugu

SEQ ID NO: 3889313 - RNA, 22 nt, Human
guuuauccuuucauauaguuag

SEQ ID NO: 3889314 - RNA, 12 nt, Human
guuuaugaaaau

SEQ ID NO: 3889315 - RNA, 17 nt, Human
guuuaugacaguaauug

SEQ ID NO: 3889316 - RNA, 21 nt, Human
guuuaugagaugcugguuuuc

SEQ ID NO: 3889317 - RNA, 13 nt, Human
guuuauggccuca

SEQ ID NO: 3889318 - RNA, 15 nt, Human
guuuauggccucagc

SEQ ID NO: 3889319 - RNA, 18 nt, Human
guuuauggccucagcugc

SEQ ID NO: 3889320 - RNA, 23 nt, Human
guuuauggccucagcugccucac

SEQ ID NO: 3889321 - RNA, 18 nt, Human
guuuauguaaauguuugu

SEQ ID NO: 3889322 - RNA, 13 nt, Human
guuuaugucuaaa

SEQ ID NO: 3889323 - RNA, 23 nt, Human
guuuaugugcuauuaauauuugu

SEQ ID NO: 3889324 - RNA, 16 nt, Human
guuuaugugugugugu

SEQ ID NO: 3889325 - RNA, 21 nt, Human
guuuuagauuuucugguucua

SEQ ID NO: 3889326 - RNA, 21 nt, Human
guuuuagcuccuugacuccuu

SEQ ID NO: 3889327 - RNA, 23 nt, Human
guuuuaggucuagccuaugugga

SEQ ID NO: 3889328 - RNA, 14 nt, Human
guuuuaguugcaga

SEQ ID NO: 3889329 - RNA, 21 nt, Human
guuuuaguugcagaaacauuu

SEQ ID NO: 3889330 - RNA, 14 nt, Human
guuuuauaaaauag

SEQ ID NO: 3889331 - RNA, 16 nt, Human
guuuuauaauccuuaa

SEQ ID NO: 3889332 - RNA, 22 nt, Human
guuuuauaauuuugugaagcaa

SEQ ID NO: 3889333 - RNA, 23 nt, Human
guuuuauacuguacuuaauaaau

SEQ ID NO: 3889334 - RNA, 12 nt, Human
guuuuauauauu

SEQ ID NO: 3889335 - RNA, 20 nt, Human
guuuuaucacauguauguuu

SEQ ID NO: 3889336 - RNA, 14 nt, Human
guuuuaucaugaca

SEQ ID NO: 3889337 - RNA, 14 nt, Human
guuuuauucauugg

SEQ ID NO: 3889338 - RNA, 14 nt, Human
guuuuauuccugua

SEQ ID NO: 3889339 - RNA, 20 nt, Human
guuuuauuccuguauguugu

SEQ ID NO: 3889340 - RNA, 13 nt, Human
guuuuauuguguu

SEQ ID NO: 3889341 - RNA, 14 nt, Human
guuuuauuuuaugu

SEQ ID NO: 3889342 - RNA, 21 nt, Human
guuuuauuuucuaaaguacug

SEQ ID NO: 3889343 - RNA, 21 nt, Human
guuuuauuuuuuauuguuuuc

SEQ ID NO: 3889344 - RNA, 14 nt, Human
guuuucaaauggag

SEQ ID NO: 3889345 - RNA, 23 nt, Human
guuuucaaauuggacuuucaaaa

SEQ ID NO: 3889346 - RNA, 23 nt, Human
guuuucaacucuucccugaacuu

SEQ ID NO: 3889347 - RNA, 11 nt, Human
guuuucacucu

SEQ ID NO: 3889348 - RNA, 12 nt, Human
guuuucacucuu

SEQ ID NO: 3889349 - RNA, 22 nt, Human
guuuucaggugcucaaaaugca

SEQ ID NO: 3889350 - RNA, 16 nt, Human
guuuucaguguacaug

SEQ ID NO: 3889351 - RNA, 17 nt, Human
guuuucauauuuuucaa

SEQ ID NO: 3889352 - RNA, 19 nt, Human
guuuucauccauaacugaa

SEQ ID NO: 3889353 - RNA, 20 nt, Human
guuuucauccauaacugaac

SEQ ID NO: 3889354 - RNA, 21 nt, Human
guuuucauccauaacugaaca

SEQ ID NO: 3889355 - RNA, 22 nt, Human
guuuucauggugaaaauguacu

SEQ ID NO: 3889356 - RNA, 23 nt, Human
guuuucauggugaaaauguacug

SEQ ID NO: 3889357 - RNA, 16 nt, Human
guuuucauguaaauaa

SEQ ID NO: 3889358 - RNA, 22 nt, Human
guuuucauuuacucuaaaaacu

SEQ ID NO: 3889359 - RNA, 16 nt, Human
guuuucauuugguuca

SEQ ID NO: 3889360 - RNA, 15 nt, Human
guuuuccaugaaaac

SEQ ID NO: 3889361 - RNA, 18 nt, Human
guuuuccaugaaaacguu

SEQ ID NO: 3889362 - RNA, 19 nt, Human
guuuuccaugaguccccug

SEQ ID NO: 3889363 - RNA, 23 nt, Human
guuuucccgagcaaagucuaaag

SEQ ID NO: 3889364 - RNA, 20 nt, Human
guuuucccuugaggaaacaa

SEQ ID NO: 3889365 - RNA, 21 nt, Human
guuuuccgcauucuuuguaca

SEQ ID NO: 3889366 - RNA, 17 nt, Human
guuuuccuaaaugcagu

SEQ ID NO: 3889367 - RNA, 16 nt, Human
guuuuccuaaauguau

SEQ ID NO: 3889368 - RNA, 17 nt, Human
guuuuccuaugcuuuga

SEQ ID NO: 3889369 - RNA, 14 nt, Human
guuuuccucccuuc

SEQ ID NO: 3889370 - RNA, 13 nt, Human
guuuuccugaaga

SEQ ID NO: 3889371 - RNA, 18 nt, Human
guuuuccuguauaggaau

SEQ ID NO: 3889372 - RNA, 17 nt, Human
guuuuccuuucucaccg

SEQ ID NO: 3889373 - RNA, 17 nt, Human
guuuucgaagcucagcc

SEQ ID NO: 3889374 - RNA, 14 nt, Human
guuuucuaaauuua

SEQ ID NO: 3889375 - RNA, 14 nt, Human
guuuucuaauugcu

SEQ ID NO: 3889376 - RNA, 16 nt, Human
guuuucuccucccagg

SEQ ID NO: 3889377 - RNA, 20 nt, Human
guuuucuccugccugugcug

SEQ ID NO: 3889378 - RNA, 19 nt, Human
guuuucucucggcucccca

SEQ ID NO: 3889379 - RNA, 14 nt, Human
guuuucucugaaca

SEQ ID NO: 3889380 - RNA, 16 nt, Human
guuuucugagaaagac

SEQ ID NO: 3889381 - RNA, 17 nt, Human
guuuucugagaaagacu

SEQ ID NO: 3889382 - RNA, 14 nt, Human
guuuucugagcccg

SEQ ID NO: 3889383 - RNA, 16 nt, Human
guuuucugggugucca

SEQ ID NO: 3889384 - RNA, 15 nt, Human
guuuucuguucuuuc

SEQ ID NO: 3889385 - RNA, 16 nt, Human
guuuucuguucuuucu

SEQ ID NO: 3889386 - RNA, 14 nt, Human
guuuucuguuucua

SEQ ID NO: 3889387 - RNA, 16 nt, Human
guuuucuuaacuuaaa

SEQ ID NO: 3889388 - RNA, 22 nt, Human
guuuucuuaaggugaggccugu

SEQ ID NO: 3889389 - RNA, 12 nt, Human
guuuucuuccca

SEQ ID NO: 3889390 - RNA, 15 nt, Human
guuuucuucccauca

SEQ ID NO: 3889391 - RNA, 20 nt, Human
guuuucuucccaucacugga

SEQ ID NO: 3889392 - RNA, 23 nt, Human
guuuucuugauaauuuuccuuua

SEQ ID NO: 3889393 - RNA, 17 nt, Human
guuuucuuuaugucuuu

SEQ ID NO: 3889394 - RNA, 18 nt, Human
guuuucuuuccuccuuuc

SEQ ID NO: 3889395 - RNA, 15 nt, Human
guuuucuuucuuuaa

SEQ ID NO: 3889396 - RNA, 17 nt, Human
guuuucuuucuuuaaau

SEQ ID NO: 3889397 - RNA, 14 nt, Human
guuuucuuugaaug

SEQ ID NO: 3889398 - RNA, 13 nt, Human
guuuugaaaagcu

SEQ ID NO: 3889399 - RNA, 22 nt, Human
guuuugaacuaauaaaagcaua

SEQ ID NO: 3889400 - RNA, 18 nt, Human
guuuugaauauuacuccu

SEQ ID NO: 3889401 - RNA, 18 nt, Human
guuuugacaucagccagc

SEQ ID NO: 3889402 - RNA, 16 nt, Human
guuuugacggaugauu

SEQ ID NO: 3889403 - RNA, 12 nt, Human
guuuugagcccu

SEQ ID NO: 3889404 - RNA, 22 nt, Human
guuuugaguagauauuacuuua

SEQ ID NO: 3889405 - RNA, 14 nt, Human
guuuugauaaagua

SEQ ID NO: 3889406 - RNA, 20 nt, Human
guuuugauaaaguaguaaaa

SEQ ID NO: 3889407 - RNA, 16 nt, Human
guuuugauaugaguau

SEQ ID NO: 3889408 - RNA, 22 nt, Human
guuuugauguuuguggccucag

SEQ ID NO: 3889409 - RNA, 13 nt, Human
guuuugauugaga

SEQ ID NO: 3889410 - RNA, 19 nt, Human
guuuugauugagaguaacu

SEQ ID NO: 3889411 - RNA, 21 nt, Human
guuuugccauguuggccaggc

SEQ ID NO: 3889412 - RNA, 20 nt, Human
guuuuggcaaacgcuaaaga

SEQ ID NO: 3889413 - RNA, 20 nt, Human
guuuuggcugaaauucuccu

SEQ ID NO: 3889414 - RNA, 15 nt, Human
guuuuggguauguuu

SEQ ID NO: 3889415 - RNA, 16 nt, Human
guuuugguccacuuuu

SEQ ID NO: 3889416 - RNA, 14 nt, Human
guuuugguuuuuuu

SEQ ID NO: 3889417 - RNA, 13 nt, Human
guuuuguaaaaga

SEQ ID NO: 3889418 - RNA, 14 nt, Human
guuuuguaaaagaa

SEQ ID NO: 3889419 - RNA, 16 nt, Human
guuuuguaaacauuua

SEQ ID NO: 3889420 - RNA, 13 nt, Human
guuuuguaaaguc

SEQ ID NO: 3889421 - RNA, 13 nt, Human
guuuuguaagaaa

SEQ ID NO: 3889422 - RNA, 16 nt, Human
guuuuguaagaugcug

SEQ ID NO: 3889423 - RNA, 17 nt, Human
guuuuguaagaugcugg

SEQ ID NO: 3889424 - RNA, 18 nt, Human
guuuuguagguacuuuug

SEQ ID NO: 3889425 - RNA, 22 nt, Human
guuuuguauacaaauauauugu

SEQ ID NO: 3889426 - RNA, 15 nt, Human
guuuuguauucucug

SEQ ID NO: 3889427 - RNA, 17 nt, Human
guuuugucaaacuguag

SEQ ID NO: 3889428 - RNA, 19 nt, Human
guuuugugaaauuuuucau

SEQ ID NO: 3889429 - RNA, 22 nt, Human
guuuugugaaauuuuucauauu

SEQ ID NO: 3889430 - RNA, 14 nt, Human
guuuugugucucuu

SEQ ID NO: 3889431 - RNA, 16 nt, Human
guuuuguuccccuccu

SEQ ID NO: 3889432 - RNA, 21 nt, Human
guuuuguuccccuccuccacu

SEQ ID NO: 3889433 - RNA, 22 nt, Human
guuuuguuccccuccuccacuc

SEQ ID NO: 3889434 - RNA, 14 nt, Human
guuuuguugacauu

SEQ ID NO: 3889435 - RNA, 17 nt, Human
guuuuguugacauucug

SEQ ID NO: 3889436 - RNA, 18 nt, Human
guuuuguugcacugaagu

SEQ ID NO: 3889437 - RNA, 14 nt, Human
guuuuguuuacaga

SEQ ID NO: 3889438 - RNA, 19 nt, Human
guuuuguuuccuuucacug

SEQ ID NO: 3889439 - RNA, 20 nt, Human
guuuuguuucgcucuuugag

SEQ ID NO: 3889440 - RNA, 15 nt, Human
guuuuguuugucucu

SEQ ID NO: 3889441 - RNA, 17 nt, Human
guuuuguuuuaaaauua

SEQ ID NO: 3889442 - RNA, 12 nt, Human
guuuuguuuugg

SEQ ID NO: 3889443 - RNA, 20 nt, Human
guuuuguuuuuuaguuccca

SEQ ID NO: 3889444 - RNA, 14 nt, Human
guuuuuaaaaauua

SEQ ID NO: 3889445 - RNA, 15 nt, Human
guuuuuaaaaauuag

SEQ ID NO: 3889446 - RNA, 13 nt, Human
guuuuuaaaaguu

SEQ ID NO: 3889447 - RNA, 15 nt, Human
guuuuuaaaaguuuc

SEQ ID NO: 3889448 - RNA, 16 nt, Human
guuuuuaaaaguuuca

SEQ ID NO: 3889449 - RNA, 15 nt, Human
guuuuuaaaaucuua

SEQ ID NO: 3889450 - RNA, 15 nt, Human
guuuuuaaacuguac

SEQ ID NO: 3889451 - RNA, 16 nt, Human
guuuuuaaacuguaca

SEQ ID NO: 3889452 - RNA, 18 nt, Human
guuuuuaaacuguacagu

SEQ ID NO: 3889453 - RNA, 19 nt, Human
guuuuuaaauuuuguaaug

SEQ ID NO: 3889454 - RNA, 20 nt, Human
guuuuuaaauuuuguaauga

SEQ ID NO: 3889455 - RNA, 21 nt, Human
guuuuuaacucuacuguguaa

SEQ ID NO: 3889456 - RNA, 19 nt, Human
guuuuuaauaaaagaaaau

SEQ ID NO: 3889457 - RNA, 20 nt, Human
guuuuuaauagcuauggaau

SEQ ID NO: 3889458 - RNA, 18 nt, Human
guuuuuaauauaaagccu

SEQ ID NO: 3889459 - RNA, 20 nt, Human
guuuuuacccauauccccuc

SEQ ID NO: 3889460 - RNA, 21 nt, Human
guuuuuaccuaccacaguguc

SEQ ID NO: 3889461 - RNA, 20 nt, Human
guuuuuaccugucacauugc

SEQ ID NO: 3889462 - RNA, 21 nt, Human
guuuuuaccugucacauugca

SEQ ID NO: 3889463 - RNA, 14 nt, Human
guuuuuacugcucu

SEQ ID NO: 3889464 - RNA, 20 nt, Human
guuuuuaugauaucccugau

SEQ ID NO: 3889465 - RNA, 23 nt, Human
guuuuuauggcuuuugugcauua

SEQ ID NO: 3889466 - RNA, 13 nt, Human
guuuuuauuaaaa

SEQ ID NO: 3889467 - RNA, 16 nt, Human
guuuuuauuaaaacau

SEQ ID NO: 3889468 - RNA, 14 nt, Human
guuuuuauuaaaag

SEQ ID NO: 3889469 - RNA, 17 nt, Human
guuuuuauuucuccuuu

SEQ ID NO: 3889470 - RNA, 14 nt, Human
uaaaaauauugugu

SEQ ID NO: 3889471 - RNA, 21 nt, Human
uaaaaauauuguguugugaau

SEQ ID NO: 3889472 - RNA, 15 nt, Human
uaaaaaucauaguac

SEQ ID NO: 3889473 - RNA, 20 nt, Human
uaaaaaucucaaauuucuaa

SEQ ID NO: 3889474 - RNA, 21 nt, Human
uaaaaaucucaaauuucuaaa

SEQ ID NO: 3889475 - RNA, 14 nt, Human
uaaaaaugaaauua

SEQ ID NO: 3889476 - RNA, 13 nt, Human
uaaaaaugacaga

SEQ ID NO: 3889477 - RNA, 16 nt, Human
uaaaaaugauuucagu

SEQ ID NO: 3889478 - RNA, 11 nt, Human
uaaaaaugcaa

SEQ ID NO: 3889479 - RNA, 20 nt, Human
uaaaaaugcaaauccuaugu

SEQ ID NO: 3889480 - RNA, 23 nt, Human
uaaaaauggaaaaauaaacacua

SEQ ID NO: 3889481 - RNA, 17 nt, Human
uaaaaaugggacuucuu

SEQ ID NO: 3889482 - RNA, 15 nt, Human
uaaaaaugguaaaau

SEQ ID NO: 3889483 - RNA, 18 nt, Human
uaaaaaugguaaaauugc

SEQ ID NO: 3889484 - RNA, 12 nt, Human
uaaaaauggugg

SEQ ID NO: 3889485 - RNA, 13 nt, Human
uaaaaaugguggc

SEQ ID NO: 3889486 - RNA, 21 nt, Human
uaaaaauguaaauauucuaua

SEQ ID NO: 3889487 - RNA, 13 nt, Human
uaaaaaugucuua

SEQ ID NO: 3889488 - RNA, 23 nt, Human
uaaaaaugucuugcuguugacau

SEQ ID NO: 3889489 - RNA, 17 nt, Human
uaaaaauuacuguguua

SEQ ID NO: 3889490 - RNA, 14 nt, Human
uaaaaauuccagaa

SEQ ID NO: 3889491 - RNA, 21 nt, Human
uaaaaauucuagauuaccaug

SEQ ID NO: 3889492 - RNA, 14 nt, Human
uaaaaauucugaau

SEQ ID NO: 3889493 - RNA, 19 nt, Human
uaaaaauuuacuacaauau

SEQ ID NO: 3889494 - RNA, 12 nt, Human
uaaaacaaaaaa

SEQ ID NO: 3889495 - RNA, 17 nt, Human
uaaaacaaaacaaaaca

SEQ ID NO: 3889496 - RNA, 20 nt, Human
uaaaacaaaacaaaacaaca

SEQ ID NO: 3889497 - RNA, 15 nt, Human
uaaaacaaaauuuga

SEQ ID NO: 3889498 - RNA, 21 nt, Human
uaaaacaaaauuugacuaauu

SEQ ID NO: 3889499 - RNA, 18 nt, Human
uaaaacaaacaauaccug

SEQ ID NO: 3889500 - RNA, 14 nt, Human
uaaaacaaagggca

SEQ ID NO: 3889501 - RNA, 17 nt, Human
uaaaacaagaaaguuuc

SEQ ID NO: 3889502 - RNA, 20 nt, Human
uaaaacaagaaaguuucccc

SEQ ID NO: 3889503 - RNA, 16 nt, Human
uaaaacaaugucaagg

SEQ ID NO: 3889504 - RNA, 23 nt, Human
uaaaacacaacaucuuuuucuac

SEQ ID NO: 3889505 - RNA, 12 nt, Human
uaaaacacagag

SEQ ID NO: 3889506 - RNA, 19 nt, Human
uaaaacacuucauugaaaa

SEQ ID NO: 3889507 - RNA, 13 nt, Human
uaaaacacuucug

SEQ ID NO: 3889508 - RNA, 18 nt, Human
uaaaacacuucuguccug

SEQ ID NO: 3889509 - RNA, 11 nt, Human
uaaaacacuug

SEQ ID NO: 3889510 - RNA, 17 nt, Human
uaaaacagacacuggca

SEQ ID NO: 3889511 - RNA, 18 nt, Human
uaaaacagacacuggcau

SEQ ID NO: 3889512 - RNA, 19 nt, Human
uaaaacagaguaaucuugu

SEQ ID NO: 3889513 - RNA, 23 nt, Human
uaaaacagcugucucuaacuuau

SEQ ID NO: 3889514 - RNA, 21 nt, Human
uaaaacagguagaauuaucua

SEQ ID NO: 3889515 - RNA, 22 nt, Human
uaaaacagguagaauuaucuaa

SEQ ID NO: 3889516 - RNA, 13 nt, Human
uaaaacaguauuu

SEQ ID NO: 3889517 - RNA, 22 nt, Human
uaaaacaguuggcaugcauccc

SEQ ID NO: 3889518 - RNA, 14 nt, Human
uaaaacauagcaaa

SEQ ID NO: 3889519 - RNA, 15 nt, Human
uaaaacauagcaaau

SEQ ID NO: 3889520 - RNA, 20 nt, Human
uaaaacaucauuccuuuuua

SEQ ID NO: 3889521 - RNA, 12 nt, Human
uaaaacaucuuu

SEQ ID NO: 3889522 - RNA, 14 nt, Human
uaaaacauguaaua

SEQ ID NO: 3889523 - RNA, 16 nt, Human
uaaaacauuaaaauau

SEQ ID NO: 3889524 - RNA, 20 nt, Human
uaaaacauuggauuauccug

SEQ ID NO: 3889525 - RNA, 20 nt, Human
uaaaacauuuauuuugacau

SEQ ID NO: 3889526 - RNA, 15 nt, Human
uaaaacauuuucaca

SEQ ID NO: 3889527 - RNA, 14 nt, Human
uaaaaccacagcag

SEQ ID NO: 3889528 - RNA, 15 nt, Human
uaaaaccacagcagu

SEQ ID NO: 3889529 - RNA, 13 nt, Human
uaaaacccaagug

SEQ ID NO: 3889530 - RNA, 17 nt, Human
uaaaacccguugauuac

SEQ ID NO: 3889531 - RNA, 13 nt, Human
uaaaaccuggaga

SEQ ID NO: 3889532 - RNA, 11 nt, Human
uaaaaccuuuc

SEQ ID NO: 3889533 - RNA, 20 nt, Human
uaaaaccuuucaaauuucac

SEQ ID NO: 3889534 - RNA, 15 nt, Human
uaaaacuaaauagca

SEQ ID NO: 3889535 - RNA, 20 nt, Human
uaaaacuaaauagcauguau

SEQ ID NO: 3889536 - RNA, 17 nt, Human
uaaaacuacuuagcacu

SEQ ID NO: 3889537 - RNA, 22 nt, Human
uaaaacuauauucauuuccacu

SEQ ID NO: 3889538 - RNA, 17 nt, Human
uaaaacucacugugauc

SEQ ID NO: 3889539 - RNA, 14 nt, Human
uaaaacucuuuuaa

SEQ ID NO: 3889540 - RNA, 18 nt, Human
uaaaacugaagucugaaa

SEQ ID NO: 3889541 - RNA, 18 nt, Human
uaaaacugaugugaaacu

SEQ ID NO: 3889542 - RNA, 12 nt, Human
uaaaacugcuuu

SEQ ID NO: 3889543 - RNA, 18 nt, Human
uaaaacuggaccuguaua

SEQ ID NO: 3889544 - RNA, 19 nt, Human
uaaaacuggcaucugacac

SEQ ID NO: 3889545 - RNA, 16 nt, Human
uaaaacuggccugacu

SEQ ID NO: 3889546 - RNA, 17 nt, Human
uaaaacuggcuuuggcu

SEQ ID NO: 3889547 - RNA, 20 nt, Human
uaaaacuguacuuugauuca

SEQ ID NO: 3889548 - RNA, 22 nt, Human
uaaaacuucuuaaauaucuuuu

SEQ ID NO: 3889549 - RNA, 13 nt, Human
uaaaacuugcugc

SEQ ID NO: 3889550 - RNA, 13 nt, Human
uaaaacuuuauuu

SEQ ID NO: 3889551 - RNA, 17 nt, Human
uaaaacuuuccucgccu

SEQ ID NO: 3889552 - RNA, 21 nt, Human
uaaaacuuugaaguuagcuuu

SEQ ID NO: 3889553 - RNA, 16 nt, Human
uaaaacuuugcugcca

SEQ ID NO: 3889554 - RNA, 17 nt, Human
uaaaagaaaauaaaaaa

SEQ ID NO: 3889555 - RNA, 13 nt, Human
uaaaagaaacacu

SEQ ID NO: 3889556 - RNA, 16 nt, Human
uaaaagaaacccugca

SEQ ID NO: 3889557 - RNA, 13 nt, Human
uaaaagaaacuuu

SEQ ID NO: 3889558 - RNA, 19 nt, Human
uaaaagaaagaaagaaaaa

SEQ ID NO: 3889559 - RNA, 20 nt, Human
uaaaagaaaggguucuguaa

SEQ ID NO: 3889560 - RNA, 23 nt, Human
uaaaagaaaggguucuguaaaau

SEQ ID NO: 3889561 - RNA, 16 nt, Human
uaaaagaaauaaacca

SEQ ID NO: 3889562 - RNA, 20 nt, Human
uaaaagaaaugcacaauguc

SEQ ID NO: 3889563 - RNA, 17 nt, Human
uaaaagaacaguaaaca

SEQ ID NO: 3889564 - RNA, 22 nt, Human
uaaaagaagaaauaguucugug

SEQ ID NO: 3889565 - RNA, 13 nt, Human
uaaaagaauauuu

SEQ ID NO: 3889566 - RNA, 16 nt, Human
uaaaagaauauuuuaa

SEQ ID NO: 3889567 - RNA, 12 nt, Human
uaaaagaaugau

SEQ ID NO: 3889568 - RNA, 20 nt, Human
uaaaagaaugggcaguuaca

SEQ ID NO: 3889569 - RNA, 12 nt, Human
uaaaagacaaau

SEQ ID NO: 3889570 - RNA, 23 nt, Human
uaaaagacaguguauguagaagc

SEQ ID NO: 3889571 - RNA, 16 nt, Human
uaaaagacucauccgu

SEQ ID NO: 3889572 - RNA, 22 nt, Human
uaaaagagaccacccauaucau

SEQ ID NO: 3889573 - RNA, 23 nt, Human
uaaaagagaccacccauaucaug

SEQ ID NO: 3889574 - RNA, 16 nt, Human
uaaaagagagagagag

SEQ ID NO: 3889575 - RNA, 17 nt, Human
uaaaagauaaauauuau

SEQ ID NO: 3889576 - RNA, 21 nt, Human
uaaaagauacaguuacucaga

SEQ ID NO: 3889577 - RNA, 12 nt, Human
uaaaagauauaa

SEQ ID NO: 3889578 - RNA, 21 nt, Human
uaaaagauauaagugcuguau

SEQ ID NO: 3889579 - RNA, 22 nt, Human
uaaaagauauaagugcuguaua

SEQ ID NO: 3889580 - RNA, 17 nt, Human
uaaaagaugaaagagca

SEQ ID NO: 3889581 - RNA, 22 nt, Human
uaaaagaugaaguuuuauacac

SEQ ID NO: 3889582 - RNA, 16 nt, Human
uaaaagaugcaaugua

SEQ ID NO: 3889583 - RNA, 15 nt, Human
uaaaagaugcuuuua

SEQ ID NO: 3889584 - RNA, 12 nt, Human
uaaaagauucau

SEQ ID NO: 3889585 - RNA, 19 nt, Human
uaaaagauucauuuuuaau

SEQ ID NO: 3889586 - RNA, 20 nt, Human
uaaaagauucauuuuuaauc

SEQ ID NO: 3889587 - RNA, 14 nt, Human
uaaaagauugagaa

SEQ ID NO: 3889588 - RNA, 16 nt, Human
uaaaagcaaaaaagaa

SEQ ID NO: 3889589 - RNA, 20 nt, Human
uaaaagcaaaaaagaaaacc

SEQ ID NO: 3889590 - RNA, 22 nt, Human
uaaaagcaaaaaagaaaaccuu

SEQ ID NO: 3889591 - RNA, 23 nt, Human
uaaaagcaaaaaagaaaaccuuu

SEQ ID NO: 3889592 - RNA, 21 nt, Human
uaaaagcaaaauaaaaacuau

SEQ ID NO: 3889593 - RNA, 21 nt, Human
uaaaagcaaaucauuuguuua

SEQ ID NO: 3889594 - RNA, 19 nt, Human
uaaaagcaacaucagcuug

SEQ ID NO: 3889595 - RNA, 11 nt, Human
uaaaagcacac

SEQ ID NO: 3889596 - RNA, 22 nt, Human
uaaaagcagaaaauaaaggaag

SEQ ID NO: 3889597 - RNA, 20 nt, Human
uaaaagcagcaucugcuaau

SEQ ID NO: 3889598 - RNA, 21 nt, Human
uaaaagcaggcuucuaugaaa

SEQ ID NO: 3889599 - RNA, 15 nt, Human
uaaaagcauaaaugc

SEQ ID NO: 3889600 - RNA, 14 nt, Human
uaaaagcauuuugu

SEQ ID NO: 3889601 - RNA, 17 nt, Human
uaaaagcauuuuguaau

SEQ ID NO: 3889602 - RNA, 18 nt, Human
uaaaagcauuuuguaaua

SEQ ID NO: 3889603 - RNA, 14 nt, Human
uaaaagcauuuuuu

SEQ ID NO: 3889604 - RNA, 18 nt, Human
uaaaagccaucauguaaa

SEQ ID NO: 3889605 - RNA, 21 nt, Human
uaaaagccuuggccucagagg

SEQ ID NO: 3889606 - RNA, 15 nt, Human
uaaaagcuuucaugu

SEQ ID NO: 3889607 - RNA, 14 nt, Human
uaaaaggaaaagca

SEQ ID NO: 3889608 - RNA, 15 nt, Human
uaaaaggaaagaaaa

SEQ ID NO: 3889609 - RNA, 12 nt, Human
uaaaaggagcca

SEQ ID NO: 3889610 - RNA, 18 nt, Human
uaaaaggauaguauuuuu

SEQ ID NO: 3889611 - RNA, 18 nt, Human
uaaaaggcaaauguguac

SEQ ID NO: 3889612 - RNA, 19 nt, Human
uaaaaggcaaauguguaca

SEQ ID NO: 3889613 - RNA, 17 nt, Human
uaaaagggacugagaaa

SEQ ID NO: 3889614 - RNA, 21 nt, Human
uaaaagggauuacccaagcaa

SEQ ID NO: 3889615 - RNA, 20 nt, Human
uaagagcaccuuccucacuu

SEQ ID NO: 3889616 - RNA, 22 nt, Human
uaagagcaguccauuucuacca

SEQ ID NO: 3889617 - RNA, 22 nt, Human
uaagagccauuuaggggccacu

SEQ ID NO: 3889618 - RNA, 18 nt, Human
uaagagcuagcgcugccg

SEQ ID NO: 3889619 - RNA, 14 nt, Human
uaagagcucaggau

SEQ ID NO: 3889620 - RNA, 17 nt, Human
uaagagcuggugucuga

SEQ ID NO: 3889621 - RNA, 18 nt, Human
uaagaggaaaguacauuu

SEQ ID NO: 3889622 - RNA, 17 nt, Human
uaagaggcagaaaauug

SEQ ID NO: 3889623 - RNA, 23 nt, Human
uaagaggcagaaaauugcacaau

SEQ ID NO: 3889624 - RNA, 15 nt, Human
uaagaggcagcguga

SEQ ID NO: 3889625 - RNA, 14 nt, Human
uaagaggcugauaa

SEQ ID NO: 3889626 - RNA, 16 nt, Human
uaagaggcugcccucc

SEQ ID NO: 3889627 - RNA, 20 nt, Human
uaagaggcugcccuccugug

SEQ ID NO: 3889628 - RNA, 23 nt, Human
uaagagggauuagggagagaaga

SEQ ID NO: 3889629 - RNA, 14 nt, Human
uaagagugcugggc

SEQ ID NO: 3889630 - RNA, 12 nt, Human
uaagaguguaga

SEQ ID NO: 3889631 - RNA, 22 nt, Human
uaagaguguagaagcauuccuu

SEQ ID NO: 3889632 - RNA, 23 nt, Human
uaagaguguagaagcauuccuuc

SEQ ID NO: 3889633 - RNA, 16 nt, Human
uaagauaaaugugcug

SEQ ID NO: 3889634 - RNA, 17 nt, Human
uaagauaaaugugcuga

SEQ ID NO: 3889635 - RNA, 12 nt, Human
uaagauaauuau

SEQ ID NO: 3889636 - RNA, 12 nt, Human
uaagauacuguu

SEQ ID NO: 3889637 - RNA, 15 nt, Human
uaagauaguguaacu

SEQ ID NO: 3889638 - RNA, 16 nt, Human
uaagauaguguaacuu

SEQ ID NO: 3889639 - RNA, 20 nt, Human
uaagauaguguaacuugcuu

SEQ ID NO: 3889640 - RNA, 19 nt, Human
uaagauaugggacauuuuu

SEQ ID NO: 3889641 - RNA, 14 nt, Human
uaagauauuuuuca

SEQ ID NO: 3889642 - RNA, 19 nt, Human
uaagauauuuuucaugauu

SEQ ID NO: 3889643 - RNA, 13 nt, Human
uaagaucacuguu

SEQ ID NO: 3889644 - RNA, 14 nt, Human
uaagaucacuguuu

SEQ ID NO: 3889645 - RNA, 23 nt, Human
uaagauccuagauccuaaggguc

SEQ ID NO: 3889646 - RNA, 16 nt, Human
uaagaucgguuaacaa

SEQ ID NO: 3889647 - RNA, 17 nt, Human
uaagaucgguuaacaaa

SEQ ID NO: 3889648 - RNA, 13 nt, Human
uaagaucucagug

SEQ ID NO: 3889649 - RNA, 11 nt, Human
uaagaugcugg

SEQ ID NO: 3889650 - RNA, 18 nt, Human
uaagauggaagcuuccag

SEQ ID NO: 3889651 - RNA, 17 nt, Human
uaagauggauucucaga

SEQ ID NO: 3889652 - RNA, 22 nt, Human
uaagauggauucucagauauuu

SEQ ID NO: 3889653 - RNA, 19 nt, Human
uaagaugucuguuugcuga

SEQ ID NO: 3889654 - RNA, 22 nt, Human
uaagauguuauauuuuucuuaa

SEQ ID NO: 3889655 - RNA, 17 nt, Human
uaagauuaagagcaaau

SEQ ID NO: 3889656 - RNA, 15 nt, Human
uaagauuagaaugaa

SEQ ID NO: 3889657 - RNA, 20 nt, Human
uaagauuauagauucuaaag

SEQ ID NO: 3889658 - RNA, 21 nt, Human
uaagauuauagauucuaaaga

SEQ ID NO: 3889659 - RNA, 16 nt, Human
uaagauuccuuuucuu

SEQ ID NO: 3889660 - RNA, 12 nt, Human
uaagauucuaac

SEQ ID NO: 3889661 - RNA, 13 nt, Human
uaagauucuaaug

SEQ ID NO: 3889662 - RNA, 11 nt, Human
uaagauucuag

SEQ ID NO: 3889663 - RNA, 17 nt, Human
uaagauucugauuuuag

SEQ ID NO: 3889664 - RNA, 19 nt, Human
uaagauuguuauuaaaugu

SEQ ID NO: 3889665 - RNA, 20 nt, Human
uaagauuguuauuaaaugua

SEQ ID NO: 3889666 - RNA, 17 nt, Human
uaagauuuaauuugcca

SEQ ID NO: 3889667 - RNA, 19 nt, Human
uaagauuuagagaugaauu

SEQ ID NO: 3889668 - RNA, 16 nt, Human
uaagauuuauuuuguu

SEQ ID NO: 3889669 - RNA, 19 nt, Human
uaagauuuguuuuuaaacu

SEQ ID NO: 3889670 - RNA, 22 nt, Human
uaagauuuguuuuuaaacugua

SEQ ID NO: 3889671 - RNA, 13 nt, Human
uaagauuuugaaa

SEQ ID NO: 3889672 - RNA, 18 nt, Human
uaagauuuuucucaaagu

SEQ ID NO: 3889673 - RNA, 23 nt, Human
uaagcaaagggagcacuggguug

SEQ ID NO: 3889674 - RNA, 14 nt, Human
uaagcaaauguuaa

SEQ ID NO: 3889675 - RNA, 20 nt, Human
uaagcaaauuucaaaagaca

SEQ ID NO: 3889676 - RNA, 18 nt, Human
uaagcaacaauuuucaga

SEQ ID NO: 3889677 - RNA, 14 nt, Human
uaagcaagaaggca

SEQ ID NO: 3889678 - RNA, 17 nt, Human
uaagcacuacauaaacu

SEQ ID NO: 3889679 - RNA, 17 nt, Human
uaagcacucuuaaagca

SEQ ID NO: 3889680 - RNA, 14 nt, Human
uaagcacugaaaaa

SEQ ID NO: 3889681 - RNA, 14 nt, Human
uaagcacugugcua

SEQ ID NO: 3889682 - RNA, 16 nt, Human
uaagcacuuuuuaaaa

SEQ ID NO: 3889683 - RNA, 21 nt, Human
uaagcagaaagugccuuucag

SEQ ID NO: 3889684 - RNA, 17 nt, Human
uaagcagaauuggaaaa

SEQ ID NO: 3889685 - RNA, 22 nt, Human
uaagcagauggaaugcuguguu

SEQ ID NO: 3889686 - RNA, 12 nt, Human
uaagcagcucuu

SEQ ID NO: 3889687 - RNA, 23 nt, Human
uaagcaggaggaggugccaacag

SEQ ID NO: 3889688 - RNA, 21 nt, Human
uaagcagguggaucuauuuca

SEQ ID NO: 3889689 - RNA, 15 nt, Human
uaagcaguaaaaacu

SEQ ID NO: 3889690 - RNA, 21 nt, Human
uaagcaguauauuaguauuau

SEQ ID NO: 3889691 - RNA, 17 nt, Human
uaagcauacuuuguaaa

SEQ ID NO: 3889692 - RNA, 15 nt, Human
uaagcaucaaacucu

SEQ ID NO: 3889693 - RNA, 13 nt, Human
uaagcaucacaaa

SEQ ID NO: 3889694 - RNA, 19 nt, Human
uaagcaucauuauuuaugu

SEQ ID NO: 3889695 - RNA, 20 nt, Human
uaagcaucauuauuuaugua

SEQ ID NO: 3889696 - RNA, 17 nt, Human
uaagcaucuaaggacaa

SEQ ID NO: 3889697 - RNA, 15 nt, Human
uaagcaugcacaaau

SEQ ID NO: 3889698 - RNA, 19 nt, Human
uaagcauuaccacucaggc

SEQ ID NO: 3889699 - RNA, 20 nt, Human
uaagcauuacucuuguaaga

SEQ ID NO: 3889700 - RNA, 18 nt, Human
uaagcauuccaacuaucu

SEQ ID NO: 3889701 - RNA, 22 nt, Human
uaagcauugaauggcuauguuu

SEQ ID NO: 3889702 - RNA, 18 nt, Human
uaagcauuguuugcuuau

SEQ ID NO: 3889703 - RNA, 16 nt, Human
uaagccaaaacaaugu

SEQ ID NO: 3889704 - RNA, 21 nt, Human
uaagccaaaauuaagguguuu

SEQ ID NO: 3889705 - RNA, 11 nt, Human
uaagccaaaga

SEQ ID NO: 3889706 - RNA, 19 nt, Human
uaagccaauuuuucugcac

SEQ ID NO: 3889707 - RNA, 18 nt, Human
uaagccacugccucuccc

SEQ ID NO: 3889708 - RNA, 19 nt, Human
uaagccacuuaaaauguuc

SEQ ID NO: 3889709 - RNA, 21 nt, Human
uaagccagacaucaacagaua

SEQ ID NO: 3889710 - RNA, 22 nt, Human
uaagccagcaccggaccagccu

SEQ ID NO: 3889711 - RNA, 22 nt, Human
uaagccagcugcccccagagcc

SEQ ID NO: 3889712 - RNA, 19 nt, Human
uaagccaguguugccuaag

SEQ ID NO: 3889713 - RNA, 19 nt, Human
uaagccauucugacucaua

SEQ ID NO: 3889714 - RNA, 22 nt, Human
uaagccccagcaagcaauccua

SEQ ID NO: 3889715 - RNA, 16 nt, Human
uaagcccuaagguccu

SEQ ID NO: 3889716 - RNA, 19 nt, Human
uaagcccucuuccaucaug

SEQ ID NO: 3889717 - RNA, 15 nt, Human
uaagcccuggccccc

SEQ ID NO: 3889718 - RNA, 11 nt, Human
uaagcccuguc

SEQ ID NO: 3889719 - RNA, 21 nt, Human
uaagccuccauuuaguucuuu

SEQ ID NO: 3889720 - RNA, 20 nt, Human
uaagccuguggcuguggaga

SEQ ID NO: 3889721 - RNA, 14 nt, Human
uaagccuuuggaaa

SEQ ID NO: 3889722 - RNA, 21 nt, Human
uaagccuuuggaaacagcucg

SEQ ID NO: 3889723 - RNA, 16 nt, Human
uaagcuaacccccuuc

SEQ ID NO: 3889724 - RNA, 15 nt, Human
uaagcuacuagcaaa

SEQ ID NO: 3889725 - RNA, 18 nt, Human
uaagcuacuagcaaaaua

SEQ ID NO: 3889726 - RNA, 18 nt, Human
uaagcuacugccauccug

SEQ ID NO: 3889727 - RNA, 22 nt, Human
uaagcuaggaaaagaaaucuau

SEQ ID NO: 3889728 - RNA, 19 nt, Human
uaagcuauuugauguaaua

SEQ ID NO: 3889729 - RNA, 21 nt, Human
uaagcuauuugauguaauacu

SEQ ID NO: 3889730 - RNA, 23 nt, Human
uaagcuauuugauguaauacuuc

SEQ ID NO: 3889731 - RNA, 16 nt, Human
uaagcuauuuuucuaa

SEQ ID NO: 3889732 - RNA, 22 nt, Human
uaagcucacguccugagaaagc

SEQ ID NO: 3889733 - RNA, 16 nt, Human
uaagcucugagcuguc

SEQ ID NO: 3889734 - RNA, 23 nt, Human
uaagcugcaaaucugauggccuu

SEQ ID NO: 3889735 - RNA, 12 nt, Human
uaagcugcagcu

SEQ ID NO: 3889736 - RNA, 16 nt, Human
uaagcugcagcuuccu

SEQ ID NO: 3889737 - RNA, 16 nt, Human
uaagcugcucuauugu

SEQ ID NO: 3889738 - RNA, 12 nt, Human
uaagcugcuuuu

SEQ ID NO: 3889739 - RNA, 16 nt, Human
uaagcuggagugcagu

SEQ ID NO: 3889740 - RNA, 17 nt, Human
uaagcuguguccuaguu

SEQ ID NO: 3889741 - RNA, 16 nt, Human
uaagcuuaaaaaaaac

SEQ ID NO: 3889742 - RNA, 18 nt, Human
uaagcuuauuuaauuaaa

SEQ ID NO: 3889743 - RNA, 17 nt, Human
uaagcuuccaggaaaaa

SEQ ID NO: 3889744 - RNA, 22 nt, Human
uaagcuuccaggaaaaaggaca

SEQ ID NO: 3889745 - RNA, 23 nt, Human
uaagcuuccaggcugcauagaag

SEQ ID NO: 3889746 - RNA, 23 nt, Human
uaagcuuccauuuuaauuuuaaa

SEQ ID NO: 3889747 - RNA, 18 nt, Human
uaagcuuugccagcugcu

SEQ ID NO: 3889748 - RNA, 16 nt, Human
uaagcuuuucuuuucu

SEQ ID NO: 3889749 - RNA, 18 nt, Human
uaaggaaaacuaccugua

SEQ ID NO: 3889750 - RNA, 16 nt, Human
uaaggaaaaguuuaau

SEQ ID NO: 3889751 - RNA, 19 nt, Human
uaaggaaaaguuuaauauu

SEQ ID NO: 3889752 - RNA, 17 nt, Human
uaaggaaacucuuaucu

SEQ ID NO: 3889753 - RNA, 19 nt, Human
uaaggaaacucuuaucuca

SEQ ID NO: 3889754 - RNA, 14 nt, Human
uaaggaaacugggu

SEQ ID NO: 3889755 - RNA, 18 nt, Human
uaaggaaagcaauaaaug

SEQ ID NO: 3889756 - RNA, 14 nt, Human
uaaggaaccaacaa

SEQ ID NO: 3889757 - RNA, 14 nt, Human
uaaggaagaaacag

SEQ ID NO: 3889758 - RNA, 13 nt, Human
uaaggaagacaau

SEQ ID NO: 3889759 - RNA, 21 nt, Human
uaaguuacacauuuuucagau

SEQ ID NO: 3889760 - RNA, 13 nt, Human
uaaguuaucuuug

SEQ ID NO: 3889761 - RNA, 14 nt, Human
uaaguuauugcagu

SEQ ID NO: 3889762 - RNA, 17 nt, Human
uaaguuauuuuuguaca

SEQ ID NO: 3889763 - RNA, 19 nt, Human
uaaguucaaauucuucuga

SEQ ID NO: 3889764 - RNA, 13 nt, Human
uaaguucauacau

SEQ ID NO: 3889765 - RNA, 22 nt, Human
uaaguucauauuccauauuuau

SEQ ID NO: 3889766 - RNA, 14 nt, Human
uaaguuccacugag

SEQ ID NO: 3889767 - RNA, 17 nt, Human
uaaguuccacugagcuc

SEQ ID NO: 3889768 - RNA, 19 nt, Human
uaaguuccacugagcucca

SEQ ID NO: 3889769 - RNA, 20 nt, Human
uaaguucuggaugcauuucu

SEQ ID NO: 3889770 - RNA, 14 nt, Human
uaaguucuuagaua

SEQ ID NO: 3889771 - RNA, 20 nt, Human
uaaguucuuagauaucuuuu

SEQ ID NO: 3889772 - RNA, 21 nt, Human
uaaguucuuaugaggagggga

SEQ ID NO: 3889773 - RNA, 20 nt, Human
uaaguugagauaguuuucau

SEQ ID NO: 3889774 - RNA, 21 nt, Human
uaaguugagauaguuuucauc

SEQ ID NO: 3889775 - RNA, 12 nt, Human
uaaguuggaaac

SEQ ID NO: 3889776 - RNA, 15 nt, Human
uaaguuggaaacacu

SEQ ID NO: 3889777 - RNA, 18 nt, Human
uaaguuggaaacacuaaa

SEQ ID NO: 3889778 - RNA, 21 nt, Human
uaaguuggaaacacuaaaugu

SEQ ID NO: 3889779 - RNA, 16 nt, Human
uaaguuggcuucuguu

SEQ ID NO: 3889780 - RNA, 20 nt, Human
uaaguuggcuucuguuucua

SEQ ID NO: 3889781 - RNA, 16 nt, Human
uaaguuguuauuucag

SEQ ID NO: 3889782 - RNA, 17 nt, Human
uaaguuuaugucuaaag

SEQ ID NO: 3889783 - RNA, 17 nt, Human
uaaguuuauuucuuaaa

SEQ ID NO: 3889784 - RNA, 20 nt, Human
uaaguuucaaacuuacuauu

SEQ ID NO: 3889785 - RNA, 18 nt, Human
uaaguuucaggugacaug

SEQ ID NO: 3889786 - RNA, 17 nt, Human
uaaguuucaguugauuu

SEQ ID NO: 3889787 - RNA, 21 nt, Human
uaaguuuccuuccagcccaga

SEQ ID NO: 3889788 - RNA, 14 nt, Human
uaaguuucuaagau

SEQ ID NO: 3889789 - RNA, 23 nt, Human
uaaguuucuaagauucuaaaggu

SEQ ID NO: 3889790 - RNA, 13 nt, Human
uaaguuucucagc

SEQ ID NO: 3889791 - RNA, 18 nt, Human
uaaguuucucagcuccca

SEQ ID NO: 3889792 - RNA, 14 nt, Human
uaaguuucugggac

SEQ ID NO: 3889793 - RNA, 20 nt, Human
uaaguuugcacucaaaucuu

SEQ ID NO: 3889794 - RNA, 20 nt, Human
uaaguuuuuauggcuuuugu

SEQ ID NO: 3889795 - RNA, 20 nt, Human
uaauaaaaaauggaaagaau

SEQ ID NO: 3889796 - RNA, 19 nt, Human
uaauaaaaagcuuuuuccu

SEQ ID NO: 3889797 - RNA, 23 nt, Human
uaauaaaaagcuuuuuccuccug

SEQ ID NO: 3889798 - RNA, 21 nt, Human
uaauaaaaaggaguauacaaa

SEQ ID NO: 3889799 - RNA, 13 nt, Human
uaauaaaaaggca

SEQ ID NO: 3889800 - RNA, 14 nt, Human
uaauaaaaaugaca

SEQ ID NO: 3889801 - RNA, 21 nt, Human
uaauaaaaaugacagacugaa

SEQ ID NO: 3889802 - RNA, 13 nt, Human
uaauaaaacugau

SEQ ID NO: 3889803 - RNA, 11 nt, Human
uaauaaaagaa

SEQ ID NO: 3889804 - RNA, 14 nt, Human
uaauaaaagaaaau

SEQ ID NO: 3889805 - RNA, 12 nt, Human
uaauaaaauauc

SEQ ID NO: 3889806 - RNA, 16 nt, Human
uaauaaaauaucauuc

SEQ ID NO: 3889807 - RNA, 17 nt, Human
uaauaaaauauuuucug

SEQ ID NO: 3889808 - RNA, 12 nt, Human
uaauaaaaucac

SEQ ID NO: 3889809 - RNA, 15 nt, Human
uaauaaaauucaaca

SEQ ID NO: 3889810 - RNA, 18 nt, Human
uaauaaacacucuugaaa

SEQ ID NO: 3889811 - RNA, 22 nt, Human
uaauaaacauccuucaagaacu

SEQ ID NO: 3889812 - RNA, 13 nt, Human
uaauaaacauucu

SEQ ID NO: 3889813 - RNA, 19 nt, Human
uaauaaacuuuuuuuugag

SEQ ID NO: 3889814 - RNA, 14 nt, Human
uaauaaagaugcuc

SEQ ID NO: 3889815 - RNA, 14 nt, Human
uaauaaaguauaua

SEQ ID NO: 3889816 - RNA, 15 nt, Human
uaauaaaguauucca

SEQ ID NO: 3889817 - RNA, 16 nt, Human
uaauaaaguguuuuca

SEQ ID NO: 3889818 - RNA, 19 nt, Human
uaauaaaguguuuucagag

SEQ ID NO: 3889819 - RNA, 20 nt, Human
uaauaaaguguuuucagagc

SEQ ID NO: 3889820 - RNA, 16 nt, Human
uaauaaauacauacgg

SEQ ID NO: 3889821 - RNA, 13 nt, Human
uaauaaauauguu

SEQ ID NO: 3889822 - RNA, 12 nt, Human
uaauaaauauuu

SEQ ID NO: 3889823 - RNA, 15 nt, Human
uaauaaauauuuaug

SEQ ID NO: 3889824 - RNA, 18 nt, Human
uaauaaaugcccucuucu

SEQ ID NO: 3889825 - RNA, 16 nt, Human
uaauaaauuauuuauu

SEQ ID NO: 3889826 - RNA, 16 nt, Human
uaauaaauugcaugcu

SEQ ID NO: 3889827 - RNA, 20 nt, Human
uaauaacauuaccuuacugu

SEQ ID NO: 3889828 - RNA, 20 nt, Human
uaauaacucggauuccagcc

SEQ ID NO: 3889829 - RNA, 13 nt, Human
uaauaacugugua

SEQ ID NO: 3889830 - RNA, 12 nt, Human
uaauaagacaua

SEQ ID NO: 3889831 - RNA, 14 nt, Human
uaauaagacauaac

SEQ ID NO: 3889832 - RNA, 18 nt, Human
uaauaagcuaaagaggcu

SEQ ID NO: 3889833 - RNA, 20 nt, Human
uaauaagcuaguugaauacu

SEQ ID NO: 3889834 - RNA, 21 nt, Human
uaauaagcuaguugaauacuu

SEQ ID NO: 3889835 - RNA, 18 nt, Human
uaauaaggaaaaguuuaa

SEQ ID NO: 3889836 - RNA, 14 nt, Human
uaauaagggaaaaa

SEQ ID NO: 3889837 - RNA, 14 nt, Human
uaauaagguuuuaa

SEQ ID NO: 3889838 - RNA, 11 nt, Human
uaauaauaaau

SEQ ID NO: 3889839 - RNA, 13 nt, Human
uaauaauaccuca

SEQ ID NO: 3889840 - RNA, 16 nt, Human
uaauaauauacuugug

SEQ ID NO: 3889841 - RNA, 21 nt, Human
uaauaauauacuuguggacua

SEQ ID NO: 3889842 - RNA, 13 nt, Human
uaauaauauaugu

SEQ ID NO: 3889843 - RNA, 19 nt, Human
uaauaauauuguuuuucuu

SEQ ID NO: 3889844 - RNA, 19 nt, Human
uaauaaucaagagccuuaa

SEQ ID NO: 3889845 - RNA, 23 nt, Human
uaauaaucuuauuagggagaaaa

SEQ ID NO: 3889846 - RNA, 12 nt, Human
uaauaaucuugu

SEQ ID NO: 3889847 - RNA, 13 nt, Human
uaauaauggguuu

SEQ ID NO: 3889848 - RNA, 14 nt, Human
uaauaauguuucaa

SEQ ID NO: 3889849 - RNA, 20 nt, Human
uaauaauuauaugcuauuuc

SEQ ID NO: 3889850 - RNA, 20 nt, Human
uaauaauugcucauaagcaa

SEQ ID NO: 3889851 - RNA, 13 nt, Human
uaauaauuucuaa

SEQ ID NO: 3889852 - RNA, 14 nt, Human
uaauaauuucuaau

SEQ ID NO: 3889853 - RNA, 22 nt, Human
uaauaauuuuaggcacccaucc

SEQ ID NO: 3889854 - RNA, 16 nt, Human
uaauaauuuuuuaauu

SEQ ID NO: 3889855 - RNA, 18 nt, Human
uaauacaaaaggcuccau

SEQ ID NO: 3889856 - RNA, 20 nt, Human
uaauacaagguauaauaaaa

SEQ ID NO: 3889857 - RNA, 21 nt, Human
uaauacaagguauaauaaaau

SEQ ID NO: 3889858 - RNA, 20 nt, Human
uaauacaaugaugcuauuug

SEQ ID NO: 3889859 - RNA, 14 nt, Human
uaauacacaaaauc

SEQ ID NO: 3889860 - RNA, 17 nt, Human
uaauacacaaaaucaaa

SEQ ID NO: 3889861 - RNA, 21 nt, Human
uaauacagcaacaauuuauga

SEQ ID NO: 3889862 - RNA, 23 nt, Human
uaauacagcagugucaucagaag

SEQ ID NO: 3889863 - RNA, 13 nt, Human
uaauacauuaaag

SEQ ID NO: 3889864 - RNA, 13 nt, Human
uaauaccucccuu

SEQ ID NO: 3889865 - RNA, 13 nt, Human
uaauaccucugug

SEQ ID NO: 3889866 - RNA, 14 nt, Human
uaauaccucugugu

SEQ ID NO: 3889867 - RNA, 14 nt, Human
uaauacuaccuuga

SEQ ID NO: 3889868 - RNA, 22 nt, Human
uaauacuaguugugaccuuagu

SEQ ID NO: 3889869 - RNA, 18 nt, Human
uaauacucaaaugaguaa

SEQ ID NO: 3889870 - RNA, 20 nt, Human
uaauacucaaaugaguaaca

SEQ ID NO: 3889871 - RNA, 14 nt, Human
uaauacucuauuuu

SEQ ID NO: 3889872 - RNA, 15 nt, Human
uaauacugaaccacu

SEQ ID NO: 3889873 - RNA, 14 nt, Human
uaauacuguauuug

SEQ ID NO: 3889874 - RNA, 13 nt, Human
uaauacuuuguau

SEQ ID NO: 3889875 - RNA, 20 nt, Human
uaauagaauaaaggcaguuu

SEQ ID NO: 3889876 - RNA, 18 nt, Human
uaauagacaauuuauuau

SEQ ID NO: 3889877 - RNA, 21 nt, Human
uaauagagcaaaauugaugug

SEQ ID NO: 3889878 - RNA, 21 nt, Human
uaauagauguuugauagauuu

SEQ ID NO: 3889879 - RNA, 22 nt, Human
uaauagauuuuuucagacuugu

SEQ ID NO: 3889880 - RNA, 15 nt, Human
uaauagcaaagaauu

SEQ ID NO: 3889881 - RNA, 15 nt, Human
uaauagcagccuuuc

SEQ ID NO: 3889882 - RNA, 19 nt, Human
uaauagcgucauaacuaga

SEQ ID NO: 3889883 - RNA, 21 nt, Human
uaauagcgucauaacuagaac

SEQ ID NO: 3889884 - RNA, 13 nt, Human
uaauaguguuaau

SEQ ID NO: 3889885 - RNA, 15 nt, Human
uaauaguguuaauca

SEQ ID NO: 3889886 - RNA, 20 nt, Human
uaauaguguuaaucaauuua

SEQ ID NO: 3889887 - RNA, 12 nt, Human
uaauauaaaaaa

SEQ ID NO: 3889888 - RNA, 15 nt, Human
uaauauaaaaaauuu

SEQ ID NO: 3889889 - RNA, 19 nt, Human
uaauauaaaguuggaugcg

SEQ ID NO: 3889890 - RNA, 13 nt, Human
uaauauaaaugca

SEQ ID NO: 3889891 - RNA, 22 nt, Human
uaauauaaaugcaaauaacaaa

SEQ ID NO: 3889892 - RNA, 13 nt, Human
uaauauaaauuca

SEQ ID NO: 3889893 - RNA, 18 nt, Human
uaauauaagaagcuuuca

SEQ ID NO: 3889894 - RNA, 22 nt, Human
uaauauaagaagcuuucaguau

SEQ ID NO: 3889895 - RNA, 18 nt, Human
uaauauaauacacaaaau

SEQ ID NO: 3889896 - RNA, 16 nt, Human
uaauauacuauauuua

SEQ ID NO: 3889897 - RNA, 14 nt, Human
uaauauauauauau

SEQ ID NO: 3889898 - RNA, 16 nt, Human
uaauauauguuuuaaa

SEQ ID NO: 3889899 - RNA, 15 nt, Human
uaauauauuaaaauu

SEQ ID NO: 3889900 - RNA, 16 nt, Human
uaauauauuaaaauuc

SEQ ID NO: 3889901 - RNA, 17 nt, Human
uaauauauuuaaaaaua

SEQ ID NO: 3889902 - RNA, 20 nt, Human
uaauauauuuguguauuuaa

SEQ ID NO: 3889903 - RNA, 17 nt, Human
uaauauauuuucuguuu

SEQ ID NO: 3889904 - RNA, 15 nt, Human
uaauaucaauagaag

SEQ ID NO: 3889905 - RNA, 18 nt, Human
uaaugaaaaugaauaucu

SEQ ID NO: 3889906 - RNA, 13 nt, Human
uaaugaaaauguc

SEQ ID NO: 3889907 - RNA, 14 nt, Human
uaaugaaaauguca

SEQ ID NO: 3889908 - RNA, 16 nt, Human
uaaugaaacaaagagu

SEQ ID NO: 3889909 - RNA, 19 nt, Human
uaaugaaagacuguacaaa

SEQ ID NO: 3889910 - RNA, 23 nt, Human
uaaugaaagacuguacaaaguag

SEQ ID NO: 3889911 - RNA, 22 nt, Human
uaaugaaagugaugacauauuu

SEQ ID NO: 3889912 - RNA, 23 nt, Human
uaaugaaauaaaucauguuaauc

SEQ ID NO: 3889913 - RNA, 19 nt, Human
uaaugaaauaucuguauuu

SEQ ID NO: 3889914 - RNA, 14 nt, Human
uaaugaacaaaauu

SEQ ID NO: 3889915 - RNA, 16 nt, Human
uaaugaaccgcugaau

SEQ ID NO: 3889916 - RNA, 13 nt, Human
uaaugaaguuuga

SEQ ID NO: 3889917 - RNA, 17 nt, Human
uaaugaaguuugaaugu

SEQ ID NO: 3889918 - RNA, 20 nt, Human
uaaugaauaccuuagugcag

SEQ ID NO: 3889919 - RNA, 18 nt, Human
uaaugaaucuaagcagca

SEQ ID NO: 3889920 - RNA, 23 nt, Human
uaaugaaugcuuaaagaauucaa

SEQ ID NO: 3889921 - RNA, 15 nt, Human
uaaugaauggacuca

SEQ ID NO: 3889922 - RNA, 15 nt, Human
uaaugacagagccag

SEQ ID NO: 3889923 - RNA, 14 nt, Human
uaaugacauucaau

SEQ ID NO: 3889924 - RNA, 16 nt, Human
uaaugaccaugaaaga

SEQ ID NO: 3889925 - RNA, 14 nt, Human
uaaugagacuuuaa

SEQ ID NO: 3889926 - RNA, 18 nt, Human
uaaugagcuauuaaaacu

SEQ ID NO: 3889927 - RNA, 19 nt, Human
uaaugagcuauuaaaacuc

SEQ ID NO: 3889928 - RNA, 14 nt, Human
uaaugauaaaacac

SEQ ID NO: 3889929 - RNA, 22 nt, Human
uaaugauaacuggaaacuucag

SEQ ID NO: 3889930 - RNA, 13 nt, Human
uaaugauauacug

SEQ ID NO: 3889931 - RNA, 19 nt, Human
uaaugaucgaaaaaauaau

SEQ ID NO: 3889932 - RNA, 14 nt, Human
uaaugauggcccau

SEQ ID NO: 3889933 - RNA, 18 nt, Human
uaaugauuccuauaaauc

SEQ ID NO: 3889934 - RNA, 12 nt, Human
uaaugauuguuu

SEQ ID NO: 3889935 - RNA, 21 nt, Human
uaaugcaaaauuuuuuuaauc

SEQ ID NO: 3889936 - RNA, 14 nt, Human
uaaugcacuuucua

SEQ ID NO: 3889937 - RNA, 15 nt, Human
uaaugcauacagaaa

SEQ ID NO: 3889938 - RNA, 16 nt, Human
uaaugcauguuaggaa

SEQ ID NO: 3889939 - RNA, 18 nt, Human
uaaugcauucuucucugu

SEQ ID NO: 3889940 - RNA, 19 nt, Human
uaaugccauuuuaaggaaa

SEQ ID NO: 3889941 - RNA, 12 nt, Human
uaaugcccagac

SEQ ID NO: 3889942 - RNA, 22 nt, Human
uaaugccggugagaauaagaga

SEQ ID NO: 3889943 - RNA, 20 nt, Human
uaaugccugcuuuuuggaaa

SEQ ID NO: 3889944 - RNA, 15 nt, Human
uaaugccuuacucuu

SEQ ID NO: 3889945 - RNA, 19 nt, Human
uaaugcgcaggcuggcccu

SEQ ID NO: 3889946 - RNA, 22 nt, Human
uaaugcgcaggcuggcccugcc

SEQ ID NO: 3889947 - RNA, 17 nt, Human
uaaugcgccaauaaacc

SEQ ID NO: 3889948 - RNA, 21 nt, Human
uaaugcuaaauguaagaauca

SEQ ID NO: 3889949 - RNA, 22 nt, Human
uaaugcuaaucuugugaaaaua

SEQ ID NO: 3889950 - RNA, 16 nt, Human
uaaugcuacgugugau

SEQ ID NO: 3889951 - RNA, 15 nt, Human
uaaugcuacugucuc

SEQ ID NO: 3889952 - RNA, 14 nt, Human
uaaugcuguugccu

SEQ ID NO: 3889953 - RNA, 17 nt, Human
uaaugcuguugccucau

SEQ ID NO: 3889954 - RNA, 20 nt, Human
uaaugcuuagagaauguucu

SEQ ID NO: 3889955 - RNA, 11 nt, Human
uaaugcuuugg

SEQ ID NO: 3889956 - RNA, 16 nt, Human
uaaugcuuugguucug

SEQ ID NO: 3889957 - RNA, 19 nt, Human
uaauggacacuuuucaccu

SEQ ID NO: 3889958 - RNA, 17 nt, Human
uaauggacagauuaaua

SEQ ID NO: 3889959 - RNA, 13 nt, Human
uaauggaugaaau

SEQ ID NO: 3889960 - RNA, 15 nt, Human
uaauggaugaaauca

SEQ ID NO: 3889961 - RNA, 17 nt, Human
uaauggaugaaaucaua

SEQ ID NO: 3889962 - RNA, 21 nt, Human
uaauggcaguuauauuuugca

SEQ ID NO: 3889963 - RNA, 16 nt, Human
uaauggccaugguacc

SEQ ID NO: 3889964 - RNA, 21 nt, Human
uaauggcugauaauuuuaaau

SEQ ID NO: 3889965 - RNA, 18 nt, Human
uaaugggguccuggccau

SEQ ID NO: 3889966 - RNA, 17 nt, Human
uaaugguaccagauaaa

SEQ ID NO: 3889967 - RNA, 19 nt, Human
uaaugguaccagauaaaau

SEQ ID NO: 3889968 - RNA, 13 nt, Human
uaauggucuaaaa

SEQ ID NO: 3889969 - RNA, 21 nt, Human
uaauggucuaaaaauaaacca

SEQ ID NO: 3889970 - RNA, 19 nt, Human
uaaugguguagaacacuaa

SEQ ID NO: 3889971 - RNA, 15 nt, Human
uaaugguuucaaaga

SEQ ID NO: 3889972 - RNA, 14 nt, Human
uaauguaaaauguu

SEQ ID NO: 3889973 - RNA, 17 nt, Human
uaauguaaaauguugaa

SEQ ID NO: 3889974 - RNA, 15 nt, Human
uaauguacaucuggc

SEQ ID NO: 3889975 - RNA, 18 nt, Human
uaauguacugauuucagu

SEQ ID NO: 3889976 - RNA, 13 nt, Human
uaauguauauaaa

SEQ ID NO: 3889977 - RNA, 13 nt, Human
uaauguaucaaac

SEQ ID NO: 3889978 - RNA, 16 nt, Human
uaauguauguuaccaa

SEQ ID NO: 3889979 - RNA, 16 nt, Human
uaauguauucauauuu

SEQ ID NO: 3889980 - RNA, 21 nt, Human
uaauguauuuguucauguuug

SEQ ID NO: 3889981 - RNA, 15 nt, Human
uaaugucaccaccuu

SEQ ID NO: 3889982 - RNA, 21 nt, Human
uaaugucaccaccuucccagc

SEQ ID NO: 3889983 - RNA, 20 nt, Human
uaaugucauaaagugagaaa

SEQ ID NO: 3889984 - RNA, 11 nt, Human
uaaugucucug

SEQ ID NO: 3889985 - RNA, 21 nt, Human
uaaugucuucauuucauugua

SEQ ID NO: 3889986 - RNA, 15 nt, Human
uaaugucuugagcuc

SEQ ID NO: 3889987 - RNA, 20 nt, Human
uaaugugaaacuggauuaaa

SEQ ID NO: 3889988 - RNA, 11 nt, Human
uaaugugaacu

SEQ ID NO: 3889989 - RNA, 13 nt, Human
uaaugugaacuag

SEQ ID NO: 3889990 - RNA, 22 nt, Human
uaaugugaacuuguagcuguaa

SEQ ID NO: 3889991 - RNA, 20 nt, Human
uaaugugaguuuggucugga

SEQ ID NO: 3889992 - RNA, 13 nt, Human
uaaugugauauua

SEQ ID NO: 3889993 - RNA, 21 nt, Human
uaaugugaugauguaauugac

SEQ ID NO: 3889994 - RNA, 16 nt, Human
uaaugugcuguguaaa

SEQ ID NO: 3889995 - RNA, 21 nt, Human
uaaugugcuguguaaaguuag

SEQ ID NO: 3889996 - RNA, 16 nt, Human
uaaugugguuauuucu

SEQ ID NO: 3889997 - RNA, 19 nt, Human
uaauguguauuacaaauau

SEQ ID NO: 3889998 - RNA, 13 nt, Human
uaaugugugaaaa

SEQ ID NO: 3889999 - RNA, 15 nt, Human
uaauguguggauugc

SEQ ID NO: 3890000 - RNA, 18 nt, Human
uaaugugugguggccuca

SEQ ID NO: 3890001 - RNA, 12 nt, Human
uaauguguguau

SEQ ID NO: 3890002 - RNA, 23 nt, Human
uaauguguuuuagaguaagaaau

SEQ ID NO: 3890003 - RNA, 17 nt, Human
uaauguuaauauugauu

SEQ ID NO: 3890004 - RNA, 15 nt, Human
uaauguuaauucagc

SEQ ID NO: 3890005 - RNA, 14 nt, Human
uaauguuacugauc

SEQ ID NO: 3890006 - RNA, 21 nt, Human
uaauguuacugaucaugcauu

SEQ ID NO: 3890007 - RNA, 20 nt, Human
uaauguucugaauaauuucu

SEQ ID NO: 3890008 - RNA, 15 nt, Human
uaauguucugugaua

SEQ ID NO: 3890009 - RNA, 18 nt, Human
uaauguucugugauacag

SEQ ID NO: 3890010 - RNA, 23 nt, Human
uaauguucuuaugcaaaauggaa

SEQ ID NO: 3890011 - RNA, 16 nt, Human
uaauguugaacaaaau

SEQ ID NO: 3890012 - RNA, 17 nt, Human
uaauguugauuucuagu

SEQ ID NO: 3890013 - RNA, 21 nt, Human
uaauguuggacaccuuuaggu

SEQ ID NO: 3890014 - RNA, 14 nt, Human
uaauguugugaaua

SEQ ID NO: 3890015 - RNA, 16 nt, Human
uaauguugugaauaau

SEQ ID NO: 3890016 - RNA, 19 nt, Human
uaauguugugaauaauuac

SEQ ID NO: 3890017 - RNA, 21 nt, Human
uaauguugugaauaauuacag

SEQ ID NO: 3890018 - RNA, 16 nt, Human
uaauguuuaagcagaa

SEQ ID NO: 3890019 - RNA, 16 nt, Human
uaauguuuaugagcca

SEQ ID NO: 3890020 - RNA, 17 nt, Human
uaauguuuauuaaaugc

SEQ ID NO: 3890021 - RNA, 17 nt, Human
uaauguuucuaucugau

SEQ ID NO: 3890022 - RNA, 14 nt, Human
uaauguuugcauau

SEQ ID NO: 3890023 - RNA, 15 nt, Human
uaauguuugcauaua

SEQ ID NO: 3890024 - RNA, 16 nt, Human
uaauguuugcauauaa

SEQ ID NO: 3890025 - RNA, 18 nt, Human
uaauuaaaaacuaguagu

SEQ ID NO: 3890026 - RNA, 19 nt, Human
uaauuaaaaacuaguaguu

SEQ ID NO: 3890027 - RNA, 15 nt, Human
uaauuaaaacacuuu

SEQ ID NO: 3890028 - RNA, 18 nt, Human
uaauuaaaagcaaaucau

SEQ ID NO: 3890029 - RNA, 19 nt, Human
uaauuaaaagcaaaucauu

SEQ ID NO: 3890030 - RNA, 14 nt, Human
uaauuaaacuguua

SEQ ID NO: 3890031 - RNA, 22 nt, Human
uaauuaaauaaaucauuaauac

SEQ ID NO: 3890032 - RNA, 13 nt, Human
uaauuaaaugcuc

SEQ ID NO: 3890033 - RNA, 14 nt, Human
uaauuaaauuaugg

SEQ ID NO: 3890034 - RNA, 23 nt, Human
uaauuaaauuuugaguucuacau

SEQ ID NO: 3890035 - RNA, 17 nt, Human
uaauuaaguaaacuaau

SEQ ID NO: 3890036 - RNA, 17 nt, Human
uaauuaaguacuaugua

SEQ ID NO: 3890037 - RNA, 11 nt, Human
uaauuaauuuc

SEQ ID NO: 3890038 - RNA, 19 nt, Human
uaauuaauuugauuaacaa

SEQ ID NO: 3890039 - RNA, 21 nt, Human
uaauuaauuugauuaacaaau

SEQ ID NO: 3890040 - RNA, 20 nt, Human
uaauuaauuuggagcacaaa

SEQ ID NO: 3890041 - RNA, 18 nt, Human
uaauuacaauauuucuga

SEQ ID NO: 3890042 - RNA, 17 nt, Human
uaauuacauauuugcau

SEQ ID NO: 3890043 - RNA, 16 nt, Human
uaauuacugccuugaa

SEQ ID NO: 3890044 - RNA, 17 nt, Human
uaauuacugccuugaaa

SEQ ID NO: 3890045 - RNA, 13 nt, Human
uaauuacuuaaaa

SEQ ID NO: 3890046 - RNA, 22 nt, Human
uaauuagagcagaugaccccuc

SEQ ID NO: 3890047 - RNA, 14 nt, Human
uaauuagauccauu

SEQ ID NO: 3890048 - RNA, 20 nt, Human
uaauuagauccauuaauuua

SEQ ID NO: 3890049 - RNA, 16 nt, Human
uaauuagcaucucagg

SEQ ID NO: 3890050 - RNA, 17 nt, Human
uaauuucccuucuugca

SEQ ID NO: 3890051 - RNA, 13 nt, Human
uaauuucuaaugu

SEQ ID NO: 3890052 - RNA, 13 nt, Human
uaauuucuccucc

SEQ ID NO: 3890053 - RNA, 17 nt, Human
uaauuucuucaaaaugu

SEQ ID NO: 3890054 - RNA, 22 nt, Human
uaauuucuucaaaauguauaua

SEQ ID NO: 3890055 - RNA, 17 nt, Human
uaauuucuuugccuguu

SEQ ID NO: 3890056 - RNA, 23 nt, Human
uaauuucuuugccuguucaguua

SEQ ID NO: 3890057 - RNA, 16 nt, Human
uaauuugacuagaaaa

SEQ ID NO: 3890058 - RNA, 12 nt, Human
uaauuugauauc

SEQ ID NO: 3890059 - RNA, 19 nt, Human
uaauuugauaucacagucu

SEQ ID NO: 3890060 - RNA, 17 nt, Human
uaauuugaugaaagcug

SEQ ID NO: 3890061 - RNA, 24 nt, Human
uaauuugaugaaagcugauuacug

SEQ ID NO: 3890062 - RNA, 14 nt, Human
uaauuugauguuua

SEQ ID NO: 3890063 - RNA, 14 nt, Human
uaauuugauuaaca

SEQ ID NO: 3890064 - RNA, 18 nt, Human
uaauuugauuaacaaaua

SEQ ID NO: 3890065 - RNA, 17 nt, Human
uaauuuggaccauuuuc

SEQ ID NO: 3890066 - RNA, 20 nt, Human
uaauuuggaccauuuuccug

SEQ ID NO: 3890067 - RNA, 23 nt, Human
uaauuuggaucucuucuuaaugu

SEQ ID NO: 3890068 - RNA, 22 nt, Human
uaauuuggggaaaccuagagaa

SEQ ID NO: 3890069 - RNA, 17 nt, Human
uaauuugguuuucacau

SEQ ID NO: 3890070 - RNA, 14 nt, Human
uaauuugugauaca

SEQ ID NO: 3890071 - RNA, 17 nt, Human
uaauuuguggugauuug

SEQ ID NO: 3890072 - RNA, 14 nt, Human
uaauuuguguaaua

SEQ ID NO: 3890073 - RNA, 22 nt, Human
uaauuuguuggggcuuuacaua

SEQ ID NO: 3890074 - RNA, 12 nt, Human
uaauuuguuucc

SEQ ID NO: 3890075 - RNA, 17 nt, Human
uaauuuuaaaaauggug

SEQ ID NO: 3890076 - RNA, 12 nt, Human
uaauuuuaaagu

SEQ ID NO: 3890077 - RNA, 14 nt, Human
uaauuuuaaccaaa

SEQ ID NO: 3890078 - RNA, 23 nt, Human
uaauuuuaaccaaaacaugucuc

SEQ ID NO: 3890079 - RNA, 19 nt, Human
uaauuuuaagauuccuuuu

SEQ ID NO: 3890080 - RNA, 14 nt, Human
uaauuuuacacauu

SEQ ID NO: 3890081 - RNA, 19 nt, Human
uaauuuuacacgcuuuugu

SEQ ID NO: 3890082 - RNA, 22 nt, Human
uaauuuuacauguuuauaaauc

SEQ ID NO: 3890083 - RNA, 19 nt, Human
uaauuuuagugacagcucu

SEQ ID NO: 3890084 - RNA, 16 nt, Human
uaauuuuaguuuuuca

SEQ ID NO: 3890085 - RNA, 23 nt, Human
uaauuuuaguuuuucauuaaaua

SEQ ID NO: 3890086 - RNA, 18 nt, Human
uaauuuuaugaaugucuu

SEQ ID NO: 3890087 - RNA, 13 nt, Human
uaauuuucucaaa

SEQ ID NO: 3890088 - RNA, 19 nt, Human
uaauuuucucaaaagcauu

SEQ ID NO: 3890089 - RNA, 23 nt, Human
uaauuuucuugaugacuggaauu

SEQ ID NO: 3890090 - RNA, 13 nt, Human
uaauuuugaaaaa

SEQ ID NO: 3890091 - RNA, 17 nt, Human
uaauuuugaaaaacugc

SEQ ID NO: 3890092 - RNA, 17 nt, Human
uaauuuugaaaagaugu

SEQ ID NO: 3890093 - RNA, 18 nt, Human
uaauuuugaagugcuguu

SEQ ID NO: 3890094 - RNA, 15 nt, Human
uaauuuugaauaaau

SEQ ID NO: 3890095 - RNA, 12 nt, Human
uaauuuugacac

SEQ ID NO: 3890096 - RNA, 21 nt, Human
uaauuuugacacuauaucugu

SEQ ID NO: 3890097 - RNA, 17 nt, Human
uaauuuugacacugaaa

SEQ ID NO: 3890098 - RNA, 20 nt, Human
uaauuuugauagugggacca

SEQ ID NO: 3890099 - RNA, 14 nt, Human
uaauuuugguugua

SEQ ID NO: 3890100 - RNA, 17 nt, Human
uaauuuugguuguauuc

SEQ ID NO: 3890101 - RNA, 14 nt, Human
uaauuuuguaucuu

SEQ ID NO: 3890102 - RNA, 11 nt, Human
uaauuuugucu

SEQ ID NO: 3890103 - RNA, 19 nt, Human
uaauuuuguguaagaaaua

SEQ ID NO: 3890104 - RNA, 20 nt, Human
uaauuuuguguaagaaauac

SEQ ID NO: 3890105 - RNA, 15 nt, Human
uaauuuuuaaaugca

SEQ ID NO: 3890106 - RNA, 18 nt, Human
uaauuuuuacccuaaugu

SEQ ID NO: 3890107 - RNA, 20 nt, Human
uaauuuuuacccuaaugucu

SEQ ID NO: 3890108 - RNA, 16 nt, Human
uaauuuuuauauuuga

SEQ ID NO: 3890109 - RNA, 17 nt, Human
uaauuuuuauauuugaa

SEQ ID NO: 3890110 - RNA, 19 nt, Human
uaauuuuuauauuugaaau

SEQ ID NO: 3890111 - RNA, 21 nt, Human
uaauuuuuauauuugaaauau

SEQ ID NO: 3890112 - RNA, 22 nt, Human
uaauuuuuauuaauuuuaguuu

SEQ ID NO: 3890113 - RNA, 23 nt, Human
uaauuuuuauucauaagccaauu

SEQ ID NO: 3890114 - RNA, 16 nt, Human
uaauuuuuauuucuuc

SEQ ID NO: 3890115 - RNA, 17 nt, Human
uaauuuuuauuucuucc

SEQ ID NO: 3890116 - RNA, 22 nt, Human
uaauuuuucagcucucuguaua

SEQ ID NO: 3890117 - RNA, 14 nt, Human
uaauuuuuccaacu

SEQ ID NO: 3890118 - RNA, 11 nt, Human
uaauuuuuccu

SEQ ID NO: 3890119 - RNA, 21 nt, Human
uaauuuuugauacuaagcauu

SEQ ID NO: 3890120 - RNA, 23 nt, Human
uaauuuuugauacuaagcauuga

SEQ ID NO: 3890121 - RNA, 14 nt, Human
uaauuuuugcuuuu

SEQ ID NO: 3890122 - RNA, 15 nt, Human
uaauuuuugcuuuua

SEQ ID NO: 3890123 - RNA, 14 nt, Human
uaauuuuuguaauu

SEQ ID NO: 3890124 - RNA, 21 nt, Human
uaauuuuuguauuauuuuugu

SEQ ID NO: 3890125 - RNA, 17 nt, Human
uaauuuuuuuaaccaaa

SEQ ID NO: 3890126 - RNA, 21 nt, Human
uaauuuuuuuaaccaaaggug

SEQ ID NO: 3890127 - RNA, 22 nt, Human
uaauuuuuuuaaccaaagguga

SEQ ID NO: 3890128 - RNA, 17 nt, Human
uaauuuuuuuauguuuu

SEQ ID NO: 3890129 - RNA, 17 nt, Human
uaauuuuuuuauuguuu

SEQ ID NO: 3890130 - RNA, 17 nt, Human
uaauuuuuuuuaaaaua

SEQ ID NO: 3890131 - RNA, 15 nt, Human
uacaaaaacacagca

SEQ ID NO: 3890132 - RNA, 15 nt, Human
uacaaaaauaaauuu

SEQ ID NO: 3890133 - RNA, 22 nt, Human
uacaaaaauaaauuuauaugaa

SEQ ID NO: 3890134 - RNA, 18 nt, Human
uacaaaaaucagccagac

SEQ ID NO: 3890135 - RNA, 20 nt, Human
uacaaaaccacaguguacca

SEQ ID NO: 3890136 - RNA, 23 nt, Human
uacaaaaccacaguguaccauua

SEQ ID NO: 3890137 - RNA, 19 nt, Human
uacaaaacgcgcagaugug

SEQ ID NO: 3890138 - RNA, 23 nt, Human
uacaaaagaggagcacuuccaaa

SEQ ID NO: 3890139 - RNA, 15 nt, Human
uacaaaagcauguga

SEQ ID NO: 3890140 - RNA, 18 nt, Human
uacaaaagggacaugaaa

SEQ ID NO: 3890141 - RNA, 15 nt, Human
uacaaaauaaaaaca

SEQ ID NO: 3890142 - RNA, 12 nt, Human
uacaaaauguaa

SEQ ID NO: 3890143 - RNA, 23 nt, Human
uacaaaauguaacuguuaccauu

SEQ ID NO: 3890144 - RNA, 14 nt, Human
uacaaaauuaagca

SEQ ID NO: 3890145 - RNA, 16 nt, Human
uacaaacaaaauuucu

SEQ ID NO: 3890146 - RNA, 18 nt, Human
uacaaacaaaauuucuau

SEQ ID NO: 3890147 - RNA, 14 nt, Human
uacaaacaagcaua

SEQ ID NO: 3890148 - RNA, 20 nt, Human
uacaaacaaucucuuaaauu

SEQ ID NO: 3890149 - RNA, 16 nt, Human
uacaaacauuuaagcu

SEQ ID NO: 3890150 - RNA, 13 nt, Human
uacaaaccuacca

SEQ ID NO: 3890151 - RNA, 19 nt, Human
uacaaacucccacuuguca

SEQ ID NO: 3890152 - RNA, 15 nt, Human
uacaaacugaagagu

SEQ ID NO: 3890153 - RNA, 14 nt, Human
uacaaacugcaaua

SEQ ID NO: 3890154 - RNA, 17 nt, Human
uacaaagaaauaacaag

SEQ ID NO: 3890155 - RNA, 13 nt, Human
uacaaagaagaca

SEQ ID NO: 3890156 - RNA, 18 nt, Human
uacaaagaagacauguuu

SEQ ID NO: 3890157 - RNA, 23 nt, Human
uacaaagcacuagagaaugcaca

SEQ ID NO: 3890158 - RNA, 13 nt, Human
uacaaaggaaaaa

SEQ ID NO: 3890159 - RNA, 14 nt, Human
uacaaaggaaaaag

SEQ ID NO: 3890160 - RNA, 14 nt, Human
uacaaagguuuaaa

SEQ ID NO: 3890161 - RNA, 19 nt, Human
uacaaagguuuaaaugaac

SEQ ID NO: 3890162 - RNA, 20 nt, Human
uacaaagguuuaaaugaaca

SEQ ID NO: 3890163 - RNA, 14 nt, Human
uacaaaguagaagu

SEQ ID NO: 3890164 - RNA, 14 nt, Human
uacaaaguauuaag

SEQ ID NO: 3890165 - RNA, 15 nt, Human
uacaaaguauuaagc

SEQ ID NO: 3890166 - RNA, 16 nt, Human
uacaaaguauuaagca

SEQ ID NO: 3890167 - RNA, 19 nt, Human
uacaaaguauuaagcauau

SEQ ID NO: 3890168 - RNA, 13 nt, Human
uacaaagugaugu

SEQ ID NO: 3890169 - RNA, 17 nt, Human
uacaaaguguauuuuau

SEQ ID NO: 3890170 - RNA, 19 nt, Human
uacaaaguguguauuaaaa

SEQ ID NO: 3890171 - RNA, 23 nt, Human
uacaaauacucuuaggaagagaa

SEQ ID NO: 3890172 - RNA, 16 nt, Human
uacaaauauaaaucuu

SEQ ID NO: 3890173 - RNA, 16 nt, Human
uacaaauauaagaaua

SEQ ID NO: 3890174 - RNA, 17 nt, Human
uacaaauauaagauuuu

SEQ ID NO: 3890175 - RNA, 21 nt, Human
uacaaaucagaagucaucuug

SEQ ID NO: 3890176 - RNA, 13 nt, Human
uacaaaugauugc

SEQ ID NO: 3890177 - RNA, 19 nt, Human
uacaaaugauugcuuuuaa

SEQ ID NO: 3890178 - RNA, 21 nt, Human
uacaaaugauugcuuuuaaaa

SEQ ID NO: 3890179 - RNA, 17 nt, Human
uacaaaugcaucuuuga

SEQ ID NO: 3890180 - RNA, 23 nt, Human
uacaaaugccuccaaaguauugu

SEQ ID NO: 3890181 - RNA, 13 nt, Human
uacaaaugccuua

SEQ ID NO: 3890182 - RNA, 13 nt, Human
uacaaauggauuu

SEQ ID NO: 3890183 - RNA, 12 nt, Human
uacaaaugucuu

SEQ ID NO: 3890184 - RNA, 18 nt, Human
uacaaauguuaaaaugug

SEQ ID NO: 3890185 - RNA, 15 nt, Human
uacaaauuaaaaaga

SEQ ID NO: 3890186 - RNA, 13 nt, Human
uacaaauuagaaa

SEQ ID NO: 3890187 - RNA, 14 nt, Human
uacaaauuagaaaa

SEQ ID NO: 3890188 - RNA, 16 nt, Human
uacaaauuauaaugua

SEQ ID NO: 3890189 - RNA, 19 nt, Human
uacaaauugcuugaaagaa

SEQ ID NO: 3890190 - RNA, 16 nt, Human
uacaaauuuguuauuu

SEQ ID NO: 3890191 - RNA, 23 nt, Human
uacaacaaaggcaaguuaagaga

SEQ ID NO: 3890192 - RNA, 19 nt, Human
uacaacaagaguuuauuuc

SEQ ID NO: 3890193 - RNA, 18 nt, Human
uacaacacuuuaaugggu

SEQ ID NO: 3890194 - RNA, 13 nt, Human
uacaacagugcua

SEQ ID NO: 3890195 - RNA, 23 nt, Human
uagaaaaucaagcagguuagaga

SEQ ID NO: 3890196 - RNA, 20 nt, Human
uagaaaaugugacccuccaa

SEQ ID NO: 3890197 - RNA, 24 nt, Human
uagaaaauguguccuaucuaucuu

SEQ ID NO: 3890198 - RNA, 16 nt, Human
uagaaaauuagacugu

SEQ ID NO: 3890199 - RNA, 23 nt, Human
uagaaaauuuguuauuuugcaac

SEQ ID NO: 3890200 - RNA, 17 nt, Human
uagaaacaaacaucuaa

SEQ ID NO: 3890201 - RNA, 13 nt, Human
uagaaacaacacu

SEQ ID NO: 3890202 - RNA, 17 nt, Human
uagaaacaacacuguag

SEQ ID NO: 3890203 - RNA, 19 nt, Human
uagaaacaacacuguagua

SEQ ID NO: 3890204 - RNA, 16 nt, Human
uagaaacacauaauua

SEQ ID NO: 3890205 - RNA, 21 nt, Human
uagaaacacauaauuaacacu

SEQ ID NO: 3890206 - RNA, 13 nt, Human
uagaaacaugaca

SEQ ID NO: 3890207 - RNA, 14 nt, Human
uagaaacaugacac

SEQ ID NO: 3890208 - RNA, 16 nt, Human
uagaaacaugacacug

SEQ ID NO: 3890209 - RNA, 17 nt, Human
uagaaacaugacacuga

SEQ ID NO: 3890210 - RNA, 19 nt, Human
uagaaacaugacacugacc

SEQ ID NO: 3890211 - RNA, 15 nt, Human
uagaaacccaagcuc

SEQ ID NO: 3890212 - RNA, 15 nt, Human
uagaaacuuccaaau

SEQ ID NO: 3890213 - RNA, 17 nt, Human
uagaaagacagagcugg

SEQ ID NO: 3890214 - RNA, 17 nt, Human
uagaaagaccaggccaa

SEQ ID NO: 3890215 - RNA, 18 nt, Human
uagaaagagauacagagg

SEQ ID NO: 3890216 - RNA, 13 nt, Human
uagaaagcauuug

SEQ ID NO: 3890217 - RNA, 17 nt, Human
uagaaagcauuugaaug

SEQ ID NO: 3890218 - RNA, 22 nt, Human
uagaaagcauuugaaugcauuu

SEQ ID NO: 3890219 - RNA, 23 nt, Human
uagaaagccuguuccccucacug

SEQ ID NO: 3890220 - RNA, 13 nt, Human
uagaaaggccuuu

SEQ ID NO: 3890221 - RNA, 16 nt, Human
uagaaaggccuuuaaa

SEQ ID NO: 3890222 - RNA, 22 nt, Human
uagaaaggggcaguuuaaagca

SEQ ID NO: 3890223 - RNA, 17 nt, Human
uagaaagugaauaaaaa

SEQ ID NO: 3890224 - RNA, 21 nt, Human
uagaaagugaauaaaaauuaa

SEQ ID NO: 3890225 - RNA, 17 nt, Human
uagaaagugccagaaag

SEQ ID NO: 3890226 - RNA, 16 nt, Human
uagaaaguguucuguu

SEQ ID NO: 3890227 - RNA, 19 nt, Human
uagaaaguguucuguuaca

SEQ ID NO: 3890228 - RNA, 21 nt, Human
uagaaaguguucuguuacaaa

SEQ ID NO: 3890229 - RNA, 16 nt, Human
uagaaauaaauagcua

SEQ ID NO: 3890230 - RNA, 22 nt, Human
uagaaauaagugguuauuucuc

SEQ ID NO: 3890231 - RNA, 15 nt, Human
uagaaauaauaugca

SEQ ID NO: 3890232 - RNA, 21 nt, Human
uagaaauaucugaaaauguau

SEQ ID NO: 3890233 - RNA, 14 nt, Human
uagaaauauuuuaa

SEQ ID NO: 3890234 - RNA, 21 nt, Human
uagaaauggaaauuuugcuau

SEQ ID NO: 3890235 - RNA, 19 nt, Human
uagaaauggggaacuacug

SEQ ID NO: 3890236 - RNA, 23 nt, Human
uagaaaugguuguauuagauguu

SEQ ID NO: 3890237 - RNA, 18 nt, Human
uagaaauguaaacugcca

SEQ ID NO: 3890238 - RNA, 19 nt, Human
uagaaauguaaacugccau

SEQ ID NO: 3890239 - RNA, 19 nt, Human
uagaaauguaacuuuugua

SEQ ID NO: 3890240 - RNA, 16 nt, Human
uagaaauguagguccu

SEQ ID NO: 3890241 - RNA, 15 nt, Human
uagaaauguuugcug

SEQ ID NO: 3890242 - RNA, 18 nt, Human
uagaaauuagcuguguga

SEQ ID NO: 3890243 - RNA, 14 nt, Human
uagaaauucuuuau

SEQ ID NO: 3890244 - RNA, 18 nt, Human
uagaaauuuuguaagaag

SEQ ID NO: 3890245 - RNA, 22 nt, Human
uagaaauuuuguaagaaggcaa

SEQ ID NO: 3890246 - RNA, 19 nt, Human
uagaaauuuuucagaugcu

SEQ ID NO: 3890247 - RNA, 20 nt, Human
uagaacaaaggacagaguau

SEQ ID NO: 3890248 - RNA, 17 nt, Human
uagaacaacauauacaa

SEQ ID NO: 3890249 - RNA, 15 nt, Human
uagaacacaggcaaa

SEQ ID NO: 3890250 - RNA, 16 nt, Human
uagaacacuaacucac

SEQ ID NO: 3890251 - RNA, 16 nt, Human
uagaacacuaauucau

SEQ ID NO: 3890252 - RNA, 12 nt, Human
uagaacacuauu

SEQ ID NO: 3890253 - RNA, 13 nt, Human
uagaacacuauuu

SEQ ID NO: 3890254 - RNA, 17 nt, Human
uagaacacuauuuucag

SEQ ID NO: 3890255 - RNA, 13 nt, Human
uagaacagaaaac

SEQ ID NO: 3890256 - RNA, 14 nt, Human
uagaacagaaaaca

SEQ ID NO: 3890257 - RNA, 21 nt, Human
uagaacagaaaacaacaaaaa

SEQ ID NO: 3890258 - RNA, 23 nt, Human
uagaacagaaaacaacaaaaaau

SEQ ID NO: 3890259 - RNA, 17 nt, Human
uagaacagauaaucagu

SEQ ID NO: 3890260 - RNA, 13 nt, Human
uagaacagguuuu

SEQ ID NO: 3890261 - RNA, 17 nt, Human
uagaacauaaagcaaau

SEQ ID NO: 3890262 - RNA, 14 nt, Human
uagaacaucccugc

SEQ ID NO: 3890263 - RNA, 17 nt, Human
uagaaccaagaagggcu

SEQ ID NO: 3890264 - RNA, 12 nt, Human
uagaaccaggca

SEQ ID NO: 3890265 - RNA, 23 nt, Human
uagaaccaggcaacuugggaacu

SEQ ID NO: 3890266 - RNA, 22 nt, Human
uagaacccggcaggcuagaacc

SEQ ID NO: 3890267 - RNA, 16 nt, Human
uagaacccuugcacag

SEQ ID NO: 3890268 - RNA, 16 nt, Human
uagaaccuagaagggc

SEQ ID NO: 3890269 - RNA, 23 nt, Human
uagaaccuagaagggcuagaacc

SEQ ID NO: 3890270 - RNA, 21 nt, Human
uagaaccucgagguuucucaa

SEQ ID NO: 3890271 - RNA, 23 nt, Human
uagaaccuggaagggcuagaacc

SEQ ID NO: 3890272 - RNA, 19 nt, Human
uagaacucaguuuuaacua

SEQ ID NO: 3890273 - RNA, 17 nt, Human
uagaacucccuuucaac

SEQ ID NO: 3890274 - RNA, 18 nt, Human
uagaacucccuuucaaca

SEQ ID NO: 3890275 - RNA, 13 nt, Human
uagaacugaauuu

SEQ ID NO: 3890276 - RNA, 22 nt, Human
uagaacugaauuuugucuuuau

SEQ ID NO: 3890277 - RNA, 20 nt, Human
uagaacuggguaaaugcaaa

SEQ ID NO: 3890278 - RNA, 15 nt, Human
uagaacuucauggau

SEQ ID NO: 3890279 - RNA, 16 nt, Human
uagaacuugacccccu

SEQ ID NO: 3890280 - RNA, 14 nt, Human
uagaacuuuguaua

SEQ ID NO: 3890281 - RNA, 19 nt, Human
uagaacuuuuuuaaauaaa

SEQ ID NO: 3890282 - RNA, 20 nt, Human
uagaacuuuuuuaaauaaac

SEQ ID NO: 3890283 - RNA, 16 nt, Human
uagaagaaagauguuu

SEQ ID NO: 3890284 - RNA, 12 nt, Human
uagaagaaauga

SEQ ID NO: 3890285 - RNA, 17 nt, Human
uagaagaaaugaaauuu

SEQ ID NO: 3890286 - RNA, 16 nt, Human
uagaagaauauuguau

SEQ ID NO: 3890287 - RNA, 17 nt, Human
uagaagaauauuguauu

SEQ ID NO: 3890288 - RNA, 14 nt, Human
uagaagaaugcaug

SEQ ID NO: 3890289 - RNA, 16 nt, Human
uagaagaaugcaugcu

SEQ ID NO: 3890290 - RNA, 20 nt, Human
uagaagacaauugacaacag

SEQ ID NO: 3890291 - RNA, 14 nt, Human
uagaagagagaggu

SEQ ID NO: 3890292 - RNA, 17 nt, Human
uagaagagucuauuguc

SEQ ID NO: 3890293 - RNA, 21 nt, Human
uagaagcacuacaccuugccu

SEQ ID NO: 3890294 - RNA, 20 nt, Human
uagaagcauuccuucuuuga

SEQ ID NO: 3890295 - RNA, 17 nt, Human
uagaagcuggaggacua

SEQ ID NO: 3890296 - RNA, 21 nt, Human
uagaaggaaaaccuagaaaac

SEQ ID NO: 3890297 - RNA, 13 nt, Human
uagaaggaaacua

SEQ ID NO: 3890298 - RNA, 17 nt, Human
uagaaggauguacauuu

SEQ ID NO: 3890299 - RNA, 21 nt, Human
uagaaggauguacauuuccaa

SEQ ID NO: 3890300 - RNA, 18 nt, Human
uagaaggcuguggugagg

SEQ ID NO: 3890301 - RNA, 23 nt, Human
uagaaggcuguggugagggaaga

SEQ ID NO: 3890302 - RNA, 22 nt, Human
uagaagggccaguccugccugg

SEQ ID NO: 3890303 - RNA, 16 nt, Human
uagaaggguuauauuu

SEQ ID NO: 3890304 - RNA, 16 nt, Human
uagaaggucggaggcu

SEQ ID NO: 3890305 - RNA, 21 nt, Human
uagaaggucggaggcuuggga

SEQ ID NO: 3890306 - RNA, 20 nt, Human
uagaaguaggaagugaaaau

SEQ ID NO: 3890307 - RNA, 16 nt, Human
uagaagucacacagua

SEQ ID NO: 3890308 - RNA, 23 nt, Human
uagaagucacauuccugaacagg

SEQ ID NO: 3890309 - RNA, 16 nt, Human
uagaagucuuagaugu

SEQ ID NO: 3890310 - RNA, 15 nt, Human
uagaagucuucauga

SEQ ID NO: 3890311 - RNA, 20 nt, Human
uagaagugagcaaaaaagag

SEQ ID NO: 3890312 - RNA, 17 nt, Human
uagaagugcauuucuga

SEQ ID NO: 3890313 - RNA, 18 nt, Human
uagaagugcauuucugaa

SEQ ID NO: 3890314 - RNA, 20 nt, Human
uagaaguggaccaggacagg

SEQ ID NO: 3890315 - RNA, 16 nt, Human
uagaagugggccagga

SEQ ID NO: 3890316 - RNA, 16 nt, Human
uagaaguuuggcugcu

SEQ ID NO: 3890317 - RNA, 21 nt, Human
uagaaguuuguccauuuguaa

SEQ ID NO: 3890318 - RNA, 13 nt, Human
uagaaguuuuugu

SEQ ID NO: 3890319 - RNA, 16 nt, Human
uagaaguuuuuguacu

SEQ ID NO: 3890320 - RNA, 18 nt, Human
uagaauaagaauuugcau

SEQ ID NO: 3890321 - RNA, 21 nt, Human
uagaauaaugugggaagaaac

SEQ ID NO: 3890322 - RNA, 20 nt, Human
uagaauagcauguuguagau

SEQ ID NO: 3890323 - RNA, 21 nt, Human
uagaauagccuguggccuuug

SEQ ID NO: 3890324 - RNA, 15 nt, Human
uagaauauaauuauc

SEQ ID NO: 3890325 - RNA, 19 nt, Human
uagaauauaggucucuucu

SEQ ID NO: 3890326 - RNA, 22 nt, Human
uagaauauaggucucuucuccc

SEQ ID NO: 3890327 - RNA, 19 nt, Human
uagaauauuuauuaccucu

SEQ ID NO: 3890328 - RNA, 21 nt, Human
uagaaucagccuaggggucag

SEQ ID NO: 3890329 - RNA, 15 nt, Human
uagaauccaaacuug

SEQ ID NO: 3890330 - RNA, 15 nt, Human
uagaaucccuguguu

SEQ ID NO: 3890331 - RNA, 20 nt, Human
uagaaucccuguguuaauuu

SEQ ID NO: 3890332 - RNA, 16 nt, Human
uagaaucuauuuucua

SEQ ID NO: 3890333 - RNA, 22 nt, Human
uagaaucuauuuucuauguacu

SEQ ID NO: 3890334 - RNA, 12 nt, Human
uagaaucuggag

SEQ ID NO: 3890335 - RNA, 13 nt, Human
uagaaucugugua

SEQ ID NO: 3890336 - RNA, 20 nt, Human
uagaaugaaaauuguauguu

SEQ ID NO: 3890337 - RNA, 19 nt, Human
uagaaugaccuuguaaugu

SEQ ID NO: 3890338 - RNA, 21 nt, Human
uagaaugaccuuguaauguaa

SEQ ID NO: 3890339 - RNA, 17 nt, Human
uagagccuguaaacuuu

SEQ ID NO: 3890340 - RNA, 16 nt, Human
uagagcuagucuuuca

SEQ ID NO: 3890341 - RNA, 14 nt, Human
uagagcuccucccu

SEQ ID NO: 3890342 - RNA, 23 nt, Human
uagagcugacacaaaccugccug

SEQ ID NO: 3890343 - RNA, 15 nt, Human
uagagcugauccaga

SEQ ID NO: 3890344 - RNA, 19 nt, Human
uagagcugauccagagcac

SEQ ID NO: 3890345 - RNA, 15 nt, Human
uagagcuucuggcac

SEQ ID NO: 3890346 - RNA, 17 nt, Human
uagagcuuucaaguaca

SEQ ID NO: 3890347 - RNA, 18 nt, Human
uagaggaaaaaaaugacu

SEQ ID NO: 3890348 - RNA, 15 nt, Human
uagaggaagcagcca

SEQ ID NO: 3890349 - RNA, 19 nt, Human
uagaggagaaacuggaacu

SEQ ID NO: 3890350 - RNA, 19 nt, Human
uagaggcagggaggggacu

SEQ ID NO: 3890351 - RNA, 18 nt, Human
uagaggccagccccaccc

SEQ ID NO: 3890352 - RNA, 20 nt, Human
uagaggccagccccacccag

SEQ ID NO: 3890353 - RNA, 12 nt, Human
uagaggccugag

SEQ ID NO: 3890354 - RNA, 16 nt, Human
uagaggcuuccuucau

SEQ ID NO: 3890355 - RNA, 18 nt, Human
uagaggcuuccuucauuu

SEQ ID NO: 3890356 - RNA, 23 nt, Human
uagaggcuucuccgccagccucc

SEQ ID NO: 3890357 - RNA, 15 nt, Human
uagagggaccucucc

SEQ ID NO: 3890358 - RNA, 21 nt, Human
uagagggacggccaagaaugu

SEQ ID NO: 3890359 - RNA, 13 nt, Human
uagagggaggggc

SEQ ID NO: 3890360 - RNA, 20 nt, Human
uagagggagguguuuaaaga

SEQ ID NO: 3890361 - RNA, 13 nt, Human
uagaggguuccug

SEQ ID NO: 3890362 - RNA, 16 nt, Human
uagagguauaauugug

SEQ ID NO: 3890363 - RNA, 19 nt, Human
uagagguccucuggagccc

SEQ ID NO: 3890364 - RNA, 20 nt, Human
uagagguccucuggagcccu

SEQ ID NO: 3890365 - RNA, 17 nt, Human
uagaggugagaaauuua

SEQ ID NO: 3890366 - RNA, 16 nt, Human
uagaggugagggaagc

SEQ ID NO: 3890367 - RNA, 16 nt, Human
uagaggugcaugccua

SEQ ID NO: 3890368 - RNA, 14 nt, Human
uagagguucaaaga

SEQ ID NO: 3890369 - RNA, 16 nt, Human
uagagguuuuguuguu

SEQ ID NO: 3890370 - RNA, 19 nt, Human
uagagguuuuguuguuuua

SEQ ID NO: 3890371 - RNA, 12 nt, Human
uagaguaaugaa

SEQ ID NO: 3890372 - RNA, 17 nt, Human
uagaguaaugaaaugga

SEQ ID NO: 3890373 - RNA, 17 nt, Human
uagaguagaagucucuu

SEQ ID NO: 3890374 - RNA, 14 nt, Human
uagagucagccuuc

SEQ ID NO: 3890375 - RNA, 21 nt, Human
uagagucauuguaauguugug

SEQ ID NO: 3890376 - RNA, 19 nt, Human
uagaguccaacguggggca

SEQ ID NO: 3890377 - RNA, 16 nt, Human
uagaguccaagguuua

SEQ ID NO: 3890378 - RNA, 20 nt, Human
uagagucccagguuggcucu

SEQ ID NO: 3890379 - RNA, 14 nt, Human
uagaguccucacuc

SEQ ID NO: 3890380 - RNA, 12 nt, Human
uagagugggagc

SEQ ID NO: 3890381 - RNA, 17 nt, Human
uagaguguagacugugg

SEQ ID NO: 3890382 - RNA, 18 nt, Human
uagaguguuguugagaau

SEQ ID NO: 3890383 - RNA, 17 nt, Human
uagaguuaacaaugaua

SEQ ID NO: 3890384 - RNA, 15 nt, Human
uagaguuaagaagcu

SEQ ID NO: 3890385 - RNA, 16 nt, Human
uagaguuaagaagcug

SEQ ID NO: 3890386 - RNA, 17 nt, Human
uagaguuaagaagcugu

SEQ ID NO: 3890387 - RNA, 16 nt, Human
uagaguuagacuguug

SEQ ID NO: 3890388 - RNA, 17 nt, Human
uagaguuagacuguugg

SEQ ID NO: 3890389 - RNA, 14 nt, Human
uagaguugauacua

SEQ ID NO: 3890390 - RNA, 16 nt, Human
uagaguugcugagagg

SEQ ID NO: 3890391 - RNA, 17 nt, Human
uagaguuuacagcucug

SEQ ID NO: 3890392 - RNA, 17 nt, Human
uagaguuugcuauuaga

SEQ ID NO: 3890393 - RNA, 15 nt, Human
uagauaaaaagaugg

SEQ ID NO: 3890394 - RNA, 21 nt, Human
uagauaaaacaucuuugaaau

SEQ ID NO: 3890395 - RNA, 15 nt, Human
uagauaaacucagaa

SEQ ID NO: 3890396 - RNA, 23 nt, Human
uagauaacaagaccucagugccu

SEQ ID NO: 3890397 - RNA, 16 nt, Human
uagauaacucuuugga

SEQ ID NO: 3890398 - RNA, 15 nt, Human
uagauaauauuguuu

SEQ ID NO: 3890399 - RNA, 12 nt, Human
uagauacaauca

SEQ ID NO: 3890400 - RNA, 21 nt, Human
uagauacaaucagcugcuuug

SEQ ID NO: 3890401 - RNA, 21 nt, Human
uagauacaccucaacuaaauc

SEQ ID NO: 3890402 - RNA, 18 nt, Human
uagauacaugcuuuuuaa

SEQ ID NO: 3890403 - RNA, 21 nt, Human
uagauagaaauaaauagcuau

SEQ ID NO: 3890404 - RNA, 20 nt, Human
uagauagcagccuggcuccc

SEQ ID NO: 3890405 - RNA, 23 nt, Human
uagauagcccuguccugguggua

SEQ ID NO: 3890406 - RNA, 22 nt, Human
uagauagcugcauguggcuuuu

SEQ ID NO: 3890407 - RNA, 20 nt, Human
uagauaggaagaaagaagac

SEQ ID NO: 3890408 - RNA, 23 nt, Human
uagauagggcugggcaaggaaaa

SEQ ID NO: 3890409 - RNA, 19 nt, Human
uagauauagagucauugua

SEQ ID NO: 3890410 - RNA, 19 nt, Human
uagauauaugcucugcaug

SEQ ID NO: 3890411 - RNA, 20 nt, Human
uagauaucaugcaaauuuca

SEQ ID NO: 3890412 - RNA, 23 nt, Human
uagauaucgacuuguuuuugcac

SEQ ID NO: 3890413 - RNA, 19 nt, Human
uagauaucuuuuuauugau

SEQ ID NO: 3890414 - RNA, 22 nt, Human
uagauaucuuuuuauugaugug

SEQ ID NO: 3890415 - RNA, 14 nt, Human
uagauauuauucau

SEQ ID NO: 3890416 - RNA, 12 nt, Human
uagauauuuggc

SEQ ID NO: 3890417 - RNA, 20 nt, Human
uagauauuuucacaauguca

SEQ ID NO: 3890418 - RNA, 13 nt, Human
uagaucaaauacu

SEQ ID NO: 3890419 - RNA, 18 nt, Human
uagaucaaauaguugcau

SEQ ID NO: 3890420 - RNA, 22 nt, Human
uagaucaacucauguuaauuga

SEQ ID NO: 3890421 - RNA, 16 nt, Human
uagaucaccagaauaa

SEQ ID NO: 3890422 - RNA, 16 nt, Human
uagaucacgagaucaa

SEQ ID NO: 3890423 - RNA, 18 nt, Human
uagauccacacacagagg

SEQ ID NO: 3890424 - RNA, 15 nt, Human
uagauccauuuccau

SEQ ID NO: 3890425 - RNA, 18 nt, Human
uagauccauuuccauugc

SEQ ID NO: 3890426 - RNA, 15 nt, Human
uagaucccccagacu

SEQ ID NO: 3890427 - RNA, 13 nt, Human
uagaucuccagcg

SEQ ID NO: 3890428 - RNA, 12 nt, Human
uagaucuucuga

SEQ ID NO: 3890429 - RNA, 13 nt, Human
uagaucuucugaa

SEQ ID NO: 3890430 - RNA, 16 nt, Human
uagaucuucugaaaug

SEQ ID NO: 3890431 - RNA, 17 nt, Human
uagaugaaaaagcaugu

SEQ ID NO: 3890432 - RNA, 19 nt, Human
uagaugaaaaagcauguac

SEQ ID NO: 3890433 - RNA, 22 nt, Human
uagaugaaaaagcauguacagu

SEQ ID NO: 3890434 - RNA, 23 nt, Human
uagaugaaaaagcauguacagug

SEQ ID NO: 3890435 - RNA, 20 nt, Human
uagaugaaugucaguuguua

SEQ ID NO: 3890436 - RNA, 19 nt, Human
uagaugacauugacuauuu

SEQ ID NO: 3890437 - RNA, 21 nt, Human
uagaugagauuguuuuaucau

SEQ ID NO: 3890438 - RNA, 19 nt, Human
uagaugauuuuuugaaagu

SEQ ID NO: 3890439 - RNA, 19 nt, Human
uagaugcaagauauuuaua

SEQ ID NO: 3890440 - RNA, 19 nt, Human
uagaugcaguucugaagaa

SEQ ID NO: 3890441 - RNA, 21 nt, Human
uagaugcauuuggguccagga

SEQ ID NO: 3890442 - RNA, 15 nt, Human
uagaugcccugcuag

SEQ ID NO: 3890443 - RNA, 19 nt, Human
uagaugcgcagccccaucu

SEQ ID NO: 3890444 - RNA, 22 nt, Human
uagaugcucuaugugcuuguaa

SEQ ID NO: 3890445 - RNA, 14 nt, Human
uagaugcugacugu

SEQ ID NO: 3890446 - RNA, 13 nt, Human
uagaugcuggccc

SEQ ID NO: 3890447 - RNA, 14 nt, Human
uagaugcuggccca

SEQ ID NO: 3890448 - RNA, 20 nt, Human
uagaugcuuuccuaaaucag

SEQ ID NO: 3890449 - RNA, 20 nt, Human
uagauggcaagcauguaacu

SEQ ID NO: 3890450 - RNA, 13 nt, Human
uagaugggaauga

SEQ ID NO: 3890451 - RNA, 15 nt, Human
uagaugggaaugaag

SEQ ID NO: 3890452 - RNA, 16 nt, Human
uagaugggucuggcug

SEQ ID NO: 3890453 - RNA, 20 nt, Human
uagaugggucuggcugagcu

SEQ ID NO: 3890454 - RNA, 15 nt, Human
uagauggugaaauuu

SEQ ID NO: 3890455 - RNA, 14 nt, Human
uagauggugcugag

SEQ ID NO: 3890456 - RNA, 17 nt, Human
uagaugguuacacuguu

SEQ ID NO: 3890457 - RNA, 19 nt, Human
uagaugguuugagccugag

SEQ ID NO: 3890458 - RNA, 13 nt, Human
uagauguaaauuu

SEQ ID NO: 3890459 - RNA, 12 nt, Human
uagauguauaua

SEQ ID NO: 3890460 - RNA, 16 nt, Human
uagauguaugcacaca

SEQ ID NO: 3890461 - RNA, 20 nt, Human
uagauguauguacuucaugc

SEQ ID NO: 3890462 - RNA, 21 nt, Human
uagaugucccuuucuuggcca

SEQ ID NO: 3890463 - RNA, 12 nt, Human
uagaugucuuuu

SEQ ID NO: 3890464 - RNA, 14 nt, Human
uagaugucuuuuau

SEQ ID NO: 3890465 - RNA, 17 nt, Human
uagaugucuuuuauagu

SEQ ID NO: 3890466 - RNA, 13 nt, Human
uagaugugauuua

SEQ ID NO: 3890467 - RNA, 16 nt, Human
uagaugugcugcuuug

SEQ ID NO: 3890468 - RNA, 11 nt, Human
uagaugugugg

SEQ ID NO: 3890469 - RNA, 22 nt, Human
uagauguucagauugcuuugau

SEQ ID NO: 3890470 - RNA, 18 nt, Human
uagauguuccaguaaucu

SEQ ID NO: 3890471 - RNA, 19 nt, Human
uagauguucucuaucauuu

SEQ ID NO: 3890472 - RNA, 11 nt, Human
uagauguugcu

SEQ ID NO: 3890473 - RNA, 20 nt, Human
uagauguuuauucuucuaga

SEQ ID NO: 3890474 - RNA, 12 nt, Human
uagauguuuccu

SEQ ID NO: 3890475 - RNA, 16 nt, Human
uagauuaaaaauuaua

SEQ ID NO: 3890476 - RNA, 14 nt, Human
uagauuaaauaaaa

SEQ ID NO: 3890477 - RNA, 15 nt, Human
uagauuaaauauaga

SEQ ID NO: 3890478 - RNA, 17 nt, Human
uagauuaauggcacuga

SEQ ID NO: 3890479 - RNA, 15 nt, Human
uagauuagaauucug

SEQ ID NO: 3890480 - RNA, 15 nt, Human
uagauuagcucugga

SEQ ID NO: 3890481 - RNA, 15 nt, Human
uagauuauaucaaag

SEQ ID NO: 3890482 - RNA, 19 nt, Human
uagauuauaucaaaguauu

SEQ ID NO: 3890483 - RNA, 17 nt, Human
uagauuauggagcuuuu

SEQ ID NO: 3890484 - RNA, 15 nt, Human
uagcauuuuaaacaa

SEQ ID NO: 3890485 - RNA, 16 nt, Human
uagcauuuugcuaaau

SEQ ID NO: 3890486 - RNA, 14 nt, Human
uagccaaaaauguc

SEQ ID NO: 3890487 - RNA, 16 nt, Human
uagccaaaaugugagu

SEQ ID NO: 3890488 - RNA, 23 nt, Human
uagccaaaaugugagugguugaa

SEQ ID NO: 3890489 - RNA, 20 nt, Human
uagccaacggccccagcuuc

SEQ ID NO: 3890490 - RNA, 13 nt, Human
uagccaaggccaa

SEQ ID NO: 3890491 - RNA, 14 nt, Human
uagccaaggccaaa

SEQ ID NO: 3890492 - RNA, 21 nt, Human
uagccaaggccaaaggaagca

SEQ ID NO: 3890493 - RNA, 20 nt, Human
uagccaaggugggcugagcc

SEQ ID NO: 3890494 - RNA, 18 nt, Human
uagccaauauuuuucuua

SEQ ID NO: 3890495 - RNA, 14 nt, Human
uagccacaccagga

SEQ ID NO: 3890496 - RNA, 17 nt, Human
uagccacaccaggauag

SEQ ID NO: 3890497 - RNA, 21 nt, Human
uagccacauuuggaauacuuu

SEQ ID NO: 3890498 - RNA, 16 nt, Human
uagccaccaucuuugc

SEQ ID NO: 3890499 - RNA, 19 nt, Human
uagccaccccagaaauggu

SEQ ID NO: 3890500 - RNA, 14 nt, Human
uagccaccugaguu

SEQ ID NO: 3890501 - RNA, 21 nt, Human
uagccacuaaccuugccuggu

SEQ ID NO: 3890502 - RNA, 22 nt, Human
uagccacuuaccuucaauaaag

SEQ ID NO: 3890503 - RNA, 21 nt, Human
uagccacuuuggucccgugca

SEQ ID NO: 3890504 - RNA, 15 nt, Human
uagccagaggagaga

SEQ ID NO: 3890505 - RNA, 18 nt, Human
uagccagcacacagggca

SEQ ID NO: 3890506 - RNA, 20 nt, Human
uagccagcacacagggcagu

SEQ ID NO: 3890507 - RNA, 18 nt, Human
uagccagccccucuuccc

SEQ ID NO: 3890508 - RNA, 23 nt, Human
uagccagccggggcgaguggcac

SEQ ID NO: 3890509 - RNA, 15 nt, Human
uagccagcugcuccc

SEQ ID NO: 3890510 - RNA, 18 nt, Human
uagccagcugcuccccag

SEQ ID NO: 3890511 - RNA, 13 nt, Human
uagccagcuguca

SEQ ID NO: 3890512 - RNA, 13 nt, Human
uagccaggaucau

SEQ ID NO: 3890513 - RNA, 22 nt, Human
uagccaggguguggcccugcca

SEQ ID NO: 3890514 - RNA, 16 nt, Human
uagccaguugaauuua

SEQ ID NO: 3890515 - RNA, 17 nt, Human
uagccauauuuguaaaa

SEQ ID NO: 3890516 - RNA, 20 nt, Human
uagccauauuuguaaaauga

SEQ ID NO: 3890517 - RNA, 13 nt, Human
uagccaugggacc

SEQ ID NO: 3890518 - RNA, 16 nt, Human
uagccauuuuuacugu

SEQ ID NO: 3890519 - RNA, 17 nt, Human
uagccauuuuuacuguu

SEQ ID NO: 3890520 - RNA, 14 nt, Human
uagcccacccugcu

SEQ ID NO: 3890521 - RNA, 15 nt, Human
uagcccacccugcug

SEQ ID NO: 3890522 - RNA, 15 nt, Human
uagcccacucugcuc

SEQ ID NO: 3890523 - RNA, 15 nt, Human
uagcccaggagagag

SEQ ID NO: 3890524 - RNA, 21 nt, Human
uagcccaggauauauuuuauu

SEQ ID NO: 3890525 - RNA, 14 nt, Human
uagcccaggcugga

SEQ ID NO: 3890526 - RNA, 19 nt, Human
uagcccaggcuggagugca

SEQ ID NO: 3890527 - RNA, 15 nt, Human
uagcccaucccugcc

SEQ ID NO: 3890528 - RNA, 20 nt, Human
uagccccaagaaggcugggg

SEQ ID NO: 3890529 - RNA, 22 nt, Human
uagccccaagaaggcuggggcu

SEQ ID NO: 3890530 - RNA, 17 nt, Human
uagccccagugacagcu

SEQ ID NO: 3890531 - RNA, 15 nt, Human
uagcccccucuuccc

SEQ ID NO: 3890532 - RNA, 15 nt, Human
uagcccccuggccuc

SEQ ID NO: 3890533 - RNA, 14 nt, Human
uagccccucccaag

SEQ ID NO: 3890534 - RNA, 23 nt, Human
uagccccucuccccgcaguguuu

SEQ ID NO: 3890535 - RNA, 12 nt, Human
uagcccgccugc

SEQ ID NO: 3890536 - RNA, 14 nt, Human
uagcccgccugcca

SEQ ID NO: 3890537 - RNA, 15 nt, Human
uagcccgccugccag

SEQ ID NO: 3890538 - RNA, 16 nt, Human
uagcccucccacuuug

SEQ ID NO: 3890539 - RNA, 17 nt, Human
uagcccucccacuuugc

SEQ ID NO: 3890540 - RNA, 18 nt, Human
uagcccuccuuuuuccaa

SEQ ID NO: 3890541 - RNA, 22 nt, Human
uagcccucucccucuaggcucu

SEQ ID NO: 3890542 - RNA, 14 nt, Human
uagcccugaacauu

SEQ ID NO: 3890543 - RNA, 13 nt, Human
uagcccuguccug

SEQ ID NO: 3890544 - RNA, 14 nt, Human
uagccgaccucagc

SEQ ID NO: 3890545 - RNA, 15 nt, Human
uagccgagagccugc

SEQ ID NO: 3890546 - RNA, 18 nt, Human
uagccgagagccugcucc

SEQ ID NO: 3890547 - RNA, 14 nt, Human
uagccuaagauaua

SEQ ID NO: 3890548 - RNA, 19 nt, Human
uagccuaagauauacuugu

SEQ ID NO: 3890549 - RNA, 20 nt, Human
uagccuauguggauuuuuuc

SEQ ID NO: 3890550 - RNA, 21 nt, Human
uagccuauuuaccugcaggcu

SEQ ID NO: 3890551 - RNA, 18 nt, Human
uagccucacuuuuaauga

SEQ ID NO: 3890552 - RNA, 22 nt, Human
uagccucaggggucugagcucc

SEQ ID NO: 3890553 - RNA, 15 nt, Human
uagccugaguagaaa

SEQ ID NO: 3890554 - RNA, 14 nt, Human
uagccugcacuuug

SEQ ID NO: 3890555 - RNA, 20 nt, Human
uagccugccucuucucuacu

SEQ ID NO: 3890556 - RNA, 12 nt, Human
uagccugcuggu

SEQ ID NO: 3890557 - RNA, 17 nt, Human
uagccuggaccucugac

SEQ ID NO: 3890558 - RNA, 22 nt, Human
uagccuggaccucugacagcag

SEQ ID NO: 3890559 - RNA, 22 nt, Human
uagccuggauauuauucuugua

SEQ ID NO: 3890560 - RNA, 11 nt, Human
uagccuggcua

SEQ ID NO: 3890561 - RNA, 14 nt, Human
uagccugggguggg

SEQ ID NO: 3890562 - RNA, 11 nt, Human
uagccuguccu

SEQ ID NO: 3890563 - RNA, 13 nt, Human
uagccuguccugu

SEQ ID NO: 3890564 - RNA, 14 nt, Human
uagccuguggcagu

SEQ ID NO: 3890565 - RNA, 13 nt, Human
uagccuguggccc

SEQ ID NO: 3890566 - RNA, 16 nt, Human
uagccuguggcccugu

SEQ ID NO: 3890567 - RNA, 15 nt, Human
uagccuguuucuucc

SEQ ID NO: 3890568 - RNA, 20 nt, Human
uagccuuagaagucacacag

SEQ ID NO: 3890569 - RNA, 16 nt, Human
uagccuuauccucuga

SEQ ID NO: 3890570 - RNA, 17 nt, Human
uagccuuauccucugau

SEQ ID NO: 3890571 - RNA, 18 nt, Human
uagccuuauccucugauc

SEQ ID NO: 3890572 - RNA, 13 nt, Human
uagccuuccucca

SEQ ID NO: 3890573 - RNA, 23 nt, Human
uagccuuccuccacauccuuucu

SEQ ID NO: 3890574 - RNA, 13 nt, Human
uagccuucucugu

SEQ ID NO: 3890575 - RNA, 13 nt, Human
uagccuugcuugu

SEQ ID NO: 3890576 - RNA, 18 nt, Human
uagccuuuaccugugaag

SEQ ID NO: 3890577 - RNA, 22 nt, Human
uagccuuuuuuccccagacuug

SEQ ID NO: 3890578 - RNA, 23 nt, Human
uagccuuuuuuccccagacuugu

SEQ ID NO: 3890579 - RNA, 23 nt, Human
uagcgacauugcagucugcuucu

SEQ ID NO: 3890580 - RNA, 17 nt, Human
uagcgaucucuccuggc

SEQ ID NO: 3890581 - RNA, 17 nt, Human
uagcgugcucacugacc

SEQ ID NO: 3890582 - RNA, 18 nt, Human
uagcguguguagauagua

SEQ ID NO: 3890583 - RNA, 23 nt, Human
uagcguuggaauuaaaacaaugu

SEQ ID NO: 3890584 - RNA, 20 nt, Human
uagcuaaacggauuccaaag

SEQ ID NO: 3890585 - RNA, 23 nt, Human
uagcuaacauuuuaaauaaaaga

SEQ ID NO: 3890586 - RNA, 17 nt, Human
uagcuaacuguaaauca

SEQ ID NO: 3890587 - RNA, 19 nt, Human
uagcuaagcggaccagccu

SEQ ID NO: 3890588 - RNA, 15 nt, Human
uagcuaaguacacaa

SEQ ID NO: 3890589 - RNA, 19 nt, Human
uagcuaauaacaugugaaa

SEQ ID NO: 3890590 - RNA, 24 nt, Human
uagcuaauaaugagcuauuaaaac

SEQ ID NO: 3890591 - RNA, 15 nt, Human
uagcuaauaauguua

SEQ ID NO: 3890592 - RNA, 12 nt, Human
uagcuaauguaa

SEQ ID NO: 3890593 - RNA, 19 nt, Human
uagcuaauguaauaacugu

SEQ ID NO: 3890594 - RNA, 13 nt, Human
uagcuacagagaa

SEQ ID NO: 3890595 - RNA, 15 nt, Human
uagcuacaggaagca

SEQ ID NO: 3890596 - RNA, 20 nt, Human
uagcuacaggaagcacccca

SEQ ID NO: 3890597 - RNA, 15 nt, Human
uagcuacagugcaua

SEQ ID NO: 3890598 - RNA, 20 nt, Human
uagcuacccaaaagagaaaa

SEQ ID NO: 3890599 - RNA, 19 nt, Human
uagcuagaaauaugauuuu

SEQ ID NO: 3890600 - RNA, 14 nt, Human
uagcuagaaguggg

SEQ ID NO: 3890601 - RNA, 20 nt, Human
uagcuagaagugggccagga

SEQ ID NO: 3890602 - RNA, 15 nt, Human
uagcuagacugguga

SEQ ID NO: 3890603 - RNA, 22 nt, Human
uagcuagacuggugacugauuc

SEQ ID NO: 3890604 - RNA, 13 nt, Human
uagcuagaggaac

SEQ ID NO: 3890605 - RNA, 21 nt, Human
uagcuauauccauguacugua

SEQ ID NO: 3890606 - RNA, 15 nt, Human
uagcuauaucuauau

SEQ ID NO: 3890607 - RNA, 17 nt, Human
uagcuauaucuauauau

SEQ ID NO: 3890608 - RNA, 17 nt, Human
uagcuaucaagaggcug

SEQ ID NO: 3890609 - RNA, 14 nt, Human
uagcuauuacugga

SEQ ID NO: 3890610 - RNA, 15 nt, Human
uagcuauuacuggau

SEQ ID NO: 3890611 - RNA, 13 nt, Human
uagcuauuacugu

SEQ ID NO: 3890612 - RNA, 14 nt, Human
uagcuauuacuguc

SEQ ID NO: 3890613 - RNA, 19 nt, Human
uagcuauuuuuauggaauu

SEQ ID NO: 3890614 - RNA, 15 nt, Human
uagcucaaugagcau

SEQ ID NO: 3890615 - RNA, 18 nt, Human
uagcucaaugagcauguu

SEQ ID NO: 3890616 - RNA, 17 nt, Human
uagcucagccccagccc

SEQ ID NO: 3890617 - RNA, 12 nt, Human
uagcucaguuua

SEQ ID NO: 3890618 - RNA, 20 nt, Human
uagcuccccuccucuccccu

SEQ ID NO: 3890619 - RNA, 11 nt, Human
uagcuccuccc

SEQ ID NO: 3890620 - RNA, 12 nt, Human
uagcuccucccc

SEQ ID NO: 3890621 - RNA, 17 nt, Human
uagcucuaauguuugca

SEQ ID NO: 3890622 - RNA, 18 nt, Human
uagcucuaauguuugcau

SEQ ID NO: 3890623 - RNA, 19 nt, Human
uagcucuaauguuugcaua

SEQ ID NO: 3890624 - RNA, 20 nt, Human
uagcucuaauguuugcauau

SEQ ID NO: 3890625 - RNA, 17 nt, Human
uagcucuauguuuacaa

SEQ ID NO: 3890626 - RNA, 13 nt, Human
uagcucucuaggc

SEQ ID NO: 3890627 - RNA, 23 nt, Human
uagcucuuguugagccgugggca

SEQ ID NO: 3890628 - RNA, 13 nt, Human
uagcucuuuccuu

SEQ ID NO: 3890629 - RNA, 18 nt, Human
uagcucuuugucagggag

SEQ ID NO: 3890630 - RNA, 19 nt, Human
uaggcauuuuuaccaucac

SEQ ID NO: 3890631 - RNA, 15 nt, Human
uaggccaaagacaaa

SEQ ID NO: 3890632 - RNA, 19 nt, Human
uaggccaaauuuguagugc

SEQ ID NO: 3890633 - RNA, 21 nt, Human
uaggccaagguguccuacaga

SEQ ID NO: 3890634 - RNA, 22 nt, Human
uaggccaagguguccuacagaa

SEQ ID NO: 3890635 - RNA, 14 nt, Human
uaggccagagccca

SEQ ID NO: 3890636 - RNA, 16 nt, Human
uaggccagagcccacu

SEQ ID NO: 3890637 - RNA, 14 nt, Human
uaggccaugaaaaa

SEQ ID NO: 3890638 - RNA, 20 nt, Human
uaggccaugaaaaaaaugau

SEQ ID NO: 3890639 - RNA, 22 nt, Human
uaggccucaacuccucccauag

SEQ ID NO: 3890640 - RNA, 16 nt, Human
uaggccucagccagag

SEQ ID NO: 3890641 - RNA, 22 nt, Human
uaggccucucaccucugugccu

SEQ ID NO: 3890642 - RNA, 15 nt, Human
uaggccuggccagau

SEQ ID NO: 3890643 - RNA, 19 nt, Human
uaggccugggugcuggcug

SEQ ID NO: 3890644 - RNA, 20 nt, Human
uaggccugggugcuggcugc

SEQ ID NO: 3890645 - RNA, 23 nt, Human
uaggccuuccucucuccagaugu

SEQ ID NO: 3890646 - RNA, 16 nt, Human
uaggccuucuugugau

SEQ ID NO: 3890647 - RNA, 20 nt, Human
uaggccuugcggcuccucag

SEQ ID NO: 3890648 - RNA, 16 nt, Human
uaggccuuuuaacauu

SEQ ID NO: 3890649 - RNA, 14 nt, Human
uaggcgagugccag

SEQ ID NO: 3890650 - RNA, 15 nt, Human
uaggcuacaauuuuc

SEQ ID NO: 3890651 - RNA, 20 nt, Human
uaggcuacaauuuucuccca

SEQ ID NO: 3890652 - RNA, 12 nt, Human
uaggcuacagag

SEQ ID NO: 3890653 - RNA, 15 nt, Human
uaggcuagggugggg

SEQ ID NO: 3890654 - RNA, 16 nt, Human
uaggcuauuaaaaaag

SEQ ID NO: 3890655 - RNA, 15 nt, Human
uaggcuauucacaac

SEQ ID NO: 3890656 - RNA, 20 nt, Human
uaggcuauuuguaaaucugc

SEQ ID NO: 3890657 - RNA, 17 nt, Human
uaggcucauuuacuguu

SEQ ID NO: 3890658 - RNA, 20 nt, Human
uaggcucauuuacuguuuua

SEQ ID NO: 3890659 - RNA, 18 nt, Human
uaggcucugcacagaugg

SEQ ID NO: 3890660 - RNA, 15 nt, Human
uaggcucugccuucg

SEQ ID NO: 3890661 - RNA, 12 nt, Human
uaggcuggagaa

SEQ ID NO: 3890662 - RNA, 11 nt, Human
uaggcugggug

SEQ ID NO: 3890663 - RNA, 17 nt, Human
uaggcugggugcccaca

SEQ ID NO: 3890664 - RNA, 18 nt, Human
uagggaaaacauuccauc

SEQ ID NO: 3890665 - RNA, 13 nt, Human
uagggaacaauuu

SEQ ID NO: 3890666 - RNA, 13 nt, Human
uagggaacucugg

SEQ ID NO: 3890667 - RNA, 15 nt, Human
uagggaacucugggg

SEQ ID NO: 3890668 - RNA, 14 nt, Human
uagggaagagaaac

SEQ ID NO: 3890669 - RNA, 17 nt, Human
uagggaaggccaccugc

SEQ ID NO: 3890670 - RNA, 22 nt, Human
uagggaauaaaauccuaagaca

SEQ ID NO: 3890671 - RNA, 21 nt, Human
uagggaauggcacagcccaaa

SEQ ID NO: 3890672 - RNA, 20 nt, Human
uagggacaggaccccagcuc

SEQ ID NO: 3890673 - RNA, 18 nt, Human
uagggaccucagagguuu

SEQ ID NO: 3890674 - RNA, 15 nt, Human
uagggaccuggggaa

SEQ ID NO: 3890675 - RNA, 18 nt, Human
uagggaccuggggaagca

SEQ ID NO: 3890676 - RNA, 19 nt, Human
uagggacuacccauagaca

SEQ ID NO: 3890677 - RNA, 20 nt, Human
uagggacuacccauagacau

SEQ ID NO: 3890678 - RNA, 20 nt, Human
uagggacucaauuucucccc

SEQ ID NO: 3890679 - RNA, 14 nt, Human
uagggacugaccag

SEQ ID NO: 3890680 - RNA, 15 nt, Human
uagggacugaccagc

SEQ ID NO: 3890681 - RNA, 13 nt, Human
uagggacuuaaaa

SEQ ID NO: 3890682 - RNA, 16 nt, Human
uagggagaaauguugu

SEQ ID NO: 3890683 - RNA, 15 nt, Human
uagggagagaagaua

SEQ ID NO: 3890684 - RNA, 12 nt, Human
uagggagaguca

SEQ ID NO: 3890685 - RNA, 23 nt, Human
uagggauagucaccuuuuaaauc

SEQ ID NO: 3890686 - RNA, 14 nt, Human
uagggaugaguacc

SEQ ID NO: 3890687 - RNA, 15 nt, Human
uagggcaccaggggu

SEQ ID NO: 3890688 - RNA, 16 nt, Human
uagggcacugggcugu

SEQ ID NO: 3890689 - RNA, 19 nt, Human
uagggcaguaacauugggu

SEQ ID NO: 3890690 - RNA, 15 nt, Human
uagggccaggcaggu

SEQ ID NO: 3890691 - RNA, 17 nt, Human
uagggcccaugggaggg

SEQ ID NO: 3890692 - RNA, 14 nt, Human
uagggcccuggagg

SEQ ID NO: 3890693 - RNA, 14 nt, Human
uagggcugggaaac

SEQ ID NO: 3890694 - RNA, 11 nt, Human
uagggcugggu

SEQ ID NO: 3890695 - RNA, 14 nt, Human
uagggcuguaaaau

SEQ ID NO: 3890696 - RNA, 15 nt, Human
uaggggaagaauaau

SEQ ID NO: 3890697 - RNA, 21 nt, Human
uaggggaggggcuccuuucca

SEQ ID NO: 3890698 - RNA, 23 nt, Human
uaggggcuuauaauaaaggacug

SEQ ID NO: 3890699 - RNA, 16 nt, Human
uagggggcuggaggag

SEQ ID NO: 3890700 - RNA, 16 nt, Human
uagggguaauauauug

SEQ ID NO: 3890701 - RNA, 17 nt, Human
uagggguaccacugaau

SEQ ID NO: 3890702 - RNA, 17 nt, Human
uaggggucaggcuccau

SEQ ID NO: 3890703 - RNA, 13 nt, Human
uagggguugcuaa

SEQ ID NO: 3890704 - RNA, 18 nt, Human
uaggguaaggugccuucu

SEQ ID NO: 3890705 - RNA, 19 nt, Human
uaggguaagugagagaggg

SEQ ID NO: 3890706 - RNA, 15 nt, Human
uaggguacauggugc

SEQ ID NO: 3890707 - RNA, 19 nt, Human
uaggguacauggugcuggg

SEQ ID NO: 3890708 - RNA, 16 nt, Human
uaggguacauuuauaa

SEQ ID NO: 3890709 - RNA, 18 nt, Human
uaggguacauuuauaauu

SEQ ID NO: 3890710 - RNA, 22 nt, Human
uaggguacauuuauaauugcau

SEQ ID NO: 3890711 - RNA, 16 nt, Human
uaggguacuaaauuua

SEQ ID NO: 3890712 - RNA, 19 nt, Human
uaggguacuaaauuuaaau

SEQ ID NO: 3890713 - RNA, 13 nt, Human
uaggguccugggg

SEQ ID NO: 3890714 - RNA, 22 nt, Human
uagggucuggaacaccaggcug

SEQ ID NO: 3890715 - RNA, 17 nt, Human
uaggguuauaauaaugu

SEQ ID NO: 3890716 - RNA, 22 nt, Human
uaggguuauaauaauguuaaca

SEQ ID NO: 3890717 - RNA, 19 nt, Human
uaggguuugugacagggcg

SEQ ID NO: 3890718 - RNA, 14 nt, Human
uagguaaaauguau

SEQ ID NO: 3890719 - RNA, 16 nt, Human
uagguaaaauguauuu

SEQ ID NO: 3890720 - RNA, 14 nt, Human
uagguacacagcuc

SEQ ID NO: 3890721 - RNA, 13 nt, Human
uagguacuuuugg

SEQ ID NO: 3890722 - RNA, 16 nt, Human
uagguaguaccaaaau

SEQ ID NO: 3890723 - RNA, 15 nt, Human
uagguaugaauaagu

SEQ ID NO: 3890724 - RNA, 14 nt, Human
uagguauuucaaaa

SEQ ID NO: 3890725 - RNA, 18 nt, Human
uaggucaagaagaagaug

SEQ ID NO: 3890726 - RNA, 20 nt, Human
uaggucacuggcucuccaag

SEQ ID NO: 3890727 - RNA, 21 nt, Human
uaggucacuggcucuccaagu

SEQ ID NO: 3890728 - RNA, 18 nt, Human
uaggucaguacccaccug

SEQ ID NO: 3890729 - RNA, 23 nt, Human
uaggucaguacccaccugagcuu

SEQ ID NO: 3890730 - RNA, 15 nt, Human
uaggucucaauaccu

SEQ ID NO: 3890731 - RNA, 12 nt, Human
uaggucuccagu

SEQ ID NO: 3890732 - RNA, 19 nt, Human
uaggucucuucucccagaa

SEQ ID NO: 3890733 - RNA, 20 nt, Human
uaggucucuucucccagaau

SEQ ID NO: 3890734 - RNA, 14 nt, Human
uaggucugaaauuu

SEQ ID NO: 3890735 - RNA, 22 nt, Human
uaggucugaaauuuuucuucuu

SEQ ID NO: 3890736 - RNA, 15 nt, Human
uaggugagaaaaaaa

SEQ ID NO: 3890737 - RNA, 21 nt, Human
uaggugauccacucgccuuca

SEQ ID NO: 3890738 - RNA, 15 nt, Human
uaggugauccaugua

SEQ ID NO: 3890739 - RNA, 21 nt, Human
uaggugaucucauuuaauccu

SEQ ID NO: 3890740 - RNA, 18 nt, Human
uaggugcuacaaaaacac

SEQ ID NO: 3890741 - RNA, 16 nt, Human
uagguggaucaccuga

SEQ ID NO: 3890742 - RNA, 20 nt, Human
uagguggguugaaagccaag

SEQ ID NO: 3890743 - RNA, 16 nt, Human
uaggugucauuuccau

SEQ ID NO: 3890744 - RNA, 13 nt, Human
uagguguggggga

SEQ ID NO: 3890745 - RNA, 17 nt, Human
uaggugugggggaagca

SEQ ID NO: 3890746 - RNA, 13 nt, Human
uagguuaaaaaaa

SEQ ID NO: 3890747 - RNA, 18 nt, Human
uagguuaacuauguacaa

SEQ ID NO: 3890748 - RNA, 19 nt, Human
uagguuaacuauguacaau

SEQ ID NO: 3890749 - RNA, 20 nt, Human
uagguuauuaugauuagcuu

SEQ ID NO: 3890750 - RNA, 20 nt, Human
uagguucccuguucuuccuc

SEQ ID NO: 3890751 - RNA, 21 nt, Human
uagguucuaaaguucuaagau

SEQ ID NO: 3890752 - RNA, 22 nt, Human
uagguucuaaaguucuaagauu

SEQ ID NO: 3890753 - RNA, 18 nt, Human
uagguucuuugcugcauu

SEQ ID NO: 3890754 - RNA, 12 nt, Human
uagguugcacac

SEQ ID NO: 3890755 - RNA, 13 nt, Human
uagguugcacacu

SEQ ID NO: 3890756 - RNA, 17 nt, Human
uagguugcacacuuugg

SEQ ID NO: 3890757 - RNA, 20 nt, Human
uagguugccaauaauacacu

SEQ ID NO: 3890758 - RNA, 13 nt, Human
uagguugggacac

SEQ ID NO: 3890759 - RNA, 18 nt, Human
uagguuuaacauaaaggu

SEQ ID NO: 3890760 - RNA, 17 nt, Human
uagguuuaacucagauc

SEQ ID NO: 3890761 - RNA, 21 nt, Human
uagguuuaacucagaucacua

SEQ ID NO: 3890762 - RNA, 17 nt, Human
uagguuuaugacaguaa

SEQ ID NO: 3890763 - RNA, 20 nt, Human
uagguuuaugacaguaauug

SEQ ID NO: 3890764 - RNA, 21 nt, Human
uagguuuaugacaguaauugu

SEQ ID NO: 3890765 - RNA, 11 nt, Human
uagguuucaaa

SEQ ID NO: 3890766 - RNA, 14 nt, Human
uagguuucaaagau

SEQ ID NO: 3890767 - RNA, 20 nt, Human
uagguuucuaaaaagucaga

SEQ ID NO: 3890768 - RNA, 16 nt, Human
uagguuuuguuugcua

SEQ ID NO: 3890769 - RNA, 23 nt, Human
uagguuuuguuugcuaucuuaau

SEQ ID NO: 3890770 - RNA, 15 nt, Human
uagguuuuuauuagu

SEQ ID NO: 3890771 - RNA, 15 nt, Human
uagguuuuuguuugu

SEQ ID NO: 3890772 - RNA, 16 nt, Human
uaguaaaaauaaaauu

SEQ ID NO: 3890773 - RNA, 15 nt, Human
uaguaaaaauacaaa

SEQ ID NO: 3890774 - RNA, 13 nt, Human
uaguaaaaauuaa

SEQ ID NO: 3890775 - RNA, 13 nt, Human
uaugaauacuuug

SEQ ID NO: 3890776 - RNA, 23 nt, Human
uaugaaucagugggcaggauaaa

SEQ ID NO: 3890777 - RNA, 20 nt, Human
uaugaaucuaugccaaagau

SEQ ID NO: 3890778 - RNA, 12 nt, Human
uaugaaucuauu

SEQ ID NO: 3890779 - RNA, 20 nt, Human
uaugaaucuauuugugggug

SEQ ID NO: 3890780 - RNA, 19 nt, Human
uaugaaugcccccagcugg

SEQ ID NO: 3890781 - RNA, 17 nt, Human
uaugaaugugaagccuu

SEQ ID NO: 3890782 - RNA, 18 nt, Human
uaugaaugugaagccuuc

SEQ ID NO: 3890783 - RNA, 15 nt, Human
uaugaauuguacaga

SEQ ID NO: 3890784 - RNA, 17 nt, Human
uaugaauuuaaauauaa

SEQ ID NO: 3890785 - RNA, 19 nt, Human
uaugaauuuaaauauaauu

SEQ ID NO: 3890786 - RNA, 23 nt, Human
uaugaauuuaaauauaauucugu

SEQ ID NO: 3890787 - RNA, 16 nt, Human
uaugacagcugucccu

SEQ ID NO: 3890788 - RNA, 20 nt, Human
uaugacagcugucccuguca

SEQ ID NO: 3890789 - RNA, 17 nt, Human
uaugacaguaauugugu

SEQ ID NO: 3890790 - RNA, 19 nt, Human
uaugacaucacuuguacaa

SEQ ID NO: 3890791 - RNA, 20 nt, Human
uaugacaucacuuguacaaa

SEQ ID NO: 3890792 - RNA, 24 nt, Human
uaugacaucacuuguacaaaauaa

SEQ ID NO: 3890793 - RNA, 21 nt, Human
uaugacauuggauagaacaug

SEQ ID NO: 3890794 - RNA, 18 nt, Human
uaugaccuucuaggaagc

SEQ ID NO: 3890795 - RNA, 15 nt, Human
uaugacgcugauaca

SEQ ID NO: 3890796 - RNA, 16 nt, Human
uaugacgcugauacau

SEQ ID NO: 3890797 - RNA, 18 nt, Human
uaugacgcugauacauaa

SEQ ID NO: 3890798 - RNA, 22 nt, Human
uaugacgcugauacauaacuaa

SEQ ID NO: 3890799 - RNA, 16 nt, Human
uaugacggaagaacau

SEQ ID NO: 3890800 - RNA, 15 nt, Human
uaugacuaaagagag

SEQ ID NO: 3890801 - RNA, 16 nt, Human
uaugacuauguaaacu

SEQ ID NO: 3890802 - RNA, 18 nt, Human
uaugacuauguaaacuac

SEQ ID NO: 3890803 - RNA, 18 nt, Human
uaugacugcuccccagcc

SEQ ID NO: 3890804 - RNA, 22 nt, Human
uaugacuuuuuauaaaauggcu

SEQ ID NO: 3890805 - RNA, 21 nt, Human
uaugagaaacuggcaaagcag

SEQ ID NO: 3890806 - RNA, 14 nt, Human
uaugagaagaauag

SEQ ID NO: 3890807 - RNA, 14 nt, Human
uaugagauugguuu

SEQ ID NO: 3890808 - RNA, 20 nt, Human
uaugagauugguuuuccugu

SEQ ID NO: 3890809 - RNA, 18 nt, Human
uaugagcauccugagccc

SEQ ID NO: 3890810 - RNA, 14 nt, Human
uaugagcucuucau

SEQ ID NO: 3890811 - RNA, 16 nt, Human
uaugagcucuucaugu

SEQ ID NO: 3890812 - RNA, 15 nt, Human
uaugagcuuccaagg

SEQ ID NO: 3890813 - RNA, 18 nt, Human
uaugagcuugcucauuaa

SEQ ID NO: 3890814 - RNA, 13 nt, Human
uaugaggaaaggu

SEQ ID NO: 3890815 - RNA, 18 nt, Human
uaugaggagugaacauuu

SEQ ID NO: 3890816 - RNA, 22 nt, Human
uaugaggcaaccacaggcagca

SEQ ID NO: 3890817 - RNA, 13 nt, Human
uaugaggcauuug

SEQ ID NO: 3890818 - RNA, 15 nt, Human
uaugaggcauuuguu

SEQ ID NO: 3890819 - RNA, 14 nt, Human
uaugaguagccagg

SEQ ID NO: 3890820 - RNA, 23 nt, Human
uaugaguauacaauauauaaaaa

SEQ ID NO: 3890821 - RNA, 15 nt, Human
uaugagucaaugugc

SEQ ID NO: 3890822 - RNA, 16 nt, Human
uaugagucaaugugca

SEQ ID NO: 3890823 - RNA, 21 nt, Human
uaugaguuuuugauagcuuua

SEQ ID NO: 3890824 - RNA, 16 nt, Human
uaugauaaaaaauuuu

SEQ ID NO: 3890825 - RNA, 20 nt, Human
uaugauaaaaaauuuuguaa

SEQ ID NO: 3890826 - RNA, 16 nt, Human
uaugauaauagauucu

SEQ ID NO: 3890827 - RNA, 24 nt, Human
uaugauagguuauuuugauguaaa

SEQ ID NO: 3890828 - RNA, 16 nt, Human
uaugauauuccauagu

SEQ ID NO: 3890829 - RNA, 22 nt, Human
uaugauauuuucugugccugaa

SEQ ID NO: 3890830 - RNA, 13 nt, Human
uaugaucaaaugu

SEQ ID NO: 3890831 - RNA, 16 nt, Human
uaugaucaaauguuua

SEQ ID NO: 3890832 - RNA, 18 nt, Human
uaugaucaaauguuuaau

SEQ ID NO: 3890833 - RNA, 22 nt, Human
uaugaucaaauguuuaaucaua

SEQ ID NO: 3890834 - RNA, 14 nt, Human
uaugaucacggcuc

SEQ ID NO: 3890835 - RNA, 21 nt, Human
uaugaucacggcucacugcag

SEQ ID NO: 3890836 - RNA, 14 nt, Human
uaugaucaguguug

SEQ ID NO: 3890837 - RNA, 20 nt, Human
uaugauccagcagauuauuc

SEQ ID NO: 3890838 - RNA, 15 nt, Human
uaugaucuguuuugu

SEQ ID NO: 3890839 - RNA, 22 nt, Human
uaugaucuugaguauaagaaau

SEQ ID NO: 3890840 - RNA, 14 nt, Human
uaugaugacuguuu

SEQ ID NO: 3890841 - RNA, 17 nt, Human
uaugauguaaucucucu

SEQ ID NO: 3890842 - RNA, 19 nt, Human
uaugauguauacugccacu

SEQ ID NO: 3890843 - RNA, 13 nt, Human
uaugauguauauu

SEQ ID NO: 3890844 - RNA, 15 nt, Human
uaugauguguuguga

SEQ ID NO: 3890845 - RNA, 20 nt, Human
uaugauguuaguuuuccuua

SEQ ID NO: 3890846 - RNA, 12 nt, Human
uaugauuaaaaa

SEQ ID NO: 3890847 - RNA, 14 nt, Human
uaugauuaaaaaua

SEQ ID NO: 3890848 - RNA, 21 nt, Human
uaugauuagcuuugucacugu

SEQ ID NO: 3890849 - RNA, 21 nt, Human
uaugauucaaaugucuauaaa

SEQ ID NO: 3890850 - RNA, 19 nt, Human
uaugauucugcuuuuacca

SEQ ID NO: 3890851 - RNA, 20 nt, Human
uaugauugccuuuuuauaac

SEQ ID NO: 3890852 - RNA, 23 nt, Human
uaugauugccuuuuuauaacuuu

SEQ ID NO: 3890853 - RNA, 18 nt, Human
uaugauuuaaaacaugua

SEQ ID NO: 3890854 - RNA, 14 nt, Human
uaugauuuauaguu

SEQ ID NO: 3890855 - RNA, 21 nt, Human
uaugauuucacuagaaaagcu

SEQ ID NO: 3890856 - RNA, 15 nt, Human
uaugauuuggaaaau

SEQ ID NO: 3890857 - RNA, 19 nt, Human
uaugauuuucauaacuuau

SEQ ID NO: 3890858 - RNA, 20 nt, Human
uaugauuuuuuaaaagaaau

SEQ ID NO: 3890859 - RNA, 22 nt, Human
uaugcaaaaguucugacuugac

SEQ ID NO: 3890860 - RNA, 14 nt, Human
uaugcaaaauggaa

SEQ ID NO: 3890861 - RNA, 16 nt, Human
uaugcaaacaggguaa

SEQ ID NO: 3890862 - RNA, 21 nt, Human
uaugcaaacauaacaaaauca

SEQ ID NO: 3890863 - RNA, 14 nt, Human
uaugcaaauauuuu

SEQ ID NO: 3890864 - RNA, 15 nt, Human
uaugcaaauucccag

SEQ ID NO: 3890865 - RNA, 16 nt, Human
uaugcaagcaguuuca

SEQ ID NO: 3890866 - RNA, 17 nt, Human
uaugcaagcaguuucaa

SEQ ID NO: 3890867 - RNA, 18 nt, Human
uaugcaagcaguuucaau

SEQ ID NO: 3890868 - RNA, 17 nt, Human
uaugcaauggauuuuca

SEQ ID NO: 3890869 - RNA, 16 nt, Human
uaugcaauuuccuuuu

SEQ ID NO: 3890870 - RNA, 16 nt, Human
uaugcacacacauaua

SEQ ID NO: 3890871 - RNA, 15 nt, Human
uaugcacaugaacuu

SEQ ID NO: 3890872 - RNA, 19 nt, Human
uaugcaccuugugucugua

SEQ ID NO: 3890873 - RNA, 16 nt, Human
uaugcacuaaauauga

SEQ ID NO: 3890874 - RNA, 19 nt, Human
uaugcacuuauaauuuucc

SEQ ID NO: 3890875 - RNA, 22 nt, Human
uaugcacuuauaauuuuccuaa

SEQ ID NO: 3890876 - RNA, 14 nt, Human
uaugcagugcugcu

SEQ ID NO: 3890877 - RNA, 17 nt, Human
uaugcaguuuuucagag

SEQ ID NO: 3890878 - RNA, 23 nt, Human
uaugcauaacugacaaaucaagu

SEQ ID NO: 3890879 - RNA, 20 nt, Human
uaugcauauauauaugugug

SEQ ID NO: 3890880 - RNA, 15 nt, Human
uaugcauauuuguuu

SEQ ID NO: 3890881 - RNA, 20 nt, Human
uaugcauggugccccaggac

SEQ ID NO: 3890882 - RNA, 21 nt, Human
uaugcauggugccccaggacc

SEQ ID NO: 3890883 - RNA, 22 nt, Human
uaugcauggugccccaggacca

SEQ ID NO: 3890884 - RNA, 16 nt, Human
uaugcaugugaagaaa

SEQ ID NO: 3890885 - RNA, 16 nt, Human
uaugcauuauaucaaa

SEQ ID NO: 3890886 - RNA, 19 nt, Human
uaugcauucacauuuagaa

SEQ ID NO: 3890887 - RNA, 22 nt, Human
uaugcauucacauuuagaaaag

SEQ ID NO: 3890888 - RNA, 23 nt, Human
uaugcauucacauuuagaaaagu

SEQ ID NO: 3890889 - RNA, 11 nt, Human
uaugcauuuga

SEQ ID NO: 3890890 - RNA, 21 nt, Human
uaugccaccaacuuacaaaaa

SEQ ID NO: 3890891 - RNA, 14 nt, Human
uaugccacuuccuu

SEQ ID NO: 3890892 - RNA, 13 nt, Human
uaugccauagaaa

SEQ ID NO: 3890893 - RNA, 14 nt, Human
uaugccauuuguuu

SEQ ID NO: 3890894 - RNA, 12 nt, Human
uaugcccaguuu

SEQ ID NO: 3890895 - RNA, 20 nt, Human
uaugcccaguuucugccucu

SEQ ID NO: 3890896 - RNA, 19 nt, Human
uaugccccauucaacaucu

SEQ ID NO: 3890897 - RNA, 20 nt, Human
uaugccgaaugcccucaggg

SEQ ID NO: 3890898 - RNA, 15 nt, Human
uaugccggaugugcu

SEQ ID NO: 3890899 - RNA, 23 nt, Human
uaugccggaugugcuuuucucca

SEQ ID NO: 3890900 - RNA, 15 nt, Human
uaugccucuccuuug

SEQ ID NO: 3890901 - RNA, 19 nt, Human
uaugccucuccuuuguaua

SEQ ID NO: 3890902 - RNA, 16 nt, Human
uaugccucuguauuua

SEQ ID NO: 3890903 - RNA, 12 nt, Human
uaugccuguacu

SEQ ID NO: 3890904 - RNA, 22 nt, Human
uaugccuguacucgcuugugca

SEQ ID NO: 3890905 - RNA, 14 nt, Human
uaugccuuguauaa

SEQ ID NO: 3890906 - RNA, 16 nt, Human
uaugccuuguuucaua

SEQ ID NO: 3890907 - RNA, 14 nt, Human
uaugcuaagaauuu

SEQ ID NO: 3890908 - RNA, 13 nt, Human
uaugcuaaucagg

SEQ ID NO: 3890909 - RNA, 17 nt, Human
uaugcuaccaccagcug

SEQ ID NO: 3890910 - RNA, 22 nt, Human
uaugcuauuucuauauuuucau

SEQ ID NO: 3890911 - RNA, 16 nt, Human
uaugcucaggggcccu

SEQ ID NO: 3890912 - RNA, 18 nt, Human
uaugcucuacccuugugu

SEQ ID NO: 3890913 - RNA, 18 nt, Human
uaugcucucacuguuugu

SEQ ID NO: 3890914 - RNA, 19 nt, Human
uaugcucugcauguuacau

SEQ ID NO: 3890915 - RNA, 16 nt, Human
uaugcucuuuuuuacu

SEQ ID NO: 3890916 - RNA, 20 nt, Human
uaugcucuuuuuuacucauu

SEQ ID NO: 3890917 - RNA, 15 nt, Human
uaugcugaucaucgc

SEQ ID NO: 3890918 - RNA, 22 nt, Human
uaugcugcuuuuauaucuguau

SEQ ID NO: 3890919 - RNA, 22 nt, Human
uaugugaaaggauaugaaucug

SEQ ID NO: 3890920 - RNA, 16 nt, Human
uaugugagugccuuuu

SEQ ID NO: 3890921 - RNA, 23 nt, Human
uaugugagugccuuuugcagaag

SEQ ID NO: 3890922 - RNA, 13 nt, Human
uaugugauuacaa

SEQ ID NO: 3890923 - RNA, 16 nt, Human
uaugugauuuuaacuc

SEQ ID NO: 3890924 - RNA, 19 nt, Human
uaugugauuuuaacucugu

SEQ ID NO: 3890925 - RNA, 21 nt, Human
uaugugauuuuaacucugucu

SEQ ID NO: 3890926 - RNA, 20 nt, Human
uaugugcacaucuguuuugu

SEQ ID NO: 3890927 - RNA, 12 nt, Human
uaugugcacugu

SEQ ID NO: 3890928 - RNA, 21 nt, Human
uaugugcacugucacuuugcu

SEQ ID NO: 3890929 - RNA, 19 nt, Human
uaugugccagauuuaugca

SEQ ID NO: 3890930 - RNA, 23 nt, Human
uaugugccagauuuaugcauauu

SEQ ID NO: 3890931 - RNA, 19 nt, Human
uaugugggggucugugugu

SEQ ID NO: 3890932 - RNA, 18 nt, Human
uaugugguuuuagauuuu

SEQ ID NO: 3890933 - RNA, 15 nt, Human
uaugugguuuuguaa

SEQ ID NO: 3890934 - RNA, 14 nt, Human
uauguguaaaaugu

SEQ ID NO: 3890935 - RNA, 14 nt, Human
uauguguaaauaca

SEQ ID NO: 3890936 - RNA, 14 nt, Human
uauguguauauaua

SEQ ID NO: 3890937 - RNA, 20 nt, Human
uauguguaugcacaguaaaa

SEQ ID NO: 3890938 - RNA, 12 nt, Human
uauguguaugug

SEQ ID NO: 3890939 - RNA, 18 nt, Human
uauguguaugugccauuu

SEQ ID NO: 3890940 - RNA, 15 nt, Human
uaugugugaggagcu

SEQ ID NO: 3890941 - RNA, 18 nt, Human
uaugugugcaugugugua

SEQ ID NO: 3890942 - RNA, 19 nt, Human
uauguguguauauguaugu

SEQ ID NO: 3890943 - RNA, 21 nt, Human
uauguguguaugggugugugu

SEQ ID NO: 3890944 - RNA, 23 nt, Human
uauguguguguguuguguguggg

SEQ ID NO: 3890945 - RNA, 17 nt, Human
uauguguguuuaaauaa

SEQ ID NO: 3890946 - RNA, 20 nt, Human
uauguguguuuaaauaaagu

SEQ ID NO: 3890947 - RNA, 13 nt, Human
uauguguucuauu

SEQ ID NO: 3890948 - RNA, 13 nt, Human
uauguguuuagaa

SEQ ID NO: 3890949 - RNA, 14 nt, Human
uauguuaaagagaa

SEQ ID NO: 3890950 - RNA, 22 nt, Human
uauguuaagcagcuaaauuuuc

SEQ ID NO: 3890951 - RNA, 19 nt, Human
uauguuagugcaaauuguc

SEQ ID NO: 3890952 - RNA, 19 nt, Human
uauguuauauauaaauaua

SEQ ID NO: 3890953 - RNA, 21 nt, Human
uauguuauauauaaauauauu

SEQ ID NO: 3890954 - RNA, 14 nt, Human
uauguuauaucaac

SEQ ID NO: 3890955 - RNA, 16 nt, Human
uauguucaaagucaaa

SEQ ID NO: 3890956 - RNA, 14 nt, Human
uauguucauuuguu

SEQ ID NO: 3890957 - RNA, 17 nt, Human
uauguucauuuguuugu

SEQ ID NO: 3890958 - RNA, 15 nt, Human
uauguuccauuaaac

SEQ ID NO: 3890959 - RNA, 17 nt, Human
uauguugaagccuuugu

SEQ ID NO: 3890960 - RNA, 13 nt, Human
uauguugacauuu

SEQ ID NO: 3890961 - RNA, 15 nt, Human
uauguugaugaaaaa

SEQ ID NO: 3890962 - RNA, 16 nt, Human
uauguugucaaagaga

SEQ ID NO: 3890963 - RNA, 21 nt, Human
uauguuguccaauuguugaca

SEQ ID NO: 3890964 - RNA, 16 nt, Human
uauguugugaagaugu

SEQ ID NO: 3890965 - RNA, 18 nt, Human
uauguuuaccuuuuaauu

SEQ ID NO: 3890966 - RNA, 18 nt, Human
uauguuuauuuacuaauu

SEQ ID NO: 3890967 - RNA, 14 nt, Human
uauguuuccuuguu

SEQ ID NO: 3890968 - RNA, 12 nt, Human
uauguuugaaua

SEQ ID NO: 3890969 - RNA, 16 nt, Human
uauguuugaauaugga

SEQ ID NO: 3890970 - RNA, 22 nt, Human
uauguuugccacuuugcaaagg

SEQ ID NO: 3890971 - RNA, 20 nt, Human
uauguuugucuuuuaaugcu

SEQ ID NO: 3890972 - RNA, 14 nt, Human
uauguuuuagcaug

SEQ ID NO: 3890973 - RNA, 16 nt, Human
uauguuuuagcaugug

SEQ ID NO: 3890974 - RNA, 21 nt, Human
uauguuuucaggcuagaugua

SEQ ID NO: 3890975 - RNA, 18 nt, Human
uauguuuucgaaaaucaa

SEQ ID NO: 3890976 - RNA, 12 nt, Human
uauguuuugguc

SEQ ID NO: 3890977 - RNA, 13 nt, Human
uauguuuuucagu

SEQ ID NO: 3890978 - RNA, 14 nt, Human
uauguuuuucaguu

SEQ ID NO: 3890979 - RNA, 20 nt, Human
uauguuuuucaguucaaagu

SEQ ID NO: 3890980 - RNA, 15 nt, Human
uauguuuuucugugu

SEQ ID NO: 3890981 - RNA, 23 nt, Human
uauuaaaaaaaacaaaaagaaca

SEQ ID NO: 3890982 - RNA, 13 nt, Human
uauuaaaaaacaa

SEQ ID NO: 3890983 - RNA, 13 nt, Human
uauuaaaaagucu

SEQ ID NO: 3890984 - RNA, 14 nt, Human
uauuaaaaagucuu

SEQ ID NO: 3890985 - RNA, 15 nt, Human
uauuaaaaagucuuu

SEQ ID NO: 3890986 - RNA, 12 nt, Human
uauuaaaaauau

SEQ ID NO: 3890987 - RNA, 18 nt, Human
uauuaaaaauauaaaacu

SEQ ID NO: 3890988 - RNA, 19 nt, Human
uauuaaaaauauaaaacug

SEQ ID NO: 3890989 - RNA, 22 nt, Human
uauuaaaaauauaaaacugcgu

SEQ ID NO: 3890990 - RNA, 20 nt, Human
uauuaaaaauauggaacuuc

SEQ ID NO: 3890991 - RNA, 18 nt, Human
uauuaaaacauuggauua

SEQ ID NO: 3890992 - RNA, 22 nt, Human
uauuaaaacucagccugggaca

SEQ ID NO: 3890993 - RNA, 17 nt, Human
uauuaaaagaaaggguu

SEQ ID NO: 3890994 - RNA, 13 nt, Human
uauuaaaagacuc

SEQ ID NO: 3890995 - RNA, 18 nt, Human
uauuaaaagacucauccg

SEQ ID NO: 3890996 - RNA, 14 nt, Human
uauuaaaagucaca

SEQ ID NO: 3890997 - RNA, 22 nt, Human
uauuaaaagucacaauguucuu

SEQ ID NO: 3890998 - RNA, 20 nt, Human
uauuaaaauaagcacugugc

SEQ ID NO: 3890999 - RNA, 17 nt, Human
uauuaaaauauuucagg

SEQ ID NO: 3891000 - RNA, 10 nt, Human
uauuaaaauu

SEQ ID NO: 3891001 - RNA, 19 nt, Human
uauuaaaauuccaaauuca

SEQ ID NO: 3891002 - RNA, 14 nt, Human
uauuaaaauucuga

SEQ ID NO: 3891003 - RNA, 15 nt, Human
uauuaaaauucugaa

SEQ ID NO: 3891004 - RNA, 17 nt, Human
uauuaaacaaaguuuca

SEQ ID NO: 3891005 - RNA, 18 nt, Human
uauuaaacaaaguuucag

SEQ ID NO: 3891006 - RNA, 20 nt, Human
uauuaaacagauuuuuacaa

SEQ ID NO: 3891007 - RNA, 17 nt, Human
uauuaaacaugcuguac

SEQ ID NO: 3891008 - RNA, 19 nt, Human
uauuaaacaugcuguacau

SEQ ID NO: 3891009 - RNA, 17 nt, Human
uauuaaaccauaagaug

SEQ ID NO: 3891010 - RNA, 18 nt, Human
uauuaaagaaaaaaaugu

SEQ ID NO: 3891011 - RNA, 20 nt, Human
uauuaaagaaaaaaauguau

SEQ ID NO: 3891012 - RNA, 14 nt, Human
uauuaaagccaugu

SEQ ID NO: 3891013 - RNA, 15 nt, Human
uauuaaaguuucaaa

SEQ ID NO: 3891014 - RNA, 21 nt, Human
uauuaaaguuucaaaaaucug

SEQ ID NO: 3891015 - RNA, 22 nt, Human
uauuaaaguuucaaaaaucuga

SEQ ID NO: 3891016 - RNA, 15 nt, Human
uauuaaauaaaauca

SEQ ID NO: 3891017 - RNA, 17 nt, Human
uauuaaauacagacacu

SEQ ID NO: 3891018 - RNA, 21 nt, Human
uauuaaauacagacacuaagu

SEQ ID NO: 3891019 - RNA, 17 nt, Human
uauuaaauggaaacuga

SEQ ID NO: 3891020 - RNA, 18 nt, Human
uauuaaauggaaacugaa

SEQ ID NO: 3891021 - RNA, 19 nt, Human
uauuaaauggaaacugaaa

SEQ ID NO: 3891022 - RNA, 12 nt, Human
uauuaaauuaca

SEQ ID NO: 3891023 - RNA, 12 nt, Human
uauuaaauuaug

SEQ ID NO: 3891024 - RNA, 20 nt, Human
uauuaaauuuuuuaaaaagc

SEQ ID NO: 3891025 - RNA, 22 nt, Human
uauuaaauuuuuuaaaaagcaa

SEQ ID NO: 3891026 - RNA, 20 nt, Human
uauuaaauuuuuuguugaca

SEQ ID NO: 3891027 - RNA, 17 nt, Human
uauuaaauuuuuuugua

SEQ ID NO: 3891028 - RNA, 18 nt, Human
uauuaaauuuuuuuguau

SEQ ID NO: 3891029 - RNA, 21 nt, Human
uauuaaauuuuuuuguaugaa

SEQ ID NO: 3891030 - RNA, 13 nt, Human
uauuaacaaaagu

SEQ ID NO: 3891031 - RNA, 18 nt, Human
uauuaacaaaaguucccu

SEQ ID NO: 3891032 - RNA, 14 nt, Human
uauuaacaauuaau

SEQ ID NO: 3891033 - RNA, 15 nt, Human
uauuaacgaugucca

SEQ ID NO: 3891034 - RNA, 16 nt, Human
uauuaacuacauuuau

SEQ ID NO: 3891035 - RNA, 18 nt, Human
uauuaacuacauuuauga

SEQ ID NO: 3891036 - RNA, 12 nt, Human
uauuaagaaagg

SEQ ID NO: 3891037 - RNA, 23 nt, Human
uauuaagaaaggaagcauuguaa

SEQ ID NO: 3891038 - RNA, 24 nt, Human
uauuaagaaaggaagcauuguaaa

SEQ ID NO: 3891039 - RNA, 14 nt, Human
uauuaagagugaaa

SEQ ID NO: 3891040 - RNA, 13 nt, Human
uauuaagauggau

SEQ ID NO: 3891041 - RNA, 18 nt, Human
uauuaagauggauucuca

SEQ ID NO: 3891042 - RNA, 18 nt, Human
uauuaagauuauaauugu

SEQ ID NO: 3891043 - RNA, 14 nt, Human
uauuaagcaguaaa

SEQ ID NO: 3891044 - RNA, 16 nt, Human
uauuaagcauauauuu

SEQ ID NO: 3891045 - RNA, 16 nt, Human
uauuaaggauguagcu

SEQ ID NO: 3891046 - RNA, 16 nt, Human
uauuaaguaacuuauu

SEQ ID NO: 3891047 - RNA, 16 nt, Human
uauuaauaaaaagaca

SEQ ID NO: 3891048 - RNA, 19 nt, Human
uauuaauaaacauucuauc

SEQ ID NO: 3891049 - RNA, 17 nt, Human
uauuaauaaauagagca

SEQ ID NO: 3891050 - RNA, 18 nt, Human
uauuaauauauauuaucu

SEQ ID NO: 3891051 - RNA, 13 nt, Human
uauuaauauuuaa

SEQ ID NO: 3891052 - RNA, 12 nt, Human
uauuaaucacug

SEQ ID NO: 3891053 - RNA, 16 nt, Human
uauuaaucacugugua

SEQ ID NO: 3891054 - RNA, 17 nt, Human
uauuaaucacuguguau

SEQ ID NO: 3891055 - RNA, 14 nt, Human
uauuaaucuuagug

SEQ ID NO: 3891056 - RNA, 17 nt, Human
uauuaaucuuaguguau

SEQ ID NO: 3891057 - RNA, 22 nt, Human
uauuaaucuuggauagcuaaua

SEQ ID NO: 3891058 - RNA, 13 nt, Human
uauuaaugaaaau

SEQ ID NO: 3891059 - RNA, 14 nt, Human
uauuaaugcacuuu

SEQ ID NO: 3891060 - RNA, 17 nt, Human
uauuaaugcacuuucua

SEQ ID NO: 3891061 - RNA, 14 nt, Human
uauuaaugcuaagg

SEQ ID NO: 3891062 - RNA, 18 nt, Human
uauuaauguuuucaaaag

SEQ ID NO: 3891063 - RNA, 11 nt, Human
uauuacaaaua

SEQ ID NO: 3891064 - RNA, 13 nt, Human
uauuacaauauuu

SEQ ID NO: 3891065 - RNA, 21 nt, Human
uauucagcucauggacuucug

SEQ ID NO: 3891066 - RNA, 17 nt, Human
uauucagcuucauuugu

SEQ ID NO: 3891067 - RNA, 16 nt, Human
uauucaggaagcucag

SEQ ID NO: 3891068 - RNA, 12 nt, Human
uauucaggacuu

SEQ ID NO: 3891069 - RNA, 16 nt, Human
uauucaggagaguaga

SEQ ID NO: 3891070 - RNA, 15 nt, Human
uauucaggcuuuagg

SEQ ID NO: 3891071 - RNA, 20 nt, Human
uauucagggaaggaggagcc

SEQ ID NO: 3891072 - RNA, 19 nt, Human
uauucaggggaaacuugau

SEQ ID NO: 3891073 - RNA, 22 nt, Human
uauucagugcuguggccugggc

SEQ ID NO: 3891074 - RNA, 18 nt, Human
uauucaguggcuaacuug

SEQ ID NO: 3891075 - RNA, 15 nt, Human
uauucagugucacug

SEQ ID NO: 3891076 - RNA, 16 nt, Human
uauucaguuaagaaaa

SEQ ID NO: 3891077 - RNA, 17 nt, Human
uauucaguucccagaau

SEQ ID NO: 3891078 - RNA, 18 nt, Human
uauucaguugguaagcuu

SEQ ID NO: 3891079 - RNA, 20 nt, Human
uauucauaagccaauuuuuc

SEQ ID NO: 3891080 - RNA, 23 nt, Human
uauucauaagccaauuuuucugc

SEQ ID NO: 3891081 - RNA, 16 nt, Human
uauucauaguuuaauu

SEQ ID NO: 3891082 - RNA, 16 nt, Human
uauucauaugcauauu

SEQ ID NO: 3891083 - RNA, 13 nt, Human
uauucauauuugu

SEQ ID NO: 3891084 - RNA, 22 nt, Human
uauucauauuuguacuuucugu

SEQ ID NO: 3891085 - RNA, 18 nt, Human
uauucauuaaauguuuga

SEQ ID NO: 3891086 - RNA, 22 nt, Human
uauucauuauuugucaaauugu

SEQ ID NO: 3891087 - RNA, 23 nt, Human
uauucauucauggaccacuguuu

SEQ ID NO: 3891088 - RNA, 19 nt, Human
uauucauucugcauugcua

SEQ ID NO: 3891089 - RNA, 22 nt, Human
uauucauucugugaucauuuau

SEQ ID NO: 3891090 - RNA, 20 nt, Human
uauucauugaagucagaugu

SEQ ID NO: 3891091 - RNA, 18 nt, Human
uauucauuguggucauag

SEQ ID NO: 3891092 - RNA, 19 nt, Human
uauucauuuaaaaugauua

SEQ ID NO: 3891093 - RNA, 12 nt, Human
uauucauuuagu

SEQ ID NO: 3891094 - RNA, 21 nt, Human
uauuccaaaaagguugcuguu

SEQ ID NO: 3891095 - RNA, 16 nt, Human
uauuccaaaccaaauu

SEQ ID NO: 3891096 - RNA, 17 nt, Human
uauuccaagacaugucu

SEQ ID NO: 3891097 - RNA, 17 nt, Human
uauuccaagcuuccaua

SEQ ID NO: 3891098 - RNA, 15 nt, Human
uauuccaccuuaaau

SEQ ID NO: 3891099 - RNA, 20 nt, Human
uauuccaccuuaaauuaaac

SEQ ID NO: 3891100 - RNA, 22 nt, Human
uauuccaccuuaaauuaaacaa

SEQ ID NO: 3891101 - RNA, 16 nt, Human
uauuccagaaugcugu

SEQ ID NO: 3891102 - RNA, 23 nt, Human
uauuccagaaugcuguacaucua

SEQ ID NO: 3891103 - RNA, 18 nt, Human
uauuccagcucauucauu

SEQ ID NO: 3891104 - RNA, 18 nt, Human
uauuccauauauuagcau

SEQ ID NO: 3891105 - RNA, 19 nt, Human
uauuccauauuagaaaacu

SEQ ID NO: 3891106 - RNA, 22 nt, Human
uauuccaugaauguaucaggaa

SEQ ID NO: 3891107 - RNA, 20 nt, Human
uauucccaagcccaugaguc

SEQ ID NO: 3891108 - RNA, 22 nt, Human
uauucccaagcccaugaguccu

SEQ ID NO: 3891109 - RNA, 13 nt, Human
uauuccuccuggg

SEQ ID NO: 3891110 - RNA, 19 nt, Human
uauuccugcauuugugaaa

SEQ ID NO: 3891111 - RNA, 14 nt, Human
uauuccuucuggcc

SEQ ID NO: 3891112 - RNA, 22 nt, Human
uauuccuugauacuaaaaguuc

SEQ ID NO: 3891113 - RNA, 19 nt, Human
uauuccuuucccuuccucu

SEQ ID NO: 3891114 - RNA, 20 nt, Human
uauuccuuuuguguacagug

SEQ ID NO: 3891115 - RNA, 22 nt, Human
uauucgauacugcgacuuucug

SEQ ID NO: 3891116 - RNA, 17 nt, Human
uauucgcuugagaaaaa

SEQ ID NO: 3891117 - RNA, 23 nt, Human
uauucuaacuuuuauuuuuauca

SEQ ID NO: 3891118 - RNA, 19 nt, Human
uauucuaagaaauaucugu

SEQ ID NO: 3891119 - RNA, 21 nt, Human
uauucuaagacuuacucuaag

SEQ ID NO: 3891120 - RNA, 22 nt, Human
uauucuaagacuuacucuaaga

SEQ ID NO: 3891121 - RNA, 20 nt, Human
uauucuauuacauuuucagu

SEQ ID NO: 3891122 - RNA, 14 nt, Human
uauucuauuuucau

SEQ ID NO: 3891123 - RNA, 17 nt, Human
uauucucaaacacaguu

SEQ ID NO: 3891124 - RNA, 22 nt, Human
uauucucaaacacaguuacacu

SEQ ID NO: 3891125 - RNA, 14 nt, Human
uauucucaaagcag

SEQ ID NO: 3891126 - RNA, 15 nt, Human
uauucucaccaggaa

SEQ ID NO: 3891127 - RNA, 13 nt, Human
uauucucacucca

SEQ ID NO: 3891128 - RNA, 14 nt, Human
uauucucacuccac

SEQ ID NO: 3891129 - RNA, 15 nt, Human
uauucucagcagagu

SEQ ID NO: 3891130 - RNA, 17 nt, Human
uauucucagcagagugc

SEQ ID NO: 3891131 - RNA, 16 nt, Human
uauucuccuccucccu

SEQ ID NO: 3891132 - RNA, 18 nt, Human
uauucucuccuguaccuc

SEQ ID NO: 3891133 - RNA, 14 nt, Human
uauucucuuuuauc

SEQ ID NO: 3891134 - RNA, 16 nt, Human
uauucugaagcaacau

SEQ ID NO: 3891135 - RNA, 17 nt, Human
uauucugggaauguaua

SEQ ID NO: 3891136 - RNA, 19 nt, Human
uauucuguagauucugugg

SEQ ID NO: 3891137 - RNA, 22 nt, Human
uauucuguagauucuguggaac

SEQ ID NO: 3891138 - RNA, 13 nt, Human
uauucugucccua

SEQ ID NO: 3891139 - RNA, 15 nt, Human
uauucugucccuagg

SEQ ID NO: 3891140 - RNA, 21 nt, Human
uauucuguguugcauuauuca

SEQ ID NO: 3891141 - RNA, 13 nt, Human
uauucuuaaaaug

SEQ ID NO: 3891142 - RNA, 15 nt, Human
uauucuuaaaaugca

SEQ ID NO: 3891143 - RNA, 15 nt, Human
uauucuuauaaaaau

SEQ ID NO: 3891144 - RNA, 17 nt, Human
uauucuuauucaaagaa

SEQ ID NO: 3891145 - RNA, 14 nt, Human
uauucuucauaaca

SEQ ID NO: 3891146 - RNA, 18 nt, Human
uauucuucuagaguucag

SEQ ID NO: 3891147 - RNA, 18 nt, Human
uauucuugaaagaagaau

SEQ ID NO: 3891148 - RNA, 23 nt, Human
uauucuugaucaguaguuugcau

SEQ ID NO: 3891149 - RNA, 16 nt, Human
uauucuugauguaaaa

SEQ ID NO: 3891150 - RNA, 14 nt, Human
uauucuugguuuuc

SEQ ID NO: 3891151 - RNA, 12 nt, Human
uauucuugugaa

SEQ ID NO: 3891152 - RNA, 22 nt, Human
uauucuugugaauauguacaua

SEQ ID NO: 3891153 - RNA, 10 nt, Human
uauucuuuga

SEQ ID NO: 3891154 - RNA, 24 nt, Human
uauucuuugauguuaacacauuuu

SEQ ID NO: 3891155 - RNA, 22 nt, Human
uauucuuugcacuuuuucuuaa

SEQ ID NO: 3891156 - RNA, 12 nt, Human
uauucuuuucca

SEQ ID NO: 3891157 - RNA, 18 nt, Human
uauucuuuucugcaaaau

SEQ ID NO: 3891158 - RNA, 13 nt, Human
uauugaaaaaaau

SEQ ID NO: 3891159 - RNA, 14 nt, Human
uauugaaaauugaa

SEQ ID NO: 3891160 - RNA, 14 nt, Human
uauugaaagaauua

SEQ ID NO: 3891161 - RNA, 13 nt, Human
uauugaaauauua

SEQ ID NO: 3891162 - RNA, 17 nt, Human
uauugaagacaauuuga

SEQ ID NO: 3891163 - RNA, 19 nt, Human
uauugaagcauuuuauaaa

SEQ ID NO: 3891164 - RNA, 16 nt, Human
uauugaaguuucagcu

SEQ ID NO: 3891165 - RNA, 17 nt, Human
uauugaauacuuacauu

SEQ ID NO: 3891166 - RNA, 14 nt, Human
uauugaauauugug

SEQ ID NO: 3891167 - RNA, 20 nt, Human
uauugaaucaguuuccaauu

SEQ ID NO: 3891168 - RNA, 16 nt, Human
uauugaaucuauuuaa

SEQ ID NO: 3891169 - RNA, 14 nt, Human
uauugaauguuaaa

SEQ ID NO: 3891170 - RNA, 19 nt, Human
uauugaauucauuucacug

SEQ ID NO: 3891171 - RNA, 15 nt, Human
uauugaauugagaug

SEQ ID NO: 3891172 - RNA, 13 nt, Human
uauugaauuuuuc

SEQ ID NO: 3891173 - RNA, 15 nt, Human
uauugaauuuuuccu

SEQ ID NO: 3891174 - RNA, 13 nt, Human
uauugacaauaau

SEQ ID NO: 3891175 - RNA, 17 nt, Human
uauugacaauaauuuca

SEQ ID NO: 3891176 - RNA, 18 nt, Human
uauugacaauaauuucag

SEQ ID NO: 3891177 - RNA, 16 nt, Human
uauugacacagaaaau

SEQ ID NO: 3891178 - RNA, 20 nt, Human
uauugacacagaaaauguug

SEQ ID NO: 3891179 - RNA, 17 nt, Human
uauugacaucagcauca

SEQ ID NO: 3891180 - RNA, 18 nt, Human
uauugacaucagcaucac

SEQ ID NO: 3891181 - RNA, 14 nt, Human
uauugacucugggu

SEQ ID NO: 3891182 - RNA, 19 nt, Human
uauugacuucaaugauagu

SEQ ID NO: 3891183 - RNA, 14 nt, Human
uauugacuuguaua

SEQ ID NO: 3891184 - RNA, 15 nt, Human
uauugagaaagagca

SEQ ID NO: 3891185 - RNA, 14 nt, Human
uauugagacaaaaa

SEQ ID NO: 3891186 - RNA, 17 nt, Human
uauugaggaaaaauaug

SEQ ID NO: 3891187 - RNA, 22 nt, Human
uauugaggaaaaauaugugaag

SEQ ID NO: 3891188 - RNA, 18 nt, Human
uauugaggccaagaauau

SEQ ID NO: 3891189 - RNA, 19 nt, Human
uauugaggccaagaauauu

SEQ ID NO: 3891190 - RNA, 23 nt, Human
uauugaggcuuuguguuguaauu

SEQ ID NO: 3891191 - RNA, 22 nt, Human
uauugaguuuguagguaaaaug

SEQ ID NO: 3891192 - RNA, 19 nt, Human
uauugauaagaucuuuuau

SEQ ID NO: 3891193 - RNA, 23 nt, Human
uauugauaagaucuuuuauuuug

SEQ ID NO: 3891194 - RNA, 14 nt, Human
uauugauaaguuca

SEQ ID NO: 3891195 - RNA, 14 nt, Human
uauugauaguacuc

SEQ ID NO: 3891196 - RNA, 12 nt, Human
uauugaugaaaa

SEQ ID NO: 3891197 - RNA, 13 nt, Human
uauugaugaaaag

SEQ ID NO: 3891198 - RNA, 22 nt, Human
uauugauguacagucugucaug

SEQ ID NO: 3891199 - RNA, 14 nt, Human
uauugaugugcaaa

SEQ ID NO: 3891200 - RNA, 14 nt, Human
uauugauugcuuuu

SEQ ID NO: 3891201 - RNA, 18 nt, Human
uauugauugggaaaacau

SEQ ID NO: 3891202 - RNA, 19 nt, Human
uauugauugggaaaacauu

SEQ ID NO: 3891203 - RNA, 23 nt, Human
uauugcacaugucuuaaugaagu

SEQ ID NO: 3891204 - RNA, 22 nt, Human
uauugcagcgauuaauaacagg

SEQ ID NO: 3891205 - RNA, 15 nt, Human
uauugcaucuguaua

SEQ ID NO: 3891206 - RNA, 21 nt, Human
uauugcaucuguauaaguaag

SEQ ID NO: 3891207 - RNA, 13 nt, Human
uauugcauuuaua

SEQ ID NO: 3891208 - RNA, 22 nt, Human
uauugccaaaacccagcugcac

SEQ ID NO: 3891209 - RNA, 16 nt, Human
uauuuacauaugaaau

SEQ ID NO: 3891210 - RNA, 17 nt, Human
uauuuacauaugaaauu

SEQ ID NO: 3891211 - RNA, 21 nt, Human
uauuuacauaugaaauuuaau

SEQ ID NO: 3891212 - RNA, 14 nt, Human
uauuuacauuuaau

SEQ ID NO: 3891213 - RNA, 18 nt, Human
uauuuaccaaaaauuuug

SEQ ID NO: 3891214 - RNA, 17 nt, Human
uauuuaccugcaggcug

SEQ ID NO: 3891215 - RNA, 15 nt, Human
uauuuacgcuuugau

SEQ ID NO: 3891216 - RNA, 19 nt, Human
uauuuacgcuuugauucau

SEQ ID NO: 3891217 - RNA, 22 nt, Human
uauuuacgcuuugauucauagu

SEQ ID NO: 3891218 - RNA, 16 nt, Human
uauuuacugagcuucu

SEQ ID NO: 3891219 - RNA, 23 nt, Human
uauuuacugagcuucucugugaa

SEQ ID NO: 3891220 - RNA, 18 nt, Human
uauuuacuucuuauacau

SEQ ID NO: 3891221 - RNA, 18 nt, Human
uauuuagauauaacacua

SEQ ID NO: 3891222 - RNA, 21 nt, Human
uauuuagaugauaaagagaca

SEQ ID NO: 3891223 - RNA, 14 nt, Human
uauuuagauucacu

SEQ ID NO: 3891224 - RNA, 19 nt, Human
uauuuagauuguuaaaaua

SEQ ID NO: 3891225 - RNA, 20 nt, Human
uauuuagcaccagggaaggg

SEQ ID NO: 3891226 - RNA, 11 nt, Human
uauuuagcaug

SEQ ID NO: 3891227 - RNA, 19 nt, Human
uauuuagcuugggaaaggu

SEQ ID NO: 3891228 - RNA, 17 nt, Human
uauuuaggcagauugaa

SEQ ID NO: 3891229 - RNA, 20 nt, Human
uauuuaguuauaguuucaga

SEQ ID NO: 3891230 - RNA, 22 nt, Human
uauuuaguuguaaaccaaguga

SEQ ID NO: 3891231 - RNA, 14 nt, Human
uauuuauaagcaga

SEQ ID NO: 3891232 - RNA, 17 nt, Human
uauuuauaauacauuuc

SEQ ID NO: 3891233 - RNA, 22 nt, Human
uauuuauaauagcaacuuuugu

SEQ ID NO: 3891234 - RNA, 16 nt, Human
uauuuauagucauuua

SEQ ID NO: 3891235 - RNA, 13 nt, Human
uauuuauauaaau

SEQ ID NO: 3891236 - RNA, 13 nt, Human
uauuuauauauuu

SEQ ID NO: 3891237 - RNA, 17 nt, Human
uauuuauauguacauga

SEQ ID NO: 3891238 - RNA, 15 nt, Human
uauuuauauguacug

SEQ ID NO: 3891239 - RNA, 17 nt, Human
uauuuauauguaugugu

SEQ ID NO: 3891240 - RNA, 17 nt, Human
uauuuauauuuauugac

SEQ ID NO: 3891241 - RNA, 18 nt, Human
uauuuauauuuauugacu

SEQ ID NO: 3891242 - RNA, 21 nt, Human
uauuuauauuuuuauuuuauu

SEQ ID NO: 3891243 - RNA, 13 nt, Human
uauuuaucaguga

SEQ ID NO: 3891244 - RNA, 21 nt, Human
uauuuaucuguaguaaacuau

SEQ ID NO: 3891245 - RNA, 13 nt, Human
uauuuaugaaagu

SEQ ID NO: 3891246 - RNA, 14 nt, Human
uauuuaugaagaaa

SEQ ID NO: 3891247 - RNA, 15 nt, Human
uauuuaugaagaaaa

SEQ ID NO: 3891248 - RNA, 19 nt, Human
uauuuaugaaguuuaaaac

SEQ ID NO: 3891249 - RNA, 13 nt, Human
uauuuaugccuug

SEQ ID NO: 3891250 - RNA, 17 nt, Human
uauuuaugggauccugg

SEQ ID NO: 3891251 - RNA, 15 nt, Human
uauuuauguacuuuu

SEQ ID NO: 3891252 - RNA, 12 nt, Human
uauuuauguauu

SEQ ID NO: 3891253 - RNA, 14 nt, Human
uauuuaugugugag

SEQ ID NO: 3891254 - RNA, 15 nt, Human
uauuuauguuaaaag

SEQ ID NO: 3891255 - RNA, 23 nt, Human
uauuuauuaaacagauuuuuaca

SEQ ID NO: 3891256 - RNA, 22 nt, Human
uauuuauuaaaugcccagcccc

SEQ ID NO: 3891257 - RNA, 15 nt, Human
uauuuauuaaauuuu

SEQ ID NO: 3891258 - RNA, 13 nt, Human
uauuuauuaagau

SEQ ID NO: 3891259 - RNA, 13 nt, Human
uauuuauuacaua

SEQ ID NO: 3891260 - RNA, 13 nt, Human
uauuuauuaccuc

SEQ ID NO: 3891261 - RNA, 13 nt, Human
uauuuauuacugu

SEQ ID NO: 3891262 - RNA, 14 nt, Human
uauuuauuauuuau

SEQ ID NO: 3891263 - RNA, 12 nt, Human
uauuuauucaau

SEQ ID NO: 3891264 - RNA, 18 nt, Human
uauuuauucaauaaagua

SEQ ID NO: 3891265 - RNA, 21 nt, Human
uauuuauucagcuucauuugu

SEQ ID NO: 3891266 - RNA, 23 nt, Human
uauuuauucauuauuugucaaau

SEQ ID NO: 3891267 - RNA, 20 nt, Human
uauuuauuccauauucaugu

SEQ ID NO: 3891268 - RNA, 17 nt, Human
uauuuauugcuacuucc

SEQ ID NO: 3891269 - RNA, 13 nt, Human
uauuuauugcuuu

SEQ ID NO: 3891270 - RNA, 15 nt, Human
uauuuauuuaaaaga

SEQ ID NO: 3891271 - RNA, 14 nt, Human
uauuuauuuaaauu

SEQ ID NO: 3891272 - RNA, 16 nt, Human
uauuuauuuaagcuua

SEQ ID NO: 3891273 - RNA, 21 nt, Human
uauuuauuuaauaacaauugu

SEQ ID NO: 3891274 - RNA, 14 nt, Human
uauuuauuuaguau

SEQ ID NO: 3891275 - RNA, 11 nt, Human
uauuuauuuau

SEQ ID NO: 3891276 - RNA, 14 nt, Human
uauuuauuuaugga

SEQ ID NO: 3891277 - RNA, 17 nt, Human
uauuuauuuuccucccc

SEQ ID NO: 3891278 - RNA, 13 nt, Human
uauuuauuuucuu

SEQ ID NO: 3891279 - RNA, 12 nt, Human
uauuuauuuugu

SEQ ID NO: 3891280 - RNA, 16 nt, Human
uauuuauuuuguaauu

SEQ ID NO: 3891281 - RNA, 22 nt, Human
uauuuauuuuuuuuaauuguau

SEQ ID NO: 3891282 - RNA, 15 nt, Human
uauuucaaaaauuug

SEQ ID NO: 3891283 - RNA, 16 nt, Human
uauuucaaaaauuugg

SEQ ID NO: 3891284 - RNA, 22 nt, Human
uauuucaaaaauuuggaauucu

SEQ ID NO: 3891285 - RNA, 20 nt, Human
uauuucaaaauauacauuca

SEQ ID NO: 3891286 - RNA, 22 nt, Human
uauuucaauuuccaagagcuga

SEQ ID NO: 3891287 - RNA, 13 nt, Human
uauuucagaaaua

SEQ ID NO: 3891288 - RNA, 14 nt, Human
uauuucagaaguuu

SEQ ID NO: 3891289 - RNA, 21 nt, Human
uauuucaggcauuggauauuu

SEQ ID NO: 3891290 - RNA, 21 nt, Human
uauuucaguacuucagcaaga

SEQ ID NO: 3891291 - RNA, 13 nt, Human
uauuucagugaau

SEQ ID NO: 3891292 - RNA, 17 nt, Human
uauuucaguguuaccug

SEQ ID NO: 3891293 - RNA, 20 nt, Human
uauuucaucacaagaacaca

SEQ ID NO: 3891294 - RNA, 20 nt, Human
uauuucaucagaacagcugu

SEQ ID NO: 3891295 - RNA, 20 nt, Human
uauuucaucauauuauacag

SEQ ID NO: 3891296 - RNA, 23 nt, Human
uauuucaucaugauaauucagca

SEQ ID NO: 3891297 - RNA, 17 nt, Human
uauuucauguggcugua

SEQ ID NO: 3891298 - RNA, 12 nt, Human
uauuucauuucu

SEQ ID NO: 3891299 - RNA, 18 nt, Human
uauuucauuuuuugcauc

SEQ ID NO: 3891300 - RNA, 18 nt, Human
uauuucccaugauuucau

SEQ ID NO: 3891301 - RNA, 21 nt, Human
uauuucccaugauuucaugua

SEQ ID NO: 3891302 - RNA, 21 nt, Human
uauuucccauuugugccagag

SEQ ID NO: 3891303 - RNA, 21 nt, Human
uauuuccccaacauguaauaa

SEQ ID NO: 3891304 - RNA, 21 nt, Human
uauuuccccaggggaaaauga

SEQ ID NO: 3891305 - RNA, 20 nt, Human
uauuucccccuuucuuccuc

SEQ ID NO: 3891306 - RNA, 15 nt, Human
uauuucccuaaaaua

SEQ ID NO: 3891307 - RNA, 17 nt, Human
uauuucccuacauuaaa

SEQ ID NO: 3891308 - RNA, 15 nt, Human
uauuucccuccccug

SEQ ID NO: 3891309 - RNA, 18 nt, Human
uauuucccucucauuuug

SEQ ID NO: 3891310 - RNA, 16 nt, Human
uauuuccuaugaugua

SEQ ID NO: 3891311 - RNA, 17 nt, Human
uauuuccuaugauguau

SEQ ID NO: 3891312 - RNA, 18 nt, Human
uauuuccuggauguuugg

SEQ ID NO: 3891313 - RNA, 11 nt, Human
uauuucuacug

SEQ ID NO: 3891314 - RNA, 17 nt, Human
uauuucuagcuuuuuaa

SEQ ID NO: 3891315 - RNA, 16 nt, Human
uauuucuaggaagaau

SEQ ID NO: 3891316 - RNA, 16 nt, Human
uauuucuauauuuuca

SEQ ID NO: 3891317 - RNA, 17 nt, Human
uauuucuauauuuucau

SEQ ID NO: 3891318 - RNA, 21 nt, Human
uauuucuaugaaauauuaugu

SEQ ID NO: 3891319 - RNA, 22 nt, Human
uauuucuaugaaauauuauguu

SEQ ID NO: 3891320 - RNA, 16 nt, Human
uauuucuaugagaaaa

SEQ ID NO: 3891321 - RNA, 11 nt, Human
uauuucuccuu

SEQ ID NO: 3891322 - RNA, 14 nt, Human
uauuucugcaaaca

SEQ ID NO: 3891323 - RNA, 15 nt, Human
uauuucugcuuucuu

SEQ ID NO: 3891324 - RNA, 17 nt, Human
uauuucugggucuuuug

SEQ ID NO: 3891325 - RNA, 22 nt, Human
uauuucugggucuuuugcuacu

SEQ ID NO: 3891326 - RNA, 15 nt, Human
uauuucuguauauaa

SEQ ID NO: 3891327 - RNA, 16 nt, Human
uauuucuuaaacacuu

SEQ ID NO: 3891328 - RNA, 23 nt, Human
uauuucuuacaggcacaaaauga

SEQ ID NO: 3891329 - RNA, 18 nt, Human
uauuucuuauacgcuuuu

SEQ ID NO: 3891330 - RNA, 16 nt, Human
uauuucuuauauaugu

SEQ ID NO: 3891331 - RNA, 19 nt, Human
uauuucuuauauaugugaa

SEQ ID NO: 3891332 - RNA, 19 nt, Human
uauuucuucguucuuuuua

SEQ ID NO: 3891333 - RNA, 13 nt, Human
uauuucuuguuug

SEQ ID NO: 3891334 - RNA, 14 nt, Human
uauuucuuguuugu

SEQ ID NO: 3891335 - RNA, 13 nt, Human
uauuucuuuguua

SEQ ID NO: 3891336 - RNA, 14 nt, Human
uauuucuuuguuau

SEQ ID NO: 3891337 - RNA, 20 nt, Human
uauuugaaaacagaaauugg

SEQ ID NO: 3891338 - RNA, 19 nt, Human
uauuugaaaacauauaaag

SEQ ID NO: 3891339 - RNA, 18 nt, Human
uauuugaaacacugguuu

SEQ ID NO: 3891340 - RNA, 15 nt, Human
uauuugaaagugccu

SEQ ID NO: 3891341 - RNA, 16 nt, Human
uauuugaacaaugaag

SEQ ID NO: 3891342 - RNA, 18 nt, Human
uauuugaacaaugaaguu

SEQ ID NO: 3891343 - RNA, 16 nt, Human
uauuugaaucuugucu

SEQ ID NO: 3891344 - RNA, 18 nt, Human
uauuugaaucuugucuca

SEQ ID NO: 3891345 - RNA, 15 nt, Human
uauuugaaugacuaa

SEQ ID NO: 3891346 - RNA, 21 nt, Human
uauuugaaugauuuuucuuua

SEQ ID NO: 3891347 - RNA, 23 nt, Human
uauuugaauuaaaacuucuuaaa

SEQ ID NO: 3891348 - RNA, 17 nt, Human
uauuugaauuauuucug

SEQ ID NO: 3891349 - RNA, 12 nt, Human
uauuugaauuuu

SEQ ID NO: 3891350 - RNA, 18 nt, Human
uauuugaauuuuaaaucu

SEQ ID NO: 3891351 - RNA, 14 nt, Human
uauuugagaauaua

SEQ ID NO: 3891352 - RNA, 19 nt, Human
uauuugagggguuucagaa

SEQ ID NO: 3891353 - RNA, 17 nt, Human
uauuugauucaaaauau

SEQ ID NO: 3891354 - RNA, 21 nt, Human
uauuugauucaaaauauuuaa

SEQ ID NO: 3891355 - RNA, 19 nt, Human
uggggugagaauugggcgg

SEQ ID NO: 3891356 - RNA, 18 nt, Human
uggggugcugggaggagg

SEQ ID NO: 3891357 - RNA, 17 nt, Human
ugggguggccugugugg

SEQ ID NO: 3891358 - RNA, 20 nt, Human
ugggguggccuguguggcca

SEQ ID NO: 3891359 - RNA, 18 nt, Human
ugggguggcugcagccuc

SEQ ID NO: 3891360 - RNA, 13 nt, Human
uggggugggagag

SEQ ID NO: 3891361 - RNA, 20 nt, Human
uggggugggccucugguuug

SEQ ID NO: 3891362 - RNA, 22 nt, Human
ugggguggggggaugguaagag

SEQ ID NO: 3891363 - RNA, 22 nt, Human
ugggguggggggggugcugggc

SEQ ID NO: 3891364 - RNA, 13 nt, Human
uggggugugcugg

SEQ ID NO: 3891365 - RNA, 21 nt, Human
ugggguguguuccaacugccc

SEQ ID NO: 3891366 - RNA, 16 nt, Human
ugggguguuugggagg

SEQ ID NO: 3891367 - RNA, 22 nt, Human
ugggguucagccccuccucugc

SEQ ID NO: 3891368 - RNA, 20 nt, Human
ugggguucguggaaagggug

SEQ ID NO: 3891369 - RNA, 16 nt, Human
ugggguugcaaccacu

SEQ ID NO: 3891370 - RNA, 21 nt, Human
ugggguuggcugggcccagaa

SEQ ID NO: 3891371 - RNA, 13 nt, Human
ugggguuuccugg

SEQ ID NO: 3891372 - RNA, 15 nt, Human
ugggguuuccuggca

SEQ ID NO: 3891373 - RNA, 17 nt, Human
ugggguuuccuggcacu

SEQ ID NO: 3891374 - RNA, 12 nt, Human
ugggguuuugua

SEQ ID NO: 3891375 - RNA, 15 nt, Human
uggguaaaauacuuu

SEQ ID NO: 3891376 - RNA, 24 nt, Human
uggguaaaauuagaugcauguuga

SEQ ID NO: 3891377 - RNA, 18 nt, Human
uggguaaaugcaaaguuc

SEQ ID NO: 3891378 - RNA, 20 nt, Human
uggguaaaugcaaaguucug

SEQ ID NO: 3891379 - RNA, 12 nt, Human
uggguaaauuca

SEQ ID NO: 3891380 - RNA, 16 nt, Human
uggguaacuagggaag

SEQ ID NO: 3891381 - RNA, 22 nt, Human
uggguaauccaggcacagcuga

SEQ ID NO: 3891382 - RNA, 18 nt, Human
uggguaaugaaacaaaga

SEQ ID NO: 3891383 - RNA, 20 nt, Human
uggguaauuuagauuguaaa

SEQ ID NO: 3891384 - RNA, 15 nt, Human
uggguacccccagga

SEQ ID NO: 3891385 - RNA, 15 nt, Human
uggguaccuauuuuc

SEQ ID NO: 3891386 - RNA, 21 nt, Human
uggguaccuauuuucauugua

SEQ ID NO: 3891387 - RNA, 23 nt, Human
uggguacuuguggacacagcucu

SEQ ID NO: 3891388 - RNA, 22 nt, Human
uggguagcugccacuugaacaa

SEQ ID NO: 3891389 - RNA, 21 nt, Human
uggguagcuucugaccucagc

SEQ ID NO: 3891390 - RNA, 17 nt, Human
uggguagggcucugaca

SEQ ID NO: 3891391 - RNA, 14 nt, Human
uggguauagauguu

SEQ ID NO: 3891392 - RNA, 17 nt, Human
uggguaucaaacagcuc

SEQ ID NO: 3891393 - RNA, 14 nt, Human
uggguaucaagaca

SEQ ID NO: 3891394 - RNA, 12 nt, Human
ugggucacagga

SEQ ID NO: 3891395 - RNA, 13 nt, Human
ugggucacaggaa

SEQ ID NO: 3891396 - RNA, 16 nt, Human
uggguccaaauaaaaa

SEQ ID NO: 3891397 - RNA, 17 nt, Human
uggguccaggccuacuc

SEQ ID NO: 3891398 - RNA, 18 nt, Human
uggguccaggccuacucc

SEQ ID NO: 3891399 - RNA, 21 nt, Human
uggguccaggggaugggaggu

SEQ ID NO: 3891400 - RNA, 19 nt, Human
uggguccaggggccccucc

SEQ ID NO: 3891401 - RNA, 17 nt, Human
ugggucccacuuccccu

SEQ ID NO: 3891402 - RNA, 22 nt, Human
ugggucccacuuccccuccuac

SEQ ID NO: 3891403 - RNA, 16 nt, Human
uggguccgauaauauc

SEQ ID NO: 3891404 - RNA, 18 nt, Human
uggguccuuuucagaagu

SEQ ID NO: 3891405 - RNA, 23 nt, Human
ugggucuaagggguugguugagg

SEQ ID NO: 3891406 - RNA, 14 nt, Human
ugggucuauuccag

SEQ ID NO: 3891407 - RNA, 20 nt, Human
ugggucucgcuuuguugccc

SEQ ID NO: 3891408 - RNA, 15 nt, Human
ugggucuggcugagc

SEQ ID NO: 3891409 - RNA, 19 nt, Human
ugggucugugucucuuuuc

SEQ ID NO: 3891410 - RNA, 13 nt, Human
ugggucugugugu

SEQ ID NO: 3891411 - RNA, 15 nt, Human
ugggucuguuuuccu

SEQ ID NO: 3891412 - RNA, 21 nt, Human
ugggucuguuuuccuuucuca

SEQ ID NO: 3891413 - RNA, 22 nt, Human
ugggucuguuuuccuuucucac

SEQ ID NO: 3891414 - RNA, 11 nt, Human
ugggucuucca

SEQ ID NO: 3891415 - RNA, 22 nt, Human
ugggucuuguuuuuuuuuucca

SEQ ID NO: 3891416 - RNA, 18 nt, Human
ugggugaaagaaaucaug

SEQ ID NO: 3891417 - RNA, 15 nt, Human
ugggugaaggcuggc

SEQ ID NO: 3891418 - RNA, 16 nt, Human
ugggugaaggcuggca

SEQ ID NO: 3891419 - RNA, 14 nt, Human
ugggugacagagca

SEQ ID NO: 3891420 - RNA, 18 nt, Human
ugggugagaugcuggaga

SEQ ID NO: 3891421 - RNA, 22 nt, Human
ugggugaggaucccugaaggcc

SEQ ID NO: 3891422 - RNA, 20 nt, Human
ugggugauuccuaagccacu

SEQ ID NO: 3891423 - RNA, 14 nt, Human
ugggugcaggagcg

SEQ ID NO: 3891424 - RNA, 20 nt, Human
ugggugcaggagcgcucccu

SEQ ID NO: 3891425 - RNA, 17 nt, Human
ugggugcccaagcucag

SEQ ID NO: 3891426 - RNA, 21 nt, Human
ugggugccuaggccugggcag

SEQ ID NO: 3891427 - RNA, 23 nt, Human
ugggugccuaggccugggcagug

SEQ ID NO: 3891428 - RNA, 14 nt, Human
ugggugcuggcugc

SEQ ID NO: 3891429 - RNA, 18 nt, Human
ugggugcuggcugcccag

SEQ ID NO: 3891430 - RNA, 19 nt, Human
ugggugcuuggaggaagga

SEQ ID NO: 3891431 - RNA, 22 nt, Human
ugggugcuuggaggaaggaaac

SEQ ID NO: 3891432 - RNA, 21 nt, Human
uggguggcccauccccccuca

SEQ ID NO: 3891433 - RNA, 23 nt, Human
uggguggcuacucugugccagag

SEQ ID NO: 3891434 - RNA, 14 nt, Human
uggguggcucacuc

SEQ ID NO: 3891435 - RNA, 20 nt, Human
uggguggcuuaaaaaaaacu

SEQ ID NO: 3891436 - RNA, 12 nt, Human
ugggugggagag

SEQ ID NO: 3891437 - RNA, 20 nt, Human
uggguggggaggaaauagaa

SEQ ID NO: 3891438 - RNA, 21 nt, Human
uggguggggggcuucauacac

SEQ ID NO: 3891439 - RNA, 20 nt, Human
uggguggggugaggaccacu

SEQ ID NO: 3891440 - RNA, 14 nt, Human
uggguggguggugg

SEQ ID NO: 3891441 - RNA, 16 nt, Human
uggguggguggugggg

SEQ ID NO: 3891442 - RNA, 22 nt, Human
ugggugguacccucuggagggg

SEQ ID NO: 3891443 - RNA, 20 nt, Human
uggguguauuuauuuuccuc

SEQ ID NO: 3891444 - RNA, 21 nt, Human
ugggugucaagagggucugag

SEQ ID NO: 3891445 - RNA, 13 nt, Human
uggguguccugcc

SEQ ID NO: 3891446 - RNA, 23 nt, Human
uggguguccugccugucugcccc

SEQ ID NO: 3891447 - RNA, 17 nt, Human
ugggugucuccuuaagc

SEQ ID NO: 3891448 - RNA, 14 nt, Human
ugggugugugacuc

SEQ ID NO: 3891449 - RNA, 15 nt, Human
uggguuagaccuaca

SEQ ID NO: 3891450 - RNA, 14 nt, Human
uggguuagacugcc

SEQ ID NO: 3891451 - RNA, 15 nt, Human
uggguuagacugcca

SEQ ID NO: 3891452 - RNA, 19 nt, Human
uggguuagacugccagcuc

SEQ ID NO: 3891453 - RNA, 18 nt, Human
uggguuagggaaaacauu

SEQ ID NO: 3891454 - RNA, 15 nt, Human
uggguuauucuggag

SEQ ID NO: 3891455 - RNA, 17 nt, Human
uggguuauucuggaguu

SEQ ID NO: 3891456 - RNA, 23 nt, Human
uggguucaagcgauucuucugcu

SEQ ID NO: 3891457 - RNA, 16 nt, Human
uggguucacugcaacc

SEQ ID NO: 3891458 - RNA, 16 nt, Human
uggguucaugaugcag

SEQ ID NO: 3891459 - RNA, 13 nt, Human
uggguucauuauu

SEQ ID NO: 3891460 - RNA, 20 nt, Human
uggguucccuuuccuuccau

SEQ ID NO: 3891461 - RNA, 21 nt, Human
uggguuccuuccucugagccu

SEQ ID NO: 3891462 - RNA, 22 nt, Human
uggguucugccugccagcugca

SEQ ID NO: 3891463 - RNA, 16 nt, Human
uggguugcagacagga

SEQ ID NO: 3891464 - RNA, 19 nt, Human
uggguugcguccugacggc

SEQ ID NO: 3891465 - RNA, 15 nt, Human
uggguuggugcacag

SEQ ID NO: 3891466 - RNA, 20 nt, Human
uggguuuggaccccagcugg

SEQ ID NO: 3891467 - RNA, 21 nt, Human
uggguuuggaccccagcuggg

SEQ ID NO: 3891468 - RNA, 21 nt, Human
uggguuuuuuuuuuuaaaaaa

SEQ ID NO: 3891469 - RNA, 15 nt, Human
ugguaaaacucacug

SEQ ID NO: 3891470 - RNA, 20 nt, Human
ugguaaaacucacugugauc

SEQ ID NO: 3891471 - RNA, 13 nt, Human
ugguaaagauauu

SEQ ID NO: 3891472 - RNA, 17 nt, Human
ugguaaagauauuauuc

SEQ ID NO: 3891473 - RNA, 17 nt, Human
ugguaaaguccuuuucu

SEQ ID NO: 3891474 - RNA, 19 nt, Human
ugguaaaugccacacaccu

SEQ ID NO: 3891475 - RNA, 19 nt, Human
ugguaaauuuccccaacag

SEQ ID NO: 3891476 - RNA, 21 nt, Human
ugguaacauccuuucuauuga

SEQ ID NO: 3891477 - RNA, 13 nt, Human
ugguaacuguuaa

SEQ ID NO: 3891478 - RNA, 12 nt, Human
ugguaagagaaa

SEQ ID NO: 3891479 - RNA, 14 nt, Human
ugguaagagaaugu

SEQ ID NO: 3891480 - RNA, 23 nt, Human
ugguaagagaauguuauagugaa

SEQ ID NO: 3891481 - RNA, 20 nt, Human
ugguaagagacagaauguau

SEQ ID NO: 3891482 - RNA, 18 nt, Human
ugguaagauuguuauuaa

SEQ ID NO: 3891483 - RNA, 18 nt, Human
ugguaagcaacauggcuu

SEQ ID NO: 3891484 - RNA, 19 nt, Human
ugguaagcaacauggcuuu

SEQ ID NO: 3891485 - RNA, 13 nt, Human
ugguaagcucugg

SEQ ID NO: 3891486 - RNA, 13 nt, Human
ugguaagcuucca

SEQ ID NO: 3891487 - RNA, 14 nt, Human
ugguaauauugacu

SEQ ID NO: 3891488 - RNA, 16 nt, Human
ugguaaucauauuaga

SEQ ID NO: 3891489 - RNA, 21 nt, Human
ugguaauccccuaaaauaaca

SEQ ID NO: 3891490 - RNA, 17 nt, Human
ugguaaucuuuaccugu

SEQ ID NO: 3891491 - RNA, 22 nt, Human
ugguaaucuuuaccuguauaca

SEQ ID NO: 3891492 - RNA, 23 nt, Human
ugguaaucuuuaccuguauacag

SEQ ID NO: 3891493 - RNA, 17 nt, Human
ugguaauucuuauucuu

SEQ ID NO: 3891494 - RNA, 23 nt, Human
ugguaauuuauaguuuauacagu

SEQ ID NO: 3891495 - RNA, 22 nt, Human
ugguaauuuguaucugaaggag

SEQ ID NO: 3891496 - RNA, 14 nt, Human
ugguacaaaaauaa

SEQ ID NO: 3891497 - RNA, 19 nt, Human
ugguacaaaaauaaauuua

SEQ ID NO: 3891498 - RNA, 16 nt, Human
uguccagugcccauuc

SEQ ID NO: 3891499 - RNA, 17 nt, Human
uguccaguucccagaag

SEQ ID NO: 3891500 - RNA, 12 nt, Human
uguccaucugcc

SEQ ID NO: 3891501 - RNA, 13 nt, Human
uguccaucugccc

SEQ ID NO: 3891502 - RNA, 14 nt, Human
uguccaucugcccg

SEQ ID NO: 3891503 - RNA, 17 nt, Human
uguccaucugcccgccu

SEQ ID NO: 3891504 - RNA, 18 nt, Human
uguccaugcgcucagggc

SEQ ID NO: 3891505 - RNA, 12 nt, Human
uguccaugugug

SEQ ID NO: 3891506 - RNA, 15 nt, Human
uguccauugacaugu

SEQ ID NO: 3891507 - RNA, 17 nt, Human
uguccauuguccaaucc

SEQ ID NO: 3891508 - RNA, 15 nt, Human
uguccauuuugugaa

SEQ ID NO: 3891509 - RNA, 18 nt, Human
uguccauuuugugaagcc

SEQ ID NO: 3891510 - RNA, 22 nt, Human
uguccauuuugugaagcccugu

SEQ ID NO: 3891511 - RNA, 16 nt, Human
uguccauuuuuacaag

SEQ ID NO: 3891512 - RNA, 23 nt, Human
ugucccaaaaagaaaggagggga

SEQ ID NO: 3891513 - RNA, 12 nt, Human
ugucccacagcu

SEQ ID NO: 3891514 - RNA, 13 nt, Human
ugucccaccagcu

SEQ ID NO: 3891515 - RNA, 18 nt, Human
ugucccacccccaccccc

SEQ ID NO: 3891516 - RNA, 12 nt, Human
ugucccaccuca

SEQ ID NO: 3891517 - RNA, 12 nt, Human
ugucccaccucu

SEQ ID NO: 3891518 - RNA, 21 nt, Human
ugucccacgugucuuccacuu

SEQ ID NO: 3891519 - RNA, 15 nt, Human
ugucccacuaucugg

SEQ ID NO: 3891520 - RNA, 16 nt, Human
ugucccacuaucuggg

SEQ ID NO: 3891521 - RNA, 20 nt, Human
ugucccagaggcugccccac

SEQ ID NO: 3891522 - RNA, 19 nt, Human
ugucccauagucccugcca

SEQ ID NO: 3891523 - RNA, 21 nt, Human
ugucccaucggagugcggacc

SEQ ID NO: 3891524 - RNA, 19 nt, Human
ugucccaugacccaccccu

SEQ ID NO: 3891525 - RNA, 17 nt, Human
ugucccaugaucccugu

SEQ ID NO: 3891526 - RNA, 18 nt, Human
ugucccaugaucccugug

SEQ ID NO: 3891527 - RNA, 22 nt, Human
ugucccauggacacuccagugc

SEQ ID NO: 3891528 - RNA, 19 nt, Human
ugucccaugugagcugcug

SEQ ID NO: 3891529 - RNA, 14 nt, Human
ugucccauucccug

SEQ ID NO: 3891530 - RNA, 14 nt, Human
uguccccaaauccg

SEQ ID NO: 3891531 - RNA, 13 nt, Human
uguccccaacagc

SEQ ID NO: 3891532 - RNA, 14 nt, Human
uguccccaacagcg

SEQ ID NO: 3891533 - RNA, 12 nt, Human
uguccccacacu

SEQ ID NO: 3891534 - RNA, 16 nt, Human
uguccccaccaucugc

SEQ ID NO: 3891535 - RNA, 18 nt, Human
uguccccacccuccacuc

SEQ ID NO: 3891536 - RNA, 14 nt, Human
uguccccagcccac

SEQ ID NO: 3891537 - RNA, 9 nt, Human
uguccccca

SEQ ID NO: 3891538 - RNA, 16 nt, Human
ugucccccagcucugg

SEQ ID NO: 3891539 - RNA, 15 nt, Human
uguccccccacuccc

SEQ ID NO: 3891540 - RNA, 19 nt, Human
uguccccccacucccucac

SEQ ID NO: 3891541 - RNA, 20 nt, Human
ugucccccuaauauuaggga

SEQ ID NO: 3891542 - RNA, 22 nt, Human
ugucccccuuuagaucucugaa

SEQ ID NO: 3891543 - RNA, 16 nt, Human
uguccccgacccuugc

SEQ ID NO: 3891544 - RNA, 17 nt, Human
uguccccgcacugggcu

SEQ ID NO: 3891545 - RNA, 16 nt, Human
uguccccgcagcccug

SEQ ID NO: 3891546 - RNA, 18 nt, Human
uguccccgcugcugugca

SEQ ID NO: 3891547 - RNA, 18 nt, Human
uguccccggggcccaggg

SEQ ID NO: 3891548 - RNA, 23 nt, Human
uguccccuauggggaugguccac

SEQ ID NO: 3891549 - RNA, 14 nt, Human
uguccccucagcuc

SEQ ID NO: 3891550 - RNA, 18 nt, Human
uguccccuccacugucac

SEQ ID NO: 3891551 - RNA, 16 nt, Human
uguccccucccagagc

SEQ ID NO: 3891552 - RNA, 11 nt, Human
uguccccucuu

SEQ ID NO: 3891553 - RNA, 14 nt, Human
uguccccucuugcc

SEQ ID NO: 3891554 - RNA, 21 nt, Human
uguccccucuugccccaaccc

SEQ ID NO: 3891555 - RNA, 15 nt, Human
uguccccugacaggg

SEQ ID NO: 3891556 - RNA, 16 nt, Human
uguccccuucucucau

SEQ ID NO: 3891557 - RNA, 21 nt, Human
uguccccuuggcagguccugg

SEQ ID NO: 3891558 - RNA, 21 nt, Human
ugucccgggguccuguggcag

SEQ ID NO: 3891559 - RNA, 22 nt, Human
ugucccuaauuuaacccagcuc

SEQ ID NO: 3891560 - RNA, 22 nt, Human
ugucccuaccgagucucuucuc

SEQ ID NO: 3891561 - RNA, 14 nt, Human
ugucccucccaccu

SEQ ID NO: 3891562 - RNA, 15 nt, Human
ugucccucccaccuc

SEQ ID NO: 3891563 - RNA, 16 nt, Human
ugucccucccaccucu

SEQ ID NO: 3891564 - RNA, 22 nt, Human
ugucccugcacuugcagacucu

SEQ ID NO: 3891565 - RNA, 23 nt, Human
ugucccugcacuugcagacucua

SEQ ID NO: 3891566 - RNA, 16 nt, Human
ugucccuggcuuccuu

SEQ ID NO: 3891567 - RNA, 20 nt, Human
ugucccugggccagggucug

SEQ ID NO: 3891568 - RNA, 16 nt, Human
ugucccugucaccaag

SEQ ID NO: 3891569 - RNA, 21 nt, Human
ugucccugucaccaagcucac

SEQ ID NO: 3891570 - RNA, 13 nt, Human
ugucccuguuaga

SEQ ID NO: 3891571 - RNA, 16 nt, Human
ugucccuuaaacaaaa

SEQ ID NO: 3891572 - RNA, 18 nt, Human
ugucccuucugucccuca

SEQ ID NO: 3891573 - RNA, 12 nt, Human
ugucccuugcug

SEQ ID NO: 3891574 - RNA, 23 nt, Human
ugucccuugcuugccugcagggc

SEQ ID NO: 3891575 - RNA, 17 nt, Human
ugucccuuucuuggcca

SEQ ID NO: 3891576 - RNA, 12 nt, Human
ugucccuuuucc

SEQ ID NO: 3891577 - RNA, 14 nt, Human
uguccgagcuuuga

SEQ ID NO: 3891578 - RNA, 15 nt, Human
uguccgcuggguggu

SEQ ID NO: 3891579 - RNA, 16 nt, Human
uguccguaguaucaga

SEQ ID NO: 3891580 - RNA, 19 nt, Human
uguccuaaggaaccuuccu

SEQ ID NO: 3891581 - RNA, 14 nt, Human
uguccuaauucuuc

SEQ ID NO: 3891582 - RNA, 19 nt, Human
uguccuaauucuucugucc

SEQ ID NO: 3891583 - RNA, 14 nt, Human
uguccuacacuuga

SEQ ID NO: 3891584 - RNA, 13 nt, Human
uguccuacagaaa

SEQ ID NO: 3891585 - RNA, 15 nt, Human
uguccuacagaaaaa

SEQ ID NO: 3891586 - RNA, 18 nt, Human
uguccuacagaaaaaccu

SEQ ID NO: 3891587 - RNA, 17 nt, Human
uguccuacucuguguca

SEQ ID NO: 3891588 - RNA, 14 nt, Human
uguccuagcacaga

SEQ ID NO: 3891589 - RNA, 18 nt, Human
uguccuagcacagauggc

SEQ ID NO: 3891590 - RNA, 21 nt, Human
uguccuagcacagauggccag

SEQ ID NO: 3891591 - RNA, 20 nt, Human
uguccuaucuaucuuccaaa

SEQ ID NO: 3891592 - RNA, 20 nt, Human
uguccuaucuccagcggccc

SEQ ID NO: 3891593 - RNA, 14 nt, Human
uguccuaugcaaua

SEQ ID NO: 3891594 - RNA, 15 nt, Human
uguccuaugcaauaa

SEQ ID NO: 3891595 - RNA, 22 nt, Human
uguccuaugggagucaagugug

SEQ ID NO: 3891596 - RNA, 15 nt, Human
uguccuauuauauuc

SEQ ID NO: 3891597 - RNA, 16 nt, Human
uguccucacugcccca

SEQ ID NO: 3891598 - RNA, 19 nt, Human
uguccucacugcucccuga

SEQ ID NO: 3891599 - RNA, 14 nt, Human
uguccucagcagcu

SEQ ID NO: 3891600 - RNA, 21 nt, Human
uguccucagccccgcguggaa

SEQ ID NO: 3891601 - RNA, 12 nt, Human
uguccucagccu

SEQ ID NO: 3891602 - RNA, 14 nt, Human
uguccucagcuucu

SEQ ID NO: 3891603 - RNA, 20 nt, Human
uguccucaguccauuuauau

SEQ ID NO: 3891604 - RNA, 17 nt, Human
uguccuccagaagccuc

SEQ ID NO: 3891605 - RNA, 23 nt, Human
uguccuccagaagccucuggcua

SEQ ID NO: 3891606 - RNA, 18 nt, Human
uguccucccauccccugg

SEQ ID NO: 3891607 - RNA, 22 nt, Human
uguccucccauccccuggacug

SEQ ID NO: 3891608 - RNA, 17 nt, Human
uguccuccccucaagga

SEQ ID NO: 3891609 - RNA, 13 nt, Human
uguccucccucca

SEQ ID NO: 3891610 - RNA, 10 nt, Human
uguccuccuc

SEQ ID NO: 3891611 - RNA, 16 nt, Human
uguccucuuucagaaa

SEQ ID NO: 3891612 - RNA, 23 nt, Human
uguccucuuucagaaaacagaaa

SEQ ID NO: 3891613 - RNA, 14 nt, Human
uguccucuuucagc

SEQ ID NO: 3891614 - RNA, 19 nt, Human
uguccucuuucagcuccug

SEQ ID NO: 3891615 - RNA, 21 nt, Human
uguccucuuucagcuccugac

SEQ ID NO: 3891616 - RNA, 14 nt, Human
uguccugaccaccc

SEQ ID NO: 3891617 - RNA, 16 nt, Human
uguccugagcucagcg

SEQ ID NO: 3891618 - RNA, 15 nt, Human
uguccugaugcuuuu

SEQ ID NO: 3891619 - RNA, 18 nt, Human
uguccugaugcuuuuguc

SEQ ID NO: 3891620 - RNA, 20 nt, Human
uguccugauggucagcuccc

SEQ ID NO: 3891621 - RNA, 18 nt, Human
uguccugcagcaaacacu

SEQ ID NO: 3891622 - RNA, 24 nt, Human
uguccugccacccagccccagcca

SEQ ID NO: 3891623 - RNA, 19 nt, Human
uguccugccugucugaagc

SEQ ID NO: 3891624 - RNA, 16 nt, Human
uguccugccugucugc

SEQ ID NO: 3891625 - RNA, 17 nt, Human
uguccugccugucugcc

SEQ ID NO: 3891626 - RNA, 19 nt, Human
uguccugccugucugcccc

SEQ ID NO: 3891627 - RNA, 16 nt, Human
uguccugccuguggcc

SEQ ID NO: 3891628 - RNA, 14 nt, Human
uguccugcuccaca

SEQ ID NO: 3891629 - RNA, 18 nt, Human
uguccugcuccacagugu

SEQ ID NO: 3891630 - RNA, 12 nt, Human
uguccugcuggu

SEQ ID NO: 3891631 - RNA, 14 nt, Human
uguccugggccugc

SEQ ID NO: 3891632 - RNA, 15 nt, Human
uguccugggccugca

SEQ ID NO: 3891633 - RNA, 16 nt, Human
uguccugggcgcccug

SEQ ID NO: 3891634 - RNA, 18 nt, Human
uguccugggcgcccugga

SEQ ID NO: 3891635 - RNA, 13 nt, Human
uguccugggcugg

SEQ ID NO: 3891636 - RNA, 13 nt, Human
uguccugguguca

SEQ ID NO: 3891637 - RNA, 23 nt, Human
uguccuguaaacacucagcuguu

SEQ ID NO: 3891638 - RNA, 20 nt, Human
uguccuguagagguuuuguu

SEQ ID NO: 3891639 - RNA, 15 nt, Human
uguccugugagaugu

SEQ ID NO: 3891640 - RNA, 23 nt, Human
uguccugugagauguguaucagu

SEQ ID NO: 3891641 - RNA, 19 nt, Human
uguccugugucaguuuaug

SEQ ID NO: 3891642 - RNA, 19 nt, Human
uguccuguugauuaauuuc

SEQ ID NO: 3891643 - RNA, 11 nt, Human
uguccuuagca

SEQ ID NO: 3891644 - RNA, 22 nt, Human
ugugaaggauuauggaaaaaua

SEQ ID NO: 3891645 - RNA, 15 nt, Human
ugugaaggcagagaa

SEQ ID NO: 3891646 - RNA, 23 nt, Human
ugugaaggugauuuaagggccca

SEQ ID NO: 3891647 - RNA, 13 nt, Human
ugugaaguuagaa

SEQ ID NO: 3891648 - RNA, 21 nt, Human
ugugaauaaagagggugggug

SEQ ID NO: 3891649 - RNA, 21 nt, Human
ugugaauaccugcucacguca

SEQ ID NO: 3891650 - RNA, 21 nt, Human
ugugaauacugcuugaauaaa

SEQ ID NO: 3891651 - RNA, 21 nt, Human
ugugaauauuuccauauggau

SEQ ID NO: 3891652 - RNA, 23 nt, Human
ugugaauauuuccauauggauuu

SEQ ID NO: 3891653 - RNA, 14 nt, Human
ugugaaugaacacu

SEQ ID NO: 3891654 - RNA, 14 nt, Human
ugugaaugcagguu

SEQ ID NO: 3891655 - RNA, 17 nt, Human
ugugaaugccacugccu

SEQ ID NO: 3891656 - RNA, 15 nt, Human
ugugaauggauugga

SEQ ID NO: 3891657 - RNA, 22 nt, Human
ugugaauggauuggauuauuua

SEQ ID NO: 3891658 - RNA, 15 nt, Human
ugugaaugugggcac

SEQ ID NO: 3891659 - RNA, 16 nt, Human
ugugaauuacuaacuu

SEQ ID NO: 3891660 - RNA, 19 nt, Human
ugugaauuaggcuguaacu

SEQ ID NO: 3891661 - RNA, 23 nt, Human
ugugaauuaggcuguaacuacuu

SEQ ID NO: 3891662 - RNA, 15 nt, Human
ugugaauuauugaca

SEQ ID NO: 3891663 - RNA, 15 nt, Human
ugugaauugacuacc

SEQ ID NO: 3891664 - RNA, 22 nt, Human
ugugaauuuucuaaaagcuuuc

SEQ ID NO: 3891665 - RNA, 14 nt, Human
ugugaauuuuuaag

SEQ ID NO: 3891666 - RNA, 15 nt, Human
ugugaauuuuuauug

SEQ ID NO: 3891667 - RNA, 17 nt, Human
ugugaauuuuuauuguu

SEQ ID NO: 3891668 - RNA, 12 nt, Human
ugugacaaaaaa

SEQ ID NO: 3891669 - RNA, 16 nt, Human
ugugacaaaaaauuaa

SEQ ID NO: 3891670 - RNA, 19 nt, Human
ugugacaacugucuaacuu

SEQ ID NO: 3891671 - RNA, 22 nt, Human
ugugacaauaauauuguuguau

SEQ ID NO: 3891672 - RNA, 15 nt, Human
ugugacaauucuguu

SEQ ID NO: 3891673 - RNA, 19 nt, Human
ugugacacacuacaccaca

SEQ ID NO: 3891674 - RNA, 21 nt, Human
ugugacacacuacaccacaca

SEQ ID NO: 3891675 - RNA, 23 nt, Human
ugugacacacuacaccacacaca

SEQ ID NO: 3891676 - RNA, 22 nt, Human
ugugacacauaugcaccuugug

SEQ ID NO: 3891677 - RNA, 23 nt, Human
ugugacagcucuuuuugugaagu

SEQ ID NO: 3891678 - RNA, 13 nt, Human
ugugacaguguug

SEQ ID NO: 3891679 - RNA, 23 nt, Human
ugugacaucucuauuccccaccc

SEQ ID NO: 3891680 - RNA, 17 nt, Human
ugugacaugcgggcugg

SEQ ID NO: 3891681 - RNA, 14 nt, Human
ugugacauuccuuc

SEQ ID NO: 3891682 - RNA, 19 nt, Human
ugugacauuugucauuuuc

SEQ ID NO: 3891683 - RNA, 20 nt, Human
ugugacauuugucauuuuca

SEQ ID NO: 3891684 - RNA, 18 nt, Human
ugugacauuuuacauuaa

SEQ ID NO: 3891685 - RNA, 17 nt, Human
ugugaccaaaaguuaca

SEQ ID NO: 3891686 - RNA, 15 nt, Human
ugugaccaacugugu

SEQ ID NO: 3891687 - RNA, 16 nt, Human
ugugaccaacuguguu

SEQ ID NO: 3891688 - RNA, 15 nt, Human
ugugaccaaguauaa

SEQ ID NO: 3891689 - RNA, 19 nt, Human
ugugaccaaguauaaacuu

SEQ ID NO: 3891690 - RNA, 13 nt, Human
ugugaccaaguua

SEQ ID NO: 3891691 - RNA, 15 nt, Human
ugugaccaaugucuu

SEQ ID NO: 3891692 - RNA, 16 nt, Human
ugugaccaaugucuug

SEQ ID NO: 3891693 - RNA, 17 nt, Human
ugugaccagcacugucu

SEQ ID NO: 3891694 - RNA, 19 nt, Human
ugugaccagucugacccuu

SEQ ID NO: 3891695 - RNA, 14 nt, Human
ugugacccacuucu

SEQ ID NO: 3891696 - RNA, 12 nt, Human
ugugaccccucc

SEQ ID NO: 3891697 - RNA, 18 nt, Human
ugugaccccuccuggggc

SEQ ID NO: 3891698 - RNA, 17 nt, Human
ugugacccucaauucau

SEQ ID NO: 3891699 - RNA, 14 nt, Human
ugugacccucugaa

SEQ ID NO: 3891700 - RNA, 12 nt, Human
ugugaccuagca

SEQ ID NO: 3891701 - RNA, 13 nt, Human
ugugaccucacgu

SEQ ID NO: 3891702 - RNA, 14 nt, Human
ugugaccucaggca

SEQ ID NO: 3891703 - RNA, 21 nt, Human
ugugaccucaggcacuagccu

SEQ ID NO: 3891704 - RNA, 14 nt, Human
ugugaccugaaguu

SEQ ID NO: 3891705 - RNA, 16 nt, Human
ugugaccugaaguuca

SEQ ID NO: 3891706 - RNA, 13 nt, Human
ugugaccugaggg

SEQ ID NO: 3891707 - RNA, 15 nt, Human
ugugaccugcugagc

SEQ ID NO: 3891708 - RNA, 18 nt, Human
ugugaccugcugagcucu

SEQ ID NO: 3891709 - RNA, 18 nt, Human
ugugaccuuaguguuucu

SEQ ID NO: 3891710 - RNA, 19 nt, Human
ugugaccuuaguguuucug

SEQ ID NO: 3891711 - RNA, 19 nt, Human
ugugaccuugagaagauuc

SEQ ID NO: 3891712 - RNA, 15 nt, Human
ugugacuaauuguau

SEQ ID NO: 3891713 - RNA, 17 nt, Human
ugugacuaauuguauaa

SEQ ID NO: 3891714 - RNA, 14 nt, Human
ugugacuagugcug

SEQ ID NO: 3891715 - RNA, 16 nt, Human
ugugacuagugcugaa

SEQ ID NO: 3891716 - RNA, 22 nt, Human
ugugacuauauagagauguuuu

SEQ ID NO: 3891717 - RNA, 15 nt, Human
ugugacucuggcuug

SEQ ID NO: 3891718 - RNA, 20 nt, Human
ugugacucuggcuuggccua

SEQ ID NO: 3891719 - RNA, 15 nt, Human
ugugacucuuuccaa

SEQ ID NO: 3891720 - RNA, 23 nt, Human
ugugacucuuuuuagggccaggc

SEQ ID NO: 3891721 - RNA, 18 nt, Human
ugugacuggcuaaagcuc

SEQ ID NO: 3891722 - RNA, 13 nt, Human
ugugacuggucag

SEQ ID NO: 3891723 - RNA, 18 nt, Human
ugugacuucagcucuguu

SEQ ID NO: 3891724 - RNA, 18 nt, Human
ugugacuuccuuggaaau

SEQ ID NO: 3891725 - RNA, 23 nt, Human
ugugacuuuugcuuuaauuccau

SEQ ID NO: 3891726 - RNA, 18 nt, Human
ugugagaaacaucucaau

SEQ ID NO: 3891727 - RNA, 21 nt, Human
ugugagaagugaaugcuggga

SEQ ID NO: 3891728 - RNA, 23 nt, Human
ugugagaagugaaugcugggacu

SEQ ID NO: 3891729 - RNA, 24 nt, Human
ugugagaagugaaugcugggacuc

SEQ ID NO: 3891730 - RNA, 19 nt, Human
ugugagacucgagaacuuu

SEQ ID NO: 3891731 - RNA, 13 nt, Human
ugugagagaaagu

SEQ ID NO: 3891732 - RNA, 16 nt, Human
ugugagagguuugacu

SEQ ID NO: 3891733 - RNA, 14 nt, Human
ugugagauguaauu

SEQ ID NO: 3891734 - RNA, 19 nt, Human
ugugagcaagcauuuaugu

SEQ ID NO: 3891735 - RNA, 17 nt, Human
ugugagccaccacgccc

SEQ ID NO: 3891736 - RNA, 14 nt, Human
ugugagccagucua

SEQ ID NO: 3891737 - RNA, 15 nt, Human
ugugagcccagcugg

SEQ ID NO: 3891738 - RNA, 14 nt, Human
ugugagccccuggu

SEQ ID NO: 3891739 - RNA, 14 nt, Human
ugugagccuuggcu

SEQ ID NO: 3891740 - RNA, 23 nt, Human
ugugagcucccaggugcagccag

SEQ ID NO: 3891741 - RNA, 20 nt, Human
ugugagcugcaccagguaga

SEQ ID NO: 3891742 - RNA, 16 nt, Human
ugugagcugcugccau

SEQ ID NO: 3891743 - RNA, 22 nt, Human
ugugaggaaagucauuggcuuu

SEQ ID NO: 3891744 - RNA, 11 nt, Human
ugugaggaagc

SEQ ID NO: 3891745 - RNA, 12 nt, Human
ugugaggaagcc

SEQ ID NO: 3891746 - RNA, 13 nt, Human
ugugaggaagccg

SEQ ID NO: 3891747 - RNA, 18 nt, Human
ugugaggaagccgcuggg

SEQ ID NO: 3891748 - RNA, 18 nt, Human
ugugaggagcugcuggcu

SEQ ID NO: 3891749 - RNA, 12 nt, Human
ugugaggcagga

SEQ ID NO: 3891750 - RNA, 14 nt, Human
ugugaggcaggaga

SEQ ID NO: 3891751 - RNA, 23 nt, Human
ugugaggcccaugguugagaaau

SEQ ID NO: 3891752 - RNA, 14 nt, Human
ugugaggccccugg

SEQ ID NO: 3891753 - RNA, 14 nt, Human
ugugagggaaagag

SEQ ID NO: 3891754 - RNA, 18 nt, Human
ugugaggggcucucucau

SEQ ID NO: 3891755 - RNA, 15 nt, Human
ugugagggugcugac

SEQ ID NO: 3891756 - RNA, 21 nt, Human
ugugaggugcagagugcccag

SEQ ID NO: 3891757 - RNA, 20 nt, Human
ugugagguuucccaauggug

SEQ ID NO: 3891758 - RNA, 12 nt, Human
ugugaguaaaua

SEQ ID NO: 3891759 - RNA, 14 nt, Human
ugugaguaaauauu

SEQ ID NO: 3891760 - RNA, 15 nt, Human
ugugaguaaauauug

SEQ ID NO: 3891761 - RNA, 22 nt, Human
ugugaguaaaucagauguugaa

SEQ ID NO: 3891762 - RNA, 15 nt, Human
ugugaguaagagcug

SEQ ID NO: 3891763 - RNA, 16 nt, Human
ugugaguaaucugaga

SEQ ID NO: 3891764 - RNA, 19 nt, Human
ugugaguaaucugagaaac

SEQ ID NO: 3891765 - RNA, 18 nt, Human
ugugaguacuacaguccu

SEQ ID NO: 3891766 - RNA, 23 nt, Human
ugugaguacuacaguccucccau

SEQ ID NO: 3891767 - RNA, 21 nt, Human
ugugagucaauacauagugcu

SEQ ID NO: 3891768 - RNA, 21 nt, Human
ugugagucuuugguucuaagg

SEQ ID NO: 3891769 - RNA, 19 nt, Human
ugugagugccuuuugcaga

SEQ ID NO: 3891770 - RNA, 20 nt, Human
ugugagugugaauauaaaug

SEQ ID NO: 3891771 - RNA, 12 nt, Human
ugugagugugac

SEQ ID NO: 3891772 - RNA, 19 nt, Human
ugugaguguguguuugugc

SEQ ID NO: 3891773 - RNA, 17 nt, Human
ugugaguguuuggggga

SEQ ID NO: 3891774 - RNA, 17 nt, Human
ugugaguguuuuuaucu

SEQ ID NO: 3891775 - RNA, 16 nt, Human
ugugaguucucccugu

SEQ ID NO: 3891776 - RNA, 21 nt, Human
ugugaguuuaguaaggcugug

SEQ ID NO: 3891777 - RNA, 18 nt, Human
ugugauaaggaucagaac

SEQ ID NO: 3891778 - RNA, 22 nt, Human
ugugauacccauagcuuccaug

SEQ ID NO: 3891779 - RNA, 13 nt, Human
ugugauauaagug

SEQ ID NO: 3891780 - RNA, 16 nt, Human
ugugauauauaagugu

SEQ ID NO: 3891781 - RNA, 17 nt, Human
ugugauauauguauuaa

SEQ ID NO: 3891782 - RNA, 14 nt, Human
ugugauauucuaag

SEQ ID NO: 3891783 - RNA, 13 nt, Human
ugugauauuucag

SEQ ID NO: 3891784 - RNA, 20 nt, Human
ugugauauuucagaaauaca

SEQ ID NO: 3891785 - RNA, 17 nt, Human
ugugaucacgccuggcu

SEQ ID NO: 3891786 - RNA, 18 nt, Human
ugugaucacgccuggcua

SEQ ID NO: 3891787 - RNA, 21 nt, Human
ugugauccuuuuauguuauuu

SEQ ID NO: 3891788 - RNA, 18 nt, Human
ugugaucugggucucuaa

SEQ ID NO: 3891789 - RNA, 15 nt, Human
uuaauuuuggaauuu

SEQ ID NO: 3891790 - RNA, 13 nt, Human
uuaauuuuguauu

SEQ ID NO: 3891791 - RNA, 15 nt, Human
uuaauuuuguauuuu

SEQ ID NO: 3891792 - RNA, 23 nt, Human
uuaauuuugucugccccaaguuu

SEQ ID NO: 3891793 - RNA, 19 nt, Human
uuaauuuuuacauggagaa

SEQ ID NO: 3891794 - RNA, 13 nt, Human
uuaauuuuuccua

SEQ ID NO: 3891795 - RNA, 15 nt, Human
uuaauuuuugauacu

SEQ ID NO: 3891796 - RNA, 17 nt, Human
uuaauuuuuuuaaccaa

SEQ ID NO: 3891797 - RNA, 23 nt, Human
uuaauuuuuuuaaccaaagguga

SEQ ID NO: 3891798 - RNA, 19 nt, Human
uuaauuuuuuugagacaga

SEQ ID NO: 3891799 - RNA, 14 nt, Human
uuacaaaaacacuu

SEQ ID NO: 3891800 - RNA, 18 nt, Human
uuacaaaaauauaaaaua

SEQ ID NO: 3891801 - RNA, 17 nt, Human
uuacaaaacuacaugag

SEQ ID NO: 3891802 - RNA, 13 nt, Human
uuacaaaagaugu

SEQ ID NO: 3891803 - RNA, 13 nt, Human
uuacaaacugaag

SEQ ID NO: 3891804 - RNA, 13 nt, Human
uuacaaacugcaa

SEQ ID NO: 3891805 - RNA, 21 nt, Human
uuacaaacugcaauagagacu

SEQ ID NO: 3891806 - RNA, 18 nt, Human
uuacaaagcccuuuuaua

SEQ ID NO: 3891807 - RNA, 16 nt, Human
uuacaaaguguguauu

SEQ ID NO: 3891808 - RNA, 22 nt, Human
uuacaaaguguguauuaaaaaa

SEQ ID NO: 3891809 - RNA, 21 nt, Human
uuacaaaguuaaaauuguuau

SEQ ID NO: 3891810 - RNA, 21 nt, Human
uuacaaaugaaaaauuccacu

SEQ ID NO: 3891811 - RNA, 14 nt, Human
uuacaaaugauugc

SEQ ID NO: 3891812 - RNA, 19 nt, Human
uuacaaaugauugcuuuua

SEQ ID NO: 3891813 - RNA, 23 nt, Human
uuacaaaugauugcuuuuaaaau

SEQ ID NO: 3891814 - RNA, 11 nt, Human
uuacaaauguu

SEQ ID NO: 3891815 - RNA, 23 nt, Human
uuacaaauuauaauguauucaua

SEQ ID NO: 3891816 - RNA, 24 nt, Human
uuacaaauuauaauguauucauau

SEQ ID NO: 3891817 - RNA, 16 nt, Human
uuacaacagauuugug

SEQ ID NO: 3891818 - RNA, 19 nt, Human
uuacaacagauuugugaac

SEQ ID NO: 3891819 - RNA, 16 nt, Human
uuacaacggagucaaa

SEQ ID NO: 3891820 - RNA, 20 nt, Human
uuacaagaaguuuauucuca

SEQ ID NO: 3891821 - RNA, 17 nt, Human
uuacaagcccccccuuc

SEQ ID NO: 3891822 - RNA, 19 nt, Human
uuacaagcccccccuucca

SEQ ID NO: 3891823 - RNA, 20 nt, Human
uuacaagcccccccuuccac

SEQ ID NO: 3891824 - RNA, 18 nt, Human
uuacaagggaagauuuau

SEQ ID NO: 3891825 - RNA, 20 nt, Human
uuacaaguaacaaaaauaaa

SEQ ID NO: 3891826 - RNA, 16 nt, Human
uuacaaguguauauca

SEQ ID NO: 3891827 - RNA, 15 nt, Human
uuacaaguuauagua

SEQ ID NO: 3891828 - RNA, 19 nt, Human
uuacaaguuauaguacuag

SEQ ID NO: 3891829 - RNA, 23 nt, Human
uuacaauaaaaucuugaaaaugc

SEQ ID NO: 3891830 - RNA, 20 nt, Human
uuacaauaggugcuuauucu

SEQ ID NO: 3891831 - RNA, 23 nt, Human
uuacaaucccaccuuuccucaaa

SEQ ID NO: 3891832 - RNA, 14 nt, Human
uuacaauggaaaca

SEQ ID NO: 3891833 - RNA, 15 nt, Human
uuacaauguaacuuu

SEQ ID NO: 3891834 - RNA, 13 nt, Human
uuacaauguaauu

SEQ ID NO: 3891835 - RNA, 17 nt, Human
uuacaauguaauuauuu

SEQ ID NO: 3891836 - RNA, 19 nt, Human
uuacaauguaauuauuuau

SEQ ID NO: 3891837 - RNA, 21 nt, Human
uuacaauguaauuauuuaugu

SEQ ID NO: 3891838 - RNA, 14 nt, Human
uuacaauguauuaa

SEQ ID NO: 3891839 - RNA, 16 nt, Human
uuacaauguucauccc

SEQ ID NO: 3891840 - RNA, 19 nt, Human
uuacaauucccugcugucg

SEQ ID NO: 3891841 - RNA, 13 nt, Human
uuacaauugaaau

SEQ ID NO: 3891842 - RNA, 15 nt, Human
uuacaauugaaauga

SEQ ID NO: 3891843 - RNA, 17 nt, Human
uuacaauugaaaugacu

SEQ ID NO: 3891844 - RNA, 18 nt, Human
uuacaauuuacaaagugu

SEQ ID NO: 3891845 - RNA, 19 nt, Human
uuacaauuuguucauccua

SEQ ID NO: 3891846 - RNA, 13 nt, Human
uuacaauuuuauc

SEQ ID NO: 3891847 - RNA, 21 nt, Human
uuacaauuuuuuuaauuuugu

SEQ ID NO: 3891848 - RNA, 18 nt, Human
uuacacaaaacaaaugcc

SEQ ID NO: 3891849 - RNA, 21 nt, Human
uuacacaaaacaaaugccaca

SEQ ID NO: 3891850 - RNA, 16 nt, Human
uuacacaauucuuacc

SEQ ID NO: 3891851 - RNA, 16 nt, Human
uuacacacacagaugu

SEQ ID NO: 3891852 - RNA, 16 nt, Human
uuacacagaaacacug

SEQ ID NO: 3891853 - RNA, 18 nt, Human
uuacacagaaacacugcc

SEQ ID NO: 3891854 - RNA, 20 nt, Human
uuacacagaaacacugccuu

SEQ ID NO: 3891855 - RNA, 20 nt, Human
uuacacagaaaugcugcugg

SEQ ID NO: 3891856 - RNA, 17 nt, Human
uuacacauuaagcaaau

SEQ ID NO: 3891857 - RNA, 17 nt, Human
uuacacauuuuucagau

SEQ ID NO: 3891858 - RNA, 22 nt, Human
uuacaccucguuagggaagaga

SEQ ID NO: 3891859 - RNA, 17 nt, Human
uuacacugccuguauac

SEQ ID NO: 3891860 - RNA, 19 nt, Human
uuacacugccuguauacuu

SEQ ID NO: 3891861 - RNA, 22 nt, Human
uuacacuggcaaugguaguuuc

SEQ ID NO: 3891862 - RNA, 13 nt, Human
uuacacugggaga

SEQ ID NO: 3891863 - RNA, 21 nt, Human
uuacacuguaccauauagcaa

SEQ ID NO: 3891864 - RNA, 13 nt, Human
uuacacuguuaga

SEQ ID NO: 3891865 - RNA, 22 nt, Human
uuacacuguuauuuucagcaug

SEQ ID NO: 3891866 - RNA, 13 nt, Human
uuacacuuuaugc

SEQ ID NO: 3891867 - RNA, 18 nt, Human
uuacagaaaaagacuuua

SEQ ID NO: 3891868 - RNA, 14 nt, Human
uuacagaaaguggu

SEQ ID NO: 3891869 - RNA, 21 nt, Human
uuacagaaaguggugcucagu

SEQ ID NO: 3891870 - RNA, 16 nt, Human
uuacagaaauacuaua

SEQ ID NO: 3891871 - RNA, 15 nt, Human
uuacagaaauggacu

SEQ ID NO: 3891872 - RNA, 19 nt, Human
uuacagaaauggacuggag

SEQ ID NO: 3891873 - RNA, 17 nt, Human
uuacagagaggagaaac

SEQ ID NO: 3891874 - RNA, 18 nt, Human
uuacagagaggagaaaca

SEQ ID NO: 3891875 - RNA, 22 nt, Human
uuacagagaggagaaacacauc

SEQ ID NO: 3891876 - RNA, 16 nt, Human
uuacagagaugucucu

SEQ ID NO: 3891877 - RNA, 15 nt, Human
uuacagaggacagua

SEQ ID NO: 3891878 - RNA, 20 nt, Human
uuacagaugaauguauuuau

SEQ ID NO: 3891879 - RNA, 15 nt, Human
uuacagcaaauccuu

SEQ ID NO: 3891880 - RNA, 20 nt, Human
uuacagcaaguagauaaaua

SEQ ID NO: 3891881 - RNA, 23 nt, Human
uuacagccaagugccaaaugcuc

SEQ ID NO: 3891882 - RNA, 14 nt, Human
uuacagccucugac

SEQ ID NO: 3891883 - RNA, 20 nt, Human
uuacagccugggcaauaaag

SEQ ID NO: 3891884 - RNA, 17 nt, Human
uuacagcucugacuuua

SEQ ID NO: 3891885 - RNA, 15 nt, Human
uuacagcuuuacaca

SEQ ID NO: 3891886 - RNA, 22 nt, Human
uuacagcuuuacacacacagau

SEQ ID NO: 3891887 - RNA, 15 nt, Human
uuacaggaacuucau

SEQ ID NO: 3891888 - RNA, 18 nt, Human
uuacaggaaguacuggag

SEQ ID NO: 3891889 - RNA, 17 nt, Human
uuacaggcacaaaauga

SEQ ID NO: 3891890 - RNA, 18 nt, Human
uuacaggcaccgagaaug

SEQ ID NO: 3891891 - RNA, 16 nt, Human
uuacaggcacuaaagu

SEQ ID NO: 3891892 - RNA, 20 nt, Human
uuacaggcaugagccacugc

SEQ ID NO: 3891893 - RNA, 11 nt, Human
uuacaggcccu

SEQ ID NO: 3891894 - RNA, 14 nt, Human
uuacagggagccuc

SEQ ID NO: 3891895 - RNA, 16 nt, Human
uuacagggagccuccu

SEQ ID NO: 3891896 - RNA, 18 nt, Human
uuacagguggacacacaa

SEQ ID NO: 3891897 - RNA, 14 nt, Human
uuacaggugugaac

SEQ ID NO: 3891898 - RNA, 14 nt, Human
uuacaguaauguca

SEQ ID NO: 3891899 - RNA, 17 nt, Human
uuacaguaaugucauaa

SEQ ID NO: 3891900 - RNA, 17 nt, Human
uuacaguaggagcccag

SEQ ID NO: 3891901 - RNA, 13 nt, Human
uuacaguauaauu

SEQ ID NO: 3891902 - RNA, 17 nt, Human
uuacaguauaauuaaca

SEQ ID NO: 3891903 - RNA, 20 nt, Human
uuacagucucagcaacaaca

SEQ ID NO: 3891904 - RNA, 19 nt, Human
uuacagugaaaauguaagc

SEQ ID NO: 3891905 - RNA, 17 nt, Human
uuacaguggggaaugaa

SEQ ID NO: 3891906 - RNA, 14 nt, Human
uuacaguuacuuuu

SEQ ID NO: 3891907 - RNA, 14 nt, Human
uuacaguucugugg

SEQ ID NO: 3891908 - RNA, 18 nt, Human
uuacaguuucaaaaacug

SEQ ID NO: 3891909 - RNA, 18 nt, Human
uuacauaaacaucagguu

SEQ ID NO: 3891910 - RNA, 14 nt, Human
uuacauacugcugu

SEQ ID NO: 3891911 - RNA, 21 nt, Human
uuacauacuuuaucaaugugu

SEQ ID NO: 3891912 - RNA, 24 nt, Human
uuacauacuuuaucaaugugucuu

SEQ ID NO: 3891913 - RNA, 20 nt, Human
uuacauaguguaggcuuuac

SEQ ID NO: 3891914 - RNA, 19 nt, Human
uuacauauguauacaugug

SEQ ID NO: 3891915 - RNA, 18 nt, Human
uuacaucaaggcuucaaa

SEQ ID NO: 3891916 - RNA, 21 nt, Human
uuacaucuguuuuaaauuuau

SEQ ID NO: 3891917 - RNA, 14 nt, Human
uuacaugaaguauu

SEQ ID NO: 3891918 - RNA, 12 nt, Human
uuacaugcauac

SEQ ID NO: 3891919 - RNA, 18 nt, Human
uuacaugcauacuucaaa

SEQ ID NO: 3891920 - RNA, 21 nt, Human
uuacaugcauacuucaaaagu

SEQ ID NO: 3891921 - RNA, 14 nt, Human
uuacaugcuuauuc

SEQ ID NO: 3891922 - RNA, 23 nt, Human
uuacauggagaaaaccaaaauga

SEQ ID NO: 3891923 - RNA, 12 nt, Human
uuacauggcucu

SEQ ID NO: 3891924 - RNA, 22 nt, Human
uuacauggcuggagcuagaauu

SEQ ID NO: 3891925 - RNA, 23 nt, Human
uuacauggcuggagcuagaauuu

SEQ ID NO: 3891926 - RNA, 16 nt, Human
uuacauguaauuugau

SEQ ID NO: 3891927 - RNA, 20 nt, Human
uuacauguaauuugaugagg

SEQ ID NO: 3891928 - RNA, 17 nt, Human
uuacauguauuauuuca

SEQ ID NO: 3891929 - RNA, 18 nt, Human
uuacauguuuucuuugcu

SEQ ID NO: 3891930 - RNA, 21 nt, Human
uuacauuccuugauaauguug

SEQ ID NO: 3891931 - RNA, 13 nt, Human
uuacauucugaau

SEQ ID NO: 3891932 - RNA, 23 nt, Human
uuacauugccguggcaucuuaaa

SEQ ID NO: 3891933 - RNA, 17 nt, Human
uucagaauuaaacuuuu

SEQ ID NO: 3891934 - RNA, 13 nt, Human
uucagaauuuagu

SEQ ID NO: 3891935 - RNA, 20 nt, Human
uucagacaagcaacagguuu

SEQ ID NO: 3891936 - RNA, 14 nt, Human
uucagacagcugcc

SEQ ID NO: 3891937 - RNA, 15 nt, Human
uucagacagcugccu

SEQ ID NO: 3891938 - RNA, 13 nt, Human
uucagacucagac

SEQ ID NO: 3891939 - RNA, 19 nt, Human
uucagacuuugcuucccau

SEQ ID NO: 3891940 - RNA, 21 nt, Human
uucagagacagcugauacuuc

SEQ ID NO: 3891941 - RNA, 15 nt, Human
uucagagacucaggg

SEQ ID NO: 3891942 - RNA, 22 nt, Human
uucagagagcagugcuuuuggc

SEQ ID NO: 3891943 - RNA, 13 nt, Human
uucagagagcugg

SEQ ID NO: 3891944 - RNA, 20 nt, Human
uucagagagggcagaggggu

SEQ ID NO: 3891945 - RNA, 22 nt, Human
uucagagccuccuuucuggcuu

SEQ ID NO: 3891946 - RNA, 14 nt, Human
uucagagcugcccu

SEQ ID NO: 3891947 - RNA, 15 nt, Human
uucagagcugcccuc

SEQ ID NO: 3891948 - RNA, 17 nt, Human
uucagagcugcccucuc

SEQ ID NO: 3891949 - RNA, 18 nt, Human
uucagagcugcccucucc

SEQ ID NO: 3891950 - RNA, 19 nt, Human
uucagagcugcccucuccu

SEQ ID NO: 3891951 - RNA, 23 nt, Human
uucagagcugcccucuccugggc

SEQ ID NO: 3891952 - RNA, 22 nt, Human
uucagaggauaaauaucaaugg

SEQ ID NO: 3891953 - RNA, 12 nt, Human
uucagaggcuca

SEQ ID NO: 3891954 - RNA, 23 nt, Human
uucagaguucuuuuugaaguauu

SEQ ID NO: 3891955 - RNA, 20 nt, Human
uucagauacuggauuguacu

SEQ ID NO: 3891956 - RNA, 15 nt, Human
uucagauauauauca

SEQ ID NO: 3891957 - RNA, 18 nt, Human
uucagauaugauucaaau

SEQ ID NO: 3891958 - RNA, 19 nt, Human
uucagauaugauucaaaug

SEQ ID NO: 3891959 - RNA, 18 nt, Human
uucagaucacugaauuua

SEQ ID NO: 3891960 - RNA, 13 nt, Human
uucagaucuuaau

SEQ ID NO: 3891961 - RNA, 21 nt, Human
uucagaucuuaauauaaauuc

SEQ ID NO: 3891962 - RNA, 13 nt, Human
uucagaugccacu

SEQ ID NO: 3891963 - RNA, 13 nt, Human
uucagauguaaug

SEQ ID NO: 3891964 - RNA, 18 nt, Human
uucagauguaauguuuuc

SEQ ID NO: 3891965 - RNA, 14 nt, Human
uucagaugucuucu

SEQ ID NO: 3891966 - RNA, 17 nt, Human
uucagaugucuucugcc

SEQ ID NO: 3891967 - RNA, 17 nt, Human
uucagauguggagccag

SEQ ID NO: 3891968 - RNA, 18 nt, Human
uucagauguggagccagg

SEQ ID NO: 3891969 - RNA, 21 nt, Human
uucagauucccagagcaaaau

SEQ ID NO: 3891970 - RNA, 22 nt, Human
uucagauucccagagcaaaaua

SEQ ID NO: 3891971 - RNA, 14 nt, Human
uucagauugcuuug

SEQ ID NO: 3891972 - RNA, 22 nt, Human
uucagauuguggaauguuggau

SEQ ID NO: 3891973 - RNA, 15 nt, Human
uucagauuugcacaa

SEQ ID NO: 3891974 - RNA, 15 nt, Human
uucagcaaacuuguu

SEQ ID NO: 3891975 - RNA, 14 nt, Human
uucagcaagagaga

SEQ ID NO: 3891976 - RNA, 21 nt, Human
uucagcaauauuuaaggagau

SEQ ID NO: 3891977 - RNA, 17 nt, Human
uucagcacuagccaaac

SEQ ID NO: 3891978 - RNA, 19 nt, Human
uucagcacuugucucauuu

SEQ ID NO: 3891979 - RNA, 21 nt, Human
uucagcacuugucucauuuua

SEQ ID NO: 3891980 - RNA, 17 nt, Human
uucagcagcaaauuuuc

SEQ ID NO: 3891981 - RNA, 12 nt, Human
uucagcaggcag

SEQ ID NO: 3891982 - RNA, 17 nt, Human
uucagcaggcccaagua

SEQ ID NO: 3891983 - RNA, 19 nt, Human
uucagcauccgcaggugcu

SEQ ID NO: 3891984 - RNA, 17 nt, Human
uucagcauuaagcuguu

SEQ ID NO: 3891985 - RNA, 22 nt, Human
uucagcauuaagcuguuccugu

SEQ ID NO: 3891986 - RNA, 13 nt, Human
uucagcauucuua

SEQ ID NO: 3891987 - RNA, 10 nt, Human
uucagccaag

SEQ ID NO: 3891988 - RNA, 19 nt, Human
uucagccaagaauucuuaa

SEQ ID NO: 3891989 - RNA, 17 nt, Human
uucagccacugagggac

SEQ ID NO: 3891990 - RNA, 14 nt, Human
uucagccccuccuc

SEQ ID NO: 3891991 - RNA, 15 nt, Human
uucagccccuccucu

SEQ ID NO: 3891992 - RNA, 16 nt, Human
uucagccccuccucug

SEQ ID NO: 3891993 - RNA, 17 nt, Human
uucagccccuccucugc

SEQ ID NO: 3891994 - RNA, 23 nt, Human
uucagccccuccucugccaccuc

SEQ ID NO: 3891995 - RNA, 12 nt, Human
uucagcccucac

SEQ ID NO: 3891996 - RNA, 23 nt, Human
uucagccuaguggcuuguccuca

SEQ ID NO: 3891997 - RNA, 16 nt, Human
uucagcguuuugcaag

SEQ ID NO: 3891998 - RNA, 20 nt, Human
uucagcuaagcuaggaauga

SEQ ID NO: 3891999 - RNA, 20 nt, Human
uucagcuaggaacaaaucuu

SEQ ID NO: 3892000 - RNA, 12 nt, Human
uucagcuccagc

SEQ ID NO: 3892001 - RNA, 22 nt, Human
uucagcuccagcucaccagccc

SEQ ID NO: 3892002 - RNA, 23 nt, Human
uucagcuccagcucaccagcccc

SEQ ID NO: 3892003 - RNA, 12 nt, Human
uucagcuccuga

SEQ ID NO: 3892004 - RNA, 14 nt, Human
uucagcuccugacc

SEQ ID NO: 3892005 - RNA, 17 nt, Human
uucagcucucuguauaa

SEQ ID NO: 3892006 - RNA, 17 nt, Human
uucagcugacuuuucug

SEQ ID NO: 3892007 - RNA, 18 nt, Human
uucagcugcauacaguuu

SEQ ID NO: 3892008 - RNA, 23 nt, Human
uucagcugccaguguccugagcc

SEQ ID NO: 3892009 - RNA, 23 nt, Human
uucagcugcccccgcucaugggc

SEQ ID NO: 3892010 - RNA, 16 nt, Human
uucagcugcuucucuu

SEQ ID NO: 3892011 - RNA, 21 nt, Human
uucagcugguugagguuucaa

SEQ ID NO: 3892012 - RNA, 16 nt, Human
uucagcuguccucccu

SEQ ID NO: 3892013 - RNA, 13 nt, Human
uucagcuugggga

SEQ ID NO: 3892014 - RNA, 18 nt, Human
uucaggaaaagccucugu

SEQ ID NO: 3892015 - RNA, 20 nt, Human
uucaggaaaagccucugugu

SEQ ID NO: 3892016 - RNA, 19 nt, Human
uucaggaaaaggccugggg

SEQ ID NO: 3892017 - RNA, 13 nt, Human
uucaggaaaauug

SEQ ID NO: 3892018 - RNA, 22 nt, Human
uucaggaaccucgaguacugug

SEQ ID NO: 3892019 - RNA, 19 nt, Human
uucaggaagcucagggccu

SEQ ID NO: 3892020 - RNA, 17 nt, Human
uucaggaagggaugcag

SEQ ID NO: 3892021 - RNA, 22 nt, Human
uucaggaagggaugcaggcucc

SEQ ID NO: 3892022 - RNA, 21 nt, Human
uucaggacuuaacggcuccag

SEQ ID NO: 3892023 - RNA, 21 nt, Human
uucaggagaaccuaacaugcu

SEQ ID NO: 3892024 - RNA, 16 nt, Human
uucaggagcagccuca

SEQ ID NO: 3892025 - RNA, 18 nt, Human
uucaggagcgcaagauag

SEQ ID NO: 3892026 - RNA, 19 nt, Human
uucaggagcgcaagauaga

SEQ ID NO: 3892027 - RNA, 20 nt, Human
uucaggaggaauacugaaca

SEQ ID NO: 3892028 - RNA, 14 nt, Human
uucaggaucuauuu

SEQ ID NO: 3892029 - RNA, 16 nt, Human
uucaggcauauuuuaa

SEQ ID NO: 3892030 - RNA, 20 nt, Human
uucaggcgauucuccugccu

SEQ ID NO: 3892031 - RNA, 21 nt, Human
uucaggcuuccugcaauuuuc

SEQ ID NO: 3892032 - RNA, 22 nt, Human
uucaggcuuccugcaauuuucu

SEQ ID NO: 3892033 - RNA, 23 nt, Human
uucagggaaccguuauuauaauu

SEQ ID NO: 3892034 - RNA, 20 nt, Human
uucagggcagauuuuaguuu

SEQ ID NO: 3892035 - RNA, 13 nt, Human
uucagggccuggu

SEQ ID NO: 3892036 - RNA, 17 nt, Human
uucaggggaaacuugau

SEQ ID NO: 3892037 - RNA, 20 nt, Human
uucaggggacucagcccuga

SEQ ID NO: 3892038 - RNA, 23 nt, Human
uucaggggacucagcccugaggu

SEQ ID NO: 3892039 - RNA, 23 nt, Human
uucaggggcugcccgcucccagu

SEQ ID NO: 3892040 - RNA, 21 nt, Human
uucagggggguugugaggccu

SEQ ID NO: 3892041 - RNA, 23 nt, Human
uucaggguaaauaggaaucauuc

SEQ ID NO: 3892042 - RNA, 16 nt, Human
uucagggugaugccag

SEQ ID NO: 3892043 - RNA, 14 nt, Human
uucagguacuaaau

SEQ ID NO: 3892044 - RNA, 14 nt, Human
uucagguccaggcu

SEQ ID NO: 3892045 - RNA, 19 nt, Human
uucaggugacaugugaaac

SEQ ID NO: 3892046 - RNA, 23 nt, Human
uucaggugacaugugaaaccuuu

SEQ ID NO: 3892047 - RNA, 21 nt, Human
uucagguuaucgaaauaacaa

SEQ ID NO: 3892048 - RNA, 22 nt, Human
uucagguuaucgaaauaacaau

SEQ ID NO: 3892049 - RNA, 16 nt, Human
uucagguuuuaguuuu

SEQ ID NO: 3892050 - RNA, 19 nt, Human
uucagguuuuguaaagaug

SEQ ID NO: 3892051 - RNA, 13 nt, Human
uucagguuuuucc

SEQ ID NO: 3892052 - RNA, 16 nt, Human
uucagguuuuuccuuu

SEQ ID NO: 3892053 - RNA, 15 nt, Human
uucaguaacugucag

SEQ ID NO: 3892054 - RNA, 23 nt, Human
uucaguaagucucauagguuaaa

SEQ ID NO: 3892055 - RNA, 20 nt, Human
uucaguaaguuaucuuugaa

SEQ ID NO: 3892056 - RNA, 21 nt, Human
uucaguacccucucagcucca

SEQ ID NO: 3892057 - RNA, 15 nt, Human
uucaguaccuggagg

SEQ ID NO: 3892058 - RNA, 23 nt, Human
uucaguaccuggaggaggagcag

SEQ ID NO: 3892059 - RNA, 19 nt, Human
uucaguacuuuuuuaaaua

SEQ ID NO: 3892060 - RNA, 14 nt, Human
uucaguaggaacug

SEQ ID NO: 3892061 - RNA, 17 nt, Human
uucaguauguugucaaa

SEQ ID NO: 3892062 - RNA, 17 nt, Human
uucaguauguuuuacac

SEQ ID NO: 3892063 - RNA, 22 nt, Human
uucaguauguuuuacacuguac

SEQ ID NO: 3892064 - RNA, 17 nt, Human
uucaguauuauauguac

SEQ ID NO: 3892065 - RNA, 21 nt, Human
uucaguauuuuggagaaauua

SEQ ID NO: 3892066 - RNA, 17 nt, Human
uucagucacauggcaug

SEQ ID NO: 3892067 - RNA, 21 nt, Human
uucagucauauaaaagcuaug

SEQ ID NO: 3892068 - RNA, 18 nt, Human
uucaguccugcuccagaa

SEQ ID NO: 3892069 - RNA, 24 nt, Human
uucagucucuauaccaauaaagug

SEQ ID NO: 3892070 - RNA, 23 nt, Human
uucagugcauuaucuacuugugu

SEQ ID NO: 3892071 - RNA, 16 nt, Human
uucagugccaaaaaca

SEQ ID NO: 3892072 - RNA, 19 nt, Human
uucagugccuuauggaaca

SEQ ID NO: 3892073 - RNA, 17 nt, Human
uucaguggcagggcuca

SEQ ID NO: 3892074 - RNA, 16 nt, Human
uucaguguaauuucuu

SEQ ID NO: 3892075 - RNA, 24 nt, Human
uucaguguaguuaauuuaucuaaa

SEQ ID NO: 3892076 - RNA, 23 nt, Human
uuccagcaauucuccugccucag

SEQ ID NO: 3892077 - RNA, 23 nt, Human
uuccagcaggagggacagucuca

SEQ ID NO: 3892078 - RNA, 15 nt, Human
uuccagcauucccag

SEQ ID NO: 3892079 - RNA, 20 nt, Human
uuccagcauucccagguagg

SEQ ID NO: 3892080 - RNA, 17 nt, Human
uuccagccccucugguc

SEQ ID NO: 3892081 - RNA, 20 nt, Human
uuccagccccucuggucgcu

SEQ ID NO: 3892082 - RNA, 21 nt, Human
uuccagccggcauggcuggga

SEQ ID NO: 3892083 - RNA, 12 nt, Human
uuccagccugcc

SEQ ID NO: 3892084 - RNA, 12 nt, Human
uuccagcugcug

SEQ ID NO: 3892085 - RNA, 15 nt, Human
uuccagcugcugucu

SEQ ID NO: 3892086 - RNA, 22 nt, Human
uuccagcugcugucuucuggac

SEQ ID NO: 3892087 - RNA, 17 nt, Human
uuccagcugucccccca

SEQ ID NO: 3892088 - RNA, 17 nt, Human
uuccaggaaaaaggaca

SEQ ID NO: 3892089 - RNA, 24 nt, Human
uuccaggaaacuccacaucugccu

SEQ ID NO: 3892090 - RNA, 16 nt, Human
uuccaggacuguuuca

SEQ ID NO: 3892091 - RNA, 23 nt, Human
uuccaggacuguuucaaacaugc

SEQ ID NO: 3892092 - RNA, 17 nt, Human
uuccaggcccgaagcau

SEQ ID NO: 3892093 - RNA, 20 nt, Human
uuccaggcuauguauaaaau

SEQ ID NO: 3892094 - RNA, 16 nt, Human
uuccaggcugcauaga

SEQ ID NO: 3892095 - RNA, 21 nt, Human
uuccaggcugcauagaaggag

SEQ ID NO: 3892096 - RNA, 14 nt, Human
uuccaggcuucugc

SEQ ID NO: 3892097 - RNA, 20 nt, Human
uuccaggcuucugcuggggc

SEQ ID NO: 3892098 - RNA, 14 nt, Human
uuccagggcaauca

SEQ ID NO: 3892099 - RNA, 14 nt, Human
uuccaggggaaccu

SEQ ID NO: 3892100 - RNA, 15 nt, Human
uuccaggggaaccug

SEQ ID NO: 3892101 - RNA, 21 nt, Human
uuccaggggugggacacccug

SEQ ID NO: 3892102 - RNA, 18 nt, Human
uuccagggucccucugug

SEQ ID NO: 3892103 - RNA, 22 nt, Human
uuccagguagcugaaaggggaa

SEQ ID NO: 3892104 - RNA, 15 nt, Human
uuccaggugggguga

SEQ ID NO: 3892105 - RNA, 17 nt, Human
uuccagguuuaagcugu

SEQ ID NO: 3892106 - RNA, 21 nt, Human
uuccaguaaggaaugauauug

SEQ ID NO: 3892107 - RNA, 15 nt, Human
uuccagucaggauga

SEQ ID NO: 3892108 - RNA, 14 nt, Human
uuccagucucaaaa

SEQ ID NO: 3892109 - RNA, 20 nt, Human
uuccagucuccaccaggaac

SEQ ID NO: 3892110 - RNA, 17 nt, Human
uuccagucuuccugaca

SEQ ID NO: 3892111 - RNA, 20 nt, Human
uuccagucuuccugacacuu

SEQ ID NO: 3892112 - RNA, 22 nt, Human
uuccagugaaaucaguuacucu

SEQ ID NO: 3892113 - RNA, 21 nt, Human
uuccagugagcuuaucaugcu

SEQ ID NO: 3892114 - RNA, 20 nt, Human
uuccagugaggcucugcccu

SEQ ID NO: 3892115 - RNA, 16 nt, Human
uuccaguggccuggcu

SEQ ID NO: 3892116 - RNA, 17 nt, Human
uuccaguggccuggcuc

SEQ ID NO: 3892117 - RNA, 11 nt, Human
uuccaguuccc

SEQ ID NO: 3892118 - RNA, 20 nt, Human
uuccaguuuauuccagagcu

SEQ ID NO: 3892119 - RNA, 18 nt, Human
uuccauaaagaagauguu

SEQ ID NO: 3892120 - RNA, 19 nt, Human
uuccauaaggaauguagcu

SEQ ID NO: 3892121 - RNA, 19 nt, Human
uuccauaaucuggacuccu

SEQ ID NO: 3892122 - RNA, 18 nt, Human
uuccauaauuaugacagu

SEQ ID NO: 3892123 - RNA, 17 nt, Human
uuccauagcaacaggaa

SEQ ID NO: 3892124 - RNA, 16 nt, Human
uuccauagcugcugcc

SEQ ID NO: 3892125 - RNA, 22 nt, Human
uuccauaguauauuaaaaaugg

SEQ ID NO: 3892126 - RNA, 23 nt, Human
uuccauaguauauuaaaaauggu

SEQ ID NO: 3892127 - RNA, 22 nt, Human
uuccauaguuuagguacucaaa

SEQ ID NO: 3892128 - RNA, 23 nt, Human
uuccauaguuuugaugacuggca

SEQ ID NO: 3892129 - RNA, 16 nt, Human
uuccauauuagaaaac

SEQ ID NO: 3892130 - RNA, 18 nt, Human
uuccauauuagaaaacuu

SEQ ID NO: 3892131 - RNA, 21 nt, Human
uuccauauuagaaaacuuugu

SEQ ID NO: 3892132 - RNA, 15 nt, Human
uuccauauucaugua

SEQ ID NO: 3892133 - RNA, 12 nt, Human
uuccauauuugg

SEQ ID NO: 3892134 - RNA, 18 nt, Human
uuccauauuuuuuuccuu

SEQ ID NO: 3892135 - RNA, 12 nt, Human
uuccaucauguc

SEQ ID NO: 3892136 - RNA, 14 nt, Human
uuccaucauguccc

SEQ ID NO: 3892137 - RNA, 17 nt, Human
uuccauccauaaaucca

SEQ ID NO: 3892138 - RNA, 23 nt, Human
uuccaucccaaccagugccaagg

SEQ ID NO: 3892139 - RNA, 13 nt, Human
uuccaucccagag

SEQ ID NO: 3892140 - RNA, 15 nt, Human
uuccaucccuacccc

SEQ ID NO: 3892141 - RNA, 18 nt, Human
uuccauccuuuacguguu

SEQ ID NO: 3892142 - RNA, 22 nt, Human
uuccaucuccuauaaucuguca

SEQ ID NO: 3892143 - RNA, 14 nt, Human
uuccaucucugacu

SEQ ID NO: 3892144 - RNA, 18 nt, Human
uuccaucuuuacaaaacu

SEQ ID NO: 3892145 - RNA, 13 nt, Human
uuccaugaaaacg

SEQ ID NO: 3892146 - RNA, 24 nt, Human
uuccaugaaaaugcaacaacaugu

SEQ ID NO: 3892147 - RNA, 20 nt, Human
uuccaugaaguuugaacuuc

SEQ ID NO: 3892148 - RNA, 12 nt, Human
uuccaugaaugu

SEQ ID NO: 3892149 - RNA, 15 nt, Human
uuccaugaauguauc

SEQ ID NO: 3892150 - RNA, 20 nt, Human
uuccaugaauguaucaggaa

SEQ ID NO: 3892151 - RNA, 17 nt, Human
uuccaugaauguuccug

SEQ ID NO: 3892152 - RNA, 13 nt, Human
uuccaugacaaua

SEQ ID NO: 3892153 - RNA, 18 nt, Human
uuccaugacugcauuuua

SEQ ID NO: 3892154 - RNA, 19 nt, Human
uuccaugacugcuugcccu

SEQ ID NO: 3892155 - RNA, 18 nt, Human
uuccaugauucuauuuau

SEQ ID NO: 3892156 - RNA, 15 nt, Human
uuccaugccugaggg

SEQ ID NO: 3892157 - RNA, 19 nt, Human
uuccauggcaggaaggcuu

SEQ ID NO: 3892158 - RNA, 17 nt, Human
uuccauggcccucauua

SEQ ID NO: 3892159 - RNA, 22 nt, Human
uuccauggccguguagaagcau

SEQ ID NO: 3892160 - RNA, 19 nt, Human
uuccaugggauacaaccuc

SEQ ID NO: 3892161 - RNA, 12 nt, Human
uuccauggggua

SEQ ID NO: 3892162 - RNA, 17 nt, Human
uuccauguaucuuuuga

SEQ ID NO: 3892163 - RNA, 14 nt, Human
uuccauguggagaa

SEQ ID NO: 3892164 - RNA, 13 nt, Human
uuccauguugcug

SEQ ID NO: 3892165 - RNA, 13 nt, Human
uuccauuacaagu

SEQ ID NO: 3892166 - RNA, 16 nt, Human
uuccauuccagaauau

SEQ ID NO: 3892167 - RNA, 13 nt, Human
uuccauucuggaa

SEQ ID NO: 3892168 - RNA, 17 nt, Human
uuccauuggaucucauu

SEQ ID NO: 3892169 - RNA, 19 nt, Human
uuccauugguccaagauuc

SEQ ID NO: 3892170 - RNA, 17 nt, Human
uuccauuguuugaaaca

SEQ ID NO: 3892171 - RNA, 21 nt, Human
uuccauuguuuggagacauuc

SEQ ID NO: 3892172 - RNA, 19 nt, Human
uuccauuuacuuaagacuu

SEQ ID NO: 3892173 - RNA, 19 nt, Human
uuccauuuaucuuucuaca

SEQ ID NO: 3892174 - RNA, 22 nt, Human
uuccauuugaggauuuagaagu

SEQ ID NO: 3892175 - RNA, 18 nt, Human
uuccauuugcauuuguuu

SEQ ID NO: 3892176 - RNA, 14 nt, Human
uuccauuugugugu

SEQ ID NO: 3892177 - RNA, 18 nt, Human
uuccauuuucccccacua

SEQ ID NO: 3892178 - RNA, 13 nt, Human
uucccaacacaaa

SEQ ID NO: 3892179 - RNA, 15 nt, Human
uucccaacacaaaga

SEQ ID NO: 3892180 - RNA, 19 nt, Human
uucccaacacuucagacug

SEQ ID NO: 3892181 - RNA, 21 nt, Human
uucccaaccccuuaagcccug

SEQ ID NO: 3892182 - RNA, 15 nt, Human
uucccaacucuagcu

SEQ ID NO: 3892183 - RNA, 20 nt, Human
uucccaacuucucuugcuuu

SEQ ID NO: 3892184 - RNA, 19 nt, Human
uucccaacuugccuuugaa

SEQ ID NO: 3892185 - RNA, 21 nt, Human
uucccaagaaaggaaaccuuu

SEQ ID NO: 3892186 - RNA, 20 nt, Human
uucccaagagcaucaugccu

SEQ ID NO: 3892187 - RNA, 11 nt, Human
uucccaagcuc

SEQ ID NO: 3892188 - RNA, 15 nt, Human
uucccaagcucugcu

SEQ ID NO: 3892189 - RNA, 16 nt, Human
uucccaagcucugcuc

SEQ ID NO: 3892190 - RNA, 13 nt, Human
uucccaagggcug

SEQ ID NO: 3892191 - RNA, 16 nt, Human
uucccaagggcugccg

SEQ ID NO: 3892192 - RNA, 23 nt, Human
uucccaauagcaacguagcuucu

SEQ ID NO: 3892193 - RNA, 16 nt, Human
uucccaaucagcacug

SEQ ID NO: 3892194 - RNA, 12 nt, Human
uucccaauggug

SEQ ID NO: 3892195 - RNA, 19 nt, Human
uucccaaugguguuuuucu

SEQ ID NO: 3892196 - RNA, 22 nt, Human
uucccaaugguguuuuucuugu

SEQ ID NO: 3892197 - RNA, 18 nt, Human
uucccacaggacauuucu

SEQ ID NO: 3892198 - RNA, 13 nt, Human
uucccacauuugu

SEQ ID NO: 3892199 - RNA, 15 nt, Human
uucccaccaaggucu

SEQ ID NO: 3892200 - RNA, 14 nt, Human
uucccacccagccu

SEQ ID NO: 3892201 - RNA, 11 nt, Human
uucccacccug

SEQ ID NO: 3892202 - RNA, 22 nt, Human
uucccaccgcccucccucccca

SEQ ID NO: 3892203 - RNA, 22 nt, Human
uucccaccucucucacuccuug

SEQ ID NO: 3892204 - RNA, 14 nt, Human
uucccacgaggaau

SEQ ID NO: 3892205 - RNA, 20 nt, Human
uucccacggccuuucuagcc

SEQ ID NO: 3892206 - RNA, 14 nt, Human
uucccacuccaagc

SEQ ID NO: 3892207 - RNA, 20 nt, Human
uucccacugcacccccuccu

SEQ ID NO: 3892208 - RNA, 23 nt, Human
uucccacugguccaucugguuuu

SEQ ID NO: 3892209 - RNA, 20 nt, Human
uucccacuuaaaaauuaaau

SEQ ID NO: 3892210 - RNA, 20 nt, Human
uucccacuuucccaccccac

SEQ ID NO: 3892211 - RNA, 13 nt, Human
uucccagaaucaa

SEQ ID NO: 3892212 - RNA, 18 nt, Human
uucccagagcaaaauaau

SEQ ID NO: 3892213 - RNA, 23 nt, Human
uucccagagcaaaauaauuuuaa

SEQ ID NO: 3892214 - RNA, 19 nt, Human
uucccagagucaucugauu

SEQ ID NO: 3892215 - RNA, 21 nt, Human
uucccagcuacaccuuucucc

SEQ ID NO: 3892216 - RNA, 18 nt, Human
uucccagcucuacccugc

SEQ ID NO: 3892217 - RNA, 16 nt, Human
uucccagcucucccuc

SEQ ID NO: 3892218 - RNA, 19 nt, Human
uucccagcugccccucccu

SEQ ID NO: 3892219 - RNA, 20 nt, Human
uucccagcugccccucccug

SEQ ID NO: 3892220 - RNA, 14 nt, Human
uucccuugagcccu

SEQ ID NO: 3892221 - RNA, 17 nt, Human
uucccuugaugaagaag

SEQ ID NO: 3892222 - RNA, 20 nt, Human
uucccuugcuuuucccucuu

SEQ ID NO: 3892223 - RNA, 16 nt, Human
uucccuuguaaacaga

SEQ ID NO: 3892224 - RNA, 23 nt, Human
uucccuuuagcacguuuaaaguu

SEQ ID NO: 3892225 - RNA, 15 nt, Human
uucccuuuccccagc

SEQ ID NO: 3892226 - RNA, 13 nt, Human
uucccuuuccuga

SEQ ID NO: 3892227 - RNA, 15 nt, Human
uucccuuuccuucca

SEQ ID NO: 3892228 - RNA, 19 nt, Human
uucccuuugacgccauccc

SEQ ID NO: 3892229 - RNA, 20 nt, Human
uucccuuugacgccauccca

SEQ ID NO: 3892230 - RNA, 21 nt, Human
uucccuuugacgccaucccag

SEQ ID NO: 3892231 - RNA, 18 nt, Human
uucccuuugccacacugu

SEQ ID NO: 3892232 - RNA, 17 nt, Human
uucccuuugcuccaccc

SEQ ID NO: 3892233 - RNA, 17 nt, Human
uucccuuuggagaugcu

SEQ ID NO: 3892234 - RNA, 17 nt, Human
uucccuuugucuuucaa

SEQ ID NO: 3892235 - RNA, 17 nt, Human
uucccuuuuacauacug

SEQ ID NO: 3892236 - RNA, 18 nt, Human
uucccuuuuacauacugc

SEQ ID NO: 3892237 - RNA, 19 nt, Human
uucccuuuuacauacugcu

SEQ ID NO: 3892238 - RNA, 19 nt, Human
uucccuuuuuuggcugcug

SEQ ID NO: 3892239 - RNA, 20 nt, Human
uucccuuuuuuggcugcuga

SEQ ID NO: 3892240 - RNA, 23 nt, Human
uuccgaaaaauccucuuccucug

SEQ ID NO: 3892241 - RNA, 20 nt, Human
uuccgaaaccaaagaagaaa

SEQ ID NO: 3892242 - RNA, 23 nt, Human
uuccgacaaccgaugcuccagcc

SEQ ID NO: 3892243 - RNA, 22 nt, Human
uuccgacucuuucugagugccu

SEQ ID NO: 3892244 - RNA, 18 nt, Human
uuccgcauucuuuguaca

SEQ ID NO: 3892245 - RNA, 15 nt, Human
uuccgccacuggggc

SEQ ID NO: 3892246 - RNA, 14 nt, Human
uuccgccccugccu

SEQ ID NO: 3892247 - RNA, 18 nt, Human
uuccgccccugccugcca

SEQ ID NO: 3892248 - RNA, 13 nt, Human
uuccgcuuggagc

SEQ ID NO: 3892249 - RNA, 22 nt, Human
uuccggauccuaagcaucuaag

SEQ ID NO: 3892250 - RNA, 23 nt, Human
uuccggauuggcuuguguguuuc

SEQ ID NO: 3892251 - RNA, 17 nt, Human
uuccggccccuccccuc

SEQ ID NO: 3892252 - RNA, 14 nt, Human
uuccggcuccugug

SEQ ID NO: 3892253 - RNA, 21 nt, Human
uuccgguagggaggcagccuc

SEQ ID NO: 3892254 - RNA, 21 nt, Human
uuccguaauaacacccuuccu

SEQ ID NO: 3892255 - RNA, 21 nt, Human
uuccgucaacguuguacugua

SEQ ID NO: 3892256 - RNA, 19 nt, Human
uuccgucacaucccacccc

SEQ ID NO: 3892257 - RNA, 21 nt, Human
uuccgucaccacgacuggcca

SEQ ID NO: 3892258 - RNA, 17 nt, Human
uuccgucagaaagugua

SEQ ID NO: 3892259 - RNA, 17 nt, Human
uuccgugaaaacggagc

SEQ ID NO: 3892260 - RNA, 14 nt, Human
uuccguugucugug

SEQ ID NO: 3892261 - RNA, 17 nt, Human
uuccguuugcuuuuguu

SEQ ID NO: 3892262 - RNA, 13 nt, Human
uuccuaaaaugcu

SEQ ID NO: 3892263 - RNA, 18 nt, Human
uuccuaaauauuaugaga

SEQ ID NO: 3892264 - RNA, 14 nt, Human
uuccuaaaugcagu

SEQ ID NO: 3892265 - RNA, 12 nt, Human
uuccuaaauuuu

SEQ ID NO: 3892266 - RNA, 18 nt, Human
uuccuaaauuuuccuguc

SEQ ID NO: 3892267 - RNA, 21 nt, Human
uuccuaaauuuuccuguccuc

SEQ ID NO: 3892268 - RNA, 14 nt, Human
uuccuaacuuuuca

SEQ ID NO: 3892269 - RNA, 22 nt, Human
uuccuaagccacuugaaauguu

SEQ ID NO: 3892270 - RNA, 17 nt, Human
uuccuaagccuguggcu

SEQ ID NO: 3892271 - RNA, 14 nt, Human
uuccuaaggcugca

SEQ ID NO: 3892272 - RNA, 19 nt, Human
uuccuaauaaaguucugua

SEQ ID NO: 3892273 - RNA, 19 nt, Human
uuccuaauaucaaaugcag

SEQ ID NO: 3892274 - RNA, 17 nt, Human
uuccuaaucagaaauuu

SEQ ID NO: 3892275 - RNA, 13 nt, Human
uuccuaauccucu

SEQ ID NO: 3892276 - RNA, 15 nt, Human
uuccuaauccucuag

SEQ ID NO: 3892277 - RNA, 16 nt, Human
uuccuaauccucuagg

SEQ ID NO: 3892278 - RNA, 18 nt, Human
uuccuaauuccacagcug

SEQ ID NO: 3892279 - RNA, 18 nt, Human
uuccuaauuucccuucuu

SEQ ID NO: 3892280 - RNA, 16 nt, Human
uuccuacaaagauguu

SEQ ID NO: 3892281 - RNA, 14 nt, Human
uuccuacacaggac

SEQ ID NO: 3892282 - RNA, 17 nt, Human
uuccuacacaggacagg

SEQ ID NO: 3892283 - RNA, 18 nt, Human
uuccuacagauagucaaa

SEQ ID NO: 3892284 - RNA, 12 nt, Human
uuccuacagccc

SEQ ID NO: 3892285 - RNA, 18 nt, Human
uuccuacaggcagucucu

SEQ ID NO: 3892286 - RNA, 16 nt, Human
uuccuacccaaccacu

SEQ ID NO: 3892287 - RNA, 23 nt, Human
uuccuacccacaccucugccaga

SEQ ID NO: 3892288 - RNA, 16 nt, Human
uuccuaccucccugca

SEQ ID NO: 3892289 - RNA, 21 nt, Human
uuccuacucuucucucugcuc

SEQ ID NO: 3892290 - RNA, 18 nt, Human
uuccuagauaaaaagaug

SEQ ID NO: 3892291 - RNA, 19 nt, Human
uuccuagauggcagucacu

SEQ ID NO: 3892292 - RNA, 17 nt, Human
uuccuagcacacacuuu

SEQ ID NO: 3892293 - RNA, 19 nt, Human
uuccuagcacacacuuuug

SEQ ID NO: 3892294 - RNA, 14 nt, Human
uuccuagccaccgc

SEQ ID NO: 3892295 - RNA, 18 nt, Human
uuccuagcugugugaaua

SEQ ID NO: 3892296 - RNA, 21 nt, Human
uuccuaguucaucccuucucu

SEQ ID NO: 3892297 - RNA, 22 nt, Human
uuccuaguucaucccuucucuu

SEQ ID NO: 3892298 - RNA, 20 nt, Human
uuccuaguucuguagaaaug

SEQ ID NO: 3892299 - RNA, 13 nt, Human
uuccuauacgcag

SEQ ID NO: 3892300 - RNA, 21 nt, Human
uuccuauauaguuuauugaca

SEQ ID NO: 3892301 - RNA, 22 nt, Human
uuccuauauaguuuauugacaa

SEQ ID NO: 3892302 - RNA, 14 nt, Human
uuccuauauccugu

SEQ ID NO: 3892303 - RNA, 15 nt, Human
uuccuaucccauccc

SEQ ID NO: 3892304 - RNA, 14 nt, Human
uuccuaugauguau

SEQ ID NO: 3892305 - RNA, 20 nt, Human
uuccuauggcuggccacugc

SEQ ID NO: 3892306 - RNA, 14 nt, Human
uuccuauguaacug

SEQ ID NO: 3892307 - RNA, 21 nt, Human
uuccuauuccaagcuuccaua

SEQ ID NO: 3892308 - RNA, 20 nt, Human
uuccuauugucauuaaaggu

SEQ ID NO: 3892309 - RNA, 14 nt, Human
uuccuauugugauu

SEQ ID NO: 3892310 - RNA, 13 nt, Human
uuccuauuucaga

SEQ ID NO: 3892311 - RNA, 15 nt, Human
uuccuauuucagaag

SEQ ID NO: 3892312 - RNA, 16 nt, Human
uuccuauuucagaagu

SEQ ID NO: 3892313 - RNA, 19 nt, Human
uuccuauuuguuuucaugg

SEQ ID NO: 3892314 - RNA, 19 nt, Human
uuccucaaaauaaagaagu

SEQ ID NO: 3892315 - RNA, 20 nt, Human
uuccucaaaauaaagaagua

SEQ ID NO: 3892316 - RNA, 17 nt, Human
uuccucaaauguugaca

SEQ ID NO: 3892317 - RNA, 14 nt, Human
uuccucaaauuuuu

SEQ ID NO: 3892318 - RNA, 22 nt, Human
uuccucaaauuuuuugacuuuu

SEQ ID NO: 3892319 - RNA, 14 nt, Human
uuccucagacucua

SEQ ID NO: 3892320 - RNA, 16 nt, Human
uuccucagcuuaucuc

SEQ ID NO: 3892321 - RNA, 22 nt, Human
uuccucaggcaaggucuggccu

SEQ ID NO: 3892322 - RNA, 23 nt, Human
uuccucaguuuaauccuucuagu

SEQ ID NO: 3892323 - RNA, 14 nt, Human
uuccucaugaauua

SEQ ID NO: 3892324 - RNA, 14 nt, Human
uuccucauuaaauu

SEQ ID NO: 3892325 - RNA, 14 nt, Human
uuccuccacauccu

SEQ ID NO: 3892326 - RNA, 23 nt, Human
uuccuccacauccuuucuaaaca

SEQ ID NO: 3892327 - RNA, 17 nt, Human
uuccuccagcugcacca

SEQ ID NO: 3892328 - RNA, 23 nt, Human
uuccuccaucuccaagaaugcug

SEQ ID NO: 3892329 - RNA, 11 nt, Human
uuccuccccag

SEQ ID NO: 3892330 - RNA, 21 nt, Human
uuccuccccauuagagucagc

SEQ ID NO: 3892331 - RNA, 12 nt, Human
uuccucccuccc

SEQ ID NO: 3892332 - RNA, 21 nt, Human
uuccucccucccucuuucccu

SEQ ID NO: 3892333 - RNA, 15 nt, Human
uuccuccucccuccu

SEQ ID NO: 3892334 - RNA, 20 nt, Human
uuccuccugacaccccacuu

SEQ ID NO: 3892335 - RNA, 15 nt, Human
uuccuccugcucaua

SEQ ID NO: 3892336 - RNA, 11 nt, Human
uuccuccuggg

SEQ ID NO: 3892337 - RNA, 21 nt, Human
uuccuccugggcccucucugc

SEQ ID NO: 3892338 - RNA, 11 nt, Human
uuccuccuuuc

SEQ ID NO: 3892339 - RNA, 14 nt, Human
uuccucgcccuggg

SEQ ID NO: 3892340 - RNA, 17 nt, Human
uuccucgccucucccac

SEQ ID NO: 3892341 - RNA, 22 nt, Human
uuccucuaacuuggcucacacu

SEQ ID NO: 3892342 - RNA, 17 nt, Human
uuccucuagaagccaag

SEQ ID NO: 3892343 - RNA, 17 nt, Human
uuccucuaguucuuugu

SEQ ID NO: 3892344 - RNA, 23 nt, Human
uuccucuauugauguacagucug

SEQ ID NO: 3892345 - RNA, 16 nt, Human
uuccucuccacugccu

SEQ ID NO: 3892346 - RNA, 15 nt, Human
uuccucucuauauuu

SEQ ID NO: 3892347 - RNA, 15 nt, Human
uuccucucuccagau

SEQ ID NO: 3892348 - RNA, 18 nt, Human
uuccucucugguggcucu

SEQ ID NO: 3892349 - RNA, 13 nt, Human
uuccucugaggcu

SEQ ID NO: 3892350 - RNA, 17 nt, Human
uuccucugcagcugacc

SEQ ID NO: 3892351 - RNA, 15 nt, Human
uuccucugccugccc

SEQ ID NO: 3892352 - RNA, 19 nt, Human
uuccucugcuaaauugaug

SEQ ID NO: 3892353 - RNA, 12 nt, Human
uuccucugggaa

SEQ ID NO: 3892354 - RNA, 22 nt, Human
uuccucuguucaaagcugccug

SEQ ID NO: 3892355 - RNA, 21 nt, Human
uuccucuguuucuccuucuga

SEQ ID NO: 3892356 - RNA, 16 nt, Human
uuccucuuccccuugc

SEQ ID NO: 3892357 - RNA, 18 nt, Human
uuccucuuccccuugccc

SEQ ID NO: 3892358 - RNA, 13 nt, Human
uuccucuugaacc

SEQ ID NO: 3892359 - RNA, 22 nt, Human
uuccucuugacccugcacccuc

SEQ ID NO: 3892360 - RNA, 13 nt, Human
uuccucuuuccau

SEQ ID NO: 3892361 - RNA, 19 nt, Human
uuccucuuuuccuucccaa

SEQ ID NO: 3892362 - RNA, 14 nt, Human
uuccugaacaggau

SEQ ID NO: 3892363 - RNA, 15 nt, Human
uuccugaacaggaua

SEQ ID NO: 3892364 - RNA, 15 nt, Human
uuccugaagaaccag

SEQ ID NO: 3892365 - RNA, 16 nt, Human
uucgaagcucagccca

SEQ ID NO: 3892366 - RNA, 15 nt, Human
uucgaaugacacugu

SEQ ID NO: 3892367 - RNA, 21 nt, Human
uucgacuguuguuaucuguuu

SEQ ID NO: 3892368 - RNA, 18 nt, Human
uucgagaccaaccugacc

SEQ ID NO: 3892369 - RNA, 15 nt, Human
uucgagaccagccug

SEQ ID NO: 3892370 - RNA, 17 nt, Human
uucgagaccagccuggc

SEQ ID NO: 3892371 - RNA, 17 nt, Human
uucgaggacuacaacca

SEQ ID NO: 3892372 - RNA, 11 nt, Human
uucgaggccug

SEQ ID NO: 3892373 - RNA, 15 nt, Human
uucgaggccugaagc

SEQ ID NO: 3892374 - RNA, 20 nt, Human
uucgauaaacaacaaggugg

SEQ ID NO: 3892375 - RNA, 20 nt, Human
uucgauacaccgggccugga

SEQ ID NO: 3892376 - RNA, 23 nt, Human
uucgauacccaggaccaagccac

SEQ ID NO: 3892377 - RNA, 20 nt, Human
uucgaugguacgugacccuc

SEQ ID NO: 3892378 - RNA, 23 nt, Human
uucgcaccuaccaucagggacag

SEQ ID NO: 3892379 - RNA, 14 nt, Human
uucgcagccacccu

SEQ ID NO: 3892380 - RNA, 20 nt, Human
uucgcaucaaaagacaauuc

SEQ ID NO: 3892381 - RNA, 14 nt, Human
uucgcauggucaca

SEQ ID NO: 3892382 - RNA, 18 nt, Human
uucgcauggucacacacu

SEQ ID NO: 3892383 - RNA, 14 nt, Human
uucgccguggcugc

SEQ ID NO: 3892384 - RNA, 15 nt, Human
uucgccuggagcccu

SEQ ID NO: 3892385 - RNA, 21 nt, Human
uucgccuuaauacuuuuuuau

SEQ ID NO: 3892386 - RNA, 16 nt, Human
uucgccuuuccucucu

SEQ ID NO: 3892387 - RNA, 15 nt, Human
uucgcgcucugcuca

SEQ ID NO: 3892388 - RNA, 19 nt, Human
uucgcggguaacugggguu

SEQ ID NO: 3892389 - RNA, 22 nt, Human
uucgcggguaacugggguugag

SEQ ID NO: 3892390 - RNA, 15 nt, Human
uucgcuccugugucu

SEQ ID NO: 3892391 - RNA, 12 nt, Human
uucgcugcaacc

SEQ ID NO: 3892392 - RNA, 14 nt, Human
uucgcuugagaaaa

SEQ ID NO: 3892393 - RNA, 21 nt, Human
uucggcauugguucccuuugc

SEQ ID NO: 3892394 - RNA, 16 nt, Human
uucggccagagcugaa

SEQ ID NO: 3892395 - RNA, 14 nt, Human
uucggccuccaucc

SEQ ID NO: 3892396 - RNA, 22 nt, Human
uucggcgccuuaaggauguucu

SEQ ID NO: 3892397 - RNA, 18 nt, Human
uucgggccaaggaccuga

SEQ ID NO: 3892398 - RNA, 17 nt, Human
uucggggaacuccugga

SEQ ID NO: 3892399 - RNA, 15 nt, Human
uucgguacccaccac

SEQ ID NO: 3892400 - RNA, 22 nt, Human
uucguacaguucuucgggaaga

SEQ ID NO: 3892401 - RNA, 19 nt, Human
uucguagcuuucccaaaua

SEQ ID NO: 3892402 - RNA, 16 nt, Human
uucguccacagcuucc

SEQ ID NO: 3892403 - RNA, 12 nt, Human
uucgucuguugu

SEQ ID NO: 3892404 - RNA, 14 nt, Human
uucgucuucacucu

SEQ ID NO: 3892405 - RNA, 14 nt, Human
uucgucuucuaauu

SEQ ID NO: 3892406 - RNA, 20 nt, Human
uucguuaguaaucuguauaa

SEQ ID NO: 3892407 - RNA, 17 nt, Human
uucguuuguuuguuuca

SEQ ID NO: 3892408 - RNA, 18 nt, Human
uucguuuguuuguuuugu

SEQ ID NO: 3892409 - RNA, 22 nt, Human
uucguuuugguuaaguuggcuu

SEQ ID NO: 3892410 - RNA, 17 nt, Human
uucuaaaaagauuagca

SEQ ID NO: 3892411 - RNA, 20 nt, Human
uucuaaaaagucagauguuu

SEQ ID NO: 3892412 - RNA, 18 nt, Human
uucuaaaaauugugauca

SEQ ID NO: 3892413 - RNA, 19 nt, Human
uucuaaaacuaaauagcau

SEQ ID NO: 3892414 - RNA, 12 nt, Human
uucuaaaacugu

SEQ ID NO: 3892415 - RNA, 14 nt, Human
uucuaaaagaauau

SEQ ID NO: 3892416 - RNA, 21 nt, Human
uucuaaaaucuuauaguucua

SEQ ID NO: 3892417 - RNA, 14 nt, Human
uucuaaaaugccuu

SEQ ID NO: 3892418 - RNA, 20 nt, Human
uucuaaaaugugauguucua

SEQ ID NO: 3892419 - RNA, 18 nt, Human
uucuaaacccaauccaaa

SEQ ID NO: 3892420 - RNA, 23 nt, Human
uucuaaacccaauccaaauggcg

SEQ ID NO: 3892421 - RNA, 20 nt, Human
uucuaaacuaggcuccuuca

SEQ ID NO: 3892422 - RNA, 15 nt, Human
uucuaaacuggagac

SEQ ID NO: 3892423 - RNA, 20 nt, Human
uucuaaagagcacuuacugu

SEQ ID NO: 3892424 - RNA, 13 nt, Human
uucuaaagauaau

SEQ ID NO: 3892425 - RNA, 12 nt, Human
uucuaaagauuc

SEQ ID NO: 3892426 - RNA, 16 nt, Human
uucuaaagauucuaua

SEQ ID NO: 3892427 - RNA, 18 nt, Human
uucuaaagccuuaagucu

SEQ ID NO: 3892428 - RNA, 16 nt, Human
uucuaaaggaguuuau

SEQ ID NO: 3892429 - RNA, 19 nt, Human
uucuaaaggaguuuauguu

SEQ ID NO: 3892430 - RNA, 18 nt, Human
uucuaaaggcuaccuuug

SEQ ID NO: 3892431 - RNA, 19 nt, Human
uucuaaaggcuaccuuugu

SEQ ID NO: 3892432 - RNA, 21 nt, Human
uucuaaaggcuaccuuuguau

SEQ ID NO: 3892433 - RNA, 16 nt, Human
uucuaaagguccacag

SEQ ID NO: 3892434 - RNA, 22 nt, Human
uucuaaagguguugucccuucu

SEQ ID NO: 3892435 - RNA, 13 nt, Human
uucuaaaguacug

SEQ ID NO: 3892436 - RNA, 20 nt, Human
uucuaaaguucuaagauucu

SEQ ID NO: 3892437 - RNA, 22 nt, Human
uucuaaauaaaauauaauuguu

SEQ ID NO: 3892438 - RNA, 23 nt, Human
uucuaaauaaaauauaauuguuu

SEQ ID NO: 3892439 - RNA, 19 nt, Human
uucuaaaucuccaaaauaa

SEQ ID NO: 3892440 - RNA, 21 nt, Human
uucuaaaucuccaaaauaaaa

SEQ ID NO: 3892441 - RNA, 12 nt, Human
uucuaaaugaau

SEQ ID NO: 3892442 - RNA, 15 nt, Human
uucuaaaugaauguu

SEQ ID NO: 3892443 - RNA, 20 nt, Human
uucuaaaugcauauccugag

SEQ ID NO: 3892444 - RNA, 19 nt, Human
uucuaacaaaaaaauauau

SEQ ID NO: 3892445 - RNA, 19 nt, Human
uucuaaccaagaggcuggu

SEQ ID NO: 3892446 - RNA, 24 nt, Human
uucuaaccuugaaugcugccagug

SEQ ID NO: 3892447 - RNA, 16 nt, Human
uucuaaccuuuacaug

SEQ ID NO: 3892448 - RNA, 23 nt, Human
uucuaacuacaaagguuuaaaug

SEQ ID NO: 3892449 - RNA, 16 nt, Human
uucuaagacucaaaug

SEQ ID NO: 3892450 - RNA, 17 nt, Human
uucuaagacuuuacuua

SEQ ID NO: 3892451 - RNA, 13 nt, Human
uucuaagagaagu

SEQ ID NO: 3892452 - RNA, 18 nt, Human
uucuaagagaaguuauuu

SEQ ID NO: 3892453 - RNA, 20 nt, Human
uucuaagaugugauauucua

SEQ ID NO: 3892454 - RNA, 23 nt, Human
uucuaagaugugauauucuaaga

SEQ ID NO: 3892455 - RNA, 15 nt, Human
uucuaagauucuaaa

SEQ ID NO: 3892456 - RNA, 17 nt, Human
uucuaagcauaaaagau

SEQ ID NO: 3892457 - RNA, 15 nt, Human
uucuaaggccuagga

SEQ ID NO: 3892458 - RNA, 17 nt, Human
uucuaaggccuaggauu

SEQ ID NO: 3892459 - RNA, 19 nt, Human
uucuaaggccuaggauucu

SEQ ID NO: 3892460 - RNA, 22 nt, Human
uucuaaggccuaggauucuaaa

SEQ ID NO: 3892461 - RNA, 17 nt, Human
uucuaaggcucugagag

SEQ ID NO: 3892462 - RNA, 23 nt, Human
uucuaagguccgguguucuaaga

SEQ ID NO: 3892463 - RNA, 17 nt, Human
uucuaaguaaaaccaca

SEQ ID NO: 3892464 - RNA, 23 nt, Human
uucuaagucaaacacuugugacu

SEQ ID NO: 3892465 - RNA, 18 nt, Human
uucuaagucauucauaaa

SEQ ID NO: 3892466 - RNA, 15 nt, Human
uucuaagucuuucca

SEQ ID NO: 3892467 - RNA, 22 nt, Human
uucuaagugaaauuucuagccu

SEQ ID NO: 3892468 - RNA, 13 nt, Human
uucuaaguuucua

SEQ ID NO: 3892469 - RNA, 16 nt, Human
uucuaaguuucuaaga

SEQ ID NO: 3892470 - RNA, 17 nt, Human
uucuaaguuucuaagau

SEQ ID NO: 3892471 - RNA, 20 nt, Human
uucuaaguuucuaagauucu

SEQ ID NO: 3892472 - RNA, 19 nt, Human
uucuaauaauuucuaaugu

SEQ ID NO: 3892473 - RNA, 18 nt, Human
uucuaauauuuauugcuu

SEQ ID NO: 3892474 - RNA, 13 nt, Human
uucuaaucugcua

SEQ ID NO: 3892475 - RNA, 13 nt, Human
uucuaaucuuuua

SEQ ID NO: 3892476 - RNA, 16 nt, Human
uucuaaugauggccca

SEQ ID NO: 3892477 - RNA, 23 nt, Human
uucuaaugugugaaucagagcac

SEQ ID NO: 3892478 - RNA, 16 nt, Human
uucuaauuauguagcu

SEQ ID NO: 3892479 - RNA, 17 nt, Human
uucuaauuccuguuugu

SEQ ID NO: 3892480 - RNA, 13 nt, Human
uucuaauugcuua

SEQ ID NO: 3892481 - RNA, 14 nt, Human
uucuaauugcuuau

SEQ ID NO: 3892482 - RNA, 17 nt, Human
uucuaauuggcaugaag

SEQ ID NO: 3892483 - RNA, 21 nt, Human
uucuaauuucaaaaauauaac

SEQ ID NO: 3892484 - RNA, 17 nt, Human
uucuacaaucuauuuau

SEQ ID NO: 3892485 - RNA, 12 nt, Human
uucuacaauuaa

SEQ ID NO: 3892486 - RNA, 19 nt, Human
uucuacacagugggaacuc

SEQ ID NO: 3892487 - RNA, 11 nt, Human
uucuacacucu

SEQ ID NO: 3892488 - RNA, 15 nt, Human
uucuacagcaaauuu

SEQ ID NO: 3892489 - RNA, 16 nt, Human
uucuacagcaaauuua

SEQ ID NO: 3892490 - RNA, 20 nt, Human
uucuacagcaaauuuauaau

SEQ ID NO: 3892491 - RNA, 21 nt, Human
uucuacagcaaauuuauaauu

SEQ ID NO: 3892492 - RNA, 17 nt, Human
uucuacaguauuaugua

SEQ ID NO: 3892493 - RNA, 21 nt, Human
uucuacagugguuuuauacug

SEQ ID NO: 3892494 - RNA, 17 nt, Human
uucuacauuucuuagac

SEQ ID NO: 3892495 - RNA, 16 nt, Human
uucuaccaaggcauau

SEQ ID NO: 3892496 - RNA, 21 nt, Human
uucuaccacacagcagcaguu

SEQ ID NO: 3892497 - RNA, 16 nt, Human
uucuacccguuccaaa

SEQ ID NO: 3892498 - RNA, 17 nt, Human
uucuacccguuccaaaa

SEQ ID NO: 3892499 - RNA, 21 nt, Human
uucuacccuagccauuccugg

SEQ ID NO: 3892500 - RNA, 13 nt, Human
uucuaccucccag

SEQ ID NO: 3892501 - RNA, 11 nt, Human
uucuaccugcc

SEQ ID NO: 3892502 - RNA, 18 nt, Human
uucuaccuugaggucuuu

SEQ ID NO: 3892503 - RNA, 19 nt, Human
uucuaccuugaggucuuuu

SEQ ID NO: 3892504 - RNA, 14 nt, Human
uucuacguuucuuu

SEQ ID NO: 3892505 - RNA, 19 nt, Human
uucuacucacuuuucccac

SEQ ID NO: 3892506 - RNA, 22 nt, Human
uucuacucgaguuacagacaaa

SEQ ID NO: 3892507 - RNA, 14 nt, Human
uucuacucucccau

SEQ ID NO: 3892508 - RNA, 19 nt, Human
uucuacucucccauggcuu

SEQ ID NO: 3892509 - RNA, 13 nt, Human
uugcaguggaaga

SEQ ID NO: 3892510 - RNA, 14 nt, Human
uugcauaaaauugg

SEQ ID NO: 3892511 - RNA, 20 nt, Human
uugcauaauaagcuaaagag

SEQ ID NO: 3892512 - RNA, 14 nt, Human
uugcauagaauaaa

SEQ ID NO: 3892513 - RNA, 17 nt, Human
uugcauaguucuagugc

SEQ ID NO: 3892514 - RNA, 16 nt, Human
uugcauaugagccgug

SEQ ID NO: 3892515 - RNA, 14 nt, Human
uugcaucagaaaug

SEQ ID NO: 3892516 - RNA, 15 nt, Human
uugcaucaguauuaa

SEQ ID NO: 3892517 - RNA, 21 nt, Human
uugcaucaguauuaauacuaa

SEQ ID NO: 3892518 - RNA, 21 nt, Human
uugcauccuuccuauaacuug

SEQ ID NO: 3892519 - RNA, 20 nt, Human
uugcaucuagguaauuuuua

SEQ ID NO: 3892520 - RNA, 20 nt, Human
uugcaucucccagauaaugu

SEQ ID NO: 3892521 - RNA, 14 nt, Human
uugcaucugaaaau

SEQ ID NO: 3892522 - RNA, 17 nt, Human
uugcaucugaaauagga

SEQ ID NO: 3892523 - RNA, 21 nt, Human
uugcaucuggguagcuguaag

SEQ ID NO: 3892524 - RNA, 23 nt, Human
uugcaucuguauaaguaagaaaa

SEQ ID NO: 3892525 - RNA, 18 nt, Human
uugcaugaagagaagcaa

SEQ ID NO: 3892526 - RNA, 12 nt, Human
uugcaugaggcu

SEQ ID NO: 3892527 - RNA, 13 nt, Human
uugcaugcaugca

SEQ ID NO: 3892528 - RNA, 17 nt, Human
uugcaugcaugcaaaug

SEQ ID NO: 3892529 - RNA, 15 nt, Human
uugcaugcugcuuua

SEQ ID NO: 3892530 - RNA, 21 nt, Human
uugcauggaaaucagccaagu

SEQ ID NO: 3892531 - RNA, 20 nt, Human
uugcauggcuccagaaaugu

SEQ ID NO: 3892532 - RNA, 16 nt, Human
uugcauggguuuugua

SEQ ID NO: 3892533 - RNA, 20 nt, Human
uugcaugugaaaaucaaaua

SEQ ID NO: 3892534 - RNA, 15 nt, Human
uugcaugugacucug

SEQ ID NO: 3892535 - RNA, 16 nt, Human
uugcaugugacucuga

SEQ ID NO: 3892536 - RNA, 17 nt, Human
uugcaugugacucugaa

SEQ ID NO: 3892537 - RNA, 15 nt, Human
uugcauguggaucaa

SEQ ID NO: 3892538 - RNA, 13 nt, Human
uugcauguuugaa

SEQ ID NO: 3892539 - RNA, 13 nt, Human
uugcauuaugcaa

SEQ ID NO: 3892540 - RNA, 16 nt, Human
uugcauuauucauuua

SEQ ID NO: 3892541 - RNA, 17 nt, Human
uugcauuauucauuuag

SEQ ID NO: 3892542 - RNA, 17 nt, Human
uugcauuccuuugucuu

SEQ ID NO: 3892543 - RNA, 12 nt, Human
uugcauucuauu

SEQ ID NO: 3892544 - RNA, 15 nt, Human
uugcauucuauugcc

SEQ ID NO: 3892545 - RNA, 16 nt, Human
uugcauucuauugccu

SEQ ID NO: 3892546 - RNA, 17 nt, Human
uugcauucuauugccuu

SEQ ID NO: 3892547 - RNA, 12 nt, Human
uugcauucuccc

SEQ ID NO: 3892548 - RNA, 22 nt, Human
uugcauugaacacaaacuguaa

SEQ ID NO: 3892549 - RNA, 20 nt, Human
uugcauuuaaaacagacacu

SEQ ID NO: 3892550 - RNA, 22 nt, Human
uugcauuuaaaacagacacugg

SEQ ID NO: 3892551 - RNA, 13 nt, Human
uugcauuucagaa

SEQ ID NO: 3892552 - RNA, 20 nt, Human
uugcauuucagaaagccuuu

SEQ ID NO: 3892553 - RNA, 12 nt, Human
uugcauuuggaa

SEQ ID NO: 3892554 - RNA, 21 nt, Human
uugcauuuggauugggguccc

SEQ ID NO: 3892555 - RNA, 18 nt, Human
uugcauuuguuuuguuua

SEQ ID NO: 3892556 - RNA, 22 nt, Human
uugcauuuguuuuguuuacaga

SEQ ID NO: 3892557 - RNA, 17 nt, Human
uugcauuuuaaaaauga

SEQ ID NO: 3892558 - RNA, 15 nt, Human
uugccaaaaaggggu

SEQ ID NO: 3892559 - RNA, 18 nt, Human
uugccaaaacccagcugc

SEQ ID NO: 3892560 - RNA, 21 nt, Human
uugccaaaacccagcugcacc

SEQ ID NO: 3892561 - RNA, 13 nt, Human
uugccaaaauaau

SEQ ID NO: 3892562 - RNA, 19 nt, Human
uugccaaaauaaugucuug

SEQ ID NO: 3892563 - RNA, 19 nt, Human
uugccaaaauucauuucua

SEQ ID NO: 3892564 - RNA, 13 nt, Human
uugccaaacauua

SEQ ID NO: 3892565 - RNA, 15 nt, Human
uugccaaacauuaau

SEQ ID NO: 3892566 - RNA, 21 nt, Human
uugccaaaguacagaauuuga

SEQ ID NO: 3892567 - RNA, 18 nt, Human
uugccaaauauguccugg

SEQ ID NO: 3892568 - RNA, 16 nt, Human
uugccaacauugccua

SEQ ID NO: 3892569 - RNA, 21 nt, Human
uugccaaccuguaauaaauau

SEQ ID NO: 3892570 - RNA, 16 nt, Human
uugccaagacaaauca

SEQ ID NO: 3892571 - RNA, 17 nt, Human
uugccaagacaaaucaa

SEQ ID NO: 3892572 - RNA, 21 nt, Human
uugccaaugaggucugaaaug

SEQ ID NO: 3892573 - RNA, 23 nt, Human
uugccaauuugcacauuaaauga

SEQ ID NO: 3892574 - RNA, 14 nt, Human
uugccaauuuuccu

SEQ ID NO: 3892575 - RNA, 14 nt, Human
uugccacagcuuuu

SEQ ID NO: 3892576 - RNA, 15 nt, Human
uugccacaggccucc

SEQ ID NO: 3892577 - RNA, 16 nt, Human
uugccacaggccuccc

SEQ ID NO: 3892578 - RNA, 18 nt, Human
uugccaccaccucugugg

SEQ ID NO: 3892579 - RNA, 13 nt, Human
uugccaccaggag

SEQ ID NO: 3892580 - RNA, 16 nt, Human
uugccaccaggagaac

SEQ ID NO: 3892581 - RNA, 17 nt, Human
uugccaccccacccucc

SEQ ID NO: 3892582 - RNA, 19 nt, Human
uugccaccccacccucccu

SEQ ID NO: 3892583 - RNA, 22 nt, Human
uugccaccccacccucccugga

SEQ ID NO: 3892584 - RNA, 16 nt, Human
uugccacccucaugcu

SEQ ID NO: 3892585 - RNA, 22 nt, Human
uugccacugagagaucugcugu

SEQ ID NO: 3892586 - RNA, 20 nt, Human
uugccagaaagcauaaaauu

SEQ ID NO: 3892587 - RNA, 14 nt, Human
uugccagagaugga

SEQ ID NO: 3892588 - RNA, 18 nt, Human
uugccagcugacaucuug

SEQ ID NO: 3892589 - RNA, 22 nt, Human
uugccagcugcugagccgcaga

SEQ ID NO: 3892590 - RNA, 12 nt, Human
uugccagcuuuu

SEQ ID NO: 3892591 - RNA, 18 nt, Human
uugccagcuuuuccuccc

SEQ ID NO: 3892592 - RNA, 22 nt, Human
uugccagcuuuuccucccuugg

SEQ ID NO: 3892593 - RNA, 12 nt, Human
uugccaggcuag

SEQ ID NO: 3892594 - RNA, 13 nt, Human
uugccagucaccc

SEQ ID NO: 3892595 - RNA, 13 nt, Human
uugccagugucuu

SEQ ID NO: 3892596 - RNA, 18 nt, Human
uugccagugucuuucuuu

SEQ ID NO: 3892597 - RNA, 22 nt, Human
uugccauacuuugucugaaaaa

SEQ ID NO: 3892598 - RNA, 23 nt, Human
uugccauccccuauggaccagaa

SEQ ID NO: 3892599 - RNA, 16 nt, Human
uugccaucccucccuc

SEQ ID NO: 3892600 - RNA, 22 nt, Human
uugccaucccucccuccaccuc

SEQ ID NO: 3892601 - RNA, 23 nt, Human
uugccaucccucccuccaccucc

SEQ ID NO: 3892602 - RNA, 21 nt, Human
uugccauccuaaaagccaccc

SEQ ID NO: 3892603 - RNA, 20 nt, Human
uugccauggaguugugauca

SEQ ID NO: 3892604 - RNA, 22 nt, Human
uugccaugggcuucacuguaua

SEQ ID NO: 3892605 - RNA, 16 nt, Human
uugccauguuggccag

SEQ ID NO: 3892606 - RNA, 17 nt, Human
uugccauuggacaguug

SEQ ID NO: 3892607 - RNA, 18 nt, Human
uugccauuggacaguugu

SEQ ID NO: 3892608 - RNA, 19 nt, Human
uugcccaaccucagcaacc

SEQ ID NO: 3892609 - RNA, 18 nt, Human
uugcccacaccgagggcg

SEQ ID NO: 3892610 - RNA, 13 nt, Human
uugcccacgcugg

SEQ ID NO: 3892611 - RNA, 17 nt, Human
uugcccacuccugcucu

SEQ ID NO: 3892612 - RNA, 12 nt, Human
uugcccagagau

SEQ ID NO: 3892613 - RNA, 16 nt, Human
uugcccagagaugccu

SEQ ID NO: 3892614 - RNA, 11 nt, Human
uugcccaggca

SEQ ID NO: 3892615 - RNA, 13 nt, Human
uugcccaggcagg

SEQ ID NO: 3892616 - RNA, 14 nt, Human
uugcccaggcaggu

SEQ ID NO: 3892617 - RNA, 20 nt, Human
uugcccaugcugggcucccg

SEQ ID NO: 3892618 - RNA, 16 nt, Human
uugccccaacccccag

SEQ ID NO: 3892619 - RNA, 17 nt, Human
uugccccaacccccagc

SEQ ID NO: 3892620 - RNA, 17 nt, Human
uugccccaacccuucuu

SEQ ID NO: 3892621 - RNA, 15 nt, Human
uugcccccagggcac

SEQ ID NO: 3892622 - RNA, 22 nt, Human
uugcccccagggcacuucacag

SEQ ID NO: 3892623 - RNA, 14 nt, Human
uugccccccuggcc

SEQ ID NO: 3892624 - RNA, 23 nt, Human
uugccccggccccggccccagcc

SEQ ID NO: 3892625 - RNA, 17 nt, Human
uugcccggauucuggga

SEQ ID NO: 3892626 - RNA, 14 nt, Human
uugcccuaagcaga

SEQ ID NO: 3892627 - RNA, 15 nt, Human
uugcccuaagcagaa

SEQ ID NO: 3892628 - RNA, 16 nt, Human
uugcccuaagcagaaa

SEQ ID NO: 3892629 - RNA, 19 nt, Human
uugcccuaagcagaaagug

SEQ ID NO: 3892630 - RNA, 15 nt, Human
uugcccucccauccc

SEQ ID NO: 3892631 - RNA, 15 nt, Human
uugcccugaccuccc

SEQ ID NO: 3892632 - RNA, 23 nt, Human
uugcccugguuucacuggcccaa

SEQ ID NO: 3892633 - RNA, 11 nt, Human
uugcccuuccc

SEQ ID NO: 3892634 - RNA, 22 nt, Human
uugccgcgucgcccucccaggc

SEQ ID NO: 3892635 - RNA, 13 nt, Human
uugccgucuaccu

SEQ ID NO: 3892636 - RNA, 21 nt, Human
uugccguugccaagaacugaa

SEQ ID NO: 3892637 - RNA, 13 nt, Human
uugccuaaaucca

SEQ ID NO: 3892638 - RNA, 14 nt, Human
uugccuaaauccau

SEQ ID NO: 3892639 - RNA, 22 nt, Human
uugccuaaauccauuuggaaau

SEQ ID NO: 3892640 - RNA, 18 nt, Human
uugccuaaauuuaaugcu

SEQ ID NO: 3892641 - RNA, 19 nt, Human
uugccucagcuuccccagu

SEQ ID NO: 3892642 - RNA, 21 nt, Human
uugccucagucccccaacaga

SEQ ID NO: 3892643 - RNA, 12 nt, Human
uugccuccaggu

SEQ ID NO: 3892644 - RNA, 17 nt, Human
uugccuccccauuuccc

SEQ ID NO: 3892645 - RNA, 15 nt, Human
uugccuccuguguaa

SEQ ID NO: 3892646 - RNA, 20 nt, Human
uugccucggcuccugcugca

SEQ ID NO: 3892647 - RNA, 12 nt, Human
uugccucuacuu

SEQ ID NO: 3892648 - RNA, 19 nt, Human
uugccucucgguugaaacc

SEQ ID NO: 3892649 - RNA, 19 nt, Human
uugccucugugcugugugu

SEQ ID NO: 3892650 - RNA, 17 nt, Human
uugccucuuccagucuu

SEQ ID NO: 3892651 - RNA, 19 nt, Human
uugccucuuccagucuucc

SEQ ID NO: 3892652 - RNA, 16 nt, Human
uugccugauauaaaug

SEQ ID NO: 3892653 - RNA, 20 nt, Human
uugccugaugacaauaaagc

SEQ ID NO: 3892654 - RNA, 18 nt, Human
uuggagaguuuccugaaa

SEQ ID NO: 3892655 - RNA, 21 nt, Human
uuggagcacaaaauucaaagc

SEQ ID NO: 3892656 - RNA, 20 nt, Human
uuggagccccaggggacaag

SEQ ID NO: 3892657 - RNA, 20 nt, Human
uuggagcgagcaucccccaa

SEQ ID NO: 3892658 - RNA, 16 nt, Human
uuggagcuauucaaga

SEQ ID NO: 3892659 - RNA, 17 nt, Human
uuggaggccuuucaucc

SEQ ID NO: 3892660 - RNA, 17 nt, Human
uuggagggucccaagcu

SEQ ID NO: 3892661 - RNA, 21 nt, Human
uuggagggucccaagcugggc

SEQ ID NO: 3892662 - RNA, 18 nt, Human
uuggaggugcuuaagcag

SEQ ID NO: 3892663 - RNA, 13 nt, Human
uuggagucacucu

SEQ ID NO: 3892664 - RNA, 21 nt, Human
uuggagucacucuuaugcugu

SEQ ID NO: 3892665 - RNA, 15 nt, Human
uuggagucacugcca

SEQ ID NO: 3892666 - RNA, 20 nt, Human
uuggagugaguguggcuccc

SEQ ID NO: 3892667 - RNA, 16 nt, Human
uuggaguguuauguau

SEQ ID NO: 3892668 - RNA, 19 nt, Human
uuggaguguuccccuucca

SEQ ID NO: 3892669 - RNA, 22 nt, Human
uuggaguguuccccuuccacug

SEQ ID NO: 3892670 - RNA, 14 nt, Human
uuggaguguuucua

SEQ ID NO: 3892671 - RNA, 13 nt, Human
uuggaguuaaaau

SEQ ID NO: 3892672 - RNA, 18 nt, Human
uuggaguucauucauauu

SEQ ID NO: 3892673 - RNA, 21 nt, Human
uuggaguucauucauauuaca

SEQ ID NO: 3892674 - RNA, 16 nt, Human
uuggauaaacaacauu

SEQ ID NO: 3892675 - RNA, 19 nt, Human
uuggauacuuggauuuagu

SEQ ID NO: 3892676 - RNA, 19 nt, Human
uuggauauguaaaacauuu

SEQ ID NO: 3892677 - RNA, 13 nt, Human
uuggauccaagga

SEQ ID NO: 3892678 - RNA, 23 nt, Human
uuggaugcagugcucgcuguugc

SEQ ID NO: 3892679 - RNA, 20 nt, Human
uuggaugggagugagacaga

SEQ ID NO: 3892680 - RNA, 16 nt, Human
uuggauguugagaggu

SEQ ID NO: 3892681 - RNA, 15 nt, Human
uuggauuauccugag

SEQ ID NO: 3892682 - RNA, 13 nt, Human
uuggauuauucau

SEQ ID NO: 3892683 - RNA, 21 nt, Human
uuggauuauucuuucuccuuu

SEQ ID NO: 3892684 - RNA, 19 nt, Human
uuggauuauuuaauaacau

SEQ ID NO: 3892685 - RNA, 21 nt, Human
uuggauuauuuaauaacauua

SEQ ID NO: 3892686 - RNA, 22 nt, Human
uuggauucccuuaaacaaaagu

SEQ ID NO: 3892687 - RNA, 15 nt, Human
uuggauucugagagc

SEQ ID NO: 3892688 - RNA, 20 nt, Human
uuggauucuuuccauuugca

SEQ ID NO: 3892689 - RNA, 14 nt, Human
uuggauuggggucc

SEQ ID NO: 3892690 - RNA, 18 nt, Human
uuggauuguauauugugu

SEQ ID NO: 3892691 - RNA, 14 nt, Human
uuggauuguccccg

SEQ ID NO: 3892692 - RNA, 15 nt, Human
uuggauuguccccga

SEQ ID NO: 3892693 - RNA, 22 nt, Human
uuggauuuccuaauacugucau

SEQ ID NO: 3892694 - RNA, 22 nt, Human
uuggauuugacauugcguuuga

SEQ ID NO: 3892695 - RNA, 14 nt, Human
uuggauuuggagag

SEQ ID NO: 3892696 - RNA, 14 nt, Human
uuggauuuguuuaa

SEQ ID NO: 3892697 - RNA, 13 nt, Human
uuggauuuuaugu

SEQ ID NO: 3892698 - RNA, 20 nt, Human
uuggauuuuauguugacauu

SEQ ID NO: 3892699 - RNA, 24 nt, Human
uuggauuuuauguugacauuuguu

SEQ ID NO: 3892700 - RNA, 23 nt, Human
uuggauuuuuaauuaaaaacuag

SEQ ID NO: 3892701 - RNA, 23 nt, Human
uuggcaaacucuccaccacacgu

SEQ ID NO: 3892702 - RNA, 15 nt, Human
uuggcaacagaagca

SEQ ID NO: 3892703 - RNA, 13 nt, Human
uuggcaaggaaag

SEQ ID NO: 3892704 - RNA, 18 nt, Human
uuggcaauaaauuuugaa

SEQ ID NO: 3892705 - RNA, 20 nt, Human
uuggcaauaaauuuugaaaa

SEQ ID NO: 3892706 - RNA, 16 nt, Human
uuggcaauaguuugca

SEQ ID NO: 3892707 - RNA, 12 nt, Human
uuggcaauuuug

SEQ ID NO: 3892708 - RNA, 14 nt, Human
uuggcaauuuugug

SEQ ID NO: 3892709 - RNA, 11 nt, Human
uuggcaccaaa

SEQ ID NO: 3892710 - RNA, 23 nt, Human
uuggcaccaaagaugcagccgcc

SEQ ID NO: 3892711 - RNA, 21 nt, Human
uuggcaccagacacccaggac

SEQ ID NO: 3892712 - RNA, 17 nt, Human
uuggcaccgaagcccag

SEQ ID NO: 3892713 - RNA, 22 nt, Human
uuggcacucacagaccuggagc

SEQ ID NO: 3892714 - RNA, 20 nt, Human
uuggcacuugccauuccaaa

SEQ ID NO: 3892715 - RNA, 13 nt, Human
uuggcagaugcag

SEQ ID NO: 3892716 - RNA, 12 nt, Human
uuggcagcaggu

SEQ ID NO: 3892717 - RNA, 14 nt, Human
uuggcagccuugug

SEQ ID NO: 3892718 - RNA, 21 nt, Human
uuggcagggguggaggagagc

SEQ ID NO: 3892719 - RNA, 16 nt, Human
uuggcagguccuggcc

SEQ ID NO: 3892720 - RNA, 14 nt, Human
uuggcaguuuggua

SEQ ID NO: 3892721 - RNA, 15 nt, Human
uuggcaguuugguau

SEQ ID NO: 3892722 - RNA, 20 nt, Human
uuggcauaacauaaaucugu

SEQ ID NO: 3892723 - RNA, 22 nt, Human
uuggcauaacauaaaucuguga

SEQ ID NO: 3892724 - RNA, 16 nt, Human
uuggcauagcucuggg

SEQ ID NO: 3892725 - RNA, 21 nt, Human
uuggcaucacagggcagagcc

SEQ ID NO: 3892726 - RNA, 15 nt, Human
uuggcaucagcuggc

SEQ ID NO: 3892727 - RNA, 13 nt, Human
uuggcaucccugg

SEQ ID NO: 3892728 - RNA, 15 nt, Human
uuggcaucccugggc

SEQ ID NO: 3892729 - RNA, 22 nt, Human
uuggcauggaaauuuaaagcag

SEQ ID NO: 3892730 - RNA, 19 nt, Human
uuggcauggauuucugucu

SEQ ID NO: 3892731 - RNA, 16 nt, Human
uuggcauguguauguu

SEQ ID NO: 3892732 - RNA, 12 nt, Human
uuggcauuugca

SEQ ID NO: 3892733 - RNA, 24 nt, Human
uuggccaaagccaaagcuaggccu

SEQ ID NO: 3892734 - RNA, 22 nt, Human
uuggccaaugcaccuaaagaaa

SEQ ID NO: 3892735 - RNA, 15 nt, Human
uuggccacagccagg

SEQ ID NO: 3892736 - RNA, 20 nt, Human
uuggccaccaggugccuuuc

SEQ ID NO: 3892737 - RNA, 22 nt, Human
uuggccacuccgagaggugggc

SEQ ID NO: 3892738 - RNA, 22 nt, Human
uuggccagccaacucugggaau

SEQ ID NO: 3892739 - RNA, 13 nt, Human
uuggccaugcaga

SEQ ID NO: 3892740 - RNA, 14 nt, Human
uuggcccaggaguu

SEQ ID NO: 3892741 - RNA, 15 nt, Human
uuggcccaggaguuu

SEQ ID NO: 3892742 - RNA, 21 nt, Human
uuggcccagggggcuuccuga

SEQ ID NO: 3892743 - RNA, 21 nt, Human
uuggccccccgaccuuguaga

SEQ ID NO: 3892744 - RNA, 14 nt, Human
uuggcccuuuccuu

SEQ ID NO: 3892745 - RNA, 21 nt, Human
uuggccggcugugcucagaga

SEQ ID NO: 3892746 - RNA, 13 nt, Human
uuggccuccggcc

SEQ ID NO: 3892747 - RNA, 11 nt, Human
uuggccugagu

SEQ ID NO: 3892748 - RNA, 21 nt, Human
uuggccugcuaaggucuugga

SEQ ID NO: 3892749 - RNA, 12 nt, Human
uuggccugcugu

SEQ ID NO: 3892750 - RNA, 14 nt, Human
uuggccugcuguga

SEQ ID NO: 3892751 - RNA, 23 nt, Human
uuggccugucuuuggauuguuaa

SEQ ID NO: 3892752 - RNA, 22 nt, Human
uuggccuucagaaccauccaua

SEQ ID NO: 3892753 - RNA, 18 nt, Human
uuggcgaaucucaaaauu

SEQ ID NO: 3892754 - RNA, 15 nt, Human
uuggcgcacccuccc

SEQ ID NO: 3892755 - RNA, 17 nt, Human
uuggcgcuauuacaaau

SEQ ID NO: 3892756 - RNA, 19 nt, Human
uuggcguagcagaguuaaa

SEQ ID NO: 3892757 - RNA, 17 nt, Human
uuggcguaggcuacaga

SEQ ID NO: 3892758 - RNA, 18 nt, Human
uuggcuagagguucaaag

SEQ ID NO: 3892759 - RNA, 22 nt, Human
uuggcuagagguucaaagauau

SEQ ID NO: 3892760 - RNA, 17 nt, Human
uuggcucaauaaagauu

SEQ ID NO: 3892761 - RNA, 14 nt, Human
uuggcucagacaug

SEQ ID NO: 3892762 - RNA, 22 nt, Human
uuggcucccauucacucuucca

SEQ ID NO: 3892763 - RNA, 22 nt, Human
uuggcucgaaucucugugccuu

SEQ ID NO: 3892764 - RNA, 13 nt, Human
uuggcucugccag

SEQ ID NO: 3892765 - RNA, 16 nt, Human
uuggcucugccagucc

SEQ ID NO: 3892766 - RNA, 22 nt, Human
uuggcucuggagacagccccag

SEQ ID NO: 3892767 - RNA, 23 nt, Human
uuggcugagauaugaacauauug

SEQ ID NO: 3892768 - RNA, 16 nt, Human
uuggcugcugaaggcu

SEQ ID NO: 3892769 - RNA, 20 nt, Human
uuggcuggaugaaauuuucu

SEQ ID NO: 3892770 - RNA, 21 nt, Human
uuggcugggggccucagugcc

SEQ ID NO: 3892771 - RNA, 22 nt, Human
uuggcuggugugguacagagaa

SEQ ID NO: 3892772 - RNA, 23 nt, Human
uuggcuggugugguacagagaag

SEQ ID NO: 3892773 - RNA, 16 nt, Human
uuggcuuaaucauuuu

SEQ ID NO: 3892774 - RNA, 16 nt, Human
uuggcuuaccugaccu

SEQ ID NO: 3892775 - RNA, 14 nt, Human
uuggcuuauaauuc

SEQ ID NO: 3892776 - RNA, 17 nt, Human
uuggcuuccuuucuugg

SEQ ID NO: 3892777 - RNA, 16 nt, Human
uuggcuugccauuuuu

SEQ ID NO: 3892778 - RNA, 18 nt, Human
uuggcuuguagaauuguu

SEQ ID NO: 3892779 - RNA, 17 nt, Human
uuggcuuuaaacacccu

SEQ ID NO: 3892780 - RNA, 22 nt, Human
uuggcuuuaaacacccuucaca

SEQ ID NO: 3892781 - RNA, 21 nt, Human
uuggcuuuauccucuuuagag

SEQ ID NO: 3892782 - RNA, 21 nt, Human
uuggcuuucaugaggaggcag

SEQ ID NO: 3892783 - RNA, 16 nt, Human
uuggcuuuguuuggau

SEQ ID NO: 3892784 - RNA, 15 nt, Human
uuggcuuuucugauc

SEQ ID NO: 3892785 - RNA, 16 nt, Human
uugggaaaacauguua

SEQ ID NO: 3892786 - RNA, 17 nt, Human
uugggaaaacauuugcu

SEQ ID NO: 3892787 - RNA, 19 nt, Human
uugggaaacuugucacuug

SEQ ID NO: 3892788 - RNA, 21 nt, Human
uugggaaacuugucacuugca

SEQ ID NO: 3892789 - RNA, 17 nt, Human
uugggaagagcuuagaa

SEQ ID NO: 3892790 - RNA, 18 nt, Human
uugggaagagcuuagaaa

SEQ ID NO: 3892791 - RNA, 23 nt, Human
uugggaaugaggaaaauucuuaa

SEQ ID NO: 3892792 - RNA, 14 nt, Human
uugggacaccaggg

SEQ ID NO: 3892793 - RNA, 22 nt, Human
uugggacccaguggcagggcac

SEQ ID NO: 3892794 - RNA, 14 nt, Human
uugggaccccuggu

SEQ ID NO: 3892795 - RNA, 18 nt, Human
uugggacuggggcugaag

SEQ ID NO: 3892796 - RNA, 15 nt, Human
uugggagagggcgca

SEQ ID NO: 3892797 - RNA, 15 nt, Human
uuuaucccuuaagaa

SEQ ID NO: 3892798 - RNA, 16 nt, Human
uuuaucccuuaagaau

SEQ ID NO: 3892799 - RNA, 18 nt, Human
uuuauccugaaauuucag

SEQ ID NO: 3892800 - RNA, 19 nt, Human
uuuauccugaaauuucaga

SEQ ID NO: 3892801 - RNA, 16 nt, Human
uuuaucgcagaccuuu

SEQ ID NO: 3892802 - RNA, 21 nt, Human
uuuaucgcccuggcaggcagg

SEQ ID NO: 3892803 - RNA, 16 nt, Human
uuuaucuagauguaaa

SEQ ID NO: 3892804 - RNA, 20 nt, Human
uuuaucuagauguaaauuuu

SEQ ID NO: 3892805 - RNA, 20 nt, Human
uuuaucuauaauuuaccuaa

SEQ ID NO: 3892806 - RNA, 20 nt, Human
uuuaucuauucugagaaaac

SEQ ID NO: 3892807 - RNA, 13 nt, Human
uuuaucuauugua

SEQ ID NO: 3892808 - RNA, 16 nt, Human
uuuaucugaauuuuua

SEQ ID NO: 3892809 - RNA, 15 nt, Human
uuuaucuguucauau

SEQ ID NO: 3892810 - RNA, 13 nt, Human
uuuaucuguuuaa

SEQ ID NO: 3892811 - RNA, 14 nt, Human
uuuaucuugucucu

SEQ ID NO: 3892812 - RNA, 12 nt, Human
uuuaucuuugau

SEQ ID NO: 3892813 - RNA, 14 nt, Human
uuuaugaaaguauu

SEQ ID NO: 3892814 - RNA, 21 nt, Human
uuuaugaaaugguuaagaauu

SEQ ID NO: 3892815 - RNA, 13 nt, Human
uuuaugaagaaaa

SEQ ID NO: 3892816 - RNA, 19 nt, Human
uuuaugaagaaaaaauaca

SEQ ID NO: 3892817 - RNA, 15 nt, Human
uuuaugaaguuuaaa

SEQ ID NO: 3892818 - RNA, 20 nt, Human
uuuaugaaugaaaaaacagu

SEQ ID NO: 3892819 - RNA, 16 nt, Human
uuuaugaauuaaagua

SEQ ID NO: 3892820 - RNA, 14 nt, Human
uuuaugacaguaau

SEQ ID NO: 3892821 - RNA, 17 nt, Human
uuuaugagccagacaaa

SEQ ID NO: 3892822 - RNA, 20 nt, Human
uuuaugagcucauguagcaa

SEQ ID NO: 3892823 - RNA, 14 nt, Human
uuuaugauguauau

SEQ ID NO: 3892824 - RNA, 14 nt, Human
uuuaugauuuaaua

SEQ ID NO: 3892825 - RNA, 18 nt, Human
uuuaugauuuaauaaaau

SEQ ID NO: 3892826 - RNA, 19 nt, Human
uuuaugauuuacucauuau

SEQ ID NO: 3892827 - RNA, 14 nt, Human
uuuaugauuuucau

SEQ ID NO: 3892828 - RNA, 18 nt, Human
uuuaugcaaaagguuuau

SEQ ID NO: 3892829 - RNA, 15 nt, Human
uuuaugcaaggaagg

SEQ ID NO: 3892830 - RNA, 18 nt, Human
uuuaugcaaggucuugca

SEQ ID NO: 3892831 - RNA, 14 nt, Human
uuuaugcagugcug

SEQ ID NO: 3892832 - RNA, 17 nt, Human
uuuaugcagugcugcuu

SEQ ID NO: 3892833 - RNA, 18 nt, Human
uuuaugccggaugugcuu

SEQ ID NO: 3892834 - RNA, 19 nt, Human
uuuaugccuucuuauugcu

SEQ ID NO: 3892835 - RNA, 20 nt, Human
uuuaugccuuuuauuucuua

SEQ ID NO: 3892836 - RNA, 20 nt, Human
uuuaugcucuuuuuuacuca

SEQ ID NO: 3892837 - RNA, 21 nt, Human
uuuaugcugaaacagaauacu

SEQ ID NO: 3892838 - RNA, 15 nt, Human
uuuaugcuuuaaaca

SEQ ID NO: 3892839 - RNA, 14 nt, Human
uuuauggcuuuugu

SEQ ID NO: 3892840 - RNA, 24 nt, Human
uuuauggcuuuugugcauuaucua

SEQ ID NO: 3892841 - RNA, 18 nt, Human
uuuaugggcauugacaaa

SEQ ID NO: 3892842 - RNA, 22 nt, Human
uuuaugggucagaguuccgacu

SEQ ID NO: 3892843 - RNA, 23 nt, Human
uuuaugguaacugcuuucuguuc

SEQ ID NO: 3892844 - RNA, 21 nt, Human
uuuaugguccuaaaagcaaaa

SEQ ID NO: 3892845 - RNA, 19 nt, Human
uuuaugguuauguuuuucu

SEQ ID NO: 3892846 - RNA, 19 nt, Human
uuuauguaaaauuuugccu

SEQ ID NO: 3892847 - RNA, 13 nt, Human
uuuauguaaugaa

SEQ ID NO: 3892848 - RNA, 20 nt, Human
uuuauguaaugaaguaaagc

SEQ ID NO: 3892849 - RNA, 19 nt, Human
uuuauguaguaauugacau

SEQ ID NO: 3892850 - RNA, 16 nt, Human
uuuauguauguuuaca

SEQ ID NO: 3892851 - RNA, 22 nt, Human
uuuauguauguuuacacuguca

SEQ ID NO: 3892852 - RNA, 15 nt, Human
uuuaugugaaacaug

SEQ ID NO: 3892853 - RNA, 13 nt, Human
uuuaugugaauuu

SEQ ID NO: 3892854 - RNA, 17 nt, Human
uuuauguuaaaagauuu

SEQ ID NO: 3892855 - RNA, 14 nt, Human
uuuauguuauauau

SEQ ID NO: 3892856 - RNA, 17 nt, Human
uuuauguuauauauaaa

SEQ ID NO: 3892857 - RNA, 13 nt, Human
uuuauguuauuua

SEQ ID NO: 3892858 - RNA, 15 nt, Human
uuuauguugacauuu

SEQ ID NO: 3892859 - RNA, 22 nt, Human
uuuauguugacauuuguuuggu

SEQ ID NO: 3892860 - RNA, 14 nt, Human
uuuauguuuagaua

SEQ ID NO: 3892861 - RNA, 12 nt, Human
uuuauguuugaa

SEQ ID NO: 3892862 - RNA, 13 nt, Human
uuuauguuuuggu

SEQ ID NO: 3892863 - RNA, 18 nt, Human
uuuauuaaaaacugagug

SEQ ID NO: 3892864 - RNA, 16 nt, Human
uuuauuaaaaucuuaa

SEQ ID NO: 3892865 - RNA, 21 nt, Human
uuuauuaaaaugauuguaaaa

SEQ ID NO: 3892866 - RNA, 22 nt, Human
uuuauuaaaaugauuguaaaau

SEQ ID NO: 3892867 - RNA, 17 nt, Human
uuuauuaaacagauuuu

SEQ ID NO: 3892868 - RNA, 22 nt, Human
uuuauuaaacagauuuuuacaa

SEQ ID NO: 3892869 - RNA, 11 nt, Human
uuuauuaaaga

SEQ ID NO: 3892870 - RNA, 13 nt, Human
uuuauuaaagaaa

SEQ ID NO: 3892871 - RNA, 15 nt, Human
uuuauuaaauacaaa

SEQ ID NO: 3892872 - RNA, 19 nt, Human
uuuauuaaauaguuaauau

SEQ ID NO: 3892873 - RNA, 19 nt, Human
uuuauuaaauguagaaagu

SEQ ID NO: 3892874 - RNA, 20 nt, Human
uuuauuaaauuuguugacaa

SEQ ID NO: 3892875 - RNA, 18 nt, Human
uuuauuaacaaauuaugu

SEQ ID NO: 3892876 - RNA, 17 nt, Human
uuuauuaacuuaauaau

SEQ ID NO: 3892877 - RNA, 14 nt, Human
uuuauuaagauuau

SEQ ID NO: 3892878 - RNA, 12 nt, Human
uuuauuaauguu

SEQ ID NO: 3892879 - RNA, 17 nt, Human
uuuauuaauugcuuuga

SEQ ID NO: 3892880 - RNA, 18 nt, Human
uuuauuacaguauaauua

SEQ ID NO: 3892881 - RNA, 19 nt, Human
uuuauuacguaugucuggu

SEQ ID NO: 3892882 - RNA, 16 nt, Human
uuuauuacuguaagaa

SEQ ID NO: 3892883 - RNA, 19 nt, Human
uuuauuauaaacuguaugc

SEQ ID NO: 3892884 - RNA, 13 nt, Human
uuuauuaugaaac

SEQ ID NO: 3892885 - RNA, 13 nt, Human
uuuauuaugcaug

SEQ ID NO: 3892886 - RNA, 18 nt, Human
uuuauuaugcuguauuuu

SEQ ID NO: 3892887 - RNA, 17 nt, Human
uuuauuauguaaauccc

SEQ ID NO: 3892888 - RNA, 16 nt, Human
uuuauuauuuauuuau

SEQ ID NO: 3892889 - RNA, 13 nt, Human
uuuauuauuucua

SEQ ID NO: 3892890 - RNA, 17 nt, Human
uuuauuauuuucaccug

SEQ ID NO: 3892891 - RNA, 20 nt, Human
uuuauucaagguaaaauucu

SEQ ID NO: 3892892 - RNA, 17 nt, Human
uuuauucaaguuauugu

SEQ ID NO: 3892893 - RNA, 21 nt, Human
uuuauucagcuucauuugugu

SEQ ID NO: 3892894 - RNA, 22 nt, Human
uuuauucagcuucauuuguguc

SEQ ID NO: 3892895 - RNA, 14 nt, Human
uuuauucauaugca

SEQ ID NO: 3892896 - RNA, 16 nt, Human
uuuauucauaugcaua

SEQ ID NO: 3892897 - RNA, 16 nt, Human
uuuauucauuagcugu

SEQ ID NO: 3892898 - RNA, 18 nt, Human
uuuauucauuagcuguga

SEQ ID NO: 3892899 - RNA, 18 nt, Human
uuuauuccagaaugcugu

SEQ ID NO: 3892900 - RNA, 19 nt, Human
uuuauuccagaaugcugua

SEQ ID NO: 3892901 - RNA, 14 nt, Human
uuuauucucauuug

SEQ ID NO: 3892902 - RNA, 14 nt, Human
uuuauucuucuaga

SEQ ID NO: 3892903 - RNA, 12 nt, Human
uuuauucuugau

SEQ ID NO: 3892904 - RNA, 20 nt, Human
uuuauugaauucauuucacu

SEQ ID NO: 3892905 - RNA, 12 nt, Human
uuuauugacaau

SEQ ID NO: 3892906 - RNA, 14 nt, Human
uuuauugacacaga

SEQ ID NO: 3892907 - RNA, 14 nt, Human
uuuauugagaauuu

SEQ ID NO: 3892908 - RNA, 18 nt, Human
uuuauugaggaaaaauau

SEQ ID NO: 3892909 - RNA, 23 nt, Human
uuuauugcuaguauuugaauuaa

SEQ ID NO: 3892910 - RNA, 16 nt, Human
uuuauuggcugagaua

SEQ ID NO: 3892911 - RNA, 21 nt, Human
uuuauuggcuuuucugaucca

SEQ ID NO: 3892912 - RNA, 15 nt, Human
uuuauugguuuugca

SEQ ID NO: 3892913 - RNA, 13 nt, Human
uuuauuguauaaa

SEQ ID NO: 3892914 - RNA, 14 nt, Human
uuuauugucaaagu

SEQ ID NO: 3892915 - RNA, 16 nt, Human
uuuauugucaaagugg

SEQ ID NO: 3892916 - RNA, 13 nt, Human
uuuauugugaucu

SEQ ID NO: 3892917 - RNA, 17 nt, Human
uuuauuguguuugucau

SEQ ID NO: 3892918 - RNA, 22 nt, Human
uuuauuguguuugucauuagcc

SEQ ID NO: 3892919 - RNA, 17 nt, Human
uuuauuguguuuuuaau

SEQ ID NO: 3892920 - RNA, 15 nt, Human
uuuauuguuaauaca

SEQ ID NO: 3892921 - RNA, 15 nt, Human
uuuauuuaaagcauu

SEQ ID NO: 3892922 - RNA, 15 nt, Human
uuuauuuaaaugucu

SEQ ID NO: 3892923 - RNA, 16 nt, Human
uuuauuuacaaauguu

SEQ ID NO: 3892924 - RNA, 19 nt, Human
uuuauuuauauguacuguu

SEQ ID NO: 3892925 - RNA, 22 nt, Human
uuuauuuauccagaaaacugug

SEQ ID NO: 3892926 - RNA, 15 nt, Human
uuuauuuauguacuu

SEQ ID NO: 3892927 - RNA, 14 nt, Human
uuuauuucaaugua

SEQ ID NO: 3892928 - RNA, 15 nt, Human
uuuauuucaauguaa

SEQ ID NO: 3892929 - RNA, 16 nt, Human
uuuauuucagcaaacu

SEQ ID NO: 3892930 - RNA, 17 nt, Human
uuuauuucauugguuaa

SEQ ID NO: 3892931 - RNA, 12 nt, Human
uuuauuuccacu

SEQ ID NO: 3892932 - RNA, 14 nt, Human
uuuauuucuacugu

SEQ ID NO: 3892933 - RNA, 21 nt, Human
uuuauuucuacugucaaauga

SEQ ID NO: 3892934 - RNA, 13 nt, Human
uuuauuucuuuua

SEQ ID NO: 3892935 - RNA, 16 nt, Human
uuuauuugcaacauuu

SEQ ID NO: 3892936 - RNA, 21 nt, Human
uuuauuuuaaaacagaagaau

SEQ ID NO: 3892937 - RNA, 13 nt, Human
uuuauuuuacaca

SEQ ID NO: 3892938 - RNA, 21 nt, Human
uuuauuuuacacagaaacacu

SEQ ID NO: 3892939 - RNA, 19 nt, Human
uuuauuuuacagcucauua

SEQ ID NO: 3892940 - RNA, 14 nt, Human
uuuauuuuacuauu

SEQ ID NO: 3892941 - RNA, 17 nt, Human
uuuauuuuacuauugga

SEQ ID NO: 3892942 - RNA, 15 nt, Human
uuuauuuuagcaguu

SEQ ID NO: 3892943 - RNA, 11 nt, Human
uuuauuuuaua

SEQ ID NO: 3892944 - RNA, 14 nt, Human
uuuauuuugacaua

SEQ ID NO: 3892945 - RNA, 18 nt, Human
uuuauuuugagauguaaa

SEQ ID NO: 3892946 - RNA, 16 nt, Human
uuuauuuuguguuuag

SEQ ID NO: 3892947 - RNA, 20 nt, Human
uuuauuuuguguuuaggaac

SEQ ID NO: 3892948 - RNA, 18 nt, Human
uuuauuuuuaaauuaugu

SEQ ID NO: 3892949 - RNA, 16 nt, Human
uuuauuuuuagaauuu

SEQ ID NO: 3892950 - RNA, 15 nt, Human
uuuauuuuucuaaaa

SEQ ID NO: 3892951 - RNA, 13 nt, Human
uuuauuuuucugu

SEQ ID NO: 3892952 - RNA, 15 nt, Human
uuuauuuuucuguua

SEQ ID NO: 3892953 - RNA, 15 nt, Human
uuuauuuuugcaugg

SEQ ID NO: 3892954 - RNA, 16 nt, Human
uuuauuuuuuagugca

SEQ ID NO: 3892955 - RNA, 16 nt, Human
uuuauuuuuugggaaa

SEQ ID NO: 3892956 - RNA, 13 nt, Human
uuuauuuuuuggu

SEQ ID NO: 3892957 - RNA, 15 nt, Human
uuuauuuuuuuaagu

SEQ ID NO: 3892958 - RNA, 21 nt, Human
uuuauuuuuuuuaauuguauu

SEQ ID NO: 3892959 - RNA, 15 nt, Human
uuucaaaaacacagu

SEQ ID NO: 3892960 - RNA, 18 nt, Human
uuucaaaaauauaacuua

SEQ ID NO: 3892961 - RNA, 21 nt, Human
uuucaaaaauauaacuuaaaa

SEQ ID NO: 3892962 - RNA, 13 nt, Human
uuucaaaaaucug

SEQ ID NO: 3892963 - RNA, 21 nt, Human
uuucaaaaaucugaagauugu

SEQ ID NO: 3892964 - RNA, 13 nt, Human
uuucaaaagacau

SEQ ID NO: 3892965 - RNA, 12 nt, Human
uuucaaaagcau

SEQ ID NO: 3892966 - RNA, 20 nt, Human
uuucaaaagguauuauacau

SEQ ID NO: 3892967 - RNA, 21 nt, Human
uuucaaaagguauuauacaug

SEQ ID NO: 3892968 - RNA, 17 nt, Human
uuucaaaauaaaaauga

SEQ ID NO: 3892969 - RNA, 11 nt, Human
uuucaaaauag

SEQ ID NO: 3892970 - RNA, 19 nt, Human
uuucaaaauagaaaaguua

SEQ ID NO: 3892971 - RNA, 21 nt, Human
uuucaaaauccaaaaagaaau

SEQ ID NO: 3892972 - RNA, 22 nt, Human
uuucaaacaaucaaguugacuc

SEQ ID NO: 3892973 - RNA, 15 nt, Human
uuucaaaccagcuuc

SEQ ID NO: 3892974 - RNA, 20 nt, Human
uuucaaaccaguauacaaga

SEQ ID NO: 3892975 - RNA, 14 nt, Human
uuucaaagaaggaa

SEQ ID NO: 3892976 - RNA, 14 nt, Human
uuucaaagaugcug

SEQ ID NO: 3892977 - RNA, 21 nt, Human
uuucaaaguuuuguuguacuu

SEQ ID NO: 3892978 - RNA, 13 nt, Human
uuucaaauaucac

SEQ ID NO: 3892979 - RNA, 20 nt, Human
uuucaaauuggacuuucaaa

SEQ ID NO: 3892980 - RNA, 20 nt, Human
uuucaacagugaagacagaa

SEQ ID NO: 3892981 - RNA, 17 nt, Human
uuucaacaguuucaaaa

SEQ ID NO: 3892982 - RNA, 21 nt, Human
uuucaacgcagcccugcuuug

SEQ ID NO: 3892983 - RNA, 18 nt, Human
uuucaacucauugcauca

SEQ ID NO: 3892984 - RNA, 22 nt, Human
uuucaagaaaaaauaaauggaa

SEQ ID NO: 3892985 - RNA, 12 nt, Human
uuucaagaauga

SEQ ID NO: 3892986 - RNA, 23 nt, Human
uuucaagaggagcccccacccug

SEQ ID NO: 3892987 - RNA, 13 nt, Human
uuucaagcaucuc

SEQ ID NO: 3892988 - RNA, 22 nt, Human
uuucaagccugccuaggaauuc

SEQ ID NO: 3892989 - RNA, 20 nt, Human
uuucaagcgucacuuuauuu

SEQ ID NO: 3892990 - RNA, 18 nt, Human
uuucaagcuuauuuugga

SEQ ID NO: 3892991 - RNA, 15 nt, Human
uuucaaggcacucua

SEQ ID NO: 3892992 - RNA, 19 nt, Human
uuucaaggcacucuagauu

SEQ ID NO: 3892993 - RNA, 16 nt, Human
uuucaagguucuaacc

SEQ ID NO: 3892994 - RNA, 15 nt, Human
uuucaaguauuuaag

SEQ ID NO: 3892995 - RNA, 16 nt, Human
uuucaaguauuuaagc

SEQ ID NO: 3892996 - RNA, 21 nt, Human
uuucaagugaaucuaaaagcu

SEQ ID NO: 3892997 - RNA, 17 nt, Human
uuucaaguuuuaaaguu

SEQ ID NO: 3892998 - RNA, 20 nt, Human
uuucaauaaagcauuuauaa

SEQ ID NO: 3892999 - RNA, 18 nt, Human
uuucaauaaaguuugauc

SEQ ID NO: 3893000 - RNA, 14 nt, Human
uuucaauagccacu

SEQ ID NO: 3893001 - RNA, 19 nt, Human
uuucaauaggaaaaacuga

SEQ ID NO: 3893002 - RNA, 20 nt, Human
uuucaauaggaaaaacugau

SEQ ID NO: 3893003 - RNA, 19 nt, Human
uuucaauauauugaacuuu

SEQ ID NO: 3893004 - RNA, 17 nt, Human
uuucaauauuuuccuuc

SEQ ID NO: 3893005 - RNA, 23 nt, Human
uuucaaucucguauagaagucuu

SEQ ID NO: 3893006 - RNA, 19 nt, Human
uuucaauguguauaaauug

SEQ ID NO: 3893007 - RNA, 12 nt, Human
uuucaauuaaac

SEQ ID NO: 3893008 - RNA, 19 nt, Human
uuucaauuaaacggauuau

SEQ ID NO: 3893009 - RNA, 22 nt, Human
uuucaauuccaccugcaaucaa

SEQ ID NO: 3893010 - RNA, 19 nt, Human
uuucaauuuccaagagcug

SEQ ID NO: 3893011 - RNA, 15 nt, Human
uuucaauuuuaaaca

SEQ ID NO: 3893012 - RNA, 18 nt, Human
uuucaauuuuaaacauau

SEQ ID NO: 3893013 - RNA, 12 nt, Human
uuucacaaauaa

SEQ ID NO: 3893014 - RNA, 18 nt, Human
uuucacaaauauuaaaaa

SEQ ID NO: 3893015 - RNA, 22 nt, Human
uuucacaaauauuaaaaagucu

SEQ ID NO: 3893016 - RNA, 13 nt, Human
uuucacaacagau

SEQ ID NO: 3893017 - RNA, 16 nt, Human
uuucacaaccuucugu

SEQ ID NO: 3893018 - RNA, 17 nt, Human
uuucacaaggucuuuaa

SEQ ID NO: 3893019 - RNA, 16 nt, Human
uuucacacaaacaagg

SEQ ID NO: 3893020 - RNA, 13 nt, Human
uuucacagcuccu

SEQ ID NO: 3893021 - RNA, 14 nt, Human
uuucacauagaugu

SEQ ID NO: 3893022 - RNA, 22 nt, Human
uuucacauagcccacuuacauu

SEQ ID NO: 3893023 - RNA, 15 nt, Human
uuucacauaucuagu

SEQ ID NO: 3893024 - RNA, 14 nt, Human
uuucacauuggaaa

SEQ ID NO: 3893025 - RNA, 19 nt, Human
uuucacauuggaaacaagu

SEQ ID NO: 3893026 - RNA, 19 nt, Human
uuucacauuguuugcugcu

SEQ ID NO: 3893027 - RNA, 13 nt, Human
uuucacauuuucc

SEQ ID NO: 3893028 - RNA, 15 nt, Human
uuucaccacauucgu

SEQ ID NO: 3893029 - RNA, 17 nt, Human
uuucaccagauuugcua

SEQ ID NO: 3893030 - RNA, 15 nt, Human
uuucaccccucccuu

SEQ ID NO: 3893031 - RNA, 22 nt, Human
uuucacccuuaacccaaggagc

SEQ ID NO: 3893032 - RNA, 20 nt, Human
uuucaccuacuuuguaagug

SEQ ID NO: 3893033 - RNA, 21 nt, Human
uuucaccuuuucaggaaaaua

SEQ ID NO: 3893034 - RNA, 15 nt, Human
uuucacgauucauuu

SEQ ID NO: 3893035 - RNA, 14 nt, Human
uuucacggaaacuc

SEQ ID NO: 3893036 - RNA, 14 nt, Human
uuucacggaaguuu

SEQ ID NO: 3893037 - RNA, 23 nt, Human
uuucacggaaguuuucaaugaug

SEQ ID NO: 3893038 - RNA, 21 nt, Human
uuucacgucauaggaaguuag

SEQ ID NO: 3893039 - RNA, 16 nt, Human
uuucacuacucagcau

SEQ ID NO: 3893040 - RNA, 15 nt, Human
uuucacuagaaaagc

SEQ ID NO: 3893041 - RNA, 23 nt, Human
uuucacuccggagugagaagcuu

SEQ ID NO: 3893042 - RNA, 14 nt, Human
uuucacucuaaguc

SEQ ID NO: 3893043 - RNA, 20 nt, Human
uuucacucuaagucauguau

SEQ ID NO: 3893044 - RNA, 23 nt, Human
uuucacucuaagucauguauguu

SEQ ID NO: 3893045 - RNA, 23 nt, Human
uuucacugacuuuuuuugugggg

SEQ ID NO: 3893046 - RNA, 17 nt, Human
uuucacugcuggcugcc

SEQ ID NO: 3893047 - RNA, 18 nt, Human
uuucacugcuggcugccu

SEQ ID NO: 3893048 - RNA, 18 nt, Human
uuucacuggaguuacauu

SEQ ID NO: 3893049 - RNA, 19 nt, Human
uuucacuggaguuacauua

SEQ ID NO: 3893050 - RNA, 24 nt, Human
uuucacuguagaaugauuucaugc

SEQ ID NO: 3893051 - RNA, 13 nt, Human
uuucacugucugu

SEQ ID NO: 3893052 - RNA, 18 nt, Human
uuucacuuguguuuuaaa

SEQ ID NO: 3893053 - RNA, 12 nt, Human
uuucacuuuaga

SEQ ID NO: 3893054 - RNA, 16 nt, Human
uuucagaaaacagaaa

SEQ ID NO: 3893055 - RNA, 19 nt, Human
uuucagaaaacagaaaaaa

SEQ ID NO: 3893056 - RNA, 22 nt, Human
uuucagaaaauauuauguguuu

SEQ ID NO: 3893057 - RNA, 16 nt, Human
uuucagaaaaugaaaa

SEQ ID NO: 3893058 - RNA, 15 nt, Human
uuucagaaagccuuu

SEQ ID NO: 3893059 - RNA, 14 nt, Human
uuucagaaauauaa

SEQ ID NO: 3893060 - RNA, 21 nt, Human
uuucagaaauauaacacauuu

SEQ ID NO: 3893061 - RNA, 22 nt, Human
uuucagaaauauaacacauuuu

SEQ ID NO: 3893062 - RNA, 20 nt, Human
uuucagaaccucuuccccag

SEQ ID NO: 3893063 - RNA, 21 nt, Human
uuucagaagugagcuuugcug

SEQ ID NO: 3893064 - RNA, 21 nt, Human
uuucagaaguuuaaauauuaa

SEQ ID NO: 3893065 - RNA, 21 nt, Human
uuucagacucccauuccugaa

SEQ ID NO: 3893066 - RNA, 15 nt, Human
uuucagacuugucaa

SEQ ID NO: 3893067 - RNA, 12 nt, Human
uuucagagauuu

SEQ ID NO: 3893068 - RNA, 13 nt, Human
uuucagagccucc

SEQ ID NO: 3893069 - RNA, 22 nt, Human
uuucagaguucuuuuugaagua

SEQ ID NO: 3893070 - RNA, 23 nt, Human
uuucagaguucuuuuugaaguau

SEQ ID NO: 3893071 - RNA, 18 nt, Human
uuucagauauaaaagacu

SEQ ID NO: 3893072 - RNA, 23 nt, Human
uuucagauaucuuggacaaauca

SEQ ID NO: 3893073 - RNA, 14 nt, Human
uuucagaugcuucu

SEQ ID NO: 3893074 - RNA, 18 nt, Human
uuucagauguaauguuuu

SEQ ID NO: 3893075 - RNA, 20 nt, Human
uuucagaugucuucugccug

SEQ ID NO: 3893076 - RNA, 22 nt, Human
uuucagaugucuucugccuguu

SEQ ID NO: 3893077 - RNA, 22 nt, Human
uuucagauuugcacaaaaagau

SEQ ID NO: 3893078 - RNA, 18 nt, Human
uuucagauuuugauaacu

SEQ ID NO: 3893079 - RNA, 21 nt, Human
uuucagcaauauuuaaggaga

SEQ ID NO: 3893080 - RNA, 13 nt, Human
uuucagcaggcag

SEQ ID NO: 3893081 - RNA, 18 nt, Human
uuucagcauuaagcuguu

SEQ ID NO: 3893082 - RNA, 17 nt, Human
uuucagccaagaauucu

SEQ ID NO: 3893083 - RNA, 14 nt, Human
uuucagccuaagag

SEQ ID NO: 3893084 - RNA, 15 nt, Human
uuucagcuaggaaca

SEQ ID NO: 3893085 - RNA, 16 nt, Human
uuucagcuaucaguag

SEQ ID NO: 3893086 - RNA, 15 nt, Human
uuucagcugucuuuu

SEQ ID NO: 3893087 - RNA, 11 nt, Human
uuucuaagaga

SEQ ID NO: 3893088 - RNA, 16 nt, Human
uuucuaagagaaguua

SEQ ID NO: 3893089 - RNA, 14 nt, Human
uuucuaagagagcu

SEQ ID NO: 3893090 - RNA, 15 nt, Human
uuucuaagauucuaa

SEQ ID NO: 3893091 - RNA, 17 nt, Human
uuucuaagauucuaaag

SEQ ID NO: 3893092 - RNA, 19 nt, Human
uuucuaagcauaaaagaug

SEQ ID NO: 3893093 - RNA, 21 nt, Human
uuucuaauaaacuuggauucu

SEQ ID NO: 3893094 - RNA, 23 nt, Human
uuucuaaugaggagagaaaauau

SEQ ID NO: 3893095 - RNA, 14 nt, Human
uuucuaauguuucu

SEQ ID NO: 3893096 - RNA, 18 nt, Human
uuucuaauuauguagcuc

SEQ ID NO: 3893097 - RNA, 19 nt, Human
uuucuaauuauguagcucu

SEQ ID NO: 3893098 - RNA, 22 nt, Human
uuucuacaaugugaacuuuauu

SEQ ID NO: 3893099 - RNA, 21 nt, Human
uuucuacaauuaauaguuugu

SEQ ID NO: 3893100 - RNA, 17 nt, Human
uuucuacagcaaauuua

SEQ ID NO: 3893101 - RNA, 16 nt, Human
uuucuaccauuucaga

SEQ ID NO: 3893102 - RNA, 18 nt, Human
uuucuacccagcgagccc

SEQ ID NO: 3893103 - RNA, 14 nt, Human
uuucuaccucccag

SEQ ID NO: 3893104 - RNA, 15 nt, Human
uuucuaccucccaga

SEQ ID NO: 3893105 - RNA, 22 nt, Human
uuucuacucucuuuuaauauuu

SEQ ID NO: 3893106 - RNA, 15 nt, Human
uuucuacucugaacu

SEQ ID NO: 3893107 - RNA, 17 nt, Human
uuucuacucugaacuaa

SEQ ID NO: 3893108 - RNA, 20 nt, Human
uuucuacugucaaaugaugu

SEQ ID NO: 3893109 - RNA, 22 nt, Human
uuucuacuuugaagucauacca

SEQ ID NO: 3893110 - RNA, 19 nt, Human
uuucuagaaguuucccuuc

SEQ ID NO: 3893111 - RNA, 23 nt, Human
uuucuagaaguuucccuuccucc

SEQ ID NO: 3893112 - RNA, 21 nt, Human
uuucuagaauuauuuuucacu

SEQ ID NO: 3893113 - RNA, 18 nt, Human
uuucuagacacuuuuucu

SEQ ID NO: 3893114 - RNA, 13 nt, Human
uuucuagaccaau
